United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 112

SEQ ID NO: 3972774 - RNA, 17 nt, Staphylococcus aureus subsp. aureus Mu50
uaaugcaccugugauaa

SEQ ID NO: 3972775 - RNA, 19 nt, Staphylococcus aureus subsp. aureus Mu50
uaaugcacugcuaauauua

SEQ ID NO: 3972776 - RNA, 21 nt, Staphylococcus aureus subsp. aureus Mu50
uaaugcagauucuucaccaac

SEQ ID NO: 3972777 - RNA, 15 nt, Staphylococcus aureus subsp. aureus Mu50
uaaugcauuauuaua

SEQ ID NO: 3972778 - RNA, 14 nt, Staphylococcus aureus subsp. aureus Mu50
uaaugccaaauaua

SEQ ID NO: 3972779 - RNA, 23 nt, Staphylococcus aureus subsp. aureus Mu50
uaaugccaccguggaauuuacca

SEQ ID NO: 3972780 - RNA, 23 nt, Staphylococcus aureus subsp. aureus Mu50
uaaugccauuguuauccaaaaca

SEQ ID NO: 3972781 - RNA, 19 nt, Staphylococcus aureus subsp. aureus Mu50
uaaugccguaguuuucucu

SEQ ID NO: 3972782 - RNA, 17 nt, Staphylococcus aureus subsp. aureus Mu50
uaaugcuacuauuaaau

SEQ ID NO: 3972783 - RNA, 13 nt, Staphylococcus aureus subsp. aureus Mu50
uaaugcuauauuu

SEQ ID NO: 3972784 - RNA, 16 nt, Staphylococcus aureus subsp. aureus Mu50
uaaugcugcuucuuca

SEQ ID NO: 3972785 - RNA, 20 nt, Staphylococcus aureus subsp. aureus Mu50
uaaugcuguacuauauucaa

SEQ ID NO: 3972786 - RNA, 14 nt, Staphylococcus aureus subsp. aureus Mu50
uaauggcaacuaag

SEQ ID NO: 3972787 - RNA, 16 nt, Staphylococcus aureus subsp. aureus Mu50
uaauggcaacuaagau

SEQ ID NO: 3972788 - RNA, 17 nt, Staphylococcus aureus subsp. aureus Mu50
uaauggcaccauacuuc

SEQ ID NO: 3972789 - RNA, 15 nt, Staphylococcus aureus subsp. aureus Mu50
uaauggcacuuaaua

SEQ ID NO: 3972790 - RNA, 18 nt, Staphylococcus aureus subsp. aureus Mu50
uaauggcacuuaauauaa

SEQ ID NO: 3972791 - RNA, 22 nt, Staphylococcus aureus subsp. aureus Mu50
uaauggcgggcccccaacacaa

SEQ ID NO: 3972792 - RNA, 16 nt, Staphylococcus aureus subsp. aureus Mu50
uaaugguauugauuau

SEQ ID NO: 3972793 - RNA, 22 nt, Staphylococcus aureus subsp. aureus Mu50
uaaugguucuauaauaaaucga

SEQ ID NO: 3972794 - RNA, 22 nt, Staphylococcus aureus subsp. aureus Mu50
uaaugguugaauaacacuagaa

SEQ ID NO: 3972795 - RNA, 20 nt, Staphylococcus aureus subsp. aureus Mu50
uaauguaaaguugauaaugu

SEQ ID NO: 3972796 - RNA, 15 nt, Staphylococcus aureus subsp. aureus Mu50
uaauguaauuauuuu

SEQ ID NO: 3972797 - RNA, 17 nt, Staphylococcus aureus subsp. aureus Mu50
uaauguacauguauaaa

SEQ ID NO: 3972798 - RNA, 23 nt, Staphylococcus aureus subsp. aureus Mu50
uaauguacauguauaaaagauau

SEQ ID NO: 3972799 - RNA, 16 nt, Staphylococcus aureus subsp. aureus Mu50
uaauguacuucaauuu

SEQ ID NO: 3972800 - RNA, 11 nt, Staphylococcus aureus subsp. aureus Mu50
uaauguauaaa

SEQ ID NO: 3972801 - RNA, 14 nt, Staphylococcus aureus subsp. aureus Mu50
uaauguauaaaaag

SEQ ID NO: 3972802 - RNA, 13 nt, Staphylococcus aureus subsp. aureus Mu50
uaauguaucauuu

SEQ ID NO: 3972803 - RNA, 14 nt, Staphylococcus aureus subsp. aureus Mu50
uaauguauuaauug

SEQ ID NO: 3972804 - RNA, 13 nt, Staphylococcus aureus subsp. aureus Mu50
uaauguauucuuc

SEQ ID NO: 3972805 - RNA, 16 nt, Staphylococcus aureus subsp. aureus Mu50
uaaugucaugaaaaua

SEQ ID NO: 3972806 - RNA, 19 nt, Staphylococcus aureus subsp. aureus Mu50
uaaugucgcacuauaaaau

SEQ ID NO: 3972807 - RNA, 19 nt, Staphylococcus aureus subsp. aureus Mu50
uaaugucucuuuucacgaa

SEQ ID NO: 3972808 - RNA, 13 nt, Staphylococcus aureus subsp. aureus Mu50
uaaugugaaaaau

SEQ ID NO: 3972809 - RNA, 14 nt, Staphylococcus aureus subsp. aureus Mu50
uaaugugcauuuau

SEQ ID NO: 3972810 - RNA, 22 nt, Staphylococcus aureus subsp. aureus Mu50
uaaugugcgucacucacuucaa

SEQ ID NO: 3972811 - RNA, 20 nt, Staphylococcus aureus subsp. aureus Mu50
uaauguuaaaauaacugcua

SEQ ID NO: 3972812 - RNA, 16 nt, Staphylococcus aureus subsp. aureus Mu50
uaauguuaaacacuca

SEQ ID NO: 3972813 - RNA, 15 nt, Staphylococcus aureus subsp. aureus Mu50
uaauguuacgcugug

SEQ ID NO: 3972814 - RNA, 13 nt, Staphylococcus aureus subsp. aureus Mu50
uaauugaaugaaa

SEQ ID NO: 3972815 - RNA, 16 nt, Staphylococcus aureus subsp. aureus Mu50
uaauugaaugaaaaag

SEQ ID NO: 3972816 - RNA, 17 nt, Staphylococcus aureus subsp. aureus Mu50
uaauugaaugaaaauaa

SEQ ID NO: 3972817 - RNA, 21 nt, Staphylococcus aureus subsp. aureus Mu50
uaauugagagaaguuucuaua

SEQ ID NO: 3972818 - RNA, 23 nt, Staphylococcus aureus subsp. aureus Mu50
uaauugauauggaucauaaucau

SEQ ID NO: 3972819 - RNA, 16 nt, Staphylococcus aureus subsp. aureus Mu50
uaauugaugaaagacu

SEQ ID NO: 3972820 - RNA, 19 nt, Staphylococcus aureus subsp. aureus Mu50
uaauugaugaugaugugcu

SEQ ID NO: 3972821 - RNA, 19 nt, Staphylococcus aureus subsp. aureus Mu50
uaauugauucucuguagau

SEQ ID NO: 3972822 - RNA, 20 nt, Staphylococcus aureus subsp. aureus Mu50
uaauugcauagcuaaauaaa

SEQ ID NO: 3972823 - RNA, 21 nt, Staphylococcus aureus subsp. aureus Mu50
uaauugcauagcuaaauaaau

SEQ ID NO: 3972824 - RNA, 17 nt, Staphylococcus aureus subsp. aureus Mu50
uaauugcuuaauaucau

SEQ ID NO: 3972825 - RNA, 15 nt, Staphylococcus aureus subsp. aureus Mu50
uaauuggaaucaucu

SEQ ID NO: 3972826 - RNA, 17 nt, Staphylococcus aureus subsp. aureus Mu50
uaauuggaaucaucuuu

SEQ ID NO: 3972827 - RNA, 15 nt, Staphylococcus aureus subsp. aureus Mu50
uaauuggauuaaaua

SEQ ID NO: 3972828 - RNA, 21 nt, Staphylococcus aureus subsp. aureus Mu50
uaauuggauugagaucuguau

SEQ ID NO: 3972829 - RNA, 16 nt, Staphylococcus aureus subsp. aureus Mu50
uaauuggguuuaauaa

SEQ ID NO: 3972830 - RNA, 19 nt, Staphylococcus aureus subsp. aureus Mu50
uaauuggguuuaauaacau

SEQ ID NO: 3972831 - RNA, 20 nt, Staphylococcus aureus subsp. aureus Mu50
uaauugguucuucuuucaua

SEQ ID NO: 3972832 - RNA, 21 nt, Staphylococcus aureus subsp. aureus Mu50
uaauugguucuucuuucauag

SEQ ID NO: 3972833 - RNA, 14 nt, Staphylococcus aureus subsp. aureus Mu50
uaauugucuuuaua

SEQ ID NO: 3972834 - RNA, 21 nt, Staphylococcus aureus subsp. aureus Mu50
uaauuguuaaacccucauuuu

SEQ ID NO: 3972835 - RNA, 13 nt, Staphylococcus aureus subsp. aureus Mu50
uaauuguuaaauc

SEQ ID NO: 3972836 - RNA, 15 nt, Staphylococcus aureus subsp. aureus Mu50
uaauuguuaaaucac

SEQ ID NO: 3972837 - RNA, 21 nt, Staphylococcus aureus subsp. aureus Mu50
uaauuguuacuaguucuaagu

SEQ ID NO: 3972838 - RNA, 17 nt, Staphylococcus aureus subsp. aureus Mu50
uaauuguuuuuucuuau

SEQ ID NO: 3972839 - RNA, 23 nt, Staphylococcus aureus subsp. aureus Mu50
uaauuuaaaagauuagaugauau

SEQ ID NO: 3972840 - RNA, 12 nt, Staphylococcus aureus subsp. aureus Mu50
uaauuuaaaaua

SEQ ID NO: 3972841 - RNA, 14 nt, Staphylococcus aureus subsp. aureus Mu50
uaauuuaaaauagu

SEQ ID NO: 3972842 - RNA, 20 nt, Staphylococcus aureus subsp. aureus Mu50
uaauuuaaaauaguucuuua

SEQ ID NO: 3972843 - RNA, 21 nt, Staphylococcus aureus subsp. aureus Mu50
uaauuuaaaauaguucuuuaa

SEQ ID NO: 3972844 - RNA, 11 nt, Staphylococcus aureus subsp. aureus Mu50
uaauuuaaaga

SEQ ID NO: 3972845 - RNA, 20 nt, Staphylococcus aureus subsp. aureus Mu50
uaauuuaaagcaucauauac

SEQ ID NO: 3972846 - RNA, 21 nt, Staphylococcus aureus subsp. aureus Mu50
uaauuuaaaggcauaauaacc

SEQ ID NO: 3972847 - RNA, 21 nt, Staphylococcus aureus subsp. aureus Mu50
uaauuuaaaucuguacuucua

SEQ ID NO: 3972848 - RNA, 20 nt, Staphylococcus aureus subsp. aureus Mu50
uaauuuaaaugauuucacuu

SEQ ID NO: 3972849 - RNA, 14 nt, Staphylococcus aureus subsp. aureus Mu50
uaauuuaaaugcuu

SEQ ID NO: 3972850 - RNA, 13 nt, Staphylococcus aureus subsp. aureus Mu50
uaauuuaauauuu

SEQ ID NO: 3972851 - RNA, 16 nt, Staphylococcus aureus subsp. aureus Mu50
uaauuuaauauuuaga

SEQ ID NO: 3972852 - RNA, 16 nt, Staphylococcus aureus subsp. aureus Mu50
uaauuuacaauuaauu

SEQ ID NO: 3972853 - RNA, 13 nt, Staphylococcus aureus subsp. aureus Mu50
uaauuuacauuaa

SEQ ID NO: 3972854 - RNA, 16 nt, Staphylococcus aureus subsp. aureus Mu50
uaauuuaguacucaau

SEQ ID NO: 3972855 - RNA, 22 nt, Staphylococcus aureus subsp. aureus Mu50
uaauuuaguaucuauacaauua

SEQ ID NO: 3972856 - RNA, 20 nt, Staphylococcus aureus subsp. aureus Mu50
uaauuuagucauuacaaauc

SEQ ID NO: 3972857 - RNA, 22 nt, Staphylococcus aureus subsp. aureus Mu50
uaauuuaguuauaauuucuguu

SEQ ID NO: 3972858 - RNA, 15 nt, Staphylococcus aureus subsp. aureus Mu50
uaauuuauaaaaaga

SEQ ID NO: 3972859 - RNA, 19 nt, Staphylococcus aureus subsp. aureus Mu50
uaauuuaucaauuucuauu

SEQ ID NO: 3972860 - RNA, 15 nt, Staphylococcus aureus subsp. aureus Mu50
uaauuuaucuuaauc

SEQ ID NO: 3972861 - RNA, 13 nt, Staphylococcus aureus subsp. aureus Mu50
uaauuucaacauu

SEQ ID NO: 3972862 - RNA, 14 nt, Staphylococcus aureus subsp. aureus Mu50
uaauuucaccagua

SEQ ID NO: 3972863 - RNA, 19 nt, Staphylococcus aureus subsp. aureus Mu50
uaauuucaccaguagucac

SEQ ID NO: 3972864 - RNA, 17 nt, Staphylococcus aureus subsp. aureus Mu50
uaauuucaguucuuaga

SEQ ID NO: 3972865 - RNA, 18 nt, Staphylococcus aureus subsp. aureus Mu50
uaauuucaguucuuagau

SEQ ID NO: 3972866 - RNA, 17 nt, Staphylococcus aureus subsp. aureus Mu50
uaauuucauguucauaa

SEQ ID NO: 3972867 - RNA, 14 nt, Staphylococcus aureus subsp. aureus Mu50
uaauuuccuaaaaa

SEQ ID NO: 3972868 - RNA, 17 nt, Staphylococcus aureus subsp. aureus Mu50
uaauuuccuaaaaacug

SEQ ID NO: 3972869 - RNA, 18 nt, Staphylococcus aureus subsp. aureus Mu50
uaauuuccuaaaaacugu

SEQ ID NO: 3972870 - RNA, 22 nt, Staphylococcus aureus subsp. aureus Mu50
uaauuuccuaaaaacugugauu

SEQ ID NO: 3972871 - RNA, 17 nt, Staphylococcus aureus subsp. aureus Mu50
uaauuucuaugaaaaaa

SEQ ID NO: 3972872 - RNA, 18 nt, Staphylococcus aureus subsp. aureus Mu50
uaauuucugguaaaaaaa

SEQ ID NO: 3972873 - RNA, 22 nt, Staphylococcus aureus subsp. aureus Mu50
uaauuucuugauggauauucaa

SEQ ID NO: 3972874 - RNA, 21 nt, Staphylococcus aureus subsp. aureus Mu50
uaauuugaaugccuacagauu

SEQ ID NO: 3972875 - RNA, 15 nt, Staphylococcus aureus subsp. aureus Mu50
uaauuugauaaaugc

SEQ ID NO: 3972876 - RNA, 12 nt, Staphylococcus aureus subsp. aureus Mu50
uaauuugauuaa

SEQ ID NO: 3972877 - RNA, 10 nt, Staphylococcus aureus subsp. aureus Mu50
uaauuuguua

SEQ ID NO: 3972878 - RNA, 15 nt, Staphylococcus aureus subsp. aureus Mu50
uaauuuuaaaaauaa

SEQ ID NO: 3972879 - RNA, 17 nt, Staphylococcus aureus subsp. aureus Mu50
uaauuuuaaaaauaaaa

SEQ ID NO: 3972880 - RNA, 17 nt, Staphylococcus aureus subsp. aureus Mu50
uaauuuuaccuguuucu

SEQ ID NO: 3972881 - RNA, 21 nt, Staphylococcus aureus subsp. aureus Mu50
uaauuuuacguuuauuuccac

SEQ ID NO: 3972882 - RNA, 20 nt, Staphylococcus aureus subsp. aureus Mu50
uaauuuuaucuuauuauuaa

SEQ ID NO: 3972883 - RNA, 14 nt, Staphylococcus aureus subsp. aureus Mu50
uaauuuuauuuaau

SEQ ID NO: 3972884 - RNA, 22 nt, Staphylococcus aureus subsp. aureus Mu50
uaauuuuauuuaauuccauuaa

SEQ ID NO: 3972885 - RNA, 17 nt, Staphylococcus aureus subsp. aureus Mu50
uaauuuucaauuagaaa

SEQ ID NO: 3972886 - RNA, 13 nt, Staphylococcus aureus subsp. aureus Mu50
uaauuuucacuuu

SEQ ID NO: 3972887 - RNA, 19 nt, Staphylococcus aureus subsp. aureus Mu50
uaauuuucacuuucaauga

SEQ ID NO: 3972888 - RNA, 13 nt, Staphylococcus aureus subsp. aureus Mu50
uaauuuucagaau

SEQ ID NO: 3972889 - RNA, 13 nt, Staphylococcus aureus subsp. aureus Mu50
uaauuuucuaaau

SEQ ID NO: 3972890 - RNA, 14 nt, Staphylococcus aureus subsp. aureus Mu50
uaauuuucuuuuuu

SEQ ID NO: 3972891 - RNA, 18 nt, Staphylococcus aureus subsp. aureus Mu50
uaauuuugacauaaaaaa

SEQ ID NO: 3972892 - RNA, 18 nt, Staphylococcus aureus subsp. aureus Mu50
uaauuuugcaacauuaaa

SEQ ID NO: 3972893 - RNA, 21 nt, Staphylococcus aureus subsp. aureus Mu50
uaauuuugcaacauuaaauua

SEQ ID NO: 3972894 - RNA, 13 nt, Staphylococcus aureus subsp. aureus Mu50
uaauuuuguaauu

SEQ ID NO: 3972895 - RNA, 13 nt, Staphylococcus aureus subsp. aureus Mu50
uaauuuuguuuca

SEQ ID NO: 3972896 - RNA, 15 nt, Staphylococcus aureus subsp. aureus Mu50
uaauuuuguuuugcu

SEQ ID NO: 3972897 - RNA, 16 nt, Staphylococcus aureus subsp. aureus Mu50
uaauuuuuaaaucuac

SEQ ID NO: 3972898 - RNA, 15 nt, Staphylococcus aureus subsp. aureus Mu50
uaauuuuucaaaagc

SEQ ID NO: 3972899 - RNA, 14 nt, Staphylococcus aureus subsp. aureus Mu50
uaauuuuucuucuu

SEQ ID NO: 3972900 - RNA, 15 nt, Staphylococcus aureus subsp. aureus Mu50
uaauuuuucuucuuu

SEQ ID NO: 3972901 - RNA, 20 nt, Staphylococcus aureus subsp. aureus Mu50
uaauuuuuuauuaagacuga

SEQ ID NO: 3972902 - RNA, 23 nt, Staphylococcus aureus subsp. aureus Mu50
uacaccuuuggcaccaguacuuu

SEQ ID NO: 3972903 - RNA, 14 nt, Staphylococcus aureus subsp. aureus Mu50
uacacgaguauuau

SEQ ID NO: 3972904 - RNA, 17 nt, Staphylococcus aureus subsp. aureus Mu50
uacacgaguauuaucac

SEQ ID NO: 3972905 - RNA, 14 nt, Staphylococcus aureus subsp. aureus Mu50
uacacgcauuacuu

SEQ ID NO: 3972906 - RNA, 17 nt, Staphylococcus aureus subsp. aureus Mu50
uacacgggcauuguuuu

SEQ ID NO: 3972907 - RNA, 23 nt, Staphylococcus aureus subsp. aureus Mu50
uacacguaacgcaguugaaaaag

SEQ ID NO: 3972908 - RNA, 22 nt, Staphylococcus aureus subsp. aureus Mu50
uacacuaaaaccuauuccuaau

SEQ ID NO: 3972909 - RNA, 18 nt, Staphylococcus aureus subsp. aureus Mu50
uacacucaaacaagauuc

SEQ ID NO: 3972910 - RNA, 20 nt, Staphylococcus aureus subsp. aureus Mu50
uacacuccccuuaucaaaac

SEQ ID NO: 3972911 - RNA, 18 nt, Staphylococcus aureus subsp. aureus Mu50
uacacugcacaucauaau

SEQ ID NO: 3972912 - RNA, 22 nt, Staphylococcus aureus subsp. aureus Mu50
uacacugcacaucauaauaaau

SEQ ID NO: 3972913 - RNA, 20 nt, Staphylococcus aureus subsp. aureus Mu50
uacacuguuuuauaaaugaa

SEQ ID NO: 3972914 - RNA, 16 nt, Staphylococcus aureus subsp. aureus Mu50
uacacuuaauauauuc

SEQ ID NO: 3972915 - RNA, 15 nt, Staphylococcus aureus subsp. aureus Mu50
uacacuuacaaauau

SEQ ID NO: 3972916 - RNA, 15 nt, Staphylococcus aureus subsp. aureus Mu50
uacacuugauaaaac

SEQ ID NO: 3972917 - RNA, 14 nt, Staphylococcus aureus subsp. aureus Mu50
uacacuugauuauc

SEQ ID NO: 3972918 - RNA, 21 nt, Staphylococcus aureus subsp. aureus Mu50
uacacuugauuaucauuguuc

SEQ ID NO: 3972919 - RNA, 22 nt, Staphylococcus aureus subsp. aureus Mu50
uacacuuggcuuaggaugaaaa

SEQ ID NO: 3972920 - RNA, 15 nt, Staphylococcus aureus subsp. aureus Mu50
uacacuuuucuuauc

SEQ ID NO: 3972921 - RNA, 12 nt, Staphylococcus aureus subsp. aureus Mu50
uacacuuuugau

SEQ ID NO: 3972922 - RNA, 20 nt, Staphylococcus aureus subsp. aureus Mu50
uacacuuuuugacauauuuu

SEQ ID NO: 3972923 - RNA, 16 nt, Staphylococcus aureus subsp. aureus Mu50
uacagacaaacauuac

SEQ ID NO: 3972924 - RNA, 14 nt, Staphylococcus aureus subsp. aureus Mu50
uacagagaaucaau

SEQ ID NO: 3972925 - RNA, 17 nt, Staphylococcus aureus subsp. aureus Mu50
uacagagaaucaauuau

SEQ ID NO: 3972926 - RNA, 18 nt, Staphylococcus aureus subsp. aureus Mu50
uacagauaaguaauaaua

SEQ ID NO: 3972927 - RNA, 14 nt, Staphylococcus aureus subsp. aureus Mu50
uacagauaauuauu

SEQ ID NO: 3972928 - RNA, 16 nt, Staphylococcus aureus subsp. aureus Mu50
uacagauaauuauuuc

SEQ ID NO: 3972929 - RNA, 18 nt, Staphylococcus aureus subsp. aureus Mu50
uacagauaggaaacuuaa

SEQ ID NO: 3972930 - RNA, 19 nt, Staphylococcus aureus subsp. aureus Mu50
uacagauaggaaacuuaaa

SEQ ID NO: 3972931 - RNA, 22 nt, Staphylococcus aureus subsp. aureus Mu50
uacagauaggaaacuuaaauau

SEQ ID NO: 3972932 - RNA, 20 nt, Staphylococcus aureus subsp. aureus Mu50
uacagaucucaauccaauua

SEQ ID NO: 3972933 - RNA, 12 nt, Staphylococcus aureus subsp. aureus Mu50
uacagaugaugc

SEQ ID NO: 3972934 - RNA, 13 nt, Staphylococcus aureus subsp. aureus Mu50
uacagaugaugcu

SEQ ID NO: 3972935 - RNA, 21 nt, Staphylococcus aureus subsp. aureus Mu50
uacagauuccugcaaaauguu

SEQ ID NO: 3972936 - RNA, 16 nt, Staphylococcus aureus subsp. aureus Mu50
uacagauuuuaaaaau

SEQ ID NO: 3972937 - RNA, 19 nt, Staphylococcus aureus subsp. aureus Mu50
uacagauuuuaaaaauuca

SEQ ID NO: 3972938 - RNA, 22 nt, Staphylococcus aureus subsp. aureus Mu50
uacagcacgagacaauaaugca

SEQ ID NO: 3972939 - RNA, 14 nt, Staphylococcus aureus subsp. aureus Mu50
uacagcaucaccua

SEQ ID NO: 3972940 - RNA, 15 nt, Staphylococcus aureus subsp. aureus Mu50
uacagcguauuuuaa

SEQ ID NO: 3972941 - RNA, 23 nt, Staphylococcus aureus subsp. aureus Mu50
uacagcguauuuuaaugauuuuu

SEQ ID NO: 3972942 - RNA, 20 nt, Staphylococcus aureus subsp. aureus Mu50
uacagcgugauucaucuauu

SEQ ID NO: 3972943 - RNA, 22 nt, Staphylococcus aureus subsp. aureus Mu50
uacagcgugauucaucuauuau

SEQ ID NO: 3972944 - RNA, 21 nt, Staphylococcus aureus subsp. aureus Mu50
uacagguuuaauaaauuuaac

SEQ ID NO: 3972945 - RNA, 19 nt, Staphylococcus aureus subsp. aureus Mu50
uacagguuuuaaaauuaaa

SEQ ID NO: 3972946 - RNA, 17 nt, Staphylococcus aureus subsp. aureus Mu50
uacaguaaauugauucu

SEQ ID NO: 3972947 - RNA, 13 nt, Staphylococcus aureus subsp. aureus Mu50
uacauaaaucuaa

SEQ ID NO: 3972948 - RNA, 15 nt, Staphylococcus aureus subsp. aureus Mu50
uacauaacccuaaaa

SEQ ID NO: 3972949 - RNA, 19 nt, Staphylococcus aureus subsp. aureus Mu50
uacauaacccuaaaaugaa

SEQ ID NO: 3972950 - RNA, 14 nt, Staphylococcus aureus subsp. aureus Mu50
uacauaauaaaaag

SEQ ID NO: 3972951 - RNA, 22 nt, Staphylococcus aureus subsp. aureus Mu50
uacauaauagacuuauauuaau

SEQ ID NO: 3972952 - RNA, 14 nt, Staphylococcus aureus subsp. aureus Mu50
uacauaaugguuca

SEQ ID NO: 3972953 - RNA, 18 nt, Staphylococcus aureus subsp. aureus Mu50
uacauaauuugaauuagu

SEQ ID NO: 3972954 - RNA, 21 nt, Staphylococcus aureus subsp. aureus Mu50
uacauaccacacuuuaaacaa

SEQ ID NO: 3972955 - RNA, 18 nt, Staphylococcus aureus subsp. aureus Mu50
uacauacggcaaauucaa

SEQ ID NO: 3972956 - RNA, 20 nt, Staphylococcus aureus subsp. aureus Mu50
uacauacggcaaauucaacu

SEQ ID NO: 3972957 - RNA, 21 nt, Staphylococcus aureus subsp. aureus Mu50
uacauacggcaaauucaacuu

SEQ ID NO: 3972958 - RNA, 15 nt, Staphylococcus aureus subsp. aureus Mu50
uacauaggauaucua

SEQ ID NO: 3972959 - RNA, 23 nt, Staphylococcus aureus subsp. aureus Mu50
uacauagguucaucuuuaugcaa

SEQ ID NO: 3972960 - RNA, 23 nt, Staphylococcus aureus subsp. aureus Mu50
uacauaguugaaucggugucuuu

SEQ ID NO: 3972961 - RNA, 24 nt, Staphylococcus aureus subsp. aureus Mu50
uacauaguugaaucggugucuuua

SEQ ID NO: 3972962 - RNA, 14 nt, Staphylococcus aureus subsp. aureus Mu50
uacauauaagaauu

SEQ ID NO: 3972963 - RNA, 17 nt, Staphylococcus aureus subsp. aureus Mu50
uacauauaagaauuguu

SEQ ID NO: 3972964 - RNA, 17 nt, Staphylococcus aureus subsp. aureus Mu50
uacauauaauaugugca

SEQ ID NO: 3972965 - RNA, 16 nt, Staphylococcus aureus subsp. aureus Mu50
uacauauaucaacaug

SEQ ID NO: 3972966 - RNA, 16 nt, Staphylococcus aureus subsp. aureus Mu50
uacauauucucugcuu

SEQ ID NO: 3972967 - RNA, 21 nt, Staphylococcus aureus subsp. aureus Mu50
uacauauucucugcuucuaaa

SEQ ID NO: 3972968 - RNA, 13 nt, Staphylococcus aureus subsp. aureus Mu50
uacaucaauuucu

SEQ ID NO: 3972969 - RNA, 15 nt, Staphylococcus aureus subsp. aureus Mu50
uacaucaauuucuag

SEQ ID NO: 3972970 - RNA, 14 nt, Staphylococcus aureus subsp. aureus Mu50
uacaucauuaaaua

SEQ ID NO: 3972971 - RNA, 17 nt, Staphylococcus aureus subsp. aureus Mu50
uacaucauuaaauauuu

SEQ ID NO: 3972972 - RNA, 14 nt, Staphylococcus aureus subsp. aureus Mu50
uacauccauacuuc

SEQ ID NO: 3972973 - RNA, 14 nt, Staphylococcus aureus subsp. aureus Mu50
uacaucuaauaaau

SEQ ID NO: 3972974 - RNA, 16 nt, Staphylococcus aureus subsp. aureus Mu50
uacaucuauauuuguu

SEQ ID NO: 3972975 - RNA, 20 nt, Staphylococcus aureus subsp. aureus Mu50
uacaugaaucaacaauuuaa

SEQ ID NO: 3972976 - RNA, 17 nt, Staphylococcus aureus subsp. aureus Mu50
uacaugacauucauuua

SEQ ID NO: 3972977 - RNA, 15 nt, Staphylococcus aureus subsp. aureus Mu50
uacaugacuccaugc

SEQ ID NO: 3972978 - RNA, 19 nt, Staphylococcus aureus subsp. aureus Mu50
uacaugcaccuuuacaaca

SEQ ID NO: 3972979 - RNA, 21 nt, Staphylococcus aureus subsp. aureus Mu50
uacauuaaaacaauaauuuaa

SEQ ID NO: 3972980 - RNA, 18 nt, Staphylococcus aureus subsp. aureus Mu50
uacauuaaagaaaauauc

SEQ ID NO: 3972981 - RNA, 15 nt, Staphylococcus aureus subsp. aureus Mu50
uacauuaauauaaau

SEQ ID NO: 3972982 - RNA, 14 nt, Staphylococcus aureus subsp. aureus Mu50
uacauuaauuuguc

SEQ ID NO: 3972983 - RNA, 17 nt, Staphylococcus aureus subsp. aureus Mu50
uacauuacgcucaucac

SEQ ID NO: 3972984 - RNA, 23 nt, Staphylococcus aureus subsp. aureus Mu50
uacauuacgcucaucaccuuuua

SEQ ID NO: 3972985 - RNA, 14 nt, Staphylococcus aureus subsp. aureus Mu50
uacauugauaaaau

SEQ ID NO: 3972986 - RNA, 17 nt, Staphylococcus aureus subsp. aureus Mu50
uacauugauaaaauaau

SEQ ID NO: 3972987 - RNA, 21 nt, Staphylococcus aureus subsp. aureus Mu50
uacauugauaaaauaaucggu

SEQ ID NO: 3972988 - RNA, 24 nt, Staphylococcus aureus subsp. aureus Mu50
uacauugguuuuuacuauaauaau

SEQ ID NO: 3972989 - RNA, 14 nt, Staphylococcus aureus subsp. aureus Mu50
uaccuuuccaauuu

SEQ ID NO: 3972990 - RNA, 17 nt, Staphylococcus aureus subsp. aureus Mu50
uaccuuuccaauuuguu

SEQ ID NO: 3972991 - RNA, 15 nt, Staphylococcus aureus subsp. aureus Mu50
uaccuuugucuuuuu

SEQ ID NO: 3972992 - RNA, 22 nt, Staphylococcus aureus subsp. aureus Mu50
uaccuuugucuuuuuuaucaug

SEQ ID NO: 3972993 - RNA, 13 nt, Staphylococcus aureus subsp. aureus Mu50
uacgaaaauauca

SEQ ID NO: 3972994 - RNA, 18 nt, Staphylococcus aureus subsp. aureus Mu50
uacgaaaguagaauuauu

SEQ ID NO: 3972995 - RNA, 19 nt, Staphylococcus aureus subsp. aureus Mu50
uacgaaaguagaauuauuu

SEQ ID NO: 3972996 - RNA, 13 nt, Staphylococcus aureus subsp. aureus Mu50
uacgaaaugcaau

SEQ ID NO: 3972997 - RNA, 20 nt, Staphylococcus aureus subsp. aureus Mu50
uacgaaguuucauguuugau

SEQ ID NO: 3972998 - RNA, 22 nt, Staphylococcus aureus subsp. aureus Mu50
uacgaaucacaguuauauauuc

SEQ ID NO: 3972999 - RNA, 11 nt, Staphylococcus aureus subsp. aureus Mu50
uacgacucucc

SEQ ID NO: 3973000 - RNA, 17 nt, Staphylococcus aureus subsp. aureus Mu50
uacgaguuauaucuuuu

SEQ ID NO: 3973001 - RNA, 15 nt, Staphylococcus aureus subsp. aureus Mu50
uacgauaaauaguga

SEQ ID NO: 3973002 - RNA, 19 nt, Staphylococcus aureus subsp. aureus Mu50
uacgaucaaaaucaugcuc

SEQ ID NO: 3973003 - RNA, 17 nt, Staphylococcus aureus subsp. aureus Mu50
uacgaucauaaauauuu

SEQ ID NO: 3973004 - RNA, 20 nt, Staphylococcus aureus subsp. aureus Mu50
uacgaugaugauuuauaaaa

SEQ ID NO: 3973005 - RNA, 16 nt, Staphylococcus aureus subsp. aureus Mu50
uacgauucaauuuaac

SEQ ID NO: 3973006 - RNA, 19 nt, Staphylococcus aureus subsp. aureus Mu50
uacgauugaguugaaaaua

SEQ ID NO: 3973007 - RNA, 20 nt, Staphylococcus aureus subsp. aureus Mu50
uacgauugaguugaaaauaa

SEQ ID NO: 3973008 - RNA, 14 nt, Staphylococcus aureus subsp. aureus Mu50
uacgauugcaauug

SEQ ID NO: 3973009 - RNA, 17 nt, Staphylococcus aureus subsp. aureus Mu50
uacgcaaugauuauaaa

SEQ ID NO: 3973010 - RNA, 22 nt, Staphylococcus aureus subsp. aureus Mu50
uacgcaaugauuauaaauacau

SEQ ID NO: 3973011 - RNA, 19 nt, Staphylococcus aureus subsp. aureus Mu50
uacgcauuuuaaauaaaau

SEQ ID NO: 3973012 - RNA, 20 nt, Staphylococcus aureus subsp. aureus Mu50
uacgccaccaguuucaagug

SEQ ID NO: 3973013 - RNA, 17 nt, Staphylococcus aureus subsp. aureus Mu50
uacgcccaucaucacug

SEQ ID NO: 3973014 - RNA, 16 nt, Staphylococcus aureus subsp. aureus Mu50
uacgccuucuuuauaa

SEQ ID NO: 3973015 - RNA, 19 nt, Staphylococcus aureus subsp. aureus Mu50
uacgccuucuuuauaacuu

SEQ ID NO: 3973016 - RNA, 16 nt, Staphylococcus aureus subsp. aureus Mu50
uacgcugucucauuaa

SEQ ID NO: 3973017 - RNA, 16 nt, Staphylococcus aureus subsp. aureus Mu50
uacgcuuuuuaaaaaa

SEQ ID NO: 3973018 - RNA, 16 nt, Staphylococcus aureus subsp. aureus Mu50
uacggagacaaguaua

SEQ ID NO: 3973019 - RNA, 15 nt, Staphylococcus aureus subsp. aureus Mu50
uacguacgguagucu

SEQ ID NO: 3973020 - RNA, 17 nt, Staphylococcus aureus subsp. aureus Mu50
uacguaucaagaaaaag

SEQ ID NO: 3973021 - RNA, 14 nt, Staphylococcus aureus subsp. aureus Mu50
uacgucauaaaaua

SEQ ID NO: 3973022 - RNA, 16 nt, Staphylococcus aureus subsp. aureus Mu50
uacgucauaaaauacc

SEQ ID NO: 3973023 - RNA, 17 nt, Staphylococcus aureus subsp. aureus Mu50
uacgucauaaaauacca

SEQ ID NO: 3973024 - RNA, 15 nt, Staphylococcus aureus subsp. aureus Mu50
uacgugcuuuaaagu

SEQ ID NO: 3973025 - RNA, 19 nt, Staphylococcus aureus subsp. aureus Mu50
uacguuauuucaauaauaa

SEQ ID NO: 3973026 - RNA, 22 nt, Staphylococcus aureus subsp. aureus Mu50
uacguuauuuuuuggucaccaa

SEQ ID NO: 3973027 - RNA, 16 nt, Staphylococcus aureus subsp. aureus Mu50
uacguuuaauaauggu

SEQ ID NO: 3973028 - RNA, 19 nt, Staphylococcus aureus subsp. aureus Mu50
uacguuuaauaaugguucu

SEQ ID NO: 3973029 - RNA, 14 nt, Staphylococcus aureus subsp. aureus Mu50
uacguuuauaucuu

SEQ ID NO: 3973030 - RNA, 17 nt, Staphylococcus aureus subsp. aureus Mu50
uacguuugcauauccuu

SEQ ID NO: 3973031 - RNA, 15 nt, Staphylococcus aureus subsp. aureus Mu50
uacguuuuaaauaaa

SEQ ID NO: 3973032 - RNA, 19 nt, Staphylococcus aureus subsp. aureus Mu50
uacguuuuuuuaaauacau

SEQ ID NO: 3973033 - RNA, 12 nt, Staphylococcus aureus subsp. aureus Mu50
uacuaaaacaug

SEQ ID NO: 3973034 - RNA, 21 nt, Staphylococcus aureus subsp. aureus Mu50
uacuaaaaguguuaugaauua

SEQ ID NO: 3973035 - RNA, 20 nt, Staphylococcus aureus subsp. aureus Mu50
uacuaaaaucacuugguaaa

SEQ ID NO: 3973036 - RNA, 17 nt, Staphylococcus aureus subsp. aureus Mu50
uacuaaaccucaacauu

SEQ ID NO: 3973037 - RNA, 17 nt, Staphylococcus aureus subsp. aureus Mu50
uacuaaacgauaaauua

SEQ ID NO: 3973038 - RNA, 14 nt, Staphylococcus aureus subsp. aureus Mu50
uacuaaacuuuuuu

SEQ ID NO: 3973039 - RNA, 19 nt, Staphylococcus aureus subsp. aureus Mu50
uacuaaauaaguaguucag

SEQ ID NO: 3973040 - RNA, 21 nt, Staphylococcus aureus subsp. aureus Mu50
uacuaaauaaguaguucagca

SEQ ID NO: 3973041 - RNA, 13 nt, Staphylococcus aureus subsp. aureus Mu50
uacuaaaucauuu

SEQ ID NO: 3973042 - RNA, 13 nt, Staphylococcus aureus subsp. aureus Mu50
uacuaaaugaauu

SEQ ID NO: 3973043 - RNA, 22 nt, Staphylococcus aureus subsp. aureus Mu50
uacuaaauugagaaguauuaug

SEQ ID NO: 3973044 - RNA, 18 nt, Staphylococcus aureus subsp. aureus Mu50
uacuaacaauuacgacaa

SEQ ID NO: 3973045 - RNA, 17 nt, Staphylococcus aureus subsp. aureus Mu50
uacuaaccuauuaaaaa

SEQ ID NO: 3973046 - RNA, 18 nt, Staphylococcus aureus subsp. aureus Mu50
uacuaaccuauuaaaaaa

SEQ ID NO: 3973047 - RNA, 18 nt, Staphylococcus aureus subsp. aureus Mu50
uacuaacucgaagucagc

SEQ ID NO: 3973048 - RNA, 16 nt, Staphylococcus aureus subsp. aureus Mu50
uacuaauauauuaauu

SEQ ID NO: 3973049 - RNA, 14 nt, Staphylococcus aureus subsp. aureus Mu50
uacuaaucuuaguu

SEQ ID NO: 3973050 - RNA, 19 nt, Staphylococcus aureus subsp. aureus Mu50
uacuaaucuuaguuaaaau

SEQ ID NO: 3973051 - RNA, 20 nt, Staphylococcus aureus subsp. aureus Mu50
uacuaaucuuuuuuuaauua

SEQ ID NO: 3973052 - RNA, 12 nt, Staphylococcus aureus subsp. aureus Mu50
uacuaauuucua

SEQ ID NO: 3973053 - RNA, 14 nt, Staphylococcus aureus subsp. aureus Mu50
uacuaauuucuaua

SEQ ID NO: 3973054 - RNA, 23 nt, Staphylococcus aureus subsp. aureus Mu50
uacuaauuucuauagaaaaagua

SEQ ID NO: 3973055 - RNA, 20 nt, Staphylococcus aureus subsp. aureus Mu50
uacuacaaacuugauuaugu

SEQ ID NO: 3973056 - RNA, 17 nt, Staphylococcus aureus subsp. aureus Mu50
uacuacauauaaugcca

SEQ ID NO: 3973057 - RNA, 14 nt, Staphylococcus aureus subsp. aureus Mu50
uacuacauuauuac

SEQ ID NO: 3973058 - RNA, 21 nt, Staphylococcus aureus subsp. aureus Mu50
uacuaccguuuuuauauacuu

SEQ ID NO: 3973059 - RNA, 16 nt, Staphylococcus aureus subsp. aureus Mu50
uacuacgcauuauuaa

SEQ ID NO: 3973060 - RNA, 16 nt, Staphylococcus aureus subsp. aureus Mu50
uacuacuuaauuaaua

SEQ ID NO: 3973061 - RNA, 23 nt, Staphylococcus aureus subsp. aureus Mu50
uacuacuugauucuacuucaccu

SEQ ID NO: 3973062 - RNA, 22 nt, Staphylococcus aureus subsp. aureus Mu50
uacuacuuuauaaauaucuuuu

SEQ ID NO: 3973063 - RNA, 14 nt, Staphylococcus aureus subsp. aureus Mu50
uacuacuuuauuug

SEQ ID NO: 3973064 - RNA, 23 nt, Staphylococcus aureus subsp. aureus Mu50
uacuagaaagcacaccuaauuca

SEQ ID NO: 3973065 - RNA, 15 nt, Staphylococcus aureus subsp. aureus Mu50
uacuagaauuaacua

SEQ ID NO: 3973066 - RNA, 19 nt, Staphylococcus aureus subsp. aureus Mu50
uacuagcauuagcaaauau

SEQ ID NO: 3973067 - RNA, 22 nt, Staphylococcus aureus subsp. aureus Mu50
uacuagcauuagcaaauauuau

SEQ ID NO: 3973068 - RNA, 20 nt, Staphylococcus aureus subsp. aureus Mu50
uacuaguuuguaauaauuaa

SEQ ID NO: 3973069 - RNA, 21 nt, Staphylococcus aureus subsp. aureus Mu50
uacuauaaaaauuuauucaaa

SEQ ID NO: 3973070 - RNA, 24 nt, Staphylococcus aureus subsp. aureus Mu50
uacuauaaaaucaucguauuucau

SEQ ID NO: 3973071 - RNA, 22 nt, Staphylococcus aureus subsp. aureus Mu50
uacuauaaauacgucaucuuua

SEQ ID NO: 3973072 - RNA, 17 nt, Staphylococcus aureus subsp. aureus Mu50
uacuauaaauccuaagu

SEQ ID NO: 3973073 - RNA, 14 nt, Staphylococcus aureus subsp. aureus Mu50
uacuauaagcaauu

SEQ ID NO: 3973074 - RNA, 13 nt, Staphylococcus aureus subsp. aureus Mu50
uacuauaauaauu

SEQ ID NO: 3973075 - RNA, 13 nt, Staphylococcus aureus subsp. aureus Mu50
uacuauacugaug

SEQ ID NO: 3973076 - RNA, 14 nt, Staphylococcus aureus subsp. aureus Mu50
uacuuucaccauuu

SEQ ID NO: 3973077 - RNA, 17 nt, Staphylococcus aureus subsp. aureus Mu50
uacuuucaccauuuacu

SEQ ID NO: 3973078 - RNA, 18 nt, Staphylococcus aureus subsp. aureus Mu50
uacuuugauauguuuccu

SEQ ID NO: 3973079 - RNA, 18 nt, Staphylococcus aureus subsp. aureus Mu50
uacuuuggaaauuuauua

SEQ ID NO: 3973080 - RNA, 22 nt, Staphylococcus aureus subsp. aureus Mu50
uacuuuggcagacguaucauca

SEQ ID NO: 3973081 - RNA, 23 nt, Staphylococcus aureus subsp. aureus Mu50
uacuuuggcagacguaucaucaa

SEQ ID NO: 3973082 - RNA, 13 nt, Staphylococcus aureus subsp. aureus Mu50
uacuuuuaaauua

SEQ ID NO: 3973083 - RNA, 15 nt, Staphylococcus aureus subsp. aureus Mu50
uacuuuuauaaucuu

SEQ ID NO: 3973084 - RNA, 15 nt, Staphylococcus aureus subsp. aureus Mu50
uacuuuuccuugauu

SEQ ID NO: 3973085 - RNA, 21 nt, Staphylococcus aureus subsp. aureus Mu50
uacuuuuccuugauucuuaua

SEQ ID NO: 3973086 - RNA, 12 nt, Staphylococcus aureus subsp. aureus Mu50
uacuuuucuaaa

SEQ ID NO: 3973087 - RNA, 20 nt, Staphylococcus aureus subsp. aureus Mu50
uacuuuucucgauuaauuuu

SEQ ID NO: 3973088 - RNA, 15 nt, Staphylococcus aureus subsp. aureus Mu50
uacuuuuucaacugu

SEQ ID NO: 3973089 - RNA, 15 nt, Staphylococcus aureus subsp. aureus Mu50
uacuuuuucaucuuu

SEQ ID NO: 3973090 - RNA, 19 nt, Staphylococcus aureus subsp. aureus Mu50
uagaaaaagcaggcaagcu

SEQ ID NO: 3973091 - RNA, 18 nt, Staphylococcus aureus subsp. aureus Mu50
uagaaaaauaugauugca

SEQ ID NO: 3973092 - RNA, 15 nt, Staphylococcus aureus subsp. aureus Mu50
uagaaaaauuucaaa

SEQ ID NO: 3973093 - RNA, 14 nt, Staphylococcus aureus subsp. aureus Mu50
uagaaaacuagaac

SEQ ID NO: 3973094 - RNA, 19 nt, Staphylococcus aureus subsp. aureus Mu50
uagaaaaguaaguaaaaua

SEQ ID NO: 3973095 - RNA, 14 nt, Staphylococcus aureus subsp. aureus Mu50
uagaaaauaugacg

SEQ ID NO: 3973096 - RNA, 22 nt, Staphylococcus aureus subsp. aureus Mu50
uagaaaauaugacgaucuucau

SEQ ID NO: 3973097 - RNA, 12 nt, Staphylococcus aureus subsp. aureus Mu50
uagaaaauuaac

SEQ ID NO: 3973098 - RNA, 15 nt, Staphylococcus aureus subsp. aureus Mu50
uagaaaccguaaaau

SEQ ID NO: 3973099 - RNA, 23 nt, Staphylococcus aureus subsp. aureus Mu50
uagaaacuuccaacauauaaaaa

SEQ ID NO: 3973100 - RNA, 22 nt, Staphylococcus aureus subsp. aureus Mu50
uagaaagcacaccuaauucaua

SEQ ID NO: 3973101 - RNA, 15 nt, Staphylococcus aureus subsp. aureus Mu50
uagaaaggcaggcau

SEQ ID NO: 3973102 - RNA, 18 nt, Staphylococcus aureus subsp. aureus Mu50
uagaaagugauucccaaa

SEQ ID NO: 3973103 - RNA, 19 nt, Staphylococcus aureus subsp. aureus Mu50
uagaaauaaucacauuaau

SEQ ID NO: 3973104 - RNA, 17 nt, Staphylococcus aureus subsp. aureus Mu50
uagaaauagauuuagaa

SEQ ID NO: 3973105 - RNA, 16 nt, Staphylococcus aureus subsp. aureus Mu50
uagaaauccucuuaua

SEQ ID NO: 3973106 - RNA, 15 nt, Staphylococcus aureus subsp. aureus Mu50
uagaaaugugcugug

SEQ ID NO: 3973107 - RNA, 20 nt, Staphylococcus aureus subsp. aureus Mu50
uagaaaugugcugugucuuu

SEQ ID NO: 3973108 - RNA, 19 nt, Staphylococcus aureus subsp. aureus Mu50
uagaaauuaccguuuauuu

SEQ ID NO: 3973109 - RNA, 14 nt, Staphylococcus aureus subsp. aureus Mu50
uagaaauuuuaaaa

SEQ ID NO: 3973110 - RNA, 21 nt, Staphylococcus aureus subsp. aureus Mu50
uagaacgaaauaguucaaaau

SEQ ID NO: 3973111 - RNA, 18 nt, Staphylococcus aureus subsp. aureus Mu50
uagaagaacaauaauuga

SEQ ID NO: 3973112 - RNA, 20 nt, Staphylococcus aureus subsp. aureus Mu50
uagaagaacaauaauugaug

SEQ ID NO: 3973113 - RNA, 22 nt, Staphylococcus aureus subsp. aureus Mu50
uagaagaacaauaauugaugaa

SEQ ID NO: 3973114 - RNA, 21 nt, Staphylococcus aureus subsp. aureus Mu50
uagaagauauaacauguauau

SEQ ID NO: 3973115 - RNA, 13 nt, Staphylococcus aureus subsp. aureus Mu50
uagaauaaacuuu

SEQ ID NO: 3973116 - RNA, 17 nt, Staphylococcus aureus subsp. aureus Mu50
uagaauagucaauuaau

SEQ ID NO: 3973117 - RNA, 18 nt, Staphylococcus aureus subsp. aureus Mu50
uagaauagucaauuaaug

SEQ ID NO: 3973118 - RNA, 19 nt, Staphylococcus aureus subsp. aureus Mu50
uagaauagucaauuaauga

SEQ ID NO: 3973119 - RNA, 14 nt, Staphylococcus aureus subsp. aureus Mu50
uagaauauuaacgu

SEQ ID NO: 3973120 - RNA, 23 nt, Staphylococcus aureus subsp. aureus Mu50
uagaaucuacgauuuucaagacc

SEQ ID NO: 3973121 - RNA, 23 nt, Staphylococcus aureus subsp. aureus Mu50
uagaaugaaaccguauuauugga

SEQ ID NO: 3973122 - RNA, 11 nt, Staphylococcus aureus subsp. aureus Mu50
uagaaugaaua

SEQ ID NO: 3973123 - RNA, 14 nt, Staphylococcus aureus subsp. aureus Mu50
uagaaugaauaauu

SEQ ID NO: 3973124 - RNA, 18 nt, Staphylococcus aureus subsp. aureus Mu50
uagaaugucgauauuucu

SEQ ID NO: 3973125 - RNA, 19 nt, Staphylococcus aureus subsp. aureus Mu50
uagaaugucgauauuucua

SEQ ID NO: 3973126 - RNA, 15 nt, Staphylococcus aureus subsp. aureus Mu50
uagaauuauuuagaa

SEQ ID NO: 3973127 - RNA, 19 nt, Staphylococcus aureus subsp. aureus Mu50
uagaauuauuuagaaacuu

SEQ ID NO: 3973128 - RNA, 20 nt, Staphylococcus aureus subsp. aureus Mu50
uagaauucacgcaauaucau

SEQ ID NO: 3973129 - RNA, 20 nt, Staphylococcus aureus subsp. aureus Mu50
uagacaauauuuuuacauau

SEQ ID NO: 3973130 - RNA, 23 nt, Staphylococcus aureus subsp. aureus Mu50
uagacaauguucuuuucaacauu

SEQ ID NO: 3973131 - RNA, 20 nt, Staphylococcus aureus subsp. aureus Mu50
uagacaauuguaguaaugaa

SEQ ID NO: 3973132 - RNA, 13 nt, Staphylococcus aureus subsp. aureus Mu50
uagacaccaaaaa

SEQ ID NO: 3973133 - RNA, 19 nt, Staphylococcus aureus subsp. aureus Mu50
uagacaguaguuaauugaa

SEQ ID NO: 3973134 - RNA, 18 nt, Staphylococcus aureus subsp. aureus Mu50
uagacauaaaaaaagaga

SEQ ID NO: 3973135 - RNA, 23 nt, Staphylococcus aureus subsp. aureus Mu50
uagacauaaauauggauuuugaa

SEQ ID NO: 3973136 - RNA, 16 nt, Staphylococcus aureus subsp. aureus Mu50
uagacaucauuguuuu

SEQ ID NO: 3973137 - RNA, 17 nt, Staphylococcus aureus subsp. aureus Mu50
uagacaucauuguuuua

SEQ ID NO: 3973138 - RNA, 18 nt, Staphylococcus aureus subsp. aureus Mu50
uagacaucauuguuuuag

SEQ ID NO: 3973139 - RNA, 15 nt, Staphylococcus aureus subsp. aureus Mu50
uagacgguaucaucu

SEQ ID NO: 3973140 - RNA, 22 nt, Staphylococcus aureus subsp. aureus Mu50
uagacguuuuuauguauuuauu

SEQ ID NO: 3973141 - RNA, 18 nt, Staphylococcus aureus subsp. aureus Mu50
uagacugacacaguaauu

SEQ ID NO: 3973142 - RNA, 17 nt, Staphylococcus aureus subsp. aureus Mu50
uagacugccaauaaaau

SEQ ID NO: 3973143 - RNA, 21 nt, Staphylococcus aureus subsp. aureus Mu50
uagacuuauuugaaugcaaau

SEQ ID NO: 3973144 - RNA, 18 nt, Staphylococcus aureus subsp. aureus Mu50
uagacuuggauaaaaauu

SEQ ID NO: 3973145 - RNA, 13 nt, Staphylococcus aureus subsp. aureus Mu50
uagagaaagaaua

SEQ ID NO: 3973146 - RNA, 19 nt, Staphylococcus aureus subsp. aureus Mu50
uagagaaauacuauucuuu

SEQ ID NO: 3973147 - RNA, 15 nt, Staphylococcus aureus subsp. aureus Mu50
uagagauaacuagaa

SEQ ID NO: 3973148 - RNA, 23 nt, Staphylococcus aureus subsp. aureus Mu50
uagagcccgagacauaaauuaau

SEQ ID NO: 3973149 - RNA, 14 nt, Staphylococcus aureus subsp. aureus Mu50
uagagcguuuugcu

SEQ ID NO: 3973150 - RNA, 14 nt, Staphylococcus aureus subsp. aureus Mu50
uagaguaauuuuac

SEQ ID NO: 3973151 - RNA, 14 nt, Staphylococcus aureus subsp. aureus Mu50
uagaguuuuuauua

SEQ ID NO: 3973152 - RNA, 14 nt, Staphylococcus aureus subsp. aureus Mu50
uagauaaaaauuac

SEQ ID NO: 3973153 - RNA, 16 nt, Staphylococcus aureus subsp. aureus Mu50
uagauaaaaauuacua

SEQ ID NO: 3973154 - RNA, 15 nt, Staphylococcus aureus subsp. aureus Mu50
uagauaaaucaagaa

SEQ ID NO: 3973155 - RNA, 18 nt, Staphylococcus aureus subsp. aureus Mu50
uagauaaaucgauaaaau

SEQ ID NO: 3973156 - RNA, 19 nt, Staphylococcus aureus subsp. aureus Mu50
uagauaaaucgauaaaaug

SEQ ID NO: 3973157 - RNA, 20 nt, Staphylococcus aureus subsp. aureus Mu50
uagauaaguaguggauaauc

SEQ ID NO: 3973158 - RNA, 12 nt, Staphylococcus aureus subsp. aureus Mu50
uagauaauauau

SEQ ID NO: 3973159 - RNA, 18 nt, Staphylococcus aureus subsp. aureus Mu50
uagauacauauaagaauu

SEQ ID NO: 3973160 - RNA, 13 nt, Staphylococcus aureus subsp. aureus Mu50
uagauaccaaacu

SEQ ID NO: 3973161 - RNA, 15 nt, Staphylococcus aureus subsp. aureus Mu50
uagauaccaaacugc

SEQ ID NO: 3973162 - RNA, 21 nt, Staphylococcus aureus subsp. aureus Mu50
uagauacugaauuuuaacuaa

SEQ ID NO: 3973163 - RNA, 18 nt, Staphylococcus aureus subsp. aureus Mu50
uagcuugagcaucuuuua

SEQ ID NO: 3973164 - RNA, 21 nt, Staphylococcus aureus subsp. aureus Mu50
uagcuugagcaucuuuuacug

SEQ ID NO: 3973165 - RNA, 15 nt, Staphylococcus aureus subsp. aureus Mu50
uagcuuuaguuacua

SEQ ID NO: 3973166 - RNA, 18 nt, Staphylococcus aureus subsp. aureus Mu50
uagcuuucguuucuuuua

SEQ ID NO: 3973167 - RNA, 16 nt, Staphylococcus aureus subsp. aureus Mu50
uagcuuucuuuuucau

SEQ ID NO: 3973168 - RNA, 18 nt, Staphylococcus aureus subsp. aureus Mu50
uaggacauauaaauguug

SEQ ID NO: 3973169 - RNA, 21 nt, Staphylococcus aureus subsp. aureus Mu50
uaggacauauaaauguugacu

SEQ ID NO: 3973170 - RNA, 16 nt, Staphylococcus aureus subsp. aureus Mu50
uaggacuaucuauaau

SEQ ID NO: 3973171 - RNA, 14 nt, Staphylococcus aureus subsp. aureus Mu50
uaggaugaaaauau

SEQ ID NO: 3973172 - RNA, 18 nt, Staphylococcus aureus subsp. aureus Mu50
uaggauguucaucaacau

SEQ ID NO: 3973173 - RNA, 17 nt, Staphylococcus aureus subsp. aureus Mu50
uaggauuuacaccuaua

SEQ ID NO: 3973174 - RNA, 18 nt, Staphylococcus aureus subsp. aureus Mu50
uaggauuuacaccuauac

SEQ ID NO: 3973175 - RNA, 16 nt, Staphylococcus aureus subsp. aureus Mu50
uaggcaacugcaagug

SEQ ID NO: 3973176 - RNA, 13 nt, Staphylococcus aureus subsp. aureus Mu50
uaggcaagguauu

SEQ ID NO: 3973177 - RNA, 13 nt, Staphylococcus aureus subsp. aureus Mu50
uaggcauaaugaa

SEQ ID NO: 3973178 - RNA, 16 nt, Staphylococcus aureus subsp. aureus Mu50
uaggcuauguaaaucg

SEQ ID NO: 3973179 - RNA, 16 nt, Staphylococcus aureus subsp. aureus Mu50
uagggauaauuuuauu

SEQ ID NO: 3973180 - RNA, 20 nt, Staphylococcus aureus subsp. aureus Mu50
uagguaaccuuaaauauagu

SEQ ID NO: 3973181 - RNA, 15 nt, Staphylococcus aureus subsp. aureus Mu50
uagguaacuaaaaug

SEQ ID NO: 3973182 - RNA, 18 nt, Staphylococcus aureus subsp. aureus Mu50
uagguaacuaaaaugucu

SEQ ID NO: 3973183 - RNA, 12 nt, Staphylococcus aureus subsp. aureus Mu50
uagguaauaauu

SEQ ID NO: 3973184 - RNA, 14 nt, Staphylococcus aureus subsp. aureus Mu50
uagguauaaucauu

SEQ ID NO: 3973185 - RNA, 19 nt, Staphylococcus aureus subsp. aureus Mu50
uagguaucuuaaagcauau

SEQ ID NO: 3973186 - RNA, 21 nt, Staphylococcus aureus subsp. aureus Mu50
uaggucaacuguaguggaaga

SEQ ID NO: 3973187 - RNA, 18 nt, Staphylococcus aureus subsp. aureus Mu50
uaggucuacgaucaaaau

SEQ ID NO: 3973188 - RNA, 23 nt, Staphylococcus aureus subsp. aureus Mu50
uaggucuugguguagauaaaucg

SEQ ID NO: 3973189 - RNA, 18 nt, Staphylococcus aureus subsp. aureus Mu50
uaggugucaucgcuuuaa

SEQ ID NO: 3973190 - RNA, 16 nt, Staphylococcus aureus subsp. aureus Mu50
uagguuauuauaaaau

SEQ ID NO: 3973191 - RNA, 23 nt, Staphylococcus aureus subsp. aureus Mu50
uagguuauuauaaaauaaauaua

SEQ ID NO: 3973192 - RNA, 16 nt, Staphylococcus aureus subsp. aureus Mu50
uagguucaucuuuaug

SEQ ID NO: 3973193 - RNA, 16 nt, Staphylococcus aureus subsp. aureus Mu50
uagguugauuucugcu

SEQ ID NO: 3973194 - RNA, 19 nt, Staphylococcus aureus subsp. aureus Mu50
uagguuuguugcuuauuaa

SEQ ID NO: 3973195 - RNA, 20 nt, Staphylococcus aureus subsp. aureus Mu50
uaguaaaccuacuaauauau

SEQ ID NO: 3973196 - RNA, 20 nt, Staphylococcus aureus subsp. aureus Mu50
uaguaagagcucucguguau

SEQ ID NO: 3973197 - RNA, 17 nt, Staphylococcus aureus subsp. aureus Mu50
uaguaagguuugaacuc

SEQ ID NO: 3973198 - RNA, 13 nt, Staphylococcus aureus subsp. aureus Mu50
uaguaauaaaaug

SEQ ID NO: 3973199 - RNA, 20 nt, Staphylococcus aureus subsp. aureus Mu50
uaguaauaacaucuaaauuu

SEQ ID NO: 3973200 - RNA, 21 nt, Staphylococcus aureus subsp. aureus Mu50
uaguaauaacaucuaaauuug

SEQ ID NO: 3973201 - RNA, 14 nt, Staphylococcus aureus subsp. aureus Mu50
uaguaauaagacaa

SEQ ID NO: 3973202 - RNA, 15 nt, Staphylococcus aureus subsp. aureus Mu50
uaguaauaagacaau

SEQ ID NO: 3973203 - RNA, 16 nt, Staphylococcus aureus subsp. aureus Mu50
uaguaauaagacaaua

SEQ ID NO: 3973204 - RNA, 22 nt, Staphylococcus aureus subsp. aureus Mu50
uaguaaucucucgcuaaauuua

SEQ ID NO: 3973205 - RNA, 19 nt, Staphylococcus aureus subsp. aureus Mu50
uaguaaugauuaacuuucu

SEQ ID NO: 3973206 - RNA, 23 nt, Staphylococcus aureus subsp. aureus Mu50
uaguaauucuucaucuucuucaa

SEQ ID NO: 3973207 - RNA, 17 nt, Staphylococcus aureus subsp. aureus Mu50
uaguaauuuuuaaaucu

SEQ ID NO: 3973208 - RNA, 17 nt, Staphylococcus aureus subsp. aureus Mu50
uaguacaaaauugucuc

SEQ ID NO: 3973209 - RNA, 19 nt, Staphylococcus aureus subsp. aureus Mu50
uaguacacgaauucauuaa

SEQ ID NO: 3973210 - RNA, 18 nt, Staphylococcus aureus subsp. aureus Mu50
uaguaccaagcuucauua

SEQ ID NO: 3973211 - RNA, 17 nt, Staphylococcus aureus subsp. aureus Mu50
uaguacggcugcuuuaa

SEQ ID NO: 3973212 - RNA, 18 nt, Staphylococcus aureus subsp. aureus Mu50
uaguacggcugcuuuaac

SEQ ID NO: 3973213 - RNA, 16 nt, Staphylococcus aureus subsp. aureus Mu50
uaguacucaauguuag

SEQ ID NO: 3973214 - RNA, 15 nt, Staphylococcus aureus subsp. aureus Mu50
uaguacuuaauuuaa

SEQ ID NO: 3973215 - RNA, 16 nt, Staphylococcus aureus subsp. aureus Mu50
uaguacuuaauuuaaa

SEQ ID NO: 3973216 - RNA, 16 nt, Staphylococcus aureus subsp. aureus Mu50
uaguagauuuauuaaa

SEQ ID NO: 3973217 - RNA, 20 nt, Staphylococcus aureus subsp. aureus Mu50
uaguagauuuauuaaauaua

SEQ ID NO: 3973218 - RNA, 14 nt, Staphylococcus aureus subsp. aureus Mu50
uaguagcuagaaca

SEQ ID NO: 3973219 - RNA, 22 nt, Staphylococcus aureus subsp. aureus Mu50
uaguaggguauugaaauaauau

SEQ ID NO: 3973220 - RNA, 12 nt, Staphylococcus aureus subsp. aureus Mu50
uaguaguguauu

SEQ ID NO: 3973221 - RNA, 18 nt, Staphylococcus aureus subsp. aureus Mu50
uaguaguguauucauuuu

SEQ ID NO: 3973222 - RNA, 13 nt, Staphylococcus aureus subsp. aureus Mu50
uaguauaaauaaa

SEQ ID NO: 3973223 - RNA, 14 nt, Staphylococcus aureus subsp. aureus Mu50
uaguauaaauauca

SEQ ID NO: 3973224 - RNA, 14 nt, Staphylococcus aureus subsp. aureus Mu50
uaguaucucauuuu

SEQ ID NO: 3973225 - RNA, 15 nt, Staphylococcus aureus subsp. aureus Mu50
uaguauggaauaaau

SEQ ID NO: 3973226 - RNA, 19 nt, Staphylococcus aureus subsp. aureus Mu50
uaguauucaaaaaauauuu

SEQ ID NO: 3973227 - RNA, 15 nt, Staphylococcus aureus subsp. aureus Mu50
uaguauuucaucauu

SEQ ID NO: 3973228 - RNA, 22 nt, Staphylococcus aureus subsp. aureus Mu50
uaguauuucaucauuaguuuuu

SEQ ID NO: 3973229 - RNA, 22 nt, Staphylococcus aureus subsp. aureus Mu50
uagucaggggccccaacacaga

SEQ ID NO: 3973230 - RNA, 12 nt, Staphylococcus aureus subsp. aureus Mu50
uagucauguuug

SEQ ID NO: 3973231 - RNA, 22 nt, Staphylococcus aureus subsp. aureus Mu50
uagucauguuuggcauaauaau

SEQ ID NO: 3973232 - RNA, 17 nt, Staphylococcus aureus subsp. aureus Mu50
uagucauuacaaaucau

SEQ ID NO: 3973233 - RNA, 16 nt, Staphylococcus aureus subsp. aureus Mu50
uaguccggggccccaa

SEQ ID NO: 3973234 - RNA, 23 nt, Staphylococcus aureus subsp. aureus Mu50
uaguccggggccccaacaaagaa

SEQ ID NO: 3973235 - RNA, 22 nt, Staphylococcus aureus subsp. aureus Mu50
uaguccuucccacuuaucauca

SEQ ID NO: 3973236 - RNA, 22 nt, Staphylococcus aureus subsp. aureus Mu50
uagucucccauaacaccuacug

SEQ ID NO: 3973237 - RNA, 15 nt, Staphylococcus aureus subsp. aureus Mu50
uagucucguaauaau

SEQ ID NO: 3973238 - RNA, 20 nt, Staphylococcus aureus subsp. aureus Mu50
uagucuucggcuuuguaaaa

SEQ ID NO: 3973239 - RNA, 13 nt, Staphylococcus aureus subsp. aureus Mu50
uagucuuuuuaag

SEQ ID NO: 3973240 - RNA, 15 nt, Staphylococcus aureus subsp. aureus Mu50
uagucuuuuuaagua

SEQ ID NO: 3973241 - RNA, 18 nt, Staphylococcus aureus subsp. aureus Mu50
uagugaaaaaguuucgga

SEQ ID NO: 3973242 - RNA, 21 nt, Staphylococcus aureus subsp. aureus Mu50
uagugaaaaaguuucggaaaa

SEQ ID NO: 3973243 - RNA, 17 nt, Staphylococcus aureus subsp. aureus Mu50
uagugaaauaccuccug

SEQ ID NO: 3973244 - RNA, 13 nt, Staphylococcus aureus subsp. aureus Mu50
uagugagcguauu

SEQ ID NO: 3973245 - RNA, 22 nt, Staphylococcus aureus subsp. aureus Mu50
uagugauauuuuucgaauuuaa

SEQ ID NO: 3973246 - RNA, 17 nt, Staphylococcus aureus subsp. aureus Mu50
uagugcaaguaauuuaa

SEQ ID NO: 3973247 - RNA, 18 nt, Staphylococcus aureus subsp. aureus Mu50
uagugcgcgauaaauaau

SEQ ID NO: 3973248 - RNA, 20 nt, Staphylococcus aureus subsp. aureus Mu50
uagugcgcgauaaauaauaa

SEQ ID NO: 3973249 - RNA, 19 nt, Staphylococcus aureus subsp. aureus Mu50
uagugcgcuuauuuuacua

SEQ ID NO: 3973250 - RNA, 13 nt, Staphylococcus aureus subsp. aureus Mu50
uauaaauaucaau

SEQ ID NO: 3973251 - RNA, 13 nt, Staphylococcus aureus subsp. aureus Mu50
uauaaauaucuuu

SEQ ID NO: 3973252 - RNA, 23 nt, Staphylococcus aureus subsp. aureus Mu50
uauaaauaugguuucuuauuaaa

SEQ ID NO: 3973253 - RNA, 17 nt, Staphylococcus aureus subsp. aureus Mu50
uauaaauauuuuuaauu

SEQ ID NO: 3973254 - RNA, 18 nt, Staphylococcus aureus subsp. aureus Mu50
uauaaauauuuuuaauua

SEQ ID NO: 3973255 - RNA, 22 nt, Staphylococcus aureus subsp. aureus Mu50
uauaaauauuuuuaauuauuuu

SEQ ID NO: 3973256 - RNA, 13 nt, Staphylococcus aureus subsp. aureus Mu50
uauaaaucaaaua

SEQ ID NO: 3973257 - RNA, 15 nt, Staphylococcus aureus subsp. aureus Mu50
uauaaaucaaauaua

SEQ ID NO: 3973258 - RNA, 18 nt, Staphylococcus aureus subsp. aureus Mu50
uauaaaucaaauauacuu

SEQ ID NO: 3973259 - RNA, 19 nt, Staphylococcus aureus subsp. aureus Mu50
uauaaaucaaauauacuuu

SEQ ID NO: 3973260 - RNA, 13 nt, Staphylococcus aureus subsp. aureus Mu50
uauaaaucauuuc

SEQ ID NO: 3973261 - RNA, 22 nt, Staphylococcus aureus subsp. aureus Mu50
uauaaauccuaagucuuuuaaa

SEQ ID NO: 3973262 - RNA, 19 nt, Staphylococcus aureus subsp. aureus Mu50
uauaaaugaaucgcuuuga

SEQ ID NO: 3973263 - RNA, 23 nt, Staphylococcus aureus subsp. aureus Mu50
uauaaaugcacaaacaaaagcac

SEQ ID NO: 3973264 - RNA, 19 nt, Staphylococcus aureus subsp. aureus Mu50
uauaaaugcagcuguauaa

SEQ ID NO: 3973265 - RNA, 18 nt, Staphylococcus aureus subsp. aureus Mu50
uauaaauggcgcgaacau

SEQ ID NO: 3973266 - RNA, 13 nt, Staphylococcus aureus subsp. aureus Mu50
uauaaauguuuau

SEQ ID NO: 3973267 - RNA, 22 nt, Staphylococcus aureus subsp. aureus Mu50
uauaaauguuuauaucuuuuau

SEQ ID NO: 3973268 - RNA, 17 nt, Staphylococcus aureus subsp. aureus Mu50
uauaaauuaaaugcaau

SEQ ID NO: 3973269 - RNA, 14 nt, Staphylococcus aureus subsp. aureus Mu50
uauaaauuauauuu

SEQ ID NO: 3973270 - RNA, 18 nt, Staphylococcus aureus subsp. aureus Mu50
uauaaauuauauuuauuu

SEQ ID NO: 3973271 - RNA, 19 nt, Staphylococcus aureus subsp. aureus Mu50
uauaaauuugguacauaau

SEQ ID NO: 3973272 - RNA, 22 nt, Staphylococcus aureus subsp. aureus Mu50
uauaaauuuguaccaaauaaau

SEQ ID NO: 3973273 - RNA, 15 nt, Staphylococcus aureus subsp. aureus Mu50
uauaaauuuugaauu

SEQ ID NO: 3973274 - RNA, 15 nt, Staphylococcus aureus subsp. aureus Mu50
uauaacaacuacuua

SEQ ID NO: 3973275 - RNA, 18 nt, Staphylococcus aureus subsp. aureus Mu50
uauaacaaguacaauaau

SEQ ID NO: 3973276 - RNA, 18 nt, Staphylococcus aureus subsp. aureus Mu50
uauaacaauaguuuucuu

SEQ ID NO: 3973277 - RNA, 16 nt, Staphylococcus aureus subsp. aureus Mu50
uauaacaccaauuaaa

SEQ ID NO: 3973278 - RNA, 18 nt, Staphylococcus aureus subsp. aureus Mu50
uauaacacgauaauuaua

SEQ ID NO: 3973279 - RNA, 14 nt, Staphylococcus aureus subsp. aureus Mu50
uauaacaucaaaua

SEQ ID NO: 3973280 - RNA, 16 nt, Staphylococcus aureus subsp. aureus Mu50
uauaacauucuucaaa

SEQ ID NO: 3973281 - RNA, 20 nt, Staphylococcus aureus subsp. aureus Mu50
uauaacauucuucaaaaaau

SEQ ID NO: 3973282 - RNA, 13 nt, Staphylococcus aureus subsp. aureus Mu50
uauaaccauaaug

SEQ ID NO: 3973283 - RNA, 18 nt, Staphylococcus aureus subsp. aureus Mu50
uauaacccuaaugugugg

SEQ ID NO: 3973284 - RNA, 23 nt, Staphylococcus aureus subsp. aureus Mu50
uauaacccucguaggcauaggcu

SEQ ID NO: 3973285 - RNA, 14 nt, Staphylococcus aureus subsp. aureus Mu50
uauaaccgcuacaa

SEQ ID NO: 3973286 - RNA, 21 nt, Staphylococcus aureus subsp. aureus Mu50
uauaaccgugaugaugugcaa

SEQ ID NO: 3973287 - RNA, 15 nt, Staphylococcus aureus subsp. aureus Mu50
uauaaccuauuaaau

SEQ ID NO: 3973288 - RNA, 16 nt, Staphylococcus aureus subsp. aureus Mu50
uauaacucuaaauaua

SEQ ID NO: 3973289 - RNA, 18 nt, Staphylococcus aureus subsp. aureus Mu50
uauaacugauaauacugu

SEQ ID NO: 3973290 - RNA, 13 nt, Staphylococcus aureus subsp. aureus Mu50
uauaacuuuaaaa

SEQ ID NO: 3973291 - RNA, 16 nt, Staphylococcus aureus subsp. aureus Mu50
uauaacuuuaaaaauu

SEQ ID NO: 3973292 - RNA, 20 nt, Staphylococcus aureus subsp. aureus Mu50
uauaagaauuguugaucaug

SEQ ID NO: 3973293 - RNA, 21 nt, Staphylococcus aureus subsp. aureus Mu50
uauaagaauuguugaucauga

SEQ ID NO: 3973294 - RNA, 18 nt, Staphylococcus aureus subsp. aureus Mu50
uauaagaauuuaaaagag

SEQ ID NO: 3973295 - RNA, 21 nt, Staphylococcus aureus subsp. aureus Mu50
uauaagaauuuaaaagagaau

SEQ ID NO: 3973296 - RNA, 17 nt, Staphylococcus aureus subsp. aureus Mu50
uauaagaggauuucuag

SEQ ID NO: 3973297 - RNA, 17 nt, Staphylococcus aureus subsp. aureus Mu50
uauaagauagauaaauc

SEQ ID NO: 3973298 - RNA, 20 nt, Staphylococcus aureus subsp. aureus Mu50
uauaagauagauaaaucaag

SEQ ID NO: 3973299 - RNA, 17 nt, Staphylococcus aureus subsp. aureus Mu50
uauaagauauagaaggg

SEQ ID NO: 3973300 - RNA, 14 nt, Staphylococcus aureus subsp. aureus Mu50
uauaagcaauuucu

SEQ ID NO: 3973301 - RNA, 18 nt, Staphylococcus aureus subsp. aureus Mu50
uauaaggauguacuauaa

SEQ ID NO: 3973302 - RNA, 23 nt, Staphylococcus aureus subsp. aureus Mu50
uauaaggauguacuauaaauccu

SEQ ID NO: 3973303 - RNA, 22 nt, Staphylococcus aureus subsp. aureus Mu50
uauaagggguauauuaaaaauu

SEQ ID NO: 3973304 - RNA, 13 nt, Staphylococcus aureus subsp. aureus Mu50
uauaaguaaauaa

SEQ ID NO: 3973305 - RNA, 16 nt, Staphylococcus aureus subsp. aureus Mu50
uauaaguaaauaauag

SEQ ID NO: 3973306 - RNA, 17 nt, Staphylococcus aureus subsp. aureus Mu50
uauaaguaaucauaaua

SEQ ID NO: 3973307 - RNA, 12 nt, Staphylococcus aureus subsp. aureus Mu50
uauaaguacaaa

SEQ ID NO: 3973308 - RNA, 15 nt, Staphylococcus aureus subsp. aureus Mu50
uauaaguacaaauaa

SEQ ID NO: 3973309 - RNA, 16 nt, Staphylococcus aureus subsp. aureus Mu50
uauaaguacaaauaau

SEQ ID NO: 3973310 - RNA, 13 nt, Staphylococcus aureus subsp. aureus Mu50
uauaaguagcuca

SEQ ID NO: 3973311 - RNA, 20 nt, Staphylococcus aureus subsp. aureus Mu50
uauaaguagcucaaaacaau

SEQ ID NO: 3973312 - RNA, 23 nt, Staphylococcus aureus subsp. aureus Mu50
uauaaguagugauuuuuuacauu

SEQ ID NO: 3973313 - RNA, 13 nt, Staphylococcus aureus subsp. aureus Mu50
uauaaguauaaug

SEQ ID NO: 3973314 - RNA, 21 nt, Staphylococcus aureus subsp. aureus Mu50
uauaaguaucgccaucauuca

SEQ ID NO: 3973315 - RNA, 23 nt, Staphylococcus aureus subsp. aureus Mu50
uauaaguaucgccaucauucacc

SEQ ID NO: 3973316 - RNA, 18 nt, Staphylococcus aureus subsp. aureus Mu50
uauaaguauuuuaggguu

SEQ ID NO: 3973317 - RNA, 20 nt, Staphylococcus aureus subsp. aureus Mu50
uauaagugauuucuucauua

SEQ ID NO: 3973318 - RNA, 21 nt, Staphylococcus aureus subsp. aureus Mu50
uauaagugauuucuucauuau

SEQ ID NO: 3973319 - RNA, 22 nt, Staphylococcus aureus subsp. aureus Mu50
uauaagugauuucuucauuauc

SEQ ID NO: 3973320 - RNA, 14 nt, Staphylococcus aureus subsp. aureus Mu50
uauaaguuaaaauu

SEQ ID NO: 3973321 - RNA, 18 nt, Staphylococcus aureus subsp. aureus Mu50
uauaaguugcauauaaaa

SEQ ID NO: 3973322 - RNA, 19 nt, Staphylococcus aureus subsp. aureus Mu50
uauaaguugcauauaaaaa

SEQ ID NO: 3973323 - RNA, 21 nt, Staphylococcus aureus subsp. aureus Mu50
uauaauaaccuaaguuaauuu

SEQ ID NO: 3973324 - RNA, 13 nt, Staphylococcus aureus subsp. aureus Mu50
uauaauaccccaa

SEQ ID NO: 3973325 - RNA, 14 nt, Staphylococcus aureus subsp. aureus Mu50
uauaauacgugugu

SEQ ID NO: 3973326 - RNA, 21 nt, Staphylococcus aureus subsp. aureus Mu50
uauaauacguguguuuucuuu

SEQ ID NO: 3973327 - RNA, 21 nt, Staphylococcus aureus subsp. aureus Mu50
uauaauacuguauuuuaacgu

SEQ ID NO: 3973328 - RNA, 14 nt, Staphylococcus aureus subsp. aureus Mu50
uauaauagaaauaa

SEQ ID NO: 3973329 - RNA, 15 nt, Staphylococcus aureus subsp. aureus Mu50
uauaauagaaauaau

SEQ ID NO: 3973330 - RNA, 13 nt, Staphylococcus aureus subsp. aureus Mu50
uauaauagagaaa

SEQ ID NO: 3973331 - RNA, 16 nt, Staphylococcus aureus subsp. aureus Mu50
uauaauauacacaaaa

SEQ ID NO: 3973332 - RNA, 12 nt, Staphylococcus aureus subsp. aureus Mu50
uauaaucauuaa

SEQ ID NO: 3973333 - RNA, 17 nt, Staphylococcus aureus subsp. aureus Mu50
uauaaucauuaaguaau

SEQ ID NO: 3973334 - RNA, 20 nt, Staphylococcus aureus subsp. aureus Mu50
uauaaucauuuaaacgaucu

SEQ ID NO: 3973335 - RNA, 14 nt, Staphylococcus aureus subsp. aureus Mu50
uauaaucuaucuug

SEQ ID NO: 3973336 - RNA, 18 nt, Staphylococcus aureus subsp. aureus Mu50
uauaaucuaucuugugcu

SEQ ID NO: 3973337 - RNA, 22 nt, Staphylococcus aureus subsp. aureus Mu50
uauauaaagaaauaauuuaaag

SEQ ID NO: 3973338 - RNA, 20 nt, Staphylococcus aureus subsp. aureus Mu50
uauauaaaguugacaauaca

SEQ ID NO: 3973339 - RNA, 21 nt, Staphylococcus aureus subsp. aureus Mu50
uauauaaaguugacaauacaa

SEQ ID NO: 3973340 - RNA, 21 nt, Staphylococcus aureus subsp. aureus Mu50
uauauaaccauaguaauaaaa

SEQ ID NO: 3973341 - RNA, 23 nt, Staphylococcus aureus subsp. aureus Mu50
uauauaaugguucuauaauaaau

SEQ ID NO: 3973342 - RNA, 13 nt, Staphylococcus aureus subsp. aureus Mu50
uauauaauugauu

SEQ ID NO: 3973343 - RNA, 18 nt, Staphylococcus aureus subsp. aureus Mu50
uauauaauuuauaaaaag

SEQ ID NO: 3973344 - RNA, 18 nt, Staphylococcus aureus subsp. aureus Mu50
uauauaauuuauuuagca

SEQ ID NO: 3973345 - RNA, 20 nt, Staphylococcus aureus subsp. aureus Mu50
uauauacaaugacagcagac

SEQ ID NO: 3973346 - RNA, 18 nt, Staphylococcus aureus subsp. aureus Mu50
uauauacccaccacauuu

SEQ ID NO: 3973347 - RNA, 13 nt, Staphylococcus aureus subsp. aureus Mu50
uauauacuaaucu

SEQ ID NO: 3973348 - RNA, 16 nt, Staphylococcus aureus subsp. aureus Mu50
uauauagauugccauu

SEQ ID NO: 3973349 - RNA, 23 nt, Staphylococcus aureus subsp. aureus Mu50
uauauagcgcgcuuauugaaaag

SEQ ID NO: 3973350 - RNA, 15 nt, Staphylococcus aureus subsp. aureus Mu50
uauauaguaaaauaa

SEQ ID NO: 3973351 - RNA, 20 nt, Staphylococcus aureus subsp. aureus Mu50
uauauaguaggguauugaaa

SEQ ID NO: 3973352 - RNA, 20 nt, Staphylococcus aureus subsp. aureus Mu50
uauauagucuaugaauaaug

SEQ ID NO: 3973353 - RNA, 13 nt, Staphylococcus aureus subsp. aureus Mu50
uauauauauuaaa

SEQ ID NO: 3973354 - RNA, 12 nt, Staphylococcus aureus subsp. aureus Mu50
uauauaucaaau

SEQ ID NO: 3973355 - RNA, 16 nt, Staphylococcus aureus subsp. aureus Mu50
uauauaucaaauacau

SEQ ID NO: 3973356 - RNA, 18 nt, Staphylococcus aureus subsp. aureus Mu50
uauauaucaaauacauuu

SEQ ID NO: 3973357 - RNA, 18 nt, Staphylococcus aureus subsp. aureus Mu50
uauauaucacaacacaua

SEQ ID NO: 3973358 - RNA, 21 nt, Staphylococcus aureus subsp. aureus Mu50
uauauaucacaacacauaaau

SEQ ID NO: 3973359 - RNA, 17 nt, Staphylococcus aureus subsp. aureus Mu50
uauauaucacauauuau

SEQ ID NO: 3973360 - RNA, 15 nt, Staphylococcus aureus subsp. aureus Mu50
uauauauccauucaa

SEQ ID NO: 3973361 - RNA, 14 nt, Staphylococcus aureus subsp. aureus Mu50
uauauauuaaaaca

SEQ ID NO: 3973362 - RNA, 15 nt, Staphylococcus aureus subsp. aureus Mu50
uauauauuaaaacaa

SEQ ID NO: 3973363 - RNA, 16 nt, Staphylococcus aureus subsp. aureus Mu50
uauauauuaaaacaau

SEQ ID NO: 3973364 - RNA, 15 nt, Staphylococcus aureus subsp. aureus Mu50
uauauauuaaaguaa

SEQ ID NO: 3973365 - RNA, 16 nt, Staphylococcus aureus subsp. aureus Mu50
uauauauuaaaguaaa

SEQ ID NO: 3973366 - RNA, 12 nt, Staphylococcus aureus subsp. aureus Mu50
uauauauucaau

SEQ ID NO: 3973367 - RNA, 14 nt, Staphylococcus aureus subsp. aureus Mu50
uauauauucaauaa

SEQ ID NO: 3973368 - RNA, 18 nt, Staphylococcus aureus subsp. aureus Mu50
uauauauuccuuaaaccg

SEQ ID NO: 3973369 - RNA, 23 nt, Staphylococcus aureus subsp. aureus Mu50
uauaucaaauacauuucaaaaaa

SEQ ID NO: 3973370 - RNA, 19 nt, Staphylococcus aureus subsp. aureus Mu50
uauaucaacguuaauauaa

SEQ ID NO: 3973371 - RNA, 17 nt, Staphylococcus aureus subsp. aureus Mu50
uauauccgcaucuuuug

SEQ ID NO: 3973372 - RNA, 17 nt, Staphylococcus aureus subsp. aureus Mu50
uauauccugccaauaua

SEQ ID NO: 3973373 - RNA, 15 nt, Staphylococcus aureus subsp. aureus Mu50
uauaucgcuuuugaa

SEQ ID NO: 3973374 - RNA, 17 nt, Staphylococcus aureus subsp. aureus Mu50
uauaucuaauacuuuca

SEQ ID NO: 3973375 - RNA, 19 nt, Staphylococcus aureus subsp. aureus Mu50
uauaucuuaaguacauaaa

SEQ ID NO: 3973376 - RNA, 13 nt, Staphylococcus aureus subsp. aureus Mu50
uauaucuuuuaua

SEQ ID NO: 3973377 - RNA, 18 nt, Staphylococcus aureus subsp. aureus Mu50
uauaugaaauauuuaucu

SEQ ID NO: 3973378 - RNA, 16 nt, Staphylococcus aureus subsp. aureus Mu50
uauaugaauugaguau

SEQ ID NO: 3973379 - RNA, 14 nt, Staphylococcus aureus subsp. aureus Mu50
uauaugaauuuuau

SEQ ID NO: 3973380 - RNA, 15 nt, Staphylococcus aureus subsp. aureus Mu50
uauaugaauuuuaua

SEQ ID NO: 3973381 - RNA, 17 nt, Staphylococcus aureus subsp. aureus Mu50
uauaugauaaauauugu

SEQ ID NO: 3973382 - RNA, 16 nt, Staphylococcus aureus subsp. aureus Mu50
uauaugccgauugcuc

SEQ ID NO: 3973383 - RNA, 23 nt, Staphylococcus aureus subsp. aureus Mu50
uauaugccgauugcucuaaucca

SEQ ID NO: 3973384 - RNA, 17 nt, Staphylococcus aureus subsp. aureus Mu50
uauauggaauuguaucu

SEQ ID NO: 3973385 - RNA, 21 nt, Staphylococcus aureus subsp. aureus Mu50
uauauggagcuacccuauuuu

SEQ ID NO: 3973386 - RNA, 15 nt, Staphylococcus aureus subsp. aureus Mu50
uauauggcaucauca

SEQ ID NO: 3973387 - RNA, 21 nt, Staphylococcus aureus subsp. aureus Mu50
uauauguaaagcuaauuuuuu

SEQ ID NO: 3973388 - RNA, 22 nt, Staphylococcus aureus subsp. aureus Mu50
uauauguaaucagaguagaaag

SEQ ID NO: 3973389 - RNA, 19 nt, Staphylococcus aureus subsp. aureus Mu50
uauauguauaacauuauua

SEQ ID NO: 3973390 - RNA, 17 nt, Staphylococcus aureus subsp. aureus Mu50
uauaugucucucuuucu

SEQ ID NO: 3973391 - RNA, 21 nt, Staphylococcus aureus subsp. aureus Mu50
uauaugucucucuuucuuauu

SEQ ID NO: 3973392 - RNA, 18 nt, Staphylococcus aureus subsp. aureus Mu50
uauauguuuuaugauuuu

SEQ ID NO: 3973393 - RNA, 12 nt, Staphylococcus aureus subsp. aureus Mu50
uauauuaaaaau

SEQ ID NO: 3973394 - RNA, 16 nt, Staphylococcus aureus subsp. aureus Mu50
uauauuaaaaauuuca

SEQ ID NO: 3973395 - RNA, 14 nt, Staphylococcus aureus subsp. aureus Mu50
uauauuaaauacua

SEQ ID NO: 3973396 - RNA, 20 nt, Staphylococcus aureus subsp. aureus Mu50
uauauuaagacguuguaaug

SEQ ID NO: 3973397 - RNA, 12 nt, Staphylococcus aureus subsp. aureus Mu50
uauauuaagcau

SEQ ID NO: 3973398 - RNA, 18 nt, Staphylococcus aureus subsp. aureus Mu50
uauauuaaggucauuuuu

SEQ ID NO: 3973399 - RNA, 15 nt, Staphylococcus aureus subsp. aureus Mu50
uauauuaauguuuga

SEQ ID NO: 3973400 - RNA, 16 nt, Staphylococcus aureus subsp. aureus Mu50
uauauuaauguuugau

SEQ ID NO: 3973401 - RNA, 20 nt, Staphylococcus aureus subsp. aureus Mu50
uauauuacucaaaauuaaag

SEQ ID NO: 3973402 - RNA, 17 nt, Staphylococcus aureus subsp. aureus Mu50
uauauuaucauugauau

SEQ ID NO: 3973403 - RNA, 13 nt, Staphylococcus aureus subsp. aureus Mu50
uauauucaacuua

SEQ ID NO: 3973404 - RNA, 18 nt, Staphylococcus aureus subsp. aureus Mu50
uauauuccacgcucacau

SEQ ID NO: 3973405 - RNA, 19 nt, Staphylococcus aureus subsp. aureus Mu50
uauauugagacaacauugu

SEQ ID NO: 3973406 - RNA, 17 nt, Staphylococcus aureus subsp. aureus Mu50
uauauugcaaaaauaau

SEQ ID NO: 3973407 - RNA, 20 nt, Staphylococcus aureus subsp. aureus Mu50
uauauugucgacuuuuagau

SEQ ID NO: 3973408 - RNA, 16 nt, Staphylococcus aureus subsp. aureus Mu50
uauauuuaacaucaau

SEQ ID NO: 3973409 - RNA, 12 nt, Staphylococcus aureus subsp. aureus Mu50
uauauuuaauuu

SEQ ID NO: 3973410 - RNA, 14 nt, Staphylococcus aureus subsp. aureus Mu50
uauauuuacacaga

SEQ ID NO: 3973411 - RNA, 22 nt, Staphylococcus aureus subsp. aureus Mu50
uauauuuacacagaaugauaua

SEQ ID NO: 3973412 - RNA, 23 nt, Staphylococcus aureus subsp. aureus Mu50
uauauuuaguuaauuauuuagau

SEQ ID NO: 3973413 - RNA, 23 nt, Staphylococcus aureus subsp. aureus Mu50
uauauuuaguuagcccuauucaa

SEQ ID NO: 3973414 - RNA, 17 nt, Staphylococcus aureus subsp. aureus Mu50
uauauuuauuuuugaua

SEQ ID NO: 3973415 - RNA, 22 nt, Staphylococcus aureus subsp. aureus Mu50
uauauuucgguauuuuaaauuu

SEQ ID NO: 3973416 - RNA, 20 nt, Staphylococcus aureus subsp. aureus Mu50
uauauuucucauacuauaag

SEQ ID NO: 3973417 - RNA, 17 nt, Staphylococcus aureus subsp. aureus Mu50
uauauuuguauaugcaa

SEQ ID NO: 3973418 - RNA, 13 nt, Staphylococcus aureus subsp. aureus Mu50
uauauuugugaau

SEQ ID NO: 3973419 - RNA, 15 nt, Staphylococcus aureus subsp. aureus Mu50
uauauuuuaugucaa

SEQ ID NO: 3973420 - RNA, 19 nt, Staphylococcus aureus subsp. aureus Mu50
uauauuuuauuagaauauu

SEQ ID NO: 3973421 - RNA, 16 nt, Staphylococcus aureus subsp. aureus Mu50
uauauuuuguuaauaa

SEQ ID NO: 3973422 - RNA, 19 nt, Staphylococcus aureus subsp. aureus Mu50
uauauuuuuaggugcuuua

SEQ ID NO: 3973423 - RNA, 11 nt, Staphylococcus aureus subsp. aureus Mu50
uauauuuuuau

SEQ ID NO: 3973424 - RNA, 14 nt, Staphylococcus aureus subsp. aureus Mu50
uauauuuuuauuaa

SEQ ID NO: 3973425 - RNA, 18 nt, Staphylococcus aureus subsp. aureus Mu50
uaucgccuggugcaggca

SEQ ID NO: 3973426 - RNA, 17 nt, Staphylococcus aureus subsp. aureus Mu50
uaucguaaaaaaacguc

SEQ ID NO: 3973427 - RNA, 18 nt, Staphylococcus aureus subsp. aureus Mu50
uaucguuguaccacccca

SEQ ID NO: 3973428 - RNA, 16 nt, Staphylococcus aureus subsp. aureus Mu50
uaucuaaacaauuccc

SEQ ID NO: 3973429 - RNA, 18 nt, Staphylococcus aureus subsp. aureus Mu50
uaucuaaaccuuuuuuaa

SEQ ID NO: 3973430 - RNA, 17 nt, Staphylococcus aureus subsp. aureus Mu50
uaucuaaagcuauaaaa

SEQ ID NO: 3973431 - RNA, 19 nt, Staphylococcus aureus subsp. aureus Mu50
uaucuaaagcuauaaaaaa

SEQ ID NO: 3973432 - RNA, 20 nt, Staphylococcus aureus subsp. aureus Mu50
uaucuaacaaucguuuuaau

SEQ ID NO: 3973433 - RNA, 20 nt, Staphylococcus aureus subsp. aureus Mu50
uaucuaaugggucaaugacu

SEQ ID NO: 3973434 - RNA, 18 nt, Staphylococcus aureus subsp. aureus Mu50
uaucuacaauaaccauuu

SEQ ID NO: 3973435 - RNA, 12 nt, Staphylococcus aureus subsp. aureus Mu50
uaucuacagaga

SEQ ID NO: 3973436 - RNA, 17 nt, Staphylococcus aureus subsp. aureus Mu50
uaucuacagagaaucaa

SEQ ID NO: 3973437 - RNA, 23 nt, Staphylococcus aureus subsp. aureus Mu50
uaucuacaugguuuucaccagac

SEQ ID NO: 3973438 - RNA, 16 nt, Staphylococcus aureus subsp. aureus Mu50
uaucuacauuaaagaa

SEQ ID NO: 3973439 - RNA, 22 nt, Staphylococcus aureus subsp. aureus Mu50
uaucuacauuaaagaaaauauc

SEQ ID NO: 3973440 - RNA, 22 nt, Staphylococcus aureus subsp. aureus Mu50
uaucuacgccuugaccuacuuu

SEQ ID NO: 3973441 - RNA, 19 nt, Staphylococcus aureus subsp. aureus Mu50
uaucuacucaaauauaaau

SEQ ID NO: 3973442 - RNA, 14 nt, Staphylococcus aureus subsp. aureus Mu50
uaucuagcugcuuc

SEQ ID NO: 3973443 - RNA, 19 nt, Staphylococcus aureus subsp. aureus Mu50
uaucuaguguucucauuau

SEQ ID NO: 3973444 - RNA, 13 nt, Staphylococcus aureus subsp. aureus Mu50
uaucuauaaaaag

SEQ ID NO: 3973445 - RNA, 14 nt, Staphylococcus aureus subsp. aureus Mu50
uaucuauaaaaaga

SEQ ID NO: 3973446 - RNA, 18 nt, Staphylococcus aureus subsp. aureus Mu50
uaucuauaaaaagaauau

SEQ ID NO: 3973447 - RNA, 24 nt, Staphylococcus aureus subsp. aureus Mu50
uaucuauacaauuauggauaaaau

SEQ ID NO: 3973448 - RNA, 15 nt, Staphylococcus aureus subsp. aureus Mu50
uaucuauaugcauau

SEQ ID NO: 3973449 - RNA, 18 nt, Staphylococcus aureus subsp. aureus Mu50
uaucuccgcuacaauuau

SEQ ID NO: 3973450 - RNA, 23 nt, Staphylococcus aureus subsp. aureus Mu50
uaucucuaccauuucaaccuuuu

SEQ ID NO: 3973451 - RNA, 19 nt, Staphylococcus aureus subsp. aureus Mu50
uaucucugaaaaacuucuu

SEQ ID NO: 3973452 - RNA, 20 nt, Staphylococcus aureus subsp. aureus Mu50
uaucucugaaaaacuucuua

SEQ ID NO: 3973453 - RNA, 19 nt, Staphylococcus aureus subsp. aureus Mu50
uaucucuuuucuauucaaa

SEQ ID NO: 3973454 - RNA, 13 nt, Staphylococcus aureus subsp. aureus Mu50
uaucugaaaauau

SEQ ID NO: 3973455 - RNA, 16 nt, Staphylococcus aureus subsp. aureus Mu50
uaucugaauuuuacug

SEQ ID NO: 3973456 - RNA, 21 nt, Staphylococcus aureus subsp. aureus Mu50
uaucugacauuucaucaauaa

SEQ ID NO: 3973457 - RNA, 22 nt, Staphylococcus aureus subsp. aureus Mu50
uaucugacauuucaucaauaau

SEQ ID NO: 3973458 - RNA, 15 nt, Staphylococcus aureus subsp. aureus Mu50
uaucuguaucaaaau

SEQ ID NO: 3973459 - RNA, 17 nt, Staphylococcus aureus subsp. aureus Mu50
uaucuguugucaucaug

SEQ ID NO: 3973460 - RNA, 12 nt, Staphylococcus aureus subsp. aureus Mu50
uaucuguuguua

SEQ ID NO: 3973461 - RNA, 16 nt, Staphylococcus aureus subsp. aureus Mu50
uaucuguuguuauaua

SEQ ID NO: 3973462 - RNA, 19 nt, Staphylococcus aureus subsp. aureus Mu50
uaucuguuguuauauaaau

SEQ ID NO: 3973463 - RNA, 14 nt, Staphylococcus aureus subsp. aureus Mu50
uaucuuacugcugu

SEQ ID NO: 3973464 - RNA, 19 nt, Staphylococcus aureus subsp. aureus Mu50
uaucuuaguaagacugcca

SEQ ID NO: 3973465 - RNA, 15 nt, Staphylococcus aureus subsp. aureus Mu50
uaucuuauuauuaau

SEQ ID NO: 3973466 - RNA, 16 nt, Staphylococcus aureus subsp. aureus Mu50
uaucuuauuauuaauu

SEQ ID NO: 3973467 - RNA, 16 nt, Staphylococcus aureus subsp. aureus Mu50
uaucuucacacuuuua

SEQ ID NO: 3973468 - RNA, 19 nt, Staphylococcus aureus subsp. aureus Mu50
uaucuucacacuuuuagaa

SEQ ID NO: 3973469 - RNA, 14 nt, Staphylococcus aureus subsp. aureus Mu50
uaucuucaguuauu

SEQ ID NO: 3973470 - RNA, 18 nt, Staphylococcus aureus subsp. aureus Mu50
uaucuucuuuuaauauuu

SEQ ID NO: 3973471 - RNA, 18 nt, Staphylococcus aureus subsp. aureus Mu50
uaucuugauuuuauaaau

SEQ ID NO: 3973472 - RNA, 19 nt, Staphylococcus aureus subsp. aureus Mu50
uaucuugucauuugaacau

SEQ ID NO: 3973473 - RNA, 14 nt, Staphylococcus aureus subsp. aureus Mu50
uaucuuuagacaua

SEQ ID NO: 3973474 - RNA, 18 nt, Staphylococcus aureus subsp. aureus Mu50
uaucuuuaguauugguac

SEQ ID NO: 3973475 - RNA, 17 nt, Staphylococcus aureus subsp. aureus Mu50
uaucuuuaguauuucau

SEQ ID NO: 3973476 - RNA, 16 nt, Staphylococcus aureus subsp. aureus Mu50
uaucuuuaucauuauu

SEQ ID NO: 3973477 - RNA, 12 nt, Staphylococcus aureus subsp. aureus Mu50
uaucuuuauuug

SEQ ID NO: 3973478 - RNA, 19 nt, Staphylococcus aureus subsp. aureus Mu50
uaucuuucaaauuaauuaa

SEQ ID NO: 3973479 - RNA, 19 nt, Staphylococcus aureus subsp. aureus Mu50
uaucuuucugaagaacgau

SEQ ID NO: 3973480 - RNA, 12 nt, Staphylococcus aureus subsp. aureus Mu50
uaucuuuucauc

SEQ ID NO: 3973481 - RNA, 14 nt, Staphylococcus aureus subsp. aureus Mu50
uaucuuuugcuucg

SEQ ID NO: 3973482 - RNA, 22 nt, Staphylococcus aureus subsp. aureus Mu50
uaucuuuuuacugcacuuuuau

SEQ ID NO: 3973483 - RNA, 16 nt, Staphylococcus aureus subsp. aureus Mu50
uaucuuuuucuaaguu

SEQ ID NO: 3973484 - RNA, 18 nt, Staphylococcus aureus subsp. aureus Mu50
uaugaaaagagaaacaaa

SEQ ID NO: 3973485 - RNA, 23 nt, Staphylococcus aureus subsp. aureus Mu50
uaugaaaagagaaacaaaacaaa

SEQ ID NO: 3973486 - RNA, 18 nt, Staphylococcus aureus subsp. aureus Mu50
uaugaaaccuuugguuca

SEQ ID NO: 3973487 - RNA, 14 nt, Staphylococcus aureus subsp. aureus Mu50
uaugaaauaacaau

SEQ ID NO: 3973488 - RNA, 14 nt, Staphylococcus aureus subsp. aureus Mu50
uaugaaauaacuag

SEQ ID NO: 3973489 - RNA, 17 nt, Staphylococcus aureus subsp. aureus Mu50
uaugaaauauuuaucuu

SEQ ID NO: 3973490 - RNA, 20 nt, Staphylococcus aureus subsp. aureus Mu50
uaugaaauuucaguaucaug

SEQ ID NO: 3973491 - RNA, 14 nt, Staphylococcus aureus subsp. aureus Mu50
uaugaaauuuuuua

SEQ ID NO: 3973492 - RNA, 14 nt, Staphylococcus aureus subsp. aureus Mu50
uaugaacaaaaaau

SEQ ID NO: 3973493 - RNA, 13 nt, Staphylococcus aureus subsp. aureus Mu50
uaugaaggcuuuu

SEQ ID NO: 3973494 - RNA, 19 nt, Staphylococcus aureus subsp. aureus Mu50
uaugaagugaaaucauuua

SEQ ID NO: 3973495 - RNA, 12 nt, Staphylococcus aureus subsp. aureus Mu50
uaugaauaaguc

SEQ ID NO: 3973496 - RNA, 19 nt, Staphylococcus aureus subsp. aureus Mu50
uaugaauaauguuuucauu

SEQ ID NO: 3973497 - RNA, 19 nt, Staphylococcus aureus subsp. aureus Mu50
uaugaaucauuuuagcacc

SEQ ID NO: 3973498 - RNA, 22 nt, Staphylococcus aureus subsp. aureus Mu50
uaugaauccugugacucaauga

SEQ ID NO: 3973499 - RNA, 16 nt, Staphylococcus aureus subsp. aureus Mu50
uaugaaucgauauaau

SEQ ID NO: 3973500 - RNA, 23 nt, Staphylococcus aureus subsp. aureus Mu50
uaugaauggcaaucuauauaaau

SEQ ID NO: 3973501 - RNA, 17 nt, Staphylococcus aureus subsp. aureus Mu50
uaugaauugaguauuaa

SEQ ID NO: 3973502 - RNA, 19 nt, Staphylococcus aureus subsp. aureus Mu50
uaugaauugaguauuaaau

SEQ ID NO: 3973503 - RNA, 20 nt, Staphylococcus aureus subsp. aureus Mu50
uaugaauugaguauuaaauu

SEQ ID NO: 3973504 - RNA, 21 nt, Staphylococcus aureus subsp. aureus Mu50
uaugaauugaguauuaaauuu

SEQ ID NO: 3973505 - RNA, 16 nt, Staphylococcus aureus subsp. aureus Mu50
uaugaauugcuuguuu

SEQ ID NO: 3973506 - RNA, 23 nt, Staphylococcus aureus subsp. aureus Mu50
uaugaauuuagaugcauaaaaaa

SEQ ID NO: 3973507 - RNA, 20 nt, Staphylococcus aureus subsp. aureus Mu50
uaugaauuuagcaucaaaaa

SEQ ID NO: 3973508 - RNA, 22 nt, Staphylococcus aureus subsp. aureus Mu50
uaugaauuuagcaucaaaaaua

SEQ ID NO: 3973509 - RNA, 21 nt, Staphylococcus aureus subsp. aureus Mu50
uaugaauuuguuuuaguaaug

SEQ ID NO: 3973510 - RNA, 21 nt, Staphylococcus aureus subsp. aureus Mu50
uaugacgcgugaauuaaaaaa

SEQ ID NO: 3973511 - RNA, 20 nt, Staphylococcus aureus subsp. aureus Mu50
uaugacggugaaaguucauu

SEQ ID NO: 3973512 - RNA, 21 nt, Staphylococcus aureus subsp. aureus Mu50
uaugugcaugagacuuauuca

SEQ ID NO: 3973513 - RNA, 16 nt, Staphylococcus aureus subsp. aureus Mu50
uauguggauacaaacc

SEQ ID NO: 3973514 - RNA, 17 nt, Staphylococcus aureus subsp. aureus Mu50
uauguguauauuauuuu

SEQ ID NO: 3973515 - RNA, 17 nt, Staphylococcus aureus subsp. aureus Mu50
uauguguuguguaucag

SEQ ID NO: 3973516 - RNA, 18 nt, Staphylococcus aureus subsp. aureus Mu50
uauguuacuuauauauuc

SEQ ID NO: 3973517 - RNA, 23 nt, Staphylococcus aureus subsp. aureus Mu50
uauguuacuuauauauucaauaa

SEQ ID NO: 3973518 - RNA, 22 nt, Staphylococcus aureus subsp. aureus Mu50
uauguucagaaauuuaauauug

SEQ ID NO: 3973519 - RNA, 15 nt, Staphylococcus aureus subsp. aureus Mu50
uauguugcuuaucaa

SEQ ID NO: 3973520 - RNA, 21 nt, Staphylococcus aureus subsp. aureus Mu50
uauguugucauaccaaauaaa

SEQ ID NO: 3973521 - RNA, 18 nt, Staphylococcus aureus subsp. aureus Mu50
uauguuuaauuugauuaa

SEQ ID NO: 3973522 - RNA, 13 nt, Staphylococcus aureus subsp. aureus Mu50
uauguuuauauug

SEQ ID NO: 3973523 - RNA, 21 nt, Staphylococcus aureus subsp. aureus Mu50
uauguuugggauauagaaaag

SEQ ID NO: 3973524 - RNA, 15 nt, Staphylococcus aureus subsp. aureus Mu50
uauguuuuauaauaa

SEQ ID NO: 3973525 - RNA, 20 nt, Staphylococcus aureus subsp. aureus Mu50
uauguuuuaucaauauuagu

SEQ ID NO: 3973526 - RNA, 15 nt, Staphylococcus aureus subsp. aureus Mu50
uauguuuuauuuucu

SEQ ID NO: 3973527 - RNA, 21 nt, Staphylococcus aureus subsp. aureus Mu50
uauuaaaaaaaaccacgcaca

SEQ ID NO: 3973528 - RNA, 20 nt, Staphylococcus aureus subsp. aureus Mu50
uauuaaaaaagaacauaaaa

SEQ ID NO: 3973529 - RNA, 13 nt, Staphylococcus aureus subsp. aureus Mu50
uauuaaaaauccu

SEQ ID NO: 3973530 - RNA, 20 nt, Staphylococcus aureus subsp. aureus Mu50
uauuaaaaauuucaauaaug

SEQ ID NO: 3973531 - RNA, 22 nt, Staphylococcus aureus subsp. aureus Mu50
uauuaaaagcaugauacucaau

SEQ ID NO: 3973532 - RNA, 16 nt, Staphylococcus aureus subsp. aureus Mu50
uauuaaaauuaaaacu

SEQ ID NO: 3973533 - RNA, 19 nt, Staphylococcus aureus subsp. aureus Mu50
uauuaaaauuaaauaauga

SEQ ID NO: 3973534 - RNA, 19 nt, Staphylococcus aureus subsp. aureus Mu50
uauuaaacauuuuugaauu

SEQ ID NO: 3973535 - RNA, 13 nt, Staphylococcus aureus subsp. aureus Mu50
uauuaaacccaau

SEQ ID NO: 3973536 - RNA, 18 nt, Staphylococcus aureus subsp. aureus Mu50
uauuaaacccaauuaacc

SEQ ID NO: 3973537 - RNA, 20 nt, Staphylococcus aureus subsp. aureus Mu50
uauuaaaguaaaauauacuu

SEQ ID NO: 3973538 - RNA, 23 nt, Staphylococcus aureus subsp. aureus Mu50
uauuaaaguaaaauauacuugaa

SEQ ID NO: 3973539 - RNA, 13 nt, Staphylococcus aureus subsp. aureus Mu50
uauuaaauaaucg

SEQ ID NO: 3973540 - RNA, 17 nt, Staphylococcus aureus subsp. aureus Mu50
uauuaaauauaugcgua

SEQ ID NO: 3973541 - RNA, 15 nt, Staphylococcus aureus subsp. aureus Mu50
uauuaaauuauuguu

SEQ ID NO: 3973542 - RNA, 14 nt, Staphylococcus aureus subsp. aureus Mu50
uauuaaauuucuga

SEQ ID NO: 3973543 - RNA, 20 nt, Staphylococcus aureus subsp. aureus Mu50
uauuaaauuuguguucaaau

SEQ ID NO: 3973544 - RNA, 22 nt, Staphylococcus aureus subsp. aureus Mu50
uauuaacaccagauaucauaau

SEQ ID NO: 3973545 - RNA, 23 nt, Staphylococcus aureus subsp. aureus Mu50
uauuaacaccagauaucauaaua

SEQ ID NO: 3973546 - RNA, 14 nt, Staphylococcus aureus subsp. aureus Mu50
uauuaacgcaaaaa

SEQ ID NO: 3973547 - RNA, 17 nt, Staphylococcus aureus subsp. aureus Mu50
uauuaacuguuuaucca

SEQ ID NO: 3973548 - RNA, 13 nt, Staphylococcus aureus subsp. aureus Mu50
uauuaacuuuaau

SEQ ID NO: 3973549 - RNA, 17 nt, Staphylococcus aureus subsp. aureus Mu50
uauuaagaaauacucac

SEQ ID NO: 3973550 - RNA, 16 nt, Staphylococcus aureus subsp. aureus Mu50
uauuaagacugauuaa

SEQ ID NO: 3973551 - RNA, 17 nt, Staphylococcus aureus subsp. aureus Mu50
uauuaagacugauuaau

SEQ ID NO: 3973552 - RNA, 20 nt, Staphylococcus aureus subsp. aureus Mu50
uauuaagacugauuaauuau

SEQ ID NO: 3973553 - RNA, 18 nt, Staphylococcus aureus subsp. aureus Mu50
uauuaagcuauacucauu

SEQ ID NO: 3973554 - RNA, 22 nt, Staphylococcus aureus subsp. aureus Mu50
uauuaaggggguaauacuauau

SEQ ID NO: 3973555 - RNA, 24 nt, Staphylococcus aureus subsp. aureus Mu50
uauuaaggggguaauacuauauga

SEQ ID NO: 3973556 - RNA, 21 nt, Staphylococcus aureus subsp. aureus Mu50
uauuaaggucauuuuuaauug

SEQ ID NO: 3973557 - RNA, 16 nt, Staphylococcus aureus subsp. aureus Mu50
uauuaaguauaucuuu

SEQ ID NO: 3973558 - RNA, 16 nt, Staphylococcus aureus subsp. aureus Mu50
uauuaagugaguuuua

SEQ ID NO: 3973559 - RNA, 17 nt, Staphylococcus aureus subsp. aureus Mu50
uauuaauauaaaauaaa

SEQ ID NO: 3973560 - RNA, 13 nt, Staphylococcus aureus subsp. aureus Mu50
uauuaauauuagu

SEQ ID NO: 3973561 - RNA, 20 nt, Staphylococcus aureus subsp. aureus Mu50
uauuaauauuagugacauuu

SEQ ID NO: 3973562 - RNA, 21 nt, Staphylococcus aureus subsp. aureus Mu50
uauuaaucauaaugaauaauu

SEQ ID NO: 3973563 - RNA, 22 nt, Staphylococcus aureus subsp. aureus Mu50
uauuaaucguuaauguauaaaa

SEQ ID NO: 3973564 - RNA, 19 nt, Staphylococcus aureus subsp. aureus Mu50
uauuaaugauugacgauuu

SEQ ID NO: 3973565 - RNA, 22 nt, Staphylococcus aureus subsp. aureus Mu50
uauuaaugcucuauauauccau

SEQ ID NO: 3973566 - RNA, 20 nt, Staphylococcus aureus subsp. aureus Mu50
uauuaauuacgucauaaaau

SEQ ID NO: 3973567 - RNA, 12 nt, Staphylococcus aureus subsp. aureus Mu50
uauuaauuuaau

SEQ ID NO: 3973568 - RNA, 13 nt, Staphylococcus aureus subsp. aureus Mu50
uauuaauuuacuc

SEQ ID NO: 3973569 - RNA, 14 nt, Staphylococcus aureus subsp. aureus Mu50
uauuaauuuacuca

SEQ ID NO: 3973570 - RNA, 12 nt, Staphylococcus aureus subsp. aureus Mu50
uauuaauuucau

SEQ ID NO: 3973571 - RNA, 15 nt, Staphylococcus aureus subsp. aureus Mu50
uauuaauuugauaaa

SEQ ID NO: 3973572 - RNA, 16 nt, Staphylococcus aureus subsp. aureus Mu50
uauuaauuuuacguuu

SEQ ID NO: 3973573 - RNA, 18 nt, Staphylococcus aureus subsp. aureus Mu50
uauuaauuuuucaaaugu

SEQ ID NO: 3973574 - RNA, 21 nt, Staphylococcus aureus subsp. aureus Mu50
uauuacaaacauuccucuauu

SEQ ID NO: 3973575 - RNA, 13 nt, Staphylococcus aureus subsp. aureus Mu50
uauuacaaugaaa

SEQ ID NO: 3973576 - RNA, 15 nt, Staphylococcus aureus subsp. aureus Mu50
uauuacaaugaaaaa

SEQ ID NO: 3973577 - RNA, 22 nt, Staphylococcus aureus subsp. aureus Mu50
uauuacaccauuguuauagcgu

SEQ ID NO: 3973578 - RNA, 15 nt, Staphylococcus aureus subsp. aureus Mu50
uauuacaucuauauu

SEQ ID NO: 3973579 - RNA, 21 nt, Staphylococcus aureus subsp. aureus Mu50
uauuaccauaacuuuauauau

SEQ ID NO: 3973580 - RNA, 21 nt, Staphylococcus aureus subsp. aureus Mu50
uauuacuacauaauuuaucaa

SEQ ID NO: 3973581 - RNA, 15 nt, Staphylococcus aureus subsp. aureus Mu50
uauuacuauaaaaaa

SEQ ID NO: 3973582 - RNA, 16 nt, Staphylococcus aureus subsp. aureus Mu50
uauuacuuauuucuuu

SEQ ID NO: 3973583 - RNA, 14 nt, Staphylococcus aureus subsp. aureus Mu50
uauuacuugaaaau

SEQ ID NO: 3973584 - RNA, 14 nt, Staphylococcus aureus subsp. aureus Mu50
uauuacuuuaauuu

SEQ ID NO: 3973585 - RNA, 22 nt, Staphylococcus aureus subsp. aureus Mu50
uauuacuuuggaaauuuauuau

SEQ ID NO: 3973586 - RNA, 19 nt, Staphylococcus aureus subsp. aureus Mu50
uauuagaacguaauguuac

SEQ ID NO: 3973587 - RNA, 20 nt, Staphylococcus aureus subsp. aureus Mu50
uauuagauaucuuaaucuaa

SEQ ID NO: 3973588 - RNA, 16 nt, Staphylococcus aureus subsp. aureus Mu50
uauuagccaauaaaau

SEQ ID NO: 3973589 - RNA, 17 nt, Staphylococcus aureus subsp. aureus Mu50
uauuagccaauaaaaug

SEQ ID NO: 3973590 - RNA, 19 nt, Staphylococcus aureus subsp. aureus Mu50
uauuagccaauaaaauguc

SEQ ID NO: 3973591 - RNA, 20 nt, Staphylococcus aureus subsp. aureus Mu50
uauuaggcuuaaauauaaug

SEQ ID NO: 3973592 - RNA, 14 nt, Staphylococcus aureus subsp. aureus Mu50
uauuaguauucaaa

SEQ ID NO: 3973593 - RNA, 20 nt, Staphylococcus aureus subsp. aureus Mu50
uauuagugauauuuuucgaa

SEQ ID NO: 3973594 - RNA, 21 nt, Staphylococcus aureus subsp. aureus Mu50
uauuauaaaaacagcagugaa

SEQ ID NO: 3973595 - RNA, 15 nt, Staphylococcus aureus subsp. aureus Mu50
uauuauaaaauaaau

SEQ ID NO: 3973596 - RNA, 19 nt, Staphylococcus aureus subsp. aureus Mu50
uauuauaaaauaaauauaa

SEQ ID NO: 3973597 - RNA, 16 nt, Staphylococcus aureus subsp. aureus Mu50
uauuauaaaauagaag

SEQ ID NO: 3973598 - RNA, 14 nt, Staphylococcus aureus subsp. aureus Mu50
uauuauaaccacca

SEQ ID NO: 3973599 - RNA, 16 nt, Staphylococcus aureus subsp. aureus Mu50
uauugaaaauagaaag

SEQ ID NO: 3973600 - RNA, 17 nt, Staphylococcus aureus subsp. aureus Mu50
uauugaaacuaauaauu

SEQ ID NO: 3973601 - RNA, 18 nt, Staphylococcus aureus subsp. aureus Mu50
uauugaaacuaauaauuu

SEQ ID NO: 3973602 - RNA, 18 nt, Staphylococcus aureus subsp. aureus Mu50
uauugaaaguguaugcau

SEQ ID NO: 3973603 - RNA, 16 nt, Staphylococcus aureus subsp. aureus Mu50
uauugaaauaauauaa

SEQ ID NO: 3973604 - RNA, 16 nt, Staphylococcus aureus subsp. aureus Mu50
uauugaaaugagcuua

SEQ ID NO: 3973605 - RNA, 20 nt, Staphylococcus aureus subsp. aureus Mu50
uauugaacaauuuuugggaa

SEQ ID NO: 3973606 - RNA, 14 nt, Staphylococcus aureus subsp. aureus Mu50
uauugaacuucuaa

SEQ ID NO: 3973607 - RNA, 16 nt, Staphylococcus aureus subsp. aureus Mu50
uauugaacuucuaaca

SEQ ID NO: 3973608 - RNA, 21 nt, Staphylococcus aureus subsp. aureus Mu50
uauugaagaugcuuuaauuaa

SEQ ID NO: 3973609 - RNA, 13 nt, Staphylococcus aureus subsp. aureus Mu50
uauugaauaauca

SEQ ID NO: 3973610 - RNA, 13 nt, Staphylococcus aureus subsp. aureus Mu50
uauugaaugaauu

SEQ ID NO: 3973611 - RNA, 14 nt, Staphylococcus aureus subsp. aureus Mu50
uauugaaugaauuc

SEQ ID NO: 3973612 - RNA, 18 nt, Staphylococcus aureus subsp. aureus Mu50
uauugaccaccuguaucu

SEQ ID NO: 3973613 - RNA, 15 nt, Staphylococcus aureus subsp. aureus Mu50
uauugagaauauuaa

SEQ ID NO: 3973614 - RNA, 14 nt, Staphylococcus aureus subsp. aureus Mu50
uauugagaauauuu

SEQ ID NO: 3973615 - RNA, 15 nt, Staphylococcus aureus subsp. aureus Mu50
uauugagaauugcaa

SEQ ID NO: 3973616 - RNA, 14 nt, Staphylococcus aureus subsp. aureus Mu50
uauugagacaacau

SEQ ID NO: 3973617 - RNA, 17 nt, Staphylococcus aureus subsp. aureus Mu50
uauugaggauaauuauu

SEQ ID NO: 3973618 - RNA, 21 nt, Staphylococcus aureus subsp. aureus Mu50
uauugauaaauauugaacaau

SEQ ID NO: 3973619 - RNA, 14 nt, Staphylococcus aureus subsp. aureus Mu50
uauugauauucuaa

SEQ ID NO: 3973620 - RNA, 19 nt, Staphylococcus aureus subsp. aureus Mu50
uauugauauucuaaaaaau

SEQ ID NO: 3973621 - RNA, 21 nt, Staphylococcus aureus subsp. aureus Mu50
uauugaucugauuucacuucu

SEQ ID NO: 3973622 - RNA, 23 nt, Staphylococcus aureus subsp. aureus Mu50
uauugaucugauuucacuucuaa

SEQ ID NO: 3973623 - RNA, 13 nt, Staphylococcus aureus subsp. aureus Mu50
uauugaugaauaa

SEQ ID NO: 3973624 - RNA, 13 nt, Staphylococcus aureus subsp. aureus Mu50
uauugauuauucu

SEQ ID NO: 3973625 - RNA, 22 nt, Staphylococcus aureus subsp. aureus Mu50
uauugauucuagugaaauaccu

SEQ ID NO: 3973626 - RNA, 14 nt, Staphylococcus aureus subsp. aureus Mu50
uauugauuguacca

SEQ ID NO: 3973627 - RNA, 21 nt, Staphylococcus aureus subsp. aureus Mu50
uauugauugugacuuguauca

SEQ ID NO: 3973628 - RNA, 21 nt, Staphylococcus aureus subsp. aureus Mu50
uauugauuugauucauuacau

SEQ ID NO: 3973629 - RNA, 15 nt, Staphylococcus aureus subsp. aureus Mu50
uauugcaaaaauaau

SEQ ID NO: 3973630 - RNA, 23 nt, Staphylococcus aureus subsp. aureus Mu50
uauugcaaaaauaauaugaauuu

SEQ ID NO: 3973631 - RNA, 14 nt, Staphylococcus aureus subsp. aureus Mu50
uauugcaauaaaau

SEQ ID NO: 3973632 - RNA, 15 nt, Staphylococcus aureus subsp. aureus Mu50
uauugcaauauaguu

SEQ ID NO: 3973633 - RNA, 16 nt, Staphylococcus aureus subsp. aureus Mu50
uauugcacuuuuuuca

SEQ ID NO: 3973634 - RNA, 23 nt, Staphylococcus aureus subsp. aureus Mu50
uauugcagcaacgcgauugcuaa

SEQ ID NO: 3973635 - RNA, 18 nt, Staphylococcus aureus subsp. aureus Mu50
uauugcauguuuaaauau

SEQ ID NO: 3973636 - RNA, 17 nt, Staphylococcus aureus subsp. aureus Mu50
uauugcauuuagacuug

SEQ ID NO: 3973637 - RNA, 23 nt, Staphylococcus aureus subsp. aureus Mu50
uauugccguuauuuucaauaaau

SEQ ID NO: 3973638 - RNA, 16 nt, Staphylococcus aureus subsp. aureus Mu50
uauugcguuuaauuua

SEQ ID NO: 3973639 - RNA, 14 nt, Staphylococcus aureus subsp. aureus Mu50
uauugcuuauuuuu

SEQ ID NO: 3973640 - RNA, 17 nt, Staphylococcus aureus subsp. aureus Mu50
uauuggaauacucuuca

SEQ ID NO: 3973641 - RNA, 18 nt, Staphylococcus aureus subsp. aureus Mu50
uauugggagcaaucaaua

SEQ ID NO: 3973642 - RNA, 15 nt, Staphylococcus aureus subsp. aureus Mu50
uauugguaaauuuau

SEQ ID NO: 3973643 - RNA, 19 nt, Staphylococcus aureus subsp. aureus Mu50
uauugguaaauuuaucauu

SEQ ID NO: 3973644 - RNA, 13 nt, Staphylococcus aureus subsp. aureus Mu50
uauugguugaaau

SEQ ID NO: 3973645 - RNA, 22 nt, Staphylococcus aureus subsp. aureus Mu50
uauuguaaucacuaucuguugu

SEQ ID NO: 3973646 - RNA, 19 nt, Staphylococcus aureus subsp. aureus Mu50
uauuguagggaguauuguu

SEQ ID NO: 3973647 - RNA, 16 nt, Staphylococcus aureus subsp. aureus Mu50
uauuguauuuuauuua

SEQ ID NO: 3973648 - RNA, 18 nt, Staphylococcus aureus subsp. aureus Mu50
uauuguauuuuauuuauu

SEQ ID NO: 3973649 - RNA, 15 nt, Staphylococcus aureus subsp. aureus Mu50
uauugucgacuuuua

SEQ ID NO: 3973650 - RNA, 19 nt, Staphylococcus aureus subsp. aureus Mu50
uauugucgacuuuuagauu

SEQ ID NO: 3973651 - RNA, 22 nt, Staphylococcus aureus subsp. aureus Mu50
uauuguuaaacuagaaaacaua

SEQ ID NO: 3973652 - RNA, 20 nt, Staphylococcus aureus subsp. aureus Mu50
uauuguuugaaaauuaacua

SEQ ID NO: 3973653 - RNA, 15 nt, Staphylococcus aureus subsp. aureus Mu50
uauuguuuuauauuu

SEQ ID NO: 3973654 - RNA, 11 nt, Staphylococcus aureus subsp. aureus Mu50
uauuguuuuca

SEQ ID NO: 3973655 - RNA, 13 nt, Staphylococcus aureus subsp. aureus Mu50
uauuguuuuuuau

SEQ ID NO: 3973656 - RNA, 13 nt, Staphylococcus aureus subsp. aureus Mu50
uauuuaaaagaca

SEQ ID NO: 3973657 - RNA, 16 nt, Staphylococcus aureus subsp. aureus Mu50
uauuuaaaauauuauu

SEQ ID NO: 3973658 - RNA, 19 nt, Staphylococcus aureus subsp. aureus Mu50
uauuuaaaaugcuuguuca

SEQ ID NO: 3973659 - RNA, 20 nt, Staphylococcus aureus subsp. aureus Mu50
uauuuaaaaugcuuguucaa

SEQ ID NO: 3973660 - RNA, 18 nt, Staphylococcus aureus subsp. aureus Mu50
uauuuaaacucucuaaaa

SEQ ID NO: 3973661 - RNA, 21 nt, Staphylococcus aureus subsp. aureus Mu50
uauuuaaacucucuaaaaagc

SEQ ID NO: 3973662 - RNA, 16 nt, Staphylococcus aureus subsp. aureus Mu50
uauuuaaauuuuaagu

SEQ ID NO: 3973663 - RNA, 21 nt, Staphylococcus aureus subsp. aureus Mu50
uauuuaaauuuucaucauaau

SEQ ID NO: 3973664 - RNA, 20 nt, Staphylococcus aureus subsp. aureus Mu50
uauuuaacacuucaguuaaa

SEQ ID NO: 3973665 - RNA, 21 nt, Staphylococcus aureus subsp. aureus Mu50
uauuuaacaucaauuacucuu

SEQ ID NO: 3973666 - RNA, 14 nt, Staphylococcus aureus subsp. aureus Mu50
uauuuaauacauuu

SEQ ID NO: 3973667 - RNA, 16 nt, Staphylococcus aureus subsp. aureus Mu50
uauuuaaucuuaauau

SEQ ID NO: 3973668 - RNA, 14 nt, Staphylococcus aureus subsp. aureus Mu50
uauuuaauguuuua

SEQ ID NO: 3973669 - RNA, 16 nt, Staphylococcus aureus subsp. aureus Mu50
uauuuaauguuuuagu

SEQ ID NO: 3973670 - RNA, 16 nt, Staphylococcus aureus subsp. aureus Mu50
uauuuaauuccauuaa

SEQ ID NO: 3973671 - RNA, 16 nt, Staphylococcus aureus subsp. aureus Mu50
uauuuaauuuugauau

SEQ ID NO: 3973672 - RNA, 15 nt, Staphylococcus aureus subsp. aureus Mu50
uauuuaauuuuucua

SEQ ID NO: 3973673 - RNA, 18 nt, Staphylococcus aureus subsp. aureus Mu50
uauuuaauuuuucuaaau

SEQ ID NO: 3973674 - RNA, 23 nt, Staphylococcus aureus subsp. aureus Mu50
uauuuaauuuuucuaaaugauuu

SEQ ID NO: 3973675 - RNA, 16 nt, Staphylococcus aureus subsp. aureus Mu50
uauuuacacacaugau

SEQ ID NO: 3973676 - RNA, 15 nt, Staphylococcus aureus subsp. aureus Mu50
uauuuacauugccac

SEQ ID NO: 3973677 - RNA, 16 nt, Staphylococcus aureus subsp. aureus Mu50
uauuuaccuucuucua

SEQ ID NO: 3973678 - RNA, 19 nt, Staphylococcus aureus subsp. aureus Mu50
uauuuacuaagucguucaa

SEQ ID NO: 3973679 - RNA, 23 nt, Staphylococcus aureus subsp. aureus Mu50
uauuuagaaacuuccaacauaua

SEQ ID NO: 3973680 - RNA, 16 nt, Staphylococcus aureus subsp. aureus Mu50
uauuuagaauaaacuu

SEQ ID NO: 3973681 - RNA, 16 nt, Staphylococcus aureus subsp. aureus Mu50
uauuuagaauucuaaa

SEQ ID NO: 3973682 - RNA, 15 nt, Staphylococcus aureus subsp. aureus Mu50
uauuuagauaaaaau

SEQ ID NO: 3973683 - RNA, 21 nt, Staphylococcus aureus subsp. aureus Mu50
uauuuagcaucuuuaccauau

SEQ ID NO: 3973684 - RNA, 14 nt, Staphylococcus aureus subsp. aureus Mu50
uauuuauaaaauaa

SEQ ID NO: 3973685 - RNA, 17 nt, Staphylococcus aureus subsp. aureus Mu50
uauuuauaaaauaaaau

SEQ ID NO: 3973686 - RNA, 18 nt, Staphylococcus aureus subsp. aureus Mu50
uauuuauaacuuuaaaaa

SEQ ID NO: 3973687 - RNA, 12 nt, Staphylococcus aureus subsp. aureus Mu50
uauuuuaucugu

SEQ ID NO: 3973688 - RNA, 12 nt, Staphylococcus aureus subsp. aureus Mu50
uauuuuaugauu

SEQ ID NO: 3973689 - RNA, 15 nt, Staphylococcus aureus subsp. aureus Mu50
uauuuucaauaaaua

SEQ ID NO: 3973690 - RNA, 16 nt, Staphylococcus aureus subsp. aureus Mu50
uauuuucaauaaauuu

SEQ ID NO: 3973691 - RNA, 19 nt, Staphylococcus aureus subsp. aureus Mu50
uauuuucaauaaauuuuau

SEQ ID NO: 3973692 - RNA, 18 nt, Staphylococcus aureus subsp. aureus Mu50
uauuuucaauauuugaua

SEQ ID NO: 3973693 - RNA, 16 nt, Staphylococcus aureus subsp. aureus Mu50
uauuuucaauuagaaa

SEQ ID NO: 3973694 - RNA, 12 nt, Staphylococcus aureus subsp. aureus Mu50
uauuuucauaaa

SEQ ID NO: 3973695 - RNA, 18 nt, Staphylococcus aureus subsp. aureus Mu50
uauuuucauaaacucuua

SEQ ID NO: 3973696 - RNA, 14 nt, Staphylococcus aureus subsp. aureus Mu50
uauuuucauuuuag

SEQ ID NO: 3973697 - RNA, 15 nt, Staphylococcus aureus subsp. aureus Mu50
uauuuucauuuuagu

SEQ ID NO: 3973698 - RNA, 20 nt, Staphylococcus aureus subsp. aureus Mu50
uauuuucuucucaacaaauc

SEQ ID NO: 3973699 - RNA, 13 nt, Staphylococcus aureus subsp. aureus Mu50
uauuuucuugugu

SEQ ID NO: 3973700 - RNA, 14 nt, Staphylococcus aureus subsp. aureus Mu50
uauuuucuugugua

SEQ ID NO: 3973701 - RNA, 13 nt, Staphylococcus aureus subsp. aureus Mu50
uauuuucuuuuuc

SEQ ID NO: 3973702 - RNA, 20 nt, Staphylococcus aureus subsp. aureus Mu50
uauuuucuuuuucuaaauaa

SEQ ID NO: 3973703 - RNA, 15 nt, Staphylococcus aureus subsp. aureus Mu50
uauuuugcaauugca

SEQ ID NO: 3973704 - RNA, 17 nt, Staphylococcus aureus subsp. aureus Mu50
uauuuugcgcuucuagu

SEQ ID NO: 3973705 - RNA, 22 nt, Staphylococcus aureus subsp. aureus Mu50
uauuuuggacugguacuacuau

SEQ ID NO: 3973706 - RNA, 12 nt, Staphylococcus aureus subsp. aureus Mu50
uauuuuguaguu

SEQ ID NO: 3973707 - RNA, 15 nt, Staphylococcus aureus subsp. aureus Mu50
uauuuuguuaauaag

SEQ ID NO: 3973708 - RNA, 12 nt, Staphylococcus aureus subsp. aureus Mu50
uauuuuguuuua

SEQ ID NO: 3973709 - RNA, 19 nt, Staphylococcus aureus subsp. aureus Mu50
uauuuuguuuuaaaaaaca

SEQ ID NO: 3973710 - RNA, 13 nt, Staphylococcus aureus subsp. aureus Mu50
uauuuuuaauuau

SEQ ID NO: 3973711 - RNA, 14 nt, Staphylococcus aureus subsp. aureus Mu50
uauuuuuauagaug

SEQ ID NO: 3973712 - RNA, 13 nt, Staphylococcus aureus subsp. aureus Mu50
uauuuuuaucauc

SEQ ID NO: 3973713 - RNA, 15 nt, Staphylococcus aureus subsp. aureus Mu50
uauuuuuaucaucau

SEQ ID NO: 3973714 - RNA, 13 nt, Staphylococcus aureus subsp. aureus Mu50
uauuuuucaucau

SEQ ID NO: 3973715 - RNA, 20 nt, Staphylococcus aureus subsp. aureus Mu50
uauuuuucgaauuuaaccag

SEQ ID NO: 3973716 - RNA, 11 nt, Staphylococcus aureus subsp. aureus Mu50
uauuuuucuuu

SEQ ID NO: 3973717 - RNA, 19 nt, Staphylococcus aureus subsp. aureus Mu50
uauuuuugcguuaauaauu

SEQ ID NO: 3973718 - RNA, 14 nt, Staphylococcus aureus subsp. aureus Mu50
uauuuuuguauucu

SEQ ID NO: 3973719 - RNA, 13 nt, Staphylococcus aureus subsp. aureus Mu50
uauuuuuuaaaau

SEQ ID NO: 3973720 - RNA, 15 nt, Staphylococcus aureus subsp. aureus Mu50
uauuuuuuaaaauga

SEQ ID NO: 3973721 - RNA, 21 nt, Staphylococcus aureus subsp. aureus Mu50
uauuuuuuaaaaugauagcua

SEQ ID NO: 3973722 - RNA, 14 nt, Staphylococcus aureus subsp. aureus Mu50
uauuuuuuaaaugc

SEQ ID NO: 3973723 - RNA, 13 nt, Staphylococcus aureus subsp. aureus Mu50
uauuuuuuaauaa

SEQ ID NO: 3973724 - RNA, 19 nt, Staphylococcus aureus subsp. aureus Mu50
uauuuuuuaguaauaacau

SEQ ID NO: 3973725 - RNA, 16 nt, Staphylococcus aureus subsp. aureus Mu50
uauuuuuuauguuuua

SEQ ID NO: 3973726 - RNA, 17 nt, Staphylococcus aureus subsp. aureus Mu50
uauuuuuuauguuuuaa

SEQ ID NO: 3973727 - RNA, 23 nt, Staphylococcus aureus subsp. aureus Mu50
uauuuuuuauguuuuaauuucuu

SEQ ID NO: 3973728 - RNA, 21 nt, Staphylococcus aureus subsp. aureus Mu50
uauuuuuuggagcguaaaguu

SEQ ID NO: 3973729 - RNA, 13 nt, Staphylococcus aureus subsp. aureus Mu50
uauuuuuuuaaau

SEQ ID NO: 3973730 - RNA, 14 nt, Staphylococcus aureus subsp. aureus Mu50
uauuuuuuuaugcu

SEQ ID NO: 3973731 - RNA, 22 nt, Staphylococcus aureus subsp. aureus Mu50
uauuuuuuuguccaauaaauug

SEQ ID NO: 3973732 - RNA, 21 nt, Staphylococcus aureus subsp. aureus Mu50
ucaaaaaaagcugauuucuau

SEQ ID NO: 3973733 - RNA, 14 nt, Staphylococcus aureus subsp. aureus Mu50
ucaaaaaauauuua

SEQ ID NO: 3973734 - RNA, 16 nt, Staphylococcus aureus subsp. aureus Mu50
ucaaaaacaguuacaa

SEQ ID NO: 3973735 - RNA, 14 nt, Staphylococcus aureus subsp. aureus Mu50
ucaaaaauaaaaau

SEQ ID NO: 3973736 - RNA, 22 nt, Staphylococcus aureus subsp. aureus Mu50
ucaaaaauaauuaugaaaagua

SEQ ID NO: 3973737 - RNA, 18 nt, Staphylococcus aureus subsp. aureus Mu50
ucaaaaaugcuuauauaa

SEQ ID NO: 3973738 - RNA, 13 nt, Staphylococcus aureus subsp. aureus Mu50
ucaaaaauguuau

SEQ ID NO: 3973739 - RNA, 19 nt, Staphylococcus aureus subsp. aureus Mu50
ucaaaaauguuaucuagua

SEQ ID NO: 3973740 - RNA, 15 nt, Staphylococcus aureus subsp. aureus Mu50
ucaaaacaauuuaaa

SEQ ID NO: 3973741 - RNA, 17 nt, Staphylococcus aureus subsp. aureus Mu50
ucaaaaccgcuauaaaa

SEQ ID NO: 3973742 - RNA, 18 nt, Staphylococcus aureus subsp. aureus Mu50
ucaaaaccgcuauaaaau

SEQ ID NO: 3973743 - RNA, 16 nt, Staphylococcus aureus subsp. aureus Mu50
ucaaaacguuuaauug

SEQ ID NO: 3973744 - RNA, 18 nt, Staphylococcus aureus subsp. aureus Mu50
ucaaaacguuuaauugca

SEQ ID NO: 3973745 - RNA, 24 nt, Staphylococcus aureus subsp. aureus Mu50
ucaaaacuagcaguaauauguugc

SEQ ID NO: 3973746 - RNA, 12 nt, Staphylococcus aureus subsp. aureus Mu50
ucaaaacugcca

SEQ ID NO: 3973747 - RNA, 17 nt, Staphylococcus aureus subsp. aureus Mu50
ucaaaaucaaauugacg

SEQ ID NO: 3973748 - RNA, 19 nt, Staphylococcus aureus subsp. aureus Mu50
ucaaaaucggauuaacauu

SEQ ID NO: 3973749 - RNA, 20 nt, Staphylococcus aureus subsp. aureus Mu50
ucaaaauguuuaacaauaau

SEQ ID NO: 3973750 - RNA, 21 nt, Staphylococcus aureus subsp. aureus Mu50
ucaaaauguuuaacaauaaua

SEQ ID NO: 3973751 - RNA, 20 nt, Staphylococcus aureus subsp. aureus Mu50
ucaaaauuaaagcuuaauua

SEQ ID NO: 3973752 - RNA, 14 nt, Staphylococcus aureus subsp. aureus Mu50
ucaaaauuaugacu

SEQ ID NO: 3973753 - RNA, 20 nt, Staphylococcus aureus subsp. aureus Mu50
ucaaaauuaugacuaacauu

SEQ ID NO: 3973754 - RNA, 23 nt, Staphylococcus aureus subsp. aureus Mu50
ucaaaauuaugacuaacauuggu

SEQ ID NO: 3973755 - RNA, 13 nt, Staphylococcus aureus subsp. aureus Mu50
ucaaaauuuugac

SEQ ID NO: 3973756 - RNA, 13 nt, Staphylococcus aureus subsp. aureus Mu50
ucaaacaaagggg

SEQ ID NO: 3973757 - RNA, 23 nt, Staphylococcus aureus subsp. aureus Mu50
ucaaacaaaucuuuuaaauuuag

SEQ ID NO: 3973758 - RNA, 16 nt, Staphylococcus aureus subsp. aureus Mu50
ucaaacaagauucaua

SEQ ID NO: 3973759 - RNA, 13 nt, Staphylococcus aureus subsp. aureus Mu50
ucaaacauauuca

SEQ ID NO: 3973760 - RNA, 19 nt, Staphylococcus aureus subsp. aureus Mu50
ucaaaccaccaaaaaucau

SEQ ID NO: 3973761 - RNA, 21 nt, Staphylococcus aureus subsp. aureus Mu50
ucaaaccaucuuaucuuuaug

SEQ ID NO: 3973762 - RNA, 15 nt, Staphylococcus aureus subsp. aureus Mu50
ucaaacggaauuaaa

SEQ ID NO: 3973763 - RNA, 14 nt, Staphylococcus aureus subsp. aureus Mu50
ucaaacuuaaaacu

SEQ ID NO: 3973764 - RNA, 16 nt, Staphylococcus aureus subsp. aureus Mu50
ucaaacuuaaaacuau

SEQ ID NO: 3973765 - RNA, 20 nt, Staphylococcus aureus subsp. aureus Mu50
ucaaacuuggcaaugaaauu

SEQ ID NO: 3973766 - RNA, 21 nt, Staphylococcus aureus subsp. aureus Mu50
ucaaagccugucggaauuggu

SEQ ID NO: 3973767 - RNA, 22 nt, Staphylococcus aureus subsp. aureus Mu50
ucaaagccugucggaauugguu

SEQ ID NO: 3973768 - RNA, 18 nt, Staphylococcus aureus subsp. aureus Mu50
ucaaagcuauauaugaau

SEQ ID NO: 3973769 - RNA, 21 nt, Staphylococcus aureus subsp. aureus Mu50
ucaaagcuauauaugaauuga

SEQ ID NO: 3973770 - RNA, 17 nt, Staphylococcus aureus subsp. aureus Mu50
ucaaaguagacauugaa

SEQ ID NO: 3973771 - RNA, 21 nt, Staphylococcus aureus subsp. aureus Mu50
ucaaaguauauacuaaucuuc

SEQ ID NO: 3973772 - RNA, 15 nt, Staphylococcus aureus subsp. aureus Mu50
ucaaaguauauugcu

SEQ ID NO: 3973773 - RNA, 19 nt, Staphylococcus aureus subsp. aureus Mu50
ucaaagucauuuagauagc

SEQ ID NO: 3973774 - RNA, 16 nt, Staphylococcus aureus subsp. aureus Mu50
ucaaaguuuaauugcu

SEQ ID NO: 3973775 - RNA, 19 nt, Staphylococcus aureus subsp. aureus Mu50
ucaagaaaaaguuuuucug

SEQ ID NO: 3973776 - RNA, 20 nt, Staphylococcus aureus subsp. aureus Mu50
ucaagaaauguuaaauuaaa

SEQ ID NO: 3973777 - RNA, 19 nt, Staphylococcus aureus subsp. aureus Mu50
ucaagaaauucgcaagccu

SEQ ID NO: 3973778 - RNA, 12 nt, Staphylococcus aureus subsp. aureus Mu50
ucaagaacaauc

SEQ ID NO: 3973779 - RNA, 12 nt, Staphylococcus aureus subsp. aureus Mu50
ucaagaauauaa

SEQ ID NO: 3973780 - RNA, 19 nt, Staphylococcus aureus subsp. aureus Mu50
ucaagaaugugaacaucua

SEQ ID NO: 3973781 - RNA, 18 nt, Staphylococcus aureus subsp. aureus Mu50
ucaagaccaaauauuuua

SEQ ID NO: 3973782 - RNA, 22 nt, Staphylococcus aureus subsp. aureus Mu50
ucaagauguuugcaacauauuu

SEQ ID NO: 3973783 - RNA, 23 nt, Staphylococcus aureus subsp. aureus Mu50
ucaagauguuugcaacauauuuu

SEQ ID NO: 3973784 - RNA, 18 nt, Staphylococcus aureus subsp. aureus Mu50
ucaagcaucauuuuucgu

SEQ ID NO: 3973785 - RNA, 23 nt, Staphylococcus aureus subsp. aureus Mu50
ucaagcgcaugcuugaacuuuua

SEQ ID NO: 3973786 - RNA, 19 nt, Staphylococcus aureus subsp. aureus Mu50
ucaagcugagcuuuaauuu

SEQ ID NO: 3973787 - RNA, 20 nt, Staphylococcus aureus subsp. aureus Mu50
ucaagcugagcuuuaauuuu

SEQ ID NO: 3973788 - RNA, 12 nt, Staphylococcus aureus subsp. aureus Mu50
ucaaguaacuca

SEQ ID NO: 3973789 - RNA, 15 nt, Staphylococcus aureus subsp. aureus Mu50
ucaaguaaugauauu

SEQ ID NO: 3973790 - RNA, 20 nt, Staphylococcus aureus subsp. aureus Mu50
ucaaguauauccgcaucuuu

SEQ ID NO: 3973791 - RNA, 14 nt, Staphylococcus aureus subsp. aureus Mu50
ucaaguauaucuuc

SEQ ID NO: 3973792 - RNA, 18 nt, Staphylococcus aureus subsp. aureus Mu50
ucaagucugcauuaauuu

SEQ ID NO: 3973793 - RNA, 14 nt, Staphylococcus aureus subsp. aureus Mu50
ucaagugaaucuaa

SEQ ID NO: 3973794 - RNA, 22 nt, Staphylococcus aureus subsp. aureus Mu50
ucaagugaaucuaacugugcaa

SEQ ID NO: 3973795 - RNA, 19 nt, Staphylococcus aureus subsp. aureus Mu50
ucaagugcuugguuaaagu

SEQ ID NO: 3973796 - RNA, 20 nt, Staphylococcus aureus subsp. aureus Mu50
ucaaguucaccguaaucuuu

SEQ ID NO: 3973797 - RNA, 13 nt, Staphylococcus aureus subsp. aureus Mu50
ucaaguuuaaaau

SEQ ID NO: 3973798 - RNA, 14 nt, Staphylococcus aureus subsp. aureus Mu50
ucaaguuuuaagug

SEQ ID NO: 3973799 - RNA, 13 nt, Staphylococcus aureus subsp. aureus Mu50
ucaaguuuugguc

SEQ ID NO: 3973800 - RNA, 17 nt, Staphylococcus aureus subsp. aureus Mu50
ucaauaaaaaugguauu

SEQ ID NO: 3973801 - RNA, 13 nt, Staphylococcus aureus subsp. aureus Mu50
ucaauaaauaaac

SEQ ID NO: 3973802 - RNA, 19 nt, Staphylococcus aureus subsp. aureus Mu50
ucaauaaauaaacaacugc

SEQ ID NO: 3973803 - RNA, 16 nt, Staphylococcus aureus subsp. aureus Mu50
ucaauaaauuuuauau

SEQ ID NO: 3973804 - RNA, 12 nt, Staphylococcus aureus subsp. aureus Mu50
ucaauaaucuua

SEQ ID NO: 3973805 - RNA, 23 nt, Staphylococcus aureus subsp. aureus Mu50
ucaauaaugcguuggcgguauuu

SEQ ID NO: 3973806 - RNA, 18 nt, Staphylococcus aureus subsp. aureus Mu50
ucaauaaugugucaaaua

SEQ ID NO: 3973807 - RNA, 14 nt, Staphylococcus aureus subsp. aureus Mu50
ucaauaauucauca

SEQ ID NO: 3973808 - RNA, 13 nt, Staphylococcus aureus subsp. aureus Mu50
ucaauaauugauu

SEQ ID NO: 3973809 - RNA, 15 nt, Staphylococcus aureus subsp. aureus Mu50
ucaauacaaagaauu

SEQ ID NO: 3973810 - RNA, 22 nt, Staphylococcus aureus subsp. aureus Mu50
ucaauaccauaauuaaauaacu

SEQ ID NO: 3973811 - RNA, 21 nt, Staphylococcus aureus subsp. aureus Mu50
ucaauacccuacuauauauca

SEQ ID NO: 3973812 - RNA, 22 nt, Staphylococcus aureus subsp. aureus Mu50
ucaauacgaaguguuauaaaua

SEQ ID NO: 3973813 - RNA, 15 nt, Staphylococcus aureus subsp. aureus Mu50
ucaauacuugaaaga

SEQ ID NO: 3973814 - RNA, 17 nt, Staphylococcus aureus subsp. aureus Mu50
ucaauagcgguuuaaaa

SEQ ID NO: 3973815 - RNA, 19 nt, Staphylococcus aureus subsp. aureus Mu50
ucaauagcgguuuaaaaau

SEQ ID NO: 3973816 - RNA, 22 nt, Staphylococcus aureus subsp. aureus Mu50
ucaauagcgguuuaaaaaugcu

SEQ ID NO: 3973817 - RNA, 14 nt, Staphylococcus aureus subsp. aureus Mu50
ucaauaguuuauaa

SEQ ID NO: 3973818 - RNA, 21 nt, Staphylococcus aureus subsp. aureus Mu50
ucaauauaaccgugaugaugu

SEQ ID NO: 3973819 - RNA, 15 nt, Staphylococcus aureus subsp. aureus Mu50
ucaauaucaaauuug

SEQ ID NO: 3973820 - RNA, 16 nt, Staphylococcus aureus subsp. aureus Mu50
ucaauaucacuaucag

SEQ ID NO: 3973821 - RNA, 14 nt, Staphylococcus aureus subsp. aureus Mu50
ucaauaucuucuaa

SEQ ID NO: 3973822 - RNA, 14 nt, Staphylococcus aureus subsp. aureus Mu50
ucaauaugaccuuu

SEQ ID NO: 3973823 - RNA, 23 nt, Staphylococcus aureus subsp. aureus Mu50
ucaauaugauccuuuaaugcuuu

SEQ ID NO: 3973824 - RNA, 12 nt, Staphylococcus aureus subsp. aureus Mu50
ucaauauuaaaa

SEQ ID NO: 3973825 - RNA, 21 nt, Staphylococcus aureus subsp. aureus Mu50
ucaauauuaaucauaaugaau

SEQ ID NO: 3973826 - RNA, 22 nt, Staphylococcus aureus subsp. aureus Mu50
ucaauauuaaucauaaugaaua

SEQ ID NO: 3973827 - RNA, 14 nt, Staphylococcus aureus subsp. aureus Mu50
ucaauauucuuauc

SEQ ID NO: 3973828 - RNA, 21 nt, Staphylococcus aureus subsp. aureus Mu50
ucaauauuuauauuaaauacu

SEQ ID NO: 3973829 - RNA, 22 nt, Staphylococcus aureus subsp. aureus Mu50
ucaaucaacgagucauaaauau

SEQ ID NO: 3973830 - RNA, 23 nt, Staphylococcus aureus subsp. aureus Mu50
ucaaucaacgagucauaaauaua

SEQ ID NO: 3973831 - RNA, 19 nt, Staphylococcus aureus subsp. aureus Mu50
ucaaucacuccucuauuuu

SEQ ID NO: 3973832 - RNA, 21 nt, Staphylococcus aureus subsp. aureus Mu50
ucaaucacuccucuauuuuau

SEQ ID NO: 3973833 - RNA, 21 nt, Staphylococcus aureus subsp. aureus Mu50
ucaauccaauuaaauauuuaa

SEQ ID NO: 3973834 - RNA, 22 nt, Staphylococcus aureus subsp. aureus Mu50
ucaaucccuuuuagcauaauua

SEQ ID NO: 3973835 - RNA, 23 nt, Staphylococcus aureus subsp. aureus Mu50
ucaaucccuuuuagcauaauuag

SEQ ID NO: 3973836 - RNA, 21 nt, Staphylococcus aureus subsp. aureus Mu50
ucaauccuaaauuauaaauag

SEQ ID NO: 3973837 - RNA, 13 nt, Staphylococcus aureus subsp. aureus Mu50
ucaauccuuuguu

SEQ ID NO: 3973838 - RNA, 18 nt, Staphylococcus aureus subsp. aureus Mu50
ucaaucgcauuuuguuuc

SEQ ID NO: 3973839 - RNA, 19 nt, Staphylococcus aureus subsp. aureus Mu50
ucaaucgucacaucacguu

SEQ ID NO: 3973840 - RNA, 15 nt, Staphylococcus aureus subsp. aureus Mu50
ucaaucguuaauuuc

SEQ ID NO: 3973841 - RNA, 15 nt, Staphylococcus aureus subsp. aureus Mu50
ucaaugaauucauuu

SEQ ID NO: 3973842 - RNA, 13 nt, Staphylococcus aureus subsp. aureus Mu50
ucaaugacaucua

SEQ ID NO: 3973843 - RNA, 22 nt, Staphylococcus aureus subsp. aureus Mu50
ucaaugagcaagucuucuaaaa

SEQ ID NO: 3973844 - RNA, 14 nt, Staphylococcus aureus subsp. aureus Mu50
ucaaugauuuuaua

SEQ ID NO: 3973845 - RNA, 20 nt, Staphylococcus aureus subsp. aureus Mu50
ucaaugauuuuauaauauua

SEQ ID NO: 3973846 - RNA, 21 nt, Staphylococcus aureus subsp. aureus Mu50
ucaaugauuuuauaauauuau

SEQ ID NO: 3973847 - RNA, 18 nt, Staphylococcus aureus subsp. aureus Mu50
ucaaugauuuuuaaaaau

SEQ ID NO: 3973848 - RNA, 19 nt, Staphylococcus aureus subsp. aureus Mu50
ucaaugauuuuuaaaaaua

SEQ ID NO: 3973849 - RNA, 17 nt, Staphylococcus aureus subsp. aureus Mu50
ucaauguaagcaacaua

SEQ ID NO: 3973850 - RNA, 14 nt, Staphylococcus aureus subsp. aureus Mu50
ucaauguaauuuuc

SEQ ID NO: 3973851 - RNA, 15 nt, Staphylococcus aureus subsp. aureus Mu50
ucaauguauauuuaa

SEQ ID NO: 3973852 - RNA, 16 nt, Staphylococcus aureus subsp. aureus Mu50
ucaauguauauuuaac

SEQ ID NO: 3973853 - RNA, 17 nt, Staphylococcus aureus subsp. aureus Mu50
ucaauguauauuuaaca

SEQ ID NO: 3973854 - RNA, 20 nt, Staphylococcus aureus subsp. aureus Mu50
ucaauguauauuuaacauca

SEQ ID NO: 3973855 - RNA, 13 nt, Staphylococcus aureus subsp. aureus Mu50
ucaauguaucaag

SEQ ID NO: 3973856 - RNA, 16 nt, Staphylococcus aureus subsp. aureus Mu50
ucaaugugagauauaa

SEQ ID NO: 3973857 - RNA, 14 nt, Staphylococcus aureus subsp. aureus Mu50
ucaauguuauuaaa

SEQ ID NO: 3973858 - RNA, 15 nt, Staphylococcus aureus subsp. aureus Mu50
ucaauguuauuaaac

SEQ ID NO: 3973859 - RNA, 14 nt, Staphylococcus aureus subsp. aureus Mu50
ucaauguuuaauuu

SEQ ID NO: 3973860 - RNA, 20 nt, Staphylococcus aureus subsp. aureus Mu50
ucaauguuuaauuuucuaaa

SEQ ID NO: 3973861 - RNA, 21 nt, Staphylococcus aureus subsp. aureus Mu50
ucaauguuuaauuuucuaaau

SEQ ID NO: 3973862 - RNA, 12 nt, Staphylococcus aureus subsp. aureus Mu50
ucacgauuaaua

SEQ ID NO: 3973863 - RNA, 14 nt, Staphylococcus aureus subsp. aureus Mu50
ucacgauuaauaaa

SEQ ID NO: 3973864 - RNA, 17 nt, Staphylococcus aureus subsp. aureus Mu50
ucacgauuaauaaaauu

SEQ ID NO: 3973865 - RNA, 20 nt, Staphylococcus aureus subsp. aureus Mu50
ucacgauuaauaaaauucua

SEQ ID NO: 3973866 - RNA, 13 nt, Staphylococcus aureus subsp. aureus Mu50
ucacgauuuucaa

SEQ ID NO: 3973867 - RNA, 14 nt, Staphylococcus aureus subsp. aureus Mu50
ucacgcugaaauuu

SEQ ID NO: 3973868 - RNA, 17 nt, Staphylococcus aureus subsp. aureus Mu50
ucacguaaugaaucaau

SEQ ID NO: 3973869 - RNA, 12 nt, Staphylococcus aureus subsp. aureus Mu50
ucacguuaucau

SEQ ID NO: 3973870 - RNA, 13 nt, Staphylococcus aureus subsp. aureus Mu50
ucacuaaaaauau

SEQ ID NO: 3973871 - RNA, 16 nt, Staphylococcus aureus subsp. aureus Mu50
ucacuaaaguaaauaa

SEQ ID NO: 3973872 - RNA, 14 nt, Staphylococcus aureus subsp. aureus Mu50
ucacuaauauuucu

SEQ ID NO: 3973873 - RNA, 20 nt, Staphylococcus aureus subsp. aureus Mu50
ucacuaaucucgguacauuu

SEQ ID NO: 3973874 - RNA, 17 nt, Staphylococcus aureus subsp. aureus Mu50
ucacuaauggauaugau

SEQ ID NO: 3973875 - RNA, 17 nt, Staphylococcus aureus subsp. aureus Mu50
ucacuacaguguaugau

SEQ ID NO: 3973876 - RNA, 16 nt, Staphylococcus aureus subsp. aureus Mu50
ucacuaggauguucau

SEQ ID NO: 3973877 - RNA, 19 nt, Staphylococcus aureus subsp. aureus Mu50
ucacuaggauguucaucaa

SEQ ID NO: 3973878 - RNA, 13 nt, Staphylococcus aureus subsp. aureus Mu50
ucacuauacaauc

SEQ ID NO: 3973879 - RNA, 23 nt, Staphylococcus aureus subsp. aureus Mu50
ucacuauagccaaaggcaaaaug

SEQ ID NO: 3973880 - RNA, 13 nt, Staphylococcus aureus subsp. aureus Mu50
ucacuauauuuca

SEQ ID NO: 3973881 - RNA, 23 nt, Staphylococcus aureus subsp. aureus Mu50
ucacuccucuauuuuaugauuug

SEQ ID NO: 3973882 - RNA, 20 nt, Staphylococcus aureus subsp. aureus Mu50
ucacugcaaacacaguacaa

SEQ ID NO: 3973883 - RNA, 17 nt, Staphylococcus aureus subsp. aureus Mu50
ucacugcacuuaugaua

SEQ ID NO: 3973884 - RNA, 15 nt, Staphylococcus aureus subsp. aureus Mu50
ucacuguagauucaa

SEQ ID NO: 3973885 - RNA, 17 nt, Staphylococcus aureus subsp. aureus Mu50
ucacuguuaaagauguc

SEQ ID NO: 3973886 - RNA, 15 nt, Staphylococcus aureus subsp. aureus Mu50
ucacuguuuuaucua

SEQ ID NO: 3973887 - RNA, 13 nt, Staphylococcus aureus subsp. aureus Mu50
ucacuguuuuauu

SEQ ID NO: 3973888 - RNA, 14 nt, Staphylococcus aureus subsp. aureus Mu50
ucacuguuuuauua

SEQ ID NO: 3973889 - RNA, 16 nt, Staphylococcus aureus subsp. aureus Mu50
ucacuguuuuauuaug

SEQ ID NO: 3973890 - RNA, 19 nt, Staphylococcus aureus subsp. aureus Mu50
ucacuuaauaaauaauuuc

SEQ ID NO: 3973891 - RNA, 11 nt, Staphylococcus aureus subsp. aureus Mu50
ucacuucaacg

SEQ ID NO: 3973892 - RNA, 23 nt, Staphylococcus aureus subsp. aureus Mu50
ucacuucuuacugaucguaacau

SEQ ID NO: 3973893 - RNA, 19 nt, Staphylococcus aureus subsp. aureus Mu50
ucacuugcgucguuuauua

SEQ ID NO: 3973894 - RNA, 20 nt, Staphylococcus aureus subsp. aureus Mu50
ucacuuggauucaaaugaca

SEQ ID NO: 3973895 - RNA, 15 nt, Staphylococcus aureus subsp. aureus Mu50
ucacuuuaacuucuu

SEQ ID NO: 3973896 - RNA, 19 nt, Staphylococcus aureus subsp. aureus Mu50
ucacuuuacccucuuuagu

SEQ ID NO: 3973897 - RNA, 15 nt, Staphylococcus aureus subsp. aureus Mu50
ucacuuuuuauauca

SEQ ID NO: 3973898 - RNA, 20 nt, Staphylococcus aureus subsp. aureus Mu50
ucacuuuuuuuaauuugauu

SEQ ID NO: 3973899 - RNA, 22 nt, Staphylococcus aureus subsp. aureus Mu50
ucagaaaugacaucaucuauaa

SEQ ID NO: 3973900 - RNA, 19 nt, Staphylococcus aureus subsp. aureus Mu50
ucagaaguuguuuagaaaa

SEQ ID NO: 3973901 - RNA, 16 nt, Staphylococcus aureus subsp. aureus Mu50
ucagaaucaaguaauu

SEQ ID NO: 3973902 - RNA, 17 nt, Staphylococcus aureus subsp. aureus Mu50
ucagaaugaacuucucu

SEQ ID NO: 3973903 - RNA, 19 nt, Staphylococcus aureus subsp. aureus Mu50
ucagauauaaguagcauca

SEQ ID NO: 3973904 - RNA, 15 nt, Staphylococcus aureus subsp. aureus Mu50
ucagaugauuuaauu

SEQ ID NO: 3973905 - RNA, 18 nt, Staphylococcus aureus subsp. aureus Mu50
ucagaugauuuaauucug

SEQ ID NO: 3973906 - RNA, 17 nt, Staphylococcus aureus subsp. aureus Mu50
ucagauuuguauuuugc

SEQ ID NO: 3973907 - RNA, 19 nt, Staphylococcus aureus subsp. aureus Mu50
ucagcauuaaucguauuuu

SEQ ID NO: 3973908 - RNA, 21 nt, Staphylococcus aureus subsp. aureus Mu50
ucagcauugggacauaaaauu

SEQ ID NO: 3973909 - RNA, 17 nt, Staphylococcus aureus subsp. aureus Mu50
ucagccacugucaugug

SEQ ID NO: 3973910 - RNA, 14 nt, Staphylococcus aureus subsp. aureus Mu50
ucagcuaaauauuu

SEQ ID NO: 3973911 - RNA, 15 nt, Staphylococcus aureus subsp. aureus Mu50
ucagcuaaguuaaau

SEQ ID NO: 3973912 - RNA, 17 nt, Staphylococcus aureus subsp. aureus Mu50
ucagcuaaguuaaauau

SEQ ID NO: 3973913 - RNA, 15 nt, Staphylococcus aureus subsp. aureus Mu50
ucagcuaauucgucu

SEQ ID NO: 3973914 - RNA, 13 nt, Staphylococcus aureus subsp. aureus Mu50
ucagcuauaaaag

SEQ ID NO: 3973915 - RNA, 14 nt, Staphylococcus aureus subsp. aureus Mu50
ucagcugaugcuuc

SEQ ID NO: 3973916 - RNA, 15 nt, Staphylococcus aureus subsp. aureus Mu50
ucagcugaugcuucg

SEQ ID NO: 3973917 - RNA, 13 nt, Staphylococcus aureus subsp. aureus Mu50
ucagcuuauuaag

SEQ ID NO: 3973918 - RNA, 14 nt, Staphylococcus aureus subsp. aureus Mu50
ucagcuuuaauaau

SEQ ID NO: 3973919 - RNA, 16 nt, Staphylococcus aureus subsp. aureus Mu50
ucagcuuuaauaauau

SEQ ID NO: 3973920 - RNA, 21 nt, Staphylococcus aureus subsp. aureus Mu50
ucagcuuuggcgacauaaaua

SEQ ID NO: 3973921 - RNA, 13 nt, Staphylococcus aureus subsp. aureus Mu50
ucagcuuuuucac

SEQ ID NO: 3973922 - RNA, 16 nt, Staphylococcus aureus subsp. aureus Mu50
ucaggaauagauguca

SEQ ID NO: 3973923 - RNA, 18 nt, Staphylococcus aureus subsp. aureus Mu50
ucaggaccaaauagagaa

SEQ ID NO: 3973924 - RNA, 23 nt, Staphylococcus aureus subsp. aureus Mu50
ucaggaucacguuuuucuuuaaa

SEQ ID NO: 3973925 - RNA, 18 nt, Staphylococcus aureus subsp. aureus Mu50
ucaggcuuuguuuuucac

SEQ ID NO: 3973926 - RNA, 14 nt, Staphylococcus aureus subsp. aureus Mu50
ucagggaaaucauc

SEQ ID NO: 3973927 - RNA, 16 nt, Staphylococcus aureus subsp. aureus Mu50
ucagggaaaucaucug

SEQ ID NO: 3973928 - RNA, 19 nt, Staphylococcus aureus subsp. aureus Mu50
ucaggggccccaacacaga

SEQ ID NO: 3973929 - RNA, 16 nt, Staphylococcus aureus subsp. aureus Mu50
ucaggguuuaagauuu

SEQ ID NO: 3973930 - RNA, 16 nt, Staphylococcus aureus subsp. aureus Mu50
ucaguaaaaacgaaau

SEQ ID NO: 3973931 - RNA, 17 nt, Staphylococcus aureus subsp. aureus Mu50
ucaguaaaaacgaaauu

SEQ ID NO: 3973932 - RNA, 24 nt, Staphylococcus aureus subsp. aureus Mu50
ucaguaaaaacgaaauuguuaucu

SEQ ID NO: 3973933 - RNA, 20 nt, Staphylococcus aureus subsp. aureus Mu50
ucaguaacugauuuuguuuc

SEQ ID NO: 3973934 - RNA, 15 nt, Staphylococcus aureus subsp. aureus Mu50
ucaguaauaauguag

SEQ ID NO: 3973935 - RNA, 16 nt, Staphylococcus aureus subsp. aureus Mu50
ucaguaccaaagaaau

SEQ ID NO: 3973936 - RNA, 23 nt, Staphylococcus aureus subsp. aureus Mu50
ucaguaggacauauaaauguuga

SEQ ID NO: 3973937 - RNA, 17 nt, Staphylococcus aureus subsp. aureus Mu50
ucaguaguuuuaaaagu

SEQ ID NO: 3973938 - RNA, 15 nt, Staphylococcus aureus subsp. aureus Mu50
ucaguaucuaaauau

SEQ ID NO: 3973939 - RNA, 18 nt, Staphylococcus aureus subsp. aureus Mu50
ucaguauuuacuuuuccu

SEQ ID NO: 3973940 - RNA, 14 nt, Staphylococcus aureus subsp. aureus Mu50
ucagucaauucaaa

SEQ ID NO: 3973941 - RNA, 18 nt, Staphylococcus aureus subsp. aureus Mu50
ucagucaauucaaacuga

SEQ ID NO: 3973942 - RNA, 15 nt, Staphylococcus aureus subsp. aureus Mu50
ucagucaguaaaaau

SEQ ID NO: 3973943 - RNA, 19 nt, Staphylococcus aureus subsp. aureus Mu50
ucaguccgcuuuuucauag

SEQ ID NO: 3973944 - RNA, 20 nt, Staphylococcus aureus subsp. aureus Mu50
ucaguccgcuuuuucauaga

SEQ ID NO: 3973945 - RNA, 13 nt, Staphylococcus aureus subsp. aureus Mu50
ucaguuaaaucuu

SEQ ID NO: 3973946 - RNA, 17 nt, Staphylococcus aureus subsp. aureus Mu50
ucaguuauaccauauuu

SEQ ID NO: 3973947 - RNA, 18 nt, Staphylococcus aureus subsp. aureus Mu50
ucaguuauaccauauuua

SEQ ID NO: 3973948 - RNA, 18 nt, Staphylococcus aureus subsp. aureus Mu50
ucaguucaaacagaaauu

SEQ ID NO: 3973949 - RNA, 16 nt, Staphylococcus aureus subsp. aureus Mu50
ucaguugagucaauuu

SEQ ID NO: 3973950 - RNA, 19 nt, Staphylococcus aureus subsp. aureus Mu50
ucaucaguaccaaagaaau

SEQ ID NO: 3973951 - RNA, 19 nt, Staphylococcus aureus subsp. aureus Mu50
ucaucauaaucaagaauau

SEQ ID NO: 3973952 - RNA, 13 nt, Staphylococcus aureus subsp. aureus Mu50
ucaucauaaucug

SEQ ID NO: 3973953 - RNA, 19 nt, Staphylococcus aureus subsp. aureus Mu50
ucaucauaaucugcugcug

SEQ ID NO: 3973954 - RNA, 21 nt, Staphylococcus aureus subsp. aureus Mu50
ucaucaugacuauuuuccauc

SEQ ID NO: 3973955 - RNA, 14 nt, Staphylococcus aureus subsp. aureus Mu50
ucaucaugcauaau

SEQ ID NO: 3973956 - RNA, 23 nt, Staphylococcus aureus subsp. aureus Mu50
ucaucaugugcuuuguuuaucaa

SEQ ID NO: 3973957 - RNA, 13 nt, Staphylococcus aureus subsp. aureus Mu50
ucaucauguucua

SEQ ID NO: 3973958 - RNA, 16 nt, Staphylococcus aureus subsp. aureus Mu50
ucaucauuaaaucuga

SEQ ID NO: 3973959 - RNA, 20 nt, Staphylococcus aureus subsp. aureus Mu50
ucaucauuaguuuuuaaaau

SEQ ID NO: 3973960 - RNA, 23 nt, Staphylococcus aureus subsp. aureus Mu50
ucaucauuguaaaacaaauuaca

SEQ ID NO: 3973961 - RNA, 13 nt, Staphylococcus aureus subsp. aureus Mu50
ucauccauaaaaa

SEQ ID NO: 3973962 - RNA, 15 nt, Staphylococcus aureus subsp. aureus Mu50
ucauccauaaaaaua

SEQ ID NO: 3973963 - RNA, 15 nt, Staphylococcus aureus subsp. aureus Mu50
ucauccgccaauuaa

SEQ ID NO: 3973964 - RNA, 17 nt, Staphylococcus aureus subsp. aureus Mu50
ucaucgaacaugaauga

SEQ ID NO: 3973965 - RNA, 21 nt, Staphylococcus aureus subsp. aureus Mu50
ucaucgaguuuguuucuaaau

SEQ ID NO: 3973966 - RNA, 18 nt, Staphylococcus aureus subsp. aureus Mu50
ucaucgcaaauacauaau

SEQ ID NO: 3973967 - RNA, 12 nt, Staphylococcus aureus subsp. aureus Mu50
ucaucguauuuc

SEQ ID NO: 3973968 - RNA, 17 nt, Staphylococcus aureus subsp. aureus Mu50
ucaucguccacgaaucu

SEQ ID NO: 3973969 - RNA, 22 nt, Staphylococcus aureus subsp. aureus Mu50
ucaucguuaucuuuaaguaauu

SEQ ID NO: 3973970 - RNA, 17 nt, Staphylococcus aureus subsp. aureus Mu50
ucaucguucauauauuu

SEQ ID NO: 3973971 - RNA, 21 nt, Staphylococcus aureus subsp. aureus Mu50
ucaucguucauauauuuuguu

SEQ ID NO: 3973972 - RNA, 21 nt, Staphylococcus aureus subsp. aureus Mu50
ucaucuaaaaugaguuguuca

SEQ ID NO: 3973973 - RNA, 20 nt, Staphylococcus aureus subsp. aureus Mu50
ucaucuaacgacccaaauua

SEQ ID NO: 3973974 - RNA, 23 nt, Staphylococcus aureus subsp. aureus Mu50
ucaucuaacgacccaaauuauau

SEQ ID NO: 3973975 - RNA, 16 nt, Staphylococcus aureus subsp. aureus Mu50
ucaucuacuauuuaau

SEQ ID NO: 3973976 - RNA, 17 nt, Staphylococcus aureus subsp. aureus Mu50
ucaucuauaauaccuaa

SEQ ID NO: 3973977 - RNA, 13 nt, Staphylococcus aureus subsp. aureus Mu50
ucaucuauucaac

SEQ ID NO: 3973978 - RNA, 12 nt, Staphylococcus aureus subsp. aureus Mu50
ucaucuauuuaa

SEQ ID NO: 3973979 - RNA, 18 nt, Staphylococcus aureus subsp. aureus Mu50
ucaucuauuuaauaaugu

SEQ ID NO: 3973980 - RNA, 23 nt, Staphylococcus aureus subsp. aureus Mu50
ucaucuauuuaauaauguaucau

SEQ ID NO: 3973981 - RNA, 22 nt, Staphylococcus aureus subsp. aureus Mu50
ucaucugaugaggcaauauuaa

SEQ ID NO: 3973982 - RNA, 19 nt, Staphylococcus aureus subsp. aureus Mu50
ucaucuggugcaauauuau

SEQ ID NO: 3973983 - RNA, 18 nt, Staphylococcus aureus subsp. aureus Mu50
ucaucuuaucaagaauau

SEQ ID NO: 3973984 - RNA, 19 nt, Staphylococcus aureus subsp. aureus Mu50
ucaucuucaaacagacuua

SEQ ID NO: 3973985 - RNA, 16 nt, Staphylococcus aureus subsp. aureus Mu50
ucaucuucaauucuua

SEQ ID NO: 3973986 - RNA, 20 nt, Staphylococcus aureus subsp. aureus Mu50
ucaucuugcgccuuguucaa

SEQ ID NO: 3973987 - RNA, 23 nt, Staphylococcus aureus subsp. aureus Mu50
ucaucuuuaugcaaaauuaauga

SEQ ID NO: 3973988 - RNA, 14 nt, Staphylococcus aureus subsp. aureus Mu50
ucaucuuuauuuac

SEQ ID NO: 3973989 - RNA, 18 nt, Staphylococcus aureus subsp. aureus Mu50
ucaucuuucaaaugcuua

SEQ ID NO: 3973990 - RNA, 21 nt, Staphylococcus aureus subsp. aureus Mu50
ucaucuuucaacgcauauucu

SEQ ID NO: 3973991 - RNA, 23 nt, Staphylococcus aureus subsp. aureus Mu50
ucaucuuucacaauuguauaaug

SEQ ID NO: 3973992 - RNA, 20 nt, Staphylococcus aureus subsp. aureus Mu50
ucaucuuuugucuuacuaau

SEQ ID NO: 3973993 - RNA, 18 nt, Staphylococcus aureus subsp. aureus Mu50
ucaucuuuuugaaauuuc

SEQ ID NO: 3973994 - RNA, 18 nt, Staphylococcus aureus subsp. aureus Mu50
ucaugaaauuagauuuua

SEQ ID NO: 3973995 - RNA, 14 nt, Staphylococcus aureus subsp. aureus Mu50
ucaugaauuuucau

SEQ ID NO: 3973996 - RNA, 15 nt, Staphylococcus aureus subsp. aureus Mu50
ucaugagacaaacgc

SEQ ID NO: 3973997 - RNA, 16 nt, Staphylococcus aureus subsp. aureus Mu50
ucaugagcacaaacua

SEQ ID NO: 3973998 - RNA, 17 nt, Staphylococcus aureus subsp. aureus Mu50
ucaugagcacaaacuaa

SEQ ID NO: 3973999 - RNA, 16 nt, Staphylococcus aureus subsp. aureus Mu50
ucaugaugauaaauug

SEQ ID NO: 3974000 - RNA, 20 nt, Staphylococcus aureus subsp. aureus Mu50
ucaugcaaaacuaaucaaau

SEQ ID NO: 3974001 - RNA, 22 nt, Staphylococcus aureus subsp. aureus Mu50
ucaugcaaaacuaaucaaauua

SEQ ID NO: 3974002 - RNA, 15 nt, Staphylococcus aureus subsp. aureus Mu50
ucaugcaaaauaaua

SEQ ID NO: 3974003 - RNA, 16 nt, Staphylococcus aureus subsp. aureus Mu50
ucaugcauaagaaaua

SEQ ID NO: 3974004 - RNA, 13 nt, Staphylococcus aureus subsp. aureus Mu50
ucaugcauucuau

SEQ ID NO: 3974005 - RNA, 20 nt, Staphylococcus aureus subsp. aureus Mu50
ucaugccgucgauagauguu

SEQ ID NO: 3974006 - RNA, 12 nt, Staphylococcus aureus subsp. aureus Mu50
ucaugccuucau

SEQ ID NO: 3974007 - RNA, 13 nt, Staphylococcus aureus subsp. aureus Mu50
ucaugccuucaug

SEQ ID NO: 3974008 - RNA, 15 nt, Staphylococcus aureus subsp. aureus Mu50
ucaugccuucauuag

SEQ ID NO: 3974009 - RNA, 21 nt, Staphylococcus aureus subsp. aureus Mu50
ucaugcuauuuaaaucuaagu

SEQ ID NO: 3974010 - RNA, 18 nt, Staphylococcus aureus subsp. aureus Mu50
ucaugcuuaauuuaugug

SEQ ID NO: 3974011 - RNA, 15 nt, Staphylococcus aureus subsp. aureus Mu50
ucaugggcaguaauu

SEQ ID NO: 3974012 - RNA, 18 nt, Staphylococcus aureus subsp. aureus Mu50
ucaugggcaguaauuuuc

SEQ ID NO: 3974013 - RNA, 18 nt, Staphylococcus aureus subsp. aureus Mu50
ucauguacaguuacuuuc

SEQ ID NO: 3974014 - RNA, 17 nt, Staphylococcus aureus subsp. aureus Mu50
ucauguauauggcauca

SEQ ID NO: 3974015 - RNA, 20 nt, Staphylococcus aureus subsp. aureus Mu50
ucauguauauggcaucauca

SEQ ID NO: 3974016 - RNA, 14 nt, Staphylococcus aureus subsp. aureus Mu50
ucauguauugucca

SEQ ID NO: 3974017 - RNA, 23 nt, Staphylococcus aureus subsp. aureus Mu50
ucauguccaucuuuuauuaaaga

SEQ ID NO: 3974018 - RNA, 23 nt, Staphylococcus aureus subsp. aureus Mu50
ucaugucuagauuuuaaaucaau

SEQ ID NO: 3974019 - RNA, 21 nt, Staphylococcus aureus subsp. aureus Mu50
ucaugugucacaaugaccauu

SEQ ID NO: 3974020 - RNA, 12 nt, Staphylococcus aureus subsp. aureus Mu50
ucauguucauaa

SEQ ID NO: 3974021 - RNA, 17 nt, Staphylococcus aureus subsp. aureus Mu50
ucauguucauaauauaa

SEQ ID NO: 3974022 - RNA, 19 nt, Staphylococcus aureus subsp. aureus Mu50
ucauguuccccauuaauua

SEQ ID NO: 3974023 - RNA, 16 nt, Staphylococcus aureus subsp. aureus Mu50
ucauguucuuguaauc

SEQ ID NO: 3974024 - RNA, 18 nt, Staphylococcus aureus subsp. aureus Mu50
ucauguuuggcauaauaa

SEQ ID NO: 3974025 - RNA, 13 nt, Staphylococcus aureus subsp. aureus Mu50
ucauuaaauauuu

SEQ ID NO: 3974026 - RNA, 13 nt, Staphylococcus aureus subsp. aureus Mu50
ucauuaaaucuga

SEQ ID NO: 3974027 - RNA, 19 nt, Staphylococcus aureus subsp. aureus Mu50
ucauuaaaucugauucauu

SEQ ID NO: 3974028 - RNA, 22 nt, Staphylococcus aureus subsp. aureus Mu50
ucauuaaauguacauuguaaau

SEQ ID NO: 3974029 - RNA, 16 nt, Staphylococcus aureus subsp. aureus Mu50
ucauuaaccuuacaua

SEQ ID NO: 3974030 - RNA, 15 nt, Staphylococcus aureus subsp. aureus Mu50
ucauuaaguacuuuu

SEQ ID NO: 3974031 - RNA, 14 nt, Staphylococcus aureus subsp. aureus Mu50
ucauuaauaaauug

SEQ ID NO: 3974032 - RNA, 14 nt, Staphylococcus aureus subsp. aureus Mu50
ucauuaauaauuaa

SEQ ID NO: 3974033 - RNA, 12 nt, Staphylococcus aureus subsp. aureus Mu50
ucauuaauacaa

SEQ ID NO: 3974034 - RNA, 14 nt, Staphylococcus aureus subsp. aureus Mu50
ucauuaauuuuuca

SEQ ID NO: 3974035 - RNA, 17 nt, Staphylococcus aureus subsp. aureus Mu50
ucauuacaaagucuguc

SEQ ID NO: 3974036 - RNA, 19 nt, Staphylococcus aureus subsp. aureus Mu50
ucauuacaaagucugucug

SEQ ID NO: 3974037 - RNA, 14 nt, Staphylococcus aureus subsp. aureus Mu50
ucauuacaaccauu

SEQ ID NO: 3974038 - RNA, 17 nt, Staphylococcus aureus subsp. aureus Mu50
ucauuagauaaaauaau

SEQ ID NO: 3974039 - RNA, 16 nt, Staphylococcus aureus subsp. aureus Mu50
ucauuagcauuauuau

SEQ ID NO: 3974040 - RNA, 17 nt, Staphylococcus aureus subsp. aureus Mu50
ucauuagcauuauuauu

SEQ ID NO: 3974041 - RNA, 16 nt, Staphylococcus aureus subsp. aureus Mu50
ucauuagccaaaucuu

SEQ ID NO: 3974042 - RNA, 21 nt, Staphylococcus aureus subsp. aureus Mu50
ucauuagcgaaaacuaaaggg

SEQ ID NO: 3974043 - RNA, 20 nt, Staphylococcus aureus subsp. aureus Mu50
ucauuagcgcaagagauaag

SEQ ID NO: 3974044 - RNA, 23 nt, Staphylococcus aureus subsp. aureus Mu50
ucauuaggucuacgaucaaaauc

SEQ ID NO: 3974045 - RNA, 16 nt, Staphylococcus aureus subsp. aureus Mu50
ucauuaguuguaucag

SEQ ID NO: 3974046 - RNA, 16 nt, Staphylococcus aureus subsp. aureus Mu50
ucauuauaaugauuuu

SEQ ID NO: 3974047 - RNA, 22 nt, Staphylococcus aureus subsp. aureus Mu50
ucauuauacgugcuuuaaaguu

SEQ ID NO: 3974048 - RNA, 19 nt, Staphylococcus aureus subsp. aureus Mu50
ucauuauagucuuaaacau

SEQ ID NO: 3974049 - RNA, 19 nt, Staphylococcus aureus subsp. aureus Mu50
ucauuauaucgucguaacu

SEQ ID NO: 3974050 - RNA, 12 nt, Staphylococcus aureus subsp. aureus Mu50
ucauuauuuaaa

SEQ ID NO: 3974051 - RNA, 13 nt, Staphylococcus aureus subsp. aureus Mu50
ucauuauuuaaau

SEQ ID NO: 3974052 - RNA, 18 nt, Staphylococcus aureus subsp. aureus Mu50
ucauuauuuagaauucua

SEQ ID NO: 3974053 - RNA, 23 nt, Staphylococcus aureus subsp. aureus Mu50
ucauuauuuagaauucuaaaaga

SEQ ID NO: 3974054 - RNA, 18 nt, Staphylococcus aureus subsp. aureus Mu50
ucauuauuugauaaauaa

SEQ ID NO: 3974055 - RNA, 19 nt, Staphylococcus aureus subsp. aureus Mu50
ucauuauuugauaaauaaa

SEQ ID NO: 3974056 - RNA, 17 nt, Staphylococcus aureus subsp. aureus Mu50
ucauucaaacuccuuuc

SEQ ID NO: 3974057 - RNA, 20 nt, Staphylococcus aureus subsp. aureus Mu50
ucauucaauuuaguucacca

SEQ ID NO: 3974058 - RNA, 14 nt, Staphylococcus aureus subsp. aureus Mu50
ucauucacaaugau

SEQ ID NO: 3974059 - RNA, 16 nt, Staphylococcus aureus subsp. aureus Mu50
ucauucacaaugauug

SEQ ID NO: 3974060 - RNA, 18 nt, Staphylococcus aureus subsp. aureus Mu50
ucauucacaaugauugaa

SEQ ID NO: 3974061 - RNA, 12 nt, Staphylococcus aureus subsp. aureus Mu50
ucauucaccuug

SEQ ID NO: 3974062 - RNA, 13 nt, Staphylococcus aureus subsp. aureus Mu50
ucauucacuguau

SEQ ID NO: 3974063 - RNA, 18 nt, Staphylococcus aureus subsp. aureus Mu50
ucauucuagcaucgaugu

SEQ ID NO: 3974064 - RNA, 17 nt, Staphylococcus aureus subsp. aureus Mu50
ucauucuguguaaauau

SEQ ID NO: 3974065 - RNA, 19 nt, Staphylococcus aureus subsp. aureus Mu50
ucauucuguguaaauauaa

SEQ ID NO: 3974066 - RNA, 23 nt, Staphylococcus aureus subsp. aureus Mu50
ucauucuguguaaauauaaauau

SEQ ID NO: 3974067 - RNA, 13 nt, Staphylococcus aureus subsp. aureus Mu50
ucauugaucgauu

SEQ ID NO: 3974068 - RNA, 23 nt, Staphylococcus aureus subsp. aureus Mu50
ucauuggcaauauacuuuuuaaa

SEQ ID NO: 3974069 - RNA, 16 nt, Staphylococcus aureus subsp. aureus Mu50
ucauugguuucaucau

SEQ ID NO: 3974070 - RNA, 19 nt, Staphylococcus aureus subsp. aureus Mu50
ucauugguuucaucauauc

SEQ ID NO: 3974071 - RNA, 14 nt, Staphylococcus aureus subsp. aureus Mu50
ucauuguaaaugau

SEQ ID NO: 3974072 - RNA, 20 nt, Staphylococcus aureus subsp. aureus Mu50
ucauuguaaauuuguuaucu

SEQ ID NO: 3974073 - RNA, 15 nt, Staphylococcus aureus subsp. aureus Mu50
ucauuguaauaauaa

SEQ ID NO: 3974074 - RNA, 16 nt, Staphylococcus aureus subsp. aureus Mu50
ucauuguauaaaaagu

SEQ ID NO: 3974075 - RNA, 18 nt, Staphylococcus aureus subsp. aureus Mu50
ucauuguguauuguuuua

SEQ ID NO: 3974076 - RNA, 18 nt, Staphylococcus aureus subsp. aureus Mu50
ucauuguuucagcugcaa

SEQ ID NO: 3974077 - RNA, 23 nt, Staphylococcus aureus subsp. aureus Mu50
ucauuguuucagcugcaauuuua

SEQ ID NO: 3974078 - RNA, 13 nt, Staphylococcus aureus subsp. aureus Mu50
ucauuuaaaauau

SEQ ID NO: 3974079 - RNA, 20 nt, Staphylococcus aureus subsp. aureus Mu50
ucauuuaaaauauuuuuucu

SEQ ID NO: 3974080 - RNA, 12 nt, Staphylococcus aureus subsp. aureus Mu50
ucauuuaaauau

SEQ ID NO: 3974081 - RNA, 14 nt, Staphylococcus aureus subsp. aureus Mu50
ucauuuaacaugua

SEQ ID NO: 3974082 - RNA, 20 nt, Staphylococcus aureus subsp. aureus Mu50
ucauuuaacauguauuuagu

SEQ ID NO: 3974083 - RNA, 13 nt, Staphylococcus aureus subsp. aureus Mu50
ucauuuauaacau

SEQ ID NO: 3974084 - RNA, 15 nt, Staphylococcus aureus subsp. aureus Mu50
ucauuuauaacauuu

SEQ ID NO: 3974085 - RNA, 20 nt, Staphylococcus aureus subsp. aureus Mu50
ucauuucaaauaagaaugug

SEQ ID NO: 3974086 - RNA, 15 nt, Staphylococcus aureus subsp. aureus Mu50
ucauuucaauauuaa

SEQ ID NO: 3974087 - RNA, 19 nt, Staphylococcus aureus subsp. aureus Mu50
ucauuucaauauuaaaaua

SEQ ID NO: 3974088 - RNA, 17 nt, Staphylococcus aureus subsp. aureus Mu50
ucauuucccuuaaauca

SEQ ID NO: 3974089 - RNA, 22 nt, Staphylococcus aureus subsp. aureus Mu50
ucauuucccuuaaaucaaguau

SEQ ID NO: 3974090 - RNA, 19 nt, Staphylococcus aureus subsp. aureus Mu50
ucauuucugucccacuccc

SEQ ID NO: 3974091 - RNA, 20 nt, Staphylococcus aureus subsp. aureus Mu50
ucauuucugucccacuccca

SEQ ID NO: 3974092 - RNA, 20 nt, Staphylococcus aureus subsp. aureus Mu50
ucauuucugucccacucccu

SEQ ID NO: 3974093 - RNA, 22 nt, Staphylococcus aureus subsp. aureus Mu50
ucauuugaacaucauuuaauug

SEQ ID NO: 3974094 - RNA, 18 nt, Staphylococcus aureus subsp. aureus Mu50
ucauuugacauaucauga

SEQ ID NO: 3974095 - RNA, 20 nt, Staphylococcus aureus subsp. aureus Mu50
ucauuuggcguucaacauua

SEQ ID NO: 3974096 - RNA, 17 nt, Staphylococcus aureus subsp. aureus Mu50
ucauuuguauuaauuug

SEQ ID NO: 3974097 - RNA, 17 nt, Staphylococcus aureus subsp. aureus Mu50
ucauuuguguaaaugaa

SEQ ID NO: 3974098 - RNA, 14 nt, Staphylococcus aureus subsp. aureus Mu50
ucauuuguguuuuu

SEQ ID NO: 3974099 - RNA, 17 nt, Staphylococcus aureus subsp. aureus Mu50
ucauuuguguuuuuaau

SEQ ID NO: 3974100 - RNA, 24 nt, Staphylococcus aureus subsp. aureus Mu50
ucauuuguguuuuuaauguuugcu

SEQ ID NO: 3974101 - RNA, 15 nt, Staphylococcus aureus subsp. aureus Mu50
ucauuuuaaauucaa

SEQ ID NO: 3974102 - RNA, 22 nt, Staphylococcus aureus subsp. aureus Mu50
ucauuuuaaguaucggugauuu

SEQ ID NO: 3974103 - RNA, 14 nt, Staphylococcus aureus subsp. aureus Mu50
ucauuuucaaauaa

SEQ ID NO: 3974104 - RNA, 19 nt, Staphylococcus aureus subsp. aureus Mu50
ucauuuucaacauaauauu

SEQ ID NO: 3974105 - RNA, 15 nt, Staphylococcus aureus subsp. aureus Mu50
ucauuuucauuguau

SEQ ID NO: 3974106 - RNA, 16 nt, Staphylococcus aureus subsp. aureus Mu50
ucauuuucauuguaug

SEQ ID NO: 3974107 - RNA, 19 nt, Staphylococcus aureus subsp. aureus Mu50
ucauuuucugcuuucgcuu

SEQ ID NO: 3974108 - RNA, 12 nt, Staphylococcus aureus subsp. aureus Mu50
ucauuuuuaauu

SEQ ID NO: 3974109 - RNA, 13 nt, Staphylococcus aureus subsp. aureus Mu50
ucauuuuuaauug

SEQ ID NO: 3974110 - RNA, 17 nt, Staphylococcus aureus subsp. aureus Mu50
ucauuuuuaauuuugac

SEQ ID NO: 3974111 - RNA, 22 nt, Staphylococcus aureus subsp. aureus Mu50
ucauuuuuaauuuugacauaaa

SEQ ID NO: 3974112 - RNA, 16 nt, Staphylococcus aureus subsp. aureus Mu50
ucauuuuuauaaauuu

SEQ ID NO: 3974113 - RNA, 21 nt, Staphylococcus aureus subsp. aureus Mu50
ucauuuuuaucccacuccuua

SEQ ID NO: 3974114 - RNA, 13 nt, Staphylococcus aureus subsp. aureus Mu50
ucauuuuuucaau

SEQ ID NO: 3974115 - RNA, 17 nt, Staphylococcus aureus subsp. aureus Mu50
ucauuuuuucaaugucu

SEQ ID NO: 3974116 - RNA, 13 nt, Staphylococcus aureus subsp. aureus Mu50
uccaaaaauugua

SEQ ID NO: 3974117 - RNA, 13 nt, Staphylococcus aureus subsp. aureus Mu50
uccaaaauccuga

SEQ ID NO: 3974118 - RNA, 22 nt, Staphylococcus aureus subsp. aureus Mu50
uccaaaguaacaugugcaagua

SEQ ID NO: 3974119 - RNA, 18 nt, Staphylococcus aureus subsp. aureus Mu50
uccaaaguacucaaguaa

SEQ ID NO: 3974120 - RNA, 16 nt, Staphylococcus aureus subsp. aureus Mu50
uccaaauauuaaaaac

SEQ ID NO: 3974121 - RNA, 18 nt, Staphylococcus aureus subsp. aureus Mu50
uccaaauucauuuguauu

SEQ ID NO: 3974122 - RNA, 22 nt, Staphylococcus aureus subsp. aureus Mu50
uccaaauugcaaaguaacaaua

SEQ ID NO: 3974123 - RNA, 16 nt, Staphylococcus aureus subsp. aureus Mu50
uccaagagaauuaaua

SEQ ID NO: 3974124 - RNA, 14 nt, Staphylococcus aureus subsp. aureus Mu50
ucccuucaacauag

SEQ ID NO: 3974125 - RNA, 21 nt, Staphylococcus aureus subsp. aureus Mu50
uccgaaaauugcuaaaaaaau

SEQ ID NO: 3974126 - RNA, 20 nt, Staphylococcus aureus subsp. aureus Mu50
uccgaauucuccguuaauuu

SEQ ID NO: 3974127 - RNA, 14 nt, Staphylococcus aureus subsp. aureus Mu50
uccgacugcaccuc

SEQ ID NO: 3974128 - RNA, 20 nt, Staphylococcus aureus subsp. aureus Mu50
uccgacuugauaaaaaauga

SEQ ID NO: 3974129 - RNA, 19 nt, Staphylococcus aureus subsp. aureus Mu50
uccgacuuuugauuuugaa

SEQ ID NO: 3974130 - RNA, 15 nt, Staphylococcus aureus subsp. aureus Mu50
uccgaggcuaauuuu

SEQ ID NO: 3974131 - RNA, 21 nt, Staphylococcus aureus subsp. aureus Mu50
uccgauaucuuuuaauucuua

SEQ ID NO: 3974132 - RNA, 13 nt, Staphylococcus aureus subsp. aureus Mu50
uccgaucaugccu

SEQ ID NO: 3974133 - RNA, 19 nt, Staphylococcus aureus subsp. aureus Mu50
uccgauuuugauauaaaaa

SEQ ID NO: 3974134 - RNA, 21 nt, Staphylococcus aureus subsp. aureus Mu50
uccgcacugccuuuuuguaau

SEQ ID NO: 3974135 - RNA, 13 nt, Staphylococcus aureus subsp. aureus Mu50
uccgcauaaauua

SEQ ID NO: 3974136 - RNA, 17 nt, Staphylococcus aureus subsp. aureus Mu50
uccgcuuguucaacuaa

SEQ ID NO: 3974137 - RNA, 21 nt, Staphylococcus aureus subsp. aureus Mu50
uccggaccuuguaaauuuaaa

SEQ ID NO: 3974138 - RNA, 14 nt, Staphylococcus aureus subsp. aureus Mu50
uccggcugaaggga

SEQ ID NO: 3974139 - RNA, 15 nt, Staphylococcus aureus subsp. aureus Mu50
uccggggccccaaca

SEQ ID NO: 3974140 - RNA, 16 nt, Staphylococcus aureus subsp. aureus Mu50
uccguauuuaccuucu

SEQ ID NO: 3974141 - RNA, 13 nt, Staphylococcus aureus subsp. aureus Mu50
uccguuaauuuaa

SEQ ID NO: 3974142 - RNA, 15 nt, Staphylococcus aureus subsp. aureus Mu50
uccguugaauucaac

SEQ ID NO: 3974143 - RNA, 13 nt, Staphylococcus aureus subsp. aureus Mu50
uccuaaaaacugu

SEQ ID NO: 3974144 - RNA, 21 nt, Staphylococcus aureus subsp. aureus Mu50
uccuaaagguaacuuuuuaac

SEQ ID NO: 3974145 - RNA, 18 nt, Staphylococcus aureus subsp. aureus Mu50
uccuaaagucgucucaau

SEQ ID NO: 3974146 - RNA, 18 nt, Staphylococcus aureus subsp. aureus Mu50
uccuaagcaucguaaaaa

SEQ ID NO: 3974147 - RNA, 19 nt, Staphylococcus aureus subsp. aureus Mu50
uccuaagcaucguaaaaaa

SEQ ID NO: 3974148 - RNA, 17 nt, Staphylococcus aureus subsp. aureus Mu50
uccuaagucuuuuaaau

SEQ ID NO: 3974149 - RNA, 17 nt, Staphylococcus aureus subsp. aureus Mu50
uccuaauaaauaucuua

SEQ ID NO: 3974150 - RNA, 14 nt, Staphylococcus aureus subsp. aureus Mu50
uccuaauaauuugg

SEQ ID NO: 3974151 - RNA, 18 nt, Staphylococcus aureus subsp. aureus Mu50
uccuaauuauauuaauga

SEQ ID NO: 3974152 - RNA, 16 nt, Staphylococcus aureus subsp. aureus Mu50
uccuaauuuuucucca

SEQ ID NO: 3974153 - RNA, 22 nt, Staphylococcus aureus subsp. aureus Mu50
uccuacacuguuuuauaaauga

SEQ ID NO: 3974154 - RNA, 21 nt, Staphylococcus aureus subsp. aureus Mu50
uccuaccccgugaaucuuauu

SEQ ID NO: 3974155 - RNA, 18 nt, Staphylococcus aureus subsp. aureus Mu50
uccuaccgcuaaaauucu

SEQ ID NO: 3974156 - RNA, 15 nt, Staphylococcus aureus subsp. aureus Mu50
uccuaucuguaccgu

SEQ ID NO: 3974157 - RNA, 20 nt, Staphylococcus aureus subsp. aureus Mu50
uccuaucuguaccguauuuu

SEQ ID NO: 3974158 - RNA, 21 nt, Staphylococcus aureus subsp. aureus Mu50
uccuaugccaaauaacguuaa

SEQ ID NO: 3974159 - RNA, 17 nt, Staphylococcus aureus subsp. aureus Mu50
uccuauggcgcaauuuu

SEQ ID NO: 3974160 - RNA, 17 nt, Staphylococcus aureus subsp. aureus Mu50
uccuauuacuacauaau

SEQ ID NO: 3974161 - RNA, 19 nt, Staphylococcus aureus subsp. aureus Mu50
uccuauuacuacauaauuu

SEQ ID NO: 3974162 - RNA, 21 nt, Staphylococcus aureus subsp. aureus Mu50
uccuauuguuuuagcaauuug

SEQ ID NO: 3974163 - RNA, 16 nt, Staphylococcus aureus subsp. aureus Mu50
uccucauuaauaaauu

SEQ ID NO: 3974164 - RNA, 18 nt, Staphylococcus aureus subsp. aureus Mu50
uccucauuaugagaccca

SEQ ID NO: 3974165 - RNA, 16 nt, Staphylococcus aureus subsp. aureus Mu50
uccuccaaagcuaagu

SEQ ID NO: 3974166 - RNA, 15 nt, Staphylococcus aureus subsp. aureus Mu50
uccucgguauuuaau

SEQ ID NO: 3974167 - RNA, 19 nt, Staphylococcus aureus subsp. aureus Mu50
uccucgguauuuaauguuu

SEQ ID NO: 3974168 - RNA, 16 nt, Staphylococcus aureus subsp. aureus Mu50
uccucgguuuuauuuu

SEQ ID NO: 3974169 - RNA, 19 nt, Staphylococcus aureus subsp. aureus Mu50
uccucgguuuuauuuuuau

SEQ ID NO: 3974170 - RNA, 20 nt, Staphylococcus aureus subsp. aureus Mu50
uccucgguuuuauuuuuauc

SEQ ID NO: 3974171 - RNA, 15 nt, Staphylococcus aureus subsp. aureus Mu50
uccucuauuguaucu

SEQ ID NO: 3974172 - RNA, 16 nt, Staphylococcus aureus subsp. aureus Mu50
uccucuuauaccaagg

SEQ ID NO: 3974173 - RNA, 16 nt, Staphylococcus aureus subsp. aureus Mu50
uccugaaauuaacguc

SEQ ID NO: 3974174 - RNA, 13 nt, Staphylococcus aureus subsp. aureus Mu50
uccugauacaaug

SEQ ID NO: 3974175 - RNA, 17 nt, Staphylococcus aureus subsp. aureus Mu50
uccugauacaaugauua

SEQ ID NO: 3974176 - RNA, 14 nt, Staphylococcus aureus subsp. aureus Mu50
uccugauuccacua

SEQ ID NO: 3974177 - RNA, 18 nt, Staphylococcus aureus subsp. aureus Mu50
uccugauuuaauguuaaa

SEQ ID NO: 3974178 - RNA, 22 nt, Staphylococcus aureus subsp. aureus Mu50
uccugcaaaauguuacacaaau

SEQ ID NO: 3974179 - RNA, 15 nt, Staphylococcus aureus subsp. aureus Mu50
uccugccaauauauu

SEQ ID NO: 3974180 - RNA, 20 nt, Staphylococcus aureus subsp. aureus Mu50
uccugcuuauuaauuguugg

SEQ ID NO: 3974181 - RNA, 17 nt, Staphylococcus aureus subsp. aureus Mu50
uccuuccaauaauaaau

SEQ ID NO: 3974182 - RNA, 17 nt, Staphylococcus aureus subsp. aureus Mu50
uccuuccauucggauaa

SEQ ID NO: 3974183 - RNA, 20 nt, Staphylococcus aureus subsp. aureus Mu50
uccuucgcuaugaccaugau

SEQ ID NO: 3974184 - RNA, 22 nt, Staphylococcus aureus subsp. aureus Mu50
uccuucgcuaugaccaugauau

SEQ ID NO: 3974185 - RNA, 21 nt, Staphylococcus aureus subsp. aureus Mu50
uccuuggaaacgauauagacc

SEQ ID NO: 3974186 - RNA, 18 nt, Staphylococcus aureus subsp. aureus Mu50
uccuugguuauuaaaauu

SEQ ID NO: 3974187 - RNA, 19 nt, Staphylococcus aureus subsp. aureus Mu50
uccuugguuauuaaaauua

SEQ ID NO: 3974188 - RNA, 23 nt, Staphylococcus aureus subsp. aureus Mu50
uccuuguuggucugauuuugcau

SEQ ID NO: 3974189 - RNA, 17 nt, Staphylococcus aureus subsp. aureus Mu50
uccuuuagcaaaaauau

SEQ ID NO: 3974190 - RNA, 14 nt, Staphylococcus aureus subsp. aureus Mu50
uccuuuauauucua

SEQ ID NO: 3974191 - RNA, 13 nt, Staphylococcus aureus subsp. aureus Mu50
uccuuuauauuua

SEQ ID NO: 3974192 - RNA, 15 nt, Staphylococcus aureus subsp. aureus Mu50
uccuuuauauuuagu

SEQ ID NO: 3974193 - RNA, 18 nt, Staphylococcus aureus subsp. aureus Mu50
uccuuuuuguuauaucua

SEQ ID NO: 3974194 - RNA, 15 nt, Staphylococcus aureus subsp. aureus Mu50
ucgaaaagaaauucu

SEQ ID NO: 3974195 - RNA, 19 nt, Staphylococcus aureus subsp. aureus Mu50
ucgaaaagaaauucuacag

SEQ ID NO: 3974196 - RNA, 20 nt, Staphylococcus aureus subsp. aureus Mu50
ucgaaaagaaauucuacagg

SEQ ID NO: 3974197 - RNA, 23 nt, Staphylococcus aureus subsp. aureus Mu50
ucgaaaagaaauucuacagguaa

SEQ ID NO: 3974198 - RNA, 20 nt, Staphylococcus aureus subsp. aureus Mu50
ucgaaaauagcuauuaaaau

SEQ ID NO: 3974199 - RNA, 21 nt, Staphylococcus aureus subsp. aureus Mu50
ucgaaaauagcuauuaaaaua

SEQ ID NO: 3974200 - RNA, 23 nt, Staphylococcus aureus subsp. aureus Mu50
ucgaaaauagcuauuaaaauaga

SEQ ID NO: 3974201 - RNA, 16 nt, Staphylococcus aureus subsp. aureus Mu50
ucgaaaauuauacaaa

SEQ ID NO: 3974202 - RNA, 17 nt, Staphylococcus aureus subsp. aureus Mu50
ucgaaaauuauacaaau

SEQ ID NO: 3974203 - RNA, 19 nt, Staphylococcus aureus subsp. aureus Mu50
ucgaaagaugauauauuca

SEQ ID NO: 3974204 - RNA, 16 nt, Staphylococcus aureus subsp. aureus Mu50
ucgaaagccaauuaau

SEQ ID NO: 3974205 - RNA, 17 nt, Staphylococcus aureus subsp. aureus Mu50
ucgaaagguauaucuuc

SEQ ID NO: 3974206 - RNA, 18 nt, Staphylococcus aureus subsp. aureus Mu50
ucgaaauauuuauucgcu

SEQ ID NO: 3974207 - RNA, 17 nt, Staphylococcus aureus subsp. aureus Mu50
ucgaaaugccuucugua

SEQ ID NO: 3974208 - RNA, 20 nt, Staphylococcus aureus subsp. aureus Mu50
ucgaacaaucggaagcauau

SEQ ID NO: 3974209 - RNA, 15 nt, Staphylococcus aureus subsp. aureus Mu50
ucgaacagaaaaucg

SEQ ID NO: 3974210 - RNA, 15 nt, Staphylococcus aureus subsp. aureus Mu50
ucgaacauaaauaaa

SEQ ID NO: 3974211 - RNA, 15 nt, Staphylococcus aureus subsp. aureus Mu50
ucgguuuuauuuuua

SEQ ID NO: 3974212 - RNA, 22 nt, Staphylococcus aureus subsp. aureus Mu50
ucgguuuuauuuuuaucaucau

SEQ ID NO: 3974213 - RNA, 23 nt, Staphylococcus aureus subsp. aureus Mu50
ucgguuuuauuuuuaucaucaug

SEQ ID NO: 3974214 - RNA, 18 nt, Staphylococcus aureus subsp. aureus Mu50
ucguaaacacuauaaaag

SEQ ID NO: 3974215 - RNA, 19 nt, Staphylococcus aureus subsp. aureus Mu50
ucguaaagaucauuuucaa

SEQ ID NO: 3974216 - RNA, 17 nt, Staphylococcus aureus subsp. aureus Mu50
ucguaacauuuaaaaaa

SEQ ID NO: 3974217 - RNA, 18 nt, Staphylococcus aureus subsp. aureus Mu50
ucguaacauuuaaaaaau

SEQ ID NO: 3974218 - RNA, 17 nt, Staphylococcus aureus subsp. aureus Mu50
ucguaacucuuuaauuu

SEQ ID NO: 3974219 - RNA, 22 nt, Staphylococcus aureus subsp. aureus Mu50
ucguaagcuucuguguuggggc

SEQ ID NO: 3974220 - RNA, 19 nt, Staphylococcus aureus subsp. aureus Mu50
ucguaaugaugacaucaau

SEQ ID NO: 3974221 - RNA, 19 nt, Staphylococcus aureus subsp. aureus Mu50
ucguaauguguuaauacuu

SEQ ID NO: 3974222 - RNA, 19 nt, Staphylococcus aureus subsp. aureus Mu50
ucguacaccauaaauguaa

SEQ ID NO: 3974223 - RNA, 16 nt, Staphylococcus aureus subsp. aureus Mu50
ucguacuuccaauacu

SEQ ID NO: 3974224 - RNA, 18 nt, Staphylococcus aureus subsp. aureus Mu50
ucguacuuccaauacugu

SEQ ID NO: 3974225 - RNA, 12 nt, Staphylococcus aureus subsp. aureus Mu50
ucguacuuucaa

SEQ ID NO: 3974226 - RNA, 13 nt, Staphylococcus aureus subsp. aureus Mu50
ucguacuuucaaa

SEQ ID NO: 3974227 - RNA, 22 nt, Staphylococcus aureus subsp. aureus Mu50
ucguagcaugacauuaaggcuu

SEQ ID NO: 3974228 - RNA, 19 nt, Staphylococcus aureus subsp. aureus Mu50
ucguaggaugcuuccuuuu

SEQ ID NO: 3974229 - RNA, 15 nt, Staphylococcus aureus subsp. aureus Mu50
ucguaguuguccauu

SEQ ID NO: 3974230 - RNA, 14 nt, Staphylococcus aureus subsp. aureus Mu50
ucguauaagaauca

SEQ ID NO: 3974231 - RNA, 18 nt, Staphylococcus aureus subsp. aureus Mu50
ucguauaauuuuaauauu

SEQ ID NO: 3974232 - RNA, 19 nt, Staphylococcus aureus subsp. aureus Mu50
ucguauaguacuaaaagua

SEQ ID NO: 3974233 - RNA, 17 nt, Staphylococcus aureus subsp. aureus Mu50
ucguauauguaaucaga

SEQ ID NO: 3974234 - RNA, 17 nt, Staphylococcus aureus subsp. aureus Mu50
ucguauuagccaauaaa

SEQ ID NO: 3974235 - RNA, 15 nt, Staphylococcus aureus subsp. aureus Mu50
ucguauucuucaaua

SEQ ID NO: 3974236 - RNA, 14 nt, Staphylococcus aureus subsp. aureus Mu50
ucguauucuuuuaa

SEQ ID NO: 3974237 - RNA, 16 nt, Staphylococcus aureus subsp. aureus Mu50
ucguauucuuuuaaua

SEQ ID NO: 3974238 - RNA, 13 nt, Staphylococcus aureus subsp. aureus Mu50
ucguauuucauau

SEQ ID NO: 3974239 - RNA, 13 nt, Staphylococcus aureus subsp. aureus Mu50
ucgucauuaugug

SEQ ID NO: 3974240 - RNA, 15 nt, Staphylococcus aureus subsp. aureus Mu50
ucgucgcugauacau

SEQ ID NO: 3974241 - RNA, 13 nt, Staphylococcus aureus subsp. aureus Mu50
ucgugaaaauaau

SEQ ID NO: 3974242 - RNA, 12 nt, Staphylococcus aureus subsp. aureus Mu50
ucgugagccccu

SEQ ID NO: 3974243 - RNA, 12 nt, Staphylococcus aureus subsp. aureus Mu50
ucguguuaauaa

SEQ ID NO: 3974244 - RNA, 18 nt, Staphylococcus aureus subsp. aureus Mu50
ucguuaaaacacccugcu

SEQ ID NO: 3974245 - RNA, 21 nt, Staphylococcus aureus subsp. aureus Mu50
ucguuaacaaucaguaauaau

SEQ ID NO: 3974246 - RNA, 16 nt, Staphylococcus aureus subsp. aureus Mu50
ucguuaaggaaagcuu

SEQ ID NO: 3974247 - RNA, 21 nt, Staphylococcus aureus subsp. aureus Mu50
ucguuaaggaaagcuucauau

SEQ ID NO: 3974248 - RNA, 16 nt, Staphylococcus aureus subsp. aureus Mu50
ucguuaauguauaaaa

SEQ ID NO: 3974249 - RNA, 14 nt, Staphylococcus aureus subsp. aureus Mu50
ucguuaauuuccaa

SEQ ID NO: 3974250 - RNA, 18 nt, Staphylococcus aureus subsp. aureus Mu50
ucguuacuaccuauuaau

SEQ ID NO: 3974251 - RNA, 20 nt, Staphylococcus aureus subsp. aureus Mu50
ucguuauaaguacaaauaau

SEQ ID NO: 3974252 - RNA, 14 nt, Staphylococcus aureus subsp. aureus Mu50
ucguuaucuaagau

SEQ ID NO: 3974253 - RNA, 21 nt, Staphylococcus aureus subsp. aureus Mu50
ucguucaagaacaaucaauac

SEQ ID NO: 3974254 - RNA, 16 nt, Staphylococcus aureus subsp. aureus Mu50
ucguucaauuguugau

SEQ ID NO: 3974255 - RNA, 15 nt, Staphylococcus aureus subsp. aureus Mu50
ucguucauauauuuu

SEQ ID NO: 3974256 - RNA, 16 nt, Staphylococcus aureus subsp. aureus Mu50
ucguucccauucuuug

SEQ ID NO: 3974257 - RNA, 20 nt, Staphylococcus aureus subsp. aureus Mu50
ucguucgaaguagcuuguuu

SEQ ID NO: 3974258 - RNA, 14 nt, Staphylococcus aureus subsp. aureus Mu50
ucguucguauauua

SEQ ID NO: 3974259 - RNA, 23 nt, Staphylococcus aureus subsp. aureus Mu50
ucguucucguguaaaaugcaaua

SEQ ID NO: 3974260 - RNA, 15 nt, Staphylococcus aureus subsp. aureus Mu50
ucguucucuuaaaua

SEQ ID NO: 3974261 - RNA, 21 nt, Staphylococcus aureus subsp. aureus Mu50
ucguucucuuaaauaugaaua

SEQ ID NO: 3974262 - RNA, 14 nt, Staphylococcus aureus subsp. aureus Mu50
ucguucuuugauua

SEQ ID NO: 3974263 - RNA, 15 nt, Staphylococcus aureus subsp. aureus Mu50
ucguucuuugauuag

SEQ ID NO: 3974264 - RNA, 18 nt, Staphylococcus aureus subsp. aureus Mu50
ucguugaaaaauauccug

SEQ ID NO: 3974265 - RNA, 17 nt, Staphylococcus aureus subsp. aureus Mu50
ucguugaagauguauuu

SEQ ID NO: 3974266 - RNA, 14 nt, Staphylococcus aureus subsp. aureus Mu50
ucguugaauacuuc

SEQ ID NO: 3974267 - RNA, 17 nt, Staphylococcus aureus subsp. aureus Mu50
ucguuguaaaacuaagu

SEQ ID NO: 3974268 - RNA, 17 nt, Staphylococcus aureus subsp. aureus Mu50
ucguuguucauaaucau

SEQ ID NO: 3974269 - RNA, 17 nt, Staphylococcus aureus subsp. aureus Mu50
ucguuguugaaauuaaa

SEQ ID NO: 3974270 - RNA, 16 nt, Staphylococcus aureus subsp. aureus Mu50
ucguuuuaauaaauug

SEQ ID NO: 3974271 - RNA, 21 nt, Staphylococcus aureus subsp. aureus Mu50
ucguuuugcuaaccaucauaa

SEQ ID NO: 3974272 - RNA, 21 nt, Staphylococcus aureus subsp. aureus Mu50
ucguuuuuucauuguaauaau

SEQ ID NO: 3974273 - RNA, 14 nt, Staphylococcus aureus subsp. aureus Mu50
ucguuuuuuuagcu

SEQ ID NO: 3974274 - RNA, 13 nt, Staphylococcus aureus subsp. aureus Mu50
ucuaaaaacauaa

SEQ ID NO: 3974275 - RNA, 14 nt, Staphylococcus aureus subsp. aureus Mu50
ucuaaaaacauaaa

SEQ ID NO: 3974276 - RNA, 19 nt, Staphylococcus aureus subsp. aureus Mu50
ucuaaaaagcggacugaaa

SEQ ID NO: 3974277 - RNA, 11 nt, Staphylococcus aureus subsp. aureus Mu50
ucuaaaaguug

SEQ ID NO: 3974278 - RNA, 13 nt, Staphylococcus aureus subsp. aureus Mu50
ucuaaaaguugaa

SEQ ID NO: 3974279 - RNA, 17 nt, Staphylococcus aureus subsp. aureus Mu50
ucuaaaaguuguaauuu

SEQ ID NO: 3974280 - RNA, 23 nt, Staphylococcus aureus subsp. aureus Mu50
ucuaaaaguuguaauuuaaaaua

SEQ ID NO: 3974281 - RNA, 19 nt, Staphylococcus aureus subsp. aureus Mu50
ucuaaaccuuuuuuaaguu

SEQ ID NO: 3974282 - RNA, 16 nt, Staphylococcus aureus subsp. aureus Mu50
ucuaaacuauaauaau

SEQ ID NO: 3974283 - RNA, 18 nt, Staphylococcus aureus subsp. aureus Mu50
ucuaaacuucuauuaaua

SEQ ID NO: 3974284 - RNA, 21 nt, Staphylococcus aureus subsp. aureus Mu50
ucuaaacuucuauuaauaauu

SEQ ID NO: 3974285 - RNA, 18 nt, Staphylococcus aureus subsp. aureus Mu50
ucuaaagaaaucucuauc

SEQ ID NO: 3974286 - RNA, 17 nt, Staphylococcus aureus subsp. aureus Mu50
ucuaaagcgauuuccau

SEQ ID NO: 3974287 - RNA, 16 nt, Staphylococcus aureus subsp. aureus Mu50
ucuaaagcuauaaaaa

SEQ ID NO: 3974288 - RNA, 17 nt, Staphylococcus aureus subsp. aureus Mu50
ucuaaagcuauaaaaaa

SEQ ID NO: 3974289 - RNA, 18 nt, Staphylococcus aureus subsp. aureus Mu50
ucuaaagcuauaaaaaau

SEQ ID NO: 3974290 - RNA, 14 nt, Staphylococcus aureus subsp. aureus Mu50
ucuaaauaaaauua

SEQ ID NO: 3974291 - RNA, 18 nt, Staphylococcus aureus subsp. aureus Mu50
ucuaaauaaaauuaaaac

SEQ ID NO: 3974292 - RNA, 19 nt, Staphylococcus aureus subsp. aureus Mu50
ucuaaauaaaauuaaaaca

SEQ ID NO: 3974293 - RNA, 19 nt, Staphylococcus aureus subsp. aureus Mu50
ucuaaauauaauagaaaua

SEQ ID NO: 3974294 - RNA, 12 nt, Staphylococcus aureus subsp. aureus Mu50
ucuaaauauauu

SEQ ID NO: 3974295 - RNA, 14 nt, Staphylococcus aureus subsp. aureus Mu50
ucuaaauauuaaau

SEQ ID NO: 3974296 - RNA, 20 nt, Staphylococcus aureus subsp. aureus Mu50
ucuaaauauuaaauuauugu

SEQ ID NO: 3974297 - RNA, 12 nt, Staphylococcus aureus subsp. aureus Mu50
ucuaaaugauuu

SEQ ID NO: 3974298 - RNA, 18 nt, Staphylococcus aureus subsp. aureus Mu50
ucuaaauuauuuauucau

SEQ ID NO: 3974299 - RNA, 22 nt, Staphylococcus aureus subsp. aureus Mu50
ucuauaccauuccaaaaauugu

SEQ ID NO: 3974300 - RNA, 21 nt, Staphylococcus aureus subsp. aureus Mu50
ucuauagaaaaaguauuacuu

SEQ ID NO: 3974301 - RNA, 14 nt, Staphylococcus aureus subsp. aureus Mu50
ucuauagaauuuuu

SEQ ID NO: 3974302 - RNA, 20 nt, Staphylococcus aureus subsp. aureus Mu50
ucuauagaauuuuucauaua

SEQ ID NO: 3974303 - RNA, 14 nt, Staphylococcus aureus subsp. aureus Mu50
ucuauagguuuaua

SEQ ID NO: 3974304 - RNA, 20 nt, Staphylococcus aureus subsp. aureus Mu50
ucuauagguuuauaaaaaau

SEQ ID NO: 3974305 - RNA, 22 nt, Staphylococcus aureus subsp. aureus Mu50
ucuauauaaaaacuguucauac

SEQ ID NO: 3974306 - RNA, 14 nt, Staphylococcus aureus subsp. aureus Mu50
ucuauauaauuuau

SEQ ID NO: 3974307 - RNA, 16 nt, Staphylococcus aureus subsp. aureus Mu50
ucuauauaauuuauuu

SEQ ID NO: 3974308 - RNA, 19 nt, Staphylococcus aureus subsp. aureus Mu50
ucuauauaguaaaauaaau

SEQ ID NO: 3974309 - RNA, 12 nt, Staphylococcus aureus subsp. aureus Mu50
ucuauaugcaua

SEQ ID NO: 3974310 - RNA, 16 nt, Staphylococcus aureus subsp. aureus Mu50
ucuauaugcauauauu

SEQ ID NO: 3974311 - RNA, 16 nt, Staphylococcus aureus subsp. aureus Mu50
ucuauauuaauagaaa

SEQ ID NO: 3974312 - RNA, 13 nt, Staphylococcus aureus subsp. aureus Mu50
ucuauauuuaauu

SEQ ID NO: 3974313 - RNA, 18 nt, Staphylococcus aureus subsp. aureus Mu50
ucuauauuuaauuuugau

SEQ ID NO: 3974314 - RNA, 12 nt, Staphylococcus aureus subsp. aureus Mu50
ucuaucaaauua

SEQ ID NO: 3974315 - RNA, 19 nt, Staphylococcus aureus subsp. aureus Mu50
ucuaucaguaugaaguugc

SEQ ID NO: 3974316 - RNA, 14 nt, Staphylococcus aureus subsp. aureus Mu50
ucuaucgccuaaaa

SEQ ID NO: 3974317 - RNA, 16 nt, Staphylococcus aureus subsp. aureus Mu50
ucuaucgccuaaaaau

SEQ ID NO: 3974318 - RNA, 21 nt, Staphylococcus aureus subsp. aureus Mu50
ucuaucgccuaaaaauaaaau

SEQ ID NO: 3974319 - RNA, 19 nt, Staphylococcus aureus subsp. aureus Mu50
ucuaucuacucaaauauaa

SEQ ID NO: 3974320 - RNA, 17 nt, Staphylococcus aureus subsp. aureus Mu50
ucuaucuauaaacguca

SEQ ID NO: 3974321 - RNA, 22 nt, Staphylococcus aureus subsp. aureus Mu50
ucuaucuauaaacgucacuuua

SEQ ID NO: 3974322 - RNA, 21 nt, Staphylococcus aureus subsp. aureus Mu50
ucuaucuccgcuacaauuaua

SEQ ID NO: 3974323 - RNA, 18 nt, Staphylococcus aureus subsp. aureus Mu50
ucuaucuucacacuuuua

SEQ ID NO: 3974324 - RNA, 13 nt, Staphylococcus aureus subsp. aureus Mu50
ucuaugauuguau

SEQ ID NO: 3974325 - RNA, 16 nt, Staphylococcus aureus subsp. aureus Mu50
ucuauggaaaauguua

SEQ ID NO: 3974326 - RNA, 20 nt, Staphylococcus aureus subsp. aureus Mu50
ucuauggcuucgcuaauaau

SEQ ID NO: 3974327 - RNA, 14 nt, Staphylococcus aureus subsp. aureus Mu50
ucuaugucaaauug

SEQ ID NO: 3974328 - RNA, 16 nt, Staphylococcus aureus subsp. aureus Mu50
ucuaugucaaauugaa

SEQ ID NO: 3974329 - RNA, 13 nt, Staphylococcus aureus subsp. aureus Mu50
ucuauuaauaauu

SEQ ID NO: 3974330 - RNA, 14 nt, Staphylococcus aureus subsp. aureus Mu50
ucuauuaaugcucu

SEQ ID NO: 3974331 - RNA, 13 nt, Staphylococcus aureus subsp. aureus Mu50
ucuauuaauuuac

SEQ ID NO: 3974332 - RNA, 17 nt, Staphylococcus aureus subsp. aureus Mu50
ucuauugcaauauaguu

SEQ ID NO: 3974333 - RNA, 21 nt, Staphylococcus aureus subsp. aureus Mu50
ucuauugugauauaugaaaua

SEQ ID NO: 3974334 - RNA, 16 nt, Staphylococcus aureus subsp. aureus Mu50
ucuauuuaauaaugua

SEQ ID NO: 3974335 - RNA, 22 nt, Staphylococcus aureus subsp. aureus Mu50
ucuauuuagcuugcuuacaaua

SEQ ID NO: 3974336 - RNA, 15 nt, Staphylococcus aureus subsp. aureus Mu50
ucuauuuauaacacu

SEQ ID NO: 3974337 - RNA, 19 nt, Staphylococcus aureus subsp. aureus Mu50
ucuauuuaucauacuucaa

SEQ ID NO: 3974338 - RNA, 22 nt, Staphylococcus aureus subsp. aureus Mu50
ucuauuucacucuacaauccua

SEQ ID NO: 3974339 - RNA, 16 nt, Staphylococcus aureus subsp. aureus Mu50
ucuauuugauaagaaa

SEQ ID NO: 3974340 - RNA, 19 nt, Staphylococcus aureus subsp. aureus Mu50
ucuauuuuauaauaaauuu

SEQ ID NO: 3974341 - RNA, 12 nt, Staphylococcus aureus subsp. aureus Mu50
ucuauuuuauga

SEQ ID NO: 3974342 - RNA, 19 nt, Staphylococcus aureus subsp. aureus Mu50
ucuauuuuaugauuugauu

SEQ ID NO: 3974343 - RNA, 14 nt, Staphylococcus aureus subsp. aureus Mu50
ucucaacgauaaga

SEQ ID NO: 3974344 - RNA, 18 nt, Staphylococcus aureus subsp. aureus Mu50
ucucaaugugagauauaa

SEQ ID NO: 3974345 - RNA, 23 nt, Staphylococcus aureus subsp. aureus Mu50
ucucaccagcucguuuuuucauu

SEQ ID NO: 3974346 - RNA, 21 nt, Staphylococcus aureus subsp. aureus Mu50
ucucagcaauacuaacugaag

SEQ ID NO: 3974347 - RNA, 13 nt, Staphylococcus aureus subsp. aureus Mu50
ucucauaauaauu

SEQ ID NO: 3974348 - RNA, 17 nt, Staphylococcus aureus subsp. aureus Mu50
ucucauagucaucuuag

SEQ ID NO: 3974349 - RNA, 17 nt, Staphylococcus aureus subsp. aureus Mu50
ucucaucgaauucauuu

SEQ ID NO: 3974350 - RNA, 20 nt, Staphylococcus aureus subsp. aureus Mu50
ucucaucuauuuaauaaugu

SEQ ID NO: 3974351 - RNA, 13 nt, Staphylococcus aureus subsp. aureus Mu50
ucucaucuucuaa

SEQ ID NO: 3974352 - RNA, 18 nt, Staphylococcus aureus subsp. aureus Mu50
ucucaucuucuaaaucaa

SEQ ID NO: 3974353 - RNA, 19 nt, Staphylococcus aureus subsp. aureus Mu50
ucucaucuucuaaaucaau

SEQ ID NO: 3974354 - RNA, 14 nt, Staphylococcus aureus subsp. aureus Mu50
ucucauuauaauga

SEQ ID NO: 3974355 - RNA, 21 nt, Staphylococcus aureus subsp. aureus Mu50
ucucauucuuuaauauaaauu

SEQ ID NO: 3974356 - RNA, 18 nt, Staphylococcus aureus subsp. aureus Mu50
ucucauugaaaucgucuu

SEQ ID NO: 3974357 - RNA, 18 nt, Staphylococcus aureus subsp. aureus Mu50
ucuccacacuaaauguuc

SEQ ID NO: 3974358 - RNA, 16 nt, Staphylococcus aureus subsp. aureus Mu50
ucuccaccauuaauag

SEQ ID NO: 3974359 - RNA, 22 nt, Staphylococcus aureus subsp. aureus Mu50
ucuccaguggaaaugauaauuu

SEQ ID NO: 3974360 - RNA, 14 nt, Staphylococcus aureus subsp. aureus Mu50
ucuccaguuuucaa

SEQ ID NO: 3974361 - RNA, 22 nt, Staphylococcus aureus subsp. aureus Mu50
ucucccuuaaauacaauuucuu

SEQ ID NO: 3974362 - RNA, 13 nt, Staphylococcus aureus subsp. aureus Mu50
ucuccuaauaauu

SEQ ID NO: 3974363 - RNA, 20 nt, Staphylococcus aureus subsp. aureus Mu50
ucuccuugcucaugagcaca

SEQ ID NO: 3974364 - RNA, 23 nt, Staphylococcus aureus subsp. aureus Mu50
ucucgcauacugucaucuuucaa

SEQ ID NO: 3974365 - RNA, 12 nt, Staphylococcus aureus subsp. aureus Mu50
ucucggcauuuu

SEQ ID NO: 3974366 - RNA, 13 nt, Staphylococcus aureus subsp. aureus Mu50
ucucguaaauugu

SEQ ID NO: 3974367 - RNA, 14 nt, Staphylococcus aureus subsp. aureus Mu50
ucucguaauaaugu

SEQ ID NO: 3974368 - RNA, 22 nt, Staphylococcus aureus subsp. aureus Mu50
ucucgucacauauaaauauuuu

SEQ ID NO: 3974369 - RNA, 14 nt, Staphylococcus aureus subsp. aureus Mu50
ucucgucuuucguc

SEQ ID NO: 3974370 - RNA, 15 nt, Staphylococcus aureus subsp. aureus Mu50
ucucgugaaaauaau

SEQ ID NO: 3974371 - RNA, 16 nt, Staphylococcus aureus subsp. aureus Mu50
ucucgugaaaauaaua

SEQ ID NO: 3974372 - RNA, 20 nt, Staphylococcus aureus subsp. aureus Mu50
ucucgugaaaauaauacuac

SEQ ID NO: 3974373 - RNA, 23 nt, Staphylococcus aureus subsp. aureus Mu50
ucucuaaaaagcggacugaaaga

SEQ ID NO: 3974374 - RNA, 17 nt, Staphylococcus aureus subsp. aureus Mu50
ucucuaaaacuuuuuca

SEQ ID NO: 3974375 - RNA, 19 nt, Staphylococcus aureus subsp. aureus Mu50
ucucuaaaacuuuuucaau

SEQ ID NO: 3974376 - RNA, 21 nt, Staphylococcus aureus subsp. aureus Mu50
ucucuaacgauuucuaguuua

SEQ ID NO: 3974377 - RNA, 18 nt, Staphylococcus aureus subsp. aureus Mu50
ucucuagugcuuugucuu

SEQ ID NO: 3974378 - RNA, 19 nt, Staphylococcus aureus subsp. aureus Mu50
ucucugcuuuaauauaauu

SEQ ID NO: 3974379 - RNA, 15 nt, Staphylococcus aureus subsp. aureus Mu50
ucucuguagauauca

SEQ ID NO: 3974380 - RNA, 12 nt, Staphylococcus aureus subsp. aureus Mu50
ucucuucuggag

SEQ ID NO: 3974381 - RNA, 18 nt, Staphylococcus aureus subsp. aureus Mu50
ucucuuuacaccauugca

SEQ ID NO: 3974382 - RNA, 21 nt, Staphylococcus aureus subsp. aureus Mu50
ucucuuuguuggggcccacac

SEQ ID NO: 3974383 - RNA, 16 nt, Staphylococcus aureus subsp. aureus Mu50
ucucuuuugauaaauu

SEQ ID NO: 3974384 - RNA, 18 nt, Staphylococcus aureus subsp. aureus Mu50
ucugaaaaaauuaauaau

SEQ ID NO: 3974385 - RNA, 16 nt, Staphylococcus aureus subsp. aureus Mu50
ucugaaaaacuucuua

SEQ ID NO: 3974386 - RNA, 17 nt, Staphylococcus aureus subsp. aureus Mu50
ucugaaaaacuucuuaa

SEQ ID NO: 3974387 - RNA, 22 nt, Staphylococcus aureus subsp. aureus Mu50
ucuuacuacuuaauuaauaauu

SEQ ID NO: 3974388 - RNA, 23 nt, Staphylococcus aureus subsp. aureus Mu50
ucuuacuacuuaauuaauaauuu

SEQ ID NO: 3974389 - RNA, 21 nt, Staphylococcus aureus subsp. aureus Mu50
ucuuacugcugcuuuuaauau

SEQ ID NO: 3974390 - RNA, 19 nt, Staphylococcus aureus subsp. aureus Mu50
ucuuacugcuguuuuuuau

SEQ ID NO: 3974391 - RNA, 20 nt, Staphylococcus aureus subsp. aureus Mu50
ucuuacuucguacaucguug

SEQ ID NO: 3974392 - RNA, 16 nt, Staphylococcus aureus subsp. aureus Mu50
ucuuacuuuuaaauua

SEQ ID NO: 3974393 - RNA, 16 nt, Staphylococcus aureus subsp. aureus Mu50
ucuuagacauuguaaa

SEQ ID NO: 3974394 - RNA, 14 nt, Staphylococcus aureus subsp. aureus Mu50
ucuuagauauuauu

SEQ ID NO: 3974395 - RNA, 22 nt, Staphylococcus aureus subsp. aureus Mu50
ucuuagauuuuauauaaaaaga

SEQ ID NO: 3974396 - RNA, 20 nt, Staphylococcus aureus subsp. aureus Mu50
ucuuagauuuucacuaauau

SEQ ID NO: 3974397 - RNA, 18 nt, Staphylococcus aureus subsp. aureus Mu50
ucuuaguaagacugccau

SEQ ID NO: 3974398 - RNA, 17 nt, Staphylococcus aureus subsp. aureus Mu50
ucuuaguuugacaucua

SEQ ID NO: 3974399 - RNA, 22 nt, Staphylococcus aureus subsp. aureus Mu50
ucuuauaaagacaccuucaaua

SEQ ID NO: 3974400 - RNA, 13 nt, Staphylococcus aureus subsp. aureus Mu50
ucuuauaacaaaa

SEQ ID NO: 3974401 - RNA, 20 nt, Staphylococcus aureus subsp. aureus Mu50
ucuuauaaguucaaccauau

SEQ ID NO: 3974402 - RNA, 13 nt, Staphylococcus aureus subsp. aureus Mu50
ucuuaucaacaac

SEQ ID NO: 3974403 - RNA, 17 nt, Staphylococcus aureus subsp. aureus Mu50
ucuuaucaagaauauaa

SEQ ID NO: 3974404 - RNA, 21 nt, Staphylococcus aureus subsp. aureus Mu50
ucuuaucaagaauauaacgaa

SEQ ID NO: 3974405 - RNA, 16 nt, Staphylococcus aureus subsp. aureus Mu50
ucuuaucaauuagcca

SEQ ID NO: 3974406 - RNA, 20 nt, Staphylococcus aureus subsp. aureus Mu50
ucuuaucaguuugcacuuca

SEQ ID NO: 3974407 - RNA, 22 nt, Staphylococcus aureus subsp. aureus Mu50
ucuuaucauaaucuucaguaua

SEQ ID NO: 3974408 - RNA, 14 nt, Staphylococcus aureus subsp. aureus Mu50
ucuuaucuuuuuac

SEQ ID NO: 3974409 - RNA, 15 nt, Staphylococcus aureus subsp. aureus Mu50
ucuuauguauaucuu

SEQ ID NO: 3974410 - RNA, 13 nt, Staphylococcus aureus subsp. aureus Mu50
ucuuauuauuaau

SEQ ID NO: 3974411 - RNA, 15 nt, Staphylococcus aureus subsp. aureus Mu50
ucuuauuuauucaua

SEQ ID NO: 3974412 - RNA, 19 nt, Staphylococcus aureus subsp. aureus Mu50
ucuuauuuguuuaauuauc

SEQ ID NO: 3974413 - RNA, 18 nt, Staphylococcus aureus subsp. aureus Mu50
ucuuauuuuguuuuaaaa

SEQ ID NO: 3974414 - RNA, 14 nt, Staphylococcus aureus subsp. aureus Mu50
ucuucaaaaaauaa

SEQ ID NO: 3974415 - RNA, 14 nt, Staphylococcus aureus subsp. aureus Mu50
ucuucaaaacguuu

SEQ ID NO: 3974416 - RNA, 21 nt, Staphylococcus aureus subsp. aureus Mu50
ucuucaaaguagauauugaau

SEQ ID NO: 3974417 - RNA, 20 nt, Staphylococcus aureus subsp. aureus Mu50
ucuucaacauaacucaaaua

SEQ ID NO: 3974418 - RNA, 13 nt, Staphylococcus aureus subsp. aureus Mu50
ucuucaauauuua

SEQ ID NO: 3974419 - RNA, 17 nt, Staphylococcus aureus subsp. aureus Mu50
ucuucaaucuaccaaua

SEQ ID NO: 3974420 - RNA, 18 nt, Staphylococcus aureus subsp. aureus Mu50
ucuucaaucuaccaauac

SEQ ID NO: 3974421 - RNA, 22 nt, Staphylococcus aureus subsp. aureus Mu50
ucuucaauucuuacaccugcaa

SEQ ID NO: 3974422 - RNA, 13 nt, Staphylococcus aureus subsp. aureus Mu50
ucuucaauugucu

SEQ ID NO: 3974423 - RNA, 14 nt, Staphylococcus aureus subsp. aureus Mu50
ucuucaauuuauuu

SEQ ID NO: 3974424 - RNA, 18 nt, Staphylococcus aureus subsp. aureus Mu50
ucuucaauuucauuuuug

SEQ ID NO: 3974425 - RNA, 18 nt, Staphylococcus aureus subsp. aureus Mu50
ucuucaccaguuuguggu

SEQ ID NO: 3974426 - RNA, 13 nt, Staphylococcus aureus subsp. aureus Mu50
ucuucaccaucug

SEQ ID NO: 3974427 - RNA, 16 nt, Staphylococcus aureus subsp. aureus Mu50
ucuucagguguaguag

SEQ ID NO: 3974428 - RNA, 19 nt, Staphylococcus aureus subsp. aureus Mu50
ucuucagguguuuuaccuu

SEQ ID NO: 3974429 - RNA, 16 nt, Staphylococcus aureus subsp. aureus Mu50
ucuucaguaauuucuc

SEQ ID NO: 3974430 - RNA, 13 nt, Staphylococcus aureus subsp. aureus Mu50
ucuucaguuauuu

SEQ ID NO: 3974431 - RNA, 16 nt, Staphylococcus aureus subsp. aureus Mu50
ucuucaucuucuucaa

SEQ ID NO: 3974432 - RNA, 12 nt, Staphylococcus aureus subsp. aureus Mu50
ucuucaucuuua

SEQ ID NO: 3974433 - RNA, 18 nt, Staphylococcus aureus subsp. aureus Mu50
ucuucggcuuuguaaaau

SEQ ID NO: 3974434 - RNA, 13 nt, Staphylococcus aureus subsp. aureus Mu50
ucuucgucaaauu

SEQ ID NO: 3974435 - RNA, 13 nt, Staphylococcus aureus subsp. aureus Mu50
ucuucguuuuaau

SEQ ID NO: 3974436 - RNA, 13 nt, Staphylococcus aureus subsp. aureus Mu50
ucuucuaaaaaau

SEQ ID NO: 3974437 - RNA, 16 nt, Staphylococcus aureus subsp. aureus Mu50
ucuucuaaaucaauau

SEQ ID NO: 3974438 - RNA, 17 nt, Staphylococcus aureus subsp. aureus Mu50
ucuucuaauucugaaau

SEQ ID NO: 3974439 - RNA, 14 nt, Staphylococcus aureus subsp. aureus Mu50
ucuucuaucuuuuc

SEQ ID NO: 3974440 - RNA, 22 nt, Staphylococcus aureus subsp. aureus Mu50
ucuucucaacaaaucuauaaau

SEQ ID NO: 3974441 - RNA, 15 nt, Staphylococcus aureus subsp. aureus Mu50
ucuucucgcauacug

SEQ ID NO: 3974442 - RNA, 19 nt, Staphylococcus aureus subsp. aureus Mu50
ucuucucuaaucacuuggc

SEQ ID NO: 3974443 - RNA, 17 nt, Staphylococcus aureus subsp. aureus Mu50
ucuucugaauuuaauag

SEQ ID NO: 3974444 - RNA, 18 nt, Staphylococcus aureus subsp. aureus Mu50
ucuucugaauuuaauagg

SEQ ID NO: 3974445 - RNA, 14 nt, Staphylococcus aureus subsp. aureus Mu50
ucuucuucagaaau

SEQ ID NO: 3974446 - RNA, 22 nt, Staphylococcus aureus subsp. aureus Mu50
ucuucuuucauaguuauuaaau

SEQ ID NO: 3974447 - RNA, 12 nt, Staphylococcus aureus subsp. aureus Mu50
ucuucuuuuaau

SEQ ID NO: 3974448 - RNA, 19 nt, Staphylococcus aureus subsp. aureus Mu50
ucuucuuuuuguccccagc

SEQ ID NO: 3974449 - RNA, 15 nt, Staphylococcus aureus subsp. aureus Mu50
ucuucuuuuuuuaac

SEQ ID NO: 3974450 - RNA, 15 nt, Staphylococcus aureus subsp. aureus Mu50
ucuucuuuuuuucuc

SEQ ID NO: 3974451 - RNA, 16 nt, Staphylococcus aureus subsp. aureus Mu50
ucuucuuuuuuucucc

SEQ ID NO: 3974452 - RNA, 22 nt, Staphylococcus aureus subsp. aureus Mu50
ucuugaaauccguuaaaauuuu

SEQ ID NO: 3974453 - RNA, 15 nt, Staphylococcus aureus subsp. aureus Mu50
ucuugaauaaauuuu

SEQ ID NO: 3974454 - RNA, 15 nt, Staphylococcus aureus subsp. aureus Mu50
ucuugaugaauuaaa

SEQ ID NO: 3974455 - RNA, 15 nt, Staphylococcus aureus subsp. aureus Mu50
ucuugauuauauuuu

SEQ ID NO: 3974456 - RNA, 19 nt, Staphylococcus aureus subsp. aureus Mu50
ucuugauuauauuuuucuu

SEQ ID NO: 3974457 - RNA, 21 nt, Staphylococcus aureus subsp. aureus Mu50
ucuugauuauauuuuucuuca

SEQ ID NO: 3974458 - RNA, 20 nt, Staphylococcus aureus subsp. aureus Mu50
ucuugcauacgaauuaaaau

SEQ ID NO: 3974459 - RNA, 22 nt, Staphylococcus aureus subsp. aureus Mu50
ucuugcgccuuguucaauucag

SEQ ID NO: 3974460 - RNA, 13 nt, Staphylococcus aureus subsp. aureus Mu50
ucuuggacuaaua

SEQ ID NO: 3974461 - RNA, 17 nt, Staphylococcus aureus subsp. aureus Mu50
ucuuggccaauuaacuu

SEQ ID NO: 3974462 - RNA, 13 nt, Staphylococcus aureus subsp. aureus Mu50
ucuugguuuuuua

SEQ ID NO: 3974463 - RNA, 15 nt, Staphylococcus aureus subsp. aureus Mu50
ucuuguaaacuucuu

SEQ ID NO: 3974464 - RNA, 19 nt, Staphylococcus aureus subsp. aureus Mu50
ucuuguaaacuucuuuucu

SEQ ID NO: 3974465 - RNA, 12 nt, Staphylococcus aureus subsp. aureus Mu50
ucuuguaauguu

SEQ ID NO: 3974466 - RNA, 14 nt, Staphylococcus aureus subsp. aureus Mu50
ucuuguauuuccuu

SEQ ID NO: 3974467 - RNA, 22 nt, Staphylococcus aureus subsp. aureus Mu50
ucuugucauuugaacaucauuu

SEQ ID NO: 3974468 - RNA, 15 nt, Staphylococcus aureus subsp. aureus Mu50
ucuuguguuucagcu

SEQ ID NO: 3974469 - RNA, 12 nt, Staphylococcus aureus subsp. aureus Mu50
ucuuguucuaaa

SEQ ID NO: 3974470 - RNA, 13 nt, Staphylococcus aureus subsp. aureus Mu50
ucuuguucuaaaa

SEQ ID NO: 3974471 - RNA, 14 nt, Staphylococcus aureus subsp. aureus Mu50
ucuuguucuaaaau

SEQ ID NO: 3974472 - RNA, 21 nt, Staphylococcus aureus subsp. aureus Mu50
ucuuguuuagggaaucccaua

SEQ ID NO: 3974473 - RNA, 17 nt, Staphylococcus aureus subsp. aureus Mu50
ucuuguuucaaacaaag

SEQ ID NO: 3974474 - RNA, 19 nt, Staphylococcus aureus subsp. aureus Mu50
ucuuuaaagaaaauuucag

SEQ ID NO: 3974475 - RNA, 13 nt, Staphylococcus aureus subsp. aureus Mu50
ucuuuuuauuuau

SEQ ID NO: 3974476 - RNA, 22 nt, Staphylococcus aureus subsp. aureus Mu50
ucuuuuuauuuauaacuuuaaa

SEQ ID NO: 3974477 - RNA, 13 nt, Staphylococcus aureus subsp. aureus Mu50
ucuuuuucuaaau

SEQ ID NO: 3974478 - RNA, 15 nt, Staphylococcus aureus subsp. aureus Mu50
ucuuuuucuaaauaa

SEQ ID NO: 3974479 - RNA, 17 nt, Staphylococcus aureus subsp. aureus Mu50
ucuuuuucuaaauaaac

SEQ ID NO: 3974480 - RNA, 16 nt, Staphylococcus aureus subsp. aureus Mu50
ucuuuuucuauacaau

SEQ ID NO: 3974481 - RNA, 15 nt, Staphylococcus aureus subsp. aureus Mu50
ucuuuuucuugcaua

SEQ ID NO: 3974482 - RNA, 21 nt, Staphylococcus aureus subsp. aureus Mu50
ucuuuuugauaauguucccuu

SEQ ID NO: 3974483 - RNA, 19 nt, Staphylococcus aureus subsp. aureus Mu50
ucuuuuugauuauauuuau

SEQ ID NO: 3974484 - RNA, 20 nt, Staphylococcus aureus subsp. aureus Mu50
ucuuuuugauuauauuuauu

SEQ ID NO: 3974485 - RNA, 15 nt, Staphylococcus aureus subsp. aureus Mu50
ucuuuuuguuuaucu

SEQ ID NO: 3974486 - RNA, 23 nt, Staphylococcus aureus subsp. aureus Mu50
ucuuuuuuaagcuuaucaacgau

SEQ ID NO: 3974487 - RNA, 18 nt, Staphylococcus aureus subsp. aureus Mu50
ucuuuuuuacuaaaauca

SEQ ID NO: 3974488 - RNA, 12 nt, Staphylococcus aureus subsp. aureus Mu50
ucuuuuuuauua

SEQ ID NO: 3974489 - RNA, 17 nt, Staphylococcus aureus subsp. aureus Mu50
ucuuuuuuauuuaauua

SEQ ID NO: 3974490 - RNA, 19 nt, Staphylococcus aureus subsp. aureus Mu50
ucuuuuuuauuuaauuauu

SEQ ID NO: 3974491 - RNA, 18 nt, Staphylococcus aureus subsp. aureus Mu50
ucuuuuuugcuguauaua

SEQ ID NO: 3974492 - RNA, 23 nt, Staphylococcus aureus subsp. aureus Mu50
ucuuuuuuuaacuuccuaaaauu

SEQ ID NO: 3974493 - RNA, 13 nt, Staphylococcus aureus subsp. aureus Mu50
ucuuuuuuuaaug

SEQ ID NO: 3974494 - RNA, 22 nt, Staphylococcus aureus subsp. aureus Mu50
ucuuuuuuuaauguguaaauuu

SEQ ID NO: 3974495 - RNA, 14 nt, Staphylococcus aureus subsp. aureus Mu50
ugaaaaaauaacug

SEQ ID NO: 3974496 - RNA, 17 nt, Staphylococcus aureus subsp. aureus Mu50
ugaaaaagauucggaaa

SEQ ID NO: 3974497 - RNA, 12 nt, Staphylococcus aureus subsp. aureus Mu50
ugaaaaaguaaa

SEQ ID NO: 3974498 - RNA, 23 nt, Staphylococcus aureus subsp. aureus Mu50
ugaaaaauauccuggaauauuaa

SEQ ID NO: 3974499 - RNA, 15 nt, Staphylococcus aureus subsp. aureus Mu50
ugaaaaauuaaaaaa

SEQ ID NO: 3974500 - RNA, 14 nt, Staphylococcus aureus subsp. aureus Mu50
ugaaaacauuauua

SEQ ID NO: 3974501 - RNA, 20 nt, Staphylococcus aureus subsp. aureus Mu50
ugaaaaccucuuuuuguugu

SEQ ID NO: 3974502 - RNA, 11 nt, Staphylococcus aureus subsp. aureus Mu50
ugaaaacuucu

SEQ ID NO: 3974503 - RNA, 19 nt, Staphylococcus aureus subsp. aureus Mu50
ugaaaagaacacgauauuc

SEQ ID NO: 3974504 - RNA, 13 nt, Staphylococcus aureus subsp. aureus Mu50
ugaaaagauaaac

SEQ ID NO: 3974505 - RNA, 20 nt, Staphylococcus aureus subsp. aureus Mu50
ugaaaaggacuuaguagauu

SEQ ID NO: 3974506 - RNA, 15 nt, Staphylococcus aureus subsp. aureus Mu50
ugaaaaguaaauuga

SEQ ID NO: 3974507 - RNA, 11 nt, Staphylococcus aureus subsp. aureus Mu50
ugaaaaguuga

SEQ ID NO: 3974508 - RNA, 18 nt, Staphylococcus aureus subsp. aureus Mu50
ugaaaaguugauugccau

SEQ ID NO: 3974509 - RNA, 20 nt, Staphylococcus aureus subsp. aureus Mu50
ugaaaaguugauugccauau

SEQ ID NO: 3974510 - RNA, 23 nt, Staphylococcus aureus subsp. aureus Mu50
ugaaaauaagcuuguaacaagca

SEQ ID NO: 3974511 - RNA, 18 nt, Staphylococcus aureus subsp. aureus Mu50
ugaaaauaauacuacaua

SEQ ID NO: 3974512 - RNA, 19 nt, Staphylococcus aureus subsp. aureus Mu50
ugaaaauaaucgaacagaa

SEQ ID NO: 3974513 - RNA, 18 nt, Staphylococcus aureus subsp. aureus Mu50
ugaaaauaccaagugcuu

SEQ ID NO: 3974514 - RNA, 18 nt, Staphylococcus aureus subsp. aureus Mu50
ugaaaauaccucuacauu

SEQ ID NO: 3974515 - RNA, 23 nt, Staphylococcus aureus subsp. aureus Mu50
ugaaaaucuaauccugguauaau

SEQ ID NO: 3974516 - RNA, 17 nt, Staphylococcus aureus subsp. aureus Mu50
ugaaaaugacgugcuuu

SEQ ID NO: 3974517 - RNA, 22 nt, Staphylococcus aureus subsp. aureus Mu50
ugaaaauuuaaugcguugaugu

SEQ ID NO: 3974518 - RNA, 22 nt, Staphylococcus aureus subsp. aureus Mu50
ugaaaauuucaccgcuuucaau

SEQ ID NO: 3974519 - RNA, 14 nt, Staphylococcus aureus subsp. aureus Mu50
ugaaacaucuugau

SEQ ID NO: 3974520 - RNA, 20 nt, Staphylococcus aureus subsp. aureus Mu50
ugaaacaucuugauauucau

SEQ ID NO: 3974521 - RNA, 14 nt, Staphylococcus aureus subsp. aureus Mu50
ugaaaccauacuaa

SEQ ID NO: 3974522 - RNA, 15 nt, Staphylococcus aureus subsp. aureus Mu50
ugaaaccguauuauu

SEQ ID NO: 3974523 - RNA, 22 nt, Staphylococcus aureus subsp. aureus Mu50
ugaaaccuuugguucaaucauu

SEQ ID NO: 3974524 - RNA, 21 nt, Staphylococcus aureus subsp. aureus Mu50
ugaaacgccucaacacuuucu

SEQ ID NO: 3974525 - RNA, 14 nt, Staphylococcus aureus subsp. aureus Mu50
ugaaacuaaauuaa

SEQ ID NO: 3974526 - RNA, 19 nt, Staphylococcus aureus subsp. aureus Mu50
ugaaacuaaauuaaaagug

SEQ ID NO: 3974527 - RNA, 13 nt, Staphylococcus aureus subsp. aureus Mu50
ugaaacuaauaau

SEQ ID NO: 3974528 - RNA, 13 nt, Staphylococcus aureus subsp. aureus Mu50
ugaaacuuuaaua

SEQ ID NO: 3974529 - RNA, 16 nt, Staphylococcus aureus subsp. aureus Mu50
ugaaacuuuaauacua

SEQ ID NO: 3974530 - RNA, 20 nt, Staphylococcus aureus subsp. aureus Mu50
ugaaagacugacuaauaaaa

SEQ ID NO: 3974531 - RNA, 14 nt, Staphylococcus aureus subsp. aureus Mu50
ugaaagauacugcu

SEQ ID NO: 3974532 - RNA, 21 nt, Staphylococcus aureus subsp. aureus Mu50
ugaaagcaucuugcaagccau

SEQ ID NO: 3974533 - RNA, 14 nt, Staphylococcus aureus subsp. aureus Mu50
ugaaaguaccuaaa

SEQ ID NO: 3974534 - RNA, 18 nt, Staphylococcus aureus subsp. aureus Mu50
ugaaaguaccuaaaauag

SEQ ID NO: 3974535 - RNA, 22 nt, Staphylococcus aureus subsp. aureus Mu50
ugaaaguacuuggaaaauacua

SEQ ID NO: 3974536 - RNA, 20 nt, Staphylococcus aureus subsp. aureus Mu50
ugaaagucaacaauugcuaa

SEQ ID NO: 3974537 - RNA, 19 nt, Staphylococcus aureus subsp. aureus Mu50
ugaaauaauauaaaaacaa

SEQ ID NO: 3974538 - RNA, 22 nt, Staphylococcus aureus subsp. aureus Mu50
ugaaauaggcgcuuguaaaauu

SEQ ID NO: 3974539 - RNA, 20 nt, Staphylococcus aureus subsp. aureus Mu50
ugaaauauaccaaccaaaac

SEQ ID NO: 3974540 - RNA, 14 nt, Staphylococcus aureus subsp. aureus Mu50
ugaaauauucuuua

SEQ ID NO: 3974541 - RNA, 19 nt, Staphylococcus aureus subsp. aureus Mu50
ugaaauauuuaucuuuaga

SEQ ID NO: 3974542 - RNA, 17 nt, Staphylococcus aureus subsp. aureus Mu50
ugaaaucauuuaaauua

SEQ ID NO: 3974543 - RNA, 17 nt, Staphylococcus aureus subsp. aureus Mu50
ugaaaucgauacuaaua

SEQ ID NO: 3974544 - RNA, 20 nt, Staphylococcus aureus subsp. aureus Mu50
ugaaaucuauugugauauau

SEQ ID NO: 3974545 - RNA, 22 nt, Staphylococcus aureus subsp. aureus Mu50
ugaaaugaaguauggaaguugu

SEQ ID NO: 3974546 - RNA, 13 nt, Staphylococcus aureus subsp. aureus Mu50
ugaaaugauacau

SEQ ID NO: 3974547 - RNA, 14 nt, Staphylococcus aureus subsp. aureus Mu50
ugaaaugauacauu

SEQ ID NO: 3974548 - RNA, 22 nt, Staphylococcus aureus subsp. aureus Mu50
ugaaaugauacauuauuaaaua

SEQ ID NO: 3974549 - RNA, 15 nt, Staphylococcus aureus subsp. aureus Mu50
ugaaauggaaaguaa

SEQ ID NO: 3974550 - RNA, 23 nt, Staphylococcus aureus subsp. aureus Mu50
ugaaauggaaaguaauaaguaau

SEQ ID NO: 3974551 - RNA, 20 nt, Staphylococcus aureus subsp. aureus Mu50
ugaaauguucccuucaaagu

SEQ ID NO: 3974552 - RNA, 12 nt, Staphylococcus aureus subsp. aureus Mu50
ugaaauguuuaa

SEQ ID NO: 3974553 - RNA, 16 nt, Staphylococcus aureus subsp. aureus Mu50
ugaaauuaaauucaaa

SEQ ID NO: 3974554 - RNA, 16 nt, Staphylococcus aureus subsp. aureus Mu50
ugaaauuagaaaaaua

SEQ ID NO: 3974555 - RNA, 19 nt, Staphylococcus aureus subsp. aureus Mu50
ugaaauuagaaaaauauga

SEQ ID NO: 3974556 - RNA, 17 nt, Staphylococcus aureus subsp. aureus Mu50
ugaaauuauuauuuaaa

SEQ ID NO: 3974557 - RNA, 21 nt, Staphylococcus aureus subsp. aureus Mu50
ugaaauuauuauuuaaauuuu

SEQ ID NO: 3974558 - RNA, 22 nt, Staphylococcus aureus subsp. aureus Mu50
ugaaauuauuauuuaaauuuuc

SEQ ID NO: 3974559 - RNA, 23 nt, Staphylococcus aureus subsp. aureus Mu50
ugaaauucgaacuaucaauauaa

SEQ ID NO: 3974560 - RNA, 14 nt, Staphylococcus aureus subsp. aureus Mu50
ugaaauucuuuugu

SEQ ID NO: 3974561 - RNA, 15 nt, Staphylococcus aureus subsp. aureus Mu50
ugaaauucuuuugua

SEQ ID NO: 3974562 - RNA, 21 nt, Staphylococcus aureus subsp. aureus Mu50
ugaaucuaaacuauaauaauu

SEQ ID NO: 3974563 - RNA, 16 nt, Staphylococcus aureus subsp. aureus Mu50
ugaaucuagaauauaa

SEQ ID NO: 3974564 - RNA, 19 nt, Staphylococcus aureus subsp. aureus Mu50
ugaaucuagaauauaacaa

SEQ ID NO: 3974565 - RNA, 20 nt, Staphylococcus aureus subsp. aureus Mu50
ugaaucuagaauauaacaac

SEQ ID NO: 3974566 - RNA, 17 nt, Staphylococcus aureus subsp. aureus Mu50
ugaaucugaagguaauu

SEQ ID NO: 3974567 - RNA, 23 nt, Staphylococcus aureus subsp. aureus Mu50
ugaaucuuauuuuguuuuaaaaa

SEQ ID NO: 3974568 - RNA, 23 nt, Staphylococcus aureus subsp. aureus Mu50
ugaaucuuguugaacucugauau

SEQ ID NO: 3974569 - RNA, 15 nt, Staphylococcus aureus subsp. aureus Mu50
ugaaucuuuguuaua

SEQ ID NO: 3974570 - RNA, 14 nt, Staphylococcus aureus subsp. aureus Mu50
ugaaugaaguaaua

SEQ ID NO: 3974571 - RNA, 21 nt, Staphylococcus aureus subsp. aureus Mu50
ugaaugaaguaauauauaaaa

SEQ ID NO: 3974572 - RNA, 14 nt, Staphylococcus aureus subsp. aureus Mu50
ugaaugagugucau

SEQ ID NO: 3974573 - RNA, 14 nt, Staphylococcus aureus subsp. aureus Mu50
ugaaugauauuaac

SEQ ID NO: 3974574 - RNA, 14 nt, Staphylococcus aureus subsp. aureus Mu50
ugaauggcaaauau

SEQ ID NO: 3974575 - RNA, 16 nt, Staphylococcus aureus subsp. aureus Mu50
ugaauggcaaauauga

SEQ ID NO: 3974576 - RNA, 22 nt, Staphylococcus aureus subsp. aureus Mu50
ugaauggcaaucuauauaaaug

SEQ ID NO: 3974577 - RNA, 12 nt, Staphylococcus aureus subsp. aureus Mu50
ugaaugguugau

SEQ ID NO: 3974578 - RNA, 18 nt, Staphylococcus aureus subsp. aureus Mu50
ugaauguaacguacaauu

SEQ ID NO: 3974579 - RNA, 23 nt, Staphylococcus aureus subsp. aureus Mu50
ugaauguuggaucggcauuguaa

SEQ ID NO: 3974580 - RNA, 22 nt, Staphylococcus aureus subsp. aureus Mu50
ugaauguuugguaacacuguga

SEQ ID NO: 3974581 - RNA, 20 nt, Staphylococcus aureus subsp. aureus Mu50
ugaauguuuucuaaaucuaa

SEQ ID NO: 3974582 - RNA, 13 nt, Staphylococcus aureus subsp. aureus Mu50
ugaauuaaaaaau

SEQ ID NO: 3974583 - RNA, 12 nt, Staphylococcus aureus subsp. aureus Mu50
ugaauuaacaau

SEQ ID NO: 3974584 - RNA, 15 nt, Staphylococcus aureus subsp. aureus Mu50
ugaauuagauuuugu

SEQ ID NO: 3974585 - RNA, 16 nt, Staphylococcus aureus subsp. aureus Mu50
ugaauucauucaauac

SEQ ID NO: 3974586 - RNA, 14 nt, Staphylococcus aureus subsp. aureus Mu50
ugaauucauuuuau

SEQ ID NO: 3974587 - RNA, 13 nt, Staphylococcus aureus subsp. aureus Mu50
ugaauugaaaaau

SEQ ID NO: 3974588 - RNA, 18 nt, Staphylococcus aureus subsp. aureus Mu50
ugaauugaaaaauuaaaa

SEQ ID NO: 3974589 - RNA, 19 nt, Staphylococcus aureus subsp. aureus Mu50
ugaauugaguauuaaauuu

SEQ ID NO: 3974590 - RNA, 20 nt, Staphylococcus aureus subsp. aureus Mu50
ugaauugaguauuaaauuug

SEQ ID NO: 3974591 - RNA, 17 nt, Staphylococcus aureus subsp. aureus Mu50
ugaauugcuuguuuuaa

SEQ ID NO: 3974592 - RNA, 17 nt, Staphylococcus aureus subsp. aureus Mu50
ugaauuggauuaucgaa

SEQ ID NO: 3974593 - RNA, 18 nt, Staphylococcus aureus subsp. aureus Mu50
ugaauugucuuaauaugc

SEQ ID NO: 3974594 - RNA, 13 nt, Staphylococcus aureus subsp. aureus Mu50
ugaauuguuaguu

SEQ ID NO: 3974595 - RNA, 19 nt, Staphylococcus aureus subsp. aureus Mu50
ugaauuguuaguuuucuua

SEQ ID NO: 3974596 - RNA, 15 nt, Staphylococcus aureus subsp. aureus Mu50
ugaauuuaauacuau

SEQ ID NO: 3974597 - RNA, 17 nt, Staphylococcus aureus subsp. aureus Mu50
ugaauuuagaugcauaa

SEQ ID NO: 3974598 - RNA, 21 nt, Staphylococcus aureus subsp. aureus Mu50
ugaauuuagcaucaaaaauaa

SEQ ID NO: 3974599 - RNA, 23 nt, Staphylococcus aureus subsp. aureus Mu50
ugaauuuagcaucaaaaauaaaa

SEQ ID NO: 3974600 - RNA, 21 nt, Staphylococcus aureus subsp. aureus Mu50
ugaauuuauuuuguaguuccu

SEQ ID NO: 3974601 - RNA, 14 nt, Staphylococcus aureus subsp. aureus Mu50
ugaauuucaaaaua

SEQ ID NO: 3974602 - RNA, 22 nt, Staphylococcus aureus subsp. aureus Mu50
ugaauuucaaaauaguaaagug

SEQ ID NO: 3974603 - RNA, 12 nt, Staphylococcus aureus subsp. aureus Mu50
ugaauuucuuua

SEQ ID NO: 3974604 - RNA, 17 nt, Staphylococcus aureus subsp. aureus Mu50
ugaauuucuuuaaguga

SEQ ID NO: 3974605 - RNA, 21 nt, Staphylococcus aureus subsp. aureus Mu50
ugaauuuuaauauauuuggag

SEQ ID NO: 3974606 - RNA, 15 nt, Staphylococcus aureus subsp. aureus Mu50
ugaauuuuacugacu

SEQ ID NO: 3974607 - RNA, 24 nt, Staphylococcus aureus subsp. aureus Mu50
ugaauuuuauaaguauauaauuga

SEQ ID NO: 3974608 - RNA, 23 nt, Staphylococcus aureus subsp. aureus Mu50
ugaauuuuauuagguaauacuuu

SEQ ID NO: 3974609 - RNA, 14 nt, Staphylococcus aureus subsp. aureus Mu50
ugacaaacauuugu

SEQ ID NO: 3974610 - RNA, 18 nt, Staphylococcus aureus subsp. aureus Mu50
ugacaaagcuaaagugaa

SEQ ID NO: 3974611 - RNA, 17 nt, Staphylococcus aureus subsp. aureus Mu50
ugacaacauaacaaaga

SEQ ID NO: 3974612 - RNA, 12 nt, Staphylococcus aureus subsp. aureus Mu50
ugacaacauuau

SEQ ID NO: 3974613 - RNA, 18 nt, Staphylococcus aureus subsp. aureus Mu50
ugacaagguaugaaauaa

SEQ ID NO: 3974614 - RNA, 22 nt, Staphylococcus aureus subsp. aureus Mu50
ugacaaguugcugaauaaaaua

SEQ ID NO: 3974615 - RNA, 18 nt, Staphylococcus aureus subsp. aureus Mu50
ugacaaucgcuugcuucu

SEQ ID NO: 3974616 - RNA, 21 nt, Staphylococcus aureus subsp. aureus Mu50
ugacacauuauugaaauuuuu

SEQ ID NO: 3974617 - RNA, 19 nt, Staphylococcus aureus subsp. aureus Mu50
ugacaccuaauaccauugu

SEQ ID NO: 3974618 - RNA, 13 nt, Staphylococcus aureus subsp. aureus Mu50
ugacaguuuccau

SEQ ID NO: 3974619 - RNA, 19 nt, Staphylococcus aureus subsp. aureus Mu50
ugacauaaaaaauaacucc

SEQ ID NO: 3974620 - RNA, 13 nt, Staphylococcus aureus subsp. aureus Mu50
ugacauaaaacuu

SEQ ID NO: 3974621 - RNA, 18 nt, Staphylococcus aureus subsp. aureus Mu50
ugacauaaaacuuacauu

SEQ ID NO: 3974622 - RNA, 19 nt, Staphylococcus aureus subsp. aureus Mu50
ugacauaacagcuaaaaau

SEQ ID NO: 3974623 - RNA, 23 nt, Staphylococcus aureus subsp. aureus Mu50
ugacauaggcgcuuuuuuuuaua

SEQ ID NO: 3974624 - RNA, 12 nt, Staphylococcus aureus subsp. aureus Mu50
ugacaucaucua

SEQ ID NO: 3974625 - RNA, 19 nt, Staphylococcus aureus subsp. aureus Mu50
ugacaucaucuauaauacc

SEQ ID NO: 3974626 - RNA, 15 nt, Staphylococcus aureus subsp. aureus Mu50
ugacaucuauuucuu

SEQ ID NO: 3974627 - RNA, 19 nt, Staphylococcus aureus subsp. aureus Mu50
ugacauggcacgauaauug

SEQ ID NO: 3974628 - RNA, 18 nt, Staphylococcus aureus subsp. aureus Mu50
ugacauuucaucaauaau

SEQ ID NO: 3974629 - RNA, 18 nt, Staphylococcus aureus subsp. aureus Mu50
ugacauuugaccaaguau

SEQ ID NO: 3974630 - RNA, 16 nt, Staphylococcus aureus subsp. aureus Mu50
ugacauuuuaaaucua

SEQ ID NO: 3974631 - RNA, 17 nt, Staphylococcus aureus subsp. aureus Mu50
ugacauuuucaaguuua

SEQ ID NO: 3974632 - RNA, 21 nt, Staphylococcus aureus subsp. aureus Mu50
ugacauuuucaaguuuaaaau

SEQ ID NO: 3974633 - RNA, 21 nt, Staphylococcus aureus subsp. aureus Mu50
ugaccaauagaauucauuaau

SEQ ID NO: 3974634 - RNA, 19 nt, Staphylococcus aureus subsp. aureus Mu50
ugaccaauagcaauugaau

SEQ ID NO: 3974635 - RNA, 15 nt, Staphylococcus aureus subsp. aureus Mu50
ugaccaccacuuuca

SEQ ID NO: 3974636 - RNA, 22 nt, Staphylococcus aureus subsp. aureus Mu50
ugaccaccuuuaucuguaacaa

SEQ ID NO: 3974637 - RNA, 22 nt, Staphylococcus aureus subsp. aureus Mu50
ugaccauuaucaagaacuuuaa

SEQ ID NO: 3974638 - RNA, 17 nt, Staphylococcus aureus subsp. aureus Mu50
ugaccauugucaugccu

SEQ ID NO: 3974639 - RNA, 14 nt, Staphylococcus aureus subsp. aureus Mu50
ugacccuugucagu

SEQ ID NO: 3974640 - RNA, 21 nt, Staphylococcus aureus subsp. aureus Mu50
ugaccgccuaugauauaugua

SEQ ID NO: 3974641 - RNA, 14 nt, Staphylococcus aureus subsp. aureus Mu50
ugaccuucaguuuc

SEQ ID NO: 3974642 - RNA, 20 nt, Staphylococcus aureus subsp. aureus Mu50
ugaccuuuacgccauucauc

SEQ ID NO: 3974643 - RNA, 15 nt, Staphylococcus aureus subsp. aureus Mu50
ugacgaaaagucagc

SEQ ID NO: 3974644 - RNA, 13 nt, Staphylococcus aureus subsp. aureus Mu50
ugacgaguagauu

SEQ ID NO: 3974645 - RNA, 17 nt, Staphylococcus aureus subsp. aureus Mu50
ugacgauaaugaaauac

SEQ ID NO: 3974646 - RNA, 22 nt, Staphylococcus aureus subsp. aureus Mu50
ugacgauaccuuuaauaauauu

SEQ ID NO: 3974647 - RNA, 17 nt, Staphylococcus aureus subsp. aureus Mu50
ugacgaucuucaugaac

SEQ ID NO: 3974648 - RNA, 21 nt, Staphylococcus aureus subsp. aureus Mu50
ugacgcgugaauuaaaaaaug

SEQ ID NO: 3974649 - RNA, 15 nt, Staphylococcus aureus subsp. aureus Mu50
ugaguucguaaucuu

SEQ ID NO: 3974650 - RNA, 14 nt, Staphylococcus aureus subsp. aureus Mu50
ugaguugaaaauaa

SEQ ID NO: 3974651 - RNA, 15 nt, Staphylococcus aureus subsp. aureus Mu50
ugaguugaaaauaau

SEQ ID NO: 3974652 - RNA, 20 nt, Staphylococcus aureus subsp. aureus Mu50
ugaguugaaaauaaucgaac

SEQ ID NO: 3974653 - RNA, 23 nt, Staphylococcus aureus subsp. aureus Mu50
ugaguuggcaucagacuaaaaug

SEQ ID NO: 3974654 - RNA, 12 nt, Staphylococcus aureus subsp. aureus Mu50
ugaguuuaaaaa

SEQ ID NO: 3974655 - RNA, 14 nt, Staphylococcus aureus subsp. aureus Mu50
ugaguuuuuuaaaa

SEQ ID NO: 3974656 - RNA, 17 nt, Staphylococcus aureus subsp. aureus Mu50
ugaguuuuuuaaaauaa

SEQ ID NO: 3974657 - RNA, 18 nt, Staphylococcus aureus subsp. aureus Mu50
ugaguuuuuuaaaauaau

SEQ ID NO: 3974658 - RNA, 23 nt, Staphylococcus aureus subsp. aureus Mu50
ugaguuuuuuaaaauaaugauau

SEQ ID NO: 3974659 - RNA, 14 nt, Staphylococcus aureus subsp. aureus Mu50
ugauaaaacuaaug

SEQ ID NO: 3974660 - RNA, 24 nt, Staphylococcus aureus subsp. aureus Mu50
ugauaaaagcccaccuaaaaagua

SEQ ID NO: 3974661 - RNA, 21 nt, Staphylococcus aureus subsp. aureus Mu50
ugauaaaaggggaaaucauuu

SEQ ID NO: 3974662 - RNA, 14 nt, Staphylococcus aureus subsp. aureus Mu50
ugauaaaauaaaua

SEQ ID NO: 3974663 - RNA, 15 nt, Staphylococcus aureus subsp. aureus Mu50
ugauaaagagccacu

SEQ ID NO: 3974664 - RNA, 21 nt, Staphylococcus aureus subsp. aureus Mu50
ugauaaaugaauugucuuaau

SEQ ID NO: 3974665 - RNA, 12 nt, Staphylococcus aureus subsp. aureus Mu50
ugauaaauuaaa

SEQ ID NO: 3974666 - RNA, 23 nt, Staphylococcus aureus subsp. aureus Mu50
ugauaacaaccgucccauaaaag

SEQ ID NO: 3974667 - RNA, 23 nt, Staphylococcus aureus subsp. aureus Mu50
ugauaaccaaaccauaaguaaaa

SEQ ID NO: 3974668 - RNA, 14 nt, Staphylococcus aureus subsp. aureus Mu50
ugauaacgagcuaa

SEQ ID NO: 3974669 - RNA, 16 nt, Staphylococcus aureus subsp. aureus Mu50
ugauaaguagaaaaua

SEQ ID NO: 3974670 - RNA, 18 nt, Staphylococcus aureus subsp. aureus Mu50
ugauaagugaugugaugu

SEQ ID NO: 3974671 - RNA, 14 nt, Staphylococcus aureus subsp. aureus Mu50
ugauaauaaaaguu

SEQ ID NO: 3974672 - RNA, 21 nt, Staphylococcus aureus subsp. aureus Mu50
ugauaauacuguuuaaauaaa

SEQ ID NO: 3974673 - RNA, 18 nt, Staphylococcus aureus subsp. aureus Mu50
ugauaauagcuugagcau

SEQ ID NO: 3974674 - RNA, 15 nt, Staphylococcus aureus subsp. aureus Mu50
ugauaauccaccaaa

SEQ ID NO: 3974675 - RNA, 16 nt, Staphylococcus aureus subsp. aureus Mu50
ugauaaugacucaagu

SEQ ID NO: 3974676 - RNA, 13 nt, Staphylococcus aureus subsp. aureus Mu50
ugauaaugcaugu

SEQ ID NO: 3974677 - RNA, 16 nt, Staphylococcus aureus subsp. aureus Mu50
ugauaauguaauuguu

SEQ ID NO: 3974678 - RNA, 19 nt, Staphylococcus aureus subsp. aureus Mu50
ugauaauguaauuguuuuu

SEQ ID NO: 3974679 - RNA, 20 nt, Staphylococcus aureus subsp. aureus Mu50
ugauaauguucccuuaccau

SEQ ID NO: 3974680 - RNA, 15 nt, Staphylococcus aureus subsp. aureus Mu50
ugauaauuaaaauaa

SEQ ID NO: 3974681 - RNA, 13 nt, Staphylococcus aureus subsp. aureus Mu50
ugauaauuaaugc

SEQ ID NO: 3974682 - RNA, 19 nt, Staphylococcus aureus subsp. aureus Mu50
ugauaauuaaugccauugu

SEQ ID NO: 3974683 - RNA, 16 nt, Staphylococcus aureus subsp. aureus Mu50
ugauaauuaauuaaaa

SEQ ID NO: 3974684 - RNA, 22 nt, Staphylococcus aureus subsp. aureus Mu50
ugauaauuaauuaaaauucucu

SEQ ID NO: 3974685 - RNA, 16 nt, Staphylococcus aureus subsp. aureus Mu50
ugauaauuaauuaugc

SEQ ID NO: 3974686 - RNA, 14 nt, Staphylococcus aureus subsp. aureus Mu50
ugauaauucuucaa

SEQ ID NO: 3974687 - RNA, 15 nt, Staphylococcus aureus subsp. aureus Mu50
ugauaauuuaauaau

SEQ ID NO: 3974688 - RNA, 13 nt, Staphylococcus aureus subsp. aureus Mu50
ugauaauuuuuag

SEQ ID NO: 3974689 - RNA, 19 nt, Staphylococcus aureus subsp. aureus Mu50
ugauacagaaccaacaaua

SEQ ID NO: 3974690 - RNA, 14 nt, Staphylococcus aureus subsp. aureus Mu50
ugauacauaaaaug

SEQ ID NO: 3974691 - RNA, 19 nt, Staphylococcus aureus subsp. aureus Mu50
ugauacaucaucgccagca

SEQ ID NO: 3974692 - RNA, 13 nt, Staphylococcus aureus subsp. aureus Mu50
ugauacauuauua

SEQ ID NO: 3974693 - RNA, 20 nt, Staphylococcus aureus subsp. aureus Mu50
ugauacauuauuaaauagau

SEQ ID NO: 3974694 - RNA, 16 nt, Staphylococcus aureus subsp. aureus Mu50
ugauacauucuauuaa

SEQ ID NO: 3974695 - RNA, 18 nt, Staphylococcus aureus subsp. aureus Mu50
ugauacccgcgauacugc

SEQ ID NO: 3974696 - RNA, 17 nt, Staphylococcus aureus subsp. aureus Mu50
ugauaccuuuaaaucua

SEQ ID NO: 3974697 - RNA, 22 nt, Staphylococcus aureus subsp. aureus Mu50
ugauacgccuaaauauuuaccu

SEQ ID NO: 3974698 - RNA, 13 nt, Staphylococcus aureus subsp. aureus Mu50
ugauacgcuuuuu

SEQ ID NO: 3974699 - RNA, 16 nt, Staphylococcus aureus subsp. aureus Mu50
ugauacgcuuuuuaaa

SEQ ID NO: 3974700 - RNA, 17 nt, Staphylococcus aureus subsp. aureus Mu50
ugauacgcuuuuuaaaa

SEQ ID NO: 3974701 - RNA, 18 nt, Staphylococcus aureus subsp. aureus Mu50
ugauacguaaacacuuua

SEQ ID NO: 3974702 - RNA, 23 nt, Staphylococcus aureus subsp. aureus Mu50
ugauacguacguugauguguugc

SEQ ID NO: 3974703 - RNA, 18 nt, Staphylococcus aureus subsp. aureus Mu50
ugauacgugguuuuauuu

SEQ ID NO: 3974704 - RNA, 18 nt, Staphylococcus aureus subsp. aureus Mu50
ugauacugcuucgcuaau

SEQ ID NO: 3974705 - RNA, 13 nt, Staphylococcus aureus subsp. aureus Mu50
ugauacuugauuu

SEQ ID NO: 3974706 - RNA, 17 nt, Staphylococcus aureus subsp. aureus Mu50
ugauagcaaugaauuaa

SEQ ID NO: 3974707 - RNA, 19 nt, Staphylococcus aureus subsp. aureus Mu50
ugauagcaccguaacauau

SEQ ID NO: 3974708 - RNA, 15 nt, Staphylococcus aureus subsp. aureus Mu50
ugauagcuaaugcau

SEQ ID NO: 3974709 - RNA, 16 nt, Staphylococcus aureus subsp. aureus Mu50
ugauagcuaaugcauu

SEQ ID NO: 3974710 - RNA, 17 nt, Staphylococcus aureus subsp. aureus Mu50
ugauagcuaaugcauua

SEQ ID NO: 3974711 - RNA, 18 nt, Staphylococcus aureus subsp. aureus Mu50
ugauagcuaaugcauuau

SEQ ID NO: 3974712 - RNA, 13 nt, Staphylococcus aureus subsp. aureus Mu50
ugauagugaauaa

SEQ ID NO: 3974713 - RNA, 20 nt, Staphylococcus aureus subsp. aureus Mu50
ugauaguguaugaauggcaa

SEQ ID NO: 3974714 - RNA, 17 nt, Staphylococcus aureus subsp. aureus Mu50
ugauaguguauguuuuu

SEQ ID NO: 3974715 - RNA, 20 nt, Staphylococcus aureus subsp. aureus Mu50
ugauaguuguaucauuaauu

SEQ ID NO: 3974716 - RNA, 12 nt, Staphylococcus aureus subsp. aureus Mu50
ugauauaaaaag

SEQ ID NO: 3974717 - RNA, 19 nt, Staphylococcus aureus subsp. aureus Mu50
ugauauaaaaagugaaagu

SEQ ID NO: 3974718 - RNA, 19 nt, Staphylococcus aureus subsp. aureus Mu50
ugauauaaaccaugauuag

SEQ ID NO: 3974719 - RNA, 14 nt, Staphylococcus aureus subsp. aureus Mu50
ugauauaauagaaa

SEQ ID NO: 3974720 - RNA, 19 nt, Staphylococcus aureus subsp. aureus Mu50
ugauauaccuugauucauu

SEQ ID NO: 3974721 - RNA, 19 nt, Staphylococcus aureus subsp. aureus Mu50
ugauauacgacaaucacag

SEQ ID NO: 3974722 - RNA, 17 nt, Staphylococcus aureus subsp. aureus Mu50
ugauauagauggcuuuu

SEQ ID NO: 3974723 - RNA, 20 nt, Staphylococcus aureus subsp. aureus Mu50
ugauauagucaaugaauaau

SEQ ID NO: 3974724 - RNA, 17 nt, Staphylococcus aureus subsp. aureus Mu50
ugauauauaacaaguac

SEQ ID NO: 3974725 - RNA, 13 nt, Staphylococcus aureus subsp. aureus Mu50
ugauauauaacca

SEQ ID NO: 3974726 - RNA, 15 nt, Staphylococcus aureus subsp. aureus Mu50
ugauauaugaaauau

SEQ ID NO: 3974727 - RNA, 17 nt, Staphylococcus aureus subsp. aureus Mu50
ugauauauguaacauaa

SEQ ID NO: 3974728 - RNA, 15 nt, Staphylococcus aureus subsp. aureus Mu50
ugauauauuacacca

SEQ ID NO: 3974729 - RNA, 15 nt, Staphylococcus aureus subsp. aureus Mu50
ugauauauucaucuc

SEQ ID NO: 3974730 - RNA, 18 nt, Staphylococcus aureus subsp. aureus Mu50
ugauaucacuauacaauc

SEQ ID NO: 3974731 - RNA, 22 nt, Staphylococcus aureus subsp. aureus Mu50
ugauauccaaagcuugauuuaa

SEQ ID NO: 3974732 - RNA, 23 nt, Staphylococcus aureus subsp. aureus Mu50
ugauaucgaaacgcuuugcagau

SEQ ID NO: 3974733 - RNA, 14 nt, Staphylococcus aureus subsp. aureus Mu50
ugauaucuuuucca

SEQ ID NO: 3974734 - RNA, 23 nt, Staphylococcus aureus subsp. aureus Mu50
ugauauuaagucuagcauuagaa

SEQ ID NO: 3974735 - RNA, 23 nt, Staphylococcus aureus subsp. aureus Mu50
ugauauuaccuucaaguuggugu

SEQ ID NO: 3974736 - RNA, 14 nt, Staphylococcus aureus subsp. aureus Mu50
ugauauugaaagug

SEQ ID NO: 3974737 - RNA, 19 nt, Staphylococcus aureus subsp. aureus Mu50
ugauuuaaaaaauuuaaug

SEQ ID NO: 3974738 - RNA, 19 nt, Staphylococcus aureus subsp. aureus Mu50
ugauuuaaaauauaaauuu

SEQ ID NO: 3974739 - RNA, 17 nt, Staphylococcus aureus subsp. aureus Mu50
ugauuuaagauuuaaua

SEQ ID NO: 3974740 - RNA, 19 nt, Staphylococcus aureus subsp. aureus Mu50
ugauuuaagggucacaccc

SEQ ID NO: 3974741 - RNA, 20 nt, Staphylococcus aureus subsp. aureus Mu50
ugauuuaauagcuaaagcuu

SEQ ID NO: 3974742 - RNA, 14 nt, Staphylococcus aureus subsp. aureus Mu50
ugauuuaauguuaa

SEQ ID NO: 3974743 - RNA, 16 nt, Staphylococcus aureus subsp. aureus Mu50
ugauuuaauuuuuaau

SEQ ID NO: 3974744 - RNA, 17 nt, Staphylococcus aureus subsp. aureus Mu50
ugauuuaauuuuuaaug

SEQ ID NO: 3974745 - RNA, 21 nt, Staphylococcus aureus subsp. aureus Mu50
ugauuuaauuuuuaauguauu

SEQ ID NO: 3974746 - RNA, 17 nt, Staphylococcus aureus subsp. aureus Mu50
ugauuuaccuuugucuu

SEQ ID NO: 3974747 - RNA, 13 nt, Staphylococcus aureus subsp. aureus Mu50
ugauuuagcauac

SEQ ID NO: 3974748 - RNA, 15 nt, Staphylococcus aureus subsp. aureus Mu50
ugauuuagcauacau

SEQ ID NO: 3974749 - RNA, 18 nt, Staphylococcus aureus subsp. aureus Mu50
ugauuuagcauacauuaa

SEQ ID NO: 3974750 - RNA, 19 nt, Staphylococcus aureus subsp. aureus Mu50
ugauuuagcauacauuaag

SEQ ID NO: 3974751 - RNA, 19 nt, Staphylococcus aureus subsp. aureus Mu50
ugauuuauucuaaauauau

SEQ ID NO: 3974752 - RNA, 16 nt, Staphylococcus aureus subsp. aureus Mu50
ugauuucacuucauaa

SEQ ID NO: 3974753 - RNA, 16 nt, Staphylococcus aureus subsp. aureus Mu50
ugauuugauucauuac

SEQ ID NO: 3974754 - RNA, 21 nt, Staphylococcus aureus subsp. aureus Mu50
ugauuugccaaaaguuauaua

SEQ ID NO: 3974755 - RNA, 20 nt, Staphylococcus aureus subsp. aureus Mu50
ugauuuggaaagaugggauu

SEQ ID NO: 3974756 - RNA, 20 nt, Staphylococcus aureus subsp. aureus Mu50
ugauuuggguaauguuuuua

SEQ ID NO: 3974757 - RNA, 19 nt, Staphylococcus aureus subsp. aureus Mu50
ugauuuguuacuucuaaua

SEQ ID NO: 3974758 - RNA, 23 nt, Staphylococcus aureus subsp. aureus Mu50
ugauuuguuacuucuaauaguaa

SEQ ID NO: 3974759 - RNA, 14 nt, Staphylococcus aureus subsp. aureus Mu50
ugauuuguuugauu

SEQ ID NO: 3974760 - RNA, 15 nt, Staphylococcus aureus subsp. aureus Mu50
ugauuuuacuugaau

SEQ ID NO: 3974761 - RNA, 14 nt, Staphylococcus aureus subsp. aureus Mu50
ugauuuuaggcaau

SEQ ID NO: 3974762 - RNA, 15 nt, Staphylococcus aureus subsp. aureus Mu50
ugauuuuauaaaguu

SEQ ID NO: 3974763 - RNA, 15 nt, Staphylococcus aureus subsp. aureus Mu50
ugauuuuauaauauu

SEQ ID NO: 3974764 - RNA, 17 nt, Staphylococcus aureus subsp. aureus Mu50
ugauuuuauaauauuau

SEQ ID NO: 3974765 - RNA, 12 nt, Staphylococcus aureus subsp. aureus Mu50
ugauuuucuuua

SEQ ID NO: 3974766 - RNA, 18 nt, Staphylococcus aureus subsp. aureus Mu50
ugauuuugcugccaaaaa

SEQ ID NO: 3974767 - RNA, 12 nt, Staphylococcus aureus subsp. aureus Mu50
ugauuuugcuuu

SEQ ID NO: 3974768 - RNA, 17 nt, Staphylococcus aureus subsp. aureus Mu50
ugauuuuggaacauauu

SEQ ID NO: 3974769 - RNA, 13 nt, Staphylococcus aureus subsp. aureus Mu50
ugauuuuguuuca

SEQ ID NO: 3974770 - RNA, 14 nt, Staphylococcus aureus subsp. aureus Mu50
ugauuuuuaaaaau

SEQ ID NO: 3974771 - RNA, 15 nt, Staphylococcus aureus subsp. aureus Mu50
ugauuuuuaaaaaua

SEQ ID NO: 3974772 - RNA, 14 nt, Staphylococcus aureus subsp. aureus Mu50
ugauuuuuaauaau

SEQ ID NO: 3974773 - RNA, 16 nt, Staphylococcus aureus subsp. aureus Mu50
ugauuuuuaauaauuu

SEQ ID NO: 3974774 - RNA, 12 nt, Staphylococcus aureus subsp. aureus Mu50
ugauuuuucaua

SEQ ID NO: 3974775 - RNA, 14 nt, Staphylococcus aureus subsp. aureus Mu50
ugauuuuucaucaa

SEQ ID NO: 3974776 - RNA, 14 nt, Staphylococcus aureus subsp. aureus Mu50
ugauuuuucauuga

SEQ ID NO: 3974777 - RNA, 20 nt, Staphylococcus aureus subsp. aureus Mu50
ugcaaaaauaauaugaauuu

SEQ ID NO: 3974778 - RNA, 12 nt, Staphylococcus aureus subsp. aureus Mu50
ugcaaaaucaac

SEQ ID NO: 3974779 - RNA, 18 nt, Staphylococcus aureus subsp. aureus Mu50
ugcaaaaucaacccauca

SEQ ID NO: 3974780 - RNA, 14 nt, Staphylococcus aureus subsp. aureus Mu50
ugcaaaaugcauua

SEQ ID NO: 3974781 - RNA, 13 nt, Staphylococcus aureus subsp. aureus Mu50
ugcaaaauuaaug

SEQ ID NO: 3974782 - RNA, 19 nt, Staphylococcus aureus subsp. aureus Mu50
ugcaaacuugauucaauau

SEQ ID NO: 3974783 - RNA, 15 nt, Staphylococcus aureus subsp. aureus Mu50
ugcaaaguaacaaua

SEQ ID NO: 3974784 - RNA, 17 nt, Staphylococcus aureus subsp. aureus Mu50
ugcaaauaaaaaaguua

SEQ ID NO: 3974785 - RNA, 13 nt, Staphylococcus aureus subsp. aureus Mu50
ugcaaauacgagu

SEQ ID NO: 3974786 - RNA, 22 nt, Staphylococcus aureus subsp. aureus Mu50
ugcaaauacgaguguuuuaauc

SEQ ID NO: 3974787 - RNA, 20 nt, Staphylococcus aureus subsp. aureus Mu50
ugcaaaucaaauacaucaau

SEQ ID NO: 3974788 - RNA, 20 nt, Staphylococcus aureus subsp. aureus Mu50
ugcaaaucucgucacauaua

SEQ ID NO: 3974789 - RNA, 14 nt, Staphylococcus aureus subsp. aureus Mu50
ugcaaauuaucauu

SEQ ID NO: 3974790 - RNA, 16 nt, Staphylococcus aureus subsp. aureus Mu50
ugcaaauuaucauuaa

SEQ ID NO: 3974791 - RNA, 22 nt, Staphylococcus aureus subsp. aureus Mu50
ugcaaauuaucauuaaauugcu

SEQ ID NO: 3974792 - RNA, 20 nt, Staphylococcus aureus subsp. aureus Mu50
ugcaacaccugguacauaaa

SEQ ID NO: 3974793 - RNA, 19 nt, Staphylococcus aureus subsp. aureus Mu50
ugcaacauuaaauuauuag

SEQ ID NO: 3974794 - RNA, 22 nt, Staphylococcus aureus subsp. aureus Mu50
ugcaacauuugauaaccaaugc

SEQ ID NO: 3974795 - RNA, 12 nt, Staphylococcus aureus subsp. aureus Mu50
ugcaacauuuug

SEQ ID NO: 3974796 - RNA, 14 nt, Staphylococcus aureus subsp. aureus Mu50
ugcaacuuauaaua

SEQ ID NO: 3974797 - RNA, 17 nt, Staphylococcus aureus subsp. aureus Mu50
ugcaacuuuaagacuuu

SEQ ID NO: 3974798 - RNA, 16 nt, Staphylococcus aureus subsp. aureus Mu50
ugcaagccaucaauau

SEQ ID NO: 3974799 - RNA, 12 nt, Staphylococcus aureus subsp. aureus Mu50
ugcaaguauuuu

SEQ ID NO: 3974800 - RNA, 16 nt, Staphylococcus aureus subsp. aureus Mu50
ugcaaguccaaauaau

SEQ ID NO: 3974801 - RNA, 20 nt, Staphylococcus aureus subsp. aureus Mu50
ugcaaguccaaauaauaucu

SEQ ID NO: 3974802 - RNA, 22 nt, Staphylococcus aureus subsp. aureus Mu50
ugcaagucguucucuuaaauau

SEQ ID NO: 3974803 - RNA, 19 nt, Staphylococcus aureus subsp. aureus Mu50
ugcaaguuggcggggcccc

SEQ ID NO: 3974804 - RNA, 19 nt, Staphylococcus aureus subsp. aureus Mu50
ugcaauaacaccaauugaa

SEQ ID NO: 3974805 - RNA, 21 nt, Staphylococcus aureus subsp. aureus Mu50
ugcaauaacaccaauugaaua

SEQ ID NO: 3974806 - RNA, 14 nt, Staphylococcus aureus subsp. aureus Mu50
ugcaauaauaaaua

SEQ ID NO: 3974807 - RNA, 16 nt, Staphylococcus aureus subsp. aureus Mu50
ugcaauaauucaucuu

SEQ ID NO: 3974808 - RNA, 18 nt, Staphylococcus aureus subsp. aureus Mu50
ugcaauacaccuauuaca

SEQ ID NO: 3974809 - RNA, 15 nt, Staphylococcus aureus subsp. aureus Mu50
ugcaauacauuaaua

SEQ ID NO: 3974810 - RNA, 21 nt, Staphylococcus aureus subsp. aureus Mu50
ugcaauacauuaauauaaaua

SEQ ID NO: 3974811 - RNA, 23 nt, Staphylococcus aureus subsp. aureus Mu50
ugcaauaccuccccaacuuaaua

SEQ ID NO: 3974812 - RNA, 17 nt, Staphylococcus aureus subsp. aureus Mu50
ugcaauaggaugaaacu

SEQ ID NO: 3974813 - RNA, 13 nt, Staphylococcus aureus subsp. aureus Mu50
ugcaauauuauau

SEQ ID NO: 3974814 - RNA, 15 nt, Staphylococcus aureus subsp. aureus Mu50
ugcaaucguugaaaa

SEQ ID NO: 3974815 - RNA, 17 nt, Staphylococcus aureus subsp. aureus Mu50
ugcaaugaauaacaaga

SEQ ID NO: 3974816 - RNA, 15 nt, Staphylococcus aureus subsp. aureus Mu50
ugcaaugagcaucuu

SEQ ID NO: 3974817 - RNA, 14 nt, Staphylococcus aureus subsp. aureus Mu50
ugcaaugcaaaucu

SEQ ID NO: 3974818 - RNA, 22 nt, Staphylococcus aureus subsp. aureus Mu50
ugcaauuagaauauauguauaa

SEQ ID NO: 3974819 - RNA, 18 nt, Staphylococcus aureus subsp. aureus Mu50
ugcaauugccuuaucagc

SEQ ID NO: 3974820 - RNA, 20 nt, Staphylococcus aureus subsp. aureus Mu50
ugcaauugccuuaucagcau

SEQ ID NO: 3974821 - RNA, 17 nt, Staphylococcus aureus subsp. aureus Mu50
ugcaauuucauaguguu

SEQ ID NO: 3974822 - RNA, 18 nt, Staphylococcus aureus subsp. aureus Mu50
ugcaauuuguaauacaag

SEQ ID NO: 3974823 - RNA, 19 nt, Staphylococcus aureus subsp. aureus Mu50
ugcacaaagauauguuuau

SEQ ID NO: 3974824 - RNA, 15 nt, Staphylococcus aureus subsp. aureus Mu50
ugcacaaauugcaau

SEQ ID NO: 3974825 - RNA, 20 nt, Staphylococcus aureus subsp. aureus Mu50
ugccucaguuagaagaugau

SEQ ID NO: 3974826 - RNA, 19 nt, Staphylococcus aureus subsp. aureus Mu50
ugccuggcaacguucuacu

SEQ ID NO: 3974827 - RNA, 17 nt, Staphylococcus aureus subsp. aureus Mu50
ugccuuaacuucauaau

SEQ ID NO: 3974828 - RNA, 22 nt, Staphylococcus aureus subsp. aureus Mu50
ugccuuaacuucauaauauauc

SEQ ID NO: 3974829 - RNA, 12 nt, Staphylococcus aureus subsp. aureus Mu50
ugccuuucuaau

SEQ ID NO: 3974830 - RNA, 15 nt, Staphylococcus aureus subsp. aureus Mu50
ugccuuuugaauaau

SEQ ID NO: 3974831 - RNA, 16 nt, Staphylococcus aureus subsp. aureus Mu50
ugccuuuugaauaauu

SEQ ID NO: 3974832 - RNA, 13 nt, Staphylococcus aureus subsp. aureus Mu50
ugccuuuuuguaa

SEQ ID NO: 3974833 - RNA, 18 nt, Staphylococcus aureus subsp. aureus Mu50
ugccuuuuuguaauugua

SEQ ID NO: 3974834 - RNA, 20 nt, Staphylococcus aureus subsp. aureus Mu50
ugccuuuuuguaauuguaau

SEQ ID NO: 3974835 - RNA, 15 nt, Staphylococcus aureus subsp. aureus Mu50
ugcgaaaauaucauu

SEQ ID NO: 3974836 - RNA, 22 nt, Staphylococcus aureus subsp. aureus Mu50
ugcgaaaccuuucgauaaacua

SEQ ID NO: 3974837 - RNA, 22 nt, Staphylococcus aureus subsp. aureus Mu50
ugcgaacucguuauagauaagu

SEQ ID NO: 3974838 - RNA, 14 nt, Staphylococcus aureus subsp. aureus Mu50
ugcgaauaauaaua

SEQ ID NO: 3974839 - RNA, 15 nt, Staphylococcus aureus subsp. aureus Mu50
ugcgaauaauaauac

SEQ ID NO: 3974840 - RNA, 15 nt, Staphylococcus aureus subsp. aureus Mu50
ugcgaauuguuagau

SEQ ID NO: 3974841 - RNA, 20 nt, Staphylococcus aureus subsp. aureus Mu50
ugcgauauacgaauccucau

SEQ ID NO: 3974842 - RNA, 16 nt, Staphylococcus aureus subsp. aureus Mu50
ugcgcaaaagcgcagg

SEQ ID NO: 3974843 - RNA, 17 nt, Staphylococcus aureus subsp. aureus Mu50
ugcgccugcuaaaaagu

SEQ ID NO: 3974844 - RNA, 14 nt, Staphylococcus aureus subsp. aureus Mu50
ugcgccuucuuuuu

SEQ ID NO: 3974845 - RNA, 16 nt, Staphylococcus aureus subsp. aureus Mu50
ugcgcuuauuuuacua

SEQ ID NO: 3974846 - RNA, 17 nt, Staphylococcus aureus subsp. aureus Mu50
ugcgguuuaaucuauau

SEQ ID NO: 3974847 - RNA, 21 nt, Staphylococcus aureus subsp. aureus Mu50
ugcguaagguauuucauugau

SEQ ID NO: 3974848 - RNA, 18 nt, Staphylococcus aureus subsp. aureus Mu50
ugcgugcuuaauuacaau

SEQ ID NO: 3974849 - RNA, 13 nt, Staphylococcus aureus subsp. aureus Mu50
ugcguuaauaauu

SEQ ID NO: 3974850 - RNA, 16 nt, Staphylococcus aureus subsp. aureus Mu50
ugcguugguauucauc

SEQ ID NO: 3974851 - RNA, 14 nt, Staphylococcus aureus subsp. aureus Mu50
ugcguuuaauuuac

SEQ ID NO: 3974852 - RNA, 20 nt, Staphylococcus aureus subsp. aureus Mu50
ugcguuuguguguuuuaaaa

SEQ ID NO: 3974853 - RNA, 13 nt, Staphylococcus aureus subsp. aureus Mu50
ugcguuuuuaaau

SEQ ID NO: 3974854 - RNA, 16 nt, Staphylococcus aureus subsp. aureus Mu50
ugcguuuuuaaauaau

SEQ ID NO: 3974855 - RNA, 16 nt, Staphylococcus aureus subsp. aureus Mu50
ugcuaaaaaaauuaaa

SEQ ID NO: 3974856 - RNA, 14 nt, Staphylococcus aureus subsp. aureus Mu50
ugcuaaaaauauug

SEQ ID NO: 3974857 - RNA, 16 nt, Staphylococcus aureus subsp. aureus Mu50
ugcuaaaaauauugaa

SEQ ID NO: 3974858 - RNA, 15 nt, Staphylococcus aureus subsp. aureus Mu50
ugcuaaaauaucaaa

SEQ ID NO: 3974859 - RNA, 16 nt, Staphylococcus aureus subsp. aureus Mu50
ugcuaaaauaucaaaa

SEQ ID NO: 3974860 - RNA, 23 nt, Staphylococcus aureus subsp. aureus Mu50
ugcuaaacgcuaaaauuuccuca

SEQ ID NO: 3974861 - RNA, 21 nt, Staphylococcus aureus subsp. aureus Mu50
ugcuaaaguguagccaaauaa

SEQ ID NO: 3974862 - RNA, 14 nt, Staphylococcus aureus subsp. aureus Mu50
ugcuaauucaagaa

SEQ ID NO: 3974863 - RNA, 16 nt, Staphylococcus aureus subsp. aureus Mu50
ugcuaauuuaacugcg

SEQ ID NO: 3974864 - RNA, 15 nt, Staphylococcus aureus subsp. aureus Mu50
ugcuaauuuauaaac

SEQ ID NO: 3974865 - RNA, 15 nt, Staphylococcus aureus subsp. aureus Mu50
ugcuaauuuuuucau

SEQ ID NO: 3974866 - RNA, 16 nt, Staphylococcus aureus subsp. aureus Mu50
ugcuaauuuuuucauc

SEQ ID NO: 3974867 - RNA, 14 nt, Staphylococcus aureus subsp. aureus Mu50
ugcuacaauuuccu

SEQ ID NO: 3974868 - RNA, 15 nt, Staphylococcus aureus subsp. aureus Mu50
ugcuacaauuuccua

SEQ ID NO: 3974869 - RNA, 20 nt, Staphylococcus aureus subsp. aureus Mu50
ugcuacagcacgagacaaua

SEQ ID NO: 3974870 - RNA, 17 nt, Staphylococcus aureus subsp. aureus Mu50
ugcuacuauuaaauaau

SEQ ID NO: 3974871 - RNA, 19 nt, Staphylococcus aureus subsp. aureus Mu50
ugcuagcuuucuuuuucau

SEQ ID NO: 3974872 - RNA, 13 nt, Staphylococcus aureus subsp. aureus Mu50
ugcuagugcucuu

SEQ ID NO: 3974873 - RNA, 24 nt, Staphylococcus aureus subsp. aureus Mu50
ugcuauauuuaguuaauuauuuag

SEQ ID NO: 3974874 - RNA, 23 nt, Staphylococcus aureus subsp. aureus Mu50
ugcuauauuucgguauuuuaaau

SEQ ID NO: 3974875 - RNA, 21 nt, Staphylococcus aureus subsp. aureus Mu50
ugcucaaaaaugcuuauauaa

SEQ ID NO: 3974876 - RNA, 20 nt, Staphylococcus aureus subsp. aureus Mu50
ugcucccuucaaaguagaca

SEQ ID NO: 3974877 - RNA, 22 nt, Staphylococcus aureus subsp. aureus Mu50
ugcucccuucaaaguagacauu

SEQ ID NO: 3974878 - RNA, 14 nt, Staphylococcus aureus subsp. aureus Mu50
ugcucguauagaaa

SEQ ID NO: 3974879 - RNA, 22 nt, Staphylococcus aureus subsp. aureus Mu50
ugcucuaaacuucuauuaauaa

SEQ ID NO: 3974880 - RNA, 13 nt, Staphylococcus aureus subsp. aureus Mu50
ugcucuaagcauu

SEQ ID NO: 3974881 - RNA, 17 nt, Staphylococcus aureus subsp. aureus Mu50
ugcucuaagcauucagu

SEQ ID NO: 3974882 - RNA, 19 nt, Staphylococcus aureus subsp. aureus Mu50
ugcucuaauccaaaauaau

SEQ ID NO: 3974883 - RNA, 20 nt, Staphylococcus aureus subsp. aureus Mu50
ugcucuaauccaaaauaauc

SEQ ID NO: 3974884 - RNA, 14 nt, Staphylococcus aureus subsp. aureus Mu50
ugcucuacaaaguu

SEQ ID NO: 3974885 - RNA, 14 nt, Staphylococcus aureus subsp. aureus Mu50
ugcucuuuaacaau

SEQ ID NO: 3974886 - RNA, 17 nt, Staphylococcus aureus subsp. aureus Mu50
ugcugaauaaaauauau

SEQ ID NO: 3974887 - RNA, 19 nt, Staphylococcus aureus subsp. aureus Mu50
ugcugauaccuaagcugau

SEQ ID NO: 3974888 - RNA, 21 nt, Staphylococcus aureus subsp. aureus Mu50
ugcugaucgcauguuuguaaa

SEQ ID NO: 3974889 - RNA, 18 nt, Staphylococcus aureus subsp. aureus Mu50
ugcugccaaaaaguauuc

SEQ ID NO: 3974890 - RNA, 18 nt, Staphylococcus aureus subsp. aureus Mu50
ugcugcuaaaauaacaac

SEQ ID NO: 3974891 - RNA, 18 nt, Staphylococcus aureus subsp. aureus Mu50
ugcugcuguacaauuucg

SEQ ID NO: 3974892 - RNA, 16 nt, Staphylococcus aureus subsp. aureus Mu50
ugcugcuuucauagaa

SEQ ID NO: 3974893 - RNA, 18 nt, Staphylococcus aureus subsp. aureus Mu50
ugcuggcgcaaugauauc

SEQ ID NO: 3974894 - RNA, 15 nt, Staphylococcus aureus subsp. aureus Mu50
ugcugguaacucuuc

SEQ ID NO: 3974895 - RNA, 18 nt, Staphylococcus aureus subsp. aureus Mu50
ugcugguugcuucuuauc

SEQ ID NO: 3974896 - RNA, 19 nt, Staphylococcus aureus subsp. aureus Mu50
ugcugguugcuucuuauca

SEQ ID NO: 3974897 - RNA, 23 nt, Staphylococcus aureus subsp. aureus Mu50
ugcuguacguuuaauaccuauga

SEQ ID NO: 3974898 - RNA, 18 nt, Staphylococcus aureus subsp. aureus Mu50
ugcuguacuauauucaau

SEQ ID NO: 3974899 - RNA, 19 nt, Staphylococcus aureus subsp. aureus Mu50
ugcuguauauauauguaaa

SEQ ID NO: 3974900 - RNA, 12 nt, Staphylococcus aureus subsp. aureus Mu50
ugcuguaucuuc

SEQ ID NO: 3974901 - RNA, 19 nt, Staphylococcus aureus subsp. aureus Mu50
ugcugucaaacaacaauca

SEQ ID NO: 3974902 - RNA, 22 nt, Staphylococcus aureus subsp. aureus Mu50
ugcuguccaucgucaucacuuu

SEQ ID NO: 3974903 - RNA, 17 nt, Staphylococcus aureus subsp. aureus Mu50
ugcugugucuuuugauu

SEQ ID NO: 3974904 - RNA, 17 nt, Staphylococcus aureus subsp. aureus Mu50
ugcuguuaauaaaucau

SEQ ID NO: 3974905 - RNA, 13 nt, Staphylococcus aureus subsp. aureus Mu50
ugcuguuacuucu

SEQ ID NO: 3974906 - RNA, 16 nt, Staphylococcus aureus subsp. aureus Mu50
ugcuguugcaauaaaa

SEQ ID NO: 3974907 - RNA, 19 nt, Staphylococcus aureus subsp. aureus Mu50
ugcuguugcaauaaaauca

SEQ ID NO: 3974908 - RNA, 14 nt, Staphylococcus aureus subsp. aureus Mu50
ugcuguuuuuauua

SEQ ID NO: 3974909 - RNA, 17 nt, Staphylococcus aureus subsp. aureus Mu50
ugcuuaauuuauguguu

SEQ ID NO: 3974910 - RNA, 18 nt, Staphylococcus aureus subsp. aureus Mu50
ugcuuaauuuguuuuaaa

SEQ ID NO: 3974911 - RNA, 19 nt, Staphylococcus aureus subsp. aureus Mu50
ugcuuaauuuguuuuaaau

SEQ ID NO: 3974912 - RNA, 22 nt, Staphylococcus aureus subsp. aureus Mu50
ugcuuaauuuguuuuaaauacu

SEQ ID NO: 3974913 - RNA, 14 nt, Staphylococcus aureus subsp. aureus Mu50
uggauaaaaugaua

SEQ ID NO: 3974914 - RNA, 13 nt, Staphylococcus aureus subsp. aureus Mu50
uggauaauugcau

SEQ ID NO: 3974915 - RNA, 24 nt, Staphylococcus aureus subsp. aureus Mu50
uggauagguaacuaaaaugucuuu

SEQ ID NO: 3974916 - RNA, 18 nt, Staphylococcus aureus subsp. aureus Mu50
uggauauuuauuuuaaua

SEQ ID NO: 3974917 - RNA, 13 nt, Staphylococcus aureus subsp. aureus Mu50
uggaucuguuaca

SEQ ID NO: 3974918 - RNA, 15 nt, Staphylococcus aureus subsp. aureus Mu50
uggaucuuucaaagu

SEQ ID NO: 3974919 - RNA, 14 nt, Staphylococcus aureus subsp. aureus Mu50
uggaugaauauauu

SEQ ID NO: 3974920 - RNA, 16 nt, Staphylococcus aureus subsp. aureus Mu50
uggauguguuuuaaua

SEQ ID NO: 3974921 - RNA, 18 nt, Staphylococcus aureus subsp. aureus Mu50
uggauguguuuuaauaau

SEQ ID NO: 3974922 - RNA, 20 nt, Staphylococcus aureus subsp. aureus Mu50
uggauguguuuuaauaauau

SEQ ID NO: 3974923 - RNA, 17 nt, Staphylococcus aureus subsp. aureus Mu50
uggauucaaaugacauu

SEQ ID NO: 3974924 - RNA, 22 nt, Staphylococcus aureus subsp. aureus Mu50
uggauucaaaugacauuuuaaa

SEQ ID NO: 3974925 - RNA, 16 nt, Staphylococcus aureus subsp. aureus Mu50
uggauuucuuuuuaaa

SEQ ID NO: 3974926 - RNA, 14 nt, Staphylococcus aureus subsp. aureus Mu50
uggauuuuaacaag

SEQ ID NO: 3974927 - RNA, 18 nt, Staphylococcus aureus subsp. aureus Mu50
uggauuuuaacaagauaa

SEQ ID NO: 3974928 - RNA, 15 nt, Staphylococcus aureus subsp. aureus Mu50
uggauuuuaauuauu

SEQ ID NO: 3974929 - RNA, 22 nt, Staphylococcus aureus subsp. aureus Mu50
uggauuuucucccauacugauu

SEQ ID NO: 3974930 - RNA, 13 nt, Staphylococcus aureus subsp. aureus Mu50
uggauuuuucuua

SEQ ID NO: 3974931 - RNA, 14 nt, Staphylococcus aureus subsp. aureus Mu50
uggcaaaacaauau

SEQ ID NO: 3974932 - RNA, 19 nt, Staphylococcus aureus subsp. aureus Mu50
uggcaaagaauccuuaauu

SEQ ID NO: 3974933 - RNA, 22 nt, Staphylococcus aureus subsp. aureus Mu50
uggcaaauacaacucccuuuua

SEQ ID NO: 3974934 - RNA, 14 nt, Staphylococcus aureus subsp. aureus Mu50
uggcaaauaugagu

SEQ ID NO: 3974935 - RNA, 23 nt, Staphylococcus aureus subsp. aureus Mu50
uggcaacggcacauucauaccga

SEQ ID NO: 3974936 - RNA, 13 nt, Staphylococcus aureus subsp. aureus Mu50
uggcaauauacuu

SEQ ID NO: 3974937 - RNA, 14 nt, Staphylococcus aureus subsp. aureus Mu50
uggcacaaaugaau

SEQ ID NO: 3974938 - RNA, 11 nt, Staphylococcus aureus subsp. aureus Mu50
uggcaccagua

SEQ ID NO: 3974939 - RNA, 16 nt, Staphylococcus aureus subsp. aureus Mu50
uggcauaaccuguaau

SEQ ID NO: 3974940 - RNA, 19 nt, Staphylococcus aureus subsp. aureus Mu50
uggcauuauugccuaaccu

SEQ ID NO: 3974941 - RNA, 23 nt, Staphylococcus aureus subsp. aureus Mu50
uggccaaacaaccugugauaaaa

SEQ ID NO: 3974942 - RNA, 19 nt, Staphylococcus aureus subsp. aureus Mu50
uggccaaccaccauaugcu

SEQ ID NO: 3974943 - RNA, 18 nt, Staphylococcus aureus subsp. aureus Mu50
uggccacuaaugcauaau

SEQ ID NO: 3974944 - RNA, 21 nt, Staphylococcus aureus subsp. aureus Mu50
uggcgacauuuguaaauauuu

SEQ ID NO: 3974945 - RNA, 18 nt, Staphylococcus aureus subsp. aureus Mu50
uggcgauuccaaucuauu

SEQ ID NO: 3974946 - RNA, 18 nt, Staphylococcus aureus subsp. aureus Mu50
uggcgcaauuuuuaacaa

SEQ ID NO: 3974947 - RNA, 17 nt, Staphylococcus aureus subsp. aureus Mu50
uggcgguuugaaaauga

SEQ ID NO: 3974948 - RNA, 14 nt, Staphylococcus aureus subsp. aureus Mu50
uggcguucaacauu

SEQ ID NO: 3974949 - RNA, 21 nt, Staphylococcus aureus subsp. aureus Mu50
uggcuacuaaucuuuuuuuaa

SEQ ID NO: 3974950 - RNA, 15 nt, Staphylococcus aureus subsp. aureus Mu50
uggcucuuuuuauuu

SEQ ID NO: 3974951 - RNA, 15 nt, Staphylococcus aureus subsp. aureus Mu50
uggcugcaucaauau

SEQ ID NO: 3974952 - RNA, 19 nt, Staphylococcus aureus subsp. aureus Mu50
uggcuugaaguuguuucuc

SEQ ID NO: 3974953 - RNA, 16 nt, Staphylococcus aureus subsp. aureus Mu50
uggcuugcuucauuau

SEQ ID NO: 3974954 - RNA, 14 nt, Staphylococcus aureus subsp. aureus Mu50
uggcuuuuuuauuu

SEQ ID NO: 3974955 - RNA, 17 nt, Staphylococcus aureus subsp. aureus Mu50
ugggaaauauuugaaaa

SEQ ID NO: 3974956 - RNA, 15 nt, Staphylococcus aureus subsp. aureus Mu50
ugggaagcgucuuuu

SEQ ID NO: 3974957 - RNA, 14 nt, Staphylococcus aureus subsp. aureus Mu50
ugggaagguaaaac

SEQ ID NO: 3974958 - RNA, 21 nt, Staphylococcus aureus subsp. aureus Mu50
ugggacauaaaauuaacuuaa

SEQ ID NO: 3974959 - RNA, 21 nt, Staphylococcus aureus subsp. aureus Mu50
ugggacgacgaaauaaauuuu

SEQ ID NO: 3974960 - RNA, 17 nt, Staphylococcus aureus subsp. aureus Mu50
ugggagaaauuuuucac

SEQ ID NO: 3974961 - RNA, 18 nt, Staphylococcus aureus subsp. aureus Mu50
ugggauauagaaaaggga

SEQ ID NO: 3974962 - RNA, 18 nt, Staphylococcus aureus subsp. aureus Mu50
ugggcaguaauuuucauu

SEQ ID NO: 3974963 - RNA, 23 nt, Staphylococcus aureus subsp. aureus Mu50
ugggcauuuugacgccagaauaa

SEQ ID NO: 3974964 - RNA, 15 nt, Staphylococcus aureus subsp. aureus Mu50
ugggcugacauuuuu

SEQ ID NO: 3974965 - RNA, 18 nt, Staphylococcus aureus subsp. aureus Mu50
ugggggauuuuuuuaugu

SEQ ID NO: 3974966 - RNA, 23 nt, Staphylococcus aureus subsp. aureus Mu50
uggggugagggccccaacacaga

SEQ ID NO: 3974967 - RNA, 14 nt, Staphylococcus aureus subsp. aureus Mu50
ugggguuuuauuuu

SEQ ID NO: 3974968 - RNA, 12 nt, Staphylococcus aureus subsp. aureus Mu50
uggguaaucuuu

SEQ ID NO: 3974969 - RNA, 15 nt, Staphylococcus aureus subsp. aureus Mu50
uggguaauguuuuua

SEQ ID NO: 3974970 - RNA, 20 nt, Staphylococcus aureus subsp. aureus Mu50
uggguuuuaccauaaauuga

SEQ ID NO: 3974971 - RNA, 17 nt, Staphylococcus aureus subsp. aureus Mu50
ugguaaaucaugacaua

SEQ ID NO: 3974972 - RNA, 12 nt, Staphylococcus aureus subsp. aureus Mu50
ugguaaauuuau

SEQ ID NO: 3974973 - RNA, 20 nt, Staphylococcus aureus subsp. aureus Mu50
ugguaacucuucaguacgaa

SEQ ID NO: 3974974 - RNA, 21 nt, Staphylococcus aureus subsp. aureus Mu50
ugguaacucuucaguacgaac

SEQ ID NO: 3974975 - RNA, 11 nt, Staphylococcus aureus subsp. aureus Mu50
ugguaauauuu

SEQ ID NO: 3974976 - RNA, 18 nt, Staphylococcus aureus subsp. aureus Mu50
ugguacauaaauaccugg

SEQ ID NO: 3974977 - RNA, 19 nt, Staphylococcus aureus subsp. aureus Mu50
ugguaccuuuccaauuugu

SEQ ID NO: 3974978 - RNA, 17 nt, Staphylococcus aureus subsp. aureus Mu50
ugguacuauuuuugacu

SEQ ID NO: 3974979 - RNA, 13 nt, Staphylococcus aureus subsp. aureus Mu50
ugguagcauuuua

SEQ ID NO: 3974980 - RNA, 16 nt, Staphylococcus aureus subsp. aureus Mu50
ugguagcauuuuagau

SEQ ID NO: 3974981 - RNA, 18 nt, Staphylococcus aureus subsp. aureus Mu50
ugguauugauuauucuuu

SEQ ID NO: 3974982 - RNA, 13 nt, Staphylococcus aureus subsp. aureus Mu50
ugguauugguaaa

SEQ ID NO: 3974983 - RNA, 17 nt, Staphylococcus aureus subsp. aureus Mu50
ugguauugguaaauuua

SEQ ID NO: 3974984 - RNA, 16 nt, Staphylococcus aureus subsp. aureus Mu50
ugguauuuuuuuaugc

SEQ ID NO: 3974985 - RNA, 12 nt, Staphylococcus aureus subsp. aureus Mu50
uggucaccaaau

SEQ ID NO: 3974986 - RNA, 22 nt, Staphylococcus aureus subsp. aureus Mu50
uggucaccuacagauaaagcuu

SEQ ID NO: 3974987 - RNA, 17 nt, Staphylococcus aureus subsp. aureus Mu50
uggucguacuuucaaau

SEQ ID NO: 3974988 - RNA, 20 nt, Staphylococcus aureus subsp. aureus Mu50
uggucuaaagcuuauuaaau

SEQ ID NO: 3974989 - RNA, 14 nt, Staphylococcus aureus subsp. aureus Mu50
uggucuaauaucaa

SEQ ID NO: 3974990 - RNA, 13 nt, Staphylococcus aureus subsp. aureus Mu50
uggucuuucuuag

SEQ ID NO: 3974991 - RNA, 20 nt, Staphylococcus aureus subsp. aureus Mu50
uggucuuuuaauuaaaagug

SEQ ID NO: 3974992 - RNA, 16 nt, Staphylococcus aureus subsp. aureus Mu50
uggugagaaauugaau

SEQ ID NO: 3974993 - RNA, 18 nt, Staphylococcus aureus subsp. aureus Mu50
uggugagaaauugaauuc

SEQ ID NO: 3974994 - RNA, 24 nt, Staphylococcus aureus subsp. aureus Mu50
uggugaguguuucauaaucucuuu

SEQ ID NO: 3974995 - RNA, 15 nt, Staphylococcus aureus subsp. aureus Mu50
uggugcccaaguuuc

SEQ ID NO: 3974996 - RNA, 19 nt, Staphylococcus aureus subsp. aureus Mu50
ugguggagaaccuuuuugu

SEQ ID NO: 3974997 - RNA, 15 nt, Staphylococcus aureus subsp. aureus Mu50
ugguggaugucaugu

SEQ ID NO: 3974998 - RNA, 19 nt, Staphylococcus aureus subsp. aureus Mu50
ugguggguauauaauuuaa

SEQ ID NO: 3974999 - RNA, 18 nt, Staphylococcus aureus subsp. aureus Mu50
ugguuagagaaaaaucug

SEQ ID NO: 3975000 - RNA, 22 nt, Staphylococcus aureus subsp. aureus Mu50
ugguuaucacuuauuauuuugu

SEQ ID NO: 3975001 - RNA, 13 nt, Staphylococcus aureus subsp. aureus Mu50
uguaauuaggauu

SEQ ID NO: 3975002 - RNA, 20 nt, Staphylococcus aureus subsp. aureus Mu50
uguaauuagugcaaguaauu

SEQ ID NO: 3975003 - RNA, 15 nt, Staphylococcus aureus subsp. aureus Mu50
uguaauugaaaugau

SEQ ID NO: 3975004 - RNA, 14 nt, Staphylococcus aureus subsp. aureus Mu50
uguaauugaugauu

SEQ ID NO: 3975005 - RNA, 18 nt, Staphylococcus aureus subsp. aureus Mu50
uguaauuguuuuuucuua

SEQ ID NO: 3975006 - RNA, 12 nt, Staphylococcus aureus subsp. aureus Mu50
uguaauuuaaaa

SEQ ID NO: 3975007 - RNA, 13 nt, Staphylococcus aureus subsp. aureus Mu50
uguaauuuaaaau

SEQ ID NO: 3975008 - RNA, 17 nt, Staphylococcus aureus subsp. aureus Mu50
uguaauuuucacuuuca

SEQ ID NO: 3975009 - RNA, 17 nt, Staphylococcus aureus subsp. aureus Mu50
uguacaauaauuaguca

SEQ ID NO: 3975010 - RNA, 14 nt, Staphylococcus aureus subsp. aureus Mu50
uguacaauuuuuaa

SEQ ID NO: 3975011 - RNA, 16 nt, Staphylococcus aureus subsp. aureus Mu50
uguacaauuuuuaaaa

SEQ ID NO: 3975012 - RNA, 18 nt, Staphylococcus aureus subsp. aureus Mu50
uguacaauuuuuaaaaac

SEQ ID NO: 3975013 - RNA, 14 nt, Staphylococcus aureus subsp. aureus Mu50
uguacacuuuugau

SEQ ID NO: 3975014 - RNA, 16 nt, Staphylococcus aureus subsp. aureus Mu50
uguacaguaauauuca

SEQ ID NO: 3975015 - RNA, 17 nt, Staphylococcus aureus subsp. aureus Mu50
uguacaucauuaaauau

SEQ ID NO: 3975016 - RNA, 15 nt, Staphylococcus aureus subsp. aureus Mu50
uguacauguauaaaa

SEQ ID NO: 3975017 - RNA, 14 nt, Staphylococcus aureus subsp. aureus Mu50
uguaccaauugauu

SEQ ID NO: 3975018 - RNA, 13 nt, Staphylococcus aureus subsp. aureus Mu50
uguaccaccccaa

SEQ ID NO: 3975019 - RNA, 17 nt, Staphylococcus aureus subsp. aureus Mu50
uguaccaguaacaauaa

SEQ ID NO: 3975020 - RNA, 21 nt, Staphylococcus aureus subsp. aureus Mu50
uguaccaucacuaaaguaaau

SEQ ID NO: 3975021 - RNA, 23 nt, Staphylococcus aureus subsp. aureus Mu50
uguacgaccagucgcauauuuug

SEQ ID NO: 3975022 - RNA, 22 nt, Staphylococcus aureus subsp. aureus Mu50
uguacguuuaauaccuaugaua

SEQ ID NO: 3975023 - RNA, 16 nt, Staphylococcus aureus subsp. aureus Mu50
uguacuacuugauucu

SEQ ID NO: 3975024 - RNA, 19 nt, Staphylococcus aureus subsp. aureus Mu50
uguacucuucguuuuaaua

SEQ ID NO: 3975025 - RNA, 15 nt, Staphylococcus aureus subsp. aureus Mu50
uguacuucuuugguc

SEQ ID NO: 3975026 - RNA, 23 nt, Staphylococcus aureus subsp. aureus Mu50
uguacuuuuauguuguuauaaag

SEQ ID NO: 3975027 - RNA, 23 nt, Staphylococcus aureus subsp. aureus Mu50
uguagaaacacaaggaauauaca

SEQ ID NO: 3975028 - RNA, 21 nt, Staphylococcus aureus subsp. aureus Mu50
uguagcacaagauucaacuug

SEQ ID NO: 3975029 - RNA, 18 nt, Staphylococcus aureus subsp. aureus Mu50
uguagcaggcaacuuuua

SEQ ID NO: 3975030 - RNA, 21 nt, Staphylococcus aureus subsp. aureus Mu50
uguagcaggcaacuuuuauua

SEQ ID NO: 3975031 - RNA, 23 nt, Staphylococcus aureus subsp. aureus Mu50
uguaggcgccauaaucauuaguu

SEQ ID NO: 3975032 - RNA, 16 nt, Staphylococcus aureus subsp. aureus Mu50
uguaggcuuuuuauuu

SEQ ID NO: 3975033 - RNA, 17 nt, Staphylococcus aureus subsp. aureus Mu50
uguaggcuuuuuauuuu

SEQ ID NO: 3975034 - RNA, 17 nt, Staphylococcus aureus subsp. aureus Mu50
uguagggggcauuauua

SEQ ID NO: 3975035 - RNA, 15 nt, Staphylococcus aureus subsp. aureus Mu50
uguaguaguuccguu

SEQ ID NO: 3975036 - RNA, 22 nt, Staphylococcus aureus subsp. aureus Mu50
uguaguaguuccguugaauuaa

SEQ ID NO: 3975037 - RNA, 21 nt, Staphylococcus aureus subsp. aureus Mu50
uguagugcgcuuauuuuacua

SEQ ID NO: 3975038 - RNA, 16 nt, Staphylococcus aureus subsp. aureus Mu50
uguagugguucuuaua

SEQ ID NO: 3975039 - RNA, 18 nt, Staphylococcus aureus subsp. aureus Mu50
uguaguuaagauaccuuu

SEQ ID NO: 3975040 - RNA, 21 nt, Staphylococcus aureus subsp. aureus Mu50
uguaguuaagauaccuuuuuc

SEQ ID NO: 3975041 - RNA, 20 nt, Staphylococcus aureus subsp. aureus Mu50
uguauaaaaagugcauauuu

SEQ ID NO: 3975042 - RNA, 16 nt, Staphylococcus aureus subsp. aureus Mu50
uguauaaaacagaauu

SEQ ID NO: 3975043 - RNA, 21 nt, Staphylococcus aureus subsp. aureus Mu50
uguauaaaagauauaaacauu

SEQ ID NO: 3975044 - RNA, 20 nt, Staphylococcus aureus subsp. aureus Mu50
uguauaaagggcuauuugau

SEQ ID NO: 3975045 - RNA, 14 nt, Staphylococcus aureus subsp. aureus Mu50
uguauaaauaauaa

SEQ ID NO: 3975046 - RNA, 17 nt, Staphylococcus aureus subsp. aureus Mu50
uguauagagagaaauaa

SEQ ID NO: 3975047 - RNA, 20 nt, Staphylococcus aureus subsp. aureus Mu50
uguauagauuguauuuaaua

SEQ ID NO: 3975048 - RNA, 20 nt, Staphylococcus aureus subsp. aureus Mu50
uguauagcuggcuuuuuaau

SEQ ID NO: 3975049 - RNA, 20 nt, Staphylococcus aureus subsp. aureus Mu50
uguauaugaauuuuauaaau

SEQ ID NO: 3975050 - RNA, 21 nt, Staphylococcus aureus subsp. aureus Mu50
uguauaugaauuuuauaaauu

SEQ ID NO: 3975051 - RNA, 20 nt, Staphylococcus aureus subsp. aureus Mu50
uguauauggcgauaacaaga

SEQ ID NO: 3975052 - RNA, 14 nt, Staphylococcus aureus subsp. aureus Mu50
uguauauucuuuuu

SEQ ID NO: 3975053 - RNA, 17 nt, Staphylococcus aureus subsp. aureus Mu50
uguauauuuaacaucaa

SEQ ID NO: 3975054 - RNA, 18 nt, Staphylococcus aureus subsp. aureus Mu50
uguauauuuaacaucaau

SEQ ID NO: 3975055 - RNA, 22 nt, Staphylococcus aureus subsp. aureus Mu50
uguaucaaaaucgguuugauua

SEQ ID NO: 3975056 - RNA, 22 nt, Staphylococcus aureus subsp. aureus Mu50
uguaucaacauuaauaaauaau

SEQ ID NO: 3975057 - RNA, 19 nt, Staphylococcus aureus subsp. aureus Mu50
uguaucaagaucaacaaug

SEQ ID NO: 3975058 - RNA, 17 nt, Staphylococcus aureus subsp. aureus Mu50
uguaucacauucaauau

SEQ ID NO: 3975059 - RNA, 21 nt, Staphylococcus aureus subsp. aureus Mu50
uguaucgauucgauuauuuag

SEQ ID NO: 3975060 - RNA, 18 nt, Staphylococcus aureus subsp. aureus Mu50
uguaucucugaaaaacuu

SEQ ID NO: 3975061 - RNA, 21 nt, Staphylococcus aureus subsp. aureus Mu50
uguaucucugaaaaacuucuu

SEQ ID NO: 3975062 - RNA, 16 nt, Staphylococcus aureus subsp. aureus Mu50
uguaugaguccuuuuu

SEQ ID NO: 3975063 - RNA, 19 nt, Staphylococcus aureus subsp. aureus Mu50
uguaugaguucguaaucuu

SEQ ID NO: 3975064 - RNA, 14 nt, Staphylococcus aureus subsp. aureus Mu50
uguaugauaaccau

SEQ ID NO: 3975065 - RNA, 20 nt, Staphylococcus aureus subsp. aureus Mu50
uguaugauagaauacuaaaa

SEQ ID NO: 3975066 - RNA, 19 nt, Staphylococcus aureus subsp. aureus Mu50
uguaugccgccuaauaaua

SEQ ID NO: 3975067 - RNA, 15 nt, Staphylococcus aureus subsp. aureus Mu50
uguauguugaaagug

SEQ ID NO: 3975068 - RNA, 21 nt, Staphylococcus aureus subsp. aureus Mu50
uguauguuuuaucaauauuag

SEQ ID NO: 3975069 - RNA, 23 nt, Staphylococcus aureus subsp. aureus Mu50
uguauuauucucucauuuguaua

SEQ ID NO: 3975070 - RNA, 17 nt, Staphylococcus aureus subsp. aureus Mu50
uguauucagucaguaaa

SEQ ID NO: 3975071 - RNA, 17 nt, Staphylococcus aureus subsp. aureus Mu50
uguauucgguuaauauu

SEQ ID NO: 3975072 - RNA, 20 nt, Staphylococcus aureus subsp. aureus Mu50
uguauucgguuaauauucuu

SEQ ID NO: 3975073 - RNA, 16 nt, Staphylococcus aureus subsp. aureus Mu50
uguauucugaaacuuu

SEQ ID NO: 3975074 - RNA, 17 nt, Staphylococcus aureus subsp. aureus Mu50
uguauucugaaacuuua

SEQ ID NO: 3975075 - RNA, 16 nt, Staphylococcus aureus subsp. aureus Mu50
uguauucuuagauauu

SEQ ID NO: 3975076 - RNA, 19 nt, Staphylococcus aureus subsp. aureus Mu50
uguauucuuggcguauuuu

SEQ ID NO: 3975077 - RNA, 18 nt, Staphylococcus aureus subsp. aureus Mu50
uguauugaucuacauaau

SEQ ID NO: 3975078 - RNA, 19 nt, Staphylococcus aureus subsp. aureus Mu50
uguauuguuugaaaauuaa

SEQ ID NO: 3975079 - RNA, 17 nt, Staphylococcus aureus subsp. aureus Mu50
uguauuguuuguuuuua

SEQ ID NO: 3975080 - RNA, 17 nt, Staphylococcus aureus subsp. aureus Mu50
uguauuuaauaaaccag

SEQ ID NO: 3975081 - RNA, 14 nt, Staphylococcus aureus subsp. aureus Mu50
uguauuuaauaagu

SEQ ID NO: 3975082 - RNA, 12 nt, Staphylococcus aureus subsp. aureus Mu50
uguauuucuuaa

SEQ ID NO: 3975083 - RNA, 18 nt, Staphylococcus aureus subsp. aureus Mu50
uguauuucuuaacauccu

SEQ ID NO: 3975084 - RNA, 15 nt, Staphylococcus aureus subsp. aureus Mu50
uguauuuggcgcuuu

SEQ ID NO: 3975085 - RNA, 20 nt, Staphylococcus aureus subsp. aureus Mu50
uguauuuuaacgucauuuuu

SEQ ID NO: 3975086 - RNA, 21 nt, Staphylococcus aureus subsp. aureus Mu50
uguauuuuaacgucauuuuua

SEQ ID NO: 3975087 - RNA, 18 nt, Staphylococcus aureus subsp. aureus Mu50
uguauuuuuacuuuuaua

SEQ ID NO: 3975088 - RNA, 17 nt, Staphylococcus aureus subsp. aureus Mu50
uguggcggugguauggu

SEQ ID NO: 3975089 - RNA, 19 nt, Staphylococcus aureus subsp. aureus Mu50
uguggcuacuaaucuuuuu

SEQ ID NO: 3975090 - RNA, 13 nt, Staphylococcus aureus subsp. aureus Mu50
uguggcucgaaaa

SEQ ID NO: 3975091 - RNA, 22 nt, Staphylococcus aureus subsp. aureus Mu50
uguggguguaccaauugauuuu

SEQ ID NO: 3975092 - RNA, 11 nt, Staphylococcus aureus subsp. aureus Mu50
ugugguaaaag

SEQ ID NO: 3975093 - RNA, 17 nt, Staphylococcus aureus subsp. aureus Mu50
uguguaaaauaaaucau

SEQ ID NO: 3975094 - RNA, 21 nt, Staphylococcus aureus subsp. aureus Mu50
uguguaucaguuauuuuaaua

SEQ ID NO: 3975095 - RNA, 23 nt, Staphylococcus aureus subsp. aureus Mu50
uguguaucuguaacauaaacaau

SEQ ID NO: 3975096 - RNA, 15 nt, Staphylococcus aureus subsp. aureus Mu50
uguguauuuuuauug

SEQ ID NO: 3975097 - RNA, 22 nt, Staphylococcus aureus subsp. aureus Mu50
ugugucaaauaggcauaaugaa

SEQ ID NO: 3975098 - RNA, 11 nt, Staphylococcus aureus subsp. aureus Mu50
ugugucaacuu

SEQ ID NO: 3975099 - RNA, 20 nt, Staphylococcus aureus subsp. aureus Mu50
uguguccauaaauauuaaau

SEQ ID NO: 3975100 - RNA, 15 nt, Staphylococcus aureus subsp. aureus Mu50
uguguccaucauuug

SEQ ID NO: 3975101 - RNA, 16 nt, Staphylococcus aureus subsp. aureus Mu50
uguguccaucauuugu

SEQ ID NO: 3975102 - RNA, 19 nt, Staphylococcus aureus subsp. aureus Mu50
uguguucggaauuugcaca

SEQ ID NO: 3975103 - RNA, 16 nt, Staphylococcus aureus subsp. aureus Mu50
uguguuggggcccaca

SEQ ID NO: 3975104 - RNA, 19 nt, Staphylococcus aureus subsp. aureus Mu50
uguguuggggcccacaccc

SEQ ID NO: 3975105 - RNA, 17 nt, Staphylococcus aureus subsp. aureus Mu50
uguguuggugcuauuaa

SEQ ID NO: 3975106 - RNA, 22 nt, Staphylococcus aureus subsp. aureus Mu50
uguguuguuucaggauaaugaa

SEQ ID NO: 3975107 - RNA, 13 nt, Staphylococcus aureus subsp. aureus Mu50
uguguuucagcuu

SEQ ID NO: 3975108 - RNA, 13 nt, Staphylococcus aureus subsp. aureus Mu50
uguguuucuuuua

SEQ ID NO: 3975109 - RNA, 18 nt, Staphylococcus aureus subsp. aureus Mu50
uguguuugcuuuuuacua

SEQ ID NO: 3975110 - RNA, 18 nt, Staphylococcus aureus subsp. aureus Mu50
uguguuuuaaaauuauuu

SEQ ID NO: 3975111 - RNA, 23 nt, Staphylococcus aureus subsp. aureus Mu50
uguuaaaaaauggauuuggucaa

SEQ ID NO: 3975112 - RNA, 16 nt, Staphylococcus aureus subsp. aureus Mu50
uguuaaaauaaugucu

SEQ ID NO: 3975113 - RNA, 15 nt, Staphylococcus aureus subsp. aureus Mu50
uguuaaaauuugaau

SEQ ID NO: 3975114 - RNA, 15 nt, Staphylococcus aureus subsp. aureus Mu50
uguuaaacccucauu

SEQ ID NO: 3975115 - RNA, 21 nt, Staphylococcus aureus subsp. aureus Mu50
uguuaaacccucauuuuuaua

SEQ ID NO: 3975116 - RNA, 22 nt, Staphylococcus aureus subsp. aureus Mu50
uguuaaacgcugauuuuauaaa

SEQ ID NO: 3975117 - RNA, 18 nt, Staphylococcus aureus subsp. aureus Mu50
uguuaaacuagaaaacau

SEQ ID NO: 3975118 - RNA, 16 nt, Staphylococcus aureus subsp. aureus Mu50
uguuaaagauuauuau

SEQ ID NO: 3975119 - RNA, 23 nt, Staphylococcus aureus subsp. aureus Mu50
uguuaaaggauggauacuuaaag

SEQ ID NO: 3975120 - RNA, 12 nt, Staphylococcus aureus subsp. aureus Mu50
uguuaaaucacc

SEQ ID NO: 3975121 - RNA, 16 nt, Staphylococcus aureus subsp. aureus Mu50
uguuaaauuaaaucga

SEQ ID NO: 3975122 - RNA, 16 nt, Staphylococcus aureus subsp. aureus Mu50
uguuaaauucuaaaac

SEQ ID NO: 3975123 - RNA, 15 nt, Staphylococcus aureus subsp. aureus Mu50
uguuaacugauaaaa

SEQ ID NO: 3975124 - RNA, 21 nt, Staphylococcus aureus subsp. aureus Mu50
uguuaacugauaaaaggggaa

SEQ ID NO: 3975125 - RNA, 14 nt, Staphylococcus aureus subsp. aureus Mu50
uguuaaguuuucaa

SEQ ID NO: 3975126 - RNA, 14 nt, Staphylococcus aureus subsp. aureus Mu50
uguuaauaaaucau

SEQ ID NO: 3975127 - RNA, 15 nt, Staphylococcus aureus subsp. aureus Mu50
uguuaauaaaucauu

SEQ ID NO: 3975128 - RNA, 19 nt, Staphylococcus aureus subsp. aureus Mu50
uguuaauaaccgaaauauu

SEQ ID NO: 3975129 - RNA, 13 nt, Staphylococcus aureus subsp. aureus Mu50
uguuaaucaaaau

SEQ ID NO: 3975130 - RNA, 20 nt, Staphylococcus aureus subsp. aureus Mu50
uguuaaucaaaauuaugacu

SEQ ID NO: 3975131 - RNA, 22 nt, Staphylococcus aureus subsp. aureus Mu50
uguuaaucaacguauauaaguu

SEQ ID NO: 3975132 - RNA, 20 nt, Staphylococcus aureus subsp. aureus Mu50
uguuaaugcuucguaaucuu

SEQ ID NO: 3975133 - RNA, 16 nt, Staphylococcus aureus subsp. aureus Mu50
uguuaaugucuucaua

SEQ ID NO: 3975134 - RNA, 13 nt, Staphylococcus aureus subsp. aureus Mu50
uguuaauuuaaua

SEQ ID NO: 3975135 - RNA, 16 nt, Staphylococcus aureus subsp. aureus Mu50
uguuaauuuaauaauu

SEQ ID NO: 3975136 - RNA, 13 nt, Staphylococcus aureus subsp. aureus Mu50
uguuaauuucaac

SEQ ID NO: 3975137 - RNA, 14 nt, Staphylococcus aureus subsp. aureus Mu50
uguuaauuuuuuau

SEQ ID NO: 3975138 - RNA, 16 nt, Staphylococcus aureus subsp. aureus Mu50
uguuaauuuuuuauua

SEQ ID NO: 3975139 - RNA, 17 nt, Staphylococcus aureus subsp. aureus Mu50
uguuaauuuuuuauuaa

SEQ ID NO: 3975140 - RNA, 16 nt, Staphylococcus aureus subsp. aureus Mu50
uguuacacaaauuaaa

SEQ ID NO: 3975141 - RNA, 15 nt, Staphylococcus aureus subsp. aureus Mu50
uguuacacuuuucuu

SEQ ID NO: 3975142 - RNA, 16 nt, Staphylococcus aureus subsp. aureus Mu50
uguuacacuuuucuua

SEQ ID NO: 3975143 - RNA, 20 nt, Staphylococcus aureus subsp. aureus Mu50
uguuacgagugcacuuguaa

SEQ ID NO: 3975144 - RNA, 22 nt, Staphylococcus aureus subsp. aureus Mu50
uguuacgagugcacuuguaaua

SEQ ID NO: 3975145 - RNA, 18 nt, Staphylococcus aureus subsp. aureus Mu50
uguuacuaguuuguaaua

SEQ ID NO: 3975146 - RNA, 23 nt, Staphylococcus aureus subsp. aureus Mu50
uguuacuaguuuguaauaauuaa

SEQ ID NO: 3975147 - RNA, 16 nt, Staphylococcus aureus subsp. aureus Mu50
uguuacugaugaacau

SEQ ID NO: 3975148 - RNA, 15 nt, Staphylococcus aureus subsp. aureus Mu50
uguuacuuauauauu

SEQ ID NO: 3975149 - RNA, 24 nt, Staphylococcus aureus subsp. aureus Mu50
uguuacuuauauauucaauaauua

SEQ ID NO: 3975150 - RNA, 18 nt, Staphylococcus aureus subsp. aureus Mu50
uguuacuucuaauaguaa

SEQ ID NO: 3975151 - RNA, 21 nt, Staphylococcus aureus subsp. aureus Mu50
uguuagauaaucucauucuuu

SEQ ID NO: 3975152 - RNA, 22 nt, Staphylococcus aureus subsp. aureus Mu50
uguuaggagagauguauaaaac

SEQ ID NO: 3975153 - RNA, 13 nt, Staphylococcus aureus subsp. aureus Mu50
uguuaggggcuuu

SEQ ID NO: 3975154 - RNA, 13 nt, Staphylococcus aureus subsp. aureus Mu50
uguuagucuuuuu

SEQ ID NO: 3975155 - RNA, 14 nt, Staphylococcus aureus subsp. aureus Mu50
uguuagucuuuuua

SEQ ID NO: 3975156 - RNA, 11 nt, Staphylococcus aureus subsp. aureus Mu50
uguuauaaaau

SEQ ID NO: 3975157 - RNA, 18 nt, Staphylococcus aureus subsp. aureus Mu50
uguuauaaaaugaauaau

SEQ ID NO: 3975158 - RNA, 23 nt, Staphylococcus aureus subsp. aureus Mu50
uguuauaaauagagaacagcagu

SEQ ID NO: 3975159 - RNA, 17 nt, Staphylococcus aureus subsp. aureus Mu50
uguuauagcguuuaaga

SEQ ID NO: 3975160 - RNA, 14 nt, Staphylococcus aureus subsp. aureus Mu50
uguuauauaaauag

SEQ ID NO: 3975161 - RNA, 21 nt, Staphylococcus aureus subsp. aureus Mu50
uguuauauaaauaugguuucu

SEQ ID NO: 3975162 - RNA, 23 nt, Staphylococcus aureus subsp. aureus Mu50
uguuauauaaauaugguuucuua

SEQ ID NO: 3975163 - RNA, 16 nt, Staphylococcus aureus subsp. aureus Mu50
uguuauauuaaacuua

SEQ ID NO: 3975164 - RNA, 23 nt, Staphylococcus aureus subsp. aureus Mu50
uguuauauuggcaguguuugacu

SEQ ID NO: 3975165 - RNA, 20 nt, Staphylococcus aureus subsp. aureus Mu50
uguuauauuguauuuuauuu

SEQ ID NO: 3975166 - RNA, 14 nt, Staphylococcus aureus subsp. aureus Mu50
uguuauauuuuuag

SEQ ID NO: 3975167 - RNA, 14 nt, Staphylococcus aureus subsp. aureus Mu50
uguuaugaaguauc

SEQ ID NO: 3975168 - RNA, 21 nt, Staphylococcus aureus subsp. aureus Mu50
uguuaugaaguauccuuauuu

SEQ ID NO: 3975169 - RNA, 15 nt, Staphylococcus aureus subsp. aureus Mu50
uguuauguaugaaag

SEQ ID NO: 3975170 - RNA, 13 nt, Staphylococcus aureus subsp. aureus Mu50
uguuauuaaaccc

SEQ ID NO: 3975171 - RNA, 13 nt, Staphylococcus aureus subsp. aureus Mu50
uguuauuauaaac

SEQ ID NO: 3975172 - RNA, 22 nt, Staphylococcus aureus subsp. aureus Mu50
uguuauuaucguaaaaaaacgu

SEQ ID NO: 3975173 - RNA, 15 nt, Staphylococcus aureus subsp. aureus Mu50
uguuauugcaauaaa

SEQ ID NO: 3975174 - RNA, 19 nt, Staphylococcus aureus subsp. aureus Mu50
uguuauugcaauaaaauua

SEQ ID NO: 3975175 - RNA, 19 nt, Staphylococcus aureus subsp. aureus Mu50
uguuauugcuuauuuuugu

SEQ ID NO: 3975176 - RNA, 16 nt, Staphylococcus aureus subsp. aureus Mu50
uguuuauuacauaauu

SEQ ID NO: 3975177 - RNA, 14 nt, Staphylococcus aureus subsp. aureus Mu50
uguuuauuuagaau

SEQ ID NO: 3975178 - RNA, 16 nt, Staphylococcus aureus subsp. aureus Mu50
uguuuauuuagaauaa

SEQ ID NO: 3975179 - RNA, 15 nt, Staphylococcus aureus subsp. aureus Mu50
uguuucaaaauaauu

SEQ ID NO: 3975180 - RNA, 19 nt, Staphylococcus aureus subsp. aureus Mu50
uguuucaaaauaauuuuau

SEQ ID NO: 3975181 - RNA, 13 nt, Staphylococcus aureus subsp. aureus Mu50
uguuucaaacaaa

SEQ ID NO: 3975182 - RNA, 12 nt, Staphylococcus aureus subsp. aureus Mu50
uguuucaacaua

SEQ ID NO: 3975183 - RNA, 14 nt, Staphylococcus aureus subsp. aureus Mu50
uguuucaacauauu

SEQ ID NO: 3975184 - RNA, 19 nt, Staphylococcus aureus subsp. aureus Mu50
uguuucaacauauuauaua

SEQ ID NO: 3975185 - RNA, 23 nt, Staphylococcus aureus subsp. aureus Mu50
uguuucaacauauuauauauauu

SEQ ID NO: 3975186 - RNA, 17 nt, Staphylococcus aureus subsp. aureus Mu50
uguuucaggauaaugaa

SEQ ID NO: 3975187 - RNA, 18 nt, Staphylococcus aureus subsp. aureus Mu50
uguuucaggauaaugaaa

SEQ ID NO: 3975188 - RNA, 21 nt, Staphylococcus aureus subsp. aureus Mu50
uguuucauaugcaucaacaga

SEQ ID NO: 3975189 - RNA, 22 nt, Staphylococcus aureus subsp. aureus Mu50
uguuuccuacacuguuuuauaa

SEQ ID NO: 3975190 - RNA, 17 nt, Staphylococcus aureus subsp. aureus Mu50
uguuucgcaaguagucu

SEQ ID NO: 3975191 - RNA, 16 nt, Staphylococcus aureus subsp. aureus Mu50
uguuucguauguuucu

SEQ ID NO: 3975192 - RNA, 12 nt, Staphylococcus aureus subsp. aureus Mu50
uguuucuaaauu

SEQ ID NO: 3975193 - RNA, 18 nt, Staphylococcus aureus subsp. aureus Mu50
uguuucuaaauucuuuuu

SEQ ID NO: 3975194 - RNA, 22 nt, Staphylococcus aureus subsp. aureus Mu50
uguuucuuuacuucuuucaaaa

SEQ ID NO: 3975195 - RNA, 18 nt, Staphylococcus aureus subsp. aureus Mu50
uguuucuuuuauuuucau

SEQ ID NO: 3975196 - RNA, 20 nt, Staphylococcus aureus subsp. aureus Mu50
uguuucuuuuauuuucauaa

SEQ ID NO: 3975197 - RNA, 22 nt, Staphylococcus aureus subsp. aureus Mu50
uguuugacaaguugcugaauaa

SEQ ID NO: 3975198 - RNA, 16 nt, Staphylococcus aureus subsp. aureus Mu50
uguuugagauauauua

SEQ ID NO: 3975199 - RNA, 21 nt, Staphylococcus aureus subsp. aureus Mu50
uguuugaugauucguauucaa

SEQ ID NO: 3975200 - RNA, 15 nt, Staphylococcus aureus subsp. aureus Mu50
uguuugcaacauauu

SEQ ID NO: 3975201 - RNA, 22 nt, Staphylococcus aureus subsp. aureus Mu50
uguuugcccugcuguuuuauuc

SEQ ID NO: 3975202 - RNA, 14 nt, Staphylococcus aureus subsp. aureus Mu50
uguuugcuuuuugu

SEQ ID NO: 3975203 - RNA, 17 nt, Staphylococcus aureus subsp. aureus Mu50
uguuuggauaucuuugu

SEQ ID NO: 3975204 - RNA, 16 nt, Staphylococcus aureus subsp. aureus Mu50
uguuuggaugaacaaa

SEQ ID NO: 3975205 - RNA, 13 nt, Staphylococcus aureus subsp. aureus Mu50
uguuuggcauaau

SEQ ID NO: 3975206 - RNA, 22 nt, Staphylococcus aureus subsp. aureus Mu50
uguuugguaacacugugaagua

SEQ ID NO: 3975207 - RNA, 16 nt, Staphylococcus aureus subsp. aureus Mu50
uguuuguaagucgcuc

SEQ ID NO: 3975208 - RNA, 24 nt, Staphylococcus aureus subsp. aureus Mu50
uguuuguaaugucgaucuaacaau

SEQ ID NO: 3975209 - RNA, 14 nt, Staphylococcus aureus subsp. aureus Mu50
uguuuguuuuuaua

SEQ ID NO: 3975210 - RNA, 12 nt, Staphylococcus aureus subsp. aureus Mu50
uguuuuaaaaaa

SEQ ID NO: 3975211 - RNA, 17 nt, Staphylococcus aureus subsp. aureus Mu50
uguuuuaaacuuauuaa

SEQ ID NO: 3975212 - RNA, 12 nt, Staphylococcus aureus subsp. aureus Mu50
uguuuuaauaau

SEQ ID NO: 3975213 - RNA, 17 nt, Staphylococcus aureus subsp. aureus Mu50
uguuuuaauaauaucuu

SEQ ID NO: 3975214 - RNA, 12 nt, Staphylococcus aureus subsp. aureus Mu50
uguuuuaauuuc

SEQ ID NO: 3975215 - RNA, 20 nt, Staphylococcus aureus subsp. aureus Mu50
uguuuuauaaaugaauuauu

SEQ ID NO: 3975216 - RNA, 14 nt, Staphylococcus aureus subsp. aureus Mu50
uguuuuauagcauu

SEQ ID NO: 3975217 - RNA, 15 nt, Staphylococcus aureus subsp. aureus Mu50
uguuuuaucaauauu

SEQ ID NO: 3975218 - RNA, 13 nt, Staphylococcus aureus subsp. aureus Mu50
uguuuuauucaau

SEQ ID NO: 3975219 - RNA, 20 nt, Staphylococcus aureus subsp. aureus Mu50
uguuuucaacaguuuuaaag

SEQ ID NO: 3975220 - RNA, 21 nt, Staphylococcus aureus subsp. aureus Mu50
uguuuucaacaguuuuaaaga

SEQ ID NO: 3975221 - RNA, 14 nt, Staphylococcus aureus subsp. aureus Mu50
uguuuucaauaauu

SEQ ID NO: 3975222 - RNA, 22 nt, Staphylococcus aureus subsp. aureus Mu50
uguuuucaucaugcauaaucau

SEQ ID NO: 3975223 - RNA, 16 nt, Staphylococcus aureus subsp. aureus Mu50
uguuuucauuuaaaag

SEQ ID NO: 3975224 - RNA, 17 nt, Staphylococcus aureus subsp. aureus Mu50
uguuuuccaauaauaaa

SEQ ID NO: 3975225 - RNA, 15 nt, Staphylococcus aureus subsp. aureus Mu50
uguuuucuaaaucua

SEQ ID NO: 3975226 - RNA, 18 nt, Staphylococcus aureus subsp. aureus Mu50
uguuuucuauaauauuua

SEQ ID NO: 3975227 - RNA, 15 nt, Staphylococcus aureus subsp. aureus Mu50
uguuuucuuuucaaa

SEQ ID NO: 3975228 - RNA, 20 nt, Staphylococcus aureus subsp. aureus Mu50
uguuuugagagauuauuuaa

SEQ ID NO: 3975229 - RNA, 20 nt, Staphylococcus aureus subsp. aureus Mu50
uguuuugcgguuuuuuugau

SEQ ID NO: 3975230 - RNA, 12 nt, Staphylococcus aureus subsp. aureus Mu50
uguuuuuaaaau

SEQ ID NO: 3975231 - RNA, 21 nt, Staphylococcus aureus subsp. aureus Mu50
uguuuuuaacagcuuuuucua

SEQ ID NO: 3975232 - RNA, 19 nt, Staphylococcus aureus subsp. aureus Mu50
uguuuuuaauguuugcuuu

SEQ ID NO: 3975233 - RNA, 13 nt, Staphylococcus aureus subsp. aureus Mu50
uguuuuuauauua

SEQ ID NO: 3975234 - RNA, 21 nt, Staphylococcus aureus subsp. aureus Mu50
uguuuuucacuguuaaagucu

SEQ ID NO: 3975235 - RNA, 16 nt, Staphylococcus aureus subsp. aureus Mu50
uguuuuucaucauuaa

SEQ ID NO: 3975236 - RNA, 17 nt, Staphylococcus aureus subsp. aureus Mu50
uguuuuucaucauuaaa

SEQ ID NO: 3975237 - RNA, 21 nt, Staphylococcus aureus subsp. aureus Mu50
uuaaaaaacaauaaaauuacu

SEQ ID NO: 3975238 - RNA, 15 nt, Staphylococcus aureus subsp. aureus Mu50
uuaaaaaacagugua

SEQ ID NO: 3975239 - RNA, 19 nt, Staphylococcus aureus subsp. aureus Mu50
uuaaaaaaccugaaacaaa

SEQ ID NO: 3975240 - RNA, 18 nt, Staphylococcus aureus subsp. aureus Mu50
uuaaaaaagaacauaaaa

SEQ ID NO: 3975241 - RNA, 12 nt, Staphylococcus aureus subsp. aureus Mu50
uuaaaaaauaug

SEQ ID NO: 3975242 - RNA, 19 nt, Staphylococcus aureus subsp. aureus Mu50
uuaaaaaauauguauguuu

SEQ ID NO: 3975243 - RNA, 16 nt, Staphylococcus aureus subsp. aureus Mu50
uuaaaaaauuuaaugu

SEQ ID NO: 3975244 - RNA, 12 nt, Staphylococcus aureus subsp. aureus Mu50
uuaaaaacagca

SEQ ID NO: 3975245 - RNA, 12 nt, Staphylococcus aureus subsp. aureus Mu50
uuaaaaauaaaa

SEQ ID NO: 3975246 - RNA, 17 nt, Staphylococcus aureus subsp. aureus Mu50
uuaaaaauacagcuaca

SEQ ID NO: 3975247 - RNA, 16 nt, Staphylococcus aureus subsp. aureus Mu50
uuaaaaauauguguua

SEQ ID NO: 3975248 - RNA, 13 nt, Staphylococcus aureus subsp. aureus Mu50
uuaaaaauucaua

SEQ ID NO: 3975249 - RNA, 19 nt, Staphylococcus aureus subsp. aureus Mu50
uuaaaaauugaaggaaaau

SEQ ID NO: 3975250 - RNA, 19 nt, Staphylococcus aureus subsp. aureus Mu50
uuaaaacaauaauuuaaua

SEQ ID NO: 3975251 - RNA, 19 nt, Staphylococcus aureus subsp. aureus Mu50
uuaaaacaaugauuaaaau

SEQ ID NO: 3975252 - RNA, 15 nt, Staphylococcus aureus subsp. aureus Mu50
uuaaaacaucauuca

SEQ ID NO: 3975253 - RNA, 17 nt, Staphylococcus aureus subsp. aureus Mu50
uuaaaacuauaaccuau

SEQ ID NO: 3975254 - RNA, 17 nt, Staphylococcus aureus subsp. aureus Mu50
uuaaaacuuucagagau

SEQ ID NO: 3975255 - RNA, 20 nt, Staphylococcus aureus subsp. aureus Mu50
uuaaaagacauccacagaau

SEQ ID NO: 3975256 - RNA, 15 nt, Staphylococcus aureus subsp. aureus Mu50
uuaaaagauaaauaa

SEQ ID NO: 3975257 - RNA, 16 nt, Staphylococcus aureus subsp. aureus Mu50
uuaaaagauaaauaaa

SEQ ID NO: 3975258 - RNA, 18 nt, Staphylococcus aureus subsp. aureus Mu50
uuaaaaggcgaaacauua

SEQ ID NO: 3975259 - RNA, 14 nt, Staphylococcus aureus subsp. aureus Mu50
uuaaaaguaacaua

SEQ ID NO: 3975260 - RNA, 21 nt, Staphylococcus aureus subsp. aureus Mu50
uuaaaagugcaaguccaaaua

SEQ ID NO: 3975261 - RNA, 15 nt, Staphylococcus aureus subsp. aureus Mu50
uuaaaauaaaucuuu

SEQ ID NO: 3975262 - RNA, 18 nt, Staphylococcus aureus subsp. aureus Mu50
uuaaaauaguucuuuaaa

SEQ ID NO: 3975263 - RNA, 23 nt, Staphylococcus aureus subsp. aureus Mu50
uuaaaaucggacaacugagaaau

SEQ ID NO: 3975264 - RNA, 14 nt, Staphylococcus aureus subsp. aureus Mu50
uuaaauuaaagcaa

SEQ ID NO: 3975265 - RNA, 22 nt, Staphylococcus aureus subsp. aureus Mu50
uuaaauuaaagcaaauuauaua

SEQ ID NO: 3975266 - RNA, 14 nt, Staphylococcus aureus subsp. aureus Mu50
uuaaauuaagaaua

SEQ ID NO: 3975267 - RNA, 16 nt, Staphylococcus aureus subsp. aureus Mu50
uuaaauuacaacuuuu

SEQ ID NO: 3975268 - RNA, 21 nt, Staphylococcus aureus subsp. aureus Mu50
uuaaauuagggugaacaguua

SEQ ID NO: 3975269 - RNA, 14 nt, Staphylococcus aureus subsp. aureus Mu50
uuaaauuauauacc

SEQ ID NO: 3975270 - RNA, 16 nt, Staphylococcus aureus subsp. aureus Mu50
uuaaauuauauaccca

SEQ ID NO: 3975271 - RNA, 21 nt, Staphylococcus aureus subsp. aureus Mu50
uuaaauuauauguuuuuauua

SEQ ID NO: 3975272 - RNA, 20 nt, Staphylococcus aureus subsp. aureus Mu50
uuaaauuauuguuuuaaugu

SEQ ID NO: 3975273 - RNA, 16 nt, Staphylococcus aureus subsp. aureus Mu50
uuaaauuauuuaauuu

SEQ ID NO: 3975274 - RNA, 19 nt, Staphylococcus aureus subsp. aureus Mu50
uuaaauuauuuaauuuuuc

SEQ ID NO: 3975275 - RNA, 22 nt, Staphylococcus aureus subsp. aureus Mu50
uuaaauuccaugucaauuuuuu

SEQ ID NO: 3975276 - RNA, 18 nt, Staphylococcus aureus subsp. aureus Mu50
uuaaauucuuauaaaaua

SEQ ID NO: 3975277 - RNA, 19 nt, Staphylococcus aureus subsp. aureus Mu50
uuaaauucuuauaaaauaa

SEQ ID NO: 3975278 - RNA, 15 nt, Staphylococcus aureus subsp. aureus Mu50
uuaaauugaaauguu

SEQ ID NO: 3975279 - RNA, 13 nt, Staphylococcus aureus subsp. aureus Mu50
uuaaauuuaaaag

SEQ ID NO: 3975280 - RNA, 14 nt, Staphylococcus aureus subsp. aureus Mu50
uuaaauuuaaaaga

SEQ ID NO: 3975281 - RNA, 15 nt, Staphylococcus aureus subsp. aureus Mu50
uuaaauuuaacucaa

SEQ ID NO: 3975282 - RNA, 19 nt, Staphylococcus aureus subsp. aureus Mu50
uuaaauuuaacucaacuua

SEQ ID NO: 3975283 - RNA, 14 nt, Staphylococcus aureus subsp. aureus Mu50
uuaaauuuauaaua

SEQ ID NO: 3975284 - RNA, 14 nt, Staphylococcus aureus subsp. aureus Mu50
uuaaauuucugaac

SEQ ID NO: 3975285 - RNA, 17 nt, Staphylococcus aureus subsp. aureus Mu50
uuaaauuuguguucaaa

SEQ ID NO: 3975286 - RNA, 14 nt, Staphylococcus aureus subsp. aureus Mu50
uuaaauuuuaaguu

SEQ ID NO: 3975287 - RNA, 19 nt, Staphylococcus aureus subsp. aureus Mu50
uuaaauuuucaucauaauc

SEQ ID NO: 3975288 - RNA, 17 nt, Staphylococcus aureus subsp. aureus Mu50
uuaacaaaauuaagaag

SEQ ID NO: 3975289 - RNA, 12 nt, Staphylococcus aureus subsp. aureus Mu50
uuaacaacauga

SEQ ID NO: 3975290 - RNA, 12 nt, Staphylococcus aureus subsp. aureus Mu50
uuaacaacuuua

SEQ ID NO: 3975291 - RNA, 21 nt, Staphylococcus aureus subsp. aureus Mu50
uuaacaauauucguaaauccu

SEQ ID NO: 3975292 - RNA, 18 nt, Staphylococcus aureus subsp. aureus Mu50
uuaacaaucaguaauaau

SEQ ID NO: 3975293 - RNA, 20 nt, Staphylococcus aureus subsp. aureus Mu50
uuaacaaugcgauuaaacuc

SEQ ID NO: 3975294 - RNA, 15 nt, Staphylococcus aureus subsp. aureus Mu50
uuaacaauugauugc

SEQ ID NO: 3975295 - RNA, 21 nt, Staphylococcus aureus subsp. aureus Mu50
uuaacaauuuuaucugaaucu

SEQ ID NO: 3975296 - RNA, 17 nt, Staphylococcus aureus subsp. aureus Mu50
uuaacacauucaaauaa

SEQ ID NO: 3975297 - RNA, 21 nt, Staphylococcus aureus subsp. aureus Mu50
uuaacaccagauaucauaaua

SEQ ID NO: 3975298 - RNA, 15 nt, Staphylococcus aureus subsp. aureus Mu50
uuaacagcuuuuucu

SEQ ID NO: 3975299 - RNA, 18 nt, Staphylococcus aureus subsp. aureus Mu50
uuaacaguuguaaucauu

SEQ ID NO: 3975300 - RNA, 15 nt, Staphylococcus aureus subsp. aureus Mu50
uuaacaucaauuacu

SEQ ID NO: 3975301 - RNA, 23 nt, Staphylococcus aureus subsp. aureus Mu50
uuaacauccugcuuauuaauugu

SEQ ID NO: 3975302 - RNA, 15 nt, Staphylococcus aureus subsp. aureus Mu50
uuaacauuauccauu

SEQ ID NO: 3975303 - RNA, 20 nt, Staphylococcus aureus subsp. aureus Mu50
uuaacauuuauucuuucucu

SEQ ID NO: 3975304 - RNA, 18 nt, Staphylococcus aureus subsp. aureus Mu50
uuaacauuugucauaaua

SEQ ID NO: 3975305 - RNA, 20 nt, Staphylococcus aureus subsp. aureus Mu50
uuaaccacuccuuaaacaaa

SEQ ID NO: 3975306 - RNA, 20 nt, Staphylococcus aureus subsp. aureus Mu50
uuaaccaguauaauuuucug

SEQ ID NO: 3975307 - RNA, 19 nt, Staphylococcus aureus subsp. aureus Mu50
uuaaccauacauaugcuau

SEQ ID NO: 3975308 - RNA, 15 nt, Staphylococcus aureus subsp. aureus Mu50
uuaacccacauuaaa

SEQ ID NO: 3975309 - RNA, 18 nt, Staphylococcus aureus subsp. aureus Mu50
uuaacccacauuaaauau

SEQ ID NO: 3975310 - RNA, 18 nt, Staphylococcus aureus subsp. aureus Mu50
uuaaccuugauuuaauuu

SEQ ID NO: 3975311 - RNA, 22 nt, Staphylococcus aureus subsp. aureus Mu50
uuaacgaaaugaccuuaauaua

SEQ ID NO: 3975312 - RNA, 20 nt, Staphylococcus aureus subsp. aureus Mu50
uuaacgucaacagcauaaau

SEQ ID NO: 3975313 - RNA, 15 nt, Staphylococcus aureus subsp. aureus Mu50
uuaacgucauuuuua

SEQ ID NO: 3975314 - RNA, 15 nt, Staphylococcus aureus subsp. aureus Mu50
uuaacguuauucauu

SEQ ID NO: 3975315 - RNA, 18 nt, Staphylococcus aureus subsp. aureus Mu50
uuaacguuauucauuugu

SEQ ID NO: 3975316 - RNA, 16 nt, Staphylococcus aureus subsp. aureus Mu50
uuaacuauaaauagaa

SEQ ID NO: 3975317 - RNA, 13 nt, Staphylococcus aureus subsp. aureus Mu50
uuaacuauaacaa

SEQ ID NO: 3975318 - RNA, 18 nt, Staphylococcus aureus subsp. aureus Mu50
uuaacuauguuacuuaua

SEQ ID NO: 3975319 - RNA, 24 nt, Staphylococcus aureus subsp. aureus Mu50
uuaacuauguuacuuauauauuca

SEQ ID NO: 3975320 - RNA, 14 nt, Staphylococcus aureus subsp. aureus Mu50
uuaacucaaagaaa

SEQ ID NO: 3975321 - RNA, 15 nt, Staphylococcus aureus subsp. aureus Mu50
uuaacugauaaaagg

SEQ ID NO: 3975322 - RNA, 15 nt, Staphylococcus aureus subsp. aureus Mu50
uuaacugcaaacuug

SEQ ID NO: 3975323 - RNA, 20 nt, Staphylococcus aureus subsp. aureus Mu50
uuaacugccauauagauauu

SEQ ID NO: 3975324 - RNA, 22 nt, Staphylococcus aureus subsp. aureus Mu50
uuaacugguugauaaauaaacu

SEQ ID NO: 3975325 - RNA, 23 nt, Staphylococcus aureus subsp. aureus Mu50
uuaacugguugauaaauaaacuc

SEQ ID NO: 3975326 - RNA, 19 nt, Staphylococcus aureus subsp. aureus Mu50
uuaacuguacgauucaauu

SEQ ID NO: 3975327 - RNA, 22 nt, Staphylococcus aureus subsp. aureus Mu50
uuaacuguacgauucaauuuaa

SEQ ID NO: 3975328 - RNA, 16 nt, Staphylococcus aureus subsp. aureus Mu50
uuaacuuaauuaaaaa

SEQ ID NO: 3975329 - RNA, 14 nt, Staphylococcus aureus subsp. aureus Mu50
uuaacuuauauacg

SEQ ID NO: 3975330 - RNA, 15 nt, Staphylococcus aureus subsp. aureus Mu50
uuaacuugaaauguu

SEQ ID NO: 3975331 - RNA, 12 nt, Staphylococcus aureus subsp. aureus Mu50
uuaacuuuaaua

SEQ ID NO: 3975332 - RNA, 13 nt, Staphylococcus aureus subsp. aureus Mu50
uuaacuuuaauua

SEQ ID NO: 3975333 - RNA, 20 nt, Staphylococcus aureus subsp. aureus Mu50
uuaacuuuccgccuucaauc

SEQ ID NO: 3975334 - RNA, 21 nt, Staphylococcus aureus subsp. aureus Mu50
uuaacuuuuuugugauuauua

SEQ ID NO: 3975335 - RNA, 16 nt, Staphylococcus aureus subsp. aureus Mu50
uuaagaaaucaacaac

SEQ ID NO: 3975336 - RNA, 21 nt, Staphylococcus aureus subsp. aureus Mu50
uuaagaauaaucgaacauaaa

SEQ ID NO: 3975337 - RNA, 21 nt, Staphylococcus aureus subsp. aureus Mu50
uuaagacugauuaauuauuga

SEQ ID NO: 3975338 - RNA, 18 nt, Staphylococcus aureus subsp. aureus Mu50
uuaagauguauaugaauu

SEQ ID NO: 3975339 - RNA, 12 nt, Staphylococcus aureus subsp. aureus Mu50
uuaagcauuugu

SEQ ID NO: 3975340 - RNA, 19 nt, Staphylococcus aureus subsp. aureus Mu50
uuaagcuaucuaaaccuuu

SEQ ID NO: 3975341 - RNA, 20 nt, Staphylococcus aureus subsp. aureus Mu50
uuaagcuuacgacauacuug

SEQ ID NO: 3975342 - RNA, 20 nt, Staphylococcus aureus subsp. aureus Mu50
uuaaggaaagcuucauauuu

SEQ ID NO: 3975343 - RNA, 14 nt, Staphylococcus aureus subsp. aureus Mu50
uuaaggucauuuuu

SEQ ID NO: 3975344 - RNA, 23 nt, Staphylococcus aureus subsp. aureus Mu50
uuaaguaaucugcaaaugccucu

SEQ ID NO: 3975345 - RNA, 18 nt, Staphylococcus aureus subsp. aureus Mu50
uuaaguacaacaguugca

SEQ ID NO: 3975346 - RNA, 14 nt, Staphylococcus aureus subsp. aureus Mu50
uuaaguacagcaua

SEQ ID NO: 3975347 - RNA, 14 nt, Staphylococcus aureus subsp. aureus Mu50
uuaaguaguuguua

SEQ ID NO: 3975348 - RNA, 18 nt, Staphylococcus aureus subsp. aureus Mu50
uuaaguaguuguuauauu

SEQ ID NO: 3975349 - RNA, 15 nt, Staphylococcus aureus subsp. aureus Mu50
uuaaguauagcuuuu

SEQ ID NO: 3975350 - RNA, 12 nt, Staphylococcus aureus subsp. aureus Mu50
uuaagucaucaa

SEQ ID NO: 3975351 - RNA, 23 nt, Staphylococcus aureus subsp. aureus Mu50
uuaagugaugaccaauauucugg

SEQ ID NO: 3975352 - RNA, 16 nt, Staphylococcus aureus subsp. aureus Mu50
uuaaugcucuauauau

SEQ ID NO: 3975353 - RNA, 20 nt, Staphylococcus aureus subsp. aureus Mu50
uuaaugcuucaaauguaaca

SEQ ID NO: 3975354 - RNA, 22 nt, Staphylococcus aureus subsp. aureus Mu50
uuaaugcuucaaauguaacauu

SEQ ID NO: 3975355 - RNA, 13 nt, Staphylococcus aureus subsp. aureus Mu50
uuaaugcuuuagc

SEQ ID NO: 3975356 - RNA, 19 nt, Staphylococcus aureus subsp. aureus Mu50
uuaauggcaacuaagauga

SEQ ID NO: 3975357 - RNA, 23 nt, Staphylococcus aureus subsp. aureus Mu50
uuaaugggcgugccauuaaaauu

SEQ ID NO: 3975358 - RNA, 20 nt, Staphylococcus aureus subsp. aureus Mu50
uuaauggucuaauaucaauu

SEQ ID NO: 3975359 - RNA, 18 nt, Staphylococcus aureus subsp. aureus Mu50
uuaauguacuucaauuua

SEQ ID NO: 3975360 - RNA, 18 nt, Staphylococcus aureus subsp. aureus Mu50
uuaauguacuuuucuguc

SEQ ID NO: 3975361 - RNA, 14 nt, Staphylococcus aureus subsp. aureus Mu50
uuaauguauaaaaa

SEQ ID NO: 3975362 - RNA, 14 nt, Staphylococcus aureus subsp. aureus Mu50
uuaauguauaaauu

SEQ ID NO: 3975363 - RNA, 15 nt, Staphylococcus aureus subsp. aureus Mu50
uuaauguaucacauu

SEQ ID NO: 3975364 - RNA, 16 nt, Staphylococcus aureus subsp. aureus Mu50
uuaauguauucuucua

SEQ ID NO: 3975365 - RNA, 21 nt, Staphylococcus aureus subsp. aureus Mu50
uuaauguauucuucuaauucu

SEQ ID NO: 3975366 - RNA, 16 nt, Staphylococcus aureus subsp. aureus Mu50
uuaaugucuaaaaaug

SEQ ID NO: 3975367 - RNA, 15 nt, Staphylococcus aureus subsp. aureus Mu50
uuaauguguaaauuu

SEQ ID NO: 3975368 - RNA, 14 nt, Staphylococcus aureus subsp. aureus Mu50
uuaauguuaaacaa

SEQ ID NO: 3975369 - RNA, 15 nt, Staphylococcus aureus subsp. aureus Mu50
uuaauguuaaacaau

SEQ ID NO: 3975370 - RNA, 17 nt, Staphylococcus aureus subsp. aureus Mu50
uuaauguuucuucaauu

SEQ ID NO: 3975371 - RNA, 14 nt, Staphylococcus aureus subsp. aureus Mu50
uuaauguuugcuuu

SEQ ID NO: 3975372 - RNA, 13 nt, Staphylococcus aureus subsp. aureus Mu50
uuaauuaaaaaau

SEQ ID NO: 3975373 - RNA, 16 nt, Staphylococcus aureus subsp. aureus Mu50
uuaauuaaaauucucu

SEQ ID NO: 3975374 - RNA, 21 nt, Staphylococcus aureus subsp. aureus Mu50
uuaauuaaaauucucuuuuaa

SEQ ID NO: 3975375 - RNA, 13 nt, Staphylococcus aureus subsp. aureus Mu50
uuaauuaaagauu

SEQ ID NO: 3975376 - RNA, 19 nt, Staphylococcus aureus subsp. aureus Mu50
uuaauuaaagcaucuucaa

SEQ ID NO: 3975377 - RNA, 20 nt, Staphylococcus aureus subsp. aureus Mu50
uuaauuaaagcaucuucaau

SEQ ID NO: 3975378 - RNA, 23 nt, Staphylococcus aureus subsp. aureus Mu50
uuaauuaaagcaucuucaauauu

SEQ ID NO: 3975379 - RNA, 20 nt, Staphylococcus aureus subsp. aureus Mu50
uuaauuaauaauuuaacuaa

SEQ ID NO: 3975380 - RNA, 22 nt, Staphylococcus aureus subsp. aureus Mu50
uuaauuacagcgugauucaucu

SEQ ID NO: 3975381 - RNA, 14 nt, Staphylococcus aureus subsp. aureus Mu50
uuaauuacgucaua

SEQ ID NO: 3975382 - RNA, 20 nt, Staphylococcus aureus subsp. aureus Mu50
uuaauuacgucauaaaauac

SEQ ID NO: 3975383 - RNA, 17 nt, Staphylococcus aureus subsp. aureus Mu50
uuaauuacuguaaauau

SEQ ID NO: 3975384 - RNA, 19 nt, Staphylococcus aureus subsp. aureus Mu50
uuaauuacuguaaauauga

SEQ ID NO: 3975385 - RNA, 14 nt, Staphylococcus aureus subsp. aureus Mu50
uuaauuaucauaaa

SEQ ID NO: 3975386 - RNA, 19 nt, Staphylococcus aureus subsp. aureus Mu50
uuaauuaucauaaagauaa

SEQ ID NO: 3975387 - RNA, 20 nt, Staphylococcus aureus subsp. aureus Mu50
uuaauuauguauuuuuauuu

SEQ ID NO: 3975388 - RNA, 21 nt, Staphylococcus aureus subsp. aureus Mu50
uuaauuauguauuuuuauuua

SEQ ID NO: 3975389 - RNA, 16 nt, Staphylococcus aureus subsp. aureus Mu50
uuaauuauuauauaau

SEQ ID NO: 3975390 - RNA, 15 nt, Staphylococcus aureus subsp. aureus Mu50
uuaauuauuuagauu

SEQ ID NO: 3975391 - RNA, 11 nt, Staphylococcus aureus subsp. aureus Mu50
uuaauuauuuc

SEQ ID NO: 3975392 - RNA, 15 nt, Staphylococcus aureus subsp. aureus Mu50
uuaauuccuucuaua

SEQ ID NO: 3975393 - RNA, 18 nt, Staphylococcus aureus subsp. aureus Mu50
uuaauucgccuaaauggu

SEQ ID NO: 3975394 - RNA, 16 nt, Staphylococcus aureus subsp. aureus Mu50
uuaauucguuuuacua

SEQ ID NO: 3975395 - RNA, 16 nt, Staphylococcus aureus subsp. aureus Mu50
uuaauugaaguaugca

SEQ ID NO: 3975396 - RNA, 14 nt, Staphylococcus aureus subsp. aureus Mu50
uuaauugcagguaa

SEQ ID NO: 3975397 - RNA, 20 nt, Staphylococcus aureus subsp. aureus Mu50
uuaauugcagguaaacggaa

SEQ ID NO: 3975398 - RNA, 17 nt, Staphylococcus aureus subsp. aureus Mu50
uuaauugcuguaaauau

SEQ ID NO: 3975399 - RNA, 19 nt, Staphylococcus aureus subsp. aureus Mu50
uuaauugcuguaaauauuc

SEQ ID NO: 3975400 - RNA, 18 nt, Staphylococcus aureus subsp. aureus Mu50
uuaauuguuuaauaacaa

SEQ ID NO: 3975401 - RNA, 18 nt, Staphylococcus aureus subsp. aureus Mu50
uuaauuuaaaucuguacu

SEQ ID NO: 3975402 - RNA, 21 nt, Staphylococcus aureus subsp. aureus Mu50
uuaauuuaaguaguuguuaua

SEQ ID NO: 3975403 - RNA, 13 nt, Staphylococcus aureus subsp. aureus Mu50
uuaauuuaauaau

SEQ ID NO: 3975404 - RNA, 13 nt, Staphylococcus aureus subsp. aureus Mu50
uuaauuuacaauu

SEQ ID NO: 3975405 - RNA, 16 nt, Staphylococcus aureus subsp. aureus Mu50
uuaauuuacaauuaau

SEQ ID NO: 3975406 - RNA, 18 nt, Staphylococcus aureus subsp. aureus Mu50
uuaauuuacaauuaauua

SEQ ID NO: 3975407 - RNA, 17 nt, Staphylococcus aureus subsp. aureus Mu50
uuaauuuagugaaacaa

SEQ ID NO: 3975408 - RNA, 13 nt, Staphylococcus aureus subsp. aureus Mu50
uuaauuuaucguu

SEQ ID NO: 3975409 - RNA, 16 nt, Staphylococcus aureus subsp. aureus Mu50
uuaauuucaacauuac

SEQ ID NO: 3975410 - RNA, 22 nt, Staphylococcus aureus subsp. aureus Mu50
uuaauuucacuuuaacuucuuu

SEQ ID NO: 3975411 - RNA, 23 nt, Staphylococcus aureus subsp. aureus Mu50
uuaauuucauguucauaauauaa

SEQ ID NO: 3975412 - RNA, 15 nt, Staphylococcus aureus subsp. aureus Mu50
uuaauuuccaauauc

SEQ ID NO: 3975413 - RNA, 19 nt, Staphylococcus aureus subsp. aureus Mu50
uuaauuucugguaaaaaaa

SEQ ID NO: 3975414 - RNA, 23 nt, Staphylococcus aureus subsp. aureus Mu50
uuaauuucugguaaaaaaauaac

SEQ ID NO: 3975415 - RNA, 18 nt, Staphylococcus aureus subsp. aureus Mu50
uuaauuuguuuuaaauac

SEQ ID NO: 3975416 - RNA, 19 nt, Staphylococcus aureus subsp. aureus Mu50
uuaauuuguuuuaaauacu

SEQ ID NO: 3975417 - RNA, 15 nt, Staphylococcus aureus subsp. aureus Mu50
uuaauuuuaaauauu

SEQ ID NO: 3975418 - RNA, 15 nt, Staphylococcus aureus subsp. aureus Mu50
uuaauuuuaccauca

SEQ ID NO: 3975419 - RNA, 13 nt, Staphylococcus aureus subsp. aureus Mu50
uuaauuuuauguc

SEQ ID NO: 3975420 - RNA, 18 nt, Staphylococcus aureus subsp. aureus Mu50
uuaauuuuaugucccaau

SEQ ID NO: 3975421 - RNA, 23 nt, Staphylococcus aureus subsp. aureus Mu50
uuaauuuuaugucccaaugcuga

SEQ ID NO: 3975422 - RNA, 12 nt, Staphylococcus aureus subsp. aureus Mu50
uuaauuuuauua

SEQ ID NO: 3975423 - RNA, 17 nt, Staphylococcus aureus subsp. aureus Mu50
uuaauuuuauuuaauuc

SEQ ID NO: 3975424 - RNA, 13 nt, Staphylococcus aureus subsp. aureus Mu50
uuaauuuuauuuu

SEQ ID NO: 3975425 - RNA, 14 nt, Staphylococcus aureus subsp. aureus Mu50
uuaauuuugacaua

SEQ ID NO: 3975426 - RNA, 17 nt, Staphylococcus aureus subsp. aureus Mu50
uuaauuuugcaacauua

SEQ ID NO: 3975427 - RNA, 23 nt, Staphylococcus aureus subsp. aureus Mu50
uuaauuuugcaacauuaaauuau

SEQ ID NO: 3975428 - RNA, 24 nt, Staphylococcus aureus subsp. aureus Mu50
uuaauuuugcaacauuaaauuauu

SEQ ID NO: 3975429 - RNA, 14 nt, Staphylococcus aureus subsp. aureus Mu50
uuaauuuuucauua

SEQ ID NO: 3975430 - RNA, 20 nt, Staphylococcus aureus subsp. aureus Mu50
uuaauuuuucauuaauacaa

SEQ ID NO: 3975431 - RNA, 15 nt, Staphylococcus aureus subsp. aureus Mu50
uuaauuuuucuaaau

SEQ ID NO: 3975432 - RNA, 17 nt, Staphylococcus aureus subsp. aureus Mu50
uuaauuuuucuaaauga

SEQ ID NO: 3975433 - RNA, 18 nt, Staphylococcus aureus subsp. aureus Mu50
uuaauuuuucuaaaugau

SEQ ID NO: 3975434 - RNA, 19 nt, Staphylococcus aureus subsp. aureus Mu50
uuaauuuuucuaaaugauu

SEQ ID NO: 3975435 - RNA, 14 nt, Staphylococcus aureus subsp. aureus Mu50
uuaauuuuuuauua

SEQ ID NO: 3975436 - RNA, 13 nt, Staphylococcus aureus subsp. aureus Mu50
uuacaaacuucac

SEQ ID NO: 3975437 - RNA, 23 nt, Staphylococcus aureus subsp. aureus Mu50
uuacaaagugauuuaaaaaauuu

SEQ ID NO: 3975438 - RNA, 17 nt, Staphylococcus aureus subsp. aureus Mu50
uuacaaaguuaaccaua

SEQ ID NO: 3975439 - RNA, 22 nt, Staphylococcus aureus subsp. aureus Mu50
uuacaaaguuaaccauacauau

SEQ ID NO: 3975440 - RNA, 23 nt, Staphylococcus aureus subsp. aureus Mu50
uuagaagaacaauaauugaugaa

SEQ ID NO: 3975441 - RNA, 15 nt, Staphylococcus aureus subsp. aureus Mu50
uuagaauaaacuuua

SEQ ID NO: 3975442 - RNA, 22 nt, Staphylococcus aureus subsp. aureus Mu50
uuagaauaagaaauaaaaggaa

SEQ ID NO: 3975443 - RNA, 22 nt, Staphylococcus aureus subsp. aureus Mu50
uuagaaucaaccguuuuauugu

SEQ ID NO: 3975444 - RNA, 17 nt, Staphylococcus aureus subsp. aureus Mu50
uuagacaaauguucuau

SEQ ID NO: 3975445 - RNA, 16 nt, Staphylococcus aureus subsp. aureus Mu50
uuagacuaaaaaacua

SEQ ID NO: 3975446 - RNA, 22 nt, Staphylococcus aureus subsp. aureus Mu50
uuagacuaaaaaacuaacuuua

SEQ ID NO: 3975447 - RNA, 17 nt, Staphylococcus aureus subsp. aureus Mu50
uuagacucacuucuuaa

SEQ ID NO: 3975448 - RNA, 18 nt, Staphylococcus aureus subsp. aureus Mu50
uuagacucacuucuuaaa

SEQ ID NO: 3975449 - RNA, 20 nt, Staphylococcus aureus subsp. aureus Mu50
uuagagaaaaaucuguuucu

SEQ ID NO: 3975450 - RNA, 16 nt, Staphylococcus aureus subsp. aureus Mu50
uuagagaagaauucuc

SEQ ID NO: 3975451 - RNA, 18 nt, Staphylococcus aureus subsp. aureus Mu50
uuagagauuguaagaauu

SEQ ID NO: 3975452 - RNA, 14 nt, Staphylococcus aureus subsp. aureus Mu50
uuagaguuuuuauu

SEQ ID NO: 3975453 - RNA, 20 nt, Staphylococcus aureus subsp. aureus Mu50
uuagauaaaauaauuguucu

SEQ ID NO: 3975454 - RNA, 14 nt, Staphylococcus aureus subsp. aureus Mu50
uuagauaauaagga

SEQ ID NO: 3975455 - RNA, 22 nt, Staphylococcus aureus subsp. aureus Mu50
uuagauacugaauuuuaacuaa

SEQ ID NO: 3975456 - RNA, 17 nt, Staphylococcus aureus subsp. aureus Mu50
uuagauauuauaaaaac

SEQ ID NO: 3975457 - RNA, 15 nt, Staphylococcus aureus subsp. aureus Mu50
uuagaugacuuuguc

SEQ ID NO: 3975458 - RNA, 17 nt, Staphylococcus aureus subsp. aureus Mu50
uuagaugagauuucguu

SEQ ID NO: 3975459 - RNA, 23 nt, Staphylococcus aureus subsp. aureus Mu50
uuagaugauauuuaacaaaauua

SEQ ID NO: 3975460 - RNA, 14 nt, Staphylococcus aureus subsp. aureus Mu50
uuagaugcauaaaa

SEQ ID NO: 3975461 - RNA, 19 nt, Staphylococcus aureus subsp. aureus Mu50
uuagaugcauaaaaaaaga

SEQ ID NO: 3975462 - RNA, 20 nt, Staphylococcus aureus subsp. aureus Mu50
uuagaugcauaaaaaaagaa

SEQ ID NO: 3975463 - RNA, 14 nt, Staphylococcus aureus subsp. aureus Mu50
uuagauugacuaag

SEQ ID NO: 3975464 - RNA, 17 nt, Staphylococcus aureus subsp. aureus Mu50
uuagauuuuauauaaaa

SEQ ID NO: 3975465 - RNA, 19 nt, Staphylococcus aureus subsp. aureus Mu50
uuagauuuucacuaauauu

SEQ ID NO: 3975466 - RNA, 20 nt, Staphylococcus aureus subsp. aureus Mu50
uuagcaaaaauauuuaaacu

SEQ ID NO: 3975467 - RNA, 21 nt, Staphylococcus aureus subsp. aureus Mu50
uuagcaaaaauauuuaaacua

SEQ ID NO: 3975468 - RNA, 18 nt, Staphylococcus aureus subsp. aureus Mu50
uuagcaaucucuuuagau

SEQ ID NO: 3975469 - RNA, 17 nt, Staphylococcus aureus subsp. aureus Mu50
uuagcauaccuuuauua

SEQ ID NO: 3975470 - RNA, 19 nt, Staphylococcus aureus subsp. aureus Mu50
uuagcauaccuuuauuauu

SEQ ID NO: 3975471 - RNA, 21 nt, Staphylococcus aureus subsp. aureus Mu50
uuagcauaccuuuauuauuua

SEQ ID NO: 3975472 - RNA, 22 nt, Staphylococcus aureus subsp. aureus Mu50
uuagcauauucgcuuaaaaacg

SEQ ID NO: 3975473 - RNA, 14 nt, Staphylococcus aureus subsp. aureus Mu50
uuagcaucugcaug

SEQ ID NO: 3975474 - RNA, 19 nt, Staphylococcus aureus subsp. aureus Mu50
uuagcaucuuuaccauaua

SEQ ID NO: 3975475 - RNA, 19 nt, Staphylococcus aureus subsp. aureus Mu50
uuagccaauaccgaauaau

SEQ ID NO: 3975476 - RNA, 23 nt, Staphylococcus aureus subsp. aureus Mu50
uuagccacagcuaauguguacuu

SEQ ID NO: 3975477 - RNA, 23 nt, Staphylococcus aureus subsp. aureus Mu50
uuagccccagcaaauacuucaag

SEQ ID NO: 3975478 - RNA, 14 nt, Staphylococcus aureus subsp. aureus Mu50
uuagcgcaagagau

SEQ ID NO: 3975479 - RNA, 14 nt, Staphylococcus aureus subsp. aureus Mu50
uuagcgcaccaauu

SEQ ID NO: 3975480 - RNA, 15 nt, Staphylococcus aureus subsp. aureus Mu50
uuagcuugcuuacaa

SEQ ID NO: 3975481 - RNA, 12 nt, Staphylococcus aureus subsp. aureus Mu50
uuagcuuuugua

SEQ ID NO: 3975482 - RNA, 23 nt, Staphylococcus aureus subsp. aureus Mu50
uuaggaagcaagccguugguugu

SEQ ID NO: 3975483 - RNA, 15 nt, Staphylococcus aureus subsp. aureus Mu50
uuaggaaugaauaaa

SEQ ID NO: 3975484 - RNA, 20 nt, Staphylococcus aureus subsp. aureus Mu50
uuaggaaugauagauuuagg

SEQ ID NO: 3975485 - RNA, 18 nt, Staphylococcus aureus subsp. aureus Mu50
uuaggauccaauuuaucu

SEQ ID NO: 3975486 - RNA, 22 nt, Staphylococcus aureus subsp. aureus Mu50
uuaggauguucagcuaacucuu

SEQ ID NO: 3975487 - RNA, 21 nt, Staphylococcus aureus subsp. aureus Mu50
uuaggcggccaguccauuauu

SEQ ID NO: 3975488 - RNA, 22 nt, Staphylococcus aureus subsp. aureus Mu50
uuaggcggccaguccauuauug

SEQ ID NO: 3975489 - RNA, 17 nt, Staphylococcus aureus subsp. aureus Mu50
uuaggcuuaaauauaau

SEQ ID NO: 3975490 - RNA, 16 nt, Staphylococcus aureus subsp. aureus Mu50
uuaggcuuauuaacuu

SEQ ID NO: 3975491 - RNA, 21 nt, Staphylococcus aureus subsp. aureus Mu50
uuaggcuuauuaacuuuuccu

SEQ ID NO: 3975492 - RNA, 17 nt, Staphylococcus aureus subsp. aureus Mu50
uuagggaaauguagauu

SEQ ID NO: 3975493 - RNA, 21 nt, Staphylococcus aureus subsp. aureus Mu50
uuagggugaacaguuagugcu

SEQ ID NO: 3975494 - RNA, 22 nt, Staphylococcus aureus subsp. aureus Mu50
uuagguaauacaucaucaaguu

SEQ ID NO: 3975495 - RNA, 12 nt, Staphylococcus aureus subsp. aureus Mu50
uuagguauauaa

SEQ ID NO: 3975496 - RNA, 17 nt, Staphylococcus aureus subsp. aureus Mu50
uuagguugauuucugcu

SEQ ID NO: 3975497 - RNA, 12 nt, Staphylococcus aureus subsp. aureus Mu50
uuaguaauaaca

SEQ ID NO: 3975498 - RNA, 15 nt, Staphylococcus aureus subsp. aureus Mu50
uuaguaauaacaucu

SEQ ID NO: 3975499 - RNA, 18 nt, Staphylococcus aureus subsp. aureus Mu50
uuaguaauuuuuaaaucu

SEQ ID NO: 3975500 - RNA, 14 nt, Staphylococcus aureus subsp. aureus Mu50
uuaguacaaaauug

SEQ ID NO: 3975501 - RNA, 18 nt, Staphylococcus aureus subsp. aureus Mu50
uuaguacacguguauugu

SEQ ID NO: 3975502 - RNA, 20 nt, Staphylococcus aureus subsp. aureus Mu50
uuaguacauauguuguuucu

SEQ ID NO: 3975503 - RNA, 14 nt, Staphylococcus aureus subsp. aureus Mu50
uuaguacuaaaccg

SEQ ID NO: 3975504 - RNA, 22 nt, Staphylococcus aureus subsp. aureus Mu50
uuaguacuaaaccgauuaauau

SEQ ID NO: 3975505 - RNA, 24 nt, Staphylococcus aureus subsp. aureus Mu50
uuaguacuaaaccgauuaauauaa

SEQ ID NO: 3975506 - RNA, 18 nt, Staphylococcus aureus subsp. aureus Mu50
uuaguacuuugauaucua

SEQ ID NO: 3975507 - RNA, 16 nt, Staphylococcus aureus subsp. aureus Mu50
uuaguagccacaauuu

SEQ ID NO: 3975508 - RNA, 18 nt, Staphylococcus aureus subsp. aureus Mu50
uuaguagccacaauuuug

SEQ ID NO: 3975509 - RNA, 15 nt, Staphylococcus aureus subsp. aureus Mu50
uuaguagucaaaauu

SEQ ID NO: 3975510 - RNA, 18 nt, Staphylococcus aureus subsp. aureus Mu50
uuaguagucaaaauugug

SEQ ID NO: 3975511 - RNA, 17 nt, Staphylococcus aureus subsp. aureus Mu50
uuaguaguguauucauu

SEQ ID NO: 3975512 - RNA, 17 nt, Staphylococcus aureus subsp. aureus Mu50
uuaguaguuguacuucu

SEQ ID NO: 3975513 - RNA, 20 nt, Staphylococcus aureus subsp. aureus Mu50
uuaguaguuuauaucaaaaa

SEQ ID NO: 3975514 - RNA, 14 nt, Staphylococcus aureus subsp. aureus Mu50
uuaguauaaauaaa

SEQ ID NO: 3975515 - RNA, 18 nt, Staphylococcus aureus subsp. aureus Mu50
uuaguauaaauaaaaaua

SEQ ID NO: 3975516 - RNA, 19 nt, Staphylococcus aureus subsp. aureus Mu50
uuaguaucgauaguucuau

SEQ ID NO: 3975517 - RNA, 14 nt, Staphylococcus aureus subsp. aureus Mu50
uuaguaucuauaca

SEQ ID NO: 3975518 - RNA, 19 nt, Staphylococcus aureus subsp. aureus Mu50
uuaguauggaauaaauggu

SEQ ID NO: 3975519 - RNA, 13 nt, Staphylococcus aureus subsp. aureus Mu50
uuaguauugguac

SEQ ID NO: 3975520 - RNA, 13 nt, Staphylococcus aureus subsp. aureus Mu50
uuagucaauguau

SEQ ID NO: 3975521 - RNA, 22 nt, Staphylococcus aureus subsp. aureus Mu50
uuagucaauguauauuuaacau

SEQ ID NO: 3975522 - RNA, 14 nt, Staphylococcus aureus subsp. aureus Mu50
uuagucauguuugg

SEQ ID NO: 3975523 - RNA, 16 nt, Staphylococcus aureus subsp. aureus Mu50
uuagucuuuuuaagua

SEQ ID NO: 3975524 - RNA, 23 nt, Staphylococcus aureus subsp. aureus Mu50
uuagugaaacaauuuguaacuau

SEQ ID NO: 3975525 - RNA, 15 nt, Staphylococcus aureus subsp. aureus Mu50
uuagugcaaguaauu

SEQ ID NO: 3975526 - RNA, 16 nt, Staphylococcus aureus subsp. aureus Mu50
uuagugucacaaagaa

SEQ ID NO: 3975527 - RNA, 16 nt, Staphylococcus aureus subsp. aureus Mu50
uuauauauucaauaau

SEQ ID NO: 3975528 - RNA, 13 nt, Staphylococcus aureus subsp. aureus Mu50
uuauaucaaaauc

SEQ ID NO: 3975529 - RNA, 13 nt, Staphylococcus aureus subsp. aureus Mu50
uuauaucaucaac

SEQ ID NO: 3975530 - RNA, 22 nt, Staphylococcus aureus subsp. aureus Mu50
uuauaucauucuguguaaauau

SEQ ID NO: 3975531 - RNA, 16 nt, Staphylococcus aureus subsp. aureus Mu50
uuauaucuuaaguaca

SEQ ID NO: 3975532 - RNA, 18 nt, Staphylococcus aureus subsp. aureus Mu50
uuauaucuuuuauacaug

SEQ ID NO: 3975533 - RNA, 23 nt, Staphylococcus aureus subsp. aureus Mu50
uuauaugcuguuggcaaaacaau

SEQ ID NO: 3975534 - RNA, 21 nt, Staphylococcus aureus subsp. aureus Mu50
uuauauguuuuaugauuuucu

SEQ ID NO: 3975535 - RNA, 12 nt, Staphylococcus aureus subsp. aureus Mu50
uuauauuaucau

SEQ ID NO: 3975536 - RNA, 19 nt, Staphylococcus aureus subsp. aureus Mu50
uuauauucaacuuauuauu

SEQ ID NO: 3975537 - RNA, 22 nt, Staphylococcus aureus subsp. aureus Mu50
uuauauugcaaaaauaauauga

SEQ ID NO: 3975538 - RNA, 18 nt, Staphylococcus aureus subsp. aureus Mu50
uuauauugcgaaaaauaa

SEQ ID NO: 3975539 - RNA, 16 nt, Staphylococcus aureus subsp. aureus Mu50
uuauauuguauuuuau

SEQ ID NO: 3975540 - RNA, 14 nt, Staphylococcus aureus subsp. aureus Mu50
uuauauuuaaacuc

SEQ ID NO: 3975541 - RNA, 13 nt, Staphylococcus aureus subsp. aureus Mu50
uuauauuuuauua

SEQ ID NO: 3975542 - RNA, 11 nt, Staphylococcus aureus subsp. aureus Mu50
uuauauuuucu

SEQ ID NO: 3975543 - RNA, 18 nt, Staphylococcus aureus subsp. aureus Mu50
uuauauuuuucuucaguu

SEQ ID NO: 3975544 - RNA, 13 nt, Staphylococcus aureus subsp. aureus Mu50
uuaucaacaacaa

SEQ ID NO: 3975545 - RNA, 17 nt, Staphylococcus aureus subsp. aureus Mu50
uuaucaacauaaaauuu

SEQ ID NO: 3975546 - RNA, 14 nt, Staphylococcus aureus subsp. aureus Mu50
uuaucaauuucucu

SEQ ID NO: 3975547 - RNA, 20 nt, Staphylococcus aureus subsp. aureus Mu50
uuaucacgugcuucguuuuu

SEQ ID NO: 3975548 - RNA, 20 nt, Staphylococcus aureus subsp. aureus Mu50
uuaucacuuauuauuuugua

SEQ ID NO: 3975549 - RNA, 22 nt, Staphylococcus aureus subsp. aureus Mu50
uuaucagcauuaaucguauuuu

SEQ ID NO: 3975550 - RNA, 14 nt, Staphylococcus aureus subsp. aureus Mu50
uuaucagguuaaca

SEQ ID NO: 3975551 - RNA, 14 nt, Staphylococcus aureus subsp. aureus Mu50
uuaucaucuauuca

SEQ ID NO: 3975552 - RNA, 14 nt, Staphylococcus aureus subsp. aureus Mu50
uuaucauuaaauug

SEQ ID NO: 3975553 - RNA, 22 nt, Staphylococcus aureus subsp. aureus Mu50
uuaucauuaaauugcuugaaau

SEQ ID NO: 3975554 - RNA, 12 nt, Staphylococcus aureus subsp. aureus Mu50
uuaucauuauuc

SEQ ID NO: 3975555 - RNA, 17 nt, Staphylococcus aureus subsp. aureus Mu50
uuaucauuauuugauaa

SEQ ID NO: 3975556 - RNA, 22 nt, Staphylococcus aureus subsp. aureus Mu50
uuauccaaaccaauuuuaacuu

SEQ ID NO: 3975557 - RNA, 18 nt, Staphylococcus aureus subsp. aureus Mu50
uuauccauucuuuguugu

SEQ ID NO: 3975558 - RNA, 15 nt, Staphylococcus aureus subsp. aureus Mu50
uuauccuacugcugu

SEQ ID NO: 3975559 - RNA, 17 nt, Staphylococcus aureus subsp. aureus Mu50
uuauccuacugcugucu

SEQ ID NO: 3975560 - RNA, 22 nt, Staphylococcus aureus subsp. aureus Mu50
uuaucgacuuugucauuuugau

SEQ ID NO: 3975561 - RNA, 17 nt, Staphylococcus aureus subsp. aureus Mu50
uuaucgaucgguauuuu

SEQ ID NO: 3975562 - RNA, 17 nt, Staphylococcus aureus subsp. aureus Mu50
uuaucguaaaaaaacgu

SEQ ID NO: 3975563 - RNA, 16 nt, Staphylococcus aureus subsp. aureus Mu50
uuaucguaauuguuaa

SEQ ID NO: 3975564 - RNA, 13 nt, Staphylococcus aureus subsp. aureus Mu50
uuaucguuuagua

SEQ ID NO: 3975565 - RNA, 18 nt, Staphylococcus aureus subsp. aureus Mu50
uuaucuaaugaucaucua

SEQ ID NO: 3975566 - RNA, 22 nt, Staphylococcus aureus subsp. aureus Mu50
uuaucuaucgguaauuuuugua

SEQ ID NO: 3975567 - RNA, 15 nt, Staphylococcus aureus subsp. aureus Mu50
uuaucugaaaauauc

SEQ ID NO: 3975568 - RNA, 16 nt, Staphylococcus aureus subsp. aureus Mu50
uuaucugaaaauauca

SEQ ID NO: 3975569 - RNA, 15 nt, Staphylococcus aureus subsp. aureus Mu50
uuaucugcaaaaugc

SEQ ID NO: 3975570 - RNA, 16 nt, Staphylococcus aureus subsp. aureus Mu50
uuaucugcaaaaugca

SEQ ID NO: 3975571 - RNA, 15 nt, Staphylococcus aureus subsp. aureus Mu50
uuaucuguaauuaau

SEQ ID NO: 3975572 - RNA, 19 nt, Staphylococcus aureus subsp. aureus Mu50
uuaucuguagaaacacuuu

SEQ ID NO: 3975573 - RNA, 20 nt, Staphylococcus aureus subsp. aureus Mu50
uuaucuguagauuagcuuaa

SEQ ID NO: 3975574 - RNA, 17 nt, Staphylococcus aureus subsp. aureus Mu50
uuaucuguaucaaaauc

SEQ ID NO: 3975575 - RNA, 15 nt, Staphylococcus aureus subsp. aureus Mu50
uuaucuuuacgauaa

SEQ ID NO: 3975576 - RNA, 12 nt, Staphylococcus aureus subsp. aureus Mu50
uuaucuuuagua

SEQ ID NO: 3975577 - RNA, 21 nt, Staphylococcus aureus subsp. aureus Mu50
uuaucuuuuguuguuuccuua

SEQ ID NO: 3975578 - RNA, 15 nt, Staphylococcus aureus subsp. aureus Mu50
uuaugaaaacauuau

SEQ ID NO: 3975579 - RNA, 19 nt, Staphylococcus aureus subsp. aureus Mu50
uuaugacaacauaacaaag

SEQ ID NO: 3975580 - RNA, 19 nt, Staphylococcus aureus subsp. aureus Mu50
uuaugacuuauuuuucauc

SEQ ID NO: 3975581 - RNA, 16 nt, Staphylococcus aureus subsp. aureus Mu50
uuaugauaauuaauua

SEQ ID NO: 3975582 - RNA, 14 nt, Staphylococcus aureus subsp. aureus Mu50
uuaugaugucaugu

SEQ ID NO: 3975583 - RNA, 15 nt, Staphylococcus aureus subsp. aureus Mu50
uuaugauuauauuuu

SEQ ID NO: 3975584 - RNA, 19 nt, Staphylococcus aureus subsp. aureus Mu50
uuaugauugcuuauuuauu

SEQ ID NO: 3975585 - RNA, 15 nt, Staphylococcus aureus subsp. aureus Mu50
uuaugcaaaauuaau

SEQ ID NO: 3975586 - RNA, 22 nt, Staphylococcus aureus subsp. aureus Mu50
uuaugcaaaauuaaugaacgaa

SEQ ID NO: 3975587 - RNA, 19 nt, Staphylococcus aureus subsp. aureus Mu50
uuaugcauauguaauacaa

SEQ ID NO: 3975588 - RNA, 18 nt, Staphylococcus aureus subsp. aureus Mu50
uuaugcaugcgcaaaagc

SEQ ID NO: 3975589 - RNA, 20 nt, Staphylococcus aureus subsp. aureus Mu50
uuaugcccuagguuuauaua

SEQ ID NO: 3975590 - RNA, 13 nt, Staphylococcus aureus subsp. aureus Mu50
uuaugcuuuaaau

SEQ ID NO: 3975591 - RNA, 18 nt, Staphylococcus aureus subsp. aureus Mu50
uuauggcgguuugaaaau

SEQ ID NO: 3975592 - RNA, 22 nt, Staphylococcus aureus subsp. aureus Mu50
uuauggcgguuugaaaaugacg

SEQ ID NO: 3975593 - RNA, 22 nt, Staphylococcus aureus subsp. aureus Mu50
uuaugggggauuuuuuuauguu

SEQ ID NO: 3975594 - RNA, 13 nt, Staphylococcus aureus subsp. aureus Mu50
uuaugguauuuau

SEQ ID NO: 3975595 - RNA, 13 nt, Staphylococcus aureus subsp. aureus Mu50
uuauguaaauaac

SEQ ID NO: 3975596 - RNA, 22 nt, Staphylococcus aureus subsp. aureus Mu50
uuauguaaauaacaguuaauua

SEQ ID NO: 3975597 - RNA, 15 nt, Staphylococcus aureus subsp. aureus Mu50
uuauguacuacauac

SEQ ID NO: 3975598 - RNA, 17 nt, Staphylococcus aureus subsp. aureus Mu50
uuauguagcuuugugua

SEQ ID NO: 3975599 - RNA, 12 nt, Staphylococcus aureus subsp. aureus Mu50
uuauguauuuau

SEQ ID NO: 3975600 - RNA, 17 nt, Staphylococcus aureus subsp. aureus Mu50
uuauguauuuuuauuua

SEQ ID NO: 3975601 - RNA, 17 nt, Staphylococcus aureus subsp. aureus Mu50
uuaugugauuaauuuca

SEQ ID NO: 3975602 - RNA, 22 nt, Staphylococcus aureus subsp. aureus Mu50
uuaugugcaccgccaagugguu

SEQ ID NO: 3975603 - RNA, 17 nt, Staphylococcus aureus subsp. aureus Mu50
uuauguucgauuauucu

SEQ ID NO: 3975604 - RNA, 16 nt, Staphylococcus aureus subsp. aureus Mu50
uuauguuuaaacauuu

SEQ ID NO: 3975605 - RNA, 17 nt, Staphylococcus aureus subsp. aureus Mu50
uuauuaaaauuaaauaa

SEQ ID NO: 3975606 - RNA, 23 nt, Staphylococcus aureus subsp. aureus Mu50
uuauuaaacacgcgguaaaacga

SEQ ID NO: 3975607 - RNA, 14 nt, Staphylococcus aureus subsp. aureus Mu50
uuauuaaacccaau

SEQ ID NO: 3975608 - RNA, 12 nt, Staphylococcus aureus subsp. aureus Mu50
uuauuaaauaac

SEQ ID NO: 3975609 - RNA, 13 nt, Staphylococcus aureus subsp. aureus Mu50
uuauuaaauaaca

SEQ ID NO: 3975610 - RNA, 18 nt, Staphylococcus aureus subsp. aureus Mu50
uuauuaaaucuuuuacua

SEQ ID NO: 3975611 - RNA, 20 nt, Staphylococcus aureus subsp. aureus Mu50
uuauuaaaucuuuuacuaaa

SEQ ID NO: 3975612 - RNA, 12 nt, Staphylococcus aureus subsp. aureus Mu50
uuauuaacugua

SEQ ID NO: 3975613 - RNA, 13 nt, Staphylococcus aureus subsp. aureus Mu50
uuauuaacugugu

SEQ ID NO: 3975614 - RNA, 12 nt, Staphylococcus aureus subsp. aureus Mu50
uuauuaacuuua

SEQ ID NO: 3975615 - RNA, 13 nt, Staphylococcus aureus subsp. aureus Mu50
uucaaauguugaa

SEQ ID NO: 3975616 - RNA, 21 nt, Staphylococcus aureus subsp. aureus Mu50
uucaaauguugacuacucaau

SEQ ID NO: 3975617 - RNA, 13 nt, Staphylococcus aureus subsp. aureus Mu50
uucaaauuauaac

SEQ ID NO: 3975618 - RNA, 13 nt, Staphylococcus aureus subsp. aureus Mu50
uucaaauuuacca

SEQ ID NO: 3975619 - RNA, 18 nt, Staphylococcus aureus subsp. aureus Mu50
uucaacaaacauaaauaa

SEQ ID NO: 3975620 - RNA, 19 nt, Staphylococcus aureus subsp. aureus Mu50
uucaacaaacauaaauaag

SEQ ID NO: 3975621 - RNA, 17 nt, Staphylococcus aureus subsp. aureus Mu50
uucaacagggguaaaac

SEQ ID NO: 3975622 - RNA, 14 nt, Staphylococcus aureus subsp. aureus Mu50
uucaacauaacuca

SEQ ID NO: 3975623 - RNA, 18 nt, Staphylococcus aureus subsp. aureus Mu50
uucaacauaacucaaaua

SEQ ID NO: 3975624 - RNA, 16 nt, Staphylococcus aureus subsp. aureus Mu50
uucaacauauaaauca

SEQ ID NO: 3975625 - RNA, 20 nt, Staphylococcus aureus subsp. aureus Mu50
uucaacauauuauauauauu

SEQ ID NO: 3975626 - RNA, 13 nt, Staphylococcus aureus subsp. aureus Mu50
uucaacaucuuua

SEQ ID NO: 3975627 - RNA, 14 nt, Staphylococcus aureus subsp. aureus Mu50
uucaacaucuuuau

SEQ ID NO: 3975628 - RNA, 15 nt, Staphylococcus aureus subsp. aureus Mu50
uucaacauuacaugc

SEQ ID NO: 3975629 - RNA, 14 nt, Staphylococcus aureus subsp. aureus Mu50
uucaaccaauuauu

SEQ ID NO: 3975630 - RNA, 17 nt, Staphylococcus aureus subsp. aureus Mu50
uucaaccaauuauuaaa

SEQ ID NO: 3975631 - RNA, 21 nt, Staphylococcus aureus subsp. aureus Mu50
uucaaccuuuuaauaguacuu

SEQ ID NO: 3975632 - RNA, 19 nt, Staphylococcus aureus subsp. aureus Mu50
uucaacgucgaauguuucu

SEQ ID NO: 3975633 - RNA, 21 nt, Staphylococcus aureus subsp. aureus Mu50
uucaacgucgaauguuucuuc

SEQ ID NO: 3975634 - RNA, 13 nt, Staphylococcus aureus subsp. aureus Mu50
uucaacuacuuca

SEQ ID NO: 3975635 - RNA, 13 nt, Staphylococcus aureus subsp. aureus Mu50
uucaacuaugaaa

SEQ ID NO: 3975636 - RNA, 16 nt, Staphylococcus aureus subsp. aureus Mu50
uucaacuuauuauuua

SEQ ID NO: 3975637 - RNA, 21 nt, Staphylococcus aureus subsp. aureus Mu50
uucaacuucgauaugauuaaa

SEQ ID NO: 3975638 - RNA, 19 nt, Staphylococcus aureus subsp. aureus Mu50
uucaacuuguuuccuacac

SEQ ID NO: 3975639 - RNA, 18 nt, Staphylococcus aureus subsp. aureus Mu50
uucaacuuuaaucaaaaa

SEQ ID NO: 3975640 - RNA, 11 nt, Staphylococcus aureus subsp. aureus Mu50
uucaagaacaa

SEQ ID NO: 3975641 - RNA, 14 nt, Staphylococcus aureus subsp. aureus Mu50
uucaagaaugugaa

SEQ ID NO: 3975642 - RNA, 14 nt, Staphylococcus aureus subsp. aureus Mu50
uucaagaccaaaua

SEQ ID NO: 3975643 - RNA, 20 nt, Staphylococcus aureus subsp. aureus Mu50
uucaagaccaaauauuuuau

SEQ ID NO: 3975644 - RNA, 14 nt, Staphylococcus aureus subsp. aureus Mu50
uucaagcguuucuu

SEQ ID NO: 3975645 - RNA, 20 nt, Staphylococcus aureus subsp. aureus Mu50
uucaaguaauggauugauaa

SEQ ID NO: 3975646 - RNA, 21 nt, Staphylococcus aureus subsp. aureus Mu50
uucaaguauauccgcaucuuu

SEQ ID NO: 3975647 - RNA, 13 nt, Staphylococcus aureus subsp. aureus Mu50
uucaaguuaugcu

SEQ ID NO: 3975648 - RNA, 15 nt, Staphylococcus aureus subsp. aureus Mu50
uucaaguuuaaaaua

SEQ ID NO: 3975649 - RNA, 19 nt, Staphylococcus aureus subsp. aureus Mu50
uucaauaaaaaugguauuc

SEQ ID NO: 3975650 - RNA, 12 nt, Staphylococcus aureus subsp. aureus Mu50
uucaauaauuca

SEQ ID NO: 3975651 - RNA, 21 nt, Staphylococcus aureus subsp. aureus Mu50
uucaauacgaaguguuauaaa

SEQ ID NO: 3975652 - RNA, 17 nt, Staphylococcus aureus subsp. aureus Mu50
uucaauagcauaugaua

SEQ ID NO: 3975653 - RNA, 14 nt, Staphylococcus aureus subsp. aureus Mu50
uucaauauuaaaau

SEQ ID NO: 3975654 - RNA, 20 nt, Staphylococcus aureus subsp. aureus Mu50
uucaauauucuuaucauuca

SEQ ID NO: 3975655 - RNA, 13 nt, Staphylococcus aureus subsp. aureus Mu50
uucaauauuugaa

SEQ ID NO: 3975656 - RNA, 24 nt, Staphylococcus aureus subsp. aureus Mu50
uucaaucauucacuucaaguuaug

SEQ ID NO: 3975657 - RNA, 12 nt, Staphylococcus aureus subsp. aureus Mu50
uucaauccuuug

SEQ ID NO: 3975658 - RNA, 14 nt, Staphylococcus aureus subsp. aureus Mu50
uucaauccuuuguu

SEQ ID NO: 3975659 - RNA, 16 nt, Staphylococcus aureus subsp. aureus Mu50
uucaaucgcauuuugu

SEQ ID NO: 3975660 - RNA, 22 nt, Staphylococcus aureus subsp. aureus Mu50
uucaaucgcauuuuguuucaac

SEQ ID NO: 3975661 - RNA, 15 nt, Staphylococcus aureus subsp. aureus Mu50
uucaaucguuucuuc

SEQ ID NO: 3975662 - RNA, 16 nt, Staphylococcus aureus subsp. aureus Mu50
uucaaucuaaucuuaa

SEQ ID NO: 3975663 - RNA, 14 nt, Staphylococcus aureus subsp. aureus Mu50
uucaaugauuuuau

SEQ ID NO: 3975664 - RNA, 18 nt, Staphylococcus aureus subsp. aureus Mu50
uucaaugauuuuauaaua

SEQ ID NO: 3975665 - RNA, 18 nt, Staphylococcus aureus subsp. aureus Mu50
uucaaugauuuuuaaaaa

SEQ ID NO: 3975666 - RNA, 19 nt, Staphylococcus aureus subsp. aureus Mu50
uucaauguaauuuucacuu

SEQ ID NO: 3975667 - RNA, 19 nt, Staphylococcus aureus subsp. aureus Mu50
uucaauguaucaccuaauu

SEQ ID NO: 3975668 - RNA, 16 nt, Staphylococcus aureus subsp. aureus Mu50
uucaaugucuacuuug

SEQ ID NO: 3975669 - RNA, 21 nt, Staphylococcus aureus subsp. aureus Mu50
uucaauguuuaauuuucuaaa

SEQ ID NO: 3975670 - RNA, 16 nt, Staphylococcus aureus subsp. aureus Mu50
uucaauuaaauguuua

SEQ ID NO: 3975671 - RNA, 20 nt, Staphylococcus aureus subsp. aureus Mu50
uucaauuaauuuaaaugcuu

SEQ ID NO: 3975672 - RNA, 13 nt, Staphylococcus aureus subsp. aureus Mu50
uucaauuaucaaa

SEQ ID NO: 3975673 - RNA, 15 nt, Staphylococcus aureus subsp. aureus Mu50
uucaauuauuucauc

SEQ ID NO: 3975674 - RNA, 21 nt, Staphylococcus aureus subsp. aureus Mu50
uucaauucgcucacaugugaa

SEQ ID NO: 3975675 - RNA, 20 nt, Staphylococcus aureus subsp. aureus Mu50
uucaauucuagucaaccuug

SEQ ID NO: 3975676 - RNA, 16 nt, Staphylococcus aureus subsp. aureus Mu50
uucaauugacauuaau

SEQ ID NO: 3975677 - RNA, 15 nt, Staphylococcus aureus subsp. aureus Mu50
uucaauugucucaau

SEQ ID NO: 3975678 - RNA, 13 nt, Staphylococcus aureus subsp. aureus Mu50
uucaauuuauggu

SEQ ID NO: 3975679 - RNA, 18 nt, Staphylococcus aureus subsp. aureus Mu50
uucaauuuaugguaaaac

SEQ ID NO: 3975680 - RNA, 22 nt, Staphylococcus aureus subsp. aureus Mu50
uucaauuucauuuuugauaacu

SEQ ID NO: 3975681 - RNA, 20 nt, Staphylococcus aureus subsp. aureus Mu50
uucacaucuuuagcuaugua

SEQ ID NO: 3975682 - RNA, 22 nt, Staphylococcus aureus subsp. aureus Mu50
uucacaugaauuuuaauauauu

SEQ ID NO: 3975683 - RNA, 14 nt, Staphylococcus aureus subsp. aureus Mu50
uucaccaacuuuuu

SEQ ID NO: 3975684 - RNA, 19 nt, Staphylococcus aureus subsp. aureus Mu50
uucaccaucuguaacuaau

SEQ ID NO: 3975685 - RNA, 18 nt, Staphylococcus aureus subsp. aureus Mu50
uucaccguaaucuuuuaa

SEQ ID NO: 3975686 - RNA, 17 nt, Staphylococcus aureus subsp. aureus Mu50
uucaccuaaaugauuaa

SEQ ID NO: 3975687 - RNA, 16 nt, Staphylococcus aureus subsp. aureus Mu50
uucacguaaugaauca

SEQ ID NO: 3975688 - RNA, 20 nt, Staphylococcus aureus subsp. aureus Mu50
uucacguaauugaguuguug

SEQ ID NO: 3975689 - RNA, 15 nt, Staphylococcus aureus subsp. aureus Mu50
uucacguagcuuuuc

SEQ ID NO: 3975690 - RNA, 18 nt, Staphylococcus aureus subsp. aureus Mu50
uucacuaaauucaauaau

SEQ ID NO: 3975691 - RNA, 21 nt, Staphylococcus aureus subsp. aureus Mu50
uucacuaaauucaauaaucuu

SEQ ID NO: 3975692 - RNA, 13 nt, Staphylococcus aureus subsp. aureus Mu50
uucacuaauauuu

SEQ ID NO: 3975693 - RNA, 16 nt, Staphylococcus aureus subsp. aureus Mu50
uucacuaauauuucuu

SEQ ID NO: 3975694 - RNA, 17 nt, Staphylococcus aureus subsp. aureus Mu50
uucacuaauauuucuua

SEQ ID NO: 3975695 - RNA, 14 nt, Staphylococcus aureus subsp. aureus Mu50
uucacuaauuucuu

SEQ ID NO: 3975696 - RNA, 22 nt, Staphylococcus aureus subsp. aureus Mu50
uucacuaccauagauuauauua

SEQ ID NO: 3975697 - RNA, 13 nt, Staphylococcus aureus subsp. aureus Mu50
uucacuacuuuuu

SEQ ID NO: 3975698 - RNA, 14 nt, Staphylococcus aureus subsp. aureus Mu50
uucacucuguaaua

SEQ ID NO: 3975699 - RNA, 16 nt, Staphylococcus aureus subsp. aureus Mu50
uucacuguauaaauaa

SEQ ID NO: 3975700 - RNA, 14 nt, Staphylococcus aureus subsp. aureus Mu50
uucacuucaaacaa

SEQ ID NO: 3975701 - RNA, 15 nt, Staphylococcus aureus subsp. aureus Mu50
uucacuucaaacaaa

SEQ ID NO: 3975702 - RNA, 14 nt, Staphylococcus aureus subsp. aureus Mu50
uucacuucauaaag

SEQ ID NO: 3975703 - RNA, 12 nt, Staphylococcus aureus subsp. aureus Mu50
uucauuuaaaaa

SEQ ID NO: 3975704 - RNA, 15 nt, Staphylococcus aureus subsp. aureus Mu50
uucauuuguauuaau

SEQ ID NO: 3975705 - RNA, 13 nt, Staphylococcus aureus subsp. aureus Mu50
uucauuuuuucaa

SEQ ID NO: 3975706 - RNA, 20 nt, Staphylococcus aureus subsp. aureus Mu50
uucauuuuuucaaugucuac

SEQ ID NO: 3975707 - RNA, 11 nt, Staphylococcus aureus subsp. aureus Mu50
uuccaaaaauu

SEQ ID NO: 3975708 - RNA, 13 nt, Staphylococcus aureus subsp. aureus Mu50
uuccaaaacaaaa

SEQ ID NO: 3975709 - RNA, 21 nt, Staphylococcus aureus subsp. aureus Mu50
uuccaaacacacuguugaaaa

SEQ ID NO: 3975710 - RNA, 18 nt, Staphylococcus aureus subsp. aureus Mu50
uuccaaauugaaauuauc

SEQ ID NO: 3975711 - RNA, 24 nt, Staphylococcus aureus subsp. aureus Mu50
uuccaaauugaaauuauccuacug

SEQ ID NO: 3975712 - RNA, 16 nt, Staphylococcus aureus subsp. aureus Mu50
uuccaacacccauaua

SEQ ID NO: 3975713 - RNA, 17 nt, Staphylococcus aureus subsp. aureus Mu50
uuccaaguauuuucucu

SEQ ID NO: 3975714 - RNA, 16 nt, Staphylococcus aureus subsp. aureus Mu50
uuccaaguuaaugcac

SEQ ID NO: 3975715 - RNA, 11 nt, Staphylococcus aureus subsp. aureus Mu50
uuccaauaaua

SEQ ID NO: 3975716 - RNA, 17 nt, Staphylococcus aureus subsp. aureus Mu50
uuccaauaauaaaccua

SEQ ID NO: 3975717 - RNA, 16 nt, Staphylococcus aureus subsp. aureus Mu50
uuccaauaauaaauca

SEQ ID NO: 3975718 - RNA, 12 nt, Staphylococcus aureus subsp. aureus Mu50
uuccaauaucuu

SEQ ID NO: 3975719 - RNA, 17 nt, Staphylococcus aureus subsp. aureus Mu50
uuccaaucaacuucaua

SEQ ID NO: 3975720 - RNA, 18 nt, Staphylococcus aureus subsp. aureus Mu50
uuccaaucaacuucauau

SEQ ID NO: 3975721 - RNA, 16 nt, Staphylococcus aureus subsp. aureus Mu50
uuccaauuuaaaauga

SEQ ID NO: 3975722 - RNA, 15 nt, Staphylococcus aureus subsp. aureus Mu50
uuccaccagccucug

SEQ ID NO: 3975723 - RNA, 17 nt, Staphylococcus aureus subsp. aureus Mu50
uuccauaaauaaaaugc

SEQ ID NO: 3975724 - RNA, 18 nt, Staphylococcus aureus subsp. aureus Mu50
uuccauaaauaaaaugcu

SEQ ID NO: 3975725 - RNA, 18 nt, Staphylococcus aureus subsp. aureus Mu50
uuccaucauuuguguaaa

SEQ ID NO: 3975726 - RNA, 21 nt, Staphylococcus aureus subsp. aureus Mu50
uuccaucauuuguguaaauga

SEQ ID NO: 3975727 - RNA, 13 nt, Staphylococcus aureus subsp. aureus Mu50
uuccauucauaaa

SEQ ID NO: 3975728 - RNA, 21 nt, Staphylococcus aureus subsp. aureus Mu50
uuccauuucgaacuugauuaa

SEQ ID NO: 3975729 - RNA, 15 nt, Staphylococcus aureus subsp. aureus Mu50
uucccaaauaguuaa

SEQ ID NO: 3975730 - RNA, 17 nt, Staphylococcus aureus subsp. aureus Mu50
uucccaaucgauuuuau

SEQ ID NO: 3975731 - RNA, 22 nt, Staphylococcus aureus subsp. aureus Mu50
uucccaucuuuuagguaauaau

SEQ ID NO: 3975732 - RNA, 19 nt, Staphylococcus aureus subsp. aureus Mu50
uuccccauuaauuaacaaa

SEQ ID NO: 3975733 - RNA, 12 nt, Staphylococcus aureus subsp. aureus Mu50
uucccuacugcu

SEQ ID NO: 3975734 - RNA, 23 nt, Staphylococcus aureus subsp. aureus Mu50
uuccgcacugccuuuuuguaauu

SEQ ID NO: 3975735 - RNA, 18 nt, Staphylococcus aureus subsp. aureus Mu50
uuccuaaaccucuaaaua

SEQ ID NO: 3975736 - RNA, 15 nt, Staphylococcus aureus subsp. aureus Mu50
uuccuaaagucgucu

SEQ ID NO: 3975737 - RNA, 19 nt, Staphylococcus aureus subsp. aureus Mu50
uuccuaauggucgugcuug

SEQ ID NO: 3975738 - RNA, 23 nt, Staphylococcus aureus subsp. aureus Mu50
uuccuacacuguuuuauaaauga

SEQ ID NO: 3975739 - RNA, 13 nt, Staphylococcus aureus subsp. aureus Mu50
uuccuagcuuuua

SEQ ID NO: 3975740 - RNA, 16 nt, Staphylococcus aureus subsp. aureus Mu50
uuccuauuaggaucca

SEQ ID NO: 3975741 - RNA, 19 nt, Staphylococcus aureus subsp. aureus Mu50
uuccucaacgggaacauca

SEQ ID NO: 3975742 - RNA, 20 nt, Staphylococcus aureus subsp. aureus Mu50
uuccugcuacaacuucuucu

SEQ ID NO: 3975743 - RNA, 15 nt, Staphylococcus aureus subsp. aureus Mu50
uuccuuguuggucug

SEQ ID NO: 3975744 - RNA, 22 nt, Staphylococcus aureus subsp. aureus Mu50
uuccuuguuuuaaacuuauuaa

SEQ ID NO: 3975745 - RNA, 19 nt, Staphylococcus aureus subsp. aureus Mu50
uuccuuuagcaaaaauauu

SEQ ID NO: 3975746 - RNA, 13 nt, Staphylococcus aureus subsp. aureus Mu50
uuccuuucuuuuu

SEQ ID NO: 3975747 - RNA, 15 nt, Staphylococcus aureus subsp. aureus Mu50
uuccuuucuuuuucg

SEQ ID NO: 3975748 - RNA, 13 nt, Staphylococcus aureus subsp. aureus Mu50
uuccuuuuuuuaa

SEQ ID NO: 3975749 - RNA, 15 nt, Staphylococcus aureus subsp. aureus Mu50
uucgaaaagaaauuc

SEQ ID NO: 3975750 - RNA, 17 nt, Staphylococcus aureus subsp. aureus Mu50
uucgaaaagaaauucua

SEQ ID NO: 3975751 - RNA, 23 nt, Staphylococcus aureus subsp. aureus Mu50
uucgaaauucucuuuguuggggc

SEQ ID NO: 3975752 - RNA, 16 nt, Staphylococcus aureus subsp. aureus Mu50
uucgaacgcuugaaaa

SEQ ID NO: 3975753 - RNA, 17 nt, Staphylococcus aureus subsp. aureus Mu50
uucgaacuaucaauaua

SEQ ID NO: 3975754 - RNA, 17 nt, Staphylococcus aureus subsp. aureus Mu50
uucgaagucauaugcau

SEQ ID NO: 3975755 - RNA, 16 nt, Staphylococcus aureus subsp. aureus Mu50
uucgaauuuaacaucu

SEQ ID NO: 3975756 - RNA, 23 nt, Staphylococcus aureus subsp. aureus Mu50
uucgacacgcccgacaucauaaa

SEQ ID NO: 3975757 - RNA, 18 nt, Staphylococcus aureus subsp. aureus Mu50
uucgacuguauacgacgu

SEQ ID NO: 3975758 - RNA, 17 nt, Staphylococcus aureus subsp. aureus Mu50
uucgaggucaucaaaag

SEQ ID NO: 3975759 - RNA, 14 nt, Staphylococcus aureus subsp. aureus Mu50
uucgauauuuguuu

SEQ ID NO: 3975760 - RNA, 16 nt, Staphylococcus aureus subsp. aureus Mu50
uucgauuauucuuaau

SEQ ID NO: 3975761 - RNA, 19 nt, Staphylococcus aureus subsp. aureus Mu50
uucgauuauuuagauaaaa

SEQ ID NO: 3975762 - RNA, 15 nt, Staphylococcus aureus subsp. aureus Mu50
uucgauucauaaaau

SEQ ID NO: 3975763 - RNA, 23 nt, Staphylococcus aureus subsp. aureus Mu50
uucgauucauuuaaaaaucaaag

SEQ ID NO: 3975764 - RNA, 20 nt, Staphylococcus aureus subsp. aureus Mu50
uucgcauacuuuuucagaau

SEQ ID NO: 3975765 - RNA, 17 nt, Staphylococcus aureus subsp. aureus Mu50
uucgcaucacugcauau

SEQ ID NO: 3975766 - RNA, 14 nt, Staphylococcus aureus subsp. aureus Mu50
uucgccuaaauggu

SEQ ID NO: 3975767 - RNA, 13 nt, Staphylococcus aureus subsp. aureus Mu50
uucggacgauuga

SEQ ID NO: 3975768 - RNA, 15 nt, Staphylococcus aureus subsp. aureus Mu50
uucggcuuuccuaau

SEQ ID NO: 3975769 - RNA, 16 nt, Staphylococcus aureus subsp. aureus Mu50
uucguaacauuuaaaa

SEQ ID NO: 3975770 - RNA, 17 nt, Staphylococcus aureus subsp. aureus Mu50
uucguaacauuuaaaaa

SEQ ID NO: 3975771 - RNA, 13 nt, Staphylococcus aureus subsp. aureus Mu50
uucguaauaaaca

SEQ ID NO: 3975772 - RNA, 14 nt, Staphylococcus aureus subsp. aureus Mu50
uucguaauaaacau

SEQ ID NO: 3975773 - RNA, 17 nt, Staphylococcus aureus subsp. aureus Mu50
uucguaauguguuaaua

SEQ ID NO: 3975774 - RNA, 21 nt, Staphylococcus aureus subsp. aureus Mu50
uucguaauugucuuuauaaaa

SEQ ID NO: 3975775 - RNA, 22 nt, Staphylococcus aureus subsp. aureus Mu50
uucguaauuuaugauuguuuau

SEQ ID NO: 3975776 - RNA, 19 nt, Staphylococcus aureus subsp. aureus Mu50
uucguacaucguugccauu

SEQ ID NO: 3975777 - RNA, 15 nt, Staphylococcus aureus subsp. aureus Mu50
uucguacuuccaaua

SEQ ID NO: 3975778 - RNA, 19 nt, Staphylococcus aureus subsp. aureus Mu50
uucguagcaugacauuaag

SEQ ID NO: 3975779 - RNA, 21 nt, Staphylococcus aureus subsp. aureus Mu50
uucguauauuacaucuauauu

SEQ ID NO: 3975780 - RNA, 15 nt, Staphylococcus aureus subsp. aureus Mu50
uucguauguuucuuu

SEQ ID NO: 3975781 - RNA, 20 nt, Staphylococcus aureus subsp. aureus Mu50
uucguauguuucuuuauuau

SEQ ID NO: 3975782 - RNA, 18 nt, Staphylococcus aureus subsp. aureus Mu50
uucguguuccaauuuuau

SEQ ID NO: 3975783 - RNA, 20 nt, Staphylococcus aureus subsp. aureus Mu50
uucguugcacuuuaauauca

SEQ ID NO: 3975784 - RNA, 17 nt, Staphylococcus aureus subsp. aureus Mu50
uucguuguucauaauca

SEQ ID NO: 3975785 - RNA, 13 nt, Staphylococcus aureus subsp. aureus Mu50
uucguuucuuuua

SEQ ID NO: 3975786 - RNA, 19 nt, Staphylococcus aureus subsp. aureus Mu50
uucguuuuaauaaauuguu

SEQ ID NO: 3975787 - RNA, 12 nt, Staphylococcus aureus subsp. aureus Mu50
uucguuuuacua

SEQ ID NO: 3975788 - RNA, 23 nt, Staphylococcus aureus subsp. aureus Mu50
uucguuuugcuaaccaucauaaa

SEQ ID NO: 3975789 - RNA, 18 nt, Staphylococcus aureus subsp. aureus Mu50
uucuaaaaaauuaaaaau

SEQ ID NO: 3975790 - RNA, 19 nt, Staphylococcus aureus subsp. aureus Mu50
uucuaaaaaauuaaaaauu

SEQ ID NO: 3975791 - RNA, 20 nt, Staphylococcus aureus subsp. aureus Mu50
uucugcuuuuucuuuaucua

SEQ ID NO: 3975792 - RNA, 16 nt, Staphylococcus aureus subsp. aureus Mu50
uucuggaauugggaaa

SEQ ID NO: 3975793 - RNA, 16 nt, Staphylococcus aureus subsp. aureus Mu50
uucuguaauaauauca

SEQ ID NO: 3975794 - RNA, 16 nt, Staphylococcus aureus subsp. aureus Mu50
uucugucuguaaauua

SEQ ID NO: 3975795 - RNA, 19 nt, Staphylococcus aureus subsp. aureus Mu50
uucuguugcaguuucaauc

SEQ ID NO: 3975796 - RNA, 16 nt, Staphylococcus aureus subsp. aureus Mu50
uucuuaacauaaaaug

SEQ ID NO: 3975797 - RNA, 18 nt, Staphylococcus aureus subsp. aureus Mu50
uucuuaacauaaaaugag

SEQ ID NO: 3975798 - RNA, 13 nt, Staphylococcus aureus subsp. aureus Mu50
uucuuaauuauca

SEQ ID NO: 3975799 - RNA, 22 nt, Staphylococcus aureus subsp. aureus Mu50
uucuuagauuuuauauaaaaag

SEQ ID NO: 3975800 - RNA, 18 nt, Staphylococcus aureus subsp. aureus Mu50
uucuuaguuugacaucua

SEQ ID NO: 3975801 - RNA, 12 nt, Staphylococcus aureus subsp. aureus Mu50
uucuuauaaaaa

SEQ ID NO: 3975802 - RNA, 14 nt, Staphylococcus aureus subsp. aureus Mu50
uucuuauaaaaauc

SEQ ID NO: 3975803 - RNA, 16 nt, Staphylococcus aureus subsp. aureus Mu50
uucuuauaaaaaucuu

SEQ ID NO: 3975804 - RNA, 13 nt, Staphylococcus aureus subsp. aureus Mu50
uucuuauaaaaua

SEQ ID NO: 3975805 - RNA, 14 nt, Staphylococcus aureus subsp. aureus Mu50
uucuuauaaaauaa

SEQ ID NO: 3975806 - RNA, 13 nt, Staphylococcus aureus subsp. aureus Mu50
uucuuaucaguuu

SEQ ID NO: 3975807 - RNA, 22 nt, Staphylococcus aureus subsp. aureus Mu50
uucuuaucuguaccguuuuuua

SEQ ID NO: 3975808 - RNA, 13 nt, Staphylococcus aureus subsp. aureus Mu50
uucuuauuaaaua

SEQ ID NO: 3975809 - RNA, 15 nt, Staphylococcus aureus subsp. aureus Mu50
uucuuauuaaauaag

SEQ ID NO: 3975810 - RNA, 23 nt, Staphylococcus aureus subsp. aureus Mu50
uucuuauuuauucauaacguguu

SEQ ID NO: 3975811 - RNA, 16 nt, Staphylococcus aureus subsp. aureus Mu50
uucuucaaaaaauaau

SEQ ID NO: 3975812 - RNA, 22 nt, Staphylococcus aureus subsp. aureus Mu50
uucuucaaaaaauaauagcaaa

SEQ ID NO: 3975813 - RNA, 18 nt, Staphylococcus aureus subsp. aureus Mu50
uucuucaaccauuuguuc

SEQ ID NO: 3975814 - RNA, 19 nt, Staphylococcus aureus subsp. aureus Mu50
uucuucaaccauuuguucu

SEQ ID NO: 3975815 - RNA, 20 nt, Staphylococcus aureus subsp. aureus Mu50
uucuucaauaacaccuuuca

SEQ ID NO: 3975816 - RNA, 13 nt, Staphylococcus aureus subsp. aureus Mu50
uucuucaauuguc

SEQ ID NO: 3975817 - RNA, 16 nt, Staphylococcus aureus subsp. aureus Mu50
uucuucaccaacuuuu

SEQ ID NO: 3975818 - RNA, 23 nt, Staphylococcus aureus subsp. aureus Mu50
uucuucaccaguuugugguaaug

SEQ ID NO: 3975819 - RNA, 14 nt, Staphylococcus aureus subsp. aureus Mu50
uucuucacuaaaaa

SEQ ID NO: 3975820 - RNA, 17 nt, Staphylococcus aureus subsp. aureus Mu50
uucuucacuaaaaauau

SEQ ID NO: 3975821 - RNA, 17 nt, Staphylococcus aureus subsp. aureus Mu50
uucuucagguguuuuac

SEQ ID NO: 3975822 - RNA, 17 nt, Staphylococcus aureus subsp. aureus Mu50
uucuucaguuaaaucuu

SEQ ID NO: 3975823 - RNA, 12 nt, Staphylococcus aureus subsp. aureus Mu50
uucuucaucuuu

SEQ ID NO: 3975824 - RNA, 22 nt, Staphylococcus aureus subsp. aureus Mu50
uucuuccaacacccauauaauu

SEQ ID NO: 3975825 - RNA, 16 nt, Staphylococcus aureus subsp. aureus Mu50
uucuucuaauucugaa

SEQ ID NO: 3975826 - RNA, 14 nt, Staphylococcus aureus subsp. aureus Mu50
uucuucuuuuuuau

SEQ ID NO: 3975827 - RNA, 12 nt, Staphylococcus aureus subsp. aureus Mu50
uucuugaauaaa

SEQ ID NO: 3975828 - RNA, 14 nt, Staphylococcus aureus subsp. aureus Mu50
uucuugagcuguua

SEQ ID NO: 3975829 - RNA, 19 nt, Staphylococcus aureus subsp. aureus Mu50
uucuugagcuguuacacuu

SEQ ID NO: 3975830 - RNA, 22 nt, Staphylococcus aureus subsp. aureus Mu50
uucuuggucugcuguaucauca

SEQ ID NO: 3975831 - RNA, 21 nt, Staphylococcus aureus subsp. aureus Mu50
uucuuguuuagggaaucccau

SEQ ID NO: 3975832 - RNA, 15 nt, Staphylococcus aureus subsp. aureus Mu50
uucuuuaaauacauc

SEQ ID NO: 3975833 - RNA, 12 nt, Staphylococcus aureus subsp. aureus Mu50
uucuuuaaauua

SEQ ID NO: 3975834 - RNA, 12 nt, Staphylococcus aureus subsp. aureus Mu50
uucuuuaacaau

SEQ ID NO: 3975835 - RNA, 13 nt, Staphylococcus aureus subsp. aureus Mu50
uucuuuaacaauu

SEQ ID NO: 3975836 - RNA, 21 nt, Staphylococcus aureus subsp. aureus Mu50
uucuuuaauauaaauuuugaa

SEQ ID NO: 3975837 - RNA, 20 nt, Staphylococcus aureus subsp. aureus Mu50
uucuuuauuagaaugaaacc

SEQ ID NO: 3975838 - RNA, 14 nt, Staphylococcus aureus subsp. aureus Mu50
uucuuucaggcuuu

SEQ ID NO: 3975839 - RNA, 24 nt, Staphylococcus aureus subsp. aureus Mu50
uucuuucaggcuuuguuuuucacu

SEQ ID NO: 3975840 - RNA, 13 nt, Staphylococcus aureus subsp. aureus Mu50
uucuuucauaauu

SEQ ID NO: 3975841 - RNA, 14 nt, Staphylococcus aureus subsp. aureus Mu50
uucuuucauaauua

SEQ ID NO: 3975842 - RNA, 18 nt, Staphylococcus aureus subsp. aureus Mu50
uucuuucuuuuuuauuaa

SEQ ID NO: 3975843 - RNA, 12 nt, Staphylococcus aureus subsp. aureus Mu50
uucuuugauuag

SEQ ID NO: 3975844 - RNA, 12 nt, Staphylococcus aureus subsp. aureus Mu50
uucuuugucauc

SEQ ID NO: 3975845 - RNA, 15 nt, Staphylococcus aureus subsp. aureus Mu50
uucuuugucaucuuu

SEQ ID NO: 3975846 - RNA, 21 nt, Staphylococcus aureus subsp. aureus Mu50
uucuuuguguuugcuuuuauu

SEQ ID NO: 3975847 - RNA, 18 nt, Staphylococcus aureus subsp. aureus Mu50
uucuuuuaaguuaucaaa

SEQ ID NO: 3975848 - RNA, 17 nt, Staphylococcus aureus subsp. aureus Mu50
uucuuuuauaucgcuuu

SEQ ID NO: 3975849 - RNA, 19 nt, Staphylococcus aureus subsp. aureus Mu50
uucuuuuguaauugaaaug

SEQ ID NO: 3975850 - RNA, 23 nt, Staphylococcus aureus subsp. aureus Mu50
uucuuuuguaauugaaaugauag

SEQ ID NO: 3975851 - RNA, 14 nt, Staphylococcus aureus subsp. aureus Mu50
uucuuuuuaucaug

SEQ ID NO: 3975852 - RNA, 20 nt, Staphylococcus aureus subsp. aureus Mu50
uucuuuuucagcuaauuguc

SEQ ID NO: 3975853 - RNA, 18 nt, Staphylococcus aureus subsp. aureus Mu50
uucuuuuuguuguuuuaa

SEQ ID NO: 3975854 - RNA, 18 nt, Staphylococcus aureus subsp. aureus Mu50
uucuuuuuuuguuaccaa

SEQ ID NO: 3975855 - RNA, 20 nt, Staphylococcus aureus subsp. aureus Mu50
uugaaaaaccaaguuuugca

SEQ ID NO: 3975856 - RNA, 16 nt, Staphylococcus aureus subsp. aureus Mu50
uugaaaaauuaaaaaa

SEQ ID NO: 3975857 - RNA, 20 nt, Staphylococcus aureus subsp. aureus Mu50
uugaaaacaauaaauuucaa

SEQ ID NO: 3975858 - RNA, 12 nt, Staphylococcus aureus subsp. aureus Mu50
uugaaaaguuug

SEQ ID NO: 3975859 - RNA, 16 nt, Staphylococcus aureus subsp. aureus Mu50
uugaaaaucuaauccu

SEQ ID NO: 3975860 - RNA, 13 nt, Staphylococcus aureus subsp. aureus Mu50
uugaaaauuucac

SEQ ID NO: 3975861 - RNA, 15 nt, Staphylococcus aureus subsp. aureus Mu50
uugaaacaagaaguu

SEQ ID NO: 3975862 - RNA, 19 nt, Staphylococcus aureus subsp. aureus Mu50
uugaaacaucuaaauaguu

SEQ ID NO: 3975863 - RNA, 19 nt, Staphylococcus aureus subsp. aureus Mu50
uugaaacaucuugauauuc

SEQ ID NO: 3975864 - RNA, 23 nt, Staphylococcus aureus subsp. aureus Mu50
uugaaaccuuggcuucauguucu

SEQ ID NO: 3975865 - RNA, 17 nt, Staphylococcus aureus subsp. aureus Mu50
uugaaacgguaucaaca

SEQ ID NO: 3975866 - RNA, 19 nt, Staphylococcus aureus subsp. aureus Mu50
uugaaacuaauaauuugua

SEQ ID NO: 3975867 - RNA, 20 nt, Staphylococcus aureus subsp. aureus Mu50
uugaaacugaguucaauuaa

SEQ ID NO: 3975868 - RNA, 15 nt, Staphylococcus aureus subsp. aureus Mu50
uugaaauguuuauca

SEQ ID NO: 3975869 - RNA, 15 nt, Staphylococcus aureus subsp. aureus Mu50
uugaaauuaauuauc

SEQ ID NO: 3975870 - RNA, 20 nt, Staphylococcus aureus subsp. aureus Mu50
uugaaauuauuauuuaaauu

SEQ ID NO: 3975871 - RNA, 16 nt, Staphylococcus aureus subsp. aureus Mu50
uugaaauugacaguuu

SEQ ID NO: 3975872 - RNA, 17 nt, Staphylococcus aureus subsp. aureus Mu50
uugaacaacaucuuuug

SEQ ID NO: 3975873 - RNA, 19 nt, Staphylococcus aureus subsp. aureus Mu50
uugaacaauucuucaucau

SEQ ID NO: 3975874 - RNA, 17 nt, Staphylococcus aureus subsp. aureus Mu50
uugaacauauuauaaaa

SEQ ID NO: 3975875 - RNA, 23 nt, Staphylococcus aureus subsp. aureus Mu50
uugaacauauuauaaaaguguaa

SEQ ID NO: 3975876 - RNA, 21 nt, Staphylococcus aureus subsp. aureus Mu50
uugaaccggaaauuaaaucga

SEQ ID NO: 3975877 - RNA, 15 nt, Staphylococcus aureus subsp. aureus Mu50
uugaacgauaacaau

SEQ ID NO: 3975878 - RNA, 21 nt, Staphylococcus aureus subsp. aureus Mu50
uugaacgauaacaauuuauua

SEQ ID NO: 3975879 - RNA, 16 nt, Staphylococcus aureus subsp. aureus Mu50
uugauggauauucaau

SEQ ID NO: 3975880 - RNA, 23 nt, Staphylococcus aureus subsp. aureus Mu50
uugaugguuaaugacuaugcaaa

SEQ ID NO: 3975881 - RNA, 15 nt, Staphylococcus aureus subsp. aureus Mu50
uugauguaauucugu

SEQ ID NO: 3975882 - RNA, 20 nt, Staphylococcus aureus subsp. aureus Mu50
uugauguguugcauuacuau

SEQ ID NO: 3975883 - RNA, 18 nt, Staphylococcus aureus subsp. aureus Mu50
uugauguucuugaaaaca

SEQ ID NO: 3975884 - RNA, 11 nt, Staphylococcus aureus subsp. aureus Mu50
uugauguuuau

SEQ ID NO: 3975885 - RNA, 14 nt, Staphylococcus aureus subsp. aureus Mu50
uugauguuuucuau

SEQ ID NO: 3975886 - RNA, 20 nt, Staphylococcus aureus subsp. aureus Mu50
uugauuaaaaacgucucuau

SEQ ID NO: 3975887 - RNA, 21 nt, Staphylococcus aureus subsp. aureus Mu50
uugauuaaaaacgucucuaua

SEQ ID NO: 3975888 - RNA, 15 nt, Staphylococcus aureus subsp. aureus Mu50
uugauuaaaaguguu

SEQ ID NO: 3975889 - RNA, 14 nt, Staphylococcus aureus subsp. aureus Mu50
uugauuaaacgguu

SEQ ID NO: 3975890 - RNA, 20 nt, Staphylococcus aureus subsp. aureus Mu50
uugauuaaacgguucauuuc

SEQ ID NO: 3975891 - RNA, 18 nt, Staphylococcus aureus subsp. aureus Mu50
uugauuaacacaauccuu

SEQ ID NO: 3975892 - RNA, 16 nt, Staphylococcus aureus subsp. aureus Mu50
uugauuaacacauucu

SEQ ID NO: 3975893 - RNA, 17 nt, Staphylococcus aureus subsp. aureus Mu50
uugauuagcauaccuuu

SEQ ID NO: 3975894 - RNA, 16 nt, Staphylococcus aureus subsp. aureus Mu50
uugauuauauuucuca

SEQ ID NO: 3975895 - RNA, 18 nt, Staphylococcus aureus subsp. aureus Mu50
uugauuauucuuugauua

SEQ ID NO: 3975896 - RNA, 15 nt, Staphylococcus aureus subsp. aureus Mu50
uugauucuaaauaau

SEQ ID NO: 3975897 - RNA, 16 nt, Staphylococcus aureus subsp. aureus Mu50
uugauucuacuucacc

SEQ ID NO: 3975898 - RNA, 20 nt, Staphylococcus aureus subsp. aureus Mu50
uugauucuucaccaguuugu

SEQ ID NO: 3975899 - RNA, 15 nt, Staphylococcus aureus subsp. aureus Mu50
uugauugauaugguu

SEQ ID NO: 3975900 - RNA, 17 nt, Staphylococcus aureus subsp. aureus Mu50
uugauuguauuuuucaa

SEQ ID NO: 3975901 - RNA, 15 nt, Staphylococcus aureus subsp. aureus Mu50
uugauuuacgugcau

SEQ ID NO: 3975902 - RNA, 20 nt, Staphylococcus aureus subsp. aureus Mu50
uugcaaaacgcauuucaugu

SEQ ID NO: 3975903 - RNA, 14 nt, Staphylococcus aureus subsp. aureus Mu50
uugcaaaauacgau

SEQ ID NO: 3975904 - RNA, 17 nt, Staphylococcus aureus subsp. aureus Mu50
uugcaaagacucaauuu

SEQ ID NO: 3975905 - RNA, 15 nt, Staphylococcus aureus subsp. aureus Mu50
uugcaaaguaacaau

SEQ ID NO: 3975906 - RNA, 21 nt, Staphylococcus aureus subsp. aureus Mu50
uugcaaauauaucaucucuau

SEQ ID NO: 3975907 - RNA, 20 nt, Staphylococcus aureus subsp. aureus Mu50
uugcaaauuaucauuaaauu

SEQ ID NO: 3975908 - RNA, 15 nt, Staphylococcus aureus subsp. aureus Mu50
uugcaacauauuuuc

SEQ ID NO: 3975909 - RNA, 13 nt, Staphylococcus aureus subsp. aureus Mu50
uugcaaguauuuu

SEQ ID NO: 3975910 - RNA, 18 nt, Staphylococcus aureus subsp. aureus Mu50
uugcaauaauucaucuug

SEQ ID NO: 3975911 - RNA, 16 nt, Staphylococcus aureus subsp. aureus Mu50
uugcaaucguauguaa

SEQ ID NO: 3975912 - RNA, 22 nt, Staphylococcus aureus subsp. aureus Mu50
uugcaaucguauguaacaauuu

SEQ ID NO: 3975913 - RNA, 20 nt, Staphylococcus aureus subsp. aureus Mu50
uugcaaugaauaacaagaaa

SEQ ID NO: 3975914 - RNA, 19 nt, Staphylococcus aureus subsp. aureus Mu50
uugcaaugcauauugugcc

SEQ ID NO: 3975915 - RNA, 18 nt, Staphylococcus aureus subsp. aureus Mu50
uugcaauggcaaccuuuu

SEQ ID NO: 3975916 - RNA, 16 nt, Staphylococcus aureus subsp. aureus Mu50
uugcaauugcaaugaa

SEQ ID NO: 3975917 - RNA, 20 nt, Staphylococcus aureus subsp. aureus Mu50
uugcaauugcaaugaauaac

SEQ ID NO: 3975918 - RNA, 19 nt, Staphylococcus aureus subsp. aureus Mu50
uugcacaaagauauguuua

SEQ ID NO: 3975919 - RNA, 21 nt, Staphylococcus aureus subsp. aureus Mu50
uugcacaguuucaucuucaac

SEQ ID NO: 3975920 - RNA, 18 nt, Staphylococcus aureus subsp. aureus Mu50
uugcacgucuuguaucaa

SEQ ID NO: 3975921 - RNA, 16 nt, Staphylococcus aureus subsp. aureus Mu50
uugcacuaugcauaau

SEQ ID NO: 3975922 - RNA, 18 nt, Staphylococcus aureus subsp. aureus Mu50
uugcacucuuuucucguu

SEQ ID NO: 3975923 - RNA, 16 nt, Staphylococcus aureus subsp. aureus Mu50
uugcacuuuuuucauu

SEQ ID NO: 3975924 - RNA, 21 nt, Staphylococcus aureus subsp. aureus Mu50
uugcauaaucaauuucaccuu

SEQ ID NO: 3975925 - RNA, 22 nt, Staphylococcus aureus subsp. aureus Mu50
uugcauauccuucaaagauuuu

SEQ ID NO: 3975926 - RNA, 19 nt, Staphylococcus aureus subsp. aureus Mu50
uugcaugacagcaaauuuu

SEQ ID NO: 3975927 - RNA, 22 nt, Staphylococcus aureus subsp. aureus Mu50
uugccaaaaguuauauaaauuu

SEQ ID NO: 3975928 - RNA, 15 nt, Staphylococcus aureus subsp. aureus Mu50
uugccaaauuucucu

SEQ ID NO: 3975929 - RNA, 20 nt, Staphylococcus aureus subsp. aureus Mu50
uugccaaauuucucuuucaa

SEQ ID NO: 3975930 - RNA, 19 nt, Staphylococcus aureus subsp. aureus Mu50
uugccauacccauauuaaa

SEQ ID NO: 3975931 - RNA, 22 nt, Staphylococcus aureus subsp. aureus Mu50
uugccauacccauauuaaauuu

SEQ ID NO: 3975932 - RNA, 19 nt, Staphylococcus aureus subsp. aureus Mu50
uugccauagaaaugugcug

SEQ ID NO: 3975933 - RNA, 20 nt, Staphylococcus aureus subsp. aureus Mu50
uugccaucaauuucuguaau

SEQ ID NO: 3975934 - RNA, 16 nt, Staphylococcus aureus subsp. aureus Mu50
uugccguauuucaaau

SEQ ID NO: 3975935 - RNA, 18 nt, Staphylococcus aureus subsp. aureus Mu50
uugccuguagaauuucuu

SEQ ID NO: 3975936 - RNA, 16 nt, Staphylococcus aureus subsp. aureus Mu50
uugccuuuugaauaau

SEQ ID NO: 3975937 - RNA, 23 nt, Staphylococcus aureus subsp. aureus Mu50
uugcgguuggcucuuuuuauuua

SEQ ID NO: 3975938 - RNA, 15 nt, Staphylococcus aureus subsp. aureus Mu50
uugcgucguuuauua

SEQ ID NO: 3975939 - RNA, 18 nt, Staphylococcus aureus subsp. aureus Mu50
uugcuaaaaaaauuaaaa

SEQ ID NO: 3975940 - RNA, 22 nt, Staphylococcus aureus subsp. aureus Mu50
uugcuaaaaaaauuaaaauguu

SEQ ID NO: 3975941 - RNA, 12 nt, Staphylococcus aureus subsp. aureus Mu50
uugcuaaaauau

SEQ ID NO: 3975942 - RNA, 22 nt, Staphylococcus aureus subsp. aureus Mu50
uugcuaaacgcuaaaauuuccu

SEQ ID NO: 3975943 - RNA, 20 nt, Staphylococcus aureus subsp. aureus Mu50
uugcuaaaguguagccaaau

SEQ ID NO: 3975944 - RNA, 12 nt, Staphylococcus aureus subsp. aureus Mu50
uugcuaaauagc

SEQ ID NO: 3975945 - RNA, 19 nt, Staphylococcus aureus subsp. aureus Mu50
uugcuagugcucuugcaau

SEQ ID NO: 3975946 - RNA, 16 nt, Staphylococcus aureus subsp. aureus Mu50
uugcuauauuaguaua

SEQ ID NO: 3975947 - RNA, 23 nt, Staphylococcus aureus subsp. aureus Mu50
uugcuauuucaacaaacauaaau

SEQ ID NO: 3975948 - RNA, 22 nt, Staphylococcus aureus subsp. aureus Mu50
uugcucaccuuuagacaauauu

SEQ ID NO: 3975949 - RNA, 20 nt, Staphylococcus aureus subsp. aureus Mu50
uugcucuaauccaaaauaau

SEQ ID NO: 3975950 - RNA, 21 nt, Staphylococcus aureus subsp. aureus Mu50
uugcucuaauccaaaauaauc

SEQ ID NO: 3975951 - RNA, 13 nt, Staphylococcus aureus subsp. aureus Mu50
uugcuggauuaca

SEQ ID NO: 3975952 - RNA, 18 nt, Staphylococcus aureus subsp. aureus Mu50
uugcuguauauauaugua

SEQ ID NO: 3975953 - RNA, 19 nt, Staphylococcus aureus subsp. aureus Mu50
uugcuuaaaccuuaauaau

SEQ ID NO: 3975954 - RNA, 13 nt, Staphylococcus aureus subsp. aureus Mu50
uugcuuaacuucc

SEQ ID NO: 3975955 - RNA, 17 nt, Staphylococcus aureus subsp. aureus Mu50
uugcuuaacuuccuuuu

SEQ ID NO: 3975956 - RNA, 15 nt, Staphylococcus aureus subsp. aureus Mu50
uugcuuaauaucaug

SEQ ID NO: 3975957 - RNA, 15 nt, Staphylococcus aureus subsp. aureus Mu50
uugcuuauuuauuuu

SEQ ID NO: 3975958 - RNA, 19 nt, Staphylococcus aureus subsp. aureus Mu50
uugcuuauuuuuguauucu

SEQ ID NO: 3975959 - RNA, 18 nt, Staphylococcus aureus subsp. aureus Mu50
uugcuucauuauauaauu

SEQ ID NO: 3975960 - RNA, 17 nt, Staphylococcus aureus subsp. aureus Mu50
uugcuucuuuaaaggaa

SEQ ID NO: 3975961 - RNA, 13 nt, Staphylococcus aureus subsp. aureus Mu50
uugcuugaaauua

SEQ ID NO: 3975962 - RNA, 22 nt, Staphylococcus aureus subsp. aureus Mu50
uugcuugaaauuauuauuuaaa

SEQ ID NO: 3975963 - RNA, 19 nt, Staphylococcus aureus subsp. aureus Mu50
uugcuuguacgauaacuac

SEQ ID NO: 3975964 - RNA, 13 nt, Staphylococcus aureus subsp. aureus Mu50
uugcuuuaauuug

SEQ ID NO: 3975965 - RNA, 15 nt, Staphylococcus aureus subsp. aureus Mu50
uugcuuuagcucuuu

SEQ ID NO: 3975966 - RNA, 18 nt, Staphylococcus aureus subsp. aureus Mu50
uugucaucauguucuaau

SEQ ID NO: 3975967 - RNA, 20 nt, Staphylococcus aureus subsp. aureus Mu50
uugucaucguauuucuagcu

SEQ ID NO: 3975968 - RNA, 23 nt, Staphylococcus aureus subsp. aureus Mu50
uugucaugccgucgauagauguu

SEQ ID NO: 3975969 - RNA, 13 nt, Staphylococcus aureus subsp. aureus Mu50
uugucaugccuuc

SEQ ID NO: 3975970 - RNA, 14 nt, Staphylococcus aureus subsp. aureus Mu50
uuguccaugccuua

SEQ ID NO: 3975971 - RNA, 17 nt, Staphylococcus aureus subsp. aureus Mu50
uuguccaugccuuaugu

SEQ ID NO: 3975972 - RNA, 20 nt, Staphylococcus aureus subsp. aureus Mu50
uuguccuaacgcuaauuuua

SEQ ID NO: 3975973 - RNA, 23 nt, Staphylococcus aureus subsp. aureus Mu50
uuguccuuuaagaacauaaccua

SEQ ID NO: 3975974 - RNA, 21 nt, Staphylococcus aureus subsp. aureus Mu50
uugucggacgauauauacaaa

SEQ ID NO: 3975975 - RNA, 22 nt, Staphylococcus aureus subsp. aureus Mu50
uugucguucucguguaaaaugc

SEQ ID NO: 3975976 - RNA, 16 nt, Staphylococcus aureus subsp. aureus Mu50
uugucucaauaauguu

SEQ ID NO: 3975977 - RNA, 13 nt, Staphylococcus aureus subsp. aureus Mu50
uugucuguauuau

SEQ ID NO: 3975978 - RNA, 16 nt, Staphylococcus aureus subsp. aureus Mu50
uugucuuaauaugcaa

SEQ ID NO: 3975979 - RNA, 13 nt, Staphylococcus aureus subsp. aureus Mu50
uugucuuugaaug

SEQ ID NO: 3975980 - RNA, 16 nt, Staphylococcus aureus subsp. aureus Mu50
uugugaauaaaauugu

SEQ ID NO: 3975981 - RNA, 15 nt, Staphylococcus aureus subsp. aureus Mu50
uugugaauaauuuca

SEQ ID NO: 3975982 - RNA, 18 nt, Staphylococcus aureus subsp. aureus Mu50
uugugaauuuauuuugua

SEQ ID NO: 3975983 - RNA, 21 nt, Staphylococcus aureus subsp. aureus Mu50
uugugacgcugguaauauuuu

SEQ ID NO: 3975984 - RNA, 18 nt, Staphylococcus aureus subsp. aureus Mu50
uugugauaauucuucaac

SEQ ID NO: 3975985 - RNA, 17 nt, Staphylococcus aureus subsp. aureus Mu50
uugugaugauaauuaau

SEQ ID NO: 3975986 - RNA, 18 nt, Staphylococcus aureus subsp. aureus Mu50
uugugaugauaauuaaug

SEQ ID NO: 3975987 - RNA, 23 nt, Staphylococcus aureus subsp. aureus Mu50
uugugaugauaauuaaugccauu

SEQ ID NO: 3975988 - RNA, 17 nt, Staphylococcus aureus subsp. aureus Mu50
uugugauuuuuaauaau

SEQ ID NO: 3975989 - RNA, 18 nt, Staphylococcus aureus subsp. aureus Mu50
uugugauuuuuaauaauu

SEQ ID NO: 3975990 - RNA, 13 nt, Staphylococcus aureus subsp. aureus Mu50
uugugauuuuuug

SEQ ID NO: 3975991 - RNA, 14 nt, Staphylococcus aureus subsp. aureus Mu50
uugugcuuuuccau

SEQ ID NO: 3975992 - RNA, 15 nt, Staphylococcus aureus subsp. aureus Mu50
uugugcuuuuccaua

SEQ ID NO: 3975993 - RNA, 21 nt, Staphylococcus aureus subsp. aureus Mu50
uuguggcaccucuuuuguuua

SEQ ID NO: 3975994 - RNA, 23 nt, Staphylococcus aureus subsp. aureus Mu50
uuguggcguaguuugaauuggga

SEQ ID NO: 3975995 - RNA, 19 nt, Staphylococcus aureus subsp. aureus Mu50
uuguguaucuguaacauaa

SEQ ID NO: 3975996 - RNA, 18 nt, Staphylococcus aureus subsp. aureus Mu50
uuguguauuguuuuacuu

SEQ ID NO: 3975997 - RNA, 24 nt, Staphylococcus aureus subsp. aureus Mu50
uuguguauuuuuauuguuuuggcu

SEQ ID NO: 3975998 - RNA, 21 nt, Staphylococcus aureus subsp. aureus Mu50
uuguguguuuuaaaauuauuu

SEQ ID NO: 3975999 - RNA, 13 nt, Staphylococcus aureus subsp. aureus Mu50
uuguguuugcuuu

SEQ ID NO: 3976000 - RNA, 20 nt, Staphylococcus aureus subsp. aureus Mu50
uuguguuuuuaauguuugcu

SEQ ID NO: 3976001 - RNA, 13 nt, Staphylococcus aureus subsp. aureus Mu50
uuguuaaaauaau

SEQ ID NO: 3976002 - RNA, 16 nt, Staphylococcus aureus subsp. aureus Mu50
uuguuaauucaacgga

SEQ ID NO: 3976003 - RNA, 14 nt, Staphylococcus aureus subsp. aureus Mu50
uuguuacauauugc

SEQ ID NO: 3976004 - RNA, 22 nt, Staphylococcus aureus subsp. aureus Mu50
uuguuaccaaacaauacauaau

SEQ ID NO: 3976005 - RNA, 23 nt, Staphylococcus aureus subsp. aureus Mu50
uuguuaccaaacaauacauaaug

SEQ ID NO: 3976006 - RNA, 21 nt, Staphylococcus aureus subsp. aureus Mu50
uuguuacuaguuuguaauaau

SEQ ID NO: 3976007 - RNA, 17 nt, Staphylococcus aureus subsp. aureus Mu50
uuguuaguuuucuuaaa

SEQ ID NO: 3976008 - RNA, 14 nt, Staphylococcus aureus subsp. aureus Mu50
uuguuauaaaggaa

SEQ ID NO: 3976009 - RNA, 19 nt, Staphylococcus aureus subsp. aureus Mu50
uuguuauaaguaaauaaua

SEQ ID NO: 3976010 - RNA, 15 nt, Staphylococcus aureus subsp. aureus Mu50
uuguuauaucuaauu

SEQ ID NO: 3976011 - RNA, 19 nt, Staphylococcus aureus subsp. aureus Mu50
uuguuaucguucaauguua

SEQ ID NO: 3976012 - RNA, 22 nt, Staphylococcus aureus subsp. aureus Mu50
uuguucaacuaaauuuucuaaa

SEQ ID NO: 3976013 - RNA, 21 nt, Staphylococcus aureus subsp. aureus Mu50
uuguucaauaugauccuuuaa

SEQ ID NO: 3976014 - RNA, 20 nt, Staphylococcus aureus subsp. aureus Mu50
uuguucaauucagcaaugag

SEQ ID NO: 3976015 - RNA, 12 nt, Staphylococcus aureus subsp. aureus Mu50
uuguucagauuu

SEQ ID NO: 3976016 - RNA, 19 nt, Staphylococcus aureus subsp. aureus Mu50
uuguucaguuaaaucugua

SEQ ID NO: 3976017 - RNA, 15 nt, Staphylococcus aureus subsp. aureus Mu50
uuguucaugguuuaa

SEQ ID NO: 3976018 - RNA, 22 nt, Staphylococcus aureus subsp. aureus Mu50
uuguucccauuuuuaaaauuau

SEQ ID NO: 3976019 - RNA, 14 nt, Staphylococcus aureus subsp. aureus Mu50
uuguucgauaaucg

SEQ ID NO: 3976020 - RNA, 12 nt, Staphylococcus aureus subsp. aureus Mu50
uuguucggcuuu

SEQ ID NO: 3976021 - RNA, 14 nt, Staphylococcus aureus subsp. aureus Mu50
uuguucuaauuguu

SEQ ID NO: 3976022 - RNA, 21 nt, Staphylococcus aureus subsp. aureus Mu50
uuguucuccgaucaugccuuc

SEQ ID NO: 3976023 - RNA, 18 nt, Staphylococcus aureus subsp. aureus Mu50
uuguucucucaaugcauu

SEQ ID NO: 3976024 - RNA, 12 nt, Staphylococcus aureus subsp. aureus Mu50
uuguucuucaga

SEQ ID NO: 3976025 - RNA, 20 nt, Staphylococcus aureus subsp. aureus Mu50
uuguucuuucuuguucuaaa

SEQ ID NO: 3976026 - RNA, 16 nt, Staphylococcus aureus subsp. aureus Mu50
uuguugaauaauuaau

SEQ ID NO: 3976027 - RNA, 16 nt, Staphylococcus aureus subsp. aureus Mu50
uuguugauaguaaucu

SEQ ID NO: 3976028 - RNA, 15 nt, Staphylococcus aureus subsp. aureus Mu50
uuguuggggcccaca

SEQ ID NO: 3976029 - RNA, 23 nt, Staphylococcus aureus subsp. aureus Mu50
uuguuggggcccacaccccaacu

SEQ ID NO: 3976030 - RNA, 23 nt, Staphylococcus aureus subsp. aureus Mu50
uuguuggucuaucgccuaaaaau

SEQ ID NO: 3976031 - RNA, 14 nt, Staphylococcus aureus subsp. aureus Mu50
uuguugguuuugca

SEQ ID NO: 3976032 - RNA, 17 nt, Staphylococcus aureus subsp. aureus Mu50
uuguuuaaguuuuucag

SEQ ID NO: 3976033 - RNA, 14 nt, Staphylococcus aureus subsp. aureus Mu50
uuguuuaauaacaa

SEQ ID NO: 3976034 - RNA, 17 nt, Staphylococcus aureus subsp. aureus Mu50
uuguuuaccuaaaucuu

SEQ ID NO: 3976035 - RNA, 13 nt, Staphylococcus aureus subsp. aureus Mu50
uuguuuagaaaag

SEQ ID NO: 3976036 - RNA, 19 nt, Staphylococcus aureus subsp. aureus Mu50
uuguuuagaagcuucugca

SEQ ID NO: 3976037 - RNA, 21 nt, Staphylococcus aureus subsp. aureus Mu50
uuguuuagaagcuucugcaug

SEQ ID NO: 3976038 - RNA, 20 nt, Staphylococcus aureus subsp. aureus Mu50
uuguuuaucaauuucucuuu

SEQ ID NO: 3976039 - RNA, 22 nt, Staphylococcus aureus subsp. aureus Mu50
uuguuuauuaggauucaauaau

SEQ ID NO: 3976040 - RNA, 12 nt, Staphylococcus aureus subsp. aureus Mu50
uuguuucaccag

SEQ ID NO: 3976041 - RNA, 20 nt, Staphylococcus aureus subsp. aureus Mu50
uuguuucagcugcaauuuua

SEQ ID NO: 3976042 - RNA, 13 nt, Staphylococcus aureus subsp. aureus Mu50
uuguuucuaaauu

SEQ ID NO: 3976043 - RNA, 12 nt, Staphylococcus aureus subsp. aureus Mu50
uuguuugcuucu

SEQ ID NO: 3976044 - RNA, 14 nt, Staphylococcus aureus subsp. aureus Mu50
uuguuuucaauaau

SEQ ID NO: 3976045 - RNA, 12 nt, Staphylococcus aureus subsp. aureus Mu50
uuguuuucacug

SEQ ID NO: 3976046 - RNA, 16 nt, Staphylococcus aureus subsp. aureus Mu50
uuguuuuccaauaaua

SEQ ID NO: 3976047 - RNA, 23 nt, Staphylococcus aureus subsp. aureus Mu50
uuguuuuccaauaauaaaccuaa

SEQ ID NO: 3976048 - RNA, 19 nt, Staphylococcus aureus subsp. aureus Mu50
uuguuuugacaaauccuaa

SEQ ID NO: 3976049 - RNA, 16 nt, Staphylococcus aureus subsp. aureus Mu50
uuguuuuuaaaaucuc

SEQ ID NO: 3976050 - RNA, 23 nt, Staphylococcus aureus subsp. aureus Mu50
uuuaaaaaacauaccugcauauu

SEQ ID NO: 3976051 - RNA, 16 nt, Staphylococcus aureus subsp. aureus Mu50
uuuaaaaaauuuaaau

SEQ ID NO: 3976052 - RNA, 12 nt, Staphylococcus aureus subsp. aureus Mu50
uuuaaaaauaaa

SEQ ID NO: 3976053 - RNA, 21 nt, Staphylococcus aureus subsp. aureus Mu50
uuuaauauuuagauacugaau

SEQ ID NO: 3976054 - RNA, 15 nt, Staphylococcus aureus subsp. aureus Mu50
uuuaauauuuucuua

SEQ ID NO: 3976055 - RNA, 13 nt, Staphylococcus aureus subsp. aureus Mu50
uuuaaucaaaaaa

SEQ ID NO: 3976056 - RNA, 18 nt, Staphylococcus aureus subsp. aureus Mu50
uuuaaugccggucauaac

SEQ ID NO: 3976057 - RNA, 22 nt, Staphylococcus aureus subsp. aureus Mu50
uuuaaugggcgugccauuaaaa

SEQ ID NO: 3976058 - RNA, 19 nt, Staphylococcus aureus subsp. aureus Mu50
uuuaauguauaaauuaguu

SEQ ID NO: 3976059 - RNA, 16 nt, Staphylococcus aureus subsp. aureus Mu50
uuuaaugucuaaaaau

SEQ ID NO: 3976060 - RNA, 16 nt, Staphylococcus aureus subsp. aureus Mu50
uuuaauguuaaacaau

SEQ ID NO: 3976061 - RNA, 14 nt, Staphylococcus aureus subsp. aureus Mu50
uuuaauguuugcuu

SEQ ID NO: 3976062 - RNA, 13 nt, Staphylococcus aureus subsp. aureus Mu50
uuuaauuaaagca

SEQ ID NO: 3976063 - RNA, 14 nt, Staphylococcus aureus subsp. aureus Mu50
uuuaauuaaaguua

SEQ ID NO: 3976064 - RNA, 18 nt, Staphylococcus aureus subsp. aureus Mu50
uuuaauuaagaaaaucau

SEQ ID NO: 3976065 - RNA, 16 nt, Staphylococcus aureus subsp. aureus Mu50
uuuaauuaauuaucau

SEQ ID NO: 3976066 - RNA, 14 nt, Staphylococcus aureus subsp. aureus Mu50
uuuaauuaauuauu

SEQ ID NO: 3976067 - RNA, 15 nt, Staphylococcus aureus subsp. aureus Mu50
uuuaauuaauuauua

SEQ ID NO: 3976068 - RNA, 17 nt, Staphylococcus aureus subsp. aureus Mu50
uuuaauuagaaauucuc

SEQ ID NO: 3976069 - RNA, 11 nt, Staphylococcus aureus subsp. aureus Mu50
uuuaauuauuu

SEQ ID NO: 3976070 - RNA, 15 nt, Staphylococcus aureus subsp. aureus Mu50
uuuaauuauuucccu

SEQ ID NO: 3976071 - RNA, 16 nt, Staphylococcus aureus subsp. aureus Mu50
uuuaauuauuuucucg

SEQ ID NO: 3976072 - RNA, 17 nt, Staphylococcus aureus subsp. aureus Mu50
uuuaauucaggaaaugc

SEQ ID NO: 3976073 - RNA, 19 nt, Staphylococcus aureus subsp. aureus Mu50
uuuaauucaggaaaugcau

SEQ ID NO: 3976074 - RNA, 22 nt, Staphylococcus aureus subsp. aureus Mu50
uuuaauucugguuuaaugagcu

SEQ ID NO: 3976075 - RNA, 16 nt, Staphylococcus aureus subsp. aureus Mu50
uuuaauugaaauagaa

SEQ ID NO: 3976076 - RNA, 14 nt, Staphylococcus aureus subsp. aureus Mu50
uuuaauugcuguaa

SEQ ID NO: 3976077 - RNA, 16 nt, Staphylococcus aureus subsp. aureus Mu50
uuuaauugguucuucu

SEQ ID NO: 3976078 - RNA, 13 nt, Staphylococcus aureus subsp. aureus Mu50
uuuaauuguuuaa

SEQ ID NO: 3976079 - RNA, 17 nt, Staphylococcus aureus subsp. aureus Mu50
uuuaauuguuuaauaac

SEQ ID NO: 3976080 - RNA, 18 nt, Staphylococcus aureus subsp. aureus Mu50
uuuaauuuaguacucaau

SEQ ID NO: 3976081 - RNA, 20 nt, Staphylococcus aureus subsp. aureus Mu50
uuuaauuugauuaaauucuu

SEQ ID NO: 3976082 - RNA, 12 nt, Staphylococcus aureus subsp. aureus Mu50
uuuaauuuguua

SEQ ID NO: 3976083 - RNA, 15 nt, Staphylococcus aureus subsp. aureus Mu50
uuuaauuuucagaau

SEQ ID NO: 3976084 - RNA, 16 nt, Staphylococcus aureus subsp. aureus Mu50
uuuaauuuucuaaaua

SEQ ID NO: 3976085 - RNA, 17 nt, Staphylococcus aureus subsp. aureus Mu50
uuuaauuuucuaaauau

SEQ ID NO: 3976086 - RNA, 19 nt, Staphylococcus aureus subsp. aureus Mu50
uuuaauuuugacauaaaaa

SEQ ID NO: 3976087 - RNA, 23 nt, Staphylococcus aureus subsp. aureus Mu50
uuuaauuuugacauaaaaaauaa

SEQ ID NO: 3976088 - RNA, 19 nt, Staphylococcus aureus subsp. aureus Mu50
uuuacaaacuucacaucau

SEQ ID NO: 3976089 - RNA, 22 nt, Staphylococcus aureus subsp. aureus Mu50
uuuacaauuaauuacuguaaau

SEQ ID NO: 3976090 - RNA, 18 nt, Staphylococcus aureus subsp. aureus Mu50
uuuacaccuauaccucau

SEQ ID NO: 3976091 - RNA, 18 nt, Staphylococcus aureus subsp. aureus Mu50
uuuacaccuauaccucgu

SEQ ID NO: 3976092 - RNA, 19 nt, Staphylococcus aureus subsp. aureus Mu50
uuuacagaacguucauaua

SEQ ID NO: 3976093 - RNA, 23 nt, Staphylococcus aureus subsp. aureus Mu50
uuuacaggagcgagccauuauua

SEQ ID NO: 3976094 - RNA, 16 nt, Staphylococcus aureus subsp. aureus Mu50
uuuacagucaacugcu

SEQ ID NO: 3976095 - RNA, 23 nt, Staphylococcus aureus subsp. aureus Mu50
uuuacauauuuauacugaucaaa

SEQ ID NO: 3976096 - RNA, 20 nt, Staphylococcus aureus subsp. aureus Mu50
uuuacauggcuuagguuuaa

SEQ ID NO: 3976097 - RNA, 23 nt, Staphylococcus aureus subsp. aureus Mu50
uuuacauggcuuagguuuaauuu

SEQ ID NO: 3976098 - RNA, 16 nt, Staphylococcus aureus subsp. aureus Mu50
uuuacauuaauuuguc

SEQ ID NO: 3976099 - RNA, 15 nt, Staphylococcus aureus subsp. aureus Mu50
uuuacauuucucguu

SEQ ID NO: 3976100 - RNA, 20 nt, Staphylococcus aureus subsp. aureus Mu50
uuuacauuuucaaaaccaau

SEQ ID NO: 3976101 - RNA, 14 nt, Staphylococcus aureus subsp. aureus Mu50
uuuaccacuuauaa

SEQ ID NO: 3976102 - RNA, 20 nt, Staphylococcus aureus subsp. aureus Mu50
uuuaccauguuuuacaaguu

SEQ ID NO: 3976103 - RNA, 17 nt, Staphylococcus aureus subsp. aureus Mu50
uuuaccauugugaauaa

SEQ ID NO: 3976104 - RNA, 20 nt, Staphylococcus aureus subsp. aureus Mu50
uuuaccauugugaauaauuu

SEQ ID NO: 3976105 - RNA, 20 nt, Staphylococcus aureus subsp. aureus Mu50
uuuaccuguuucuuuacuuc

SEQ ID NO: 3976106 - RNA, 22 nt, Staphylococcus aureus subsp. aureus Mu50
uuuaccuucgcauacuuuuuca

SEQ ID NO: 3976107 - RNA, 18 nt, Staphylococcus aureus subsp. aureus Mu50
uuuacgauaaacuaaaaa

SEQ ID NO: 3976108 - RNA, 15 nt, Staphylococcus aureus subsp. aureus Mu50
uuuacgugcauugua

SEQ ID NO: 3976109 - RNA, 13 nt, Staphylococcus aureus subsp. aureus Mu50
uuuacuaaagaua

SEQ ID NO: 3976110 - RNA, 14 nt, Staphylococcus aureus subsp. aureus Mu50
uuuacuaaaugaau

SEQ ID NO: 3976111 - RNA, 23 nt, Staphylococcus aureus subsp. aureus Mu50
uuuacuagaaagcacaccuaauu

SEQ ID NO: 3976112 - RNA, 16 nt, Staphylococcus aureus subsp. aureus Mu50
uuuacucaaaccaucu

SEQ ID NO: 3976113 - RNA, 14 nt, Staphylococcus aureus subsp. aureus Mu50
uuuacucuaaagga

SEQ ID NO: 3976114 - RNA, 18 nt, Staphylococcus aureus subsp. aureus Mu50
uuuacugcuucgacauug

SEQ ID NO: 3976115 - RNA, 12 nt, Staphylococcus aureus subsp. aureus Mu50
uuuacuuaaucu

SEQ ID NO: 3976116 - RNA, 17 nt, Staphylococcus aureus subsp. aureus Mu50
uuuacuuacuuuucuaa

SEQ ID NO: 3976117 - RNA, 13 nt, Staphylococcus aureus subsp. aureus Mu50
uuuacuucauaag

SEQ ID NO: 3976118 - RNA, 17 nt, Staphylococcus aureus subsp. aureus Mu50
uuuacuugaauauagcu

SEQ ID NO: 3976119 - RNA, 21 nt, Staphylococcus aureus subsp. aureus Mu50
uuuacuugcuuuuucaaauaa

SEQ ID NO: 3976120 - RNA, 17 nt, Staphylococcus aureus subsp. aureus Mu50
uuuacuuuuccuugauu

SEQ ID NO: 3976121 - RNA, 14 nt, Staphylococcus aureus subsp. aureus Mu50
uuuagacaauauuu

SEQ ID NO: 3976122 - RNA, 15 nt, Staphylococcus aureus subsp. aureus Mu50
uuuagacaauauuuu

SEQ ID NO: 3976123 - RNA, 12 nt, Staphylococcus aureus subsp. aureus Mu50
uuuagacaucau

SEQ ID NO: 3976124 - RNA, 16 nt, Staphylococcus aureus subsp. aureus Mu50
uuuagaguuuuuauua

SEQ ID NO: 3976125 - RNA, 15 nt, Staphylococcus aureus subsp. aureus Mu50
uuuagauaaaaauua

SEQ ID NO: 3976126 - RNA, 15 nt, Staphylococcus aureus subsp. aureus Mu50
uuuagaugcauaaaa

SEQ ID NO: 3976127 - RNA, 17 nt, Staphylococcus aureus subsp. aureus Mu50
uuuagaugcauaaaaaa

SEQ ID NO: 3976128 - RNA, 21 nt, Staphylococcus aureus subsp. aureus Mu50
uuuagcaacaguauuugccuu

SEQ ID NO: 3976129 - RNA, 20 nt, Staphylococcus aureus subsp. aureus Mu50
uuuagcaccggcaucuugaa

SEQ ID NO: 3976130 - RNA, 12 nt, Staphylococcus aureus subsp. aureus Mu50
uuuagcauugcc

SEQ ID NO: 3976131 - RNA, 13 nt, Staphylococcus aureus subsp. aureus Mu50
uuuagccaaugcu

SEQ ID NO: 3976132 - RNA, 17 nt, Staphylococcus aureus subsp. aureus Mu50
uuuagccccagcaaaua

SEQ ID NO: 3976133 - RNA, 22 nt, Staphylococcus aureus subsp. aureus Mu50
uuuaggaaugaauaaagcuaac

SEQ ID NO: 3976134 - RNA, 23 nt, Staphylococcus aureus subsp. aureus Mu50
uuuaggacgugccuuaacuucau

SEQ ID NO: 3976135 - RNA, 14 nt, Staphylococcus aureus subsp. aureus Mu50
uuuagguaauaauu

SEQ ID NO: 3976136 - RNA, 21 nt, Staphylococcus aureus subsp. aureus Mu50
uuuagguaauacaucaucaag

SEQ ID NO: 3976137 - RNA, 20 nt, Staphylococcus aureus subsp. aureus Mu50
uuuaggugcuuuaaugccgg

SEQ ID NO: 3976138 - RNA, 22 nt, Staphylococcus aureus subsp. aureus Mu50
uuuagguucuucaucuuuuaug

SEQ ID NO: 3976139 - RNA, 21 nt, Staphylococcus aureus subsp. aureus Mu50
uuuagguuuguugcuuauuaa

SEQ ID NO: 3976140 - RNA, 19 nt, Staphylococcus aureus subsp. aureus Mu50
uuuaguacauauguuguuu

SEQ ID NO: 3976141 - RNA, 15 nt, Staphylococcus aureus subsp. aureus Mu50
uuuauuauaaaauag

SEQ ID NO: 3976142 - RNA, 12 nt, Staphylococcus aureus subsp. aureus Mu50
uuuauuaucagc

SEQ ID NO: 3976143 - RNA, 16 nt, Staphylococcus aureus subsp. aureus Mu50
uuuauuaucuuuaauu

SEQ ID NO: 3976144 - RNA, 15 nt, Staphylococcus aureus subsp. aureus Mu50
uuuauucaaaucaua

SEQ ID NO: 3976145 - RNA, 14 nt, Staphylococcus aureus subsp. aureus Mu50
uuuauucacuuuuu

SEQ ID NO: 3976146 - RNA, 15 nt, Staphylococcus aureus subsp. aureus Mu50
uuuauucgcuuguuc

SEQ ID NO: 3976147 - RNA, 14 nt, Staphylococcus aureus subsp. aureus Mu50
uuuauucuucaguu

SEQ ID NO: 3976148 - RNA, 19 nt, Staphylococcus aureus subsp. aureus Mu50
uuuauugaggauaauuauu

SEQ ID NO: 3976149 - RNA, 15 nt, Staphylococcus aureus subsp. aureus Mu50
uuuauugcaauaaca

SEQ ID NO: 3976150 - RNA, 16 nt, Staphylococcus aureus subsp. aureus Mu50
uuuauugccgguuaaa

SEQ ID NO: 3976151 - RNA, 13 nt, Staphylococcus aureus subsp. aureus Mu50
uuuauuuaacacu

SEQ ID NO: 3976152 - RNA, 20 nt, Staphylococcus aureus subsp. aureus Mu50
uuuauuuaacacuucaguua

SEQ ID NO: 3976153 - RNA, 14 nt, Staphylococcus aureus subsp. aureus Mu50
uuuauuuaauuauu

SEQ ID NO: 3976154 - RNA, 12 nt, Staphylococcus aureus subsp. aureus Mu50
uuuauuucuaua

SEQ ID NO: 3976155 - RNA, 16 nt, Staphylococcus aureus subsp. aureus Mu50
uuuauuugucuuugaa

SEQ ID NO: 3976156 - RNA, 16 nt, Staphylococcus aureus subsp. aureus Mu50
uuuauuuuaauauuuu

SEQ ID NO: 3976157 - RNA, 14 nt, Staphylococcus aureus subsp. aureus Mu50
uuuauuuuauaaga

SEQ ID NO: 3976158 - RNA, 21 nt, Staphylococcus aureus subsp. aureus Mu50
uuuauuuucuuuuucuaaaua

SEQ ID NO: 3976159 - RNA, 22 nt, Staphylococcus aureus subsp. aureus Mu50
uuuauuuuuggauucaccaauu

SEQ ID NO: 3976160 - RNA, 11 nt, Staphylococcus aureus subsp. aureus Mu50
uuuauuuuuuu

SEQ ID NO: 3976161 - RNA, 13 nt, Staphylococcus aureus subsp. aureus Mu50
uuucaaacauauu

SEQ ID NO: 3976162 - RNA, 20 nt, Staphylococcus aureus subsp. aureus Mu50
uuucaaacgugauuuuauca

SEQ ID NO: 3976163 - RNA, 23 nt, Staphylococcus aureus subsp. aureus Mu50
uuucaaagcugucaacuugucua

SEQ ID NO: 3976164 - RNA, 14 nt, Staphylococcus aureus subsp. aureus Mu50
uuucaaauaagaau

SEQ ID NO: 3976165 - RNA, 15 nt, Staphylococcus aureus subsp. aureus Mu50
uuucaaauaauauaa

SEQ ID NO: 3976166 - RNA, 20 nt, Staphylococcus aureus subsp. aureus Mu50
uuucaacaaacauaaauaag

SEQ ID NO: 3976167 - RNA, 15 nt, Staphylococcus aureus subsp. aureus Mu50
uuucaacauaauauu

SEQ ID NO: 3976168 - RNA, 15 nt, Staphylococcus aureus subsp. aureus Mu50
uuucaacauauuaua

SEQ ID NO: 3976169 - RNA, 11 nt, Staphylococcus aureus subsp. aureus Mu50
uuucaacauuu

SEQ ID NO: 3976170 - RNA, 15 nt, Staphylococcus aureus subsp. aureus Mu50
uuucaacauuuuuua

SEQ ID NO: 3976171 - RNA, 14 nt, Staphylococcus aureus subsp. aureus Mu50
uuucaagaccaaau

SEQ ID NO: 3976172 - RNA, 23 nt, Staphylococcus aureus subsp. aureus Mu50
uuucaagugcuugguuaaaguua

SEQ ID NO: 3976173 - RNA, 17 nt, Staphylococcus aureus subsp. aureus Mu50
uuucaaguuuaaaauac

SEQ ID NO: 3976174 - RNA, 19 nt, Staphylococcus aureus subsp. aureus Mu50
uuucaaguuuaaaauacga

SEQ ID NO: 3976175 - RNA, 15 nt, Staphylococcus aureus subsp. aureus Mu50
uuucaauaaauuuua

SEQ ID NO: 3976176 - RNA, 22 nt, Staphylococcus aureus subsp. aureus Mu50
uuucaauauguggcgcucuuau

SEQ ID NO: 3976177 - RNA, 17 nt, Staphylococcus aureus subsp. aureus Mu50
uuucaauauuaaaauac

SEQ ID NO: 3976178 - RNA, 16 nt, Staphylococcus aureus subsp. aureus Mu50
uuucaauccuuuguuu

SEQ ID NO: 3976179 - RNA, 17 nt, Staphylococcus aureus subsp. aureus Mu50
uuucaauguaucaagau

SEQ ID NO: 3976180 - RNA, 14 nt, Staphylococcus aureus subsp. aureus Mu50
uuucaauuaaaugu

SEQ ID NO: 3976181 - RNA, 13 nt, Staphylococcus aureus subsp. aureus Mu50
uuucaauucuagu

SEQ ID NO: 3976182 - RNA, 14 nt, Staphylococcus aureus subsp. aureus Mu50
uuucaccuuguaaa

SEQ ID NO: 3976183 - RNA, 21 nt, Staphylococcus aureus subsp. aureus Mu50
uuucacgaauaucuuaaagaa

SEQ ID NO: 3976184 - RNA, 14 nt, Staphylococcus aureus subsp. aureus Mu50
uuucacgauuucuu

SEQ ID NO: 3976185 - RNA, 21 nt, Staphylococcus aureus subsp. aureus Mu50
uuucacgauuuuuaaaaugcu

SEQ ID NO: 3976186 - RNA, 21 nt, Staphylococcus aureus subsp. aureus Mu50
uuucacguagcuuuucauuua

SEQ ID NO: 3976187 - RNA, 22 nt, Staphylococcus aureus subsp. aureus Mu50
uuucacuacgucaagcuuugcu

SEQ ID NO: 3976188 - RNA, 17 nt, Staphylococcus aureus subsp. aureus Mu50
uuucacucauauuacuu

SEQ ID NO: 3976189 - RNA, 17 nt, Staphylococcus aureus subsp. aureus Mu50
uuucacuugaccacuuu

SEQ ID NO: 3976190 - RNA, 21 nt, Staphylococcus aureus subsp. aureus Mu50
uuucaguaauuguuacuaguu

SEQ ID NO: 3976191 - RNA, 14 nt, Staphylococcus aureus subsp. aureus Mu50
uuucaguagaugcu

SEQ ID NO: 3976192 - RNA, 18 nt, Staphylococcus aureus subsp. aureus Mu50
uuucauaauuaauaacau

SEQ ID NO: 3976193 - RNA, 19 nt, Staphylococcus aureus subsp. aureus Mu50
uuucauaauuaauaacauc

SEQ ID NO: 3976194 - RNA, 17 nt, Staphylococcus aureus subsp. aureus Mu50
uuucauaccuugauuau

SEQ ID NO: 3976195 - RNA, 20 nt, Staphylococcus aureus subsp. aureus Mu50
uuucauagaaccauuucuag

SEQ ID NO: 3976196 - RNA, 18 nt, Staphylococcus aureus subsp. aureus Mu50
uuucauagaugcauaaaa

SEQ ID NO: 3976197 - RNA, 22 nt, Staphylococcus aureus subsp. aureus Mu50
uuucauaguuauuaaaucuuuu

SEQ ID NO: 3976198 - RNA, 19 nt, Staphylococcus aureus subsp. aureus Mu50
uuucauaugcaucaacaga

SEQ ID NO: 3976199 - RNA, 20 nt, Staphylococcus aureus subsp. aureus Mu50
uuucauaugcaucaacagau

SEQ ID NO: 3976200 - RNA, 16 nt, Staphylococcus aureus subsp. aureus Mu50
uuucauauggugaacu

SEQ ID NO: 3976201 - RNA, 19 nt, Staphylococcus aureus subsp. aureus Mu50
uuucauauucacaucuuua

SEQ ID NO: 3976202 - RNA, 19 nt, Staphylococcus aureus subsp. aureus Mu50
uuucaucaugugcuuuguu

SEQ ID NO: 3976203 - RNA, 15 nt, Staphylococcus aureus subsp. aureus Mu50
uuucaucauuaaaau

SEQ ID NO: 3976204 - RNA, 19 nt, Staphylococcus aureus subsp. aureus Mu50
uuucaucauuaaaaucaac

SEQ ID NO: 3976205 - RNA, 16 nt, Staphylococcus aureus subsp. aureus Mu50
uuucaucguucauaua

SEQ ID NO: 3976206 - RNA, 13 nt, Staphylococcus aureus subsp. aureus Mu50
uuucaucuuuuau

SEQ ID NO: 3976207 - RNA, 15 nt, Staphylococcus aureus subsp. aureus Mu50
uuucaugaaaaguug

SEQ ID NO: 3976208 - RNA, 20 nt, Staphylococcus aureus subsp. aureus Mu50
uuucaugcacuuuaacauaa

SEQ ID NO: 3976209 - RNA, 22 nt, Staphylococcus aureus subsp. aureus Mu50
uuucaugugucacaaugaccau

SEQ ID NO: 3976210 - RNA, 22 nt, Staphylococcus aureus subsp. aureus Mu50
uuucauguuugauucuaaauaa

SEQ ID NO: 3976211 - RNA, 22 nt, Staphylococcus aureus subsp. aureus Mu50
uuucauuggauagguaacuaaa

SEQ ID NO: 3976212 - RNA, 12 nt, Staphylococcus aureus subsp. aureus Mu50
uuucauuguaaa

SEQ ID NO: 3976213 - RNA, 20 nt, Staphylococcus aureus subsp. aureus Mu50
uuucauuguaacucaauaug

SEQ ID NO: 3976214 - RNA, 14 nt, Staphylococcus aureus subsp. aureus Mu50
uuucauuguaauaa

SEQ ID NO: 3976215 - RNA, 13 nt, Staphylococcus aureus subsp. aureus Mu50
uuucauuuggaaa

SEQ ID NO: 3976216 - RNA, 18 nt, Staphylococcus aureus subsp. aureus Mu50
uuucauuuuuaucccacu

SEQ ID NO: 3976217 - RNA, 18 nt, Staphylococcus aureus subsp. aureus Mu50
uuuccaaauugcaaagua

SEQ ID NO: 3976218 - RNA, 20 nt, Staphylococcus aureus subsp. aureus Mu50
uuuccaaauugcaaaguaac

SEQ ID NO: 3976219 - RNA, 13 nt, Staphylococcus aureus subsp. aureus Mu50
uuuccaauaucuu

SEQ ID NO: 3976220 - RNA, 13 nt, Staphylococcus aureus subsp. aureus Mu50
uuuccaauuuguu

SEQ ID NO: 3976221 - RNA, 16 nt, Staphylococcus aureus subsp. aureus Mu50
uuuccauaaauaaaau

SEQ ID NO: 3976222 - RNA, 20 nt, Staphylococcus aureus subsp. aureus Mu50
uuuccauaaauaaaaugcua

SEQ ID NO: 3976223 - RNA, 22 nt, Staphylococcus aureus subsp. aureus Mu50
uuuccauaaauauuuaaaauau

SEQ ID NO: 3976224 - RNA, 18 nt, Staphylococcus aureus subsp. aureus Mu50
uuuccauuuaucaacaau

SEQ ID NO: 3976225 - RNA, 14 nt, Staphylococcus aureus subsp. aureus Mu50
uuucccauuuaucu

SEQ ID NO: 3976226 - RNA, 17 nt, Staphylococcus aureus subsp. aureus Mu50
uuucccuacugcuugug

SEQ ID NO: 3976227 - RNA, 23 nt, Staphylococcus aureus subsp. aureus Mu50
uuucccuacugcuugugugaaau

SEQ ID NO: 3976228 - RNA, 19 nt, Staphylococcus aureus subsp. aureus Mu50
uuuccucgguuuuauuuuu

SEQ ID NO: 3976229 - RNA, 12 nt, Staphylococcus aureus subsp. aureus Mu50
uuugaaugcaaa

SEQ ID NO: 3976230 - RNA, 17 nt, Staphylococcus aureus subsp. aureus Mu50
uuugaaugcaaaucaaa

SEQ ID NO: 3976231 - RNA, 22 nt, Staphylococcus aureus subsp. aureus Mu50
uuugaaugcaaaucaaauacau

SEQ ID NO: 3976232 - RNA, 12 nt, Staphylococcus aureus subsp. aureus Mu50
uuugaauuggga

SEQ ID NO: 3976233 - RNA, 17 nt, Staphylococcus aureus subsp. aureus Mu50
uuugacaaauccuaauu

SEQ ID NO: 3976234 - RNA, 21 nt, Staphylococcus aureus subsp. aureus Mu50
uuugacaaguugcugaauaaa

SEQ ID NO: 3976235 - RNA, 19 nt, Staphylococcus aureus subsp. aureus Mu50
uuugacacauuauugaaau

SEQ ID NO: 3976236 - RNA, 12 nt, Staphylococcus aureus subsp. aureus Mu50
uuugacauaaaa

SEQ ID NO: 3976237 - RNA, 18 nt, Staphylococcus aureus subsp. aureus Mu50
uuugacauaucgauauuc

SEQ ID NO: 3976238 - RNA, 16 nt, Staphylococcus aureus subsp. aureus Mu50
uuugacaucuauuucu

SEQ ID NO: 3976239 - RNA, 14 nt, Staphylococcus aureus subsp. aureus Mu50
uuugagagauuauu

SEQ ID NO: 3976240 - RNA, 17 nt, Staphylococcus aureus subsp. aureus Mu50
uuugagcauuuuuauau

SEQ ID NO: 3976241 - RNA, 19 nt, Staphylococcus aureus subsp. aureus Mu50
uuugagcggaaauaugauu

SEQ ID NO: 3976242 - RNA, 17 nt, Staphylococcus aureus subsp. aureus Mu50
uuugaguauccaauacu

SEQ ID NO: 3976243 - RNA, 18 nt, Staphylococcus aureus subsp. aureus Mu50
uuugaguauccaauacua

SEQ ID NO: 3976244 - RNA, 23 nt, Staphylococcus aureus subsp. aureus Mu50
uuugaguauuugccuuuuuuauu

SEQ ID NO: 3976245 - RNA, 17 nt, Staphylococcus aureus subsp. aureus Mu50
uuugauaaauaaaauuu

SEQ ID NO: 3976246 - RNA, 14 nt, Staphylococcus aureus subsp. aureus Mu50
uuugauaacaaaac

SEQ ID NO: 3976247 - RNA, 21 nt, Staphylococcus aureus subsp. aureus Mu50
uuugauaacaauuuuaaaucu

SEQ ID NO: 3976248 - RNA, 12 nt, Staphylococcus aureus subsp. aureus Mu50
uuugauaagaaa

SEQ ID NO: 3976249 - RNA, 17 nt, Staphylococcus aureus subsp. aureus Mu50
uuugauaguaauaguua

SEQ ID NO: 3976250 - RNA, 17 nt, Staphylococcus aureus subsp. aureus Mu50
uuugauaucacuauaca

SEQ ID NO: 3976251 - RNA, 13 nt, Staphylococcus aureus subsp. aureus Mu50
uuugauauuucau

SEQ ID NO: 3976252 - RNA, 15 nt, Staphylococcus aureus subsp. aureus Mu50
uuugauccaaaguac

SEQ ID NO: 3976253 - RNA, 11 nt, Staphylococcus aureus subsp. aureus Mu50
uuugaugauuu

SEQ ID NO: 3976254 - RNA, 16 nt, Staphylococcus aureus subsp. aureus Mu50
uuugauguucacuaaa

SEQ ID NO: 3976255 - RNA, 16 nt, Staphylococcus aureus subsp. aureus Mu50
uuugauuauauuuauu

SEQ ID NO: 3976256 - RNA, 16 nt, Staphylococcus aureus subsp. aureus Mu50
uuugauucuaaauaau

SEQ ID NO: 3976257 - RNA, 20 nt, Staphylococcus aureus subsp. aureus Mu50
uuugauuuggguaauguuuu

SEQ ID NO: 3976258 - RNA, 13 nt, Staphylococcus aureus subsp. aureus Mu50
uuugauuuugaau

SEQ ID NO: 3976259 - RNA, 16 nt, Staphylococcus aureus subsp. aureus Mu50
uuugauuuugaauaaa

SEQ ID NO: 3976260 - RNA, 19 nt, Staphylococcus aureus subsp. aureus Mu50
uuugcaaaacgcauuucau

SEQ ID NO: 3976261 - RNA, 19 nt, Staphylococcus aureus subsp. aureus Mu50
uuugcaacauauuuucaca

SEQ ID NO: 3976262 - RNA, 21 nt, Staphylococcus aureus subsp. aureus Mu50
uuugcaacauauuuucacaau

SEQ ID NO: 3976263 - RNA, 14 nt, Staphylococcus aureus subsp. aureus Mu50
uuugcaaucaucug

SEQ ID NO: 3976264 - RNA, 20 nt, Staphylococcus aureus subsp. aureus Mu50
uuugcaauugcaaugaauaa

SEQ ID NO: 3976265 - RNA, 21 nt, Staphylococcus aureus subsp. aureus Mu50
uuugcaauugcaaugaauaac

SEQ ID NO: 3976266 - RNA, 17 nt, Staphylococcus aureus subsp. aureus Mu50
uuugcagauugauauaa

SEQ ID NO: 3976267 - RNA, 14 nt, Staphylococcus aureus subsp. aureus Mu50
uuugcauacauauc

SEQ ID NO: 3976268 - RNA, 16 nt, Staphylococcus aureus subsp. aureus Mu50
uuugcauacauaucuu

SEQ ID NO: 3976269 - RNA, 22 nt, Staphylococcus aureus subsp. aureus Mu50
uuugccccgccauucauaaaug

SEQ ID NO: 3976270 - RNA, 18 nt, Staphylococcus aureus subsp. aureus Mu50
uuugcuaaccaucauaaa

SEQ ID NO: 3976271 - RNA, 19 nt, Staphylococcus aureus subsp. aureus Mu50
uuugcuaaccaucauaaau

SEQ ID NO: 3976272 - RNA, 19 nt, Staphylococcus aureus subsp. aureus Mu50
uuugcucuaaacuucuauu

SEQ ID NO: 3976273 - RNA, 22 nt, Staphylococcus aureus subsp. aureus Mu50
uuugcucuaaacuucuauuaau

SEQ ID NO: 3976274 - RNA, 18 nt, Staphylococcus aureus subsp. aureus Mu50
uuugcuggcgcaaugaua

SEQ ID NO: 3976275 - RNA, 20 nt, Staphylococcus aureus subsp. aureus Mu50
uuugcugguugcuucuuauc

SEQ ID NO: 3976276 - RNA, 17 nt, Staphylococcus aureus subsp. aureus Mu50
uuugcuguccacuauau

SEQ ID NO: 3976277 - RNA, 17 nt, Staphylococcus aureus subsp. aureus Mu50
uuugcuguuuaguuaau

SEQ ID NO: 3976278 - RNA, 12 nt, Staphylococcus aureus subsp. aureus Mu50
uuugcuucuuua

SEQ ID NO: 3976279 - RNA, 21 nt, Staphylococcus aureus subsp. aureus Mu50
uuugcuuuaaaauucucuagu

SEQ ID NO: 3976280 - RNA, 23 nt, Staphylococcus aureus subsp. aureus Mu50
uuugcuuuagcucuuuuuugauu

SEQ ID NO: 3976281 - RNA, 18 nt, Staphylococcus aureus subsp. aureus Mu50
uuugcuuuauuuucuugu

SEQ ID NO: 3976282 - RNA, 15 nt, Staphylococcus aureus subsp. aureus Mu50
uuugcuuuuuauuuu

SEQ ID NO: 3976283 - RNA, 17 nt, Staphylococcus aureus subsp. aureus Mu50
uuuggaaaccguuuaga

SEQ ID NO: 3976284 - RNA, 15 nt, Staphylococcus aureus subsp. aureus Mu50
uuuggaaauuuauua

SEQ ID NO: 3976285 - RNA, 14 nt, Staphylococcus aureus subsp. aureus Mu50
uuuggaugaacaaa

SEQ ID NO: 3976286 - RNA, 15 nt, Staphylococcus aureus subsp. aureus Mu50
uuuggauuucuuuuu

SEQ ID NO: 3976287 - RNA, 24 nt, Staphylococcus aureus subsp. aureus Mu50
uuuggcacauaaaucaauguacua

SEQ ID NO: 3976288 - RNA, 16 nt, Staphylococcus aureus subsp. aureus Mu50
uuuggcgacauaaaua

SEQ ID NO: 3976289 - RNA, 20 nt, Staphylococcus aureus subsp. aureus Mu50
uuuggcuuuuuauaccaaua

SEQ ID NO: 3976290 - RNA, 14 nt, Staphylococcus aureus subsp. aureus Mu50
uuugguacauaaua

SEQ ID NO: 3976291 - RNA, 21 nt, Staphylococcus aureus subsp. aureus Mu50
uuugguggagaaccauuuuau

SEQ ID NO: 3976292 - RNA, 19 nt, Staphylococcus aureus subsp. aureus Mu50
uuugguguuuaacuaaacc

SEQ ID NO: 3976293 - RNA, 21 nt, Staphylococcus aureus subsp. aureus Mu50
uuugguguuuaacuaaaccau

SEQ ID NO: 3976294 - RNA, 15 nt, Staphylococcus aureus subsp. aureus Mu50
uuuguaaccuaaaaa

SEQ ID NO: 3976295 - RNA, 20 nt, Staphylococcus aureus subsp. aureus Mu50
uuuguaagcucaugaaucag

SEQ ID NO: 3976296 - RNA, 19 nt, Staphylococcus aureus subsp. aureus Mu50
uuuguaauacaagcaauac

SEQ ID NO: 3976297 - RNA, 13 nt, Staphylococcus aureus subsp. aureus Mu50
uuuguaauacauc

SEQ ID NO: 3976298 - RNA, 20 nt, Staphylococcus aureus subsp. aureus Mu50
uuuguaaucccauuuuaaag

SEQ ID NO: 3976299 - RNA, 23 nt, Staphylococcus aureus subsp. aureus Mu50
uuuguaaucccauuuuaaaguca

SEQ ID NO: 3976300 - RNA, 15 nt, Staphylococcus aureus subsp. aureus Mu50
uuuguaccaaauaaa

SEQ ID NO: 3976301 - RNA, 21 nt, Staphylococcus aureus subsp. aureus Mu50
uuuguaccaaauaaauuaaau

SEQ ID NO: 3976302 - RNA, 23 nt, Staphylococcus aureus subsp. aureus Mu50
uuuguaccaaauaaauuaaauuu

SEQ ID NO: 3976303 - RNA, 17 nt, Staphylococcus aureus subsp. aureus Mu50
uuuguauaccuauuccu

SEQ ID NO: 3976304 - RNA, 20 nt, Staphylococcus aureus subsp. aureus Mu50
uuuguauauucuuuuuaacu

SEQ ID NO: 3976305 - RNA, 13 nt, Staphylococcus aureus subsp. aureus Mu50
uuuguaugaguuc

SEQ ID NO: 3976306 - RNA, 16 nt, Staphylococcus aureus subsp. aureus Mu50
uuuguaugauaaccau

SEQ ID NO: 3976307 - RNA, 14 nt, Staphylococcus aureus subsp. aureus Mu50
uuuguauuagcauc

SEQ ID NO: 3976308 - RNA, 15 nt, Staphylococcus aureus subsp. aureus Mu50
uuuguauuguuugaa

SEQ ID NO: 3976309 - RNA, 12 nt, Staphylococcus aureus subsp. aureus Mu50
uuuguauuuaug

SEQ ID NO: 3976310 - RNA, 12 nt, Staphylococcus aureus subsp. aureus Mu50
uuugucauaaua

SEQ ID NO: 3976311 - RNA, 13 nt, Staphylococcus aureus subsp. aureus Mu50
uuugucauuucuu

SEQ ID NO: 3976312 - RNA, 13 nt, Staphylococcus aureus subsp. aureus Mu50
uuugucguuacua

SEQ ID NO: 3976313 - RNA, 15 nt, Staphylococcus aureus subsp. aureus Mu50
uuugucucucaacau

SEQ ID NO: 3976314 - RNA, 19 nt, Staphylococcus aureus subsp. aureus Mu50
uuuguggcaccucuuuugu

SEQ ID NO: 3976315 - RNA, 15 nt, Staphylococcus aureus subsp. aureus Mu50
uuuguuacuucuaau

SEQ ID NO: 3976316 - RNA, 16 nt, Staphylococcus aureus subsp. aureus Mu50
uuuguuauaucuaauu

SEQ ID NO: 3976317 - RNA, 21 nt, Staphylococcus aureus subsp. aureus Mu50
uuuuagugacaaacauuuguu

SEQ ID NO: 3976318 - RNA, 23 nt, Staphylococcus aureus subsp. aureus Mu50
uuuuaguuagggaaauguagauu

SEQ ID NO: 3976319 - RNA, 14 nt, Staphylococcus aureus subsp. aureus Mu50
uuuuauaaaugaau

SEQ ID NO: 3976320 - RNA, 14 nt, Staphylococcus aureus subsp. aureus Mu50
uuuuauaaauuuug

SEQ ID NO: 3976321 - RNA, 16 nt, Staphylococcus aureus subsp. aureus Mu50
uuuuauaaguuaaaaa

SEQ ID NO: 3976322 - RNA, 14 nt, Staphylococcus aureus subsp. aureus Mu50
uuuuauaauaaauu

SEQ ID NO: 3976323 - RNA, 17 nt, Staphylococcus aureus subsp. aureus Mu50
uuuuauacauaaauauu

SEQ ID NO: 3976324 - RNA, 16 nt, Staphylococcus aureus subsp. aureus Mu50
uuuuauaguaauagcu

SEQ ID NO: 3976325 - RNA, 22 nt, Staphylococcus aureus subsp. aureus Mu50
uuuuauauucaacuuauuauuu

SEQ ID NO: 3976326 - RNA, 22 nt, Staphylococcus aureus subsp. aureus Mu50
uuuuauauugcgaaaaauaauu

SEQ ID NO: 3976327 - RNA, 17 nt, Staphylococcus aureus subsp. aureus Mu50
uuuuauauuuaaacucu

SEQ ID NO: 3976328 - RNA, 18 nt, Staphylococcus aureus subsp. aureus Mu50
uuuuaucaauauuaguuu

SEQ ID NO: 3976329 - RNA, 19 nt, Staphylococcus aureus subsp. aureus Mu50
uuuuaucaucuauucaacu

SEQ ID NO: 3976330 - RNA, 21 nt, Staphylococcus aureus subsp. aureus Mu50
uuuuaucgaaagguauaucuu

SEQ ID NO: 3976331 - RNA, 21 nt, Staphylococcus aureus subsp. aureus Mu50
uuuuaugaauugaguauuaaa

SEQ ID NO: 3976332 - RNA, 18 nt, Staphylococcus aureus subsp. aureus Mu50
uuuuaugacguaauuaau

SEQ ID NO: 3976333 - RNA, 15 nt, Staphylococcus aureus subsp. aureus Mu50
uuuuaugauuugauu

SEQ ID NO: 3976334 - RNA, 17 nt, Staphylococcus aureus subsp. aureus Mu50
uuuuaugauuuucuuua

SEQ ID NO: 3976335 - RNA, 19 nt, Staphylococcus aureus subsp. aureus Mu50
uuuuaugauuuucuuuaau

SEQ ID NO: 3976336 - RNA, 24 nt, Staphylococcus aureus subsp. aureus Mu50
uuuuaugcauuauagaugacugua

SEQ ID NO: 3976337 - RNA, 15 nt, Staphylococcus aureus subsp. aureus Mu50
uuuuaugcuuuaaau

SEQ ID NO: 3976338 - RNA, 18 nt, Staphylococcus aureus subsp. aureus Mu50
uuuuaugcuuuaaaucga

SEQ ID NO: 3976339 - RNA, 18 nt, Staphylococcus aureus subsp. aureus Mu50
uuuuauggcgguuugaaa

SEQ ID NO: 3976340 - RNA, 16 nt, Staphylococcus aureus subsp. aureus Mu50
uuuuauguauuuauua

SEQ ID NO: 3976341 - RNA, 23 nt, Staphylococcus aureus subsp. aureus Mu50
uuuuaugucaauagcgguuuaaa

SEQ ID NO: 3976342 - RNA, 20 nt, Staphylococcus aureus subsp. aureus Mu50
uuuuaugucuaguucuugag

SEQ ID NO: 3976343 - RNA, 13 nt, Staphylococcus aureus subsp. aureus Mu50
uuuuauguuaaau

SEQ ID NO: 3976344 - RNA, 21 nt, Staphylococcus aureus subsp. aureus Mu50
uuuuauguucagaaauuuaau

SEQ ID NO: 3976345 - RNA, 19 nt, Staphylococcus aureus subsp. aureus Mu50
uuuuauguuuaauuugauu

SEQ ID NO: 3976346 - RNA, 15 nt, Staphylococcus aureus subsp. aureus Mu50
uuuuauguuuuaauu

SEQ ID NO: 3976347 - RNA, 13 nt, Staphylococcus aureus subsp. aureus Mu50
uuuuauuaauuaa

SEQ ID NO: 3976348 - RNA, 19 nt, Staphylococcus aureus subsp. aureus Mu50
uuuuauuacuuauuucuuu

SEQ ID NO: 3976349 - RNA, 17 nt, Staphylococcus aureus subsp. aureus Mu50
uuuuauuagaauauuca

SEQ ID NO: 3976350 - RNA, 22 nt, Staphylococcus aureus subsp. aureus Mu50
uuuuauuauacacuuuuugaca

SEQ ID NO: 3976351 - RNA, 16 nt, Staphylococcus aureus subsp. aureus Mu50
uuuuauuaucuuuaau

SEQ ID NO: 3976352 - RNA, 19 nt, Staphylococcus aureus subsp. aureus Mu50
uuuuauuaucuuuguaaau

SEQ ID NO: 3976353 - RNA, 20 nt, Staphylococcus aureus subsp. aureus Mu50
uuuuauuauugucaucaugu

SEQ ID NO: 3976354 - RNA, 14 nt, Staphylococcus aureus subsp. aureus Mu50
uuuuauucacuuuu

SEQ ID NO: 3976355 - RNA, 21 nt, Staphylococcus aureus subsp. aureus Mu50
uuuuauucacuuuuuuuaauu

SEQ ID NO: 3976356 - RNA, 23 nt, Staphylococcus aureus subsp. aureus Mu50
uuuuauucgauaauauaacugca

SEQ ID NO: 3976357 - RNA, 13 nt, Staphylococcus aureus subsp. aureus Mu50
uuuuauucuaaua

SEQ ID NO: 3976358 - RNA, 16 nt, Staphylococcus aureus subsp. aureus Mu50
uuuuauuguuuuggcu

SEQ ID NO: 3976359 - RNA, 17 nt, Staphylococcus aureus subsp. aureus Mu50
uuuuauuuauacuaaau

SEQ ID NO: 3976360 - RNA, 13 nt, Staphylococcus aureus subsp. aureus Mu50
uuuuauuuauauu

SEQ ID NO: 3976361 - RNA, 18 nt, Staphylococcus aureus subsp. aureus Mu50
uuuuauuugauuauucuu

SEQ ID NO: 3976362 - RNA, 17 nt, Staphylococcus aureus subsp. aureus Mu50
uuuuauuuuaauauuuu

SEQ ID NO: 3976363 - RNA, 20 nt, Staphylococcus aureus subsp. aureus Mu50
uuuuauuuuuuucacuaauu

SEQ ID NO: 3976364 - RNA, 16 nt, Staphylococcus aureus subsp. aureus Mu50
uuuucaaaaauagucg

SEQ ID NO: 3976365 - RNA, 16 nt, Staphylococcus aureus subsp. aureus Mu50
uuuucaaaacugccaa

SEQ ID NO: 3976366 - RNA, 20 nt, Staphylococcus aureus subsp. aureus Mu50
uuuucaaaaucuuuaucagu

SEQ ID NO: 3976367 - RNA, 14 nt, Staphylococcus aureus subsp. aureus Mu50
uuuucaaacauauu

SEQ ID NO: 3976368 - RNA, 20 nt, Staphylococcus aureus subsp. aureus Mu50
uuuucaaacauauucauucu

SEQ ID NO: 3976369 - RNA, 21 nt, Staphylococcus aureus subsp. aureus Mu50
uuuucaaacauauucauucua

SEQ ID NO: 3976370 - RNA, 14 nt, Staphylococcus aureus subsp. aureus Mu50
uuuucaaaugaaaa

SEQ ID NO: 3976371 - RNA, 12 nt, Staphylococcus aureus subsp. aureus Mu50
uuuucaacugua

SEQ ID NO: 3976372 - RNA, 19 nt, Staphylococcus aureus subsp. aureus Mu50
uuuucaaguuuaaaauacg

SEQ ID NO: 3976373 - RNA, 15 nt, Staphylococcus aureus subsp. aureus Mu50
uuuucaauaaauuuu

SEQ ID NO: 3976374 - RNA, 22 nt, Staphylococcus aureus subsp. aureus Mu50
uuuucacgaauaucuuaaagaa

SEQ ID NO: 3976375 - RNA, 15 nt, Staphylococcus aureus subsp. aureus Mu50
uuuucacuaauauuu

SEQ ID NO: 3976376 - RNA, 18 nt, Staphylococcus aureus subsp. aureus Mu50
uuuucacuguuuuaucua

SEQ ID NO: 3976377 - RNA, 11 nt, Staphylococcus aureus subsp. aureus Mu50
uuuucacuuca

SEQ ID NO: 3976378 - RNA, 15 nt, Staphylococcus aureus subsp. aureus Mu50
uuuucagaaucagaa

SEQ ID NO: 3976379 - RNA, 19 nt, Staphylococcus aureus subsp. aureus Mu50
uuuucagcaguugcacaaa

SEQ ID NO: 3976380 - RNA, 13 nt, Staphylococcus aureus subsp. aureus Mu50
uuuucauaauuaa

SEQ ID NO: 3976381 - RNA, 14 nt, Staphylococcus aureus subsp. aureus Mu50
uuuucauaauuaau

SEQ ID NO: 3976382 - RNA, 21 nt, Staphylococcus aureus subsp. aureus Mu50
uuuucauagaacaaaauguag

SEQ ID NO: 3976383 - RNA, 16 nt, Staphylococcus aureus subsp. aureus Mu50
uuuucauauacuuaac

SEQ ID NO: 3976384 - RNA, 12 nt, Staphylococcus aureus subsp. aureus Mu50
uuuucaucauua

SEQ ID NO: 3976385 - RNA, 15 nt, Staphylococcus aureus subsp. aureus Mu50
uuuucaugaaaaguu

SEQ ID NO: 3976386 - RNA, 13 nt, Staphylococcus aureus subsp. aureus Mu50
uuuucauuauuaa

SEQ ID NO: 3976387 - RNA, 16 nt, Staphylococcus aureus subsp. aureus Mu50
uuuucauuguaauaau

SEQ ID NO: 3976388 - RNA, 21 nt, Staphylococcus aureus subsp. aureus Mu50
uuuucauuuaacauguauuua

SEQ ID NO: 3976389 - RNA, 14 nt, Staphylococcus aureus subsp. aureus Mu50
uuuucauuucuuug

SEQ ID NO: 3976390 - RNA, 15 nt, Staphylococcus aureus subsp. aureus Mu50
uuuucauuucuuugu

SEQ ID NO: 3976391 - RNA, 13 nt, Staphylococcus aureus subsp. aureus Mu50
uuuuccaauaaua

SEQ ID NO: 3976392 - RNA, 13 nt, Staphylococcus aureus subsp. aureus Mu50
uuuuccauaaaua

SEQ ID NO: 3976393 - RNA, 19 nt, Staphylococcus aureus subsp. aureus Mu50
uuuuccauucauaaaagca

SEQ ID NO: 3976394 - RNA, 19 nt, Staphylococcus aureus subsp. aureus Mu50
uuuuccuaaaccucuaaau

SEQ ID NO: 3976395 - RNA, 18 nt, Staphylococcus aureus subsp. aureus Mu50
uuuucgaacuuuuguucu

SEQ ID NO: 3976396 - RNA, 18 nt, Staphylococcus aureus subsp. aureus Mu50
uuuucguauaauuuuaau

SEQ ID NO: 3976397 - RNA, 14 nt, Staphylococcus aureus subsp. aureus Mu50
uuuucuaaacaacu

SEQ ID NO: 3976398 - RNA, 12 nt, Staphylococcus aureus subsp. aureus Mu50
uuuucuaaauga

SEQ ID NO: 3976399 - RNA, 14 nt, Staphylococcus aureus subsp. aureus Mu50
uuuucuaauuguuu

SEQ ID NO: 3976400 - RNA, 16 nt, Staphylococcus aureus subsp. aureus Mu50
uuuucuagcuauaucc

SEQ ID NO: 3976401 - RNA, 17 nt, Staphylococcus aureus subsp. aureus Mu50
uuuucuagguaauacga

SEQ ID NO: 3976402 - RNA, 13 nt, Staphylococcus aureus subsp. aureus Mu50
uuuucuauggcac

SEQ ID NO: 3976403 - RNA, 14 nt, Staphylococcus aureus subsp. aureus Mu50
uuuucuauggcaca

SEQ ID NO: 3976404 - RNA, 13 nt, Staphylococcus aureus subsp. aureus Mu50
uuuucuauucaaa

SEQ ID NO: 3976405 - RNA, 23 nt, Staphylococcus aureus subsp. aureus Mu50
uuuuuaucgaaagguauaucuuc

SEQ ID NO: 3976406 - RNA, 18 nt, Staphylococcus aureus subsp. aureus Mu50
uuuuuauguuaaaucgau

SEQ ID NO: 3976407 - RNA, 13 nt, Staphylococcus aureus subsp. aureus Mu50
uuuuuauuaugaa

SEQ ID NO: 3976408 - RNA, 10 nt, Staphylococcus aureus subsp. aureus Mu50
uuuuuauuua

SEQ ID NO: 3976409 - RNA, 15 nt, Staphylococcus aureus subsp. aureus Mu50
uuuuuauuuuacuua

SEQ ID NO: 3976410 - RNA, 13 nt, Staphylococcus aureus subsp. aureus Mu50
uuuuucaaauaau

SEQ ID NO: 3976411 - RNA, 17 nt, Staphylococcus aureus subsp. aureus Mu50
uuuuucaaauaauauaa

SEQ ID NO: 3976412 - RNA, 14 nt, Staphylococcus aureus subsp. aureus Mu50
uuuuucaaugucua

SEQ ID NO: 3976413 - RNA, 14 nt, Staphylococcus aureus subsp. aureus Mu50
uuuuucaauucgcu

SEQ ID NO: 3976414 - RNA, 22 nt, Staphylococcus aureus subsp. aureus Mu50
uuuuucagcuguccgauuuuuu

SEQ ID NO: 3976415 - RNA, 19 nt, Staphylococcus aureus subsp. aureus Mu50
uuuuucauaauuaauaaca

SEQ ID NO: 3976416 - RNA, 20 nt, Staphylococcus aureus subsp. aureus Mu50
uuuuucauaauuaauaacau

SEQ ID NO: 3976417 - RNA, 19 nt, Staphylococcus aureus subsp. aureus Mu50
uuuuucaugauuuacuaau

SEQ ID NO: 3976418 - RNA, 17 nt, Staphylococcus aureus subsp. aureus Mu50
uuuuucgaaguggcaaa

SEQ ID NO: 3976419 - RNA, 21 nt, Staphylococcus aureus subsp. aureus Mu50
uuuuucgagaugauauuacau

SEQ ID NO: 3976420 - RNA, 15 nt, Staphylococcus aureus subsp. aureus Mu50
uuuuucguaacauuu

SEQ ID NO: 3976421 - RNA, 13 nt, Staphylococcus aureus subsp. aureus Mu50
uuuuucguuguuc

SEQ ID NO: 3976422 - RNA, 22 nt, Staphylococcus aureus subsp. aureus Mu50
uuuuucuaaaugauuuauucua

SEQ ID NO: 3976423 - RNA, 22 nt, Staphylococcus aureus subsp. aureus Mu50
uuuuucucaaugugagauauaa

SEQ ID NO: 3976424 - RNA, 12 nt, Staphylococcus aureus subsp. aureus Mu50
uuuuucuuucau

SEQ ID NO: 3976425 - RNA, 17 nt, Staphylococcus aureus subsp. aureus Mu50
uuuuucuuuuguuuuca

SEQ ID NO: 3976426 - RNA, 17 nt, Staphylococcus aureus subsp. aureus Mu50
uuuuugacauauuuuuu

SEQ ID NO: 3976427 - RNA, 19 nt, Staphylococcus aureus subsp. aureus Mu50
uuuuugacucagaaucuua

SEQ ID NO: 3976428 - RNA, 22 nt, Staphylococcus aureus subsp. aureus Mu50
uuuuugaguauccaauacuacu

SEQ ID NO: 3976429 - RNA, 20 nt, Staphylococcus aureus subsp. aureus Mu50
uuuuugcguuuuuaaauaau

SEQ ID NO: 3976430 - RNA, 19 nt, Staphylococcus aureus subsp. aureus Mu50
uuuuuggagcguaaaguuu

SEQ ID NO: 3976431 - RNA, 15 nt, Staphylococcus aureus subsp. aureus Mu50
uuuuuggcuuaucaa

SEQ ID NO: 3976432 - RNA, 21 nt, Staphylococcus aureus subsp. aureus Mu50
uuuuuguaaacaugguuuucu

SEQ ID NO: 3976433 - RNA, 15 nt, Staphylococcus aureus subsp. aureus Mu50
uuuuuguaauacauc

SEQ ID NO: 3976434 - RNA, 13 nt, Staphylococcus aureus subsp. aureus Mu50
uuuuuguauuuau

SEQ ID NO: 3976435 - RNA, 21 nt, Staphylococcus aureus subsp. aureus Mu50
uuuuuguccccagcccuuuuc

SEQ ID NO: 3976436 - RNA, 18 nt, Staphylococcus aureus subsp. aureus Mu50
uuuuuguugcaauugccu

SEQ ID NO: 3976437 - RNA, 22 nt, Staphylococcus aureus subsp. aureus Mu50
uuuuuguuuucaaaugaaaaua

SEQ ID NO: 3976438 - RNA, 14 nt, Staphylococcus aureus subsp. aureus Mu50
uuuuuuaaauacau

SEQ ID NO: 3976439 - RNA, 11 nt, Staphylococcus aureus subsp. aureus Mu50
uuuuuuaauuu

SEQ ID NO: 3976440 - RNA, 15 nt, Staphylococcus aureus subsp. aureus Mu50
uuuuuuaauuugauu

SEQ ID NO: 3976441 - RNA, 21 nt, Staphylococcus aureus subsp. aureus Mu50
uuuuuuauauguuauauuaaa

SEQ ID NO: 3976442 - RNA, 21 nt, Staphylococcus aureus subsp. aureus Mu50
uuuuuuaugcacaaaaaaauc

SEQ ID NO: 3976443 - RNA, 14 nt, Staphylococcus aureus subsp. aureus Mu50
uuuuuuauucuaau

SEQ ID NO: 3976444 - RNA, 14 nt, Staphylococcus aureus subsp. aureus Mu50
uuuuuuauuugucu

SEQ ID NO: 3976445 - RNA, 11 nt, Staphylococcus aureus subsp. aureus Mu50
uuuuuuauuuu

SEQ ID NO: 3976446 - RNA, 19 nt, Staphylococcus aureus subsp. aureus Mu50
uuuuuucaauucuagucag

SEQ ID NO: 3976447 - RNA, 15 nt, Staphylococcus aureus subsp. aureus Mu50
uuuuuucauuucuuu

SEQ ID NO: 3976448 - RNA, 13 nt, Staphylococcus aureus subsp. aureus Mu50
uuuuuuccuuucu

SEQ ID NO: 3976449 - RNA, 12 nt, Staphylococcus aureus subsp. aureus Mu50
aaaaaaaucucc

SEQ ID NO: 3976450 - RNA, 12 nt, Staphylococcus aureus subsp. aureus Mu50
aaaaaacaauag

SEQ ID NO: 3976451 - RNA, 14 nt, Staphylococcus aureus subsp. aureus Mu50
aaaaaacaguguag

SEQ ID NO: 3976452 - RNA, 17 nt, Staphylococcus aureus subsp. aureus Mu50
aaaacaaagguuuguaa

SEQ ID NO: 3976453 - RNA, 13 nt, Staphylococcus aureus subsp. aureus Mu50
aaaacaaauuaca

SEQ ID NO: 3976454 - RNA, 17 nt, Staphylococcus aureus subsp. aureus Mu50
aaaacaauaaaauuacu

SEQ ID NO: 3976455 - RNA, 13 nt, Staphylococcus aureus subsp. aureus Mu50
aaaacaauaauuu

SEQ ID NO: 3976456 - RNA, 22 nt, Staphylococcus aureus subsp. aureus Mu50
aaaacaauauugacuuuuacag

SEQ ID NO: 3976457 - RNA, 12 nt, Staphylococcus aureus subsp. aureus Mu50
aaaacaaugccc

SEQ ID NO: 3976458 - RNA, 22 nt, Staphylococcus aureus subsp. aureus Mu50
aaaacagaggucuucgcaauca

SEQ ID NO: 3976459 - RNA, 15 nt, Staphylococcus aureus subsp. aureus Mu50
aaaacagcaaauaaa

SEQ ID NO: 3976460 - RNA, 18 nt, Staphylococcus aureus subsp. aureus Mu50
aaaacagguggaaguguu

SEQ ID NO: 3976461 - RNA, 19 nt, Staphylococcus aureus subsp. aureus Mu50
aaaacaguguagcacaaga

SEQ ID NO: 3976462 - RNA, 17 nt, Staphylococcus aureus subsp. aureus Mu50
aaaacauaaauacaaaa

SEQ ID NO: 3976463 - RNA, 12 nt, Staphylococcus aureus subsp. aureus Mu50
aaaacauaccug

SEQ ID NO: 3976464 - RNA, 12 nt, Staphylococcus aureus subsp. aureus Mu50
aaaacaucauuc

SEQ ID NO: 3976465 - RNA, 13 nt, Staphylococcus aureus subsp. aureus Mu50
aaaacaucauuca

SEQ ID NO: 3976466 - RNA, 15 nt, Staphylococcus aureus subsp. aureus Mu50
aaaacaucuacauca

SEQ ID NO: 3976467 - RNA, 20 nt, Staphylococcus aureus subsp. aureus Mu50
aaaacauucccuuaauaaua

SEQ ID NO: 3976468 - RNA, 13 nt, Staphylococcus aureus subsp. aureus Mu50
aaaacauuuugug

SEQ ID NO: 3976469 - RNA, 21 nt, Staphylococcus aureus subsp. aureus Mu50
aaaaccgaacaucugaaaaaa

SEQ ID NO: 3976470 - RNA, 20 nt, Staphylococcus aureus subsp. aureus Mu50
aaaaccgagaaucuccauuu

SEQ ID NO: 3976471 - RNA, 18 nt, Staphylococcus aureus subsp. aureus Mu50
aaaaccgaggaaauccuu

SEQ ID NO: 3976472 - RNA, 22 nt, Staphylococcus aureus subsp. aureus Mu50
aaaaccgcuauaaaauuuugaa

SEQ ID NO: 3976473 - RNA, 17 nt, Staphylococcus aureus subsp. aureus Mu50
aaaaccguaauuuuaau

SEQ ID NO: 3976474 - RNA, 20 nt, Staphylococcus aureus subsp. aureus Mu50
aaaaccuauuccuaauaaau

SEQ ID NO: 3976475 - RNA, 21 nt, Staphylococcus aureus subsp. aureus Mu50
aaaaccuauuccuaauaaaua

SEQ ID NO: 3976476 - RNA, 13 nt, Staphylococcus aureus subsp. aureus Mu50
aaaaccucuuuuu

SEQ ID NO: 3976477 - RNA, 18 nt, Staphylococcus aureus subsp. aureus Mu50
aaaaccugggacauuaau

SEQ ID NO: 3976478 - RNA, 19 nt, Staphylococcus aureus subsp. aureus Mu50
aaaaccuuuucaaauuaua

SEQ ID NO: 3976479 - RNA, 21 nt, Staphylococcus aureus subsp. aureus Mu50
aaaaccuuuucaaauuauaac

SEQ ID NO: 3976480 - RNA, 19 nt, Staphylococcus aureus subsp. aureus Mu50
aaaacgaagucagucaauu

SEQ ID NO: 3976481 - RNA, 22 nt, Staphylococcus aureus subsp. aureus Mu50
aaaacgacucauuauaaaugaa

SEQ ID NO: 3976482 - RNA, 14 nt, Staphylococcus aureus subsp. aureus Mu50
aaaacgagauuaca

SEQ ID NO: 3976483 - RNA, 16 nt, Staphylococcus aureus subsp. aureus Mu50
aaaacgauaagaauua

SEQ ID NO: 3976484 - RNA, 13 nt, Staphylococcus aureus subsp. aureus Mu50
aaaacgauaauaa

SEQ ID NO: 3976485 - RNA, 16 nt, Staphylococcus aureus subsp. aureus Mu50
aaaacgugacauuuuc

SEQ ID NO: 3976486 - RNA, 16 nt, Staphylococcus aureus subsp. aureus Mu50
aaaacgugcaaauaaa

SEQ ID NO: 3976487 - RNA, 12 nt, Staphylococcus aureus subsp. aureus Mu50
aaaacguuuaau

SEQ ID NO: 3976488 - RNA, 14 nt, Staphylococcus aureus subsp. aureus Mu50
aaaacuaaagggac

SEQ ID NO: 3976489 - RNA, 19 nt, Staphylococcus aureus subsp. aureus Mu50
aaaacuaaagguauucuau

SEQ ID NO: 3976490 - RNA, 14 nt, Staphylococcus aureus subsp. aureus Mu50
aaaacuaaucaaau

SEQ ID NO: 3976491 - RNA, 12 nt, Staphylococcus aureus subsp. aureus Mu50
aaaacuauaaua

SEQ ID NO: 3976492 - RNA, 18 nt, Staphylococcus aureus subsp. aureus Mu50
aaaacuauuuuaaaaaug

SEQ ID NO: 3976493 - RNA, 16 nt, Staphylococcus aureus subsp. aureus Mu50
aaaacucuaaaaguug

SEQ ID NO: 3976494 - RNA, 18 nt, Staphylococcus aureus subsp. aureus Mu50
aaaacuguaaaucaucau

SEQ ID NO: 3976495 - RNA, 23 nt, Staphylococcus aureus subsp. aureus Mu50
aaaacuuccugcuuuuuuuauaa

SEQ ID NO: 3976496 - RNA, 13 nt, Staphylococcus aureus subsp. aureus Mu50
aaaacuucuuaac

SEQ ID NO: 3976497 - RNA, 22 nt, Staphylococcus aureus subsp. aureus Mu50
aaaacuugugauauauaaccau

SEQ ID NO: 3976498 - RNA, 18 nt, Staphylococcus aureus subsp. aureus Mu50
aaaacuuguuguuauuua

SEQ ID NO: 3976499 - RNA, 12 nt, Staphylococcus aureus subsp. aureus Mu50
aaaacuuuucau

SEQ ID NO: 3976500 - RNA, 16 nt, Staphylococcus aureus subsp. aureus Mu50
aaaagaaauucuacag

SEQ ID NO: 3976501 - RNA, 20 nt, Staphylococcus aureus subsp. aureus Mu50
aaaagaacuacgcauuuuaa

SEQ ID NO: 3976502 - RNA, 14 nt, Staphylococcus aureus subsp. aureus Mu50
aaaagacagaaauu

SEQ ID NO: 3976503 - RNA, 16 nt, Staphylococcus aureus subsp. aureus Mu50
aaaagacagcaguagg

SEQ ID NO: 3976504 - RNA, 23 nt, Staphylococcus aureus subsp. aureus Mu50
aaaagacagcaguaggauaauuu

SEQ ID NO: 3976505 - RNA, 19 nt, Staphylococcus aureus subsp. aureus Mu50
aaaagacaugagauuauuu

SEQ ID NO: 3976506 - RNA, 22 nt, Staphylococcus aureus subsp. aureus Mu50
aaaagagaaacaaaacaaaaaa

SEQ ID NO: 3976507 - RNA, 14 nt, Staphylococcus aureus subsp. aureus Mu50
aaaagagaauuuua

SEQ ID NO: 3976508 - RNA, 19 nt, Staphylococcus aureus subsp. aureus Mu50
aaaagaggcgccacaacau

SEQ ID NO: 3976509 - RNA, 16 nt, Staphylococcus aureus subsp. aureus Mu50
aaaagauaaauaaaag

SEQ ID NO: 3976510 - RNA, 17 nt, Staphylococcus aureus subsp. aureus Mu50
aaaagauauaaacauuu

SEQ ID NO: 3976511 - RNA, 21 nt, Staphylococcus aureus subsp. aureus Mu50
aaaagaugguuuuguuuugcu

SEQ ID NO: 3976512 - RNA, 21 nt, Staphylococcus aureus subsp. aureus Mu50
aaaagauguugcucgugcauu

SEQ ID NO: 3976513 - RNA, 15 nt, Staphylococcus aureus subsp. aureus Mu50
aaaagauuagaugau

SEQ ID NO: 3976514 - RNA, 16 nt, Staphylococcus aureus subsp. aureus Mu50
aaaagcagcaguaaga

SEQ ID NO: 3976515 - RNA, 17 nt, Staphylococcus aureus subsp. aureus Mu50
aaaagcaggcaagcuau

SEQ ID NO: 3976516 - RNA, 19 nt, Staphylococcus aureus subsp. aureus Mu50
aaaagcagucgaacaauga

SEQ ID NO: 3976517 - RNA, 22 nt, Staphylococcus aureus subsp. aureus Mu50
aaaagccucuaaugauuaaaaa

SEQ ID NO: 3976518 - RNA, 23 nt, Staphylococcus aureus subsp. aureus Mu50
aaaagccucuaaugauuaaaaau

SEQ ID NO: 3976519 - RNA, 14 nt, Staphylococcus aureus subsp. aureus Mu50
aaaagcuaaagagu

SEQ ID NO: 3976520 - RNA, 18 nt, Staphylococcus aureus subsp. aureus Mu50
aaaagcugauuucuauca

SEQ ID NO: 3976521 - RNA, 18 nt, Staphylococcus aureus subsp. aureus Mu50
aaaagcuguaguuucaac

SEQ ID NO: 3976522 - RNA, 20 nt, Staphylococcus aureus subsp. aureus Mu50
aaaaggaaaaacuuuucaug

SEQ ID NO: 3976523 - RNA, 19 nt, Staphylococcus aureus subsp. aureus Mu50
aaaaggcgaaacauuaaaa

SEQ ID NO: 3976524 - RNA, 22 nt, Staphylococcus aureus subsp. aureus Mu50
aaaagguuguuuuucaucauua

SEQ ID NO: 3976525 - RNA, 15 nt, Staphylococcus aureus subsp. aureus Mu50
aaaaguaaguaaaau

SEQ ID NO: 3976526 - RNA, 22 nt, Staphylococcus aureus subsp. aureus Mu50
aaaaguacuuuaaaauuguaua

SEQ ID NO: 3976527 - RNA, 14 nt, Staphylococcus aureus subsp. aureus Mu50
aaaaguauuacuuu

SEQ ID NO: 3976528 - RNA, 23 nt, Staphylococcus aureus subsp. aureus Mu50
aaaaguauugccguuauuuucaa

SEQ ID NO: 3976529 - RNA, 19 nt, Staphylococcus aureus subsp. aureus Mu50
aaaagucccgcuuaaaaug

SEQ ID NO: 3976530 - RNA, 16 nt, Staphylococcus aureus subsp. aureus Mu50
aaaagucgauaaauau

SEQ ID NO: 3976531 - RNA, 20 nt, Staphylococcus aureus subsp. aureus Mu50
aaaagugcauauuuaauaca

SEQ ID NO: 3976532 - RNA, 15 nt, Staphylococcus aureus subsp. aureus Mu50
aaaaguguaauguuc

SEQ ID NO: 3976533 - RNA, 20 nt, Staphylococcus aureus subsp. aureus Mu50
aaaaguuaggcgacuuaacu

SEQ ID NO: 3976534 - RNA, 18 nt, Staphylococcus aureus subsp. aureus Mu50
aaaaguuauauaaauuug

SEQ ID NO: 3976535 - RNA, 18 nt, Staphylococcus aureus subsp. aureus Mu50
aaaaguuaucugcuuuuc

SEQ ID NO: 3976536 - RNA, 21 nt, Staphylococcus aureus subsp. aureus Mu50
aaaaguugauuaaaaguguug

SEQ ID NO: 3976537 - RNA, 16 nt, Staphylococcus aureus subsp. aureus Mu50
aaaaguuguaauuuaa

SEQ ID NO: 3976538 - RNA, 17 nt, Staphylococcus aureus subsp. aureus Mu50
aaaaguuguaauuuaaa

SEQ ID NO: 3976539 - RNA, 13 nt, Staphylococcus aureus subsp. aureus Mu50
aaaaugcucaagu

SEQ ID NO: 3976540 - RNA, 17 nt, Staphylococcus aureus subsp. aureus Mu50
aaaaugcuuuuuugaaa

SEQ ID NO: 3976541 - RNA, 17 nt, Staphylococcus aureus subsp. aureus Mu50
aaaauggcaucuggcaa

SEQ ID NO: 3976542 - RNA, 18 nt, Staphylococcus aureus subsp. aureus Mu50
aaaauggcgaaaaagcua

SEQ ID NO: 3976543 - RNA, 23 nt, Staphylococcus aureus subsp. aureus Mu50
aaaauggugauccgccuugauuu

SEQ ID NO: 3976544 - RNA, 15 nt, Staphylococcus aureus subsp. aureus Mu50
aaaaugguuaaaauc

SEQ ID NO: 3976545 - RNA, 22 nt, Staphylococcus aureus subsp. aureus Mu50
aaaauguaggcgccauaaucau

SEQ ID NO: 3976546 - RNA, 15 nt, Staphylococcus aureus subsp. aureus Mu50
aaaaugucauuugaa

SEQ ID NO: 3976547 - RNA, 17 nt, Staphylococcus aureus subsp. aureus Mu50
aaaaugucuuugaaaaa

SEQ ID NO: 3976548 - RNA, 12 nt, Staphylococcus aureus subsp. aureus Mu50
aaaauguuaaua

SEQ ID NO: 3976549 - RNA, 14 nt, Staphylococcus aureus subsp. aureus Mu50
aaaauguuaauaau

SEQ ID NO: 3976550 - RNA, 15 nt, Staphylococcus aureus subsp. aureus Mu50
aaaauguuacacaaa

SEQ ID NO: 3976551 - RNA, 19 nt, Staphylococcus aureus subsp. aureus Mu50
aaaauguuacacaaauuaa

SEQ ID NO: 3976552 - RNA, 24 nt, Staphylococcus aureus subsp. aureus Mu50
aaaauguuaggugaaaccauacua

SEQ ID NO: 3976553 - RNA, 14 nt, Staphylococcus aureus subsp. aureus Mu50
aaaauguuuaacaa

SEQ ID NO: 3976554 - RNA, 13 nt, Staphylococcus aureus subsp. aureus Mu50
aaaauuaaaaaac

SEQ ID NO: 3976555 - RNA, 13 nt, Staphylococcus aureus subsp. aureus Mu50
aaaauuaaaaugu

SEQ ID NO: 3976556 - RNA, 22 nt, Staphylococcus aureus subsp. aureus Mu50
aaaauuaaauaaugauaaauua

SEQ ID NO: 3976557 - RNA, 15 nt, Staphylococcus aureus subsp. aureus Mu50
aaaauuaacuuaaaa

SEQ ID NO: 3976558 - RNA, 13 nt, Staphylococcus aureus subsp. aureus Mu50
aaaauuaauaauu

SEQ ID NO: 3976559 - RNA, 21 nt, Staphylococcus aureus subsp. aureus Mu50
aaaauuagacguguaaauguu

SEQ ID NO: 3976560 - RNA, 15 nt, Staphylococcus aureus subsp. aureus Mu50
aaaauuauguaaaaa

SEQ ID NO: 3976561 - RNA, 16 nt, Staphylococcus aureus subsp. aureus Mu50
aaaauuauguaaaaaa

SEQ ID NO: 3976562 - RNA, 21 nt, Staphylococcus aureus subsp. aureus Mu50
aaaauuauugaauuugaauaa

SEQ ID NO: 3976563 - RNA, 22 nt, Staphylococcus aureus subsp. aureus Mu50
aaaauuauuuggcucuauauca

SEQ ID NO: 3976564 - RNA, 14 nt, Staphylococcus aureus subsp. aureus Mu50
aaaauucaauauua

SEQ ID NO: 3976565 - RNA, 19 nt, Staphylococcus aureus subsp. aureus Mu50
aaaauucaauauuaaucau

SEQ ID NO: 3976566 - RNA, 21 nt, Staphylococcus aureus subsp. aureus Mu50
aaaauuccuagcuuuuauguc

SEQ ID NO: 3976567 - RNA, 20 nt, Staphylococcus aureus subsp. aureus Mu50
aaaauucgcuuguaacaagc

SEQ ID NO: 3976568 - RNA, 18 nt, Staphylococcus aureus subsp. aureus Mu50
aaaauucuauaauuuuaa

SEQ ID NO: 3976569 - RNA, 19 nt, Staphylococcus aureus subsp. aureus Mu50
aaaauugcuaaaaaaauua

SEQ ID NO: 3976570 - RNA, 15 nt, Staphylococcus aureus subsp. aureus Mu50
aaaauugcuauauua

SEQ ID NO: 3976571 - RNA, 21 nt, Staphylococcus aureus subsp. aureus Mu50
aaaauugguuuggauaaaaug

SEQ ID NO: 3976572 - RNA, 23 nt, Staphylococcus aureus subsp. aureus Mu50
aaaauugguuuggauaaaaugau

SEQ ID NO: 3976573 - RNA, 16 nt, Staphylococcus aureus subsp. aureus Mu50
aaaauuguauagaaug

SEQ ID NO: 3976574 - RNA, 23 nt, Staphylococcus aureus subsp. aureus Mu50
aaaauuuaaauaauaauucauaa

SEQ ID NO: 3976575 - RNA, 16 nt, Staphylococcus aureus subsp. aureus Mu50
aaaauuuauucaaaau

SEQ ID NO: 3976576 - RNA, 19 nt, Staphylococcus aureus subsp. aureus Mu50
aaaauuuauucaaaauuca

SEQ ID NO: 3976577 - RNA, 18 nt, Staphylococcus aureus subsp. aureus Mu50
aaaauuuauucaaaucau

SEQ ID NO: 3976578 - RNA, 19 nt, Staphylococcus aureus subsp. aureus Mu50
aaaauuuuaauuaauuauu

SEQ ID NO: 3976579 - RNA, 22 nt, Staphylococcus aureus subsp. aureus Mu50
aaaauuuuaauuaauuauuaua

SEQ ID NO: 3976580 - RNA, 18 nt, Staphylococcus aureus subsp. aureus Mu50
aaaauuuucguguuaaua

SEQ ID NO: 3976581 - RNA, 14 nt, Staphylococcus aureus subsp. aureus Mu50
aaaauuuugaagaa

SEQ ID NO: 3976582 - RNA, 17 nt, Staphylococcus aureus subsp. aureus Mu50
aaaauuuuuaaaaaaau

SEQ ID NO: 3976583 - RNA, 19 nt, Staphylococcus aureus subsp. aureus Mu50
aaaauuuuuaaaaaaauaa

SEQ ID NO: 3976584 - RNA, 15 nt, Staphylococcus aureus subsp. aureus Mu50
aaacaaaaaacuucc

SEQ ID NO: 3976585 - RNA, 13 nt, Staphylococcus aureus subsp. aureus Mu50
aaacaaaaaauau

SEQ ID NO: 3976586 - RNA, 17 nt, Staphylococcus aureus subsp. aureus Mu50
aaacaaaaaauaucuuu

SEQ ID NO: 3976587 - RNA, 21 nt, Staphylococcus aureus subsp. aureus Mu50
aaacaaaaaauaucuuuuugu

SEQ ID NO: 3976588 - RNA, 12 nt, Staphylococcus aureus subsp. aureus Mu50
aaacaaaaaggu

SEQ ID NO: 3976589 - RNA, 20 nt, Staphylococcus aureus subsp. aureus Mu50
aaacaaaaaucuacuaagug

SEQ ID NO: 3976590 - RNA, 19 nt, Staphylococcus aureus subsp. aureus Mu50
aaacaaagguuuguaagac

SEQ ID NO: 3976591 - RNA, 14 nt, Staphylococcus aureus subsp. aureus Mu50
aaacaaauaaaugu

SEQ ID NO: 3976592 - RNA, 16 nt, Staphylococcus aureus subsp. aureus Mu50
aaacaaaucuuuuaaa

SEQ ID NO: 3976593 - RNA, 22 nt, Staphylococcus aureus subsp. aureus Mu50
aaacaaaucuuuuaaauuuagu

SEQ ID NO: 3976594 - RNA, 19 nt, Staphylococcus aureus subsp. aureus Mu50
aaacaaauuaguuugauau

SEQ ID NO: 3976595 - RNA, 21 nt, Staphylococcus aureus subsp. aureus Mu50
aaacaacaaucaaauuacaaa

SEQ ID NO: 3976596 - RNA, 12 nt, Staphylococcus aureus subsp. aureus Mu50
aaacaacaucac

SEQ ID NO: 3976597 - RNA, 15 nt, Staphylococcus aureus subsp. aureus Mu50
aaacaacugagucaa

SEQ ID NO: 3976598 - RNA, 15 nt, Staphylococcus aureus subsp. aureus Mu50
aaacaagccuuaaaa

SEQ ID NO: 3976599 - RNA, 13 nt, Staphylococcus aureus subsp. aureus Mu50
aaacaauaaaaaa

SEQ ID NO: 3976600 - RNA, 23 nt, Staphylococcus aureus subsp. aureus Mu50
aaacaauacguuuucggauugaa

SEQ ID NO: 3976601 - RNA, 16 nt, Staphylococcus aureus subsp. aureus Mu50
aaacaaucguugaaga

SEQ ID NO: 3976602 - RNA, 17 nt, Staphylococcus aureus subsp. aureus Mu50
aaacaaucguugaagau

SEQ ID NO: 3976603 - RNA, 17 nt, Staphylococcus aureus subsp. aureus Mu50
aaacaaugauuaaaauu

SEQ ID NO: 3976604 - RNA, 13 nt, Staphylococcus aureus subsp. aureus Mu50
aaacaaugcaagu

SEQ ID NO: 3976605 - RNA, 15 nt, Staphylococcus aureus subsp. aureus Mu50
aaacaauuuguaacu

SEQ ID NO: 3976606 - RNA, 22 nt, Staphylococcus aureus subsp. aureus Mu50
aaacaauuuguaacuauugaaa

SEQ ID NO: 3976607 - RNA, 15 nt, Staphylococcus aureus subsp. aureus Mu50
aaacacaaauaaagg

SEQ ID NO: 3976608 - RNA, 15 nt, Staphylococcus aureus subsp. aureus Mu50
aaacacaaggaauau

SEQ ID NO: 3976609 - RNA, 19 nt, Staphylococcus aureus subsp. aureus Mu50
aaacacagacguuuuugaa

SEQ ID NO: 3976610 - RNA, 18 nt, Staphylococcus aureus subsp. aureus Mu50
aaacacaguacaaauaac

SEQ ID NO: 3976611 - RNA, 22 nt, Staphylococcus aureus subsp. aureus Mu50
aaacacaguacaaauaacaaac

SEQ ID NO: 3976612 - RNA, 18 nt, Staphylococcus aureus subsp. aureus Mu50
aaacacccugcuuaucau

SEQ ID NO: 3976613 - RNA, 12 nt, Staphylococcus aureus subsp. aureus Mu50
aaacacuauaaa

SEQ ID NO: 3976614 - RNA, 22 nt, Staphylococcus aureus subsp. aureus Mu50
aaacagaaauugcgaauuguua

SEQ ID NO: 3976615 - RNA, 14 nt, Staphylococcus aureus subsp. aureus Mu50
aaacagcaaauaaa

SEQ ID NO: 3976616 - RNA, 16 nt, Staphylococcus aureus subsp. aureus Mu50
aaacagcaguaagaua

SEQ ID NO: 3976617 - RNA, 17 nt, Staphylococcus aureus subsp. aureus Mu50
aaacagcaguaagauau

SEQ ID NO: 3976618 - RNA, 19 nt, Staphylococcus aureus subsp. aureus Mu50
aaacagcaguaagauuauu

SEQ ID NO: 3976619 - RNA, 13 nt, Staphylococcus aureus subsp. aureus Mu50
aaacaguguagca

SEQ ID NO: 3976620 - RNA, 18 nt, Staphylococcus aureus subsp. aureus Mu50
aaacauaaauaagcagua

SEQ ID NO: 3976621 - RNA, 20 nt, Staphylococcus aureus subsp. aureus Mu50
aaacauaaauacaaaaauau

SEQ ID NO: 3976622 - RNA, 15 nt, Staphylococcus aureus subsp. aureus Mu50
aaacauaaugacauc

SEQ ID NO: 3976623 - RNA, 17 nt, Staphylococcus aureus subsp. aureus Mu50
aaacauaaugacaucau

SEQ ID NO: 3976624 - RNA, 21 nt, Staphylococcus aureus subsp. aureus Mu50
aaacauaauuaccuuuccauu

SEQ ID NO: 3976625 - RNA, 22 nt, Staphylococcus aureus subsp. aureus Mu50
aaacauaauuaccuuuccauuc

SEQ ID NO: 3976626 - RNA, 18 nt, Staphylococcus aureus subsp. aureus Mu50
aaacuucuauuaauaauu

SEQ ID NO: 3976627 - RNA, 19 nt, Staphylococcus aureus subsp. aureus Mu50
aaacuucuauuaauaauuu

SEQ ID NO: 3976628 - RNA, 22 nt, Staphylococcus aureus subsp. aureus Mu50
aaacuucuuguuucaaacaaag

SEQ ID NO: 3976629 - RNA, 10 nt, Staphylococcus aureus subsp. aureus Mu50
aaacuucuuu

SEQ ID NO: 3976630 - RNA, 14 nt, Staphylococcus aureus subsp. aureus Mu50
aaacuucuuuucuu

SEQ ID NO: 3976631 - RNA, 19 nt, Staphylococcus aureus subsp. aureus Mu50
aaacuugagcuauucauag

SEQ ID NO: 3976632 - RNA, 19 nt, Staphylococcus aureus subsp. aureus Mu50
aaacuuuaauuaauguuca

SEQ ID NO: 3976633 - RNA, 21 nt, Staphylococcus aureus subsp. aureus Mu50
aaagaaccacgcaucauguau

SEQ ID NO: 3976634 - RNA, 22 nt, Staphylococcus aureus subsp. aureus Mu50
aaagaacgucgcgaaaacguug

SEQ ID NO: 3976635 - RNA, 22 nt, Staphylococcus aureus subsp. aureus Mu50
aaagaacuaacauaauuuuuau

SEQ ID NO: 3976636 - RNA, 15 nt, Staphylococcus aureus subsp. aureus Mu50
aaagaacuauuuuaa

SEQ ID NO: 3976637 - RNA, 18 nt, Staphylococcus aureus subsp. aureus Mu50
aaagaagcucccauuaau

SEQ ID NO: 3976638 - RNA, 18 nt, Staphylococcus aureus subsp. aureus Mu50
aaagaaggggagaguuaa

SEQ ID NO: 3976639 - RNA, 22 nt, Staphylococcus aureus subsp. aureus Mu50
aaagaaggggagaguuaauccu

SEQ ID NO: 3976640 - RNA, 13 nt, Staphylococcus aureus subsp. aureus Mu50
aaagaauaaaugu

SEQ ID NO: 3976641 - RNA, 20 nt, Staphylococcus aureus subsp. aureus Mu50
aaagaauuucgaaaagaaau

SEQ ID NO: 3976642 - RNA, 21 nt, Staphylococcus aureus subsp. aureus Mu50
aaagaauuucgaaaagaaauu

SEQ ID NO: 3976643 - RNA, 19 nt, Staphylococcus aureus subsp. aureus Mu50
aaagacaccaucaacgcca

SEQ ID NO: 3976644 - RNA, 12 nt, Staphylococcus aureus subsp. aureus Mu50
aaagacagaaau

SEQ ID NO: 3976645 - RNA, 18 nt, Staphylococcus aureus subsp. aureus Mu50
aaagacguuuuuuuauaa

SEQ ID NO: 3976646 - RNA, 19 nt, Staphylococcus aureus subsp. aureus Mu50
aaagacuacaagucauuau

SEQ ID NO: 3976647 - RNA, 19 nt, Staphylococcus aureus subsp. aureus Mu50
aaagacuagccauaccuua

SEQ ID NO: 3976648 - RNA, 20 nt, Staphylococcus aureus subsp. aureus Mu50
aaagacucaauuucauuuga

SEQ ID NO: 3976649 - RNA, 19 nt, Staphylococcus aureus subsp. aureus Mu50
aaagacugacuaauaaaac

SEQ ID NO: 3976650 - RNA, 21 nt, Staphylococcus aureus subsp. aureus Mu50
aaagacuuuccaccauaugug

SEQ ID NO: 3976651 - RNA, 22 nt, Staphylococcus aureus subsp. aureus Mu50
aaagagaugggcuaagguuguu

SEQ ID NO: 3976652 - RNA, 13 nt, Staphylococcus aureus subsp. aureus Mu50
aaagagcguguua

SEQ ID NO: 3976653 - RNA, 15 nt, Staphylococcus aureus subsp. aureus Mu50
aaagaggcuuuaaaa

SEQ ID NO: 3976654 - RNA, 16 nt, Staphylococcus aureus subsp. aureus Mu50
aaagagguacuagaau

SEQ ID NO: 3976655 - RNA, 16 nt, Staphylococcus aureus subsp. aureus Mu50
aaagauaaacaagcca

SEQ ID NO: 3976656 - RNA, 18 nt, Staphylococcus aureus subsp. aureus Mu50
aaagauaagaagagccag

SEQ ID NO: 3976657 - RNA, 12 nt, Staphylococcus aureus subsp. aureus Mu50
aaagauauaaac

SEQ ID NO: 3976658 - RNA, 13 nt, Staphylococcus aureus subsp. aureus Mu50
aaagauauacuua

SEQ ID NO: 3976659 - RNA, 14 nt, Staphylococcus aureus subsp. aureus Mu50
aaagauauagaauu

SEQ ID NO: 3976660 - RNA, 15 nt, Staphylococcus aureus subsp. aureus Mu50
aaagauauagaauuc

SEQ ID NO: 3976661 - RNA, 16 nt, Staphylococcus aureus subsp. aureus Mu50
aaagauauagaauuca

SEQ ID NO: 3976662 - RNA, 13 nt, Staphylococcus aureus subsp. aureus Mu50
aaagaucauuaaa

SEQ ID NO: 3976663 - RNA, 14 nt, Staphylococcus aureus subsp. aureus Mu50
aaagaucauuaaaa

SEQ ID NO: 3976664 - RNA, 16 nt, Staphylococcus aureus subsp. aureus Mu50
aaagaugggauuucac

SEQ ID NO: 3976665 - RNA, 23 nt, Staphylococcus aureus subsp. aureus Mu50
aaagaugguuuuguuuugcucuu

SEQ ID NO: 3976666 - RNA, 12 nt, Staphylococcus aureus subsp. aureus Mu50
aaagaugucgaa

SEQ ID NO: 3976667 - RNA, 18 nt, Staphylococcus aureus subsp. aureus Mu50
aaagaugucgaaaaguau

SEQ ID NO: 3976668 - RNA, 23 nt, Staphylococcus aureus subsp. aureus Mu50
aaagaugucgaaaaguauaugaa

SEQ ID NO: 3976669 - RNA, 12 nt, Staphylococcus aureus subsp. aureus Mu50
aaagauuaaaau

SEQ ID NO: 3976670 - RNA, 19 nt, Staphylococcus aureus subsp. aureus Mu50
aaagauuagaugauauuua

SEQ ID NO: 3976671 - RNA, 17 nt, Staphylococcus aureus subsp. aureus Mu50
aaagauuuacccauuac

SEQ ID NO: 3976672 - RNA, 19 nt, Staphylococcus aureus subsp. aureus Mu50
aaagauuucaguucaucau

SEQ ID NO: 3976673 - RNA, 15 nt, Staphylococcus aureus subsp. aureus Mu50
aaagcaaaggcgcac

SEQ ID NO: 3976674 - RNA, 19 nt, Staphylococcus aureus subsp. aureus Mu50
aaagcaaauuauauagaaa

SEQ ID NO: 3976675 - RNA, 21 nt, Staphylococcus aureus subsp. aureus Mu50
aaagcacccuaauuuguuagu

SEQ ID NO: 3976676 - RNA, 22 nt, Staphylococcus aureus subsp. aureus Mu50
aaagcacuagccguuauuuuuu

SEQ ID NO: 3976677 - RNA, 19 nt, Staphylococcus aureus subsp. aureus Mu50
aaagcaucuucaauauuua

SEQ ID NO: 3976678 - RNA, 21 nt, Staphylococcus aureus subsp. aureus Mu50
aaagcaucuucaauauuuaaa

SEQ ID NO: 3976679 - RNA, 15 nt, Staphylococcus aureus subsp. aureus Mu50
aaagccaauuaauaa

SEQ ID NO: 3976680 - RNA, 18 nt, Staphylococcus aureus subsp. aureus Mu50
aaagccaccuaaaucucc

SEQ ID NO: 3976681 - RNA, 22 nt, Staphylococcus aureus subsp. aureus Mu50
aaagcccuauuguuuuuuauaa

SEQ ID NO: 3976682 - RNA, 16 nt, Staphylococcus aureus subsp. aureus Mu50
aaagccuucuaucucu

SEQ ID NO: 3976683 - RNA, 14 nt, Staphylococcus aureus subsp. aureus Mu50
aaagcgaauuaucu

SEQ ID NO: 3976684 - RNA, 17 nt, Staphylococcus aureus subsp. aureus Mu50
aaagcgaauuaucuuua

SEQ ID NO: 3976685 - RNA, 18 nt, Staphylococcus aureus subsp. aureus Mu50
aaagcguucaauuuuugu

SEQ ID NO: 3976686 - RNA, 13 nt, Staphylococcus aureus subsp. aureus Mu50
aaagcuaauuuuu

SEQ ID NO: 3976687 - RNA, 18 nt, Staphylococcus aureus subsp. aureus Mu50
aaagcuauaaaaaaucuu

SEQ ID NO: 3976688 - RNA, 23 nt, Staphylococcus aureus subsp. aureus Mu50
aaagcuauaaaaaaucuuuugau

SEQ ID NO: 3976689 - RNA, 19 nt, Staphylococcus aureus subsp. aureus Mu50
aaagcucggcacaccauuu

SEQ ID NO: 3976690 - RNA, 15 nt, Staphylococcus aureus subsp. aureus Mu50
aaagcugauuuuuca

SEQ ID NO: 3976691 - RNA, 15 nt, Staphylococcus aureus subsp. aureus Mu50
aaagcugucaacuug

SEQ ID NO: 3976692 - RNA, 16 nt, Staphylococcus aureus subsp. aureus Mu50
aaagcuguuuauuggu

SEQ ID NO: 3976693 - RNA, 20 nt, Staphylococcus aureus subsp. aureus Mu50
aaagcuucgucaaugacuaa

SEQ ID NO: 3976694 - RNA, 14 nt, Staphylococcus aureus subsp. aureus Mu50
aaagcuugauuuaa

SEQ ID NO: 3976695 - RNA, 18 nt, Staphylococcus aureus subsp. aureus Mu50
aaagcuugauuuaacaac

SEQ ID NO: 3976696 - RNA, 21 nt, Staphylococcus aureus subsp. aureus Mu50
aaagcuugauuuaacaaccuc

SEQ ID NO: 3976697 - RNA, 17 nt, Staphylococcus aureus subsp. aureus Mu50
aaagcuuuaguuaaaua

SEQ ID NO: 3976698 - RNA, 23 nt, Staphylococcus aureus subsp. aureus Mu50
aaaggaugaugugaauguuuugu

SEQ ID NO: 3976699 - RNA, 19 nt, Staphylococcus aureus subsp. aureus Mu50
aaaggauggauacuuaaag

SEQ ID NO: 3976700 - RNA, 22 nt, Staphylococcus aureus subsp. aureus Mu50
aaaggauuauuaacuuuaauau

SEQ ID NO: 3976701 - RNA, 17 nt, Staphylococcus aureus subsp. aureus Mu50
aaaggcgaaacauuaaa

SEQ ID NO: 3976702 - RNA, 20 nt, Staphylococcus aureus subsp. aureus Mu50
aaaggcgucuuaaauuaggg

SEQ ID NO: 3976703 - RNA, 15 nt, Staphylococcus aureus subsp. aureus Mu50
aaaggcucauuuguu

SEQ ID NO: 3976704 - RNA, 15 nt, Staphylococcus aureus subsp. aureus Mu50
aaagggaauggauua

SEQ ID NO: 3976705 - RNA, 14 nt, Staphylococcus aureus subsp. aureus Mu50
aaagggcaaaaaag

SEQ ID NO: 3976706 - RNA, 18 nt, Staphylococcus aureus subsp. aureus Mu50
aaagggcgaaauggauuc

SEQ ID NO: 3976707 - RNA, 18 nt, Staphylococcus aureus subsp. aureus Mu50
aaagguaacuuuuuaacu

SEQ ID NO: 3976708 - RNA, 22 nt, Staphylococcus aureus subsp. aureus Mu50
aaagguauaucuucauuuaaaa

SEQ ID NO: 3976709 - RNA, 16 nt, Staphylococcus aureus subsp. aureus Mu50
aaaggucaaaaaauua

SEQ ID NO: 3976710 - RNA, 15 nt, Staphylococcus aureus subsp. aureus Mu50
aaaggucccauuaaa

SEQ ID NO: 3976711 - RNA, 17 nt, Staphylococcus aureus subsp. aureus Mu50
aaaggucccauuaaaau

SEQ ID NO: 3976712 - RNA, 18 nt, Staphylococcus aureus subsp. aureus Mu50
aaaggucuauguacaaua

SEQ ID NO: 3976713 - RNA, 15 nt, Staphylococcus aureus subsp. aureus Mu50
aaauaaauuaaauuu

SEQ ID NO: 3976714 - RNA, 21 nt, Staphylococcus aureus subsp. aureus Mu50
aaauaaauuuugcgaaaauau

SEQ ID NO: 3976715 - RNA, 16 nt, Staphylococcus aureus subsp. aureus Mu50
aaauaacaauagugac

SEQ ID NO: 3976716 - RNA, 20 nt, Staphylococcus aureus subsp. aureus Mu50
aaauaaccgcacuuucuauu

SEQ ID NO: 3976717 - RNA, 19 nt, Staphylococcus aureus subsp. aureus Mu50
aaauaacguuaauauaauu

SEQ ID NO: 3976718 - RNA, 21 nt, Staphylococcus aureus subsp. aureus Mu50
aaauaacguuaauauaauuaa

SEQ ID NO: 3976719 - RNA, 14 nt, Staphylococcus aureus subsp. aureus Mu50
aaauaacuucguuu

SEQ ID NO: 3976720 - RNA, 17 nt, Staphylococcus aureus subsp. aureus Mu50
aaauaacuucguuuuaa

SEQ ID NO: 3976721 - RNA, 20 nt, Staphylococcus aureus subsp. aureus Mu50
aaauaacuuuuuaaaggacc

SEQ ID NO: 3976722 - RNA, 17 nt, Staphylococcus aureus subsp. aureus Mu50
aaauaagauauauaaua

SEQ ID NO: 3976723 - RNA, 18 nt, Staphylococcus aureus subsp. aureus Mu50
aaauaagcaaucauaaua

SEQ ID NO: 3976724 - RNA, 18 nt, Staphylococcus aureus subsp. aureus Mu50
aaauaagcaucacauaug

SEQ ID NO: 3976725 - RNA, 18 nt, Staphylococcus aureus subsp. aureus Mu50
aaauaagcuuguaacaag

SEQ ID NO: 3976726 - RNA, 19 nt, Staphylococcus aureus subsp. aureus Mu50
aaauaaguuaaugugcauu

SEQ ID NO: 3976727 - RNA, 22 nt, Staphylococcus aureus subsp. aureus Mu50
aaauaauaaguugaauauaaaa

SEQ ID NO: 3976728 - RNA, 17 nt, Staphylococcus aureus subsp. aureus Mu50
aaauaauacuacauaua

SEQ ID NO: 3976729 - RNA, 13 nt, Staphylococcus aureus subsp. aureus Mu50
aaauaauauaaaa

SEQ ID NO: 3976730 - RNA, 14 nt, Staphylococcus aureus subsp. aureus Mu50
aaauaauauaaaaa

SEQ ID NO: 3976731 - RNA, 16 nt, Staphylococcus aureus subsp. aureus Mu50
aaauaauauaaaacga

SEQ ID NO: 3976732 - RNA, 22 nt, Staphylococcus aureus subsp. aureus Mu50
aaauaauaugaauuuagaugca

SEQ ID NO: 3976733 - RNA, 13 nt, Staphylococcus aureus subsp. aureus Mu50
aaauaaucgaaga

SEQ ID NO: 3976734 - RNA, 15 nt, Staphylococcus aureus subsp. aureus Mu50
aaauaaucucuucaa

SEQ ID NO: 3976735 - RNA, 16 nt, Staphylococcus aureus subsp. aureus Mu50
aaauaaucucuucaau

SEQ ID NO: 3976736 - RNA, 11 nt, Staphylococcus aureus subsp. aureus Mu50
aaauaaugaau

SEQ ID NO: 3976737 - RNA, 20 nt, Staphylococcus aureus subsp. aureus Mu50
aaauaaugucuuacuuuuaa

SEQ ID NO: 3976738 - RNA, 19 nt, Staphylococcus aureus subsp. aureus Mu50
aaauaauuaugaaaaguaa

SEQ ID NO: 3976739 - RNA, 14 nt, Staphylococcus aureus subsp. aureus Mu50
aaauaauuuacauu

SEQ ID NO: 3976740 - RNA, 16 nt, Staphylococcus aureus subsp. aureus Mu50
aaauacaaaaauauag

SEQ ID NO: 3976741 - RNA, 15 nt, Staphylococcus aureus subsp. aureus Mu50
aaauacaaacccuuu

SEQ ID NO: 3976742 - RNA, 18 nt, Staphylococcus aureus subsp. aureus Mu50
aaauacaaacccuuuaaa

SEQ ID NO: 3976743 - RNA, 21 nt, Staphylococcus aureus subsp. aureus Mu50
aaauacaaacccuuuaaacau

SEQ ID NO: 3976744 - RNA, 19 nt, Staphylococcus aureus subsp. aureus Mu50
aaauacaaagccuuaauau

SEQ ID NO: 3976745 - RNA, 12 nt, Staphylococcus aureus subsp. aureus Mu50
aaauacaaauau

SEQ ID NO: 3976746 - RNA, 14 nt, Staphylococcus aureus subsp. aureus Mu50
aaauacaaauauau

SEQ ID NO: 3976747 - RNA, 14 nt, Staphylococcus aureus subsp. aureus Mu50
aaauacaaauuaca

SEQ ID NO: 3976748 - RNA, 16 nt, Staphylococcus aureus subsp. aureus Mu50
aaauacaacucccuuu

SEQ ID NO: 3976749 - RNA, 16 nt, Staphylococcus aureus subsp. aureus Mu50
aaauacaucaauuucu

SEQ ID NO: 3976750 - RNA, 17 nt, Staphylococcus aureus subsp. aureus Mu50
aaauacaucaauuucua

SEQ ID NO: 3976751 - RNA, 16 nt, Staphylococcus aureus subsp. aureus Mu50
aaauacaucggaauuc

SEQ ID NO: 3976752 - RNA, 20 nt, Staphylococcus aureus subsp. aureus Mu50
aaauacaugugggauaucuu

SEQ ID NO: 3976753 - RNA, 22 nt, Staphylococcus aureus subsp. aureus Mu50
aaauacaugugggauaucuucu

SEQ ID NO: 3976754 - RNA, 17 nt, Staphylococcus aureus subsp. aureus Mu50
aaauaccgucuucucua

SEQ ID NO: 3976755 - RNA, 18 nt, Staphylococcus aureus subsp. aureus Mu50
aaauaccuaccacaauaa

SEQ ID NO: 3976756 - RNA, 15 nt, Staphylococcus aureus subsp. aureus Mu50
aaauaccucuacauu

SEQ ID NO: 3976757 - RNA, 20 nt, Staphylococcus aureus subsp. aureus Mu50
aaauaccucuacauuauauu

SEQ ID NO: 3976758 - RNA, 19 nt, Staphylococcus aureus subsp. aureus Mu50
aaauacgacaccaacauau

SEQ ID NO: 3976759 - RNA, 16 nt, Staphylococcus aureus subsp. aureus Mu50
aaauacgguacagaua

SEQ ID NO: 3976760 - RNA, 13 nt, Staphylococcus aureus subsp. aureus Mu50
aaauacguuuaau

SEQ ID NO: 3976761 - RNA, 15 nt, Staphylococcus aureus subsp. aureus Mu50
aaauacuauacugau

SEQ ID NO: 3976762 - RNA, 20 nt, Staphylococcus aureus subsp. aureus Mu50
aaauacuauacugaugaaaa

SEQ ID NO: 3976763 - RNA, 16 nt, Staphylococcus aureus subsp. aureus Mu50
aaauacuauucuuucu

SEQ ID NO: 3976764 - RNA, 17 nt, Staphylococcus aureus subsp. aureus Mu50
aaauacuugaauuuaau

SEQ ID NO: 3976765 - RNA, 21 nt, Staphylococcus aureus subsp. aureus Mu50
aaauacuugaauuuaauaagu

SEQ ID NO: 3976766 - RNA, 22 nt, Staphylococcus aureus subsp. aureus Mu50
aaauacuuguuuaccuaaaucu

SEQ ID NO: 3976767 - RNA, 16 nt, Staphylococcus aureus subsp. aureus Mu50
aaauagaaaaauuuca

SEQ ID NO: 3976768 - RNA, 14 nt, Staphylococcus aureus subsp. aureus Mu50
aaauagaaagaaau

SEQ ID NO: 3976769 - RNA, 22 nt, Staphylococcus aureus subsp. aureus Mu50
aaauagacaccaaaaaacagag

SEQ ID NO: 3976770 - RNA, 20 nt, Staphylococcus aureus subsp. aureus Mu50
aaauagacugccaauaaaau

SEQ ID NO: 3976771 - RNA, 14 nt, Staphylococcus aureus subsp. aureus Mu50
aaauagauugaaaa

SEQ ID NO: 3976772 - RNA, 14 nt, Staphylococcus aureus subsp. aureus Mu50
aaauagauuuagaa

SEQ ID NO: 3976773 - RNA, 17 nt, Staphylococcus aureus subsp. aureus Mu50
aaauagccauauucaua

SEQ ID NO: 3976774 - RNA, 20 nt, Staphylococcus aureus subsp. aureus Mu50
aaauagccauauucauauua

SEQ ID NO: 3976775 - RNA, 16 nt, Staphylococcus aureus subsp. aureus Mu50
aaauagcguaauuauu

SEQ ID NO: 3976776 - RNA, 16 nt, Staphylococcus aureus subsp. aureus Mu50
aaauagcuauuaaaau

SEQ ID NO: 3976777 - RNA, 16 nt, Staphylococcus aureus subsp. aureus Mu50
aaauagcuguuugaua

SEQ ID NO: 3976778 - RNA, 22 nt, Staphylococcus aureus subsp. aureus Mu50
aaauagcuucuuaaaucaacau

SEQ ID NO: 3976779 - RNA, 16 nt, Staphylococcus aureus subsp. aureus Mu50
aaauaggcauaaugaa

SEQ ID NO: 3976780 - RNA, 18 nt, Staphylococcus aureus subsp. aureus Mu50
aaauaggcgcuuguaaaa

SEQ ID NO: 3976781 - RNA, 18 nt, Staphylococcus aureus subsp. aureus Mu50
aaauagucggggccccaa

SEQ ID NO: 3976782 - RNA, 17 nt, Staphylococcus aureus subsp. aureus Mu50
aaauaguucaaaauacu

SEQ ID NO: 3976783 - RNA, 20 nt, Staphylococcus aureus subsp. aureus Mu50
aaauaguucaaauggacuaa

SEQ ID NO: 3976784 - RNA, 23 nt, Staphylococcus aureus subsp. aureus Mu50
aaauaguuuuucauauucacauc

SEQ ID NO: 3976785 - RNA, 16 nt, Staphylococcus aureus subsp. aureus Mu50
aaauauaaaauccuaa

SEQ ID NO: 3976786 - RNA, 19 nt, Staphylococcus aureus subsp. aureus Mu50
aaauauaaaauccuaagca

SEQ ID NO: 3976787 - RNA, 15 nt, Staphylococcus aureus subsp. aureus Mu50
aaauauaaauaaaag

SEQ ID NO: 3976788 - RNA, 15 nt, Staphylococcus aureus subsp. aureus Mu50
aaauauaaauaugaa

SEQ ID NO: 3976789 - RNA, 21 nt, Staphylococcus aureus subsp. aureus Mu50
aaauauaauacuguauuuuaa

SEQ ID NO: 3976790 - RNA, 19 nt, Staphylococcus aureus subsp. aureus Mu50
aaauauaauagaaauaauc

SEQ ID NO: 3976791 - RNA, 18 nt, Staphylococcus aureus subsp. aureus Mu50
aaauauaauguauaaaac

SEQ ID NO: 3976792 - RNA, 15 nt, Staphylococcus aureus subsp. aureus Mu50
aaauauaccaaccaa

SEQ ID NO: 3976793 - RNA, 17 nt, Staphylococcus aureus subsp. aureus Mu50
aaauauaccaaccaaaa

SEQ ID NO: 3976794 - RNA, 18 nt, Staphylococcus aureus subsp. aureus Mu50
aaauauacuaaauuugaa

SEQ ID NO: 3976795 - RNA, 21 nt, Staphylococcus aureus subsp. aureus Mu50
aaauauacuugccuucaaauu

SEQ ID NO: 3976796 - RNA, 23 nt, Staphylococcus aureus subsp. aureus Mu50
aaauauacuuuuaccauugugaa

SEQ ID NO: 3976797 - RNA, 14 nt, Staphylococcus aureus subsp. aureus Mu50
aaauauaucuaaua

SEQ ID NO: 3976798 - RNA, 18 nt, Staphylococcus aureus subsp. aureus Mu50
aaauauaucuagccugaa

SEQ ID NO: 3976799 - RNA, 14 nt, Staphylococcus aureus subsp. aureus Mu50
aaauauauuaguga

SEQ ID NO: 3976800 - RNA, 19 nt, Staphylococcus aureus subsp. aureus Mu50
aaauauauugcacauaaaa

SEQ ID NO: 3976801 - RNA, 21 nt, Staphylococcus aureus subsp. aureus Mu50
aaaucauuuugccucguccau

SEQ ID NO: 3976802 - RNA, 16 nt, Staphylococcus aureus subsp. aureus Mu50
aaauccaaaaucuuua

SEQ ID NO: 3976803 - RNA, 20 nt, Staphylococcus aureus subsp. aureus Mu50
aaauccaagcgcuucaggca

SEQ ID NO: 3976804 - RNA, 15 nt, Staphylococcus aureus subsp. aureus Mu50
aaauccacacauuaa

SEQ ID NO: 3976805 - RNA, 18 nt, Staphylococcus aureus subsp. aureus Mu50
aaaucccaaguuacaaua

SEQ ID NO: 3976806 - RNA, 18 nt, Staphylococcus aureus subsp. aureus Mu50
aaauccgcauaaauuaga

SEQ ID NO: 3976807 - RNA, 16 nt, Staphylococcus aureus subsp. aureus Mu50
aaauccuaauuuuucu

SEQ ID NO: 3976808 - RNA, 13 nt, Staphylococcus aureus subsp. aureus Mu50
aaauccucuuaua

SEQ ID NO: 3976809 - RNA, 24 nt, Staphylococcus aureus subsp. aureus Mu50
aaauccuuaaauggagauucucgg

SEQ ID NO: 3976810 - RNA, 19 nt, Staphylococcus aureus subsp. aureus Mu50
aaaucgauacuaauaucuu

SEQ ID NO: 3976811 - RNA, 22 nt, Staphylococcus aureus subsp. aureus Mu50
aaaucgauacuaauaucuucuu

SEQ ID NO: 3976812 - RNA, 15 nt, Staphylococcus aureus subsp. aureus Mu50
aaaucggaauaaaau

SEQ ID NO: 3976813 - RNA, 16 nt, Staphylococcus aureus subsp. aureus Mu50
aaaucggaauaaaaua

SEQ ID NO: 3976814 - RNA, 15 nt, Staphylococcus aureus subsp. aureus Mu50
aaaucggauuaacau

SEQ ID NO: 3976815 - RNA, 15 nt, Staphylococcus aureus subsp. aureus Mu50
aaaucgguuugauua

SEQ ID NO: 3976816 - RNA, 16 nt, Staphylococcus aureus subsp. aureus Mu50
aaaucgugcuguuauc

SEQ ID NO: 3976817 - RNA, 15 nt, Staphylococcus aureus subsp. aureus Mu50
aaaucguuaaggaaa

SEQ ID NO: 3976818 - RNA, 19 nt, Staphylococcus aureus subsp. aureus Mu50
aaaucguuaaggaaagcuu

SEQ ID NO: 3976819 - RNA, 14 nt, Staphylococcus aureus subsp. aureus Mu50
aaaucguuauaagu

SEQ ID NO: 3976820 - RNA, 12 nt, Staphylococcus aureus subsp. aureus Mu50
aaaucguuucau

SEQ ID NO: 3976821 - RNA, 24 nt, Staphylococcus aureus subsp. aureus Mu50
aaaucuaauccugguauaauggac

SEQ ID NO: 3976822 - RNA, 16 nt, Staphylococcus aureus subsp. aureus Mu50
aaaucuaauuauucau

SEQ ID NO: 3976823 - RNA, 13 nt, Staphylococcus aureus subsp. aureus Mu50
aaaucuacaauau

SEQ ID NO: 3976824 - RNA, 15 nt, Staphylococcus aureus subsp. aureus Mu50
aaaucuacaauauua

SEQ ID NO: 3976825 - RNA, 22 nt, Staphylococcus aureus subsp. aureus Mu50
aaaucuacaauauuaaaauuaa

SEQ ID NO: 3976826 - RNA, 17 nt, Staphylococcus aureus subsp. aureus Mu50
aaaucuauaaauaucaa

SEQ ID NO: 3976827 - RNA, 19 nt, Staphylococcus aureus subsp. aureus Mu50
aaaucuauaacgauaguuu

SEQ ID NO: 3976828 - RNA, 10 nt, Staphylococcus aureus subsp. aureus Mu50
aaaucuauau

SEQ ID NO: 3976829 - RNA, 16 nt, Staphylococcus aureus subsp. aureus Mu50
aaaucuauauaaaguu

SEQ ID NO: 3976830 - RNA, 13 nt, Staphylococcus aureus subsp. aureus Mu50
aaaucuaucuacu

SEQ ID NO: 3976831 - RNA, 18 nt, Staphylococcus aureus subsp. aureus Mu50
aaaucuaucuacucaaau

SEQ ID NO: 3976832 - RNA, 14 nt, Staphylococcus aureus subsp. aureus Mu50
aaaucuauugugau

SEQ ID NO: 3976833 - RNA, 14 nt, Staphylococcus aureus subsp. aureus Mu50
aaaucucauaauaa

SEQ ID NO: 3976834 - RNA, 21 nt, Staphylococcus aureus subsp. aureus Mu50
aaaucucgucacauauaaaua

SEQ ID NO: 3976835 - RNA, 15 nt, Staphylococcus aureus subsp. aureus Mu50
aaaucugauucauua

SEQ ID NO: 3976836 - RNA, 12 nt, Staphylococcus aureus subsp. aureus Mu50
aaaucugcuuua

SEQ ID NO: 3976837 - RNA, 15 nt, Staphylococcus aureus subsp. aureus Mu50
aaaucuguuuaaauu

SEQ ID NO: 3976838 - RNA, 20 nt, Staphylococcus aureus subsp. aureus Mu50
aaaucuguuuaaauuuaaaa

SEQ ID NO: 3976839 - RNA, 19 nt, Staphylococcus aureus subsp. aureus Mu50
aaaucuuaaagauuuuuca

SEQ ID NO: 3976840 - RNA, 21 nt, Staphylococcus aureus subsp. aureus Mu50
aaaucuuaugaugucauguau

SEQ ID NO: 3976841 - RNA, 17 nt, Staphylococcus aureus subsp. aureus Mu50
aaaucuucaagugccau

SEQ ID NO: 3976842 - RNA, 17 nt, Staphylococcus aureus subsp. aureus Mu50
aaaucuucuauuuucau

SEQ ID NO: 3976843 - RNA, 16 nt, Staphylococcus aureus subsp. aureus Mu50
aaaucuucuccaauca

SEQ ID NO: 3976844 - RNA, 23 nt, Staphylococcus aureus subsp. aureus Mu50
aaaucuuguuggauuuuaacaag

SEQ ID NO: 3976845 - RNA, 14 nt, Staphylococcus aureus subsp. aureus Mu50
aaaucuuuaaaugu

SEQ ID NO: 3976846 - RNA, 21 nt, Staphylococcus aureus subsp. aureus Mu50
aaaucuuuaaauguaucacuu

SEQ ID NO: 3976847 - RNA, 16 nt, Staphylococcus aureus subsp. aureus Mu50
aaaucuuuacuuguaa

SEQ ID NO: 3976848 - RNA, 18 nt, Staphylococcus aureus subsp. aureus Mu50
aaaucuuuacuuguaauu

SEQ ID NO: 3976849 - RNA, 23 nt, Staphylococcus aureus subsp. aureus Mu50
aaaucuuuacuuguaauuaauac

SEQ ID NO: 3976850 - RNA, 15 nt, Staphylococcus aureus subsp. aureus Mu50
aaaucuuuaucaguu

SEQ ID NO: 3976851 - RNA, 14 nt, Staphylococcus aureus subsp. aureus Mu50
aaaucuuuuaaauu

SEQ ID NO: 3976852 - RNA, 22 nt, Staphylococcus aureus subsp. aureus Mu50
aaaucuuuuaaauuuaguaucu

SEQ ID NO: 3976853 - RNA, 16 nt, Staphylococcus aureus subsp. aureus Mu50
aaaucuuuuagcuuuu

SEQ ID NO: 3976854 - RNA, 22 nt, Staphylococcus aureus subsp. aureus Mu50
aaaucuuuuagcuuuuguaaag

SEQ ID NO: 3976855 - RNA, 22 nt, Staphylococcus aureus subsp. aureus Mu50
aaaucuuuugagacguuuucca

SEQ ID NO: 3976856 - RNA, 14 nt, Staphylococcus aureus subsp. aureus Mu50
aaaugaaaaaguaa

SEQ ID NO: 3976857 - RNA, 13 nt, Staphylococcus aureus subsp. aureus Mu50
aaaugaaaguacc

SEQ ID NO: 3976858 - RNA, 22 nt, Staphylococcus aureus subsp. aureus Mu50
aaaugaaaguaccuaaaauaga

SEQ ID NO: 3976859 - RNA, 14 nt, Staphylococcus aureus subsp. aureus Mu50
aaaugaaauaggcg

SEQ ID NO: 3976860 - RNA, 17 nt, Staphylococcus aureus subsp. aureus Mu50
aaaugaauaaucaaagu

SEQ ID NO: 3976861 - RNA, 19 nt, Staphylococcus aureus subsp. aureus Mu50
aaaugaauauaauaacaau

SEQ ID NO: 3976862 - RNA, 15 nt, Staphylococcus aureus subsp. aureus Mu50
aaaugaauugcuugu

SEQ ID NO: 3976863 - RNA, 14 nt, Staphylococcus aureus subsp. aureus Mu50
aaaugacaucaucu

SEQ ID NO: 3976864 - RNA, 20 nt, Staphylococcus aureus subsp. aureus Mu50
aaaugacaucaucuauaaua

SEQ ID NO: 3976865 - RNA, 21 nt, Staphylococcus aureus subsp. aureus Mu50
aaaugacaucaucuauaauac

SEQ ID NO: 3976866 - RNA, 15 nt, Staphylococcus aureus subsp. aureus Mu50
aaaugacauuuaaua

SEQ ID NO: 3976867 - RNA, 15 nt, Staphylococcus aureus subsp. aureus Mu50
aaaugacauuuuaaa

SEQ ID NO: 3976868 - RNA, 19 nt, Staphylococcus aureus subsp. aureus Mu50
aaaugaccuggaauauugu

SEQ ID NO: 3976869 - RNA, 15 nt, Staphylococcus aureus subsp. aureus Mu50
aaaugaccuuaauau

SEQ ID NO: 3976870 - RNA, 13 nt, Staphylococcus aureus subsp. aureus Mu50
aaaugacgauacg

SEQ ID NO: 3976871 - RNA, 18 nt, Staphylococcus aureus subsp. aureus Mu50
aaaugacgcucgagcucu

SEQ ID NO: 3976872 - RNA, 20 nt, Staphylococcus aureus subsp. aureus Mu50
aaaugacgugcuuuuaaaug

SEQ ID NO: 3976873 - RNA, 21 nt, Staphylococcus aureus subsp. aureus Mu50
aaaugacgugcuuuuaaaugu

SEQ ID NO: 3976874 - RNA, 24 nt, Staphylococcus aureus subsp. aureus Mu50
aaaugacgugcuuuuaaauguauu

SEQ ID NO: 3976875 - RNA, 14 nt, Staphylococcus aureus subsp. aureus Mu50
aaaugacugaauua

SEQ ID NO: 3976876 - RNA, 18 nt, Staphylococcus aureus subsp. aureus Mu50
aaaugacugaauuaauau

SEQ ID NO: 3976877 - RNA, 18 nt, Staphylococcus aureus subsp. aureus Mu50
aaaugacuucacauuuau

SEQ ID NO: 3976878 - RNA, 16 nt, Staphylococcus aureus subsp. aureus Mu50
aaaugagcguuccauu

SEQ ID NO: 3976879 - RNA, 15 nt, Staphylococcus aureus subsp. aureus Mu50
aaaugaguacaacau

SEQ ID NO: 3976880 - RNA, 12 nt, Staphylococcus aureus subsp. aureus Mu50
aaaugauaagaa

SEQ ID NO: 3976881 - RNA, 12 nt, Staphylococcus aureus subsp. aureus Mu50
aaaugauaauuu

SEQ ID NO: 3976882 - RNA, 22 nt, Staphylococcus aureus subsp. aureus Mu50
aaaugauaauuuaauaauguac

SEQ ID NO: 3976883 - RNA, 20 nt, Staphylococcus aureus subsp. aureus Mu50
aaaugauacauuauuaaaua

SEQ ID NO: 3976884 - RNA, 23 nt, Staphylococcus aureus subsp. aureus Mu50
aaaugauagcuaaacauuuuaua

SEQ ID NO: 3976885 - RNA, 20 nt, Staphylococcus aureus subsp. aureus Mu50
aaaugauagggcauugagau

SEQ ID NO: 3976886 - RNA, 13 nt, Staphylococcus aureus subsp. aureus Mu50
aaaugauaucuau

SEQ ID NO: 3976887 - RNA, 17 nt, Staphylococcus aureus subsp. aureus Mu50
aaaugauaucugacauu

SEQ ID NO: 3976888 - RNA, 16 nt, Staphylococcus aureus subsp. aureus Mu50
aaaugaucaucguaua

SEQ ID NO: 3976889 - RNA, 16 nt, Staphylococcus aureus subsp. aureus Mu50
aaauuacacccuuuaa

SEQ ID NO: 3976890 - RNA, 15 nt, Staphylococcus aureus subsp. aureus Mu50
aaauuacuauauuua

SEQ ID NO: 3976891 - RNA, 13 nt, Staphylococcus aureus subsp. aureus Mu50
aaauuacuugaau

SEQ ID NO: 3976892 - RNA, 16 nt, Staphylococcus aureus subsp. aureus Mu50
aaauuacuugaauauu

SEQ ID NO: 3976893 - RNA, 19 nt, Staphylococcus aureus subsp. aureus Mu50
aaauuagaaaaauaugauu

SEQ ID NO: 3976894 - RNA, 12 nt, Staphylococcus aureus subsp. aureus Mu50
aaauuagaauua

SEQ ID NO: 3976895 - RNA, 23 nt, Staphylococcus aureus subsp. aureus Mu50
aaauuagagaacgcuuuauuacu

SEQ ID NO: 3976896 - RNA, 20 nt, Staphylococcus aureus subsp. aureus Mu50
aaauuagauuuuaugcuuua

SEQ ID NO: 3976897 - RNA, 22 nt, Staphylococcus aureus subsp. aureus Mu50
aaauuagcaagugaguaacauu

SEQ ID NO: 3976898 - RNA, 18 nt, Staphylococcus aureus subsp. aureus Mu50
aaauuagucauccaaaga

SEQ ID NO: 3976899 - RNA, 23 nt, Staphylococcus aureus subsp. aureus Mu50
aaauuagugguuagcuauauuuu

SEQ ID NO: 3976900 - RNA, 22 nt, Staphylococcus aureus subsp. aureus Mu50
aaauuauaaauuugguacauaa

SEQ ID NO: 3976901 - RNA, 14 nt, Staphylococcus aureus subsp. aureus Mu50
aaauuauacaaauu

SEQ ID NO: 3976902 - RNA, 18 nt, Staphylococcus aureus subsp. aureus Mu50
aaauuauacaaauuauaa

SEQ ID NO: 3976903 - RNA, 13 nt, Staphylococcus aureus subsp. aureus Mu50
aaauuauauaaau

SEQ ID NO: 3976904 - RNA, 21 nt, Staphylococcus aureus subsp. aureus Mu50
aaauuauauacccaccacauu

SEQ ID NO: 3976905 - RNA, 15 nt, Staphylococcus aureus subsp. aureus Mu50
aaauuauauagaaaa

SEQ ID NO: 3976906 - RNA, 18 nt, Staphylococcus aureus subsp. aureus Mu50
aaauuauauagaaaacua

SEQ ID NO: 3976907 - RNA, 14 nt, Staphylococcus aureus subsp. aureus Mu50
aaauuaucagaauc

SEQ ID NO: 3976908 - RNA, 20 nt, Staphylococcus aureus subsp. aureus Mu50
aaauuaugacuuauuuuuca

SEQ ID NO: 3976909 - RNA, 13 nt, Staphylococcus aureus subsp. aureus Mu50
aaauuaugauuau

SEQ ID NO: 3976910 - RNA, 18 nt, Staphylococcus aureus subsp. aureus Mu50
aaauuaugauuauauuuu

SEQ ID NO: 3976911 - RNA, 21 nt, Staphylococcus aureus subsp. aureus Mu50
aaauuaugauuauauuuucuc

SEQ ID NO: 3976912 - RNA, 13 nt, Staphylococcus aureus subsp. aureus Mu50
aaauuauuauuua

SEQ ID NO: 3976913 - RNA, 20 nt, Staphylococcus aureus subsp. aureus Mu50
aaauuauugaauuugaauaa

SEQ ID NO: 3976914 - RNA, 16 nt, Staphylococcus aureus subsp. aureus Mu50
aaauuauuguuuuaau

SEQ ID NO: 3976915 - RNA, 12 nt, Staphylococcus aureus subsp. aureus Mu50
aaauuauuuaau

SEQ ID NO: 3976916 - RNA, 17 nt, Staphylococcus aureus subsp. aureus Mu50
aaauuauuuaauuuuuc

SEQ ID NO: 3976917 - RNA, 19 nt, Staphylococcus aureus subsp. aureus Mu50
aaauuauuuaauuuuucua

SEQ ID NO: 3976918 - RNA, 14 nt, Staphylococcus aureus subsp. aureus Mu50
aaauucaacuauga

SEQ ID NO: 3976919 - RNA, 17 nt, Staphylococcus aureus subsp. aureus Mu50
aaauucaacuaugaaau

SEQ ID NO: 3976920 - RNA, 18 nt, Staphylococcus aureus subsp. aureus Mu50
aaauucaacuaugaaauu

SEQ ID NO: 3976921 - RNA, 14 nt, Staphylococcus aureus subsp. aureus Mu50
aaauucaguaucua

SEQ ID NO: 3976922 - RNA, 12 nt, Staphylococcus aureus subsp. aureus Mu50
aaauucaucuug

SEQ ID NO: 3976923 - RNA, 13 nt, Staphylococcus aureus subsp. aureus Mu50
aaauucauuugua

SEQ ID NO: 3976924 - RNA, 18 nt, Staphylococcus aureus subsp. aureus Mu50
aaauuccaagagaauuaa

SEQ ID NO: 3976925 - RNA, 20 nt, Staphylococcus aureus subsp. aureus Mu50
aaauuccaagagaauuaaua

SEQ ID NO: 3976926 - RNA, 23 nt, Staphylococcus aureus subsp. aureus Mu50
aaauuccaugucaauuuuuucau

SEQ ID NO: 3976927 - RNA, 15 nt, Staphylococcus aureus subsp. aureus Mu50
aaauucgaaaagaaa

SEQ ID NO: 3976928 - RNA, 16 nt, Staphylococcus aureus subsp. aureus Mu50
aaauucgaaaagaaau

SEQ ID NO: 3976929 - RNA, 17 nt, Staphylococcus aureus subsp. aureus Mu50
aaauucgaacuaucaau

SEQ ID NO: 3976930 - RNA, 19 nt, Staphylococcus aureus subsp. aureus Mu50
aaauucgacucaaacaaua

SEQ ID NO: 3976931 - RNA, 19 nt, Staphylococcus aureus subsp. aureus Mu50
aaauucgcuugauuaauuu

SEQ ID NO: 3976932 - RNA, 21 nt, Staphylococcus aureus subsp. aureus Mu50
aaauucgcuugauuaauuuua

SEQ ID NO: 3976933 - RNA, 21 nt, Staphylococcus aureus subsp. aureus Mu50
aaauucuacaggcaaugcaag

SEQ ID NO: 3976934 - RNA, 22 nt, Staphylococcus aureus subsp. aureus Mu50
aaauucuacaggcaaugcaagu

SEQ ID NO: 3976935 - RNA, 23 nt, Staphylococcus aureus subsp. aureus Mu50
aaauucuacaggcaaugcaaguu

SEQ ID NO: 3976936 - RNA, 17 nt, Staphylococcus aureus subsp. aureus Mu50
aaauucuacagguaaug

SEQ ID NO: 3976937 - RNA, 21 nt, Staphylococcus aureus subsp. aureus Mu50
aaauucuacagguaaugcaag

SEQ ID NO: 3976938 - RNA, 23 nt, Staphylococcus aureus subsp. aureus Mu50
aaauucuacagguaaugcaaguu

SEQ ID NO: 3976939 - RNA, 21 nt, Staphylococcus aureus subsp. aureus Mu50
aaauucuauaauuuuaauuau

SEQ ID NO: 3976940 - RNA, 14 nt, Staphylococcus aureus subsp. aureus Mu50
aaauucucaauuaa

SEQ ID NO: 3976941 - RNA, 13 nt, Staphylococcus aureus subsp. aureus Mu50
aaauucucuaauu

SEQ ID NO: 3976942 - RNA, 17 nt, Staphylococcus aureus subsp. aureus Mu50
aaauucucuaauuucuc

SEQ ID NO: 3976943 - RNA, 12 nt, Staphylococcus aureus subsp. aureus Mu50
aaauucucuuuu

SEQ ID NO: 3976944 - RNA, 16 nt, Staphylococcus aureus subsp. aureus Mu50
aaauucucuuuuaaau

SEQ ID NO: 3976945 - RNA, 21 nt, Staphylococcus aureus subsp. aureus Mu50
aaauucucuuuuaaauucuua

SEQ ID NO: 3976946 - RNA, 18 nt, Staphylococcus aureus subsp. aureus Mu50
aaauucuuauaaaauaaa

SEQ ID NO: 3976947 - RNA, 20 nt, Staphylococcus aureus subsp. aureus Mu50
aaauucuuauaaaauaaaaa

SEQ ID NO: 3976948 - RNA, 18 nt, Staphylococcus aureus subsp. aureus Mu50
aaauucuuuucaagaaau

SEQ ID NO: 3976949 - RNA, 11 nt, Staphylococcus aureus subsp. aureus Mu50
aaauucuuuuu

SEQ ID NO: 3976950 - RNA, 22 nt, Staphylococcus aureus subsp. aureus Mu50
aaauugaaauguuuaucaauuc

SEQ ID NO: 3976951 - RNA, 15 nt, Staphylococcus aureus subsp. aureus Mu50
aaauugacucaaaga

SEQ ID NO: 3976952 - RNA, 17 nt, Staphylococcus aureus subsp. aureus Mu50
aaauugauauugcaaaa

SEQ ID NO: 3976953 - RNA, 14 nt, Staphylococcus aureus subsp. aureus Mu50
aaauugauuaaaua

SEQ ID NO: 3976954 - RNA, 17 nt, Staphylococcus aureus subsp. aureus Mu50
aaauugauuaaauaaau

SEQ ID NO: 3976955 - RNA, 23 nt, Staphylococcus aureus subsp. aureus Mu50
aaauugauucuuuggugaaguau

SEQ ID NO: 3976956 - RNA, 19 nt, Staphylococcus aureus subsp. aureus Mu50
aaauugcaaaguaacaaua

SEQ ID NO: 3976957 - RNA, 19 nt, Staphylococcus aureus subsp. aureus Mu50
aaauugcuaaaaaaauuaa

SEQ ID NO: 3976958 - RNA, 21 nt, Staphylococcus aureus subsp. aureus Mu50
aaauugcuaaaaaaauuaaaa

SEQ ID NO: 3976959 - RNA, 17 nt, Staphylococcus aureus subsp. aureus Mu50
aaauugcuauauuagua

SEQ ID NO: 3976960 - RNA, 17 nt, Staphylococcus aureus subsp. aureus Mu50
aaauugcuugaaauuau

SEQ ID NO: 3976961 - RNA, 18 nt, Staphylococcus aureus subsp. aureus Mu50
aaauugcuugaaauuauu

SEQ ID NO: 3976962 - RNA, 15 nt, Staphylococcus aureus subsp. aureus Mu50
aaauugguuuggaua

SEQ ID NO: 3976963 - RNA, 23 nt, Staphylococcus aureus subsp. aureus Mu50
aaauugguuuggauaaaaugaua

SEQ ID NO: 3976964 - RNA, 13 nt, Staphylococcus aureus subsp. aureus Mu50
aaauuguauagaa

SEQ ID NO: 3976965 - RNA, 14 nt, Staphylococcus aureus subsp. aureus Mu50
aaauuguauagaau

SEQ ID NO: 3976966 - RNA, 14 nt, Staphylococcus aureus subsp. aureus Mu50
aaauuguaugaaua

SEQ ID NO: 3976967 - RNA, 22 nt, Staphylococcus aureus subsp. aureus Mu50
aaauuguaugaauaauaugguu

SEQ ID NO: 3976968 - RNA, 24 nt, Staphylococcus aureus subsp. aureus Mu50
aaauuguauuucuuaacauccuuu

SEQ ID NO: 3976969 - RNA, 16 nt, Staphylococcus aureus subsp. aureus Mu50
aaauuguguugaauca

SEQ ID NO: 3976970 - RNA, 23 nt, Staphylococcus aureus subsp. aureus Mu50
aaauuguguugaaucaacaguuu

SEQ ID NO: 3976971 - RNA, 14 nt, Staphylococcus aureus subsp. aureus Mu50
aaauuguguuucuu

SEQ ID NO: 3976972 - RNA, 20 nt, Staphylococcus aureus subsp. aureus Mu50
aaauuguuccuucgauaguu

SEQ ID NO: 3976973 - RNA, 23 nt, Staphylococcus aureus subsp. aureus Mu50
aaauuguuccuucgauaguuuau

SEQ ID NO: 3976974 - RNA, 17 nt, Staphylococcus aureus subsp. aureus Mu50
aaauuguucuaauacac

SEQ ID NO: 3976975 - RNA, 17 nt, Staphylococcus aureus subsp. aureus Mu50
aaauuuaaaacaaugau

SEQ ID NO: 3976976 - RNA, 19 nt, Staphylococcus aureus subsp. aureus Mu50
aacaaucacgauuaauguc

SEQ ID NO: 3976977 - RNA, 15 nt, Staphylococcus aureus subsp. aureus Mu50
aacaaucguuuuaau

SEQ ID NO: 3976978 - RNA, 19 nt, Staphylococcus aureus subsp. aureus Mu50
aacaaugcgaagaaaucau

SEQ ID NO: 3976979 - RNA, 14 nt, Staphylococcus aureus subsp. aureus Mu50
aacaauucauuaau

SEQ ID NO: 3976980 - RNA, 17 nt, Staphylococcus aureus subsp. aureus Mu50
aacaauugauugcucua

SEQ ID NO: 3976981 - RNA, 16 nt, Staphylococcus aureus subsp. aureus Mu50
aacaauugcuaaucca

SEQ ID NO: 3976982 - RNA, 15 nt, Staphylococcus aureus subsp. aureus Mu50
aacaauuuauuaaaa

SEQ ID NO: 3976983 - RNA, 22 nt, Staphylococcus aureus subsp. aureus Mu50
aacaauuugaggauacauaaau

SEQ ID NO: 3976984 - RNA, 12 nt, Staphylococcus aureus subsp. aureus Mu50
aacaauuuuaaa

SEQ ID NO: 3976985 - RNA, 20 nt, Staphylococcus aureus subsp. aureus Mu50
aacaauuuuaaaucuuuuag

SEQ ID NO: 3976986 - RNA, 21 nt, Staphylococcus aureus subsp. aureus Mu50
aacaauuuuugggaagaauaa

SEQ ID NO: 3976987 - RNA, 18 nt, Staphylococcus aureus subsp. aureus Mu50
aacacaaaaaugaagaau

SEQ ID NO: 3976988 - RNA, 19 nt, Staphylococcus aureus subsp. aureus Mu50
aacacaaaaaugaagaaua

SEQ ID NO: 3976989 - RNA, 16 nt, Staphylococcus aureus subsp. aureus Mu50
aacacaaauaaaggca

SEQ ID NO: 3976990 - RNA, 22 nt, Staphylococcus aureus subsp. aureus Mu50
aacacacuuauaaucuauaaau

SEQ ID NO: 3976991 - RNA, 17 nt, Staphylococcus aureus subsp. aureus Mu50
aacacagacguuuuuga

SEQ ID NO: 3976992 - RNA, 23 nt, Staphylococcus aureus subsp. aureus Mu50
aacacagagaaauucgaaaagaa

SEQ ID NO: 3976993 - RNA, 18 nt, Staphylococcus aureus subsp. aureus Mu50
aacacagagaauuucgaa

SEQ ID NO: 3976994 - RNA, 23 nt, Staphylococcus aureus subsp. aureus Mu50
aacacagagaauuucgaaaagaa

SEQ ID NO: 3976995 - RNA, 16 nt, Staphylococcus aureus subsp. aureus Mu50
aacacaguacaaauaa

SEQ ID NO: 3976996 - RNA, 14 nt, Staphylococcus aureus subsp. aureus Mu50
aacacauaaauuaa

SEQ ID NO: 3976997 - RNA, 17 nt, Staphylococcus aureus subsp. aureus Mu50
aacacauaaauuaagca

SEQ ID NO: 3976998 - RNA, 19 nt, Staphylococcus aureus subsp. aureus Mu50
aacacauucuuauuugaaa

SEQ ID NO: 3976999 - RNA, 13 nt, Staphylococcus aureus subsp. aureus Mu50
aacaccaauuaaa

SEQ ID NO: 3977000 - RNA, 20 nt, Staphylococcus aureus subsp. aureus Mu50
aacaccaauugaaauuaacu

SEQ ID NO: 3977001 - RNA, 15 nt, Staphylococcus aureus subsp. aureus Mu50
aacaccacacagcau

SEQ ID NO: 3977002 - RNA, 16 nt, Staphylococcus aureus subsp. aureus Mu50
aacaccacacagcauu

SEQ ID NO: 3977003 - RNA, 17 nt, Staphylococcus aureus subsp. aureus Mu50
aacacccugcuuaucau

SEQ ID NO: 3977004 - RNA, 22 nt, Staphylococcus aureus subsp. aureus Mu50
aacaccugguacauaaauaccu

SEQ ID NO: 3977005 - RNA, 14 nt, Staphylococcus aureus subsp. aureus Mu50
aacacgaacugcau

SEQ ID NO: 3977006 - RNA, 19 nt, Staphylococcus aureus subsp. aureus Mu50
aacacgaugagcgcauaaa

SEQ ID NO: 3977007 - RNA, 21 nt, Staphylococcus aureus subsp. aureus Mu50
aacacgaugagcgcauaaauu

SEQ ID NO: 3977008 - RNA, 20 nt, Staphylococcus aureus subsp. aureus Mu50
aacacgauuugguugaacug

SEQ ID NO: 3977009 - RNA, 13 nt, Staphylococcus aureus subsp. aureus Mu50
aacacgcucuuuu

SEQ ID NO: 3977010 - RNA, 21 nt, Staphylococcus aureus subsp. aureus Mu50
aacacucaaaauguuuaacaa

SEQ ID NO: 3977011 - RNA, 19 nt, Staphylococcus aureus subsp. aureus Mu50
aacacugagaauuucuaau

SEQ ID NO: 3977012 - RNA, 18 nt, Staphylococcus aureus subsp. aureus Mu50
aacacuucguauugaaug

SEQ ID NO: 3977013 - RNA, 18 nt, Staphylococcus aureus subsp. aureus Mu50
aacagaaccgaaaauaau

SEQ ID NO: 3977014 - RNA, 15 nt, Staphylococcus aureus subsp. aureus Mu50
aacagcacauuuuua

SEQ ID NO: 3977015 - RNA, 20 nt, Staphylococcus aureus subsp. aureus Mu50
aacagcacauuuuuaguuag

SEQ ID NO: 3977016 - RNA, 22 nt, Staphylococcus aureus subsp. aureus Mu50
aacagcaguaagauuauuuuca

SEQ ID NO: 3977017 - RNA, 13 nt, Staphylococcus aureus subsp. aureus Mu50
aacagcauaaaua

SEQ ID NO: 3977018 - RNA, 20 nt, Staphylococcus aureus subsp. aureus Mu50
aacagcggaauacagaugau

SEQ ID NO: 3977019 - RNA, 16 nt, Staphylococcus aureus subsp. aureus Mu50
aacagcgugaauauaa

SEQ ID NO: 3977020 - RNA, 13 nt, Staphylococcus aureus subsp. aureus Mu50
aacagcuacaaau

SEQ ID NO: 3977021 - RNA, 15 nt, Staphylococcus aureus subsp. aureus Mu50
aacagcuacaaauaa

SEQ ID NO: 3977022 - RNA, 23 nt, Staphylococcus aureus subsp. aureus Mu50
aacagcugcagucgcaauggcaa

SEQ ID NO: 3977023 - RNA, 20 nt, Staphylococcus aureus subsp. aureus Mu50
aacagcuuuuucuacaccua

SEQ ID NO: 3977024 - RNA, 18 nt, Staphylococcus aureus subsp. aureus Mu50
aacagggguuuuuauaug

SEQ ID NO: 3977025 - RNA, 18 nt, Staphylococcus aureus subsp. aureus Mu50
aacagucccaaccccuuu

SEQ ID NO: 3977026 - RNA, 14 nt, Staphylococcus aureus subsp. aureus Mu50
aacaguccuuauua

SEQ ID NO: 3977027 - RNA, 13 nt, Staphylococcus aureus subsp. aureus Mu50
aacaguuaauaug

SEQ ID NO: 3977028 - RNA, 15 nt, Staphylococcus aureus subsp. aureus Mu50
aacaguuaauuauac

SEQ ID NO: 3977029 - RNA, 12 nt, Staphylococcus aureus subsp. aureus Mu50
aacaguuuuaaa

SEQ ID NO: 3977030 - RNA, 13 nt, Staphylococcus aureus subsp. aureus Mu50
aacaguuuuaaag

SEQ ID NO: 3977031 - RNA, 18 nt, Staphylococcus aureus subsp. aureus Mu50
aacaguuuuauuaucuuu

SEQ ID NO: 3977032 - RNA, 12 nt, Staphylococcus aureus subsp. aureus Mu50
aacauaaaaaug

SEQ ID NO: 3977033 - RNA, 14 nt, Staphylococcus aureus subsp. aureus Mu50
aacauaaaaaugcu

SEQ ID NO: 3977034 - RNA, 13 nt, Staphylococcus aureus subsp. aureus Mu50
aacauaauauuuc

SEQ ID NO: 3977035 - RNA, 12 nt, Staphylococcus aureus subsp. aureus Mu50
aacauaaugaca

SEQ ID NO: 3977036 - RNA, 14 nt, Staphylococcus aureus subsp. aureus Mu50
aacauaauuuuuau

SEQ ID NO: 3977037 - RNA, 18 nt, Staphylococcus aureus subsp. aureus Mu50
aacauacguuauuuuuug

SEQ ID NO: 3977038 - RNA, 15 nt, Staphylococcus aureus subsp. aureus Mu50
aacauacuauaaaaa

SEQ ID NO: 3977039 - RNA, 22 nt, Staphylococcus aureus subsp. aureus Mu50
aacauacuauaaaaauuuauuc

SEQ ID NO: 3977040 - RNA, 12 nt, Staphylococcus aureus subsp. aureus Mu50
aacauagaauaa

SEQ ID NO: 3977041 - RNA, 23 nt, Staphylococcus aureus subsp. aureus Mu50
aacauagauacaaaguacaguua

SEQ ID NO: 3977042 - RNA, 17 nt, Staphylococcus aureus subsp. aureus Mu50
aacauagcuuaauaauu

SEQ ID NO: 3977043 - RNA, 18 nt, Staphylococcus aureus subsp. aureus Mu50
aacauagcuuaauaauua

SEQ ID NO: 3977044 - RNA, 21 nt, Staphylococcus aureus subsp. aureus Mu50
aacauagcuuaauaauuaaua

SEQ ID NO: 3977045 - RNA, 13 nt, Staphylococcus aureus subsp. aureus Mu50
aacauauuauaua

SEQ ID NO: 3977046 - RNA, 15 nt, Staphylococcus aureus subsp. aureus Mu50
aacauauuauauaua

SEQ ID NO: 3977047 - RNA, 19 nt, Staphylococcus aureus subsp. aureus Mu50
aacauauuauauauauucc

SEQ ID NO: 3977048 - RNA, 23 nt, Staphylococcus aureus subsp. aureus Mu50
aacauauucaguauauguauaga

SEQ ID NO: 3977049 - RNA, 14 nt, Staphylococcus aureus subsp. aureus Mu50
aacauauucauaau

SEQ ID NO: 3977050 - RNA, 21 nt, Staphylococcus aureus subsp. aureus Mu50
aacauauuuuaacuaugaaug

SEQ ID NO: 3977051 - RNA, 21 nt, Staphylococcus aureus subsp. aureus Mu50
aacauauuuucacaaucauag

SEQ ID NO: 3977052 - RNA, 19 nt, Staphylococcus aureus subsp. aureus Mu50
aacaucaaauagacaccaa

SEQ ID NO: 3977053 - RNA, 12 nt, Staphylococcus aureus subsp. aureus Mu50
aacaucaucguc

SEQ ID NO: 3977054 - RNA, 14 nt, Staphylococcus aureus subsp. aureus Mu50
aacaucaucuaugc

SEQ ID NO: 3977055 - RNA, 14 nt, Staphylococcus aureus subsp. aureus Mu50
aacaucauuucuga

SEQ ID NO: 3977056 - RNA, 16 nt, Staphylococcus aureus subsp. aureus Mu50
aacauccccaaaaaua

SEQ ID NO: 3977057 - RNA, 17 nt, Staphylococcus aureus subsp. aureus Mu50
aacauccccaaaaauag

SEQ ID NO: 3977058 - RNA, 22 nt, Staphylococcus aureus subsp. aureus Mu50
aacaucgauuuaucauuauuug

SEQ ID NO: 3977059 - RNA, 16 nt, Staphylococcus aureus subsp. aureus Mu50
aacaucggcaccagua

SEQ ID NO: 3977060 - RNA, 11 nt, Staphylococcus aureus subsp. aureus Mu50
aacaucuaaau

SEQ ID NO: 3977061 - RNA, 19 nt, Staphylococcus aureus subsp. aureus Mu50
aacaucuaaauaguuuuuc

SEQ ID NO: 3977062 - RNA, 20 nt, Staphylococcus aureus subsp. aureus Mu50
aacaucuaaauaguuuuuca

SEQ ID NO: 3977063 - RNA, 23 nt, Staphylococcus aureus subsp. aureus Mu50
aacaucuacaucaaauuuuucga

SEQ ID NO: 3977064 - RNA, 15 nt, Staphylococcus aureus subsp. aureus Mu50
aacccaucauguaca

SEQ ID NO: 3977065 - RNA, 16 nt, Staphylococcus aureus subsp. aureus Mu50
aacccauggauucuga

SEQ ID NO: 3977066 - RNA, 20 nt, Staphylococcus aureus subsp. aureus Mu50
aacccauuuucaaaacuagc

SEQ ID NO: 3977067 - RNA, 15 nt, Staphylococcus aureus subsp. aureus Mu50
aacccuaaaaugaau

SEQ ID NO: 3977068 - RNA, 22 nt, Staphylococcus aureus subsp. aureus Mu50
aacccuaauguguggauuuaau

SEQ ID NO: 3977069 - RNA, 21 nt, Staphylococcus aureus subsp. aureus Mu50
aaccgaagcgcagugaccuca

SEQ ID NO: 3977070 - RNA, 15 nt, Staphylococcus aureus subsp. aureus Mu50
aaccgauauuucuga

SEQ ID NO: 3977071 - RNA, 16 nt, Staphylococcus aureus subsp. aureus Mu50
aaccgauauuucugaa

SEQ ID NO: 3977072 - RNA, 21 nt, Staphylococcus aureus subsp. aureus Mu50
aaccgccaacuaauguuaaaa

SEQ ID NO: 3977073 - RNA, 17 nt, Staphylococcus aureus subsp. aureus Mu50
aaccgcuuaauucuuca

SEQ ID NO: 3977074 - RNA, 18 nt, Staphylococcus aureus subsp. aureus Mu50
aaccguaacuauaugaaa

SEQ ID NO: 3977075 - RNA, 15 nt, Staphylococcus aureus subsp. aureus Mu50
aaccguuauauauua

SEQ ID NO: 3977076 - RNA, 13 nt, Staphylococcus aureus subsp. aureus Mu50
aaccguuuuauug

SEQ ID NO: 3977077 - RNA, 13 nt, Staphylococcus aureus subsp. aureus Mu50
aaccuaaaaacaa

SEQ ID NO: 3977078 - RNA, 18 nt, Staphylococcus aureus subsp. aureus Mu50
aaccuaaagauaauauua

SEQ ID NO: 3977079 - RNA, 14 nt, Staphylococcus aureus subsp. aureus Mu50
aaccuaaagauaua

SEQ ID NO: 3977080 - RNA, 16 nt, Staphylococcus aureus subsp. aureus Mu50
aaccuaaguuaauuua

SEQ ID NO: 3977081 - RNA, 16 nt, Staphylococcus aureus subsp. aureus Mu50
aaccuaaugcuuuaau

SEQ ID NO: 3977082 - RNA, 12 nt, Staphylococcus aureus subsp. aureus Mu50
aaccuacaauau

SEQ ID NO: 3977083 - RNA, 23 nt, Staphylococcus aureus subsp. aureus Mu50
aaccuagggauaauuuuauugac

SEQ ID NO: 3977084 - RNA, 14 nt, Staphylococcus aureus subsp. aureus Mu50
aaccuauuaaaucu

SEQ ID NO: 3977085 - RNA, 13 nt, Staphylococcus aureus subsp. aureus Mu50
aaccuauuaauua

SEQ ID NO: 3977086 - RNA, 23 nt, Staphylococcus aureus subsp. aureus Mu50
aaccuauuccuaauaaauaucuu

SEQ ID NO: 3977087 - RNA, 22 nt, Staphylococcus aureus subsp. aureus Mu50
aaccucuguuuuguugguguuu

SEQ ID NO: 3977088 - RNA, 19 nt, Staphylococcus aureus subsp. aureus Mu50
aaccucuuuuuguuguugu

SEQ ID NO: 3977089 - RNA, 22 nt, Staphylococcus aureus subsp. aureus Mu50
aaccugagccauaacugaauaa

SEQ ID NO: 3977090 - RNA, 13 nt, Staphylococcus aureus subsp. aureus Mu50
aaccuguaauuga

SEQ ID NO: 3977091 - RNA, 12 nt, Staphylococcus aureus subsp. aureus Mu50
aaccuuaaauau

SEQ ID NO: 3977092 - RNA, 17 nt, Staphylococcus aureus subsp. aureus Mu50
aaccuuacccaaaaaau

SEQ ID NO: 3977093 - RNA, 13 nt, Staphylococcus aureus subsp. aureus Mu50
aaccuugauuuaa

SEQ ID NO: 3977094 - RNA, 20 nt, Staphylococcus aureus subsp. aureus Mu50
aaccuugauuuaauuuuuaa

SEQ ID NO: 3977095 - RNA, 18 nt, Staphylococcus aureus subsp. aureus Mu50
aaccuuggcuucauguuc

SEQ ID NO: 3977096 - RNA, 11 nt, Staphylococcus aureus subsp. aureus Mu50
aaccuuuaaaa

SEQ ID NO: 3977097 - RNA, 14 nt, Staphylococcus aureus subsp. aureus Mu50
aaccuuuaaaacau

SEQ ID NO: 3977098 - RNA, 13 nt, Staphylococcus aureus subsp. aureus Mu50
aaccuuuaaaagu

SEQ ID NO: 3977099 - RNA, 15 nt, Staphylococcus aureus subsp. aureus Mu50
aaccuuuaaaaguaa

SEQ ID NO: 3977100 - RNA, 13 nt, Staphylococcus aureus subsp. aureus Mu50
aaccuuuucaaau

SEQ ID NO: 3977101 - RNA, 16 nt, Staphylococcus aureus subsp. aureus Mu50
aaccuuuucaaauuau

SEQ ID NO: 3977102 - RNA, 22 nt, Staphylococcus aureus subsp. aureus Mu50
aacgaaucgccuacuauaaaua

SEQ ID NO: 3977103 - RNA, 18 nt, Staphylococcus aureus subsp. aureus Mu50
aacgacacuuuuuaguga

SEQ ID NO: 3977104 - RNA, 15 nt, Staphylococcus aureus subsp. aureus Mu50
aacgacauuguuuag

SEQ ID NO: 3977105 - RNA, 19 nt, Staphylococcus aureus subsp. aureus Mu50
aacgacguaauccuuggaa

SEQ ID NO: 3977106 - RNA, 13 nt, Staphylococcus aureus subsp. aureus Mu50
aacgacuaaccac

SEQ ID NO: 3977107 - RNA, 16 nt, Staphylococcus aureus subsp. aureus Mu50
aacgacuaaccacauu

SEQ ID NO: 3977108 - RNA, 14 nt, Staphylococcus aureus subsp. aureus Mu50
aacgaggucuuuuu

SEQ ID NO: 3977109 - RNA, 17 nt, Staphylococcus aureus subsp. aureus Mu50
aacgauaaauuaacuua

SEQ ID NO: 3977110 - RNA, 18 nt, Staphylococcus aureus subsp. aureus Mu50
aacgauaagaauuaacaa

SEQ ID NO: 3977111 - RNA, 23 nt, Staphylococcus aureus subsp. aureus Mu50
aacgauaagauagcuauauuuag

SEQ ID NO: 3977112 - RNA, 18 nt, Staphylococcus aureus subsp. aureus Mu50
aacgauaccaaauauauu

SEQ ID NO: 3977113 - RNA, 18 nt, Staphylococcus aureus subsp. aureus Mu50
aacgauagacauugagau

SEQ ID NO: 3977114 - RNA, 23 nt, Staphylococcus aureus subsp. aureus Mu50
aacgauagauucugauacagaac

SEQ ID NO: 3977115 - RNA, 20 nt, Staphylococcus aureus subsp. aureus Mu50
aacgauaguaguacacgaau

SEQ ID NO: 3977116 - RNA, 13 nt, Staphylococcus aureus subsp. aureus Mu50
aacgauauuuuaa

SEQ ID NO: 3977117 - RNA, 19 nt, Staphylococcus aureus subsp. aureus Mu50
aacgaucuguccauuuauc

SEQ ID NO: 3977118 - RNA, 17 nt, Staphylococcus aureus subsp. aureus Mu50
aacgaugcuacuuaaag

SEQ ID NO: 3977119 - RNA, 19 nt, Staphylococcus aureus subsp. aureus Mu50
aacgaugcuacuuaaagcu

SEQ ID NO: 3977120 - RNA, 18 nt, Staphylococcus aureus subsp. aureus Mu50
aacgauuucuaguuuauc

SEQ ID NO: 3977121 - RNA, 18 nt, Staphylococcus aureus subsp. aureus Mu50
aacgccucaacacuuucu

SEQ ID NO: 3977122 - RNA, 16 nt, Staphylococcus aureus subsp. aureus Mu50
aacgcuaauuuuacuc

SEQ ID NO: 3977123 - RNA, 18 nt, Staphylococcus aureus subsp. aureus Mu50
aacgcucaacuauauaua

SEQ ID NO: 3977124 - RNA, 20 nt, Staphylococcus aureus subsp. aureus Mu50
aacgcuugaaaaauuuuacu

SEQ ID NO: 3977125 - RNA, 19 nt, Staphylococcus aureus subsp. aureus Mu50
aacgcuuugcagauugaua

SEQ ID NO: 3977126 - RNA, 14 nt, Staphylococcus aureus subsp. aureus Mu50
aacggaaauaacca

SEQ ID NO: 3977127 - RNA, 20 nt, Staphylococcus aureus subsp. aureus Mu50
aacgguacagauaagaauau

SEQ ID NO: 3977128 - RNA, 16 nt, Staphylococcus aureus subsp. aureus Mu50
aacgguuguauuucau

SEQ ID NO: 3977129 - RNA, 19 nt, Staphylococcus aureus subsp. aureus Mu50
aacguacaauguauuaccu

SEQ ID NO: 3977130 - RNA, 15 nt, Staphylococcus aureus subsp. aureus Mu50
aacguacauuuauga

SEQ ID NO: 3977131 - RNA, 17 nt, Staphylococcus aureus subsp. aureus Mu50
aacguacauuuuuauga

SEQ ID NO: 3977132 - RNA, 21 nt, Staphylococcus aureus subsp. aureus Mu50
aacguacuguguaauaccaau

SEQ ID NO: 3977133 - RNA, 14 nt, Staphylococcus aureus subsp. aureus Mu50
aacgucaacagcau

SEQ ID NO: 3977134 - RNA, 22 nt, Staphylococcus aureus subsp. aureus Mu50
aacgucacaugccaucuuugua

SEQ ID NO: 3977135 - RNA, 12 nt, Staphylococcus aureus subsp. aureus Mu50
aacgucacuuua

SEQ ID NO: 3977136 - RNA, 22 nt, Staphylococcus aureus subsp. aureus Mu50
aacgucauauguuuuauaauaa

SEQ ID NO: 3977137 - RNA, 20 nt, Staphylococcus aureus subsp. aureus Mu50
aacgucauuuuuaauaaugc

SEQ ID NO: 3977138 - RNA, 19 nt, Staphylococcus aureus subsp. aureus Mu50
aacgucgugucugaauaca

SEQ ID NO: 3977139 - RNA, 22 nt, Staphylococcus aureus subsp. aureus Mu50
aacguguuugaauggcaaauau

SEQ ID NO: 3977140 - RNA, 20 nt, Staphylococcus aureus subsp. aureus Mu50
aacguuauucguuaacaauc

SEQ ID NO: 3977141 - RNA, 19 nt, Staphylococcus aureus subsp. aureus Mu50
aacguucaaucguuucuuc

SEQ ID NO: 3977142 - RNA, 18 nt, Staphylococcus aureus subsp. aureus Mu50
aacguucauauaugauaa

SEQ ID NO: 3977143 - RNA, 17 nt, Staphylococcus aureus subsp. aureus Mu50
aacguugaguauuacuu

SEQ ID NO: 3977144 - RNA, 23 nt, Staphylococcus aureus subsp. aureus Mu50
aacguugccauacccauauuaaa

SEQ ID NO: 3977145 - RNA, 23 nt, Staphylococcus aureus subsp. aureus Mu50
aacuaaaaagcgugguucccaau

SEQ ID NO: 3977146 - RNA, 19 nt, Staphylococcus aureus subsp. aureus Mu50
aacuaaaacgauaauaaua

SEQ ID NO: 3977147 - RNA, 20 nt, Staphylococcus aureus subsp. aureus Mu50
aacuaaaacgauaauaauaa

SEQ ID NO: 3977148 - RNA, 11 nt, Staphylococcus aureus subsp. aureus Mu50
aacuaaaaugu

SEQ ID NO: 3977149 - RNA, 12 nt, Staphylococcus aureus subsp. aureus Mu50
aacuaaaauguc

SEQ ID NO: 3977150 - RNA, 17 nt, Staphylococcus aureus subsp. aureus Mu50
aacuaaaaugucuuuga

SEQ ID NO: 3977151 - RNA, 15 nt, Staphylococcus aureus subsp. aureus Mu50
aacuaaaccauugaa

SEQ ID NO: 3977152 - RNA, 16 nt, Staphylococcus aureus subsp. aureus Mu50
aacuuagaauuuacaa

SEQ ID NO: 3977153 - RNA, 13 nt, Staphylococcus aureus subsp. aureus Mu50
aacuuauucuuca

SEQ ID NO: 3977154 - RNA, 18 nt, Staphylococcus aureus subsp. aureus Mu50
aacuucacgcaaaacaau

SEQ ID NO: 3977155 - RNA, 14 nt, Staphylococcus aureus subsp. aureus Mu50
aacuucauaauaua

SEQ ID NO: 3977156 - RNA, 13 nt, Staphylococcus aureus subsp. aureus Mu50
aacuuccuaaaau

SEQ ID NO: 3977157 - RNA, 21 nt, Staphylococcus aureus subsp. aureus Mu50
aacuuccuaaaauuuacaaau

SEQ ID NO: 3977158 - RNA, 18 nt, Staphylococcus aureus subsp. aureus Mu50
aacuucuauuaagaaaua

SEQ ID NO: 3977159 - RNA, 22 nt, Staphylococcus aureus subsp. aureus Mu50
aacuucugaaacgccucaacac

SEQ ID NO: 3977160 - RNA, 18 nt, Staphylococcus aureus subsp. aureus Mu50
aacuucugauucuucacu

SEQ ID NO: 3977161 - RNA, 22 nt, Staphylococcus aureus subsp. aureus Mu50
aacuucuucuccguauuuaccu

SEQ ID NO: 3977162 - RNA, 14 nt, Staphylococcus aureus subsp. aureus Mu50
aacuucuuguuuca

SEQ ID NO: 3977163 - RNA, 13 nt, Staphylococcus aureus subsp. aureus Mu50
aacuucuuuucuu

SEQ ID NO: 3977164 - RNA, 21 nt, Staphylococcus aureus subsp. aureus Mu50
aacuucuuuuguuuuaccauc

SEQ ID NO: 3977165 - RNA, 22 nt, Staphylococcus aureus subsp. aureus Mu50
aacuucuuuuguuuuaccauca

SEQ ID NO: 3977166 - RNA, 18 nt, Staphylococcus aureus subsp. aureus Mu50
aacuugaacuaaaacgau

SEQ ID NO: 3977167 - RNA, 22 nt, Staphylococcus aureus subsp. aureus Mu50
aacuugagcuauucauagaccu

SEQ ID NO: 3977168 - RNA, 19 nt, Staphylococcus aureus subsp. aureus Mu50
aacuugaucauuauaaaau

SEQ ID NO: 3977169 - RNA, 15 nt, Staphylococcus aureus subsp. aureus Mu50
aacuugcgauaaguu

SEQ ID NO: 3977170 - RNA, 21 nt, Staphylococcus aureus subsp. aureus Mu50
aacuuggcaaugaaauuacca

SEQ ID NO: 3977171 - RNA, 23 nt, Staphylococcus aureus subsp. aureus Mu50
aacuuggcuuaaucucuuuuuga

SEQ ID NO: 3977172 - RNA, 14 nt, Staphylococcus aureus subsp. aureus Mu50
aacuuguaaucaua

SEQ ID NO: 3977173 - RNA, 16 nt, Staphylococcus aureus subsp. aureus Mu50
aacuuguccguuuuau

SEQ ID NO: 3977174 - RNA, 20 nt, Staphylococcus aureus subsp. aureus Mu50
aacuuguuguuauuuauuug

SEQ ID NO: 3977175 - RNA, 23 nt, Staphylococcus aureus subsp. aureus Mu50
aacuuguuguuauuuauuugauu

SEQ ID NO: 3977176 - RNA, 17 nt, Staphylococcus aureus subsp. aureus Mu50
aacuuuaagcugucaua

SEQ ID NO: 3977177 - RNA, 14 nt, Staphylococcus aureus subsp. aureus Mu50
aacuuuaauaccag

SEQ ID NO: 3977178 - RNA, 13 nt, Staphylococcus aureus subsp. aureus Mu50
aacuuuaauacua

SEQ ID NO: 3977179 - RNA, 13 nt, Staphylococcus aureus subsp. aureus Mu50
aacuuuaauuaaa

SEQ ID NO: 3977180 - RNA, 19 nt, Staphylococcus aureus subsp. aureus Mu50
aacuuuaauuuuucauuaa

SEQ ID NO: 3977181 - RNA, 23 nt, Staphylococcus aureus subsp. aureus Mu50
aacuuuaccaccauuuuuagaaa

SEQ ID NO: 3977182 - RNA, 19 nt, Staphylococcus aureus subsp. aureus Mu50
aacuuuaguauauucaaca

SEQ ID NO: 3977183 - RNA, 16 nt, Staphylococcus aureus subsp. aureus Mu50
aacuuuaucacuguau

SEQ ID NO: 3977184 - RNA, 15 nt, Staphylococcus aureus subsp. aureus Mu50
aacuuuauggggugu

SEQ ID NO: 3977185 - RNA, 16 nt, Staphylococcus aureus subsp. aureus Mu50
aacuuucacucauauu

SEQ ID NO: 3977186 - RNA, 20 nt, Staphylococcus aureus subsp. aureus Mu50
aacuuucacucauauuacuu

SEQ ID NO: 3977187 - RNA, 12 nt, Staphylococcus aureus subsp. aureus Mu50
aacuuucagcac

SEQ ID NO: 3977188 - RNA, 17 nt, Staphylococcus aureus subsp. aureus Mu50
aacuuuuauugccauaa

SEQ ID NO: 3977189 - RNA, 13 nt, Staphylococcus aureus subsp. aureus Mu50
aacuuuucaaaca

SEQ ID NO: 3977190 - RNA, 21 nt, Staphylococcus aureus subsp. aureus Mu50
aacuuuucaaacaauacaguu

SEQ ID NO: 3977191 - RNA, 22 nt, Staphylococcus aureus subsp. aureus Mu50
aacuuuucagcaguugcacaaa

SEQ ID NO: 3977192 - RNA, 16 nt, Staphylococcus aureus subsp. aureus Mu50
aacuuuuccuuguugg

SEQ ID NO: 3977193 - RNA, 19 nt, Staphylococcus aureus subsp. aureus Mu50
aacuuuucuaucucuugug

SEQ ID NO: 3977194 - RNA, 23 nt, Staphylococcus aureus subsp. aureus Mu50
aacuuuugggaagcgucuuuuuu

SEQ ID NO: 3977195 - RNA, 17 nt, Staphylococcus aureus subsp. aureus Mu50
aacuuuuuaacugccau

SEQ ID NO: 3977196 - RNA, 19 nt, Staphylococcus aureus subsp. aureus Mu50
aacuuuuuaacugccauau

SEQ ID NO: 3977197 - RNA, 15 nt, Staphylococcus aureus subsp. aureus Mu50
aacuuuuuuaacagc

SEQ ID NO: 3977198 - RNA, 15 nt, Staphylococcus aureus subsp. aureus Mu50
aacuuuuuuaacuuu

SEQ ID NO: 3977199 - RNA, 21 nt, Staphylococcus aureus subsp. aureus Mu50
aagaaaaagugauaauuaaaa

SEQ ID NO: 3977200 - RNA, 22 nt, Staphylococcus aureus subsp. aureus Mu50
aagaaaaagugauaauuaaaau

SEQ ID NO: 3977201 - RNA, 21 nt, Staphylococcus aureus subsp. aureus Mu50
aagaaaaauuuucuugguuug

SEQ ID NO: 3977202 - RNA, 15 nt, Staphylococcus aureus subsp. aureus Mu50
aagaaaauacuaaca

SEQ ID NO: 3977203 - RNA, 19 nt, Staphylococcus aureus subsp. aureus Mu50
aagaaacaauucauuaaua

SEQ ID NO: 3977204 - RNA, 19 nt, Staphylococcus aureus subsp. aureus Mu50
aagaaaccuuuuuucucuu

SEQ ID NO: 3977205 - RNA, 18 nt, Staphylococcus aureus subsp. aureus Mu50
aagaaacggaaaugacuu

SEQ ID NO: 3977206 - RNA, 15 nt, Staphylococcus aureus subsp. aureus Mu50
aagaaauaauuuaaa

SEQ ID NO: 3977207 - RNA, 17 nt, Staphylococcus aureus subsp. aureus Mu50
aagaaauaauuuaaagg

SEQ ID NO: 3977208 - RNA, 14 nt, Staphylococcus aureus subsp. aureus Mu50
aagaaaucaccaga

SEQ ID NO: 3977209 - RNA, 20 nt, Staphylococcus aureus subsp. aureus Mu50
aagaaaucaccagauuuuaa

SEQ ID NO: 3977210 - RNA, 13 nt, Staphylococcus aureus subsp. aureus Mu50
aagaaaucuauaa

SEQ ID NO: 3977211 - RNA, 13 nt, Staphylococcus aureus subsp. aureus Mu50
aagaaauguuaaa

SEQ ID NO: 3977212 - RNA, 15 nt, Staphylococcus aureus subsp. aureus Mu50
aagaaauguuaaauu

SEQ ID NO: 3977213 - RNA, 13 nt, Staphylococcus aureus subsp. aureus Mu50
aagaaauuaaagu

SEQ ID NO: 3977214 - RNA, 17 nt, Staphylococcus aureus subsp. aureus Mu50
aagaaauucgcaagccu

SEQ ID NO: 3977215 - RNA, 13 nt, Staphylococcus aureus subsp. aureus Mu50
aagaaauucuaca

SEQ ID NO: 3977216 - RNA, 14 nt, Staphylococcus aureus subsp. aureus Mu50
aagaaauucuacaa

SEQ ID NO: 3977217 - RNA, 19 nt, Staphylococcus aureus subsp. aureus Mu50
aagaaauucuacaggcaau

SEQ ID NO: 3977218 - RNA, 22 nt, Staphylococcus aureus subsp. aureus Mu50
aagaaauucuacaggcaaugca

SEQ ID NO: 3977219 - RNA, 22 nt, Staphylococcus aureus subsp. aureus Mu50
aagaaauucuacagguaaugca

SEQ ID NO: 3977220 - RNA, 13 nt, Staphylococcus aureus subsp. aureus Mu50
aagaaauuguguu

SEQ ID NO: 3977221 - RNA, 14 nt, Staphylococcus aureus subsp. aureus Mu50
aagaaauuuuuucu

SEQ ID NO: 3977222 - RNA, 14 nt, Staphylococcus aureus subsp. aureus Mu50
aagaacauaaccua

SEQ ID NO: 3977223 - RNA, 21 nt, Staphylococcus aureus subsp. aureus Mu50
aagaaccgauauuucugaauu

SEQ ID NO: 3977224 - RNA, 18 nt, Staphylococcus aureus subsp. aureus Mu50
aagaacgaaacuuuaauu

SEQ ID NO: 3977225 - RNA, 15 nt, Staphylococcus aureus subsp. aureus Mu50
aagaacuauuuuaaa

SEQ ID NO: 3977226 - RNA, 15 nt, Staphylococcus aureus subsp. aureus Mu50
aagaacuuuaaaaau

SEQ ID NO: 3977227 - RNA, 22 nt, Staphylococcus aureus subsp. aureus Mu50
aagaagacauuggauuacuucc

SEQ ID NO: 3977228 - RNA, 11 nt, Staphylococcus aureus subsp. aureus Mu50
aagaagagcca

SEQ ID NO: 3977229 - RNA, 21 nt, Staphylococcus aureus subsp. aureus Mu50
aagaaggaugaguuuaaaaau

SEQ ID NO: 3977230 - RNA, 16 nt, Staphylococcus aureus subsp. aureus Mu50
aagaaguaauguuaaa

SEQ ID NO: 3977231 - RNA, 19 nt, Staphylococcus aureus subsp. aureus Mu50
aagaagugccguauucuuu

SEQ ID NO: 3977232 - RNA, 15 nt, Staphylococcus aureus subsp. aureus Mu50
aagaaguuuccaacg

SEQ ID NO: 3977233 - RNA, 15 nt, Staphylococcus aureus subsp. aureus Mu50
aagaauaaaaaaguu

SEQ ID NO: 3977234 - RNA, 16 nt, Staphylococcus aureus subsp. aureus Mu50
aagaauaaaaaaguug

SEQ ID NO: 3977235 - RNA, 15 nt, Staphylococcus aureus subsp. aureus Mu50
aagaauaaacaacau

SEQ ID NO: 3977236 - RNA, 15 nt, Staphylococcus aureus subsp. aureus Mu50
aagaauacaaauauu

SEQ ID NO: 3977237 - RNA, 17 nt, Staphylococcus aureus subsp. aureus Mu50
aagaauacaugacucca

SEQ ID NO: 3977238 - RNA, 14 nt, Staphylococcus aureus subsp. aureus Mu50
aagaauauuuaagu

SEQ ID NO: 3977239 - RNA, 22 nt, Staphylococcus aureus subsp. aureus Mu50
aagaaucagcuaaauauuuuac

SEQ ID NO: 3977240 - RNA, 14 nt, Staphylococcus aureus subsp. aureus Mu50
aagcaucgaacaau

SEQ ID NO: 3977241 - RNA, 15 nt, Staphylococcus aureus subsp. aureus Mu50
aagcaucguaaaaaa

SEQ ID NO: 3977242 - RNA, 18 nt, Staphylococcus aureus subsp. aureus Mu50
aagcaucuccaauuuaau

SEQ ID NO: 3977243 - RNA, 20 nt, Staphylococcus aureus subsp. aureus Mu50
aagcaugacacucauucaau

SEQ ID NO: 3977244 - RNA, 20 nt, Staphylococcus aureus subsp. aureus Mu50
aagcaugauacucaauaaaa

SEQ ID NO: 3977245 - RNA, 11 nt, Staphylococcus aureus subsp. aureus Mu50
aagcauuuguc

SEQ ID NO: 3977246 - RNA, 15 nt, Staphylococcus aureus subsp. aureus Mu50
aagcauuuuucaauu

SEQ ID NO: 3977247 - RNA, 16 nt, Staphylococcus aureus subsp. aureus Mu50
aagcauuuuucaauua

SEQ ID NO: 3977248 - RNA, 20 nt, Staphylococcus aureus subsp. aureus Mu50
aagcauuuuucaauuauagu

SEQ ID NO: 3977249 - RNA, 14 nt, Staphylococcus aureus subsp. aureus Mu50
aagccaagauaaau

SEQ ID NO: 3977250 - RNA, 14 nt, Staphylococcus aureus subsp. aureus Mu50
aagccaucuuucuu

SEQ ID NO: 3977251 - RNA, 15 nt, Staphylococcus aureus subsp. aureus Mu50
aagccaucuuucuuu

SEQ ID NO: 3977252 - RNA, 23 nt, Staphylococcus aureus subsp. aureus Mu50
aagcccaugcccgauaaaaccac

SEQ ID NO: 3977253 - RNA, 22 nt, Staphylococcus aureus subsp. aureus Mu50
aagcccuauuguuuuuuauaag

SEQ ID NO: 3977254 - RNA, 14 nt, Staphylococcus aureus subsp. aureus Mu50
aagccuuaaaauau

SEQ ID NO: 3977255 - RNA, 13 nt, Staphylococcus aureus subsp. aureus Mu50
aagccuuaauauc

SEQ ID NO: 3977256 - RNA, 16 nt, Staphylococcus aureus subsp. aureus Mu50
aagccuucaauaguuu

SEQ ID NO: 3977257 - RNA, 21 nt, Staphylococcus aureus subsp. aureus Mu50
aagcgaauacaauaguacuaa

SEQ ID NO: 3977258 - RNA, 14 nt, Staphylococcus aureus subsp. aureus Mu50
aagcgcaauuaaaa

SEQ ID NO: 3977259 - RNA, 12 nt, Staphylococcus aureus subsp. aureus Mu50
aagcgcagugac

SEQ ID NO: 3977260 - RNA, 15 nt, Staphylococcus aureus subsp. aureus Mu50
aagcgcagugaccuc

SEQ ID NO: 3977261 - RNA, 17 nt, Staphylococcus aureus subsp. aureus Mu50
aagcgcuuggauuuuuu

SEQ ID NO: 3977262 - RNA, 19 nt, Staphylococcus aureus subsp. aureus Mu50
aagcguuucuugaucuaau

SEQ ID NO: 3977263 - RNA, 15 nt, Staphylococcus aureus subsp. aureus Mu50
aagcuaaauguuaau

SEQ ID NO: 3977264 - RNA, 14 nt, Staphylococcus aureus subsp. aureus Mu50
aagcuaaguuugaa

SEQ ID NO: 3977265 - RNA, 13 nt, Staphylococcus aureus subsp. aureus Mu50
aagcuaaugcaag

SEQ ID NO: 3977266 - RNA, 23 nt, Staphylococcus aureus subsp. aureus Mu50
aagcuaauucauauucaaauuua

SEQ ID NO: 3977267 - RNA, 19 nt, Staphylococcus aureus subsp. aureus Mu50
aagcuauaaaaaaucuuuu

SEQ ID NO: 3977268 - RNA, 15 nt, Staphylococcus aureus subsp. aureus Mu50
aagcuaucguuuauu

SEQ ID NO: 3977269 - RNA, 17 nt, Staphylococcus aureus subsp. aureus Mu50
aagcuaucuucagauuc

SEQ ID NO: 3977270 - RNA, 18 nt, Staphylococcus aureus subsp. aureus Mu50
aagcucaauaaauuauga

SEQ ID NO: 3977271 - RNA, 20 nt, Staphylococcus aureus subsp. aureus Mu50
aagcucauuucaauauuaaa

SEQ ID NO: 3977272 - RNA, 13 nt, Staphylococcus aureus subsp. aureus Mu50
aagcucccauuaa

SEQ ID NO: 3977273 - RNA, 14 nt, Staphylococcus aureus subsp. aureus Mu50
aagcugaaaaucau

SEQ ID NO: 3977274 - RNA, 17 nt, Staphylococcus aureus subsp. aureus Mu50
aagcugacuuuccacca

SEQ ID NO: 3977275 - RNA, 15 nt, Staphylococcus aureus subsp. aureus Mu50
aagcugagcuuuaau

SEQ ID NO: 3977276 - RNA, 17 nt, Staphylococcus aureus subsp. aureus Mu50
aagcugaugugacaaag

SEQ ID NO: 3977277 - RNA, 14 nt, Staphylococcus aureus subsp. aureus Mu50
aagcugauuaaaau

SEQ ID NO: 3977278 - RNA, 15 nt, Staphylococcus aureus subsp. aureus Mu50
aagcugauuaaaaug

SEQ ID NO: 3977279 - RNA, 14 nt, Staphylococcus aureus subsp. aureus Mu50
aagcugauuucuau

SEQ ID NO: 3977280 - RNA, 22 nt, Staphylococcus aureus subsp. aureus Mu50
aagcugauuucuaucaaauaau

SEQ ID NO: 3977281 - RNA, 23 nt, Staphylococcus aureus subsp. aureus Mu50
aagcugauuucuaucaaauaaug

SEQ ID NO: 3977282 - RNA, 18 nt, Staphylococcus aureus subsp. aureus Mu50
aagcugauuuuucauuga

SEQ ID NO: 3977283 - RNA, 23 nt, Staphylococcus aureus subsp. aureus Mu50
aagcuguuggugaguguuucaua

SEQ ID NO: 3977284 - RNA, 13 nt, Staphylococcus aureus subsp. aureus Mu50
aagcuguuuauug

SEQ ID NO: 3977285 - RNA, 13 nt, Staphylococcus aureus subsp. aureus Mu50
aagcuuauuaaau

SEQ ID NO: 3977286 - RNA, 14 nt, Staphylococcus aureus subsp. aureus Mu50
aagcuuauuaaauc

SEQ ID NO: 3977287 - RNA, 18 nt, Staphylococcus aureus subsp. aureus Mu50
aagcuucacuugaaguga

SEQ ID NO: 3977288 - RNA, 24 nt, Staphylococcus aureus subsp. aureus Mu50
aagcuucauauuuagguaauacau

SEQ ID NO: 3977289 - RNA, 20 nt, Staphylococcus aureus subsp. aureus Mu50
aagcuugcuguucaacaucu

SEQ ID NO: 3977290 - RNA, 20 nt, Staphylococcus aureus subsp. aureus Mu50
aagcuuguaacaagcauuuu

SEQ ID NO: 3977291 - RNA, 21 nt, Staphylococcus aureus subsp. aureus Mu50
aagcuuguaauccuuguucua

SEQ ID NO: 3977292 - RNA, 15 nt, Staphylococcus aureus subsp. aureus Mu50
aagcuuuaguuaaau

SEQ ID NO: 3977293 - RNA, 17 nt, Staphylococcus aureus subsp. aureus Mu50
aagcuuuaguuaaauag

SEQ ID NO: 3977294 - RNA, 18 nt, Staphylococcus aureus subsp. aureus Mu50
aagcuuucauuaauuuuu

SEQ ID NO: 3977295 - RNA, 19 nt, Staphylococcus aureus subsp. aureus Mu50
aagcuuuuacgccuucuuu

SEQ ID NO: 3977296 - RNA, 23 nt, Staphylococcus aureus subsp. aureus Mu50
aagcuuuuuugcuuuuauaauaa

SEQ ID NO: 3977297 - RNA, 13 nt, Staphylococcus aureus subsp. aureus Mu50
aaggaaagcuuca

SEQ ID NO: 3977298 - RNA, 16 nt, Staphylococcus aureus subsp. aureus Mu50
aaggaagcaucuccaa

SEQ ID NO: 3977299 - RNA, 21 nt, Staphylococcus aureus subsp. aureus Mu50
aaggaagucaccauauuuaac

SEQ ID NO: 3977300 - RNA, 20 nt, Staphylococcus aureus subsp. aureus Mu50
aaggaauagcuacaauuaaa

SEQ ID NO: 3977301 - RNA, 20 nt, Staphylococcus aureus subsp. aureus Mu50
aaggaaucguaaagcuguug

SEQ ID NO: 3977302 - RNA, 22 nt, Staphylococcus aureus subsp. aureus Mu50
aaggaaucguaaagcuguuggu

SEQ ID NO: 3977303 - RNA, 12 nt, Staphylococcus aureus subsp. aureus Mu50
aaggacaggaau

SEQ ID NO: 3977304 - RNA, 17 nt, Staphylococcus aureus subsp. aureus Mu50
aaggauaagaacgagaa

SEQ ID NO: 3977305 - RNA, 12 nt, Staphylococcus aureus subsp. aureus Mu50
aaggaucauguu

SEQ ID NO: 3977306 - RNA, 19 nt, Staphylococcus aureus subsp. aureus Mu50
aaggaucauguuccccauu

SEQ ID NO: 3977307 - RNA, 15 nt, Staphylococcus aureus subsp. aureus Mu50
aaggaugaguuuaaa

SEQ ID NO: 3977308 - RNA, 14 nt, Staphylococcus aureus subsp. aureus Mu50
aaggaugaugugaa

SEQ ID NO: 3977309 - RNA, 20 nt, Staphylococcus aureus subsp. aureus Mu50
aaggaugaugugaauguuuu

SEQ ID NO: 3977310 - RNA, 22 nt, Staphylococcus aureus subsp. aureus Mu50
aaggauguacuauaaauccuaa

SEQ ID NO: 3977311 - RNA, 16 nt, Staphylococcus aureus subsp. aureus Mu50
aaggauguuauaaaau

SEQ ID NO: 3977312 - RNA, 14 nt, Staphylococcus aureus subsp. aureus Mu50
aaggauuuuagauu

SEQ ID NO: 3977313 - RNA, 16 nt, Staphylococcus aureus subsp. aureus Mu50
aaggccauuuguagac

SEQ ID NO: 3977314 - RNA, 14 nt, Staphylococcus aureus subsp. aureus Mu50
aaggccauuuuuau

SEQ ID NO: 3977315 - RNA, 17 nt, Staphylococcus aureus subsp. aureus Mu50
aaggcgaaacauuaaaa

SEQ ID NO: 3977316 - RNA, 16 nt, Staphylococcus aureus subsp. aureus Mu50
aaggcgcucucuuuuu

SEQ ID NO: 3977317 - RNA, 16 nt, Staphylococcus aureus subsp. aureus Mu50
aagggagcauuucacu

SEQ ID NO: 3977318 - RNA, 21 nt, Staphylococcus aureus subsp. aureus Mu50
aagggagcauuucauuaguuu

SEQ ID NO: 3977319 - RNA, 21 nt, Staphylococcus aureus subsp. aureus Mu50
aagggaucggucuugaaaacc

SEQ ID NO: 3977320 - RNA, 18 nt, Staphylococcus aureus subsp. aureus Mu50
aaggggguaauacuauau

SEQ ID NO: 3977321 - RNA, 21 nt, Staphylococcus aureus subsp. aureus Mu50
aagguacguuguaauaguaag

SEQ ID NO: 3977322 - RNA, 23 nt, Staphylococcus aureus subsp. aureus Mu50
aagguauggcuagucuuuaacuu

SEQ ID NO: 3977323 - RNA, 15 nt, Staphylococcus aureus subsp. aureus Mu50
aaggucccauuaaaa

SEQ ID NO: 3977324 - RNA, 17 nt, Staphylococcus aureus subsp. aureus Mu50
aaggucccauuaaaauu

SEQ ID NO: 3977325 - RNA, 20 nt, Staphylococcus aureus subsp. aureus Mu50
aaggucuauguacaauaauu

SEQ ID NO: 3977326 - RNA, 16 nt, Staphylococcus aureus subsp. aureus Mu50
aaggugauugaacaau

SEQ ID NO: 3977327 - RNA, 20 nt, Staphylococcus aureus subsp. aureus Mu50
aaggugugggcuuuauuauc

SEQ ID NO: 3977328 - RNA, 17 nt, Staphylococcus aureus subsp. aureus Mu50
aagucucuugucauuuc

SEQ ID NO: 3977329 - RNA, 20 nt, Staphylococcus aureus subsp. aureus Mu50
aagucugaugucgaaaauag

SEQ ID NO: 3977330 - RNA, 18 nt, Staphylococcus aureus subsp. aureus Mu50
aagucugcugguaacucu

SEQ ID NO: 3977331 - RNA, 20 nt, Staphylococcus aureus subsp. aureus Mu50
aagucugcugguaacucuuc

SEQ ID NO: 3977332 - RNA, 21 nt, Staphylococcus aureus subsp. aureus Mu50
aagucuguugguuuaucagcu

SEQ ID NO: 3977333 - RNA, 23 nt, Staphylococcus aureus subsp. aureus Mu50
aagucuguugguuuaucagcuuu

SEQ ID NO: 3977334 - RNA, 13 nt, Staphylococcus aureus subsp. aureus Mu50
aagucuugugaua

SEQ ID NO: 3977335 - RNA, 19 nt, Staphylococcus aureus subsp. aureus Mu50
aagucuugugauaauucuu

SEQ ID NO: 3977336 - RNA, 14 nt, Staphylococcus aureus subsp. aureus Mu50
aagucuuuaauagc

SEQ ID NO: 3977337 - RNA, 19 nt, Staphylococcus aureus subsp. aureus Mu50
aagucuuuacucuacacuc

SEQ ID NO: 3977338 - RNA, 12 nt, Staphylococcus aureus subsp. aureus Mu50
aagugaaaucau

SEQ ID NO: 3977339 - RNA, 18 nt, Staphylococcus aureus subsp. aureus Mu50
aagugaaaucauuuaaau

SEQ ID NO: 3977340 - RNA, 23 nt, Staphylococcus aureus subsp. aureus Mu50
aagugaaucuaacugugcaacaa

SEQ ID NO: 3977341 - RNA, 15 nt, Staphylococcus aureus subsp. aureus Mu50
aagugacaacauuau

SEQ ID NO: 3977342 - RNA, 23 nt, Staphylococcus aureus subsp. aureus Mu50
aagugacuuaauaucauauucaa

SEQ ID NO: 3977343 - RNA, 13 nt, Staphylococcus aureus subsp. aureus Mu50
aagugaugugaug

SEQ ID NO: 3977344 - RNA, 21 nt, Staphylococcus aureus subsp. aureus Mu50
aagugauuuaaaaaauuuaau

SEQ ID NO: 3977345 - RNA, 22 nt, Staphylococcus aureus subsp. aureus Mu50
aagugauuucuucauuaucaau

SEQ ID NO: 3977346 - RNA, 19 nt, Staphylococcus aureus subsp. aureus Mu50
aagugcauauuuaauacau

SEQ ID NO: 3977347 - RNA, 18 nt, Staphylococcus aureus subsp. aureus Mu50
aagugccauuuuuaaauu

SEQ ID NO: 3977348 - RNA, 21 nt, Staphylococcus aureus subsp. aureus Mu50
aagugccauuuuuaaauuacu

SEQ ID NO: 3977349 - RNA, 18 nt, Staphylococcus aureus subsp. aureus Mu50
aagugccguccauuucca

SEQ ID NO: 3977350 - RNA, 13 nt, Staphylococcus aureus subsp. aureus Mu50
aagugcgauuauc

SEQ ID NO: 3977351 - RNA, 17 nt, Staphylococcus aureus subsp. aureus Mu50
aagugcgguuauuuaua

SEQ ID NO: 3977352 - RNA, 20 nt, Staphylococcus aureus subsp. aureus Mu50
aagugcgguuuaaucuauau

SEQ ID NO: 3977353 - RNA, 23 nt, Staphylococcus aureus subsp. aureus Mu50
aagugcgguuuaaucuauauaua

SEQ ID NO: 3977354 - RNA, 23 nt, Staphylococcus aureus subsp. aureus Mu50
aagugcuaagagguauacaguua

SEQ ID NO: 3977355 - RNA, 15 nt, Staphylococcus aureus subsp. aureus Mu50
aagugcucaaauuuu

SEQ ID NO: 3977356 - RNA, 16 nt, Staphylococcus aureus subsp. aureus Mu50
aagugcuguuacuucu

SEQ ID NO: 3977357 - RNA, 20 nt, Staphylococcus aureus subsp. aureus Mu50
aagugcuugguuaaaguuaa

SEQ ID NO: 3977358 - RNA, 15 nt, Staphylococcus aureus subsp. aureus Mu50
aaguggcaaacauuu

SEQ ID NO: 3977359 - RNA, 20 nt, Staphylococcus aureus subsp. aureus Mu50
aagugguuguucccauuuuu

SEQ ID NO: 3977360 - RNA, 19 nt, Staphylococcus aureus subsp. aureus Mu50
aaguguagccaaauaaauu

SEQ ID NO: 3977361 - RNA, 15 nt, Staphylococcus aureus subsp. aureus Mu50
aaguguuaaugucuu

SEQ ID NO: 3977362 - RNA, 13 nt, Staphylococcus aureus subsp. aureus Mu50
aaguguuauaaau

SEQ ID NO: 3977363 - RNA, 16 nt, Staphylococcus aureus subsp. aureus Mu50
aaguguugaggcguuu

SEQ ID NO: 3977364 - RNA, 12 nt, Staphylococcus aureus subsp. aureus Mu50
aaguguuucaac

SEQ ID NO: 3977365 - RNA, 15 nt, Staphylococcus aureus subsp. aureus Mu50
aaguguuucaacaua

SEQ ID NO: 3977366 - RNA, 20 nt, Staphylococcus aureus subsp. aureus Mu50
aaguguuucaacauauuaua

SEQ ID NO: 3977367 - RNA, 19 nt, Staphylococcus aureus subsp. aureus Mu50
aaguuaaaaccuuuucaaa

SEQ ID NO: 3977368 - RNA, 23 nt, Staphylococcus aureus subsp. aureus Mu50
aaguuaaaaccuuuucaaauuau

SEQ ID NO: 3977369 - RNA, 19 nt, Staphylococcus aureus subsp. aureus Mu50
aaguuaaaauugguuugga

SEQ ID NO: 3977370 - RNA, 13 nt, Staphylococcus aureus subsp. aureus Mu50
aaguuaagucgcc

SEQ ID NO: 3977371 - RNA, 17 nt, Staphylococcus aureus subsp. aureus Mu50
aaguuaauaaacgcuuc

SEQ ID NO: 3977372 - RNA, 20 nt, Staphylococcus aureus subsp. aureus Mu50
aaguuaaucagaaaagcagu

SEQ ID NO: 3977373 - RNA, 21 nt, Staphylococcus aureus subsp. aureus Mu50
aaguuaaugcacugcuaauau

SEQ ID NO: 3977374 - RNA, 14 nt, Staphylococcus aureus subsp. aureus Mu50
aaguuaauuaugua

SEQ ID NO: 3977375 - RNA, 17 nt, Staphylococcus aureus subsp. aureus Mu50
aaguuaauuauguauuu

SEQ ID NO: 3977376 - RNA, 19 nt, Staphylococcus aureus subsp. aureus Mu50
aaguuagacuaaaaaacua

SEQ ID NO: 3977377 - RNA, 18 nt, Staphylococcus aureus subsp. aureus Mu50
aaguuaggcgacuuaacu

SEQ ID NO: 3977378 - RNA, 17 nt, Staphylococcus aureus subsp. aureus Mu50
aaguuauaaauuauauu

SEQ ID NO: 3977379 - RNA, 17 nt, Staphylococcus aureus subsp. aureus Mu50
aaguuauaucaucaaca

SEQ ID NO: 3977380 - RNA, 22 nt, Staphylococcus aureus subsp. aureus Mu50
aaguuauaucaucaacaaucuu

SEQ ID NO: 3977381 - RNA, 18 nt, Staphylococcus aureus subsp. aureus Mu50
aaguuaucaaauugaccg

SEQ ID NO: 3977382 - RNA, 22 nt, Staphylococcus aureus subsp. aureus Mu50
aaguuaucggcuaaaguuauaa

SEQ ID NO: 3977383 - RNA, 19 nt, Staphylococcus aureus subsp. aureus Mu50
aaguuaucugcuuuucuau

SEQ ID NO: 3977384 - RNA, 16 nt, Staphylococcus aureus subsp. aureus Mu50
aaguuauuuauucagc

SEQ ID NO: 3977385 - RNA, 19 nt, Staphylococcus aureus subsp. aureus Mu50
aaguucaaccauaugacuu

SEQ ID NO: 3977386 - RNA, 22 nt, Staphylococcus aureus subsp. aureus Mu50
aaguucaucuggugcaauauua

SEQ ID NO: 3977387 - RNA, 13 nt, Staphylococcus aureus subsp. aureus Mu50
aaguucuagauua

SEQ ID NO: 3977388 - RNA, 15 nt, Staphylococcus aureus subsp. aureus Mu50
aaguucuagauuauu

SEQ ID NO: 3977389 - RNA, 14 nt, Staphylococcus aureus subsp. aureus Mu50
aaguucuuuuguaa

SEQ ID NO: 3977390 - RNA, 15 nt, Staphylococcus aureus subsp. aureus Mu50
aaguugaauauaaaa

SEQ ID NO: 3977391 - RNA, 18 nt, Staphylococcus aureus subsp. aureus Mu50
aaguugaauauaaaaaag

SEQ ID NO: 3977392 - RNA, 15 nt, Staphylococcus aureus subsp. aureus Mu50
aaguugacaauacaa

SEQ ID NO: 3977393 - RNA, 18 nt, Staphylococcus aureus subsp. aureus Mu50
aaguugacaauacaaauc

SEQ ID NO: 3977394 - RNA, 13 nt, Staphylococcus aureus subsp. aureus Mu50
aaguugauuaaaa

SEQ ID NO: 3977395 - RNA, 20 nt, Staphylococcus aureus subsp. aureus Mu50
aaguugcacuugguucauaa

SEQ ID NO: 3977396 - RNA, 15 nt, Staphylococcus aureus subsp. aureus Mu50
aaguugcauauaaaa

SEQ ID NO: 3977397 - RNA, 16 nt, Staphylococcus aureus subsp. aureus Mu50
aaguugcugaauaaaa

SEQ ID NO: 3977398 - RNA, 18 nt, Staphylococcus aureus subsp. aureus Mu50
aaguugcugaauaaaaua

SEQ ID NO: 3977399 - RNA, 18 nt, Staphylococcus aureus subsp. aureus Mu50
aaguuggcuggcccccaa

SEQ ID NO: 3977400 - RNA, 21 nt, Staphylococcus aureus subsp. aureus Mu50
aaguuggggaugggccccaac

SEQ ID NO: 3977401 - RNA, 18 nt, Staphylococcus aureus subsp. aureus Mu50
aaguugguccaaaucgug

SEQ ID NO: 3977402 - RNA, 19 nt, Staphylococcus aureus subsp. aureus Mu50
aaguuguaauuuaaaauag

SEQ ID NO: 3977403 - RNA, 15 nt, Staphylococcus aureus subsp. aureus Mu50
aaguugucaucuaau

SEQ ID NO: 3977404 - RNA, 19 nt, Staphylococcus aureus subsp. aureus Mu50
aaguugucaucuaauuaca

SEQ ID NO: 3977405 - RNA, 19 nt, Staphylococcus aureus subsp. aureus Mu50
aaguuguugaaauuucugu

SEQ ID NO: 3977406 - RNA, 13 nt, Staphylococcus aureus subsp. aureus Mu50
aaguuuaaaauac

SEQ ID NO: 3977407 - RNA, 14 nt, Staphylococcus aureus subsp. aureus Mu50
aaguuuaaaauacg

SEQ ID NO: 3977408 - RNA, 18 nt, Staphylococcus aureus subsp. aureus Mu50
aaguuuaaucguauuagc

SEQ ID NO: 3977409 - RNA, 23 nt, Staphylococcus aureus subsp. aureus Mu50
aaguuuaaucguauuagccaaua

SEQ ID NO: 3977410 - RNA, 19 nt, Staphylococcus aureus subsp. aureus Mu50
aaguuuacagguugaauaa

SEQ ID NO: 3977411 - RNA, 18 nt, Staphylococcus aureus subsp. aureus Mu50
aaguuuauacuuaauaua

SEQ ID NO: 3977412 - RNA, 14 nt, Staphylococcus aureus subsp. aureus Mu50
aaguuuauuuaugu

SEQ ID NO: 3977413 - RNA, 23 nt, Staphylococcus aureus subsp. aureus Mu50
aaguuuccaacguuauucguuaa

SEQ ID NO: 3977414 - RNA, 13 nt, Staphylococcus aureus subsp. aureus Mu50
aaguuuccuaucu

SEQ ID NO: 3977415 - RNA, 19 nt, Staphylococcus aureus subsp. aureus Mu50
aauaagcgcaauuaaaagu

SEQ ID NO: 3977416 - RNA, 20 nt, Staphylococcus aureus subsp. aureus Mu50
aauaagcgcaauuaaaagua

SEQ ID NO: 3977417 - RNA, 17 nt, Staphylococcus aureus subsp. aureus Mu50
aauaagcguaaaaucau

SEQ ID NO: 3977418 - RNA, 13 nt, Staphylococcus aureus subsp. aureus Mu50
aauaagcuacuaa

SEQ ID NO: 3977419 - RNA, 19 nt, Staphylococcus aureus subsp. aureus Mu50
aauaagcuuguaacaagca

SEQ ID NO: 3977420 - RNA, 20 nt, Staphylococcus aureus subsp. aureus Mu50
aauaaggaagcguaugaugu

SEQ ID NO: 3977421 - RNA, 21 nt, Staphylococcus aureus subsp. aureus Mu50
aauaagguauggcuagucuuu

SEQ ID NO: 3977422 - RNA, 15 nt, Staphylococcus aureus subsp. aureus Mu50
aauaaguaauaauuu

SEQ ID NO: 3977423 - RNA, 20 nt, Staphylococcus aureus subsp. aureus Mu50
aauaaguaauaauuuauuga

SEQ ID NO: 3977424 - RNA, 13 nt, Staphylococcus aureus subsp. aureus Mu50
aauaagugauaaa

SEQ ID NO: 3977425 - RNA, 15 nt, Staphylococcus aureus subsp. aureus Mu50
aauaagugauaaaua

SEQ ID NO: 3977426 - RNA, 15 nt, Staphylococcus aureus subsp. aureus Mu50
aauaagugguuguuc

SEQ ID NO: 3977427 - RNA, 14 nt, Staphylococcus aureus subsp. aureus Mu50
aauaaguuaaugug

SEQ ID NO: 3977428 - RNA, 19 nt, Staphylococcus aureus subsp. aureus Mu50
aauaaguugaauauaaaaa

SEQ ID NO: 3977429 - RNA, 23 nt, Staphylococcus aureus subsp. aureus Mu50
aauaaguugaauauaaaaaagau

SEQ ID NO: 3977430 - RNA, 18 nt, Staphylococcus aureus subsp. aureus Mu50
aauaaguugucaucuaau

SEQ ID NO: 3977431 - RNA, 19 nt, Staphylococcus aureus subsp. aureus Mu50
aauaaguugucaucuaauu

SEQ ID NO: 3977432 - RNA, 15 nt, Staphylococcus aureus subsp. aureus Mu50
aauaauaaguugaau

SEQ ID NO: 3977433 - RNA, 14 nt, Staphylococcus aureus subsp. aureus Mu50
aauaauaaucuuua

SEQ ID NO: 3977434 - RNA, 16 nt, Staphylococcus aureus subsp. aureus Mu50
aauaauaauugcuuua

SEQ ID NO: 3977435 - RNA, 17 nt, Staphylococcus aureus subsp. aureus Mu50
aauaauaccuucaauug

SEQ ID NO: 3977436 - RNA, 15 nt, Staphylococcus aureus subsp. aureus Mu50
aauaauacgcuugau

SEQ ID NO: 3977437 - RNA, 14 nt, Staphylococcus aureus subsp. aureus Mu50
aauaauacuacaua

SEQ ID NO: 3977438 - RNA, 18 nt, Staphylococcus aureus subsp. aureus Mu50
aauaauacuacauauaau

SEQ ID NO: 3977439 - RNA, 14 nt, Staphylococcus aureus subsp. aureus Mu50
aauaauagauaaua

SEQ ID NO: 3977440 - RNA, 18 nt, Staphylococcus aureus subsp. aureus Mu50
aauaauagcaguuucuga

SEQ ID NO: 3977441 - RNA, 22 nt, Staphylococcus aureus subsp. aureus Mu50
aauaauaggauaccacaucgca

SEQ ID NO: 3977442 - RNA, 19 nt, Staphylococcus aureus subsp. aureus Mu50
aauaauauaaaaacaaaag

SEQ ID NO: 3977443 - RNA, 12 nt, Staphylococcus aureus subsp. aureus Mu50
aauaauauauuu

SEQ ID NO: 3977444 - RNA, 14 nt, Staphylococcus aureus subsp. aureus Mu50
aauaauauauuuag

SEQ ID NO: 3977445 - RNA, 16 nt, Staphylococcus aureus subsp. aureus Mu50
aauaauaucaccuuuu

SEQ ID NO: 3977446 - RNA, 23 nt, Staphylococcus aureus subsp. aureus Mu50
aauaauaucaccuuuuuuaagau

SEQ ID NO: 3977447 - RNA, 13 nt, Staphylococcus aureus subsp. aureus Mu50
aauaauaugaauu

SEQ ID NO: 3977448 - RNA, 19 nt, Staphylococcus aureus subsp. aureus Mu50
aauaauaugccauaguaau

SEQ ID NO: 3977449 - RNA, 14 nt, Staphylococcus aureus subsp. aureus Mu50
aauaauauugaaug

SEQ ID NO: 3977450 - RNA, 12 nt, Staphylococcus aureus subsp. aureus Mu50
aauaaucaaacc

SEQ ID NO: 3977451 - RNA, 17 nt, Staphylococcus aureus subsp. aureus Mu50
aauaaucaaaccaccaa

SEQ ID NO: 3977452 - RNA, 15 nt, Staphylococcus aureus subsp. aureus Mu50
aauaaucauccauau

SEQ ID NO: 3977453 - RNA, 17 nt, Staphylococcus aureus subsp. aureus Mu50
aauaaucauccauauau

SEQ ID NO: 3977454 - RNA, 15 nt, Staphylococcus aureus subsp. aureus Mu50
aauaauccaagauau

SEQ ID NO: 3977455 - RNA, 18 nt, Staphylococcus aureus subsp. aureus Mu50
aauaauccgagucauacu

SEQ ID NO: 3977456 - RNA, 15 nt, Staphylococcus aureus subsp. aureus Mu50
aauaaucgaacagaa

SEQ ID NO: 3977457 - RNA, 18 nt, Staphylococcus aureus subsp. aureus Mu50
aauaaucgaacagaaaau

SEQ ID NO: 3977458 - RNA, 16 nt, Staphylococcus aureus subsp. aureus Mu50
aauaaucggacugaug

SEQ ID NO: 3977459 - RNA, 19 nt, Staphylococcus aureus subsp. aureus Mu50
aauaaucggacugauggaa

SEQ ID NO: 3977460 - RNA, 20 nt, Staphylococcus aureus subsp. aureus Mu50
aauaaucgguaauuacuugu

SEQ ID NO: 3977461 - RNA, 21 nt, Staphylococcus aureus subsp. aureus Mu50
aauaaucgguaauuacuugua

SEQ ID NO: 3977462 - RNA, 21 nt, Staphylococcus aureus subsp. aureus Mu50
aauaaucguaaacacuauaaa

SEQ ID NO: 3977463 - RNA, 14 nt, Staphylococcus aureus subsp. aureus Mu50
aauaaugacaaauu

SEQ ID NO: 3977464 - RNA, 15 nt, Staphylococcus aureus subsp. aureus Mu50
aauaaugacaaauua

SEQ ID NO: 3977465 - RNA, 19 nt, Staphylococcus aureus subsp. aureus Mu50
aauaaugacugacacuuua

SEQ ID NO: 3977466 - RNA, 15 nt, Staphylococcus aureus subsp. aureus Mu50
aauaaugauauauua

SEQ ID NO: 3977467 - RNA, 18 nt, Staphylococcus aureus subsp. aureus Mu50
aauaauguacacuuuuga

SEQ ID NO: 3977468 - RNA, 15 nt, Staphylococcus aureus subsp. aureus Mu50
aauaaugugaaaaau

SEQ ID NO: 3977469 - RNA, 18 nt, Staphylococcus aureus subsp. aureus Mu50
aauaaugugaaaaaucuu

SEQ ID NO: 3977470 - RNA, 17 nt, Staphylococcus aureus subsp. aureus Mu50
aauaaugugucaaauag

SEQ ID NO: 3977471 - RNA, 17 nt, Staphylococcus aureus subsp. aureus Mu50
aauaauguuuccauuua

SEQ ID NO: 3977472 - RNA, 23 nt, Staphylococcus aureus subsp. aureus Mu50
aauaauguuuccugauauuucaa

SEQ ID NO: 3977473 - RNA, 12 nt, Staphylococcus aureus subsp. aureus Mu50
aauaauuaaaua

SEQ ID NO: 3977474 - RNA, 16 nt, Staphylococcus aureus subsp. aureus Mu50
aauaauuaaauaaaaa

SEQ ID NO: 3977475 - RNA, 20 nt, Staphylococcus aureus subsp. aureus Mu50
aauaauuaaauaaaaauauu

SEQ ID NO: 3977476 - RNA, 23 nt, Staphylococcus aureus subsp. aureus Mu50
aauaauuagauuuaaaaugucau

SEQ ID NO: 3977477 - RNA, 18 nt, Staphylococcus aureus subsp. aureus Mu50
aauaauucauaaaugcuu

SEQ ID NO: 3977478 - RNA, 16 nt, Staphylococcus aureus subsp. aureus Mu50
aauaauuccaguauua

SEQ ID NO: 3977479 - RNA, 14 nt, Staphylococcus aureus subsp. aureus Mu50
aauaauugaugaaa

SEQ ID NO: 3977480 - RNA, 13 nt, Staphylococcus aureus subsp. aureus Mu50
aauaauugcuaaa

SEQ ID NO: 3977481 - RNA, 16 nt, Staphylococcus aureus subsp. aureus Mu50
aauaauugcuaaaaua

SEQ ID NO: 3977482 - RNA, 17 nt, Staphylococcus aureus subsp. aureus Mu50
aauaauuggcugaugaa

SEQ ID NO: 3977483 - RNA, 22 nt, Staphylococcus aureus subsp. aureus Mu50
aauaauuguucuucagaaacuu

SEQ ID NO: 3977484 - RNA, 13 nt, Staphylococcus aureus subsp. aureus Mu50
aauaauuuaaagg

SEQ ID NO: 3977485 - RNA, 22 nt, Staphylococcus aureus subsp. aureus Mu50
aauaauuucaguucuuagauuu

SEQ ID NO: 3977486 - RNA, 16 nt, Staphylococcus aureus subsp. aureus Mu50
aauaauuuuaucuaaa

SEQ ID NO: 3977487 - RNA, 18 nt, Staphylococcus aureus subsp. aureus Mu50
aauaauuuuuuuccuuuc

SEQ ID NO: 3977488 - RNA, 23 nt, Staphylococcus aureus subsp. aureus Mu50
aauaauuuuuuuccuuucuuuuu

SEQ ID NO: 3977489 - RNA, 14 nt, Staphylococcus aureus subsp. aureus Mu50
aauacaaagaauua

SEQ ID NO: 3977490 - RNA, 16 nt, Staphylococcus aureus subsp. aureus Mu50
aauacaaauauaucua

SEQ ID NO: 3977491 - RNA, 15 nt, Staphylococcus aureus subsp. aureus Mu50
aauacaaauauuaag

SEQ ID NO: 3977492 - RNA, 19 nt, Staphylococcus aureus subsp. aureus Mu50
aauacaaauuacaauaagc

SEQ ID NO: 3977493 - RNA, 14 nt, Staphylococcus aureus subsp. aureus Mu50
aauacaagucuuua

SEQ ID NO: 3977494 - RNA, 16 nt, Staphylococcus aureus subsp. aureus Mu50
aauacaagucuuuacu

SEQ ID NO: 3977495 - RNA, 21 nt, Staphylococcus aureus subsp. aureus Mu50
aauacaagucuuuacucuaca

SEQ ID NO: 3977496 - RNA, 15 nt, Staphylococcus aureus subsp. aureus Mu50
aauacaaugaauugu

SEQ ID NO: 3977497 - RNA, 19 nt, Staphylococcus aureus subsp. aureus Mu50
aauacaauuucuucauuuu

SEQ ID NO: 3977498 - RNA, 20 nt, Staphylococcus aureus subsp. aureus Mu50
aauacaauuucuucauuuuc

SEQ ID NO: 3977499 - RNA, 20 nt, Staphylococcus aureus subsp. aureus Mu50
aauacacgacgcuaaacaaa

SEQ ID NO: 3977500 - RNA, 21 nt, Staphylococcus aureus subsp. aureus Mu50
aauacacgaucaguugaguca

SEQ ID NO: 3977501 - RNA, 12 nt, Staphylococcus aureus subsp. aureus Mu50
aauacacuugau

SEQ ID NO: 3977502 - RNA, 16 nt, Staphylococcus aureus subsp. aureus Mu50
aauacacuugauaaaa

SEQ ID NO: 3977503 - RNA, 21 nt, Staphylococcus aureus subsp. aureus Mu50
aauagaacgaaauaguucaaa

SEQ ID NO: 3977504 - RNA, 19 nt, Staphylococcus aureus subsp. aureus Mu50
aauagacugccaauaaaau

SEQ ID NO: 3977505 - RNA, 22 nt, Staphylococcus aureus subsp. aureus Mu50
aauagacugucucguuuuuuga

SEQ ID NO: 3977506 - RNA, 14 nt, Staphylococcus aureus subsp. aureus Mu50
aauagagaaagaau

SEQ ID NO: 3977507 - RNA, 16 nt, Staphylococcus aureus subsp. aureus Mu50
aauagagaaagaauaa

SEQ ID NO: 3977508 - RNA, 16 nt, Staphylococcus aureus subsp. aureus Mu50
aauagagaacuugcuu

SEQ ID NO: 3977509 - RNA, 23 nt, Staphylococcus aureus subsp. aureus Mu50
aauagagacauuuuaucugaaaa

SEQ ID NO: 3977510 - RNA, 15 nt, Staphylococcus aureus subsp. aureus Mu50
aauagauaauauaua

SEQ ID NO: 3977511 - RNA, 16 nt, Staphylococcus aureus subsp. aureus Mu50
aauagauaaugcaccu

SEQ ID NO: 3977512 - RNA, 21 nt, Staphylococcus aureus subsp. aureus Mu50
aauagaugucacuguuaaaga

SEQ ID NO: 3977513 - RNA, 16 nt, Staphylococcus aureus subsp. aureus Mu50
aauagauugaaaaaau

SEQ ID NO: 3977514 - RNA, 13 nt, Staphylococcus aureus subsp. aureus Mu50
aauagcaaaauua

SEQ ID NO: 3977515 - RNA, 22 nt, Staphylococcus aureus subsp. aureus Mu50
aauagcagggugcuaaauuuac

SEQ ID NO: 3977516 - RNA, 15 nt, Staphylococcus aureus subsp. aureus Mu50
aauagcaguuucuga

SEQ ID NO: 3977517 - RNA, 20 nt, Staphylococcus aureus subsp. aureus Mu50
aauagcauuuguaaacagua

SEQ ID NO: 3977518 - RNA, 19 nt, Staphylococcus aureus subsp. aureus Mu50
aauagccauucgaugcuaa

SEQ ID NO: 3977519 - RNA, 21 nt, Staphylococcus aureus subsp. aureus Mu50
aauagcgauuuuaaagaaaag

SEQ ID NO: 3977520 - RNA, 14 nt, Staphylococcus aureus subsp. aureus Mu50
aauagcuacaauua

SEQ ID NO: 3977521 - RNA, 17 nt, Staphylococcus aureus subsp. aureus Mu50
aauagcuauauuuaaaa

SEQ ID NO: 3977522 - RNA, 23 nt, Staphylococcus aureus subsp. aureus Mu50
aauagcuauauuuuuguauuuau

SEQ ID NO: 3977523 - RNA, 12 nt, Staphylococcus aureus subsp. aureus Mu50
aauagcugcaau

SEQ ID NO: 3977524 - RNA, 13 nt, Staphylococcus aureus subsp. aureus Mu50
aauaggaauacca

SEQ ID NO: 3977525 - RNA, 13 nt, Staphylococcus aureus subsp. aureus Mu50
aauaggauaugcu

SEQ ID NO: 3977526 - RNA, 13 nt, Staphylococcus aureus subsp. aureus Mu50
aauaggauuauua

SEQ ID NO: 3977527 - RNA, 15 nt, Staphylococcus aureus subsp. aureus Mu50
aauaggcaggaauga

SEQ ID NO: 3977528 - RNA, 21 nt, Staphylococcus aureus subsp. aureus Mu50
aauaggcgcuuguaaaauuuu

SEQ ID NO: 3977529 - RNA, 14 nt, Staphylococcus aureus subsp. aureus Mu50
aauaggucgcugug

SEQ ID NO: 3977530 - RNA, 16 nt, Staphylococcus aureus subsp. aureus Mu50
aauagguuauuugaua

SEQ ID NO: 3977531 - RNA, 15 nt, Staphylococcus aureus subsp. aureus Mu50
aauaguaaagugaaa

SEQ ID NO: 3977532 - RNA, 17 nt, Staphylococcus aureus subsp. aureus Mu50
aauaguaaagugaaaua

SEQ ID NO: 3977533 - RNA, 18 nt, Staphylococcus aureus subsp. aureus Mu50
aauaguaaagugaaauaa

SEQ ID NO: 3977534 - RNA, 17 nt, Staphylococcus aureus subsp. aureus Mu50
aauaguaaugaugugaa

SEQ ID NO: 3977535 - RNA, 20 nt, Staphylococcus aureus subsp. aureus Mu50
aauaguagccuagauaccaa

SEQ ID NO: 3977536 - RNA, 12 nt, Staphylococcus aureus subsp. aureus Mu50
aauagugugcaa

SEQ ID NO: 3977537 - RNA, 19 nt, Staphylococcus aureus subsp. aureus Mu50
aauaguuaaaguagaaccu

SEQ ID NO: 3977538 - RNA, 15 nt, Staphylococcus aureus subsp. aureus Mu50
aauaguuaacgauag

SEQ ID NO: 3977539 - RNA, 15 nt, Staphylococcus aureus subsp. aureus Mu50
aauaguuaagauuuu

SEQ ID NO: 3977540 - RNA, 19 nt, Staphylococcus aureus subsp. aureus Mu50
aauaguuaagauuuuaacu

SEQ ID NO: 3977541 - RNA, 17 nt, Staphylococcus aureus subsp. aureus Mu50
aauaguuaccaaaauuu

SEQ ID NO: 3977542 - RNA, 19 nt, Staphylococcus aureus subsp. aureus Mu50
aauaguuuucuucacugcu

SEQ ID NO: 3977543 - RNA, 13 nt, Staphylococcus aureus subsp. aureus Mu50
aauauaaaaaaga

SEQ ID NO: 3977544 - RNA, 14 nt, Staphylococcus aureus subsp. aureus Mu50
aauauaaaaaagau

SEQ ID NO: 3977545 - RNA, 16 nt, Staphylococcus aureus subsp. aureus Mu50
aauauaaaaacaaaag

SEQ ID NO: 3977546 - RNA, 19 nt, Staphylococcus aureus subsp. aureus Mu50
aauauaaaacgauaagaau

SEQ ID NO: 3977547 - RNA, 18 nt, Staphylococcus aureus subsp. aureus Mu50
aauauaaaaggaagcauc

SEQ ID NO: 3977548 - RNA, 13 nt, Staphylococcus aureus subsp. aureus Mu50
aauauaaauaaaa

SEQ ID NO: 3977549 - RNA, 14 nt, Staphylococcus aureus subsp. aureus Mu50
aauauaaauaugaa

SEQ ID NO: 3977550 - RNA, 14 nt, Staphylococcus aureus subsp. aureus Mu50
aauauaaauuuuga

SEQ ID NO: 3977551 - RNA, 13 nt, Staphylococcus aureus subsp. aureus Mu50
aauauaacaucaa

SEQ ID NO: 3977552 - RNA, 14 nt, Staphylococcus aureus subsp. aureus Mu50
aauauaacaucaaa

SEQ ID NO: 3977553 - RNA, 17 nt, Staphylococcus aureus subsp. aureus Mu50
aauauaacaucaaauag

SEQ ID NO: 3977554 - RNA, 18 nt, Staphylococcus aureus subsp. aureus Mu50
aauauaacaucaaauaga

SEQ ID NO: 3977555 - RNA, 18 nt, Staphylococcus aureus subsp. aureus Mu50
aauauaaccgugaugaug

SEQ ID NO: 3977556 - RNA, 17 nt, Staphylococcus aureus subsp. aureus Mu50
aauauaacgacacuuuu

SEQ ID NO: 3977557 - RNA, 19 nt, Staphylococcus aureus subsp. aureus Mu50
aauauaacugcauguacau

SEQ ID NO: 3977558 - RNA, 20 nt, Staphylococcus aureus subsp. aureus Mu50
aauauaacugcauguacauc

SEQ ID NO: 3977559 - RNA, 19 nt, Staphylococcus aureus subsp. aureus Mu50
aauauaacuucuauuaaga

SEQ ID NO: 3977560 - RNA, 18 nt, Staphylococcus aureus subsp. aureus Mu50
aauauaauagaaauaauc

SEQ ID NO: 3977561 - RNA, 13 nt, Staphylococcus aureus subsp. aureus Mu50
aauauaaugaucc

SEQ ID NO: 3977562 - RNA, 20 nt, Staphylococcus aureus subsp. aureus Mu50
aauauaauguauaaaacaga

SEQ ID NO: 3977563 - RNA, 23 nt, Staphylococcus aureus subsp. aureus Mu50
aauauaauuaaacauuuagauuu

SEQ ID NO: 3977564 - RNA, 18 nt, Staphylococcus aureus subsp. aureus Mu50
aauauaauuaauuuugua

SEQ ID NO: 3977565 - RNA, 13 nt, Staphylococcus aureus subsp. aureus Mu50
aauauaauuauua

SEQ ID NO: 3977566 - RNA, 19 nt, Staphylococcus aureus subsp. aureus Mu50
aauauaauuugguuaauac

SEQ ID NO: 3977567 - RNA, 13 nt, Staphylococcus aureus subsp. aureus Mu50
aauauaauuuuuu

SEQ ID NO: 3977568 - RNA, 14 nt, Staphylococcus aureus subsp. aureus Mu50
aauauaccaaccaa

SEQ ID NO: 3977569 - RNA, 15 nt, Staphylococcus aureus subsp. aureus Mu50
aauauaccaaccaaa

SEQ ID NO: 3977570 - RNA, 17 nt, Staphylococcus aureus subsp. aureus Mu50
aauauacuuaauuuaaa

SEQ ID NO: 3977571 - RNA, 20 nt, Staphylococcus aureus subsp. aureus Mu50
aauauacuuaauuuaaaucu

SEQ ID NO: 3977572 - RNA, 22 nt, Staphylococcus aureus subsp. aureus Mu50
aauauacuugaagcaucgauuu

SEQ ID NO: 3977573 - RNA, 11 nt, Staphylococcus aureus subsp. aureus Mu50
aauauacuuuu

SEQ ID NO: 3977574 - RNA, 19 nt, Staphylococcus aureus subsp. aureus Mu50
aauauacuuuuuaaaugau

SEQ ID NO: 3977575 - RNA, 23 nt, Staphylococcus aureus subsp. aureus Mu50
aauauacuuuuuaaaugauuuaa

SEQ ID NO: 3977576 - RNA, 17 nt, Staphylococcus aureus subsp. aureus Mu50
aauauagaaaaugagua

SEQ ID NO: 3977577 - RNA, 20 nt, Staphylococcus aureus subsp. aureus Mu50
aauauagaagugcgguuuaa

SEQ ID NO: 3977578 - RNA, 14 nt, Staphylococcus aureus subsp. aureus Mu50
aauauagauuugaa

SEQ ID NO: 3977579 - RNA, 21 nt, Staphylococcus aureus subsp. aureus Mu50
aauauagauuugaauuaaagu

SEQ ID NO: 3977580 - RNA, 15 nt, Staphylococcus aureus subsp. aureus Mu50
aauauagauuuugua

SEQ ID NO: 3977581 - RNA, 22 nt, Staphylococcus aureus subsp. aureus Mu50
aauauagauuuuguauuagcau

SEQ ID NO: 3977582 - RNA, 22 nt, Staphylococcus aureus subsp. aureus Mu50
aauauagcuauuacuauaaaaa

SEQ ID NO: 3977583 - RNA, 16 nt, Staphylococcus aureus subsp. aureus Mu50
aauauaguuaaaguua

SEQ ID NO: 3977584 - RNA, 22 nt, Staphylococcus aureus subsp. aureus Mu50
aauauauaaggcgcucucuuuu

SEQ ID NO: 3977585 - RNA, 16 nt, Staphylococcus aureus subsp. aureus Mu50
aauauauccugccaau

SEQ ID NO: 3977586 - RNA, 21 nt, Staphylococcus aureus subsp. aureus Mu50
aauauauccugccaauauauu

SEQ ID NO: 3977587 - RNA, 23 nt, Staphylococcus aureus subsp. aureus Mu50
aauauauccugccaauauauuca

SEQ ID NO: 3977588 - RNA, 21 nt, Staphylococcus aureus subsp. aureus Mu50
aauauaucuagccugaaauag

SEQ ID NO: 3977589 - RNA, 13 nt, Staphylococcus aureus subsp. aureus Mu50
aauauauguauaa

SEQ ID NO: 3977590 - RNA, 13 nt, Staphylococcus aureus subsp. aureus Mu50
aauauauuaacaa

SEQ ID NO: 3977591 - RNA, 19 nt, Staphylococcus aureus subsp. aureus Mu50
aauauuugaacgagcaccu

SEQ ID NO: 3977592 - RNA, 22 nt, Staphylococcus aureus subsp. aureus Mu50
aauauuugaacgagcaccuuuu

SEQ ID NO: 3977593 - RNA, 17 nt, Staphylococcus aureus subsp. aureus Mu50
aauauuuuacaaaauau

SEQ ID NO: 3977594 - RNA, 13 nt, Staphylococcus aureus subsp. aureus Mu50
aauauuuuaucug

SEQ ID NO: 3977595 - RNA, 18 nt, Staphylococcus aureus subsp. aureus Mu50
aauauuuucauguccauc

SEQ ID NO: 3977596 - RNA, 22 nt, Staphylococcus aureus subsp. aureus Mu50
aauauuuucauguccaucuuuu

SEQ ID NO: 3977597 - RNA, 20 nt, Staphylococcus aureus subsp. aureus Mu50
aauauuuuuacauauuuaua

SEQ ID NO: 3977598 - RNA, 15 nt, Staphylococcus aureus subsp. aureus Mu50
aauauuuuucaauua

SEQ ID NO: 3977599 - RNA, 23 nt, Staphylococcus aureus subsp. aureus Mu50
aauauuuuucaauuaaauguuua

SEQ ID NO: 3977600 - RNA, 23 nt, Staphylococcus aureus subsp. aureus Mu50
aauauuuuuguugcaauugccuu

SEQ ID NO: 3977601 - RNA, 16 nt, Staphylococcus aureus subsp. aureus Mu50
aauauuuuuuaaaaug

SEQ ID NO: 3977602 - RNA, 17 nt, Staphylococcus aureus subsp. aureus Mu50
aauauuuuuuaaaauga

SEQ ID NO: 3977603 - RNA, 23 nt, Staphylococcus aureus subsp. aureus Mu50
aaucaaaaauaauuaugaaaagu

SEQ ID NO: 3977604 - RNA, 22 nt, Staphylococcus aureus subsp. aureus Mu50
aaucaaagaaaaagugauaauu

SEQ ID NO: 3977605 - RNA, 21 nt, Staphylococcus aureus subsp. aureus Mu50
aaucaaagaggaacagcggaa

SEQ ID NO: 3977606 - RNA, 21 nt, Staphylococcus aureus subsp. aureus Mu50
aaucaaagaggcacagcggaa

SEQ ID NO: 3977607 - RNA, 21 nt, Staphylococcus aureus subsp. aureus Mu50
aaucaaagaggcuuuaaaauu

SEQ ID NO: 3977608 - RNA, 14 nt, Staphylococcus aureus subsp. aureus Mu50
aaucaaauacauca

SEQ ID NO: 3977609 - RNA, 17 nt, Staphylococcus aureus subsp. aureus Mu50
aaucaaauacaucaauu

SEQ ID NO: 3977610 - RNA, 16 nt, Staphylococcus aureus subsp. aureus Mu50
aaucaacaauuuaaac

SEQ ID NO: 3977611 - RNA, 12 nt, Staphylococcus aureus subsp. aureus Mu50
aaucaacaucau

SEQ ID NO: 3977612 - RNA, 21 nt, Staphylococcus aureus subsp. aureus Mu50
aaucaacaucaucuuuaauuu

SEQ ID NO: 3977613 - RNA, 14 nt, Staphylococcus aureus subsp. aureus Mu50
aaucaacccaucau

SEQ ID NO: 3977614 - RNA, 20 nt, Staphylococcus aureus subsp. aureus Mu50
aaucaacuuagaauuuacaa

SEQ ID NO: 3977615 - RNA, 22 nt, Staphylococcus aureus subsp. aureus Mu50
aaucaacuuagaauuuacaagu

SEQ ID NO: 3977616 - RNA, 15 nt, Staphylococcus aureus subsp. aureus Mu50
aaucaagaaauguua

SEQ ID NO: 3977617 - RNA, 12 nt, Staphylococcus aureus subsp. aureus Mu50
aaucaagaauau

SEQ ID NO: 3977618 - RNA, 13 nt, Staphylococcus aureus subsp. aureus Mu50
aaucaagcaaugc

SEQ ID NO: 3977619 - RNA, 19 nt, Staphylococcus aureus subsp. aureus Mu50
aaucaagcaaugcaugcuu

SEQ ID NO: 3977620 - RNA, 18 nt, Staphylococcus aureus subsp. aureus Mu50
aaucaagucugcauuaau

SEQ ID NO: 3977621 - RNA, 13 nt, Staphylococcus aureus subsp. aureus Mu50
aaucaauaccaac

SEQ ID NO: 3977622 - RNA, 17 nt, Staphylococcus aureus subsp. aureus Mu50
aaucaauccaucaauac

SEQ ID NO: 3977623 - RNA, 13 nt, Staphylococcus aureus subsp. aureus Mu50
aaucaauuauuga

SEQ ID NO: 3977624 - RNA, 13 nt, Staphylococcus aureus subsp. aureus Mu50
aaucacaauauaa

SEQ ID NO: 3977625 - RNA, 14 nt, Staphylococcus aureus subsp. aureus Mu50
aaucacaguuauau

SEQ ID NO: 3977626 - RNA, 14 nt, Staphylococcus aureus subsp. aureus Mu50
aaucacauaugaua

SEQ ID NO: 3977627 - RNA, 22 nt, Staphylococcus aureus subsp. aureus Mu50
aaucacauuaauuggauuaaau

SEQ ID NO: 3977628 - RNA, 23 nt, Staphylococcus aureus subsp. aureus Mu50
aaucaccaacaacuuuguuuuca

SEQ ID NO: 3977629 - RNA, 15 nt, Staphylococcus aureus subsp. aureus Mu50
aaucaccuuuggcua

SEQ ID NO: 3977630 - RNA, 17 nt, Staphylococcus aureus subsp. aureus Mu50
aaucaccuuuuuuaacu

SEQ ID NO: 3977631 - RNA, 15 nt, Staphylococcus aureus subsp. aureus Mu50
aaucacgauuuucaa

SEQ ID NO: 3977632 - RNA, 17 nt, Staphylococcus aureus subsp. aureus Mu50
aaucacgauuuucaagu

SEQ ID NO: 3977633 - RNA, 16 nt, Staphylococcus aureus subsp. aureus Mu50
aaucacgccauaaucu

SEQ ID NO: 3977634 - RNA, 14 nt, Staphylococcus aureus subsp. aureus Mu50
aaucacgcuaacau

SEQ ID NO: 3977635 - RNA, 15 nt, Staphylococcus aureus subsp. aureus Mu50
aaucacgcuaacauu

SEQ ID NO: 3977636 - RNA, 23 nt, Staphylococcus aureus subsp. aureus Mu50
aaucacuaucuguuguuauauaa

SEQ ID NO: 3977637 - RNA, 14 nt, Staphylococcus aureus subsp. aureus Mu50
aaucacugcuuuca

SEQ ID NO: 3977638 - RNA, 15 nt, Staphylococcus aureus subsp. aureus Mu50
aaucacugcuuucaa

SEQ ID NO: 3977639 - RNA, 21 nt, Staphylococcus aureus subsp. aureus Mu50
aaucacuuggcgacauuugua

SEQ ID NO: 3977640 - RNA, 23 nt, Staphylococcus aureus subsp. aureus Mu50
aaucacuuggcgacauuuguaaa

SEQ ID NO: 3977641 - RNA, 19 nt, Staphylococcus aureus subsp. aureus Mu50
aaucagaguagaaaguguu

SEQ ID NO: 3977642 - RNA, 16 nt, Staphylococcus aureus subsp. aureus Mu50
aaucagaugauuuaau

SEQ ID NO: 3977643 - RNA, 17 nt, Staphylococcus aureus subsp. aureus Mu50
aaucagaugauuuaauu

SEQ ID NO: 3977644 - RNA, 18 nt, Staphylococcus aureus subsp. aureus Mu50
aaucagaugauuuaauuc

SEQ ID NO: 3977645 - RNA, 17 nt, Staphylococcus aureus subsp. aureus Mu50
aaucagcuuuuucacau

SEQ ID NO: 3977646 - RNA, 19 nt, Staphylococcus aureus subsp. aureus Mu50
aaucagguuuaaacaguuu

SEQ ID NO: 3977647 - RNA, 14 nt, Staphylococcus aureus subsp. aureus Mu50
aaucaguaauaaug

SEQ ID NO: 3977648 - RNA, 15 nt, Staphylococcus aureus subsp. aureus Mu50
aaucaguauuuacuu

SEQ ID NO: 3977649 - RNA, 17 nt, Staphylococcus aureus subsp. aureus Mu50
aaucaguauuuacuuuu

SEQ ID NO: 3977650 - RNA, 16 nt, Staphylococcus aureus subsp. aureus Mu50
aaucagucauucacau

SEQ ID NO: 3977651 - RNA, 20 nt, Staphylococcus aureus subsp. aureus Mu50
aaucagugaaauaucaagau

SEQ ID NO: 3977652 - RNA, 18 nt, Staphylococcus aureus subsp. aureus Mu50
aaucaguuuuuaaaucaa

SEQ ID NO: 3977653 - RNA, 13 nt, Staphylococcus aureus subsp. aureus Mu50
aaucauaaugaau

SEQ ID NO: 3977654 - RNA, 14 nt, Staphylococcus aureus subsp. aureus Mu50
aaucauaaugaaua

SEQ ID NO: 3977655 - RNA, 18 nt, Staphylococcus aureus subsp. aureus Mu50
aaucauaccggcaaauaa

SEQ ID NO: 3977656 - RNA, 20 nt, Staphylococcus aureus subsp. aureus Mu50
aaucauaccggcaaauaaca

SEQ ID NO: 3977657 - RNA, 23 nt, Staphylococcus aureus subsp. aureus Mu50
aaucauaccggcaaauaacaaug

SEQ ID NO: 3977658 - RNA, 17 nt, Staphylococcus aureus subsp. aureus Mu50
aaucauacgagaaauua

SEQ ID NO: 3977659 - RNA, 20 nt, Staphylococcus aureus subsp. aureus Mu50
aaucauacgagaaauuagaa

SEQ ID NO: 3977660 - RNA, 12 nt, Staphylococcus aureus subsp. aureus Mu50
aaucauagauau

SEQ ID NO: 3977661 - RNA, 20 nt, Staphylococcus aureus subsp. aureus Mu50
aaucauagcaacaucggcac

SEQ ID NO: 3977662 - RNA, 16 nt, Staphylococcus aureus subsp. aureus Mu50
aaucauagcauuaaga

SEQ ID NO: 3977663 - RNA, 17 nt, Staphylococcus aureus subsp. aureus Mu50
aaucauagcauuaagau

SEQ ID NO: 3977664 - RNA, 16 nt, Staphylococcus aureus subsp. aureus Mu50
aaucaucauuaaaucu

SEQ ID NO: 3977665 - RNA, 14 nt, Staphylococcus aureus subsp. aureus Mu50
aaucauccauauau

SEQ ID NO: 3977666 - RNA, 19 nt, Staphylococcus aureus subsp. aureus Mu50
aaucaucgaacaugaauga

SEQ ID NO: 3977667 - RNA, 15 nt, Staphylococcus aureus subsp. aureus Mu50
aaucaucgcaaauac

SEQ ID NO: 3977668 - RNA, 16 nt, Staphylococcus aureus subsp. aureus Mu50
aaucaucgcaaauaca

SEQ ID NO: 3977669 - RNA, 14 nt, Staphylococcus aureus subsp. aureus Mu50
aaucaucuguuuua

SEQ ID NO: 3977670 - RNA, 21 nt, Staphylococcus aureus subsp. aureus Mu50
aaucaucuuaacaacuuuaau

SEQ ID NO: 3977671 - RNA, 15 nt, Staphylococcus aureus subsp. aureus Mu50
aaucaucuuuuugaa

SEQ ID NO: 3977672 - RNA, 17 nt, Staphylococcus aureus subsp. aureus Mu50
aaucaucuuuuugaaau

SEQ ID NO: 3977673 - RNA, 13 nt, Staphylococcus aureus subsp. aureus Mu50
aaucaugacauaa

SEQ ID NO: 3977674 - RNA, 15 nt, Staphylococcus aureus subsp. aureus Mu50
aaucaugacauaaaa

SEQ ID NO: 3977675 - RNA, 21 nt, Staphylococcus aureus subsp. aureus Mu50
aaucaugcucguuuuuauuca

SEQ ID NO: 3977676 - RNA, 15 nt, Staphylococcus aureus subsp. aureus Mu50
aaucauguaaugcuu

SEQ ID NO: 3977677 - RNA, 18 nt, Staphylococcus aureus subsp. aureus Mu50
aaucauguaaugcuuaaa

SEQ ID NO: 3977678 - RNA, 23 nt, Staphylococcus aureus subsp. aureus Mu50
aaucauguaaugcuuaaaaacaa

SEQ ID NO: 3977679 - RNA, 19 nt, Staphylococcus aureus subsp. aureus Mu50
aaucugcaacgauuuuaaa

SEQ ID NO: 3977680 - RNA, 21 nt, Staphylococcus aureus subsp. aureus Mu50
aaucugcuuuauuuuaucauc

SEQ ID NO: 3977681 - RNA, 20 nt, Staphylococcus aureus subsp. aureus Mu50
aaucuguacuucuaauuugc

SEQ ID NO: 3977682 - RNA, 14 nt, Staphylococcus aureus subsp. aureus Mu50
aaucuguucauaau

SEQ ID NO: 3977683 - RNA, 19 nt, Staphylococcus aureus subsp. aureus Mu50
aaucuguucauaauguaag

SEQ ID NO: 3977684 - RNA, 21 nt, Staphylococcus aureus subsp. aureus Mu50
aaucuuaaagauuuuucagcu

SEQ ID NO: 3977685 - RNA, 21 nt, Staphylococcus aureus subsp. aureus Mu50
aaucuuaaucgcucuaaauag

SEQ ID NO: 3977686 - RNA, 14 nt, Staphylococcus aureus subsp. aureus Mu50
aaucuuaauugucu

SEQ ID NO: 3977687 - RNA, 17 nt, Staphylococcus aureus subsp. aureus Mu50
aaucuuaguacaaaauu

SEQ ID NO: 3977688 - RNA, 13 nt, Staphylococcus aureus subsp. aureus Mu50
aaucuuaguuaaa

SEQ ID NO: 3977689 - RNA, 15 nt, Staphylococcus aureus subsp. aureus Mu50
aaucuuaguuaaaau

SEQ ID NO: 3977690 - RNA, 16 nt, Staphylococcus aureus subsp. aureus Mu50
aaucuuaguuaaaauu

SEQ ID NO: 3977691 - RNA, 18 nt, Staphylococcus aureus subsp. aureus Mu50
aaucuuaguuaaaauuca

SEQ ID NO: 3977692 - RNA, 17 nt, Staphylococcus aureus subsp. aureus Mu50
aaucuuaucauaaucuu

SEQ ID NO: 3977693 - RNA, 21 nt, Staphylococcus aureus subsp. aureus Mu50
aaucuuaugaugucauguauu

SEQ ID NO: 3977694 - RNA, 22 nt, Staphylococcus aureus subsp. aureus Mu50
aaucuuauuuuguuuuaaaaaa

SEQ ID NO: 3977695 - RNA, 23 nt, Staphylococcus aureus subsp. aureus Mu50
aaucuuauuuuguuuuaaaaaac

SEQ ID NO: 3977696 - RNA, 12 nt, Staphylococcus aureus subsp. aureus Mu50
aaucuucgucau

SEQ ID NO: 3977697 - RNA, 17 nt, Staphylococcus aureus subsp. aureus Mu50
aaucuucuaguaauucu

SEQ ID NO: 3977698 - RNA, 15 nt, Staphylococcus aureus subsp. aureus Mu50
aaucuucuauuuuca

SEQ ID NO: 3977699 - RNA, 20 nt, Staphylococcus aureus subsp. aureus Mu50
aaucuucuccaaucaucauu

SEQ ID NO: 3977700 - RNA, 23 nt, Staphylococcus aureus subsp. aureus Mu50
aaucuucuccaaucaucauuaaa

SEQ ID NO: 3977701 - RNA, 20 nt, Staphylococcus aureus subsp. aureus Mu50
aaucuugauuauauuuuucu

SEQ ID NO: 3977702 - RNA, 13 nt, Staphylococcus aureus subsp. aureus Mu50
aaucuuggugaua

SEQ ID NO: 3977703 - RNA, 18 nt, Staphylococcus aureus subsp. aureus Mu50
aaucuuggugauagucuu

SEQ ID NO: 3977704 - RNA, 17 nt, Staphylococcus aureus subsp. aureus Mu50
aaucuuguucuaauugu

SEQ ID NO: 3977705 - RNA, 18 nt, Staphylococcus aureus subsp. aureus Mu50
aaucuuguuggauuuuaa

SEQ ID NO: 3977706 - RNA, 13 nt, Staphylococcus aureus subsp. aureus Mu50
aaucuuguuuuca

SEQ ID NO: 3977707 - RNA, 18 nt, Staphylococcus aureus subsp. aureus Mu50
aaucuuuacuuguaauua

SEQ ID NO: 3977708 - RNA, 21 nt, Staphylococcus aureus subsp. aureus Mu50
aaucuuuacuuguaauuaaua

SEQ ID NO: 3977709 - RNA, 14 nt, Staphylococcus aureus subsp. aureus Mu50
aaucuuuauuaaua

SEQ ID NO: 3977710 - RNA, 13 nt, Staphylococcus aureus subsp. aureus Mu50
aaucuuuguuaua

SEQ ID NO: 3977711 - RNA, 20 nt, Staphylococcus aureus subsp. aureus Mu50
aaucuuuguuauauuuuuag

SEQ ID NO: 3977712 - RNA, 13 nt, Staphylococcus aureus subsp. aureus Mu50
aaucuuuuaaauu

SEQ ID NO: 3977713 - RNA, 12 nt, Staphylococcus aureus subsp. aureus Mu50
aaucuuuuaacu

SEQ ID NO: 3977714 - RNA, 15 nt, Staphylococcus aureus subsp. aureus Mu50
aaucuuuuagcuuuu

SEQ ID NO: 3977715 - RNA, 20 nt, Staphylococcus aureus subsp. aureus Mu50
aaucuuuuuuacuaaaauca

SEQ ID NO: 3977716 - RNA, 18 nt, Staphylococcus aureus subsp. aureus Mu50
aaugaaaacagguggaag

SEQ ID NO: 3977717 - RNA, 18 nt, Staphylococcus aureus subsp. aureus Mu50
aaugaaaauaagcuugua

SEQ ID NO: 3977718 - RNA, 18 nt, Staphylococcus aureus subsp. aureus Mu50
aaugaaaccguauuauug

SEQ ID NO: 3977719 - RNA, 19 nt, Staphylococcus aureus subsp. aureus Mu50
aaugaaaguaccuaaaaua

SEQ ID NO: 3977720 - RNA, 20 nt, Staphylococcus aureus subsp. aureus Mu50
aaugaaaguaccuaaaauag

SEQ ID NO: 3977721 - RNA, 23 nt, Staphylococcus aureus subsp. aureus Mu50
aaugaaaguaccuaaaauagaaa

SEQ ID NO: 3977722 - RNA, 20 nt, Staphylococcus aureus subsp. aureus Mu50
aaugaaaugaaguauggaag

SEQ ID NO: 3977723 - RNA, 20 nt, Staphylococcus aureus subsp. aureus Mu50
aaugaacaagggccauccau

SEQ ID NO: 3977724 - RNA, 24 nt, Staphylococcus aureus subsp. aureus Mu50
aaugaaccagcuaaccaaauaauu

SEQ ID NO: 3977725 - RNA, 22 nt, Staphylococcus aureus subsp. aureus Mu50
aaugaacgauauucuacaugaa

SEQ ID NO: 3977726 - RNA, 14 nt, Staphylococcus aureus subsp. aureus Mu50
aaugaagaauacaa

SEQ ID NO: 3977727 - RNA, 18 nt, Staphylococcus aureus subsp. aureus Mu50
aaugaagaauacaaauau

SEQ ID NO: 3977728 - RNA, 17 nt, Staphylococcus aureus subsp. aureus Mu50
aaugaagguguugaaaa

SEQ ID NO: 3977729 - RNA, 21 nt, Staphylococcus aureus subsp. aureus Mu50
aaugaaguaauauauaaaagu

SEQ ID NO: 3977730 - RNA, 16 nt, Staphylococcus aureus subsp. aureus Mu50
aaugaauaaauugaua

SEQ ID NO: 3977731 - RNA, 22 nt, Staphylococcus aureus subsp. aureus Mu50
aaugaauaaucaaaguucguaa

SEQ ID NO: 3977732 - RNA, 18 nt, Staphylococcus aureus subsp. aureus Mu50
aaugaauaaugacaaauu

SEQ ID NO: 3977733 - RNA, 23 nt, Staphylococcus aureus subsp. aureus Mu50
aaugaauaaugacaaauuaucac

SEQ ID NO: 3977734 - RNA, 21 nt, Staphylococcus aureus subsp. aureus Mu50
aaugaauaauugcuaaaauau

SEQ ID NO: 3977735 - RNA, 19 nt, Staphylococcus aureus subsp. aureus Mu50
aaugaauaguaaucagcuu

SEQ ID NO: 3977736 - RNA, 12 nt, Staphylococcus aureus subsp. aureus Mu50
aaugaaucaauu

SEQ ID NO: 3977737 - RNA, 16 nt, Staphylococcus aureus subsp. aureus Mu50
aaugaaugaagacgaa

SEQ ID NO: 3977738 - RNA, 15 nt, Staphylococcus aureus subsp. aureus Mu50
aaugaauuauuuaaa

SEQ ID NO: 3977739 - RNA, 16 nt, Staphylococcus aureus subsp. aureus Mu50
aaugaauuauuuaaaa

SEQ ID NO: 3977740 - RNA, 20 nt, Staphylococcus aureus subsp. aureus Mu50
aaugaauuauuuaaaaugcu

SEQ ID NO: 3977741 - RNA, 17 nt, Staphylococcus aureus subsp. aureus Mu50
aaugaauucuauccuaa

SEQ ID NO: 3977742 - RNA, 21 nt, Staphylococcus aureus subsp. aureus Mu50
aaugacagcagacuucuuuca

SEQ ID NO: 3977743 - RNA, 19 nt, Staphylococcus aureus subsp. aureus Mu50
aaugacaucaucuauaaua

SEQ ID NO: 3977744 - RNA, 21 nt, Staphylococcus aureus subsp. aureus Mu50
aaugacauuuaauacuuuucu

SEQ ID NO: 3977745 - RNA, 15 nt, Staphylococcus aureus subsp. aureus Mu50
aaugaccauugucau

SEQ ID NO: 3977746 - RNA, 20 nt, Staphylococcus aureus subsp. aureus Mu50
aaugaccauugucaugccuu

SEQ ID NO: 3977747 - RNA, 20 nt, Staphylococcus aureus subsp. aureus Mu50
aaugaccggcauauaaucca

SEQ ID NO: 3977748 - RNA, 15 nt, Staphylococcus aureus subsp. aureus Mu50
aaugaccuggaauau

SEQ ID NO: 3977749 - RNA, 14 nt, Staphylococcus aureus subsp. aureus Mu50
aaugaccuuaauau

SEQ ID NO: 3977750 - RNA, 14 nt, Staphylococcus aureus subsp. aureus Mu50
aaugacgagaauua

SEQ ID NO: 3977751 - RNA, 17 nt, Staphylococcus aureus subsp. aureus Mu50
aaugacgugcuuuuaaa

SEQ ID NO: 3977752 - RNA, 20 nt, Staphylococcus aureus subsp. aureus Mu50
aaugacgugcuuuuaaaugu

SEQ ID NO: 3977753 - RNA, 21 nt, Staphylococcus aureus subsp. aureus Mu50
aaugacgugcuuuuaaaugua

SEQ ID NO: 3977754 - RNA, 13 nt, Staphylococcus aureus subsp. aureus Mu50
aaugacuaaaucg

SEQ ID NO: 3977755 - RNA, 18 nt, Staphylococcus aureus subsp. aureus Mu50
aaugacuaaaucgacaua

SEQ ID NO: 3977756 - RNA, 22 nt, Staphylococcus aureus subsp. aureus Mu50
aaugacuaccuguuggcuuuaa

SEQ ID NO: 3977757 - RNA, 17 nt, Staphylococcus aureus subsp. aureus Mu50
aaugacuauaacaccaa

SEQ ID NO: 3977758 - RNA, 23 nt, Staphylococcus aureus subsp. aureus Mu50
aaugacuauaacaccaauuaaau

SEQ ID NO: 3977759 - RNA, 18 nt, Staphylococcus aureus subsp. aureus Mu50
aaugacuaugcaaaugaa

SEQ ID NO: 3977760 - RNA, 19 nt, Staphylococcus aureus subsp. aureus Mu50
aaugacuaugcaaaugaaa

SEQ ID NO: 3977761 - RNA, 21 nt, Staphylococcus aureus subsp. aureus Mu50
aaugacugaauuaauauccaa

SEQ ID NO: 3977762 - RNA, 19 nt, Staphylococcus aureus subsp. aureus Mu50
aaugacugagaaaaauauu

SEQ ID NO: 3977763 - RNA, 19 nt, Staphylococcus aureus subsp. aureus Mu50
aaugacuucuuuauauuua

SEQ ID NO: 3977764 - RNA, 15 nt, Staphylococcus aureus subsp. aureus Mu50
aaugagaaugugcuu

SEQ ID NO: 3977765 - RNA, 23 nt, Staphylococcus aureus subsp. aureus Mu50
aaugagaaugugcuuguaacaag

SEQ ID NO: 3977766 - RNA, 21 nt, Staphylococcus aureus subsp. aureus Mu50
aaugguucuauaauaaaucga

SEQ ID NO: 3977767 - RNA, 16 nt, Staphylococcus aureus subsp. aureus Mu50
aaugguuucauaaacu

SEQ ID NO: 3977768 - RNA, 19 nt, Staphylococcus aureus subsp. aureus Mu50
aaugguuucauaaacugaa

SEQ ID NO: 3977769 - RNA, 17 nt, Staphylococcus aureus subsp. aureus Mu50
aauguaaauaaaaauua

SEQ ID NO: 3977770 - RNA, 21 nt, Staphylococcus aureus subsp. aureus Mu50
aauguaacauuaaaaauaaaa

SEQ ID NO: 3977771 - RNA, 22 nt, Staphylococcus aureus subsp. aureus Mu50
aauguaagaacgaaacuuuaau

SEQ ID NO: 3977772 - RNA, 21 nt, Staphylococcus aureus subsp. aureus Mu50
aauguaagcaacauaugauuu

SEQ ID NO: 3977773 - RNA, 20 nt, Staphylococcus aureus subsp. aureus Mu50
aauguaagcgaauacaauag

SEQ ID NO: 3977774 - RNA, 22 nt, Staphylococcus aureus subsp. aureus Mu50
aauguaagcgaauacaauagua

SEQ ID NO: 3977775 - RNA, 19 nt, Staphylococcus aureus subsp. aureus Mu50
aauguaagcgcaauggcca

SEQ ID NO: 3977776 - RNA, 16 nt, Staphylococcus aureus subsp. aureus Mu50
aauguaaugauacaaa

SEQ ID NO: 3977777 - RNA, 21 nt, Staphylococcus aureus subsp. aureus Mu50
aauguaccgaauccuucauca

SEQ ID NO: 3977778 - RNA, 13 nt, Staphylococcus aureus subsp. aureus Mu50
aauguacuucaau

SEQ ID NO: 3977779 - RNA, 18 nt, Staphylococcus aureus subsp. aureus Mu50
aauguacuucaauuuaug

SEQ ID NO: 3977780 - RNA, 22 nt, Staphylococcus aureus subsp. aureus Mu50
aauguacuuuucugucuguaaa

SEQ ID NO: 3977781 - RNA, 19 nt, Staphylococcus aureus subsp. aureus Mu50
aauguagauuacuuugcua

SEQ ID NO: 3977782 - RNA, 21 nt, Staphylococcus aureus subsp. aureus Mu50
aauguaggcgccauaaucauu

SEQ ID NO: 3977783 - RNA, 23 nt, Staphylococcus aureus subsp. aureus Mu50
aauguaggcgccauaaucauuag

SEQ ID NO: 3977784 - RNA, 17 nt, Staphylococcus aureus subsp. aureus Mu50
aauguauaaauaauaaa

SEQ ID NO: 3977785 - RNA, 13 nt, Staphylococcus aureus subsp. aureus Mu50
aauguaugauaua

SEQ ID NO: 3977786 - RNA, 15 nt, Staphylococcus aureus subsp. aureus Mu50
aauguaugauauaaa

SEQ ID NO: 3977787 - RNA, 15 nt, Staphylococcus aureus subsp. aureus Mu50
aauguauuaaacauu

SEQ ID NO: 3977788 - RNA, 23 nt, Staphylococcus aureus subsp. aureus Mu50
aauguauuauucucucauuugua

SEQ ID NO: 3977789 - RNA, 22 nt, Staphylococcus aureus subsp. aureus Mu50
aauguauucagucaguaaaaau

SEQ ID NO: 3977790 - RNA, 22 nt, Staphylococcus aureus subsp. aureus Mu50
aauguauucuucuaauucugaa

SEQ ID NO: 3977791 - RNA, 21 nt, Staphylococcus aureus subsp. aureus Mu50
aauguauugcuauaagaacua

SEQ ID NO: 3977792 - RNA, 20 nt, Staphylococcus aureus subsp. aureus Mu50
aauguauuuuuacuuuuaua

SEQ ID NO: 3977793 - RNA, 21 nt, Staphylococcus aureus subsp. aureus Mu50
aauguauuuuuacuuuuauaa

SEQ ID NO: 3977794 - RNA, 23 nt, Staphylococcus aureus subsp. aureus Mu50
aaugucauagccuauuuaaaaga

SEQ ID NO: 3977795 - RNA, 18 nt, Staphylococcus aureus subsp. aureus Mu50
aauguccgacuugauaaa

SEQ ID NO: 3977796 - RNA, 20 nt, Staphylococcus aureus subsp. aureus Mu50
aauguccgacuugauaaaaa

SEQ ID NO: 3977797 - RNA, 22 nt, Staphylococcus aureus subsp. aureus Mu50
aaugucgcacuauaaaauucac

SEQ ID NO: 3977798 - RNA, 14 nt, Staphylococcus aureus subsp. aureus Mu50
aaugucguauaugu

SEQ ID NO: 3977799 - RNA, 21 nt, Staphylococcus aureus subsp. aureus Mu50
aaugucguauauguaaucaga

SEQ ID NO: 3977800 - RNA, 15 nt, Staphylococcus aureus subsp. aureus Mu50
aaugucuaaaaaugu

SEQ ID NO: 3977801 - RNA, 16 nt, Staphylococcus aureus subsp. aureus Mu50
aaugucucuuuucacg

SEQ ID NO: 3977802 - RNA, 14 nt, Staphylococcus aureus subsp. aureus Mu50
aaugucuucauaau

SEQ ID NO: 3977803 - RNA, 14 nt, Staphylococcus aureus subsp. aureus Mu50
aaugucuuucaaau

SEQ ID NO: 3977804 - RNA, 16 nt, Staphylococcus aureus subsp. aureus Mu50
aaugucuuugaaaaac

SEQ ID NO: 3977805 - RNA, 15 nt, Staphylococcus aureus subsp. aureus Mu50
aaugugaccuuaugu

SEQ ID NO: 3977806 - RNA, 22 nt, Staphylococcus aureus subsp. aureus Mu50
aaugugagauacguuauuucaa

SEQ ID NO: 3977807 - RNA, 17 nt, Staphylococcus aureus subsp. aureus Mu50
aaugugagauauaaagg

SEQ ID NO: 3977808 - RNA, 12 nt, Staphylococcus aureus subsp. aureus Mu50
aaugugaugauu

SEQ ID NO: 3977809 - RNA, 14 nt, Staphylococcus aureus subsp. aureus Mu50
aaugugaugauuaa

SEQ ID NO: 3977810 - RNA, 15 nt, Staphylococcus aureus subsp. aureus Mu50
aaugugaugauuaau

SEQ ID NO: 3977811 - RNA, 13 nt, Staphylococcus aureus subsp. aureus Mu50
aaugugcuuguaa

SEQ ID NO: 3977812 - RNA, 16 nt, Staphylococcus aureus subsp. aureus Mu50
aaugugcuuguaacaa

SEQ ID NO: 3977813 - RNA, 21 nt, Staphylococcus aureus subsp. aureus Mu50
aauguggaacaugauucauga

SEQ ID NO: 3977814 - RNA, 18 nt, Staphylococcus aureus subsp. aureus Mu50
aauguguacuuaaaaaua

SEQ ID NO: 3977815 - RNA, 22 nt, Staphylococcus aureus subsp. aureus Mu50
aauguguaugguuuuguacaua

SEQ ID NO: 3977816 - RNA, 21 nt, Staphylococcus aureus subsp. aureus Mu50
aauguguggauuuaauuuuua

SEQ ID NO: 3977817 - RNA, 23 nt, Staphylococcus aureus subsp. aureus Mu50
aauguguuaaucaacguauauaa

SEQ ID NO: 3977818 - RNA, 18 nt, Staphylococcus aureus subsp. aureus Mu50
aauguguuggcuuuuuga

SEQ ID NO: 3977819 - RNA, 19 nt, Staphylococcus aureus subsp. aureus Mu50
aauguuaaacacucaaaau

SEQ ID NO: 3977820 - RNA, 14 nt, Staphylococcus aureus subsp. aureus Mu50
aauguuaaagauua

SEQ ID NO: 3977821 - RNA, 16 nt, Staphylococcus aureus subsp. aureus Mu50
aauguuaaagauuauu

SEQ ID NO: 3977822 - RNA, 21 nt, Staphylococcus aureus subsp. aureus Mu50
aauguuaacugcaaacuugau

SEQ ID NO: 3977823 - RNA, 14 nt, Staphylococcus aureus subsp. aureus Mu50
aauguuaauaauga

SEQ ID NO: 3977824 - RNA, 17 nt, Staphylococcus aureus subsp. aureus Mu50
aauguuaaucaaaauua

SEQ ID NO: 3977825 - RNA, 19 nt, Staphylococcus aureus subsp. aureus Mu50
aauguuacacaaauuaaaa

SEQ ID NO: 3977826 - RNA, 21 nt, Staphylococcus aureus subsp. aureus Mu50
aauguuacacaaauuaaaacu

SEQ ID NO: 3977827 - RNA, 23 nt, Staphylococcus aureus subsp. aureus Mu50
aauguuacacaucgaucuaaaua

SEQ ID NO: 3977828 - RNA, 24 nt, Staphylococcus aureus subsp. aureus Mu50
aauguuaucuugcuuauugauaua

SEQ ID NO: 3977829 - RNA, 14 nt, Staphylococcus aureus subsp. aureus Mu50
aauguuauuagaua

SEQ ID NO: 3977830 - RNA, 21 nt, Staphylococcus aureus subsp. aureus Mu50
aauguuauugcuuauuuuugu

SEQ ID NO: 3977831 - RNA, 22 nt, Staphylococcus aureus subsp. aureus Mu50
aauguuauugcuuauuuuugua

SEQ ID NO: 3977832 - RNA, 11 nt, Staphylococcus aureus subsp. aureus Mu50
aauguugaaug

SEQ ID NO: 3977833 - RNA, 17 nt, Staphylococcus aureus subsp. aureus Mu50
aauguugauagccaccu

SEQ ID NO: 3977834 - RNA, 23 nt, Staphylococcus aureus subsp. aureus Mu50
aauguuggaaaaggucaaaaaau

SEQ ID NO: 3977835 - RNA, 21 nt, Staphylococcus aureus subsp. aureus Mu50
aauguugucguuucuagcaac

SEQ ID NO: 3977836 - RNA, 20 nt, Staphylococcus aureus subsp. aureus Mu50
aauguuuaauuuucuaaaua

SEQ ID NO: 3977837 - RNA, 22 nt, Staphylococcus aureus subsp. aureus Mu50
aauguuuaauuuucuaaauaua

SEQ ID NO: 3977838 - RNA, 12 nt, Staphylococcus aureus subsp. aureus Mu50
aauguuucauau

SEQ ID NO: 3977839 - RNA, 13 nt, Staphylococcus aureus subsp. aureus Mu50
aauguuuccauuu

SEQ ID NO: 3977840 - RNA, 23 nt, Staphylococcus aureus subsp. aureus Mu50
aauguuugaagugauuugccaaa

SEQ ID NO: 3977841 - RNA, 21 nt, Staphylococcus aureus subsp. aureus Mu50
aauguuugaguguuuaugaaa

SEQ ID NO: 3977842 - RNA, 14 nt, Staphylococcus aureus subsp. aureus Mu50
aauguuugaugauu

SEQ ID NO: 3977843 - RNA, 12 nt, Staphylococcus aureus subsp. aureus Mu50
aauguuuuaugu

SEQ ID NO: 3977844 - RNA, 16 nt, Staphylococcus aureus subsp. aureus Mu50
aauguuuuauguauuu

SEQ ID NO: 3977845 - RNA, 18 nt, Staphylococcus aureus subsp. aureus Mu50
aauguuuuauguauuuau

SEQ ID NO: 3977846 - RNA, 17 nt, Staphylococcus aureus subsp. aureus Mu50
aauguuuuuacaaaugu

SEQ ID NO: 3977847 - RNA, 14 nt, Staphylococcus aureus subsp. aureus Mu50
aauuaaaaaacaaa

SEQ ID NO: 3977848 - RNA, 14 nt, Staphylococcus aureus subsp. aureus Mu50
aauuaaaaaacaau

SEQ ID NO: 3977849 - RNA, 20 nt, Staphylococcus aureus subsp. aureus Mu50
aauuaaaaaacaauaaaauu

SEQ ID NO: 3977850 - RNA, 14 nt, Staphylococcus aureus subsp. aureus Mu50
aauuaaaaaaccug

SEQ ID NO: 3977851 - RNA, 14 nt, Staphylococcus aureus subsp. aureus Mu50
aauuaaaaaaugau

SEQ ID NO: 3977852 - RNA, 17 nt, Staphylococcus aureus subsp. aureus Mu50
aauuaaaacagcaaaua

SEQ ID NO: 3977853 - RNA, 17 nt, Staphylococcus aureus subsp. aureus Mu50
aauuauacaaauuauaa

SEQ ID NO: 3977854 - RNA, 15 nt, Staphylococcus aureus subsp. aureus Mu50
aauuauacguuacua

SEQ ID NO: 3977855 - RNA, 12 nt, Staphylococcus aureus subsp. aureus Mu50
aauuauauaccc

SEQ ID NO: 3977856 - RNA, 22 nt, Staphylococcus aureus subsp. aureus Mu50
aauuauauagaaaacuagaacu

SEQ ID NO: 3977857 - RNA, 13 nt, Staphylococcus aureus subsp. aureus Mu50
aauuauauuaaug

SEQ ID NO: 3977858 - RNA, 18 nt, Staphylococcus aureus subsp. aureus Mu50
aauuauauuuauuuguac

SEQ ID NO: 3977859 - RNA, 20 nt, Staphylococcus aureus subsp. aureus Mu50
aauuauauuuauuuguacau

SEQ ID NO: 3977860 - RNA, 20 nt, Staphylococcus aureus subsp. aureus Mu50
aauuaucagaaucaaguaau

SEQ ID NO: 3977861 - RNA, 17 nt, Staphylococcus aureus subsp. aureus Mu50
aauuaucauaaagauaa

SEQ ID NO: 3977862 - RNA, 23 nt, Staphylococcus aureus subsp. aureus Mu50
aauuaucauaaagauaagauggu

SEQ ID NO: 3977863 - RNA, 14 nt, Staphylococcus aureus subsp. aureus Mu50
aauuaucauauaaa

SEQ ID NO: 3977864 - RNA, 19 nt, Staphylococcus aureus subsp. aureus Mu50
aauuaucauuaaauugcuu

SEQ ID NO: 3977865 - RNA, 15 nt, Staphylococcus aureus subsp. aureus Mu50
aauuauccuacugcu

SEQ ID NO: 3977866 - RNA, 18 nt, Staphylococcus aureus subsp. aureus Mu50
aauuauccuacugcuguc

SEQ ID NO: 3977867 - RNA, 20 nt, Staphylococcus aureus subsp. aureus Mu50
aauuaucuguagguaagaaa

SEQ ID NO: 3977868 - RNA, 16 nt, Staphylococcus aureus subsp. aureus Mu50
aauuaucuuaagucau

SEQ ID NO: 3977869 - RNA, 15 nt, Staphylococcus aureus subsp. aureus Mu50
aauuaucuucaucau

SEQ ID NO: 3977870 - RNA, 14 nt, Staphylococcus aureus subsp. aureus Mu50
aauuaucuuuacga

SEQ ID NO: 3977871 - RNA, 21 nt, Staphylococcus aureus subsp. aureus Mu50
aauuaucuuuacgauaaacua

SEQ ID NO: 3977872 - RNA, 15 nt, Staphylococcus aureus subsp. aureus Mu50
aauuaugacuuauuu

SEQ ID NO: 3977873 - RNA, 19 nt, Staphylococcus aureus subsp. aureus Mu50
aauuaugacuuauuuuuca

SEQ ID NO: 3977874 - RNA, 15 nt, Staphylococcus aureus subsp. aureus Mu50
aauuauggagcggaa

SEQ ID NO: 3977875 - RNA, 22 nt, Staphylococcus aureus subsp. aureus Mu50
aauuauggagcggaagauagga

SEQ ID NO: 3977876 - RNA, 15 nt, Staphylococcus aureus subsp. aureus Mu50
aauuauguaaaaaau

SEQ ID NO: 3977877 - RNA, 22 nt, Staphylococcus aureus subsp. aureus Mu50
aauuauuaaagcuaucuucaga

SEQ ID NO: 3977878 - RNA, 12 nt, Staphylococcus aureus subsp. aureus Mu50
aauuauuaacgc

SEQ ID NO: 3977879 - RNA, 22 nt, Staphylococcus aureus subsp. aureus Mu50
aauuauuaacgcaaaaauacuc

SEQ ID NO: 3977880 - RNA, 17 nt, Staphylococcus aureus subsp. aureus Mu50
aauuauuagaacguaau

SEQ ID NO: 3977881 - RNA, 12 nt, Staphylococcus aureus subsp. aureus Mu50
aauuauuauaau

SEQ ID NO: 3977882 - RNA, 13 nt, Staphylococcus aureus subsp. aureus Mu50
aauuauuauaaua

SEQ ID NO: 3977883 - RNA, 15 nt, Staphylococcus aureus subsp. aureus Mu50
aauuauuauaauaaa

SEQ ID NO: 3977884 - RNA, 19 nt, Staphylococcus aureus subsp. aureus Mu50
aauuauuauaauaaauaga

SEQ ID NO: 3977885 - RNA, 22 nt, Staphylococcus aureus subsp. aureus Mu50
aauuauugaaaacaaaaagguu

SEQ ID NO: 3977886 - RNA, 15 nt, Staphylococcus aureus subsp. aureus Mu50
aauuauuuagaaacu

SEQ ID NO: 3977887 - RNA, 24 nt, Staphylococcus aureus subsp. aureus Mu50
aauuauuuauucauuauagucuua

SEQ ID NO: 3977888 - RNA, 14 nt, Staphylococcus aureus subsp. aureus Mu50
aauuauuucaauua

SEQ ID NO: 3977889 - RNA, 20 nt, Staphylococcus aureus subsp. aureus Mu50
aauuauuucucuuuccacug

SEQ ID NO: 3977890 - RNA, 14 nt, Staphylococcus aureus subsp. aureus Mu50
aauuauuuuaaaaa

SEQ ID NO: 3977891 - RNA, 20 nt, Staphylococcus aureus subsp. aureus Mu50
aauuauuuuaaaaaaugaug

SEQ ID NO: 3977892 - RNA, 15 nt, Staphylococcus aureus subsp. aureus Mu50
aauuauuuuucaaau

SEQ ID NO: 3977893 - RNA, 16 nt, Staphylococcus aureus subsp. aureus Mu50
aauuauuuuucaaaua

SEQ ID NO: 3977894 - RNA, 21 nt, Staphylococcus aureus subsp. aureus Mu50
aauuauuuuucucaacaguuu

SEQ ID NO: 3977895 - RNA, 13 nt, Staphylococcus aureus subsp. aureus Mu50
aauucaacgucau

SEQ ID NO: 3977896 - RNA, 19 nt, Staphylococcus aureus subsp. aureus Mu50
aauucaacgucaucaaaac

SEQ ID NO: 3977897 - RNA, 20 nt, Staphylococcus aureus subsp. aureus Mu50
aauucaacuaugaaauugga

SEQ ID NO: 3977898 - RNA, 13 nt, Staphylococcus aureus subsp. aureus Mu50
aauucaagaacag

SEQ ID NO: 3977899 - RNA, 15 nt, Staphylococcus aureus subsp. aureus Mu50
aauucaauaaucuua

SEQ ID NO: 3977900 - RNA, 16 nt, Staphylococcus aureus subsp. aureus Mu50
aauucaauaaucuuag

SEQ ID NO: 3977901 - RNA, 14 nt, Staphylococcus aureus subsp. aureus Mu50
aauucaauauuaau

SEQ ID NO: 3977902 - RNA, 17 nt, Staphylococcus aureus subsp. aureus Mu50
aauucaauauuaaucau

SEQ ID NO: 3977903 - RNA, 20 nt, Staphylococcus aureus subsp. aureus Mu50
aauucaaugauuuuuaaaaa

SEQ ID NO: 3977904 - RNA, 15 nt, Staphylococcus aureus subsp. aureus Mu50
aauucagaugaauaa

SEQ ID NO: 3977905 - RNA, 16 nt, Staphylococcus aureus subsp. aureus Mu50
aauucaggaaaugcau

SEQ ID NO: 3977906 - RNA, 21 nt, Staphylococcus aureus subsp. aureus Mu50
aauucaggauggaaugauacg

SEQ ID NO: 3977907 - RNA, 20 nt, Staphylococcus aureus subsp. aureus Mu50
aauucaguaucuaaauauua

SEQ ID NO: 3977908 - RNA, 14 nt, Staphylococcus aureus subsp. aureus Mu50
aauucauaaaugcu

SEQ ID NO: 3977909 - RNA, 12 nt, Staphylococcus aureus subsp. aureus Mu50
aauucauauuaa

SEQ ID NO: 3977910 - RNA, 20 nt, Staphylococcus aureus subsp. aureus Mu50
aauucaucuuaucaagaaua

SEQ ID NO: 3977911 - RNA, 21 nt, Staphylococcus aureus subsp. aureus Mu50
aauucaucuuaucaagaauau

SEQ ID NO: 3977912 - RNA, 14 nt, Staphylococcus aureus subsp. aureus Mu50
aauucauucaauac

SEQ ID NO: 3977913 - RNA, 19 nt, Staphylococcus aureus subsp. aureus Mu50
aauuccaagagaauuaaua

SEQ ID NO: 3977914 - RNA, 21 nt, Staphylococcus aureus subsp. aureus Mu50
aauuccaugucaauuuuuuca

SEQ ID NO: 3977915 - RNA, 18 nt, Staphylococcus aureus subsp. aureus Mu50
aauucccauguauucuua

SEQ ID NO: 3977916 - RNA, 14 nt, Staphylococcus aureus subsp. aureus Mu50
aauucgaaaagaaa

SEQ ID NO: 3977917 - RNA, 19 nt, Staphylococcus aureus subsp. aureus Mu50
aauucgaacuaucaauaua

SEQ ID NO: 3977918 - RNA, 18 nt, Staphylococcus aureus subsp. aureus Mu50
aauucgaugacuuuuuaa

SEQ ID NO: 3977919 - RNA, 21 nt, Staphylococcus aureus subsp. aureus Mu50
aauucgcaagccuucuauaua

SEQ ID NO: 3977920 - RNA, 12 nt, Staphylococcus aureus subsp. aureus Mu50
aauucgcauuaa

SEQ ID NO: 3977921 - RNA, 22 nt, Staphylococcus aureus subsp. aureus Mu50
aauucgccuaaaugguuuugaa

SEQ ID NO: 3977922 - RNA, 22 nt, Staphylococcus aureus subsp. aureus Mu50
aauucgcucacaugugaaauaa

SEQ ID NO: 3977923 - RNA, 17 nt, Staphylococcus aureus subsp. aureus Mu50
aauucgucuguuucaua

SEQ ID NO: 3977924 - RNA, 13 nt, Staphylococcus aureus subsp. aureus Mu50
aauucguugauuu

SEQ ID NO: 3977925 - RNA, 22 nt, Staphylococcus aureus subsp. aureus Mu50
aauucguuuuacuacugucuca

SEQ ID NO: 3977926 - RNA, 23 nt, Staphylococcus aureus subsp. aureus Mu50
aauucguuuugcuaaccaucaua

SEQ ID NO: 3977927 - RNA, 14 nt, Staphylococcus aureus subsp. aureus Mu50
aauucuaaaagaau

SEQ ID NO: 3977928 - RNA, 19 nt, Staphylococcus aureus subsp. aureus Mu50
aauucuacaaacaaugcaa

SEQ ID NO: 3977929 - RNA, 19 nt, Staphylococcus aureus subsp. aureus Mu50
aauucuacaggcaaugcaa

SEQ ID NO: 3977930 - RNA, 19 nt, Staphylococcus aureus subsp. aureus Mu50
aauucuacagguaaugcaa

SEQ ID NO: 3977931 - RNA, 17 nt, Staphylococcus aureus subsp. aureus Mu50
aauucuauaauuuuaau

SEQ ID NO: 3977932 - RNA, 14 nt, Staphylococcus aureus subsp. aureus Mu50
aauucuaucuauaa

SEQ ID NO: 3977933 - RNA, 11 nt, Staphylococcus aureus subsp. aureus Mu50
aauucuauuuu

SEQ ID NO: 3977934 - RNA, 14 nt, Staphylococcus aureus subsp. aureus Mu50
aauucuauuuuuga

SEQ ID NO: 3977935 - RNA, 20 nt, Staphylococcus aureus subsp. aureus Mu50
aauucuauuuuugauuuaau

SEQ ID NO: 3977936 - RNA, 21 nt, Staphylococcus aureus subsp. aureus Mu50
aauucuauuuuugauuuaaua

SEQ ID NO: 3977937 - RNA, 19 nt, Staphylococcus aureus subsp. aureus Mu50
aauucucgauuuuuuuaua

SEQ ID NO: 3977938 - RNA, 18 nt, Staphylococcus aureus subsp. aureus Mu50
aauucucuaacuuuacca

SEQ ID NO: 3977939 - RNA, 20 nt, Staphylococcus aureus subsp. aureus Mu50
aauucucuuuguuggggccc

SEQ ID NO: 3977940 - RNA, 20 nt, Staphylococcus aureus subsp. aureus Mu50
aauucucuuuuaaauucuua

SEQ ID NO: 3977941 - RNA, 20 nt, Staphylococcus aureus subsp. aureus Mu50
aauuguggagaucuaacaau

SEQ ID NO: 3977942 - RNA, 21 nt, Staphylococcus aureus subsp. aureus Mu50
aauuguggcuacuaaucuuuu

SEQ ID NO: 3977943 - RNA, 16 nt, Staphylococcus aureus subsp. aureus Mu50
aauuguguugaaucaa

SEQ ID NO: 3977944 - RNA, 21 nt, Staphylococcus aureus subsp. aureus Mu50
aauuguguugaaucaacaguu

SEQ ID NO: 3977945 - RNA, 16 nt, Staphylococcus aureus subsp. aureus Mu50
aauuguguuucuuuua

SEQ ID NO: 3977946 - RNA, 17 nt, Staphylococcus aureus subsp. aureus Mu50
aauuguuaaaucaccaa

SEQ ID NO: 3977947 - RNA, 19 nt, Staphylococcus aureus subsp. aureus Mu50
aauuguuaguuuucuuaaa

SEQ ID NO: 3977948 - RNA, 22 nt, Staphylococcus aureus subsp. aureus Mu50
aauuguuaguuuucuuaaaaga

SEQ ID NO: 3977949 - RNA, 22 nt, Staphylococcus aureus subsp. aureus Mu50
aauuguucauuggcaauauacu

SEQ ID NO: 3977950 - RNA, 13 nt, Staphylococcus aureus subsp. aureus Mu50
aauuguucuaaua

SEQ ID NO: 3977951 - RNA, 15 nt, Staphylococcus aureus subsp. aureus Mu50
aauuguugcaaaaua

SEQ ID NO: 3977952 - RNA, 22 nt, Staphylococcus aureus subsp. aureus Mu50
aauuguuuaauaacaaaauuaa

SEQ ID NO: 3977953 - RNA, 13 nt, Staphylococcus aureus subsp. aureus Mu50
aauuuaaaacaau

SEQ ID NO: 3977954 - RNA, 19 nt, Staphylococcus aureus subsp. aureus Mu50
aauuuaaaacaaugauuaa

SEQ ID NO: 3977955 - RNA, 20 nt, Staphylococcus aureus subsp. aureus Mu50
aauuuaaaacaaugauuaaa

SEQ ID NO: 3977956 - RNA, 21 nt, Staphylococcus aureus subsp. aureus Mu50
aauuuaaaacaaugauuaaaa

SEQ ID NO: 3977957 - RNA, 15 nt, Staphylococcus aureus subsp. aureus Mu50
aauuuaaaagaaaaa

SEQ ID NO: 3977958 - RNA, 14 nt, Staphylococcus aureus subsp. aureus Mu50
aauuuaaaauaaua

SEQ ID NO: 3977959 - RNA, 14 nt, Staphylococcus aureus subsp. aureus Mu50
aauuuaaaauaguu

SEQ ID NO: 3977960 - RNA, 23 nt, Staphylococcus aureus subsp. aureus Mu50
aauuuaaacgcacuauuuuuaua

SEQ ID NO: 3977961 - RNA, 21 nt, Staphylococcus aureus subsp. aureus Mu50
aauuuaaagaacuauuuuaaa

SEQ ID NO: 3977962 - RNA, 16 nt, Staphylococcus aureus subsp. aureus Mu50
aauuuaaaggcauaau

SEQ ID NO: 3977963 - RNA, 20 nt, Staphylococcus aureus subsp. aureus Mu50
aauuuaaagucuucaucuuu

SEQ ID NO: 3977964 - RNA, 11 nt, Staphylococcus aureus subsp. aureus Mu50
aauuuaaauaa

SEQ ID NO: 3977965 - RNA, 12 nt, Staphylococcus aureus subsp. aureus Mu50
aauuuaaauaau

SEQ ID NO: 3977966 - RNA, 14 nt, Staphylococcus aureus subsp. aureus Mu50
aauuuaaauaauaa

SEQ ID NO: 3977967 - RNA, 12 nt, Staphylococcus aureus subsp. aureus Mu50
aauuuaaauauu

SEQ ID NO: 3977968 - RNA, 10 nt, Staphylococcus aureus subsp. aureus Mu50
aauuuaaaug

SEQ ID NO: 3977969 - RNA, 13 nt, Staphylococcus aureus subsp. aureus Mu50
aauuuaaaugaua

SEQ ID NO: 3977970 - RNA, 19 nt, Staphylococcus aureus subsp. aureus Mu50
aauuuaaaugcuuaauuug

SEQ ID NO: 3977971 - RNA, 17 nt, Staphylococcus aureus subsp. aureus Mu50
aauuuaacguuuugaug

SEQ ID NO: 3977972 - RNA, 13 nt, Staphylococcus aureus subsp. aureus Mu50
aauuuaauaauua

SEQ ID NO: 3977973 - RNA, 18 nt, Staphylococcus aureus subsp. aureus Mu50
aauuuaauaauuaaauau

SEQ ID NO: 3977974 - RNA, 19 nt, Staphylococcus aureus subsp. aureus Mu50
aauuuaauacuauaguaag

SEQ ID NO: 3977975 - RNA, 18 nt, Staphylococcus aureus subsp. aureus Mu50
aauuuaauugguucuucu

SEQ ID NO: 3977976 - RNA, 19 nt, Staphylococcus aureus subsp. aureus Mu50
aauuuaccauuuucaauaa

SEQ ID NO: 3977977 - RNA, 20 nt, Staphylococcus aureus subsp. aureus Mu50
aauuuaccauuuucaauaaa

SEQ ID NO: 3977978 - RNA, 16 nt, Staphylococcus aureus subsp. aureus Mu50
aauuuacguacuucau

SEQ ID NO: 3977979 - RNA, 17 nt, Staphylococcus aureus subsp. aureus Mu50
aauuuacuccuuacaau

SEQ ID NO: 3977980 - RNA, 16 nt, Staphylococcus aureus subsp. aureus Mu50
aauuuagaugcauaaa

SEQ ID NO: 3977981 - RNA, 15 nt, Staphylococcus aureus subsp. aureus Mu50
aauuuagcaaauauu

SEQ ID NO: 3977982 - RNA, 20 nt, Staphylococcus aureus subsp. aureus Mu50
aauuuagcaaauauuucugg

SEQ ID NO: 3977983 - RNA, 19 nt, Staphylococcus aureus subsp. aureus Mu50
aauuuagcaucaaaaauaa

SEQ ID NO: 3977984 - RNA, 15 nt, Staphylococcus aureus subsp. aureus Mu50
aauuuaguauaaaua

SEQ ID NO: 3977985 - RNA, 16 nt, Staphylococcus aureus subsp. aureus Mu50
aauuuaguaucuauac

SEQ ID NO: 3977986 - RNA, 15 nt, Staphylococcus aureus subsp. aureus Mu50
aauuuaguccuucuu

SEQ ID NO: 3977987 - RNA, 12 nt, Staphylococcus aureus subsp. aureus Mu50
aauuuagugaaa

SEQ ID NO: 3977988 - RNA, 16 nt, Staphylococcus aureus subsp. aureus Mu50
aauuuagugaaacaau

SEQ ID NO: 3977989 - RNA, 20 nt, Staphylococcus aureus subsp. aureus Mu50
aauuuaguuauaauuucugu

SEQ ID NO: 3977990 - RNA, 16 nt, Staphylococcus aureus subsp. aureus Mu50
aauuuauauagucuau

SEQ ID NO: 3977991 - RNA, 18 nt, Staphylococcus aureus subsp. aureus Mu50
aauuuaucaauuucuauu

SEQ ID NO: 3977992 - RNA, 16 nt, Staphylococcus aureus subsp. aureus Mu50
aauuuaucugcaaaau

SEQ ID NO: 3977993 - RNA, 18 nt, Staphylococcus aureus subsp. aureus Mu50
aauuuauguguugugaua

SEQ ID NO: 3977994 - RNA, 22 nt, Staphylococcus aureus subsp. aureus Mu50
aauuuauguguugugauauaua

SEQ ID NO: 3977995 - RNA, 22 nt, Staphylococcus aureus subsp. aureus Mu50
aauuuauuaaaacgaaguuauu

SEQ ID NO: 3977996 - RNA, 21 nt, Staphylococcus aureus subsp. aureus Mu50
aauuuauuaauuuuauuuaau

SEQ ID NO: 3977997 - RNA, 13 nt, Staphylococcus aureus subsp. aureus Mu50
aauuuauuauaaa

SEQ ID NO: 3977998 - RNA, 16 nt, Staphylococcus aureus subsp. aureus Mu50
aauuuauuauaaaaua

SEQ ID NO: 3977999 - RNA, 17 nt, Staphylococcus aureus subsp. aureus Mu50
aauuuauuauaaaauag

SEQ ID NO: 3978000 - RNA, 12 nt, Staphylococcus aureus subsp. aureus Mu50
aauuuauuauua

SEQ ID NO: 3978001 - RNA, 13 nt, Staphylococcus aureus subsp. aureus Mu50
aauuuauucaaaa

SEQ ID NO: 3978002 - RNA, 19 nt, Staphylococcus aureus subsp. aureus Mu50
aauuuauucaaaauucaau

SEQ ID NO: 3978003 - RNA, 20 nt, Staphylococcus aureus subsp. aureus Mu50
aauuuauucaaaucauaagu

SEQ ID NO: 3978004 - RNA, 12 nt, Staphylococcus aureus subsp. aureus Mu50
aauuucaaaaau

SEQ ID NO: 3978005 - RNA, 19 nt, Staphylococcus aureus subsp. aureus Mu50
aauuucaaaauaguaaagu

SEQ ID NO: 3978006 - RNA, 14 nt, Staphylococcus aureus subsp. aureus Mu50
aauuucaauaaugu

SEQ ID NO: 3978007 - RNA, 17 nt, Staphylococcus aureus subsp. aureus Mu50
aauuucaauuuggaaau

SEQ ID NO: 3978008 - RNA, 19 nt, Staphylococcus aureus subsp. aureus Mu50
aauuucacgcugaaauuuu

SEQ ID NO: 3978009 - RNA, 21 nt, Staphylococcus aureus subsp. aureus Mu50
aauuucacuuuaacuucuuuu

SEQ ID NO: 3978010 - RNA, 14 nt, Staphylococcus aureus subsp. aureus Mu50
aauuucaguaccau

SEQ ID NO: 3978011 - RNA, 19 nt, Staphylococcus aureus subsp. aureus Mu50
aauuucaguaccauguuuu

SEQ ID NO: 3978012 - RNA, 23 nt, Staphylococcus aureus subsp. aureus Mu50
aauuucaguaucauguucuuaua

SEQ ID NO: 3978013 - RNA, 20 nt, Staphylococcus aureus subsp. aureus Mu50
aauuucauaaaguuuauuua

SEQ ID NO: 3978014 - RNA, 23 nt, Staphylococcus aureus subsp. aureus Mu50
aauuucauaaaguuuauuuaugu

SEQ ID NO: 3978015 - RNA, 20 nt, Staphylococcus aureus subsp. aureus Mu50
aauuucauaguuaucgauuu

SEQ ID NO: 3978016 - RNA, 16 nt, Staphylococcus aureus subsp. aureus Mu50
aauuucauauaaugaa

SEQ ID NO: 3978017 - RNA, 20 nt, Staphylococcus aureus subsp. aureus Mu50
aauuucaucacgugauaaug

SEQ ID NO: 3978018 - RNA, 22 nt, Staphylococcus aureus subsp. aureus Mu50
aauuucaucacgugauaaugac

SEQ ID NO: 3978019 - RNA, 14 nt, Staphylococcus aureus subsp. aureus Mu50
aauuucaugugcaa

SEQ ID NO: 3978020 - RNA, 15 nt, Staphylococcus aureus subsp. aureus Mu50
aauuucauguucaua

SEQ ID NO: 3978021 - RNA, 17 nt, Staphylococcus aureus subsp. aureus Mu50
aauuucauguucauaau

SEQ ID NO: 3978022 - RNA, 19 nt, Staphylococcus aureus subsp. aureus Mu50
aauuucauuugaaauaguu

SEQ ID NO: 3978023 - RNA, 14 nt, Staphylococcus aureus subsp. aureus Mu50
aauuucauuuuuga

SEQ ID NO: 3978024 - RNA, 17 nt, Staphylococcus aureus subsp. aureus Mu50
aauuucauuuuugauaa

SEQ ID NO: 3978025 - RNA, 21 nt, Staphylococcus aureus subsp. aureus Mu50
aauuuccaauaucuucuuuua

SEQ ID NO: 3978026 - RNA, 14 nt, Staphylococcus aureus subsp. aureus Mu50
aauuuccuaaaaac

SEQ ID NO: 3978027 - RNA, 15 nt, Staphylococcus aureus subsp. aureus Mu50
aauuucgaaaagaaa

SEQ ID NO: 3978028 - RNA, 17 nt, Staphylococcus aureus subsp. aureus Mu50
aauuucgaaaagaaauu

SEQ ID NO: 3978029 - RNA, 20 nt, Staphylococcus aureus subsp. aureus Mu50
acaaaaaauaucuuuuuguu

SEQ ID NO: 3978030 - RNA, 14 nt, Staphylococcus aureus subsp. aureus Mu50
acaaaaaauuguaa

SEQ ID NO: 3978031 - RNA, 18 nt, Staphylococcus aureus subsp. aureus Mu50
acaaaaacaucuacauca

SEQ ID NO: 3978032 - RNA, 13 nt, Staphylococcus aureus subsp. aureus Mu50
acaaaaagaauuu

SEQ ID NO: 3978033 - RNA, 22 nt, Staphylococcus aureus subsp. aureus Mu50
acaaaaagaauuucgaaaagaa

SEQ ID NO: 3978034 - RNA, 12 nt, Staphylococcus aureus subsp. aureus Mu50
acaaaaagacuu

SEQ ID NO: 3978035 - RNA, 17 nt, Staphylococcus aureus subsp. aureus Mu50
acaaaaagacuuccaau

SEQ ID NO: 3978036 - RNA, 17 nt, Staphylococcus aureus subsp. aureus Mu50
acaaaaauauagcuauu

SEQ ID NO: 3978037 - RNA, 13 nt, Staphylococcus aureus subsp. aureus Mu50
acaaaaaugaaga

SEQ ID NO: 3978038 - RNA, 10 nt, Staphylococcus aureus subsp. aureus Mu50
acaaaagaaa

SEQ ID NO: 3978039 - RNA, 17 nt, Staphylococcus aureus subsp. aureus Mu50
acaaaagaaaguuaauu

SEQ ID NO: 3978040 - RNA, 23 nt, Staphylococcus aureus subsp. aureus Mu50
acaaaagaggcgccacaacaugu

SEQ ID NO: 3978041 - RNA, 18 nt, Staphylococcus aureus subsp. aureus Mu50
acaaaagaucgauacuuu

SEQ ID NO: 3978042 - RNA, 22 nt, Staphylococcus aureus subsp. aureus Mu50
acaaaaucaccuuuuuuaacuu

SEQ ID NO: 3978043 - RNA, 15 nt, Staphylococcus aureus subsp. aureus Mu50
acaaacaaaagcacc

SEQ ID NO: 3978044 - RNA, 23 nt, Staphylococcus aureus subsp. aureus Mu50
acaaacauaaauaagcaguaaga

SEQ ID NO: 3978045 - RNA, 16 nt, Staphylococcus aureus subsp. aureus Mu50
acaaacauuaaucuau

SEQ ID NO: 3978046 - RNA, 21 nt, Staphylococcus aureus subsp. aureus Mu50
acaaacauuacccuuuaaacu

SEQ ID NO: 3978047 - RNA, 20 nt, Staphylococcus aureus subsp. aureus Mu50
acaaaccauuccaauuucaa

SEQ ID NO: 3978048 - RNA, 21 nt, Staphylococcus aureus subsp. aureus Mu50
acaaacccuuuaaacauauuu

SEQ ID NO: 3978049 - RNA, 15 nt, Staphylococcus aureus subsp. aureus Mu50
acaaacgacuaacca

SEQ ID NO: 3978050 - RNA, 13 nt, Staphylococcus aureus subsp. aureus Mu50
acaaacuucacau

SEQ ID NO: 3978051 - RNA, 18 nt, Staphylococcus aureus subsp. aureus Mu50
acaaagaaauuaaaguag

SEQ ID NO: 3978052 - RNA, 17 nt, Staphylococcus aureus subsp. aureus Mu50
acaaagauauguuuaua

SEQ ID NO: 3978053 - RNA, 16 nt, Staphylococcus aureus subsp. aureus Mu50
acaaagcucaauaaau

SEQ ID NO: 3978054 - RNA, 20 nt, Staphylococcus aureus subsp. aureus Mu50
acaaaggauuauuaacuuua

SEQ ID NO: 3978055 - RNA, 21 nt, Staphylococcus aureus subsp. aureus Mu50
acaaaggauuauuaacuuuaa

SEQ ID NO: 3978056 - RNA, 21 nt, Staphylococcus aureus subsp. aureus Mu50
acaaaggggaugggagaaauu

SEQ ID NO: 3978057 - RNA, 19 nt, Staphylococcus aureus subsp. aureus Mu50
acaaagugauuuaaaaaau

SEQ ID NO: 3978058 - RNA, 23 nt, Staphylococcus aureus subsp. aureus Mu50
acaaagugauuuaaaaaauuuaa

SEQ ID NO: 3978059 - RNA, 14 nt, Staphylococcus aureus subsp. aureus Mu50
acaaaguuaaccau

SEQ ID NO: 3978060 - RNA, 12 nt, Staphylococcus aureus subsp. aureus Mu50
acaaauaaaggc

SEQ ID NO: 3978061 - RNA, 14 nt, Staphylococcus aureus subsp. aureus Mu50
acaaauaacaaaca

SEQ ID NO: 3978062 - RNA, 14 nt, Staphylococcus aureus subsp. aureus Mu50
acaaauaauuuaca

SEQ ID NO: 3978063 - RNA, 16 nt, Staphylococcus aureus subsp. aureus Mu50
acaaauaauuuacauu

SEQ ID NO: 3978064 - RNA, 17 nt, Staphylococcus aureus subsp. aureus Mu50
acaaauaauuuacauua

SEQ ID NO: 3978065 - RNA, 23 nt, Staphylococcus aureus subsp. aureus Mu50
acaaauauaauguauaaaacaga

SEQ ID NO: 3978066 - RNA, 20 nt, Staphylococcus aureus subsp. aureus Mu50
acaaauauacuugccuucaa

SEQ ID NO: 3978067 - RNA, 23 nt, Staphylococcus aureus subsp. aureus Mu50
acaaauauacuugccuucaaauu

SEQ ID NO: 3978068 - RNA, 22 nt, Staphylococcus aureus subsp. aureus Mu50
acaaauauaucuagccugaaau

SEQ ID NO: 3978069 - RNA, 12 nt, Staphylococcus aureus subsp. aureus Mu50
acaaauauguaa

SEQ ID NO: 3978070 - RNA, 20 nt, Staphylococcus aureus subsp. aureus Mu50
acaaaucaugacauaaaacu

SEQ ID NO: 3978071 - RNA, 18 nt, Staphylococcus aureus subsp. aureus Mu50
acaaaucguaaacauaau

SEQ ID NO: 3978072 - RNA, 16 nt, Staphylococcus aureus subsp. aureus Mu50
acaaaucuuuuaaauu

SEQ ID NO: 3978073 - RNA, 11 nt, Staphylococcus aureus subsp. aureus Mu50
acaaaugaaaa

SEQ ID NO: 3978074 - RNA, 18 nt, Staphylococcus aureus subsp. aureus Mu50
acaaaugccuuaucuaua

SEQ ID NO: 3978075 - RNA, 15 nt, Staphylococcus aureus subsp. aureus Mu50
acaaauguauaaaua

SEQ ID NO: 3978076 - RNA, 16 nt, Staphylococcus aureus subsp. aureus Mu50
acaaauguauaaauaa

SEQ ID NO: 3978077 - RNA, 21 nt, Staphylococcus aureus subsp. aureus Mu50
acaaauguauaaauaauaaau

SEQ ID NO: 3978078 - RNA, 21 nt, Staphylococcus aureus subsp. aureus Mu50
acaaauguucuauagaaaaag

SEQ ID NO: 3978079 - RNA, 17 nt, Staphylococcus aureus subsp. aureus Mu50
acaaauuaaaaaacaau

SEQ ID NO: 3978080 - RNA, 18 nt, Staphylococcus aureus subsp. aureus Mu50
acaaauuaaaaagguacu

SEQ ID NO: 3978081 - RNA, 16 nt, Staphylococcus aureus subsp. aureus Mu50
acaaauuaucacucau

SEQ ID NO: 3978082 - RNA, 12 nt, Staphylococcus aureus subsp. aureus Mu50
acaaauuauuaa

SEQ ID NO: 3978083 - RNA, 22 nt, Staphylococcus aureus subsp. aureus Mu50
acaaauugcaauggcaaccuuu

SEQ ID NO: 3978084 - RNA, 21 nt, Staphylococcus aureus subsp. aureus Mu50
acaaauuugaauauacuuaau

SEQ ID NO: 3978085 - RNA, 14 nt, Staphylococcus aureus subsp. aureus Mu50
acaacacauaaauu

SEQ ID NO: 3978086 - RNA, 15 nt, Staphylococcus aureus subsp. aureus Mu50
acaacacgaugacau

SEQ ID NO: 3978087 - RNA, 14 nt, Staphylococcus aureus subsp. aureus Mu50
acaacauaacaaag

SEQ ID NO: 3978088 - RNA, 21 nt, Staphylococcus aureus subsp. aureus Mu50
acaacaucgauuuaucauuau

SEQ ID NO: 3978089 - RNA, 17 nt, Staphylococcus aureus subsp. aureus Mu50
acaacaucuuuuguugu

SEQ ID NO: 3978090 - RNA, 14 nt, Staphylococcus aureus subsp. aureus Mu50
acaacauuguugau

SEQ ID NO: 3978091 - RNA, 21 nt, Staphylococcus aureus subsp. aureus Mu50
acaaccucugauacuucacca

SEQ ID NO: 3978092 - RNA, 18 nt, Staphylococcus aureus subsp. aureus Mu50
acaaccugugauaaaaau

SEQ ID NO: 3978093 - RNA, 21 nt, Staphylococcus aureus subsp. aureus Mu50
acaaccugugauaaaaaucuu

SEQ ID NO: 3978094 - RNA, 17 nt, Staphylococcus aureus subsp. aureus Mu50
acaacuaauaacaaaua

SEQ ID NO: 3978095 - RNA, 15 nt, Staphylococcus aureus subsp. aureus Mu50
acaacuacuuaaauu

SEQ ID NO: 3978096 - RNA, 13 nt, Staphylococcus aureus subsp. aureus Mu50
acaacuauuccca

SEQ ID NO: 3978097 - RNA, 16 nt, Staphylococcus aureus subsp. aureus Mu50
acaacucguuuuucca

SEQ ID NO: 3978098 - RNA, 17 nt, Staphylococcus aureus subsp. aureus Mu50
acaacucguuuuuccau

SEQ ID NO: 3978099 - RNA, 21 nt, Staphylococcus aureus subsp. aureus Mu50
acaacugagaaaucuuaaaga

SEQ ID NO: 3978100 - RNA, 13 nt, Staphylococcus aureus subsp. aureus Mu50
acaacugauuuaa

SEQ ID NO: 3978101 - RNA, 19 nt, Staphylococcus aureus subsp. aureus Mu50
acaacugcgacauguccau

SEQ ID NO: 3978102 - RNA, 23 nt, Staphylococcus aureus subsp. aureus Mu50
acaacuucuucuccguauuuacc

SEQ ID NO: 3978103 - RNA, 19 nt, Staphylococcus aureus subsp. aureus Mu50
acaacuugaacuaaaacga

SEQ ID NO: 3978104 - RNA, 16 nt, Staphylococcus aureus subsp. aureus Mu50
acaacuuuaauuuuuc

SEQ ID NO: 3978105 - RNA, 19 nt, Staphylococcus aureus subsp. aureus Mu50
acaacuuuacgauaaauag

SEQ ID NO: 3978106 - RNA, 21 nt, Staphylococcus aureus subsp. aureus Mu50
acaacuuuguuuucaguaacu

SEQ ID NO: 3978107 - RNA, 21 nt, Staphylococcus aureus subsp. aureus Mu50
acaagauaacuagcaaaugca

SEQ ID NO: 3978108 - RNA, 19 nt, Staphylococcus aureus subsp. aureus Mu50
acaagauucauacacugca

SEQ ID NO: 3978109 - RNA, 20 nt, Staphylococcus aureus subsp. aureus Mu50
acaagcaucaugaaauuaga

SEQ ID NO: 3978110 - RNA, 17 nt, Staphylococcus aureus subsp. aureus Mu50
acaagcuuuuuucaauu

SEQ ID NO: 3978111 - RNA, 20 nt, Staphylococcus aureus subsp. aureus Mu50
acaagguaugaaauaacaau

SEQ ID NO: 3978112 - RNA, 14 nt, Staphylococcus aureus subsp. aureus Mu50
acaagguucuaaau

SEQ ID NO: 3978113 - RNA, 15 nt, Staphylococcus aureus subsp. aureus Mu50
acaaguacaauaaua

SEQ ID NO: 3978114 - RNA, 15 nt, Staphylococcus aureus subsp. aureus Mu50
acaaguauaaaugca

SEQ ID NO: 3978115 - RNA, 18 nt, Staphylococcus aureus subsp. aureus Mu50
acaaguauacuugaagaa

SEQ ID NO: 3978116 - RNA, 15 nt, Staphylococcus aureus subsp. aureus Mu50
acacagaaugauaua

SEQ ID NO: 3978117 - RNA, 22 nt, Staphylococcus aureus subsp. aureus Mu50
acacagagaaauucgaaaagaa

SEQ ID NO: 3978118 - RNA, 22 nt, Staphylococcus aureus subsp. aureus Mu50
acacagagaauuucgaaaagaa

SEQ ID NO: 3978119 - RNA, 21 nt, Staphylococcus aureus subsp. aureus Mu50
acacagcuaaacgcaauacga

SEQ ID NO: 3978120 - RNA, 14 nt, Staphylococcus aureus subsp. aureus Mu50
acacagguaaauuu

SEQ ID NO: 3978121 - RNA, 16 nt, Staphylococcus aureus subsp. aureus Mu50
acacagguaaauuuaa

SEQ ID NO: 3978122 - RNA, 13 nt, Staphylococcus aureus subsp. aureus Mu50
acacaguacaaau

SEQ ID NO: 3978123 - RNA, 14 nt, Staphylococcus aureus subsp. aureus Mu50
acacaguacaaaua

SEQ ID NO: 3978124 - RNA, 20 nt, Staphylococcus aureus subsp. aureus Mu50
acacaguacaaauaacaaac

SEQ ID NO: 3978125 - RNA, 13 nt, Staphylococcus aureus subsp. aureus Mu50
acacauaaauuaa

SEQ ID NO: 3978126 - RNA, 12 nt, Staphylococcus aureus subsp. aureus Mu50
acacauacaccu

SEQ ID NO: 3978127 - RNA, 19 nt, Staphylococcus aureus subsp. aureus Mu50
acacaucgaucuaaauaua

SEQ ID NO: 3978128 - RNA, 20 nt, Staphylococcus aureus subsp. aureus Mu50
acacaucgaucuaaauauau

SEQ ID NO: 3978129 - RNA, 16 nt, Staphylococcus aureus subsp. aureus Mu50
acacaugcacuuuauu

SEQ ID NO: 3978130 - RNA, 21 nt, Staphylococcus aureus subsp. aureus Mu50
acacauuauugaaauuuuuaa

SEQ ID NO: 3978131 - RNA, 22 nt, Staphylococcus aureus subsp. aureus Mu50
acacauuauugaaauuuuuaau

SEQ ID NO: 3978132 - RNA, 13 nt, Staphylococcus aureus subsp. aureus Mu50
acaccaacauauu

SEQ ID NO: 3978133 - RNA, 20 nt, Staphylococcus aureus subsp. aureus Mu50
acaccauuguuauagcguuu

SEQ ID NO: 3978134 - RNA, 15 nt, Staphylococcus aureus subsp. aureus Mu50
acaccuauaccucau

SEQ ID NO: 3978135 - RNA, 14 nt, Staphylococcus aureus subsp. aureus Mu50
acaccuuaucacuu

SEQ ID NO: 3978136 - RNA, 13 nt, Staphylococcus aureus subsp. aureus Mu50
acaccuucaauau

SEQ ID NO: 3978137 - RNA, 14 nt, Staphylococcus aureus subsp. aureus Mu50
acaccuucaauauc

SEQ ID NO: 3978138 - RNA, 16 nt, Staphylococcus aureus subsp. aureus Mu50
acaccuucaauaucug

SEQ ID NO: 3978139 - RNA, 18 nt, Staphylococcus aureus subsp. aureus Mu50
acacgaauaccaagacca

SEQ ID NO: 3978140 - RNA, 20 nt, Staphylococcus aureus subsp. aureus Mu50
acacgacgcuaaacaaaggg

SEQ ID NO: 3978141 - RNA, 19 nt, Staphylococcus aureus subsp. aureus Mu50
acacgcauuacuuuagaaa

SEQ ID NO: 3978142 - RNA, 21 nt, Staphylococcus aureus subsp. aureus Mu50
acacgcgguaaaacgaaguca

SEQ ID NO: 3978143 - RNA, 19 nt, Staphylococcus aureus subsp. aureus Mu50
acacuaaaaccuauuccua

SEQ ID NO: 3978144 - RNA, 14 nt, Staphylococcus aureus subsp. aureus Mu50
acacuaaauguucu

SEQ ID NO: 3978145 - RNA, 21 nt, Staphylococcus aureus subsp. aureus Mu50
acacuagucuuuuuauuuuaa

SEQ ID NO: 3978146 - RNA, 16 nt, Staphylococcus aureus subsp. aureus Mu50
acacuaucguuuuuau

SEQ ID NO: 3978147 - RNA, 23 nt, Staphylococcus aureus subsp. aureus Mu50
acacucaaaauguuuaacaauaa

SEQ ID NO: 3978148 - RNA, 17 nt, Staphylococcus aureus subsp. aureus Mu50
acacugagaauuucuaa

SEQ ID NO: 3978149 - RNA, 15 nt, Staphylococcus aureus subsp. aureus Mu50
acacugcacaucaua

SEQ ID NO: 3978150 - RNA, 14 nt, Staphylococcus aureus subsp. aureus Mu50
acacugccguuuga

SEQ ID NO: 3978151 - RNA, 19 nt, Staphylococcus aureus subsp. aureus Mu50
acacugugaaguauugcca

SEQ ID NO: 3978152 - RNA, 22 nt, Staphylococcus aureus subsp. aureus Mu50
acacuguuuuauaaaugaauua

SEQ ID NO: 3978153 - RNA, 21 nt, Staphylococcus aureus subsp. aureus Mu50
acacuuauaaucuauaaaugg

SEQ ID NO: 3978154 - RNA, 21 nt, Staphylococcus aureus subsp. aureus Mu50
acacuuccaucaauccaacua

SEQ ID NO: 3978155 - RNA, 21 nt, Staphylococcus aureus subsp. aureus Mu50
acacuucguauugaaugaauu

SEQ ID NO: 3978156 - RNA, 18 nt, Staphylococcus aureus subsp. aureus Mu50
acacuugaggccauaagc

SEQ ID NO: 3978157 - RNA, 13 nt, Staphylococcus aureus subsp. aureus Mu50
acacuugauaaaa

SEQ ID NO: 3978158 - RNA, 20 nt, Staphylococcus aureus subsp. aureus Mu50
acacuuggcuuaggaugaaa

SEQ ID NO: 3978159 - RNA, 16 nt, Staphylococcus aureus subsp. aureus Mu50
acacuuuaguauuaua

SEQ ID NO: 3978160 - RNA, 15 nt, Staphylococcus aureus subsp. aureus Mu50
acacuuuucuuauca

SEQ ID NO: 3978161 - RNA, 12 nt, Staphylococcus aureus subsp. aureus Mu50
acagaaaacaaa

SEQ ID NO: 3978162 - RNA, 11 nt, Staphylococcus aureus subsp. aureus Mu50
acagaaaaggg

SEQ ID NO: 3978163 - RNA, 17 nt, Staphylococcus aureus subsp. aureus Mu50
acagaaccgaaaauaau

SEQ ID NO: 3978164 - RNA, 14 nt, Staphylococcus aureus subsp. aureus Mu50
acagaauuucauca

SEQ ID NO: 3978165 - RNA, 16 nt, Staphylococcus aureus subsp. aureus Mu50
acagaauuucaucaaa

SEQ ID NO: 3978166 - RNA, 18 nt, Staphylococcus aureus subsp. aureus Mu50
acagaauuucaucaaauc

SEQ ID NO: 3978167 - RNA, 14 nt, Staphylococcus aureus subsp. aureus Mu50
acagacaaacauua

SEQ ID NO: 3978168 - RNA, 13 nt, Staphylococcus aureus subsp. aureus Mu50
acagacuuuuuac

SEQ ID NO: 3978169 - RNA, 13 nt, Staphylococcus aureus subsp. aureus Mu50
acagagaaauucg

SEQ ID NO: 3978170 - RNA, 22 nt, Staphylococcus aureus subsp. aureus Mu50
acagagaaauucgaaaagaaau

SEQ ID NO: 3978171 - RNA, 17 nt, Staphylococcus aureus subsp. aureus Mu50
acagauaaguaauaaua

SEQ ID NO: 3978172 - RNA, 21 nt, Staphylococcus aureus subsp. aureus Mu50
acagauaggaaacuuaaauau

SEQ ID NO: 3978173 - RNA, 19 nt, Staphylococcus aureus subsp. aureus Mu50
acagauuuuaaaaauucau

SEQ ID NO: 3978174 - RNA, 12 nt, Staphylococcus aureus subsp. aureus Mu50
acagcaaauaaa

SEQ ID NO: 3978175 - RNA, 14 nt, Staphylococcus aureus subsp. aureus Mu50
acagcaaauaaaau

SEQ ID NO: 3978176 - RNA, 22 nt, Staphylococcus aureus subsp. aureus Mu50
acagcacauuuuuaguuagaaa

SEQ ID NO: 3978177 - RNA, 20 nt, Staphylococcus aureus subsp. aureus Mu50
acagcagacuucuuucaauu

SEQ ID NO: 3978178 - RNA, 18 nt, Staphylococcus aureus subsp. aureus Mu50
acagcaguaggauaauuu

SEQ ID NO: 3978179 - RNA, 22 nt, Staphylococcus aureus subsp. aureus Mu50
acagcaguaggauaauuucaau

SEQ ID NO: 3978180 - RNA, 21 nt, Staphylococcus aureus subsp. aureus Mu50
acagcaucaccuaaagcuuua

SEQ ID NO: 3978181 - RNA, 20 nt, Staphylococcus aureus subsp. aureus Mu50
acagcauuuccuaugugcug

SEQ ID NO: 3978182 - RNA, 16 nt, Staphylococcus aureus subsp. aureus Mu50
acagccgaggcaauau

SEQ ID NO: 3978183 - RNA, 17 nt, Staphylococcus aureus subsp. aureus Mu50
acagcggaauacagaug

SEQ ID NO: 3978184 - RNA, 14 nt, Staphylococcus aureus subsp. aureus Mu50
acagcgguuuguau

SEQ ID NO: 3978185 - RNA, 22 nt, Staphylococcus aureus subsp. aureus Mu50
acagcguauuuuaaugauuuuu

SEQ ID NO: 3978186 - RNA, 19 nt, Staphylococcus aureus subsp. aureus Mu50
acagcgugaauauaaguaa

SEQ ID NO: 3978187 - RNA, 22 nt, Staphylococcus aureus subsp. aureus Mu50
acagcgugauucaucuauuauu

SEQ ID NO: 3978188 - RNA, 13 nt, Staphylococcus aureus subsp. aureus Mu50
acagcuucauuaa

SEQ ID NO: 3978189 - RNA, 15 nt, Staphylococcus aureus subsp. aureus Mu50
acagggguaaaacuu

SEQ ID NO: 3978190 - RNA, 20 nt, Staphylococcus aureus subsp. aureus Mu50
acagguaaauuuaaaauaau

SEQ ID NO: 3978191 - RNA, 17 nt, Staphylococcus aureus subsp. aureus Mu50
acaggugcuuacuuuua

SEQ ID NO: 3978192 - RNA, 18 nt, Staphylococcus aureus subsp. aureus Mu50
acaguaaauugauucuuu

SEQ ID NO: 3978193 - RNA, 13 nt, Staphylococcus aureus subsp. aureus Mu50
acaguaaguaaua

SEQ ID NO: 3978194 - RNA, 15 nt, Staphylococcus aureus subsp. aureus Mu50
acaguacaaauaaca

SEQ ID NO: 3978195 - RNA, 22 nt, Staphylococcus aureus subsp. aureus Mu50
acaguaguuaauugaaugaaaa

SEQ ID NO: 3978196 - RNA, 22 nt, Staphylococcus aureus subsp. aureus Mu50
acagucaacugcugcuaaaaua

SEQ ID NO: 3978197 - RNA, 18 nt, Staphylococcus aureus subsp. aureus Mu50
acagucauaaauugauuu

SEQ ID NO: 3978198 - RNA, 20 nt, Staphylococcus aureus subsp. aureus Mu50
acagucccaaccccuuuauu

SEQ ID NO: 3978199 - RNA, 15 nt, Staphylococcus aureus subsp. aureus Mu50
acagugaaucuaaac

SEQ ID NO: 3978200 - RNA, 17 nt, Staphylococcus aureus subsp. aureus Mu50
acaguggauuacagaug

SEQ ID NO: 3978201 - RNA, 19 nt, Staphylococcus aureus subsp. aureus Mu50
acaguguugaauuucaaaa

SEQ ID NO: 3978202 - RNA, 20 nt, Staphylococcus aureus subsp. aureus Mu50
acaguguugaauuucaaaau

SEQ ID NO: 3978203 - RNA, 15 nt, Staphylococcus aureus subsp. aureus Mu50
acauuucugaugcua

SEQ ID NO: 3978204 - RNA, 23 nt, Staphylococcus aureus subsp. aureus Mu50
acauuugguggagaaccaaaaau

SEQ ID NO: 3978205 - RNA, 19 nt, Staphylococcus aureus subsp. aureus Mu50
acauuugguggagaaccuu

SEQ ID NO: 3978206 - RNA, 15 nt, Staphylococcus aureus subsp. aureus Mu50
acauuugguucuucu

SEQ ID NO: 3978207 - RNA, 12 nt, Staphylococcus aureus subsp. aureus Mu50
acauuugucaua

SEQ ID NO: 3978208 - RNA, 14 nt, Staphylococcus aureus subsp. aureus Mu50
acauuugucauaau

SEQ ID NO: 3978209 - RNA, 12 nt, Staphylococcus aureus subsp. aureus Mu50
acauuuuaaauc

SEQ ID NO: 3978210 - RNA, 14 nt, Staphylococcus aureus subsp. aureus Mu50
acauuuuaaaucua

SEQ ID NO: 3978211 - RNA, 17 nt, Staphylococcus aureus subsp. aureus Mu50
acauuuuaucugaaaau

SEQ ID NO: 3978212 - RNA, 18 nt, Staphylococcus aureus subsp. aureus Mu50
acauuuuaucugaaaaua

SEQ ID NO: 3978213 - RNA, 12 nt, Staphylococcus aureus subsp. aureus Mu50
acauuuucaaaa

SEQ ID NO: 3978214 - RNA, 17 nt, Staphylococcus aureus subsp. aureus Mu50
acauuuucaaaaccaau

SEQ ID NO: 3978215 - RNA, 19 nt, Staphylococcus aureus subsp. aureus Mu50
acauuuucaaguuuaaaau

SEQ ID NO: 3978216 - RNA, 19 nt, Staphylococcus aureus subsp. aureus Mu50
acauuuugccccucauuca

SEQ ID NO: 3978217 - RNA, 15 nt, Staphylococcus aureus subsp. aureus Mu50
acauuuuugaauuua

SEQ ID NO: 3978218 - RNA, 21 nt, Staphylococcus aureus subsp. aureus Mu50
acauuuuugaauuuaauacua

SEQ ID NO: 3978219 - RNA, 14 nt, Staphylococcus aureus subsp. aureus Mu50
acauuuuuggcuua

SEQ ID NO: 3978220 - RNA, 16 nt, Staphylococcus aureus subsp. aureus Mu50
acauuuuugugcaaaa

SEQ ID NO: 3978221 - RNA, 22 nt, Staphylococcus aureus subsp. aureus Mu50
acauuuuuuauagcaaauugau

SEQ ID NO: 3978222 - RNA, 13 nt, Staphylococcus aureus subsp. aureus Mu50
accaaaauuauau

SEQ ID NO: 3978223 - RNA, 17 nt, Staphylococcus aureus subsp. aureus Mu50
accaaagaaaucaccag

SEQ ID NO: 3978224 - RNA, 15 nt, Staphylococcus aureus subsp. aureus Mu50
accaaauaaauuaaa

SEQ ID NO: 3978225 - RNA, 16 nt, Staphylococcus aureus subsp. aureus Mu50
accaaauaaauuaaau

SEQ ID NO: 3978226 - RNA, 23 nt, Staphylococcus aureus subsp. aureus Mu50
accaaaugugguggguauauaau

SEQ ID NO: 3978227 - RNA, 16 nt, Staphylococcus aureus subsp. aureus Mu50
accaacaacuuuguuu

SEQ ID NO: 3978228 - RNA, 12 nt, Staphylococcus aureus subsp. aureus Mu50
accaacaagguu

SEQ ID NO: 3978229 - RNA, 22 nt, Staphylococcus aureus subsp. aureus Mu50
accaacaauugcacuuggugau

SEQ ID NO: 3978230 - RNA, 17 nt, Staphylococcus aureus subsp. aureus Mu50
accaacaccuaauauuu

SEQ ID NO: 3978231 - RNA, 19 nt, Staphylococcus aureus subsp. aureus Mu50
accaaccaaaaccaaauga

SEQ ID NO: 3978232 - RNA, 20 nt, Staphylococcus aureus subsp. aureus Mu50
accaaccaaaaccaaaugaa

SEQ ID NO: 3978233 - RNA, 22 nt, Staphylococcus aureus subsp. aureus Mu50
accaacugucgguucaucuaaa

SEQ ID NO: 3978234 - RNA, 23 nt, Staphylococcus aureus subsp. aureus Mu50
accaaggguuucuggcucuucuu

SEQ ID NO: 3978235 - RNA, 24 nt, Staphylococcus aureus subsp. aureus Mu50
accaagugcuuuuuuaccagcaug

SEQ ID NO: 3978236 - RNA, 17 nt, Staphylococcus aureus subsp. aureus Mu50
accaaucaauaguuuau

SEQ ID NO: 3978237 - RNA, 20 nt, Staphylococcus aureus subsp. aureus Mu50
accaaugaauaaauugauau

SEQ ID NO: 3978238 - RNA, 20 nt, Staphylococcus aureus subsp. aureus Mu50
accaaugauagugaauaaug

SEQ ID NO: 3978239 - RNA, 13 nt, Staphylococcus aureus subsp. aureus Mu50
accaauuagcaug

SEQ ID NO: 3978240 - RNA, 15 nt, Staphylococcus aureus subsp. aureus Mu50
accaauuagcaugac

SEQ ID NO: 3978241 - RNA, 15 nt, Staphylococcus aureus subsp. aureus Mu50
accaauugaaauuaa

SEQ ID NO: 3978242 - RNA, 21 nt, Staphylococcus aureus subsp. aureus Mu50
accaauugaaauuaacuguau

SEQ ID NO: 3978243 - RNA, 14 nt, Staphylococcus aureus subsp. aureus Mu50
accaauugaauauu

SEQ ID NO: 3978244 - RNA, 15 nt, Staphylococcus aureus subsp. aureus Mu50
accaauugaauauuu

SEQ ID NO: 3978245 - RNA, 19 nt, Staphylococcus aureus subsp. aureus Mu50
accaauugcugauauaaua

SEQ ID NO: 3978246 - RNA, 18 nt, Staphylococcus aureus subsp. aureus Mu50
accaauuuuaacuuauau

SEQ ID NO: 3978247 - RNA, 14 nt, Staphylococcus aureus subsp. aureus Mu50
accacaaccaguca

SEQ ID NO: 3978248 - RNA, 17 nt, Staphylococcus aureus subsp. aureus Mu50
accacacuuuaaacaag

SEQ ID NO: 3978249 - RNA, 17 nt, Staphylococcus aureus subsp. aureus Mu50
accacauuauaauggac

SEQ ID NO: 3978250 - RNA, 14 nt, Staphylococcus aureus subsp. aureus Mu50
accaccaccuguga

SEQ ID NO: 3978251 - RNA, 14 nt, Staphylococcus aureus subsp. aureus Mu50
accaccacuuucag

SEQ ID NO: 3978252 - RNA, 11 nt, Staphylococcus aureus subsp. aureus Mu50
accaccccaac

SEQ ID NO: 3978253 - RNA, 15 nt, Staphylococcus aureus subsp. aureus Mu50
accaccccaacuugc

SEQ ID NO: 3978254 - RNA, 19 nt, Staphylococcus aureus subsp. aureus Mu50
accaccugauaaugcaugu

SEQ ID NO: 3978255 - RNA, 14 nt, Staphylococcus aureus subsp. aureus Mu50
accaccugcaauuu

SEQ ID NO: 3978256 - RNA, 20 nt, Staphylococcus aureus subsp. aureus Mu50
accacucaauucucuaacuu

SEQ ID NO: 3978257 - RNA, 14 nt, Staphylococcus aureus subsp. aureus Mu50
accacuuauaacau

SEQ ID NO: 3978258 - RNA, 14 nt, Staphylococcus aureus subsp. aureus Mu50
accacuucuucacc

SEQ ID NO: 3978259 - RNA, 16 nt, Staphylococcus aureus subsp. aureus Mu50
accacuugaauacuuu

SEQ ID NO: 3978260 - RNA, 20 nt, Staphylococcus aureus subsp. aureus Mu50
accacuuuccauacaccuuu

SEQ ID NO: 3978261 - RNA, 19 nt, Staphylococcus aureus subsp. aureus Mu50
accacuuuuguuaaaaaau

SEQ ID NO: 3978262 - RNA, 20 nt, Staphylococcus aureus subsp. aureus Mu50
accagccucuguguuggggc

SEQ ID NO: 3978263 - RNA, 15 nt, Staphylococcus aureus subsp. aureus Mu50
accagcuaacaaaag

SEQ ID NO: 3978264 - RNA, 14 nt, Staphylococcus aureus subsp. aureus Mu50
accagcuaaccaaa

SEQ ID NO: 3978265 - RNA, 17 nt, Staphylococcus aureus subsp. aureus Mu50
accaguagcuaaugcaa

SEQ ID NO: 3978266 - RNA, 22 nt, Staphylococcus aureus subsp. aureus Mu50
accaguauaaccauguauaucu

SEQ ID NO: 3978267 - RNA, 21 nt, Staphylococcus aureus subsp. aureus Mu50
accaguucgaaaauuauacaa

SEQ ID NO: 3978268 - RNA, 14 nt, Staphylococcus aureus subsp. aureus Mu50
accaguuucuggua

SEQ ID NO: 3978269 - RNA, 17 nt, Staphylococcus aureus subsp. aureus Mu50
accaguuugaucauaau

SEQ ID NO: 3978270 - RNA, 23 nt, Staphylococcus aureus subsp. aureus Mu50
accaguuugaucauaauucagug

SEQ ID NO: 3978271 - RNA, 18 nt, Staphylococcus aureus subsp. aureus Mu50
accauaacuuuauauaua

SEQ ID NO: 3978272 - RNA, 20 nt, Staphylococcus aureus subsp. aureus Mu50
accauaacuuuauauauaaa

SEQ ID NO: 3978273 - RNA, 16 nt, Staphylococcus aureus subsp. aureus Mu50
accauaauuaaauaac

SEQ ID NO: 3978274 - RNA, 23 nt, Staphylococcus aureus subsp. aureus Mu50
accauagauuauauuaucauuga

SEQ ID NO: 3978275 - RNA, 16 nt, Staphylococcus aureus subsp. aureus Mu50
accauaucaaguuuua

SEQ ID NO: 3978276 - RNA, 20 nt, Staphylococcus aureus subsp. aureus Mu50
accauauuuaugguguagcu

SEQ ID NO: 3978277 - RNA, 18 nt, Staphylococcus aureus subsp. aureus Mu50
accauauuuuuagaaaag

SEQ ID NO: 3978278 - RNA, 21 nt, Staphylococcus aureus subsp. aureus Mu50
accaucaacgccauauuuauu

SEQ ID NO: 3978279 - RNA, 14 nt, Staphylococcus aureus subsp. aureus Mu50
accaucaugacagc

SEQ ID NO: 3978280 - RNA, 16 nt, Staphylococcus aureus subsp. aureus Mu50
accaucauucauaugg

SEQ ID NO: 3978281 - RNA, 20 nt, Staphylococcus aureus subsp. aureus Mu50
accaucucaacuaaucgugu

SEQ ID NO: 3978282 - RNA, 14 nt, Staphylococcus aureus subsp. aureus Mu50
accaucucuauuuu

SEQ ID NO: 3978283 - RNA, 17 nt, Staphylococcus aureus subsp. aureus Mu50
accaugagaaaccgcuu

SEQ ID NO: 3978284 - RNA, 16 nt, Staphylococcus aureus subsp. aureus Mu50
accaugccagcuucua

SEQ ID NO: 3978285 - RNA, 18 nt, Staphylococcus aureus subsp. aureus Mu50
accauggcgauuccaauc

SEQ ID NO: 3978286 - RNA, 14 nt, Staphylococcus aureus subsp. aureus Mu50
accauuaauaguaa

SEQ ID NO: 3978287 - RNA, 20 nt, Staphylococcus aureus subsp. aureus Mu50
accauuaucaagaacuuuaa

SEQ ID NO: 3978288 - RNA, 14 nt, Staphylococcus aureus subsp. aureus Mu50
accauuaugauuaa

SEQ ID NO: 3978289 - RNA, 22 nt, Staphylococcus aureus subsp. aureus Mu50
accauucaucgucucacuuaau

SEQ ID NO: 3978290 - RNA, 14 nt, Staphylococcus aureus subsp. aureus Mu50
accauuccaaaaau

SEQ ID NO: 3978291 - RNA, 19 nt, Staphylococcus aureus subsp. aureus Mu50
accucuuuuguuuaguaug

SEQ ID NO: 3978292 - RNA, 21 nt, Staphylococcus aureus subsp. aureus Mu50
accugcaauauagcaauuuuc

SEQ ID NO: 3978293 - RNA, 16 nt, Staphylococcus aureus subsp. aureus Mu50
accugcauauguguuu

SEQ ID NO: 3978294 - RNA, 17 nt, Staphylococcus aureus subsp. aureus Mu50
accugcgccuucuuuuu

SEQ ID NO: 3978295 - RNA, 16 nt, Staphylococcus aureus subsp. aureus Mu50
accugcugaaguuuga

SEQ ID NO: 3978296 - RNA, 18 nt, Staphylococcus aureus subsp. aureus Mu50
accugcugaaguuugaac

SEQ ID NO: 3978297 - RNA, 17 nt, Staphylococcus aureus subsp. aureus Mu50
accugcuuuuuauuauu

SEQ ID NO: 3978298 - RNA, 15 nt, Staphylococcus aureus subsp. aureus Mu50
accugggacauuaau

SEQ ID NO: 3978299 - RNA, 19 nt, Staphylococcus aureus subsp. aureus Mu50
accugggacauuaaucgau

SEQ ID NO: 3978300 - RNA, 18 nt, Staphylococcus aureus subsp. aureus Mu50
accuggucguacuuucaa

SEQ ID NO: 3978301 - RNA, 16 nt, Staphylococcus aureus subsp. aureus Mu50
accugugauaaaaauc

SEQ ID NO: 3978302 - RNA, 12 nt, Staphylococcus aureus subsp. aureus Mu50
accuguuaaugu

SEQ ID NO: 3978303 - RNA, 22 nt, Staphylococcus aureus subsp. aureus Mu50
accuguuaauguuccaauaaac

SEQ ID NO: 3978304 - RNA, 17 nt, Staphylococcus aureus subsp. aureus Mu50
accuguuacuugagaac

SEQ ID NO: 3978305 - RNA, 22 nt, Staphylococcus aureus subsp. aureus Mu50
accuuaauaggauaugcuaaac

SEQ ID NO: 3978306 - RNA, 18 nt, Staphylococcus aureus subsp. aureus Mu50
accuuacauaggauaucu

SEQ ID NO: 3978307 - RNA, 15 nt, Staphylococcus aureus subsp. aureus Mu50
accuuacccaaaaaa

SEQ ID NO: 3978308 - RNA, 19 nt, Staphylococcus aureus subsp. aureus Mu50
accuuacuacgcauuauua

SEQ ID NO: 3978309 - RNA, 19 nt, Staphylococcus aureus subsp. aureus Mu50
accuuaucaguguaaguuu

SEQ ID NO: 3978310 - RNA, 13 nt, Staphylococcus aureus subsp. aureus Mu50
accuucaauaucu

SEQ ID NO: 3978311 - RNA, 15 nt, Staphylococcus aureus subsp. aureus Mu50
accuucaaucaacga

SEQ ID NO: 3978312 - RNA, 22 nt, Staphylococcus aureus subsp. aureus Mu50
accuucaauugacauuaaugau

SEQ ID NO: 3978313 - RNA, 16 nt, Staphylococcus aureus subsp. aureus Mu50
accuucagaugcuaca

SEQ ID NO: 3978314 - RNA, 23 nt, Staphylococcus aureus subsp. aureus Mu50
accuucccagucaugucccauaa

SEQ ID NO: 3978315 - RNA, 16 nt, Staphylococcus aureus subsp. aureus Mu50
accuucgagugcuuuu

SEQ ID NO: 3978316 - RNA, 22 nt, Staphylococcus aureus subsp. aureus Mu50
accuucgucgcuaagaaccuuu

SEQ ID NO: 3978317 - RNA, 20 nt, Staphylococcus aureus subsp. aureus Mu50
accuucugauacuucaucug

SEQ ID NO: 3978318 - RNA, 14 nt, Staphylococcus aureus subsp. aureus Mu50
accuucuucucuaa

SEQ ID NO: 3978319 - RNA, 18 nt, Staphylococcus aureus subsp. aureus Mu50
accuugaaugauauuaac

SEQ ID NO: 3978320 - RNA, 18 nt, Staphylococcus aureus subsp. aureus Mu50
accuugauuuaauuuuua

SEQ ID NO: 3978321 - RNA, 20 nt, Staphylococcus aureus subsp. aureus Mu50
accuugauuuaauuuuuaau

SEQ ID NO: 3978322 - RNA, 15 nt, Staphylococcus aureus subsp. aureus Mu50
accuuguaaauuuaa

SEQ ID NO: 3978323 - RNA, 14 nt, Staphylococcus aureus subsp. aureus Mu50
accuuguuaaaaua

SEQ ID NO: 3978324 - RNA, 16 nt, Staphylococcus aureus subsp. aureus Mu50
accuuguucuuuacuc

SEQ ID NO: 3978325 - RNA, 15 nt, Staphylococcus aureus subsp. aureus Mu50
accuuuaaaacauca

SEQ ID NO: 3978326 - RNA, 17 nt, Staphylococcus aureus subsp. aureus Mu50
accuuuaccaguaucau

SEQ ID NO: 3978327 - RNA, 18 nt, Staphylococcus aureus subsp. aureus Mu50
accuuuaucuguaacaaa

SEQ ID NO: 3978328 - RNA, 20 nt, Staphylococcus aureus subsp. aureus Mu50
accuuuaugugcaucauuua

SEQ ID NO: 3978329 - RNA, 18 nt, Staphylococcus aureus subsp. aureus Mu50
accuuucaaauauaucua

SEQ ID NO: 3978330 - RNA, 22 nt, Staphylococcus aureus subsp. aureus Mu50
accuuuccauucguauaagaau

SEQ ID NO: 3978331 - RNA, 23 nt, Staphylococcus aureus subsp. aureus Mu50
accuuuccauucguauaagaauc

SEQ ID NO: 3978332 - RNA, 15 nt, Staphylococcus aureus subsp. aureus Mu50
accuuucgauaaacu

SEQ ID NO: 3978333 - RNA, 13 nt, Staphylococcus aureus subsp. aureus Mu50
accuuugucuuuu

SEQ ID NO: 3978334 - RNA, 17 nt, Staphylococcus aureus subsp. aureus Mu50
accuuugucuuuuuuau

SEQ ID NO: 3978335 - RNA, 21 nt, Staphylococcus aureus subsp. aureus Mu50
accuuuuaaggcagcuaaaaa

SEQ ID NO: 3978336 - RNA, 22 nt, Staphylococcus aureus subsp. aureus Mu50
accuuuugauguuuaugacaaa

SEQ ID NO: 3978337 - RNA, 14 nt, Staphylococcus aureus subsp. aureus Mu50
accuuuuucuacca

SEQ ID NO: 3978338 - RNA, 21 nt, Staphylococcus aureus subsp. aureus Mu50
accuuuuuguuuucaauaauu

SEQ ID NO: 3978339 - RNA, 12 nt, Staphylococcus aureus subsp. aureus Mu50
accuuuuuuaag

SEQ ID NO: 3978340 - RNA, 13 nt, Staphylococcus aureus subsp. aureus Mu50
accuuuuuucucu

SEQ ID NO: 3978341 - RNA, 20 nt, Staphylococcus aureus subsp. aureus Mu50
acgaaaaagaugguuuuguu

SEQ ID NO: 3978342 - RNA, 21 nt, Staphylococcus aureus subsp. aureus Mu50
acgaaaaaugccaacuauacc

SEQ ID NO: 3978343 - RNA, 18 nt, Staphylococcus aureus subsp. aureus Mu50
acgaaaagucagcuuaca

SEQ ID NO: 3978344 - RNA, 20 nt, Staphylococcus aureus subsp. aureus Mu50
acgaaaauucgcuuguaaca

SEQ ID NO: 3978345 - RNA, 19 nt, Staphylococcus aureus subsp. aureus Mu50
acgaaacacacuaaaagcu

SEQ ID NO: 3978346 - RNA, 18 nt, Staphylococcus aureus subsp. aureus Mu50
acgaaaguagaauuauuu

SEQ ID NO: 3978347 - RNA, 16 nt, Staphylococcus aureus subsp. aureus Mu50
acgaaauaaauuuuac

SEQ ID NO: 3978348 - RNA, 15 nt, Staphylococcus aureus subsp. aureus Mu50
acgaaauaguucaaa

SEQ ID NO: 3978349 - RNA, 20 nt, Staphylococcus aureus subsp. aureus Mu50
acgaaaugaccuuaauauaa

SEQ ID NO: 3978350 - RNA, 23 nt, Staphylococcus aureus subsp. aureus Mu50
acgaacaucuaauacauuauguu

SEQ ID NO: 3978351 - RNA, 19 nt, Staphylococcus aureus subsp. aureus Mu50
acgaagcgggccucaucga

SEQ ID NO: 3978352 - RNA, 23 nt, Staphylococcus aureus subsp. aureus Mu50
acgaaucacaguuauauauuccu

SEQ ID NO: 3978353 - RNA, 14 nt, Staphylococcus aureus subsp. aureus Mu50
acgaauuaaaauaa

SEQ ID NO: 3978354 - RNA, 17 nt, Staphylococcus aureus subsp. aureus Mu50
acgacaccaacauauuu

SEQ ID NO: 3978355 - RNA, 13 nt, Staphylococcus aureus subsp. aureus Mu50
acgacauuuuuag

SEQ ID NO: 3978356 - RNA, 22 nt, Staphylococcus aureus subsp. aureus Mu50
acgaccagucgcauauuuugau

SEQ ID NO: 3978357 - RNA, 16 nt, Staphylococcus aureus subsp. aureus Mu50
acgacgaaauaaauuu

SEQ ID NO: 3978358 - RNA, 18 nt, Staphylococcus aureus subsp. aureus Mu50
acgacguccagcuaauaa

SEQ ID NO: 3978359 - RNA, 20 nt, Staphylococcus aureus subsp. aureus Mu50
acgagaaaugucaguuuuga

SEQ ID NO: 3978360 - RNA, 15 nt, Staphylococcus aureus subsp. aureus Mu50
acgagcaacaucuuu

SEQ ID NO: 3978361 - RNA, 19 nt, Staphylococcus aureus subsp. aureus Mu50
acgagcaacaucuuuuguu

SEQ ID NO: 3978362 - RNA, 16 nt, Staphylococcus aureus subsp. aureus Mu50
acgagcaguauauauc

SEQ ID NO: 3978363 - RNA, 19 nt, Staphylococcus aureus subsp. aureus Mu50
acgagcuugggacagaaaa

SEQ ID NO: 3978364 - RNA, 20 nt, Staphylococcus aureus subsp. aureus Mu50
acgagucauaaauauaaaau

SEQ ID NO: 3978365 - RNA, 22 nt, Staphylococcus aureus subsp. aureus Mu50
acgagugcacuuguaauauuau

SEQ ID NO: 3978366 - RNA, 17 nt, Staphylococcus aureus subsp. aureus Mu50
acgagugcuuucaccuu

SEQ ID NO: 3978367 - RNA, 20 nt, Staphylococcus aureus subsp. aureus Mu50
acgauaaauagugauugcuu

SEQ ID NO: 3978368 - RNA, 12 nt, Staphylococcus aureus subsp. aureus Mu50
acgauaacaauu

SEQ ID NO: 3978369 - RNA, 20 nt, Staphylococcus aureus subsp. aureus Mu50
acgauaacaauuuauuaaaa

SEQ ID NO: 3978370 - RNA, 20 nt, Staphylococcus aureus subsp. aureus Mu50
acgauaacagcuacaaauaa

SEQ ID NO: 3978371 - RNA, 21 nt, Staphylococcus aureus subsp. aureus Mu50
acgauaacagcuacaaauaau

SEQ ID NO: 3978372 - RNA, 23 nt, Staphylococcus aureus subsp. aureus Mu50
acgauaacagcuacaaauaauga

SEQ ID NO: 3978373 - RNA, 22 nt, Staphylococcus aureus subsp. aureus Mu50
acgauaacuacacuuaauauau

SEQ ID NO: 3978374 - RNA, 14 nt, Staphylococcus aureus subsp. aureus Mu50
acgauaagaauuaa

SEQ ID NO: 3978375 - RNA, 20 nt, Staphylococcus aureus subsp. aureus Mu50
acgauaagcacgauaaaaau

SEQ ID NO: 3978376 - RNA, 23 nt, Staphylococcus aureus subsp. aureus Mu50
acgauaauaacuagaacaagaau

SEQ ID NO: 3978377 - RNA, 15 nt, Staphylococcus aureus subsp. aureus Mu50
acgauaauaauaaga

SEQ ID NO: 3978378 - RNA, 13 nt, Staphylococcus aureus subsp. aureus Mu50
acgauaauuauac

SEQ ID NO: 3978379 - RNA, 17 nt, Staphylococcus aureus subsp. aureus Mu50
acgauaauuauacguua

SEQ ID NO: 3978380 - RNA, 16 nt, Staphylococcus aureus subsp. aureus Mu50
acgauaauuguuaaag

SEQ ID NO: 3978381 - RNA, 18 nt, Staphylococcus aureus subsp. aureus Mu50
acgauaccuuuaauaaua

SEQ ID NO: 3978382 - RNA, 17 nt, Staphylococcus aureus subsp. aureus Mu50
acgauacgacuugaaau

SEQ ID NO: 3978383 - RNA, 21 nt, Staphylococcus aureus subsp. aureus Mu50
acgauacgacuugaaaucuuu

SEQ ID NO: 3978384 - RNA, 22 nt, Staphylococcus aureus subsp. aureus Mu50
acgauagugguacuauuuuuga

SEQ ID NO: 3978385 - RNA, 17 nt, Staphylococcus aureus subsp. aureus Mu50
acgauauaacauuaaaa

SEQ ID NO: 3978386 - RNA, 15 nt, Staphylococcus aureus subsp. aureus Mu50
acgauauucuacaug

SEQ ID NO: 3978387 - RNA, 21 nt, Staphylococcus aureus subsp. aureus Mu50
acgauauuuuaaaaaguaauu

SEQ ID NO: 3978388 - RNA, 16 nt, Staphylococcus aureus subsp. aureus Mu50
acgaucauaaauauuu

SEQ ID NO: 3978389 - RNA, 17 nt, Staphylococcus aureus subsp. aureus Mu50
acgaugaaacucuguuu

SEQ ID NO: 3978390 - RNA, 13 nt, Staphylococcus aureus subsp. aureus Mu50
acgaugguugcuu

SEQ ID NO: 3978391 - RNA, 14 nt, Staphylococcus aureus subsp. aureus Mu50
acgauuaauaaaau

SEQ ID NO: 3978392 - RNA, 15 nt, Staphylococcus aureus subsp. aureus Mu50
acgauugaacaucuc

SEQ ID NO: 3978393 - RNA, 18 nt, Staphylococcus aureus subsp. aureus Mu50
acgauugaguugaaaaua

SEQ ID NO: 3978394 - RNA, 23 nt, Staphylococcus aureus subsp. aureus Mu50
acgauugauagacauaaccuugc

SEQ ID NO: 3978395 - RNA, 16 nt, Staphylococcus aureus subsp. aureus Mu50
acgauugauuaucaua

SEQ ID NO: 3978396 - RNA, 18 nt, Staphylococcus aureus subsp. aureus Mu50
acgauuuaauuaaaacau

SEQ ID NO: 3978397 - RNA, 17 nt, Staphylococcus aureus subsp. aureus Mu50
acgauuuguucaaugau

SEQ ID NO: 3978398 - RNA, 20 nt, Staphylococcus aureus subsp. aureus Mu50
acgauuuugucuuuuauauu

SEQ ID NO: 3978399 - RNA, 19 nt, Staphylococcus aureus subsp. aureus Mu50
acgauuuuuaaaaugcuuu

SEQ ID NO: 3978400 - RNA, 17 nt, Staphylococcus aureus subsp. aureus Mu50
acgcaaaaauacuccuu

SEQ ID NO: 3978401 - RNA, 14 nt, Staphylococcus aureus subsp. aureus Mu50
acgcaaaacaauau

SEQ ID NO: 3978402 - RNA, 17 nt, Staphylococcus aureus subsp. aureus Mu50
acgcaauacgaauaucu

SEQ ID NO: 3978403 - RNA, 13 nt, Staphylococcus aureus subsp. aureus Mu50
acgcaauaucaua

SEQ ID NO: 3978404 - RNA, 15 nt, Staphylococcus aureus subsp. aureus Mu50
acgcaauuuaauauu

SEQ ID NO: 3978405 - RNA, 23 nt, Staphylococcus aureus subsp. aureus Mu50
acgcaauuuaauauuauaaguug

SEQ ID NO: 3978406 - RNA, 16 nt, Staphylococcus aureus subsp. aureus Mu50
acgcacaucuaaguga

SEQ ID NO: 3978407 - RNA, 19 nt, Staphylococcus aureus subsp. aureus Mu50
acgcacguauauacgauug

SEQ ID NO: 3978408 - RNA, 14 nt, Staphylococcus aureus subsp. aureus Mu50
acgcacuauuuuua

SEQ ID NO: 3978409 - RNA, 15 nt, Staphylococcus aureus subsp. aureus Mu50
acgcacuauuuuuau

SEQ ID NO: 3978410 - RNA, 21 nt, Staphylococcus aureus subsp. aureus Mu50
acgcacuauuuuuauaaguau

SEQ ID NO: 3978411 - RNA, 23 nt, Staphylococcus aureus subsp. aureus Mu50
acgcauacaggaaauugaagcgu

SEQ ID NO: 3978412 - RNA, 23 nt, Staphylococcus aureus subsp. aureus Mu50
acgcauuacuuuagaaagugauu

SEQ ID NO: 3978413 - RNA, 13 nt, Staphylococcus aureus subsp. aureus Mu50
acgcauuuuaaau

SEQ ID NO: 3978414 - RNA, 15 nt, Staphylococcus aureus subsp. aureus Mu50
acgcauuuuaaauaa

SEQ ID NO: 3978415 - RNA, 19 nt, Staphylococcus aureus subsp. aureus Mu50
acgcauuuuaaauaaaaug

SEQ ID NO: 3978416 - RNA, 21 nt, Staphylococcus aureus subsp. aureus Mu50
acgccaaauaucaguaauaau

SEQ ID NO: 3978417 - RNA, 15 nt, Staphylococcus aureus subsp. aureus Mu50
acgccauaagaaaau

SEQ ID NO: 3978418 - RNA, 14 nt, Staphylococcus aureus subsp. aureus Mu50
acgccauucaucau

SEQ ID NO: 3978419 - RNA, 21 nt, Staphylococcus aureus subsp. aureus Mu50
acgccucaacacuuucuacuc

SEQ ID NO: 3978420 - RNA, 23 nt, Staphylococcus aureus subsp. aureus Mu50
acgccuggaaucgcguuuaacaa

SEQ ID NO: 3978421 - RNA, 13 nt, Staphylococcus aureus subsp. aureus Mu50
acgccuuuccauu

SEQ ID NO: 3978422 - RNA, 23 nt, Staphylococcus aureus subsp. aureus Mu50
acgcgauugacguggucuacuuc

SEQ ID NO: 3978423 - RNA, 17 nt, Staphylococcus aureus subsp. aureus Mu50
acgcgugaauuaaaaaa

SEQ ID NO: 3978424 - RNA, 16 nt, Staphylococcus aureus subsp. aureus Mu50
acgcuaaacaaagggg

SEQ ID NO: 3978425 - RNA, 17 nt, Staphylococcus aureus subsp. aureus Mu50
acgcuaaacaaagggga

SEQ ID NO: 3978426 - RNA, 21 nt, Staphylococcus aureus subsp. aureus Mu50
acgcuaauggaugaauauauu

SEQ ID NO: 3978427 - RNA, 22 nt, Staphylococcus aureus subsp. aureus Mu50
acgcuaauggaugaauauauug

SEQ ID NO: 3978428 - RNA, 17 nt, Staphylococcus aureus subsp. aureus Mu50
acgcuaauuuuacucug

SEQ ID NO: 3978429 - RNA, 21 nt, Staphylococcus aureus subsp. aureus Mu50
acgcuagcauaucuuuaucau

SEQ ID NO: 3978430 - RNA, 19 nt, Staphylococcus aureus subsp. aureus Mu50
acgcuagugcgcgauaaau

SEQ ID NO: 3978431 - RNA, 17 nt, Staphylococcus aureus subsp. aureus Mu50
acgcucaacuauauaua

SEQ ID NO: 3978432 - RNA, 22 nt, Staphylococcus aureus subsp. aureus Mu50
acgcugaaauuuuuuagugaaa

SEQ ID NO: 3978433 - RNA, 23 nt, Staphylococcus aureus subsp. aureus Mu50
acgcugaaauuuuuuagugaaaa

SEQ ID NO: 3978434 - RNA, 15 nt, Staphylococcus aureus subsp. aureus Mu50
acgcugguaauauuu

SEQ ID NO: 3978435 - RNA, 19 nt, Staphylococcus aureus subsp. aureus Mu50
acgcugguaauauuuuugu

SEQ ID NO: 3978436 - RNA, 15 nt, Staphylococcus aureus subsp. aureus Mu50
acgcuucaauuauuu

SEQ ID NO: 3978437 - RNA, 17 nt, Staphylococcus aureus subsp. aureus Mu50
acgcuucaauuauuuca

SEQ ID NO: 3978438 - RNA, 13 nt, Staphylococcus aureus subsp. aureus Mu50
acgcuugauaaaa

SEQ ID NO: 3978439 - RNA, 17 nt, Staphylococcus aureus subsp. aureus Mu50
acgcuuuauuacuuuaa

SEQ ID NO: 3978440 - RNA, 15 nt, Staphylococcus aureus subsp. aureus Mu50
acgcuuuuuaaaaaa

SEQ ID NO: 3978441 - RNA, 16 nt, Staphylococcus aureus subsp. aureus Mu50
acggaacuacuacauu

SEQ ID NO: 3978442 - RNA, 19 nt, Staphylococcus aureus subsp. aureus Mu50
acggcaaauucaacuuuaa

SEQ ID NO: 3978443 - RNA, 15 nt, Staphylococcus aureus subsp. aureus Mu50
acggcacgauacauc

SEQ ID NO: 3978444 - RNA, 14 nt, Staphylococcus aureus subsp. aureus Mu50
acggcugcuuuaac

SEQ ID NO: 3978445 - RNA, 16 nt, Staphylococcus aureus subsp. aureus Mu50
acggcugcuuuaacug

SEQ ID NO: 3978446 - RNA, 17 nt, Staphylococcus aureus subsp. aureus Mu50
acgggaacaucauaauc

SEQ ID NO: 3978447 - RNA, 21 nt, Staphylococcus aureus subsp. aureus Mu50
acgguaaauaaccacuuugaa

SEQ ID NO: 3978448 - RNA, 14 nt, Staphylococcus aureus subsp. aureus Mu50
acgguaacuuuuua

SEQ ID NO: 3978449 - RNA, 23 nt, Staphylococcus aureus subsp. aureus Mu50
acgguagucucccauaacaccua

SEQ ID NO: 3978450 - RNA, 20 nt, Staphylococcus aureus subsp. aureus Mu50
acgguauaaaaaaauuaacu

SEQ ID NO: 3978451 - RNA, 22 nt, Staphylococcus aureus subsp. aureus Mu50
acgguaucaucugcauuuaauu

SEQ ID NO: 3978452 - RNA, 13 nt, Staphylococcus aureus subsp. aureus Mu50
acgguauuuucaa

SEQ ID NO: 3978453 - RNA, 22 nt, Staphylococcus aureus subsp. aureus Mu50
acgguauuuucaaaacugccaa

SEQ ID NO: 3978454 - RNA, 22 nt, Staphylococcus aureus subsp. aureus Mu50
acggugaaaguucauuacaaac

SEQ ID NO: 3978455 - RNA, 15 nt, Staphylococcus aureus subsp. aureus Mu50
acgguuauggugugu

SEQ ID NO: 3978456 - RNA, 19 nt, Staphylococcus aureus subsp. aureus Mu50
acguaauccuuggaaacga

SEQ ID NO: 3978457 - RNA, 14 nt, Staphylococcus aureus subsp. aureus Mu50
acguaaugaaucaa

SEQ ID NO: 3978458 - RNA, 16 nt, Staphylococcus aureus subsp. aureus Mu50
acguaaugaaucaauu

SEQ ID NO: 3978459 - RNA, 17 nt, Staphylococcus aureus subsp. aureus Mu50
acguaauuaauagguua

SEQ ID NO: 3978460 - RNA, 14 nt, Staphylococcus aureus subsp. aureus Mu50
acguacauuuuuau

SEQ ID NO: 3978461 - RNA, 16 nt, Staphylococcus aureus subsp. aureus Mu50
acguauacaaauugau

SEQ ID NO: 3978462 - RNA, 17 nt, Staphylococcus aureus subsp. aureus Mu50
acguauauaaguuaaaa

SEQ ID NO: 3978463 - RNA, 17 nt, Staphylococcus aureus subsp. aureus Mu50
acguaucaagaaaaagu

SEQ ID NO: 3978464 - RNA, 21 nt, Staphylococcus aureus subsp. aureus Mu50
acguaucaucaaaguuuaauu

SEQ ID NO: 3978465 - RNA, 20 nt, Staphylococcus aureus subsp. aureus Mu50
acuaauuucuauagaaaaag

SEQ ID NO: 3978466 - RNA, 19 nt, Staphylococcus aureus subsp. aureus Mu50
acuacacuccccuuaucaa

SEQ ID NO: 3978467 - RNA, 23 nt, Staphylococcus aureus subsp. aureus Mu50
acuacauuauuacugauuguuaa

SEQ ID NO: 3978468 - RNA, 16 nt, Staphylococcus aureus subsp. aureus Mu50
acuaccuuccauuucg

SEQ ID NO: 3978469 - RNA, 15 nt, Staphylococcus aureus subsp. aureus Mu50
acuacgcauuauuaa

SEQ ID NO: 3978470 - RNA, 15 nt, Staphylococcus aureus subsp. aureus Mu50
acuacgcauuuuaaa

SEQ ID NO: 3978471 - RNA, 17 nt, Staphylococcus aureus subsp. aureus Mu50
acuacgcauuuuaaaua

SEQ ID NO: 3978472 - RNA, 18 nt, Staphylococcus aureus subsp. aureus Mu50
acuacgcauuuuaaauaa

SEQ ID NO: 3978473 - RNA, 19 nt, Staphylococcus aureus subsp. aureus Mu50
acuacgucauacuaucuac

SEQ ID NO: 3978474 - RNA, 14 nt, Staphylococcus aureus subsp. aureus Mu50
acuacuuaauuaau

SEQ ID NO: 3978475 - RNA, 18 nt, Staphylococcus aureus subsp. aureus Mu50
acuacuuaauuaauaauu

SEQ ID NO: 3978476 - RNA, 15 nt, Staphylococcus aureus subsp. aureus Mu50
acuacuuguuuguuu

SEQ ID NO: 3978477 - RNA, 14 nt, Staphylococcus aureus subsp. aureus Mu50
acuacuuuauaaau

SEQ ID NO: 3978478 - RNA, 14 nt, Staphylococcus aureus subsp. aureus Mu50
acuacuuuuucaac

SEQ ID NO: 3978479 - RNA, 19 nt, Staphylococcus aureus subsp. aureus Mu50
acuacuuuuucaacuguac

SEQ ID NO: 3978480 - RNA, 18 nt, Staphylococcus aureus subsp. aureus Mu50
acuagaaaacauaaauac

SEQ ID NO: 3978481 - RNA, 19 nt, Staphylococcus aureus subsp. aureus Mu50
acuagaaaacauaaauaca

SEQ ID NO: 3978482 - RNA, 12 nt, Staphylococcus aureus subsp. aureus Mu50
acuagaaugauu

SEQ ID NO: 3978483 - RNA, 21 nt, Staphylococcus aureus subsp. aureus Mu50
acuagcauuagcaaauauuau

SEQ ID NO: 3978484 - RNA, 22 nt, Staphylococcus aureus subsp. aureus Mu50
acuagcauuagcaaauauuauu

SEQ ID NO: 3978485 - RNA, 19 nt, Staphylococcus aureus subsp. aureus Mu50
acuagcuaaugcacgugag

SEQ ID NO: 3978486 - RNA, 23 nt, Staphylococcus aureus subsp. aureus Mu50
acuaggaauauaaaacugugcau

SEQ ID NO: 3978487 - RNA, 14 nt, Staphylococcus aureus subsp. aureus Mu50
acuagggguuuuua

SEQ ID NO: 3978488 - RNA, 16 nt, Staphylococcus aureus subsp. aureus Mu50
acuagggguuuuuaau

SEQ ID NO: 3978489 - RNA, 14 nt, Staphylococcus aureus subsp. aureus Mu50
acuaguaauagaau

SEQ ID NO: 3978490 - RNA, 22 nt, Staphylococcus aureus subsp. aureus Mu50
acuaguaauagaauagucaauu

SEQ ID NO: 3978491 - RNA, 20 nt, Staphylococcus aureus subsp. aureus Mu50
acuagucuuuuuauuuuaau

SEQ ID NO: 3978492 - RNA, 22 nt, Staphylococcus aureus subsp. aureus Mu50
acuaguucuaaguguugaccau

SEQ ID NO: 3978493 - RNA, 14 nt, Staphylococcus aureus subsp. aureus Mu50
acuaguuuguaaua

SEQ ID NO: 3978494 - RNA, 18 nt, Staphylococcus aureus subsp. aureus Mu50
acuaguuuguaauaauua

SEQ ID NO: 3978495 - RNA, 19 nt, Staphylococcus aureus subsp. aureus Mu50
acuaguuuguaauaauuaa

SEQ ID NO: 3978496 - RNA, 17 nt, Staphylococcus aureus subsp. aureus Mu50
acuauaaaauucaccaa

SEQ ID NO: 3978497 - RNA, 19 nt, Staphylococcus aureus subsp. aureus Mu50
acuauaaaauucaccaacu

SEQ ID NO: 3978498 - RNA, 14 nt, Staphylococcus aureus subsp. aureus Mu50
acuauaaauccuaa

SEQ ID NO: 3978499 - RNA, 21 nt, Staphylococcus aureus subsp. aureus Mu50
acuauaaauccuaagucuuuu

SEQ ID NO: 3978500 - RNA, 19 nt, Staphylococcus aureus subsp. aureus Mu50
acuauaacaccaauuaaau

SEQ ID NO: 3978501 - RNA, 19 nt, Staphylococcus aureus subsp. aureus Mu50
acuauaaccuauuaaaucu

SEQ ID NO: 3978502 - RNA, 20 nt, Staphylococcus aureus subsp. aureus Mu50
acuauaauaauuaacugcgg

SEQ ID NO: 3978503 - RNA, 15 nt, Staphylococcus aureus subsp. aureus Mu50
acuauaauaauugga

SEQ ID NO: 3978504 - RNA, 16 nt, Staphylococcus aureus subsp. aureus Mu50
acuauaauaauuggaa

SEQ ID NO: 3978505 - RNA, 14 nt, Staphylococcus aureus subsp. aureus Mu50
acuauaaugaugua

SEQ ID NO: 3978506 - RNA, 16 nt, Staphylococcus aureus subsp. aureus Mu50
acuauaauuucuuaau

SEQ ID NO: 3978507 - RNA, 21 nt, Staphylococcus aureus subsp. aureus Mu50
acuauacuuuuauagaaaauu

SEQ ID NO: 3978508 - RNA, 22 nt, Staphylococcus aureus subsp. aureus Mu50
acuauagccaaaggcaaaaugu

SEQ ID NO: 3978509 - RNA, 23 nt, Staphylococcus aureus subsp. aureus Mu50
acuauagccaaaggcaaaaugua

SEQ ID NO: 3978510 - RNA, 12 nt, Staphylococcus aureus subsp. aureus Mu50
acuauauauagu

SEQ ID NO: 3978511 - RNA, 13 nt, Staphylococcus aureus subsp. aureus Mu50
acuauauccuuuu

SEQ ID NO: 3978512 - RNA, 16 nt, Staphylococcus aureus subsp. aureus Mu50
acuauauccuuuuuga

SEQ ID NO: 3978513 - RNA, 13 nt, Staphylococcus aureus subsp. aureus Mu50
acuauaugaaaag

SEQ ID NO: 3978514 - RNA, 16 nt, Staphylococcus aureus subsp. aureus Mu50
acuauaugaaaagaga

SEQ ID NO: 3978515 - RNA, 22 nt, Staphylococcus aureus subsp. aureus Mu50
acuauaugaaaagagaaacaaa

SEQ ID NO: 3978516 - RNA, 17 nt, Staphylococcus aureus subsp. aureus Mu50
acuauaugugucgagua

SEQ ID NO: 3978517 - RNA, 14 nt, Staphylococcus aureus subsp. aureus Mu50
acuauauuuauuag

SEQ ID NO: 3978518 - RNA, 14 nt, Staphylococcus aureus subsp. aureus Mu50
acuaucaaugacau

SEQ ID NO: 3978519 - RNA, 14 nt, Staphylococcus aureus subsp. aureus Mu50
acuaucguuuuuau

SEQ ID NO: 3978520 - RNA, 20 nt, Staphylococcus aureus subsp. aureus Mu50
acuaucuacaauaaccauuu

SEQ ID NO: 3978521 - RNA, 15 nt, Staphylococcus aureus subsp. aureus Mu50
acuaucuguuguuau

SEQ ID NO: 3978522 - RNA, 23 nt, Staphylococcus aureus subsp. aureus Mu50
acuaucuguuguuauauaaauag

SEQ ID NO: 3978523 - RNA, 14 nt, Staphylococcus aureus subsp. aureus Mu50
acuaucuuuugcuu

SEQ ID NO: 3978524 - RNA, 14 nt, Staphylococcus aureus subsp. aureus Mu50
acuaugcaaaugaa

SEQ ID NO: 3978525 - RNA, 13 nt, Staphylococcus aureus subsp. aureus Mu50
acuauggcauuau

SEQ ID NO: 3978526 - RNA, 15 nt, Staphylococcus aureus subsp. aureus Mu50
acuauggcauuauug

SEQ ID NO: 3978527 - RNA, 17 nt, Staphylococcus aureus subsp. aureus Mu50
acuauguuacuuauaua

SEQ ID NO: 3978528 - RNA, 13 nt, Staphylococcus aureus subsp. aureus Mu50
acuauuaaaggaa

SEQ ID NO: 3978529 - RNA, 19 nt, Staphylococcus aureus subsp. aureus Mu50
acuauuaaaggaaaucaau

SEQ ID NO: 3978530 - RNA, 21 nt, Staphylococcus aureus subsp. aureus Mu50
acuauuaaauaaucgcccauc

SEQ ID NO: 3978531 - RNA, 15 nt, Staphylococcus aureus subsp. aureus Mu50
acuauuaucgaagaa

SEQ ID NO: 3978532 - RNA, 13 nt, Staphylococcus aureus subsp. aureus Mu50
acuauugaaaaua

SEQ ID NO: 3978533 - RNA, 15 nt, Staphylococcus aureus subsp. aureus Mu50
acuauugaaaauaga

SEQ ID NO: 3978534 - RNA, 19 nt, Staphylococcus aureus subsp. aureus Mu50
acuauugaaaauagaaaga

SEQ ID NO: 3978535 - RNA, 13 nt, Staphylococcus aureus subsp. aureus Mu50
acuauuuuaaaaa

SEQ ID NO: 3978536 - RNA, 17 nt, Staphylococcus aureus subsp. aureus Mu50
acuauuuuaaaaaugcu

SEQ ID NO: 3978537 - RNA, 18 nt, Staphylococcus aureus subsp. aureus Mu50
acuauuuuaaaaaugcug

SEQ ID NO: 3978538 - RNA, 13 nt, Staphylococcus aureus subsp. aureus Mu50
acuauuuuaaauu

SEQ ID NO: 3978539 - RNA, 19 nt, Staphylococcus aureus subsp. aureus Mu50
acuauuuuugaaaagagcg

SEQ ID NO: 3978540 - RNA, 23 nt, Staphylococcus aureus subsp. aureus Mu50
acucaaaauguuuaacaauaaua

SEQ ID NO: 3978541 - RNA, 17 nt, Staphylococcus aureus subsp. aureus Mu50
acucaaagauauacuua

SEQ ID NO: 3978542 - RNA, 16 nt, Staphylococcus aureus subsp. aureus Mu50
acucaaauauaaauaa

SEQ ID NO: 3978543 - RNA, 14 nt, Staphylococcus aureus subsp. aureus Mu50
acucaaauaucuaa

SEQ ID NO: 3978544 - RNA, 13 nt, Staphylococcus aureus subsp. aureus Mu50
acucaauaaaauu

SEQ ID NO: 3978545 - RNA, 22 nt, Staphylococcus aureus subsp. aureus Mu50
acucaauaugaaaccuuugguu

SEQ ID NO: 3978546 - RNA, 22 nt, Staphylococcus aureus subsp. aureus Mu50
acucaaugauuguaauaucuaa

SEQ ID NO: 3978547 - RNA, 15 nt, Staphylococcus aureus subsp. aureus Mu50
acucaauucucuaac

SEQ ID NO: 3978548 - RNA, 13 nt, Staphylococcus aureus subsp. aureus Mu50
acucacuucaacg

SEQ ID NO: 3978549 - RNA, 16 nt, Staphylococcus aureus subsp. aureus Mu50
acucacuucuuaaaau

SEQ ID NO: 3978550 - RNA, 20 nt, Staphylococcus aureus subsp. aureus Mu50
acucagaaucuuacauugau

SEQ ID NO: 3978551 - RNA, 15 nt, Staphylococcus aureus subsp. aureus Mu50
acucaguuauauuaa

SEQ ID NO: 3978552 - RNA, 19 nt, Staphylococcus aureus subsp. aureus Mu50
acucauaaccgcuucuuuu

SEQ ID NO: 3978553 - RNA, 13 nt, Staphylococcus aureus subsp. aureus Mu50
acuguaaaacaau

SEQ ID NO: 3978554 - RNA, 12 nt, Staphylococcus aureus subsp. aureus Mu50
acuguaaaucau

SEQ ID NO: 3978555 - RNA, 13 nt, Staphylococcus aureus subsp. aureus Mu50
acuguaaaucauc

SEQ ID NO: 3978556 - RNA, 16 nt, Staphylococcus aureus subsp. aureus Mu50
acuguaaaucaucaua

SEQ ID NO: 3978557 - RNA, 19 nt, Staphylococcus aureus subsp. aureus Mu50
acuguaaaucaucauaacc

SEQ ID NO: 3978558 - RNA, 14 nt, Staphylococcus aureus subsp. aureus Mu50
acuguaccaucacu

SEQ ID NO: 3978559 - RNA, 15 nt, Staphylococcus aureus subsp. aureus Mu50
acuguaguacuauag

SEQ ID NO: 3978560 - RNA, 23 nt, Staphylococcus aureus subsp. aureus Mu50
acuguauaaauaaccgcacuuuc

SEQ ID NO: 3978561 - RNA, 19 nt, Staphylococcus aureus subsp. aureus Mu50
acuguauaaggauguacua

SEQ ID NO: 3978562 - RNA, 21 nt, Staphylococcus aureus subsp. aureus Mu50
acuguauggucuggaauaaau

SEQ ID NO: 3978563 - RNA, 22 nt, Staphylococcus aureus subsp. aureus Mu50
acuguauuuuaacgucauuuuu

SEQ ID NO: 3978564 - RNA, 16 nt, Staphylococcus aureus subsp. aureus Mu50
acugucgcucauccuc

SEQ ID NO: 3978565 - RNA, 16 nt, Staphylococcus aureus subsp. aureus Mu50
acugucgguucaucua

SEQ ID NO: 3978566 - RNA, 20 nt, Staphylococcus aureus subsp. aureus Mu50
acugucgguucaucuaaaau

SEQ ID NO: 3978567 - RNA, 15 nt, Staphylococcus aureus subsp. aureus Mu50
acugucucaucuucu

SEQ ID NO: 3978568 - RNA, 23 nt, Staphylococcus aureus subsp. aureus Mu50
acugucucaucuucuaaaucaau

SEQ ID NO: 3978569 - RNA, 19 nt, Staphylococcus aureus subsp. aureus Mu50
acugugauauuaauugaaa

SEQ ID NO: 3978570 - RNA, 18 nt, Staphylococcus aureus subsp. aureus Mu50
acugugauucauucguac

SEQ ID NO: 3978571 - RNA, 15 nt, Staphylococcus aureus subsp. aureus Mu50
acuguguaauaccaa

SEQ ID NO: 3978572 - RNA, 15 nt, Staphylococcus aureus subsp. aureus Mu50
acuguugacauuuga

SEQ ID NO: 3978573 - RNA, 21 nt, Staphylococcus aureus subsp. aureus Mu50
acuguuucacguaaugaauca

SEQ ID NO: 3978574 - RNA, 20 nt, Staphylococcus aureus subsp. aureus Mu50
acuguuuguuuauugagaau

SEQ ID NO: 3978575 - RNA, 15 nt, Staphylococcus aureus subsp. aureus Mu50
acuuaaaaaugaaau

SEQ ID NO: 3978576 - RNA, 12 nt, Staphylococcus aureus subsp. aureus Mu50
acuuaaaauuua

SEQ ID NO: 3978577 - RNA, 13 nt, Staphylococcus aureus subsp. aureus Mu50
acuuaaaauuuaa

SEQ ID NO: 3978578 - RNA, 22 nt, Staphylococcus aureus subsp. aureus Mu50
acuuaaaauuuaaauauugaag

SEQ ID NO: 3978579 - RNA, 15 nt, Staphylococcus aureus subsp. aureus Mu50
acuuaaagauuuacc

SEQ ID NO: 3978580 - RNA, 21 nt, Staphylococcus aureus subsp. aureus Mu50
acuuaaauaucgacaaauuaa

SEQ ID NO: 3978581 - RNA, 13 nt, Staphylococcus aureus subsp. aureus Mu50
acuuaaccauuua

SEQ ID NO: 3978582 - RNA, 15 nt, Staphylococcus aureus subsp. aureus Mu50
acuuaaccauuuaaa

SEQ ID NO: 3978583 - RNA, 21 nt, Staphylococcus aureus subsp. aureus Mu50
acuuaacgagugcuuucaccu

SEQ ID NO: 3978584 - RNA, 20 nt, Staphylococcus aureus subsp. aureus Mu50
acuuaauauaguuaauguaa

SEQ ID NO: 3978585 - RNA, 20 nt, Staphylococcus aureus subsp. aureus Mu50
acuuaaucguucccauucuu

SEQ ID NO: 3978586 - RNA, 17 nt, Staphylococcus aureus subsp. aureus Mu50
acuuaaugcuucaaaug

SEQ ID NO: 3978587 - RNA, 22 nt, Staphylococcus aureus subsp. aureus Mu50
acuuaauuaauaauuuaacuaa

SEQ ID NO: 3978588 - RNA, 13 nt, Staphylococcus aureus subsp. aureus Mu50
acuuacaaauaua

SEQ ID NO: 3978589 - RNA, 13 nt, Staphylococcus aureus subsp. aureus Mu50
acuuacaagucua

SEQ ID NO: 3978590 - RNA, 16 nt, Staphylococcus aureus subsp. aureus Mu50
acuuacaagucuaguu

SEQ ID NO: 3978591 - RNA, 13 nt, Staphylococcus aureus subsp. aureus Mu50
acuuacauuacau

SEQ ID NO: 3978592 - RNA, 20 nt, Staphylococcus aureus subsp. aureus Mu50
acuuacauuuuaauaaaauc

SEQ ID NO: 3978593 - RNA, 23 nt, Staphylococcus aureus subsp. aureus Mu50
acuuaccaugaugagauaaaauc

SEQ ID NO: 3978594 - RNA, 15 nt, Staphylococcus aureus subsp. aureus Mu50
acuuaccuaauagga

SEQ ID NO: 3978595 - RNA, 18 nt, Staphylococcus aureus subsp. aureus Mu50
acuuacugugaaaauacc

SEQ ID NO: 3978596 - RNA, 13 nt, Staphylococcus aureus subsp. aureus Mu50
acuuacuuuucua

SEQ ID NO: 3978597 - RNA, 19 nt, Staphylococcus aureus subsp. aureus Mu50
acuuagcaaucucuuuaga

SEQ ID NO: 3978598 - RNA, 22 nt, Staphylococcus aureus subsp. aureus Mu50
acuuaguagauuuauuaaauau

SEQ ID NO: 3978599 - RNA, 13 nt, Staphylococcus aureus subsp. aureus Mu50
acuuauaauauua

SEQ ID NO: 3978600 - RNA, 23 nt, Staphylococcus aureus subsp. aureus Mu50
acuuauauacguugauuaacaca

SEQ ID NO: 3978601 - RNA, 13 nt, Staphylococcus aureus subsp. aureus Mu50
acuuauauauuca

SEQ ID NO: 3978602 - RNA, 23 nt, Staphylococcus aureus subsp. aureus Mu50
acuuauauauucaauaauuauua

SEQ ID NO: 3978603 - RNA, 13 nt, Staphylococcus aureus subsp. aureus Mu50
acuuaucaucaca

SEQ ID NO: 3978604 - RNA, 22 nt, Staphylococcus aureus subsp. aureus Mu50
acuuaucgccuggugcaggcau

SEQ ID NO: 3978605 - RNA, 21 nt, Staphylococcus aureus subsp. aureus Mu50
acuuaucuguagauuagcuua

SEQ ID NO: 3978606 - RNA, 13 nt, Staphylococcus aureus subsp. aureus Mu50
acuuaugauacug

SEQ ID NO: 3978607 - RNA, 15 nt, Staphylococcus aureus subsp. aureus Mu50
acuuaugauacugau

SEQ ID NO: 3978608 - RNA, 20 nt, Staphylococcus aureus subsp. aureus Mu50
acuuaugauacugauauuua

SEQ ID NO: 3978609 - RNA, 18 nt, Staphylococcus aureus subsp. aureus Mu50
acuuauggguucaauauc

SEQ ID NO: 3978610 - RNA, 14 nt, Staphylococcus aureus subsp. aureus Mu50
acuuauuaauuaau

SEQ ID NO: 3978611 - RNA, 15 nt, Staphylococcus aureus subsp. aureus Mu50
acuuauuaauuaaua

SEQ ID NO: 3978612 - RNA, 18 nt, Staphylococcus aureus subsp. aureus Mu50
acuuauuaauuaauagag

SEQ ID NO: 3978613 - RNA, 12 nt, Staphylococcus aureus subsp. aureus Mu50
acuuauucuuca

SEQ ID NO: 3978614 - RNA, 19 nt, Staphylococcus aureus subsp. aureus Mu50
acuuauugacgaguagauu

SEQ ID NO: 3978615 - RNA, 17 nt, Staphylococcus aureus subsp. aureus Mu50
acuuauuucuuuucauu

SEQ ID NO: 3978616 - RNA, 22 nt, Staphylococcus aureus subsp. aureus Mu50
acuuauuugccauauacacacu

SEQ ID NO: 3978617 - RNA, 23 nt, Staphylococcus aureus subsp. aureus Mu50
acuuauuuuauacgaaucacagu

SEQ ID NO: 3978618 - RNA, 16 nt, Staphylococcus aureus subsp. aureus Mu50
acuuauuuuucaucau

SEQ ID NO: 3978619 - RNA, 18 nt, Staphylococcus aureus subsp. aureus Mu50
acuuauuuuucaucauuu

SEQ ID NO: 3978620 - RNA, 13 nt, Staphylococcus aureus subsp. aureus Mu50
acuucaaacaaag

SEQ ID NO: 3978621 - RNA, 14 nt, Staphylococcus aureus subsp. aureus Mu50
acuucaaacaaagg

SEQ ID NO: 3978622 - RNA, 15 nt, Staphylococcus aureus subsp. aureus Mu50
acuucaaacaaaggg

SEQ ID NO: 3978623 - RNA, 16 nt, Staphylococcus aureus subsp. aureus Mu50
acuucaacauauaaau

SEQ ID NO: 3978624 - RNA, 19 nt, Staphylococcus aureus subsp. aureus Mu50
acuucaacgucaucugcuu

SEQ ID NO: 3978625 - RNA, 18 nt, Staphylococcus aureus subsp. aureus Mu50
acuucaccacauaaaaau

SEQ ID NO: 3978626 - RNA, 19 nt, Staphylococcus aureus subsp. aureus Mu50
acuucaccacauaaaaaua

SEQ ID NO: 3978627 - RNA, 16 nt, Staphylococcus aureus subsp. aureus Mu50
acuucaccaucuuuaa

SEQ ID NO: 3978628 - RNA, 17 nt, Staphylococcus aureus subsp. aureus Mu50
acuucacgcaaaacaau

SEQ ID NO: 3978629 - RNA, 18 nt, Staphylococcus aureus subsp. aureus Mu50
acuucacuaggaucuuuu

SEQ ID NO: 3978630 - RNA, 21 nt, Staphylococcus aureus subsp. aureus Mu50
acuucacuaggaucuuuucca

SEQ ID NO: 3978631 - RNA, 17 nt, Staphylococcus aureus subsp. aureus Mu50
acuucauaagucacagu

SEQ ID NO: 3978632 - RNA, 11 nt, Staphylococcus aureus subsp. aureus Mu50
acuucaucuaa

SEQ ID NO: 3978633 - RNA, 13 nt, Staphylococcus aureus subsp. aureus Mu50
acuucaucuaaau

SEQ ID NO: 3978634 - RNA, 21 nt, Staphylococcus aureus subsp. aureus Mu50
acuucaucuguaucaaucaac

SEQ ID NO: 3978635 - RNA, 15 nt, Staphylococcus aureus subsp. aureus Mu50
acuucauuaguugcc

SEQ ID NO: 3978636 - RNA, 21 nt, Staphylococcus aureus subsp. aureus Mu50
acuuccaauacuguugucuug

SEQ ID NO: 3978637 - RNA, 13 nt, Staphylococcus aureus subsp. aureus Mu50
acuuccaucaauc

SEQ ID NO: 3978638 - RNA, 14 nt, Staphylococcus aureus subsp. aureus Mu50
acuuccaucaaucc

SEQ ID NO: 3978639 - RNA, 20 nt, Staphylococcus aureus subsp. aureus Mu50
acuuccaucaauccaacuac

SEQ ID NO: 3978640 - RNA, 11 nt, Staphylococcus aureus subsp. aureus Mu50
acuucccaauc

SEQ ID NO: 3978641 - RNA, 22 nt, Staphylococcus aureus subsp. aureus Mu50
acuuucuaagauacguugaugu

SEQ ID NO: 3978642 - RNA, 15 nt, Staphylococcus aureus subsp. aureus Mu50
acuuucuauuaauau

SEQ ID NO: 3978643 - RNA, 14 nt, Staphylococcus aureus subsp. aureus Mu50
acuuucuugaugaa

SEQ ID NO: 3978644 - RNA, 18 nt, Staphylococcus aureus subsp. aureus Mu50
acuuucuuuuguuuuuau

SEQ ID NO: 3978645 - RNA, 20 nt, Staphylococcus aureus subsp. aureus Mu50
acuuugauaucuacagagaa

SEQ ID NO: 3978646 - RNA, 14 nt, Staphylococcus aureus subsp. aureus Mu50
acuuugauauguuu

SEQ ID NO: 3978647 - RNA, 17 nt, Staphylococcus aureus subsp. aureus Mu50
acuuugauauguuuccu

SEQ ID NO: 3978648 - RNA, 17 nt, Staphylococcus aureus subsp. aureus Mu50
acuuuggacuuuaaagu

SEQ ID NO: 3978649 - RNA, 15 nt, Staphylococcus aureus subsp. aureus Mu50
acuuugucauuuuga

SEQ ID NO: 3978650 - RNA, 14 nt, Staphylococcus aureus subsp. aureus Mu50
acuuugucuguauu

SEQ ID NO: 3978651 - RNA, 19 nt, Staphylococcus aureus subsp. aureus Mu50
acuuugucuuuaaugaaag

SEQ ID NO: 3978652 - RNA, 13 nt, Staphylococcus aureus subsp. aureus Mu50
acuuuguucaugu

SEQ ID NO: 3978653 - RNA, 19 nt, Staphylococcus aureus subsp. aureus Mu50
acuuuguucugcuuuuucu

SEQ ID NO: 3978654 - RNA, 21 nt, Staphylococcus aureus subsp. aureus Mu50
acuuuguucugcuuuuucuuu

SEQ ID NO: 3978655 - RNA, 22 nt, Staphylococcus aureus subsp. aureus Mu50
acuuuguuuucaguaacugauu

SEQ ID NO: 3978656 - RNA, 21 nt, Staphylococcus aureus subsp. aureus Mu50
acuuuuaccauugugaauaau

SEQ ID NO: 3978657 - RNA, 15 nt, Staphylococcus aureus subsp. aureus Mu50
acuuuuagaguuuuu

SEQ ID NO: 3978658 - RNA, 16 nt, Staphylococcus aureus subsp. aureus Mu50
acuuuuauaauucuaa

SEQ ID NO: 3978659 - RNA, 22 nt, Staphylococcus aureus subsp. aureus Mu50
acuuuuauugcacuuuuuucau

SEQ ID NO: 3978660 - RNA, 15 nt, Staphylococcus aureus subsp. aureus Mu50
acuuuuauugccaua

SEQ ID NO: 3978661 - RNA, 12 nt, Staphylococcus aureus subsp. aureus Mu50
acuuuucuaaac

SEQ ID NO: 3978662 - RNA, 14 nt, Staphylococcus aureus subsp. aureus Mu50
acuuuucuaaacaa

SEQ ID NO: 3978663 - RNA, 20 nt, Staphylococcus aureus subsp. aureus Mu50
acuuuuggucuguugaaguc

SEQ ID NO: 3978664 - RNA, 19 nt, Staphylococcus aureus subsp. aureus Mu50
acuuuuguaaaaaaagaca

SEQ ID NO: 3978665 - RNA, 15 nt, Staphylococcus aureus subsp. aureus Mu50
acuuuuguuaaaaaa

SEQ ID NO: 3978666 - RNA, 16 nt, Staphylococcus aureus subsp. aureus Mu50
acuuuuguuaaaaaau

SEQ ID NO: 3978667 - RNA, 12 nt, Staphylococcus aureus subsp. aureus Mu50
acuuuuuaaagg

SEQ ID NO: 3978668 - RNA, 14 nt, Staphylococcus aureus subsp. aureus Mu50
acuuuuuaauaauu

SEQ ID NO: 3978669 - RNA, 17 nt, Staphylococcus aureus subsp. aureus Mu50
acuuuuuaauuccaaag

SEQ ID NO: 3978670 - RNA, 17 nt, Staphylococcus aureus subsp. aureus Mu50
acuuuuuauaucaaaau

SEQ ID NO: 3978671 - RNA, 14 nt, Staphylococcus aureus subsp. aureus Mu50
acuuuuucaucuuu

SEQ ID NO: 3978672 - RNA, 16 nt, Staphylococcus aureus subsp. aureus Mu50
acuuuuugaguaucca

SEQ ID NO: 3978673 - RNA, 14 nt, Staphylococcus aureus subsp. aureus Mu50
acuuuuugaugauu

SEQ ID NO: 3978674 - RNA, 13 nt, Staphylococcus aureus subsp. aureus Mu50
acuuuuuguuaau

SEQ ID NO: 3978675 - RNA, 20 nt, Staphylococcus aureus subsp. aureus Mu50
acuuuuuugagcauuuuuau

SEQ ID NO: 3978676 - RNA, 14 nt, Staphylococcus aureus subsp. aureus Mu50
acuuuuuuuaaauc

SEQ ID NO: 3978677 - RNA, 18 nt, Staphylococcus aureus subsp. aureus Mu50
acuuuuuuuaauuugauu

SEQ ID NO: 3978678 - RNA, 19 nt, Staphylococcus aureus subsp. aureus Mu50
agaaaaagugauaauuaaa

SEQ ID NO: 3978679 - RNA, 11 nt, Staphylococcus aureus subsp. aureus Mu50
agaaaaaguuu

SEQ ID NO: 3978680 - RNA, 18 nt, Staphylococcus aureus subsp. aureus Mu50
agaaaaaguuuuucugac

SEQ ID NO: 3978681 - RNA, 13 nt, Staphylococcus aureus subsp. aureus Mu50
agaaaaauaugau

SEQ ID NO: 3978682 - RNA, 14 nt, Staphylococcus aureus subsp. aureus Mu50
agaaaaauaugauu

SEQ ID NO: 3978683 - RNA, 16 nt, Staphylococcus aureus subsp. aureus Mu50
agaaaacauaaauaca

SEQ ID NO: 3978684 - RNA, 18 nt, Staphylococcus aureus subsp. aureus Mu50
agaaaacauaaauacaaa

SEQ ID NO: 3978685 - RNA, 16 nt, Staphylococcus aureus subsp. aureus Mu50
agaaaacuauuuuaaa

SEQ ID NO: 3978686 - RNA, 18 nt, Staphylococcus aureus subsp. aureus Mu50
agaaaaggauuauaggua

SEQ ID NO: 3978687 - RNA, 17 nt, Staphylococcus aureus subsp. aureus Mu50
agaaaagggcaaaaaag

SEQ ID NO: 3978688 - RNA, 20 nt, Staphylococcus aureus subsp. aureus Mu50
agaaaaguaaguaaaauaaa

SEQ ID NO: 3978689 - RNA, 23 nt, Staphylococcus aureus subsp. aureus Mu50
agaaaaguuacuuacgccaauca

SEQ ID NO: 3978690 - RNA, 21 nt, Staphylococcus aureus subsp. aureus Mu50
agaaaauaugacgaucuucau

SEQ ID NO: 3978691 - RNA, 16 nt, Staphylococcus aureus subsp. aureus Mu50
agaaaaucauucauuu

SEQ ID NO: 3978692 - RNA, 22 nt, Staphylococcus aureus subsp. aureus Mu50
agaaaaucguuauaaguacaaa

SEQ ID NO: 3978693 - RNA, 18 nt, Staphylococcus aureus subsp. aureus Mu50
agaaaaugaguacaacau

SEQ ID NO: 3978694 - RNA, 22 nt, Staphylococcus aureus subsp. aureus Mu50
agaaacaaugcgaagaaaucau

SEQ ID NO: 3978695 - RNA, 13 nt, Staphylococcus aureus subsp. aureus Mu50
agaaacacaagga

SEQ ID NO: 3978696 - RNA, 16 nt, Staphylococcus aureus subsp. aureus Mu50
agaaacacaaggaaua

SEQ ID NO: 3978697 - RNA, 11 nt, Staphylococcus aureus subsp. aureus Mu50
agaaacacuuu

SEQ ID NO: 3978698 - RNA, 18 nt, Staphylococcus aureus subsp. aureus Mu50
agaaacauuauauaacac

SEQ ID NO: 3978699 - RNA, 16 nt, Staphylococcus aureus subsp. aureus Mu50
agaaaccguaaaauca

SEQ ID NO: 3978700 - RNA, 15 nt, Staphylococcus aureus subsp. aureus Mu50
agaaacggaaaugac

SEQ ID NO: 3978701 - RNA, 23 nt, Staphylococcus aureus subsp. aureus Mu50
agaaacuauagauaggauauuuu

SEQ ID NO: 3978702 - RNA, 23 nt, Staphylococcus aureus subsp. aureus Mu50
agaaacuauuaucgaagaaacau

SEQ ID NO: 3978703 - RNA, 16 nt, Staphylococcus aureus subsp. aureus Mu50
agaaacuuccaacaua

SEQ ID NO: 3978704 - RNA, 13 nt, Staphylococcus aureus subsp. aureus Mu50
agaaagaauaaau

SEQ ID NO: 3978705 - RNA, 18 nt, Staphylococcus aureus subsp. aureus Mu50
agaaagaauaaauguuaa

SEQ ID NO: 3978706 - RNA, 18 nt, Staphylococcus aureus subsp. aureus Mu50
agaaagaccauuguauua

SEQ ID NO: 3978707 - RNA, 17 nt, Staphylococcus aureus subsp. aureus Mu50
agaaagcuaauaucaau

SEQ ID NO: 3978708 - RNA, 14 nt, Staphylococcus aureus subsp. aureus Mu50
agaaaguaaaaguu

SEQ ID NO: 3978709 - RNA, 16 nt, Staphylococcus aureus subsp. aureus Mu50
agaaagugaaggagau

SEQ ID NO: 3978710 - RNA, 23 nt, Staphylococcus aureus subsp. aureus Mu50
agaaauacuaauuucuauagaaa

SEQ ID NO: 3978711 - RNA, 20 nt, Staphylococcus aureus subsp. aureus Mu50
agaaauacucaguuuauuga

SEQ ID NO: 3978712 - RNA, 12 nt, Staphylococcus aureus subsp. aureus Mu50
agaaaucaccag

SEQ ID NO: 3978713 - RNA, 16 nt, Staphylococcus aureus subsp. aureus Mu50
agaaaucaccagauuu

SEQ ID NO: 3978714 - RNA, 17 nt, Staphylococcus aureus subsp. aureus Mu50
agaaaucucuaucgccu

SEQ ID NO: 3978715 - RNA, 14 nt, Staphylococcus aureus subsp. aureus Mu50
agaaaucuuaaaga

SEQ ID NO: 3978716 - RNA, 21 nt, Staphylococcus aureus subsp. aureus Mu50
agaaaugacgauaccuuuaau

SEQ ID NO: 3978717 - RNA, 16 nt, Staphylococcus aureus subsp. aureus Mu50
agaaaugucaguuuug

SEQ ID NO: 3978718 - RNA, 19 nt, Staphylococcus aureus subsp. aureus Mu50
agaaauuagaaccaucauu

SEQ ID NO: 3978719 - RNA, 16 nt, Staphylococcus aureus subsp. aureus Mu50
agaaauucgaaaagaa

SEQ ID NO: 3978720 - RNA, 18 nt, Staphylococcus aureus subsp. aureus Mu50
agaaauucgaaaagaaau

SEQ ID NO: 3978721 - RNA, 21 nt, Staphylococcus aureus subsp. aureus Mu50
agaaauucgaaaagaaauucu

SEQ ID NO: 3978722 - RNA, 12 nt, Staphylococcus aureus subsp. aureus Mu50
agaaauucuaca

SEQ ID NO: 3978723 - RNA, 18 nt, Staphylococcus aureus subsp. aureus Mu50
agaaauucuacaaacaau

SEQ ID NO: 3978724 - RNA, 16 nt, Staphylococcus aureus subsp. aureus Mu50
agaaauucuacaggua

SEQ ID NO: 3978725 - RNA, 23 nt, Staphylococcus aureus subsp. aureus Mu50
agaaauucuacagguaaugcaag

SEQ ID NO: 3978726 - RNA, 20 nt, Staphylococcus aureus subsp. aureus Mu50
agaaauuguguuucuuuuau

SEQ ID NO: 3978727 - RNA, 21 nt, Staphylococcus aureus subsp. aureus Mu50
agaaauuguguuucuuuuauu

SEQ ID NO: 3978728 - RNA, 21 nt, Staphylococcus aureus subsp. aureus Mu50
agaaauuuaauauuguuaauu

SEQ ID NO: 3978729 - RNA, 20 nt, Staphylococcus aureus subsp. aureus Mu50
agaauuuuaauuaauuauca

SEQ ID NO: 3978730 - RNA, 21 nt, Staphylococcus aureus subsp. aureus Mu50
agaauuuuaauuaauuaucau

SEQ ID NO: 3978731 - RNA, 13 nt, Staphylococcus aureus subsp. aureus Mu50
agacaacauuguu

SEQ ID NO: 3978732 - RNA, 20 nt, Staphylococcus aureus subsp. aureus Mu50
agacaauaaugcacgcgugc

SEQ ID NO: 3978733 - RNA, 12 nt, Staphylococcus aureus subsp. aureus Mu50
agacaauauuuu

SEQ ID NO: 3978734 - RNA, 21 nt, Staphylococcus aureus subsp. aureus Mu50
agacaaugauuugugguaauc

SEQ ID NO: 3978735 - RNA, 13 nt, Staphylococcus aureus subsp. aureus Mu50
agacaccaaaaaa

SEQ ID NO: 3978736 - RNA, 16 nt, Staphylococcus aureus subsp. aureus Mu50
agacaccuuaucacuu

SEQ ID NO: 3978737 - RNA, 15 nt, Staphylococcus aureus subsp. aureus Mu50
agacaccuucaauau

SEQ ID NO: 3978738 - RNA, 17 nt, Staphylococcus aureus subsp. aureus Mu50
agacacggccugcaagu

SEQ ID NO: 3978739 - RNA, 14 nt, Staphylococcus aureus subsp. aureus Mu50
agacacuuaacuug

SEQ ID NO: 3978740 - RNA, 13 nt, Staphylococcus aureus subsp. aureus Mu50
agacauaaaaaaa

SEQ ID NO: 3978741 - RNA, 14 nt, Staphylococcus aureus subsp. aureus Mu50
agacauaaaaaaag

SEQ ID NO: 3978742 - RNA, 12 nt, Staphylococcus aureus subsp. aureus Mu50
agacauaaauau

SEQ ID NO: 3978743 - RNA, 18 nt, Staphylococcus aureus subsp. aureus Mu50
agacauacucacaaaaaa

SEQ ID NO: 3978744 - RNA, 19 nt, Staphylococcus aureus subsp. aureus Mu50
agacaucaucuauuuuuaa

SEQ ID NO: 3978745 - RNA, 16 nt, Staphylococcus aureus subsp. aureus Mu50
agacaucauuguuuua

SEQ ID NO: 3978746 - RNA, 15 nt, Staphylococcus aureus subsp. aureus Mu50
agacauccacagaau

SEQ ID NO: 3978747 - RNA, 11 nt, Staphylococcus aureus subsp. aureus Mu50
agacauccaug

SEQ ID NO: 3978748 - RNA, 15 nt, Staphylococcus aureus subsp. aureus Mu50
agacaugagauuauu

SEQ ID NO: 3978749 - RNA, 12 nt, Staphylococcus aureus subsp. aureus Mu50
agacauuaaaaa

SEQ ID NO: 3978750 - RNA, 14 nt, Staphylococcus aureus subsp. aureus Mu50
agacauuacauuua

SEQ ID NO: 3978751 - RNA, 16 nt, Staphylococcus aureus subsp. aureus Mu50
agacauuuuaucugaa

SEQ ID NO: 3978752 - RNA, 17 nt, Staphylococcus aureus subsp. aureus Mu50
agacauuuuaucugaaa

SEQ ID NO: 3978753 - RNA, 12 nt, Staphylococcus aureus subsp. aureus Mu50
agaccaaauauu

SEQ ID NO: 3978754 - RNA, 19 nt, Staphylococcus aureus subsp. aureus Mu50
agaccauuuuauauuuuag

SEQ ID NO: 3978755 - RNA, 22 nt, Staphylococcus aureus subsp. aureus Mu50
agacccaccguuaaaauauaug

SEQ ID NO: 3978756 - RNA, 14 nt, Staphylococcus aureus subsp. aureus Mu50
agaccccgaaaaga

SEQ ID NO: 3978757 - RNA, 17 nt, Staphylococcus aureus subsp. aureus Mu50
agaccuucaauaucuuc

SEQ ID NO: 3978758 - RNA, 17 nt, Staphylococcus aureus subsp. aureus Mu50
agaccuucuucucuaau

SEQ ID NO: 3978759 - RNA, 16 nt, Staphylococcus aureus subsp. aureus Mu50
agacgauuucaaugag

SEQ ID NO: 3978760 - RNA, 19 nt, Staphylococcus aureus subsp. aureus Mu50
agacguaaguguaaaugaa

SEQ ID NO: 3978761 - RNA, 20 nt, Staphylococcus aureus subsp. aureus Mu50
agacguacaugcuucaauau

SEQ ID NO: 3978762 - RNA, 14 nt, Staphylococcus aureus subsp. aureus Mu50
agacguuuuccaug

SEQ ID NO: 3978763 - RNA, 17 nt, Staphylococcus aureus subsp. aureus Mu50
agacguuuuugaaucag

SEQ ID NO: 3978764 - RNA, 14 nt, Staphylococcus aureus subsp. aureus Mu50
agacguuuuuuuau

SEQ ID NO: 3978765 - RNA, 13 nt, Staphylococcus aureus subsp. aureus Mu50
agacuaaaaugaa

SEQ ID NO: 3978766 - RNA, 17 nt, Staphylococcus aureus subsp. aureus Mu50
agacuaauuaucuucau

SEQ ID NO: 3978767 - RNA, 19 nt, Staphylococcus aureus subsp. aureus Mu50
agacuagccauaccuuauu

SEQ ID NO: 3978768 - RNA, 14 nt, Staphylococcus aureus subsp. aureus Mu50
agacuauaggucuu

SEQ ID NO: 3978769 - RNA, 15 nt, Staphylococcus aureus subsp. aureus Mu50
agacucaauuucauu

SEQ ID NO: 3978770 - RNA, 13 nt, Staphylococcus aureus subsp. aureus Mu50
agacucacuucuu

SEQ ID NO: 3978771 - RNA, 14 nt, Staphylococcus aureus subsp. aureus Mu50
agacucacuucuua

SEQ ID NO: 3978772 - RNA, 15 nt, Staphylococcus aureus subsp. aureus Mu50
agacugccaauaaaa

SEQ ID NO: 3978773 - RNA, 19 nt, Staphylococcus aureus subsp. aureus Mu50
agacugccaauaaaaugca

SEQ ID NO: 3978774 - RNA, 20 nt, Staphylococcus aureus subsp. aureus Mu50
agacugccaauaaaaugcaa

SEQ ID NO: 3978775 - RNA, 17 nt, Staphylococcus aureus subsp. aureus Mu50
agacuuauucaacguau

SEQ ID NO: 3978776 - RNA, 24 nt, Staphylococcus aureus subsp. aureus Mu50
agacuugguuacuuaguaaggaau

SEQ ID NO: 3978777 - RNA, 22 nt, Staphylococcus aureus subsp. aureus Mu50
agacuuucuugaugaauuaaac

SEQ ID NO: 3978778 - RNA, 23 nt, Staphylococcus aureus subsp. aureus Mu50
agagaaagaauaaauguuaaaga

SEQ ID NO: 3978779 - RNA, 17 nt, Staphylococcus aureus subsp. aureus Mu50
agagaaauucgaaaaga

SEQ ID NO: 3978780 - RNA, 19 nt, Staphylococcus aureus subsp. aureus Mu50
agagaaauucgaaaagaaa

SEQ ID NO: 3978781 - RNA, 16 nt, Staphylococcus aureus subsp. aureus Mu50
agagaacgcuuuauua

SEQ ID NO: 3978782 - RNA, 20 nt, Staphylococcus aureus subsp. aureus Mu50
agagaacgcuuuauuacuuu

SEQ ID NO: 3978783 - RNA, 20 nt, Staphylococcus aureus subsp. aureus Mu50
agagaaguuucuauagaauu

SEQ ID NO: 3978784 - RNA, 18 nt, Staphylococcus aureus subsp. aureus Mu50
agagaauuucgaaaagaa

SEQ ID NO: 3978785 - RNA, 19 nt, Staphylococcus aureus subsp. aureus Mu50
agagaauuucgaaaagaaa

SEQ ID NO: 3978786 - RNA, 21 nt, Staphylococcus aureus subsp. aureus Mu50
agagaauuucgaaaagaaauu

SEQ ID NO: 3978787 - RNA, 23 nt, Staphylococcus aureus subsp. aureus Mu50
agagaauuuuaauuaauuaucau

SEQ ID NO: 3978788 - RNA, 12 nt, Staphylococcus aureus subsp. aureus Mu50
agagacauuuua

SEQ ID NO: 3978789 - RNA, 13 nt, Staphylococcus aureus subsp. aureus Mu50
agagaugaaagau

SEQ ID NO: 3978790 - RNA, 13 nt, Staphylococcus aureus subsp. aureus Mu50
agagaugggcuaa

SEQ ID NO: 3978791 - RNA, 15 nt, Staphylococcus aureus subsp. aureus Mu50
agagccacuaaugau

SEQ ID NO: 3978792 - RNA, 20 nt, Staphylococcus aureus subsp. aureus Mu50
agagcucaaccucuuaguuc

SEQ ID NO: 3978793 - RNA, 22 nt, Staphylococcus aureus subsp. aureus Mu50
agaggaacagcggaauacagau

SEQ ID NO: 3978794 - RNA, 17 nt, Staphylococcus aureus subsp. aureus Mu50
agaggacgcuuuauucu

SEQ ID NO: 3978795 - RNA, 19 nt, Staphylococcus aureus subsp. aureus Mu50
agaggauaggcaacugcaa

SEQ ID NO: 3978796 - RNA, 15 nt, Staphylococcus aureus subsp. aureus Mu50
agaggcuuuaaaauu

SEQ ID NO: 3978797 - RNA, 17 nt, Staphylococcus aureus subsp. aureus Mu50
agagguacuagaauuaa

SEQ ID NO: 3978798 - RNA, 23 nt, Staphylococcus aureus subsp. aureus Mu50
agaguaguucggaugagaaaugu

SEQ ID NO: 3978799 - RNA, 17 nt, Staphylococcus aureus subsp. aureus Mu50
agaguuuuuauuauuag

SEQ ID NO: 3978800 - RNA, 14 nt, Staphylococcus aureus subsp. aureus Mu50
agauaaaaauuacu

SEQ ID NO: 3978801 - RNA, 15 nt, Staphylococcus aureus subsp. aureus Mu50
agauaaacaagccaa

SEQ ID NO: 3978802 - RNA, 21 nt, Staphylococcus aureus subsp. aureus Mu50
agauaaauaaaaggcauucuu

SEQ ID NO: 3978803 - RNA, 14 nt, Staphylococcus aureus subsp. aureus Mu50
agauaaaucaucau

SEQ ID NO: 3978804 - RNA, 17 nt, Staphylococcus aureus subsp. aureus Mu50
agauaaauuaauaugaa

SEQ ID NO: 3978805 - RNA, 18 nt, Staphylococcus aureus subsp. aureus Mu50
agauaaguaauaauauaa

SEQ ID NO: 3978806 - RNA, 16 nt, Staphylococcus aureus subsp. aureus Mu50
agauaaguuacuagca

SEQ ID NO: 3978807 - RNA, 15 nt, Staphylococcus aureus subsp. aureus Mu50
agauaauagagaacu

SEQ ID NO: 3978808 - RNA, 21 nt, Staphylococcus aureus subsp. aureus Mu50
agauaauagagaacuugcuuu

SEQ ID NO: 3978809 - RNA, 12 nt, Staphylococcus aureus subsp. aureus Mu50
agauaaugcacc

SEQ ID NO: 3978810 - RNA, 16 nt, Staphylococcus aureus subsp. aureus Mu50
agauaccaaacugccu

SEQ ID NO: 3978811 - RNA, 13 nt, Staphylococcus aureus subsp. aureus Mu50
agauacguuauuu

SEQ ID NO: 3978812 - RNA, 18 nt, Staphylococcus aureus subsp. aureus Mu50
agauacguugauguaauu

SEQ ID NO: 3978813 - RNA, 23 nt, Staphylococcus aureus subsp. aureus Mu50
agauacuucaguacgguuauuua

SEQ ID NO: 3978814 - RNA, 16 nt, Staphylococcus aureus subsp. aureus Mu50
agauacuucuuuugca

SEQ ID NO: 3978815 - RNA, 13 nt, Staphylococcus aureus subsp. aureus Mu50
agauagaaauuac

SEQ ID NO: 3978816 - RNA, 14 nt, Staphylococcus aureus subsp. aureus Mu50
agauagaaauuacc

SEQ ID NO: 3978817 - RNA, 16 nt, Staphylococcus aureus subsp. aureus Mu50
agcaaauauuauuaaa

SEQ ID NO: 3978818 - RNA, 17 nt, Staphylococcus aureus subsp. aureus Mu50
agcaaauauuauuaaau

SEQ ID NO: 3978819 - RNA, 15 nt, Staphylococcus aureus subsp. aureus Mu50
agcaaaugcacugua

SEQ ID NO: 3978820 - RNA, 18 nt, Staphylococcus aureus subsp. aureus Mu50
agcaaauuaguaugacuu

SEQ ID NO: 3978821 - RNA, 16 nt, Staphylococcus aureus subsp. aureus Mu50
agcaaauugauuaaau

SEQ ID NO: 3978822 - RNA, 13 nt, Staphylococcus aureus subsp. aureus Mu50
agcaacaaaagau

SEQ ID NO: 3978823 - RNA, 16 nt, Staphylococcus aureus subsp. aureus Mu50
agcaacaucggcacca

SEQ ID NO: 3978824 - RNA, 19 nt, Staphylococcus aureus subsp. aureus Mu50
agcaacgauaccaaauaua

SEQ ID NO: 3978825 - RNA, 15 nt, Staphylococcus aureus subsp. aureus Mu50
agcaacugaucauuu

SEQ ID NO: 3978826 - RNA, 19 nt, Staphylococcus aureus subsp. aureus Mu50
agcaauaucaucauuuaaa

SEQ ID NO: 3978827 - RNA, 15 nt, Staphylococcus aureus subsp. aureus Mu50
agcaaucauaauacu

SEQ ID NO: 3978828 - RNA, 21 nt, Staphylococcus aureus subsp. aureus Mu50
agcaaucgacacuuccaucaa

SEQ ID NO: 3978829 - RNA, 21 nt, Staphylococcus aureus subsp. aureus Mu50
agcaaugcaugcuucucaauu

SEQ ID NO: 3978830 - RNA, 20 nt, Staphylococcus aureus subsp. aureus Mu50
agcaauuaaagucaauuuaa

SEQ ID NO: 3978831 - RNA, 19 nt, Staphylococcus aureus subsp. aureus Mu50
agcaauucuucaauuucau

SEQ ID NO: 3978832 - RNA, 18 nt, Staphylococcus aureus subsp. aureus Mu50
agcaauucuugaaaaguu

SEQ ID NO: 3978833 - RNA, 20 nt, Staphylococcus aureus subsp. aureus Mu50
agcaauugaaucaaauacau

SEQ ID NO: 3978834 - RNA, 13 nt, Staphylococcus aureus subsp. aureus Mu50
agcaauuucauca

SEQ ID NO: 3978835 - RNA, 22 nt, Staphylococcus aureus subsp. aureus Mu50
agcaauuucgauugcguuuucu

SEQ ID NO: 3978836 - RNA, 21 nt, Staphylococcus aureus subsp. aureus Mu50
agcaauuugcuguccacuaua

SEQ ID NO: 3978837 - RNA, 14 nt, Staphylococcus aureus subsp. aureus Mu50
agcacaaacuaaaa

SEQ ID NO: 3978838 - RNA, 17 nt, Staphylococcus aureus subsp. aureus Mu50
agcacagcgauuaaaug

SEQ ID NO: 3978839 - RNA, 20 nt, Staphylococcus aureus subsp. aureus Mu50
agcacagcgauuaaaugaug

SEQ ID NO: 3978840 - RNA, 13 nt, Staphylococcus aureus subsp. aureus Mu50
agcacauuuuuag

SEQ ID NO: 3978841 - RNA, 21 nt, Staphylococcus aureus subsp. aureus Mu50
agcacauuuuuaguuagaaag

SEQ ID NO: 3978842 - RNA, 17 nt, Staphylococcus aureus subsp. aureus Mu50
agcaccauuauuaaaug

SEQ ID NO: 3978843 - RNA, 22 nt, Staphylococcus aureus subsp. aureus Mu50
agcaccgacaauuauaauaaaa

SEQ ID NO: 3978844 - RNA, 14 nt, Staphylococcus aureus subsp. aureus Mu50
agcacgagaaaugu

SEQ ID NO: 3978845 - RNA, 15 nt, Staphylococcus aureus subsp. aureus Mu50
agcacgagaaauguc

SEQ ID NO: 3978846 - RNA, 16 nt, Staphylococcus aureus subsp. aureus Mu50
agcacgagacaauaau

SEQ ID NO: 3978847 - RNA, 17 nt, Staphylococcus aureus subsp. aureus Mu50
agcacuagccguuauuu

SEQ ID NO: 3978848 - RNA, 16 nt, Staphylococcus aureus subsp. aureus Mu50
agcacuaucuuuugcu

SEQ ID NO: 3978849 - RNA, 17 nt, Staphylococcus aureus subsp. aureus Mu50
agcacuaucuuuugcuu

SEQ ID NO: 3978850 - RNA, 17 nt, Staphylococcus aureus subsp. aureus Mu50
agcacugaaaucuagac

SEQ ID NO: 3978851 - RNA, 20 nt, Staphylococcus aureus subsp. aureus Mu50
agcagcgauacguuuauauc

SEQ ID NO: 3978852 - RNA, 20 nt, Staphylococcus aureus subsp. aureus Mu50
agcaguaagacagcuucuca

SEQ ID NO: 3978853 - RNA, 20 nt, Staphylococcus aureus subsp. aureus Mu50
agcaguaagacgauuucaau

SEQ ID NO: 3978854 - RNA, 15 nt, Staphylococcus aureus subsp. aureus Mu50
agcaguaagauaauu

SEQ ID NO: 3978855 - RNA, 14 nt, Staphylococcus aureus subsp. aureus Mu50
agcaguaauauguu

SEQ ID NO: 3978856 - RNA, 18 nt, Staphylococcus aureus subsp. aureus Mu50
agcaguaggauaauuuca

SEQ ID NO: 3978857 - RNA, 22 nt, Staphylococcus aureus subsp. aureus Mu50
agcaguaggauaauuucaauuu

SEQ ID NO: 3978858 - RNA, 18 nt, Staphylococcus aureus subsp. aureus Mu50
agcaguauauaucaaaua

SEQ ID NO: 3978859 - RNA, 24 nt, Staphylococcus aureus subsp. aureus Mu50
agcaguauauaucaaauacauuuc

SEQ ID NO: 3978860 - RNA, 16 nt, Staphylococcus aureus subsp. aureus Mu50
agcaguugacuguaaa

SEQ ID NO: 3978861 - RNA, 20 nt, Staphylococcus aureus subsp. aureus Mu50
agcaguugacuguaaaacaa

SEQ ID NO: 3978862 - RNA, 17 nt, Staphylococcus aureus subsp. aureus Mu50
agcauaccuacagaaug

SEQ ID NO: 3978863 - RNA, 14 nt, Staphylococcus aureus subsp. aureus Mu50
agcauaccuuuauu

SEQ ID NO: 3978864 - RNA, 21 nt, Staphylococcus aureus subsp. aureus Mu50
agcauaccuuuauuauuuaau

SEQ ID NO: 3978865 - RNA, 17 nt, Staphylococcus aureus subsp. aureus Mu50
agcauaucucaagauau

SEQ ID NO: 3978866 - RNA, 13 nt, Staphylococcus aureus subsp. aureus Mu50
agcauauuucuaa

SEQ ID NO: 3978867 - RNA, 13 nt, Staphylococcus aureus subsp. aureus Mu50
agcaucaucaauu

SEQ ID NO: 3978868 - RNA, 15 nt, Staphylococcus aureus subsp. aureus Mu50
agcaucaucaauuua

SEQ ID NO: 3978869 - RNA, 23 nt, Staphylococcus aureus subsp. aureus Mu50
agcaucaucaauuuaguccuucu

SEQ ID NO: 3978870 - RNA, 14 nt, Staphylococcus aureus subsp. aureus Mu50
agcaucauuuuucg

SEQ ID NO: 3978871 - RNA, 14 nt, Staphylococcus aureus subsp. aureus Mu50
agcaucgaacaauc

SEQ ID NO: 3978872 - RNA, 21 nt, Staphylococcus aureus subsp. aureus Mu50
agcaucguaaaaaacaaaaaa

SEQ ID NO: 3978873 - RNA, 17 nt, Staphylococcus aureus subsp. aureus Mu50
agcaucuacaauauuca

SEQ ID NO: 3978874 - RNA, 15 nt, Staphylococcus aureus subsp. aureus Mu50
agcaucuccaauuua

SEQ ID NO: 3978875 - RNA, 16 nt, Staphylococcus aureus subsp. aureus Mu50
agcaucugcaugguuu

SEQ ID NO: 3978876 - RNA, 21 nt, Staphylococcus aureus subsp. aureus Mu50
agcaucuugucuaguucgauu

SEQ ID NO: 3978877 - RNA, 23 nt, Staphylococcus aureus subsp. aureus Mu50
agcaucuuuaccauauaauucuu

SEQ ID NO: 3978878 - RNA, 21 nt, Staphylococcus aureus subsp. aureus Mu50
agcaugaauagcuuguugaac

SEQ ID NO: 3978879 - RNA, 22 nt, Staphylococcus aureus subsp. aureus Mu50
agcaugacacucauucaauuua

SEQ ID NO: 3978880 - RNA, 21 nt, Staphylococcus aureus subsp. aureus Mu50
agcaugauaaaguauguuguc

SEQ ID NO: 3978881 - RNA, 17 nt, Staphylococcus aureus subsp. aureus Mu50
agcauuaaauuccaugu

SEQ ID NO: 3978882 - RNA, 18 nt, Staphylococcus aureus subsp. aureus Mu50
agcauuagcaaauauuau

SEQ ID NO: 3978883 - RNA, 11 nt, Staphylococcus aureus subsp. aureus Mu50
agcauuauuau

SEQ ID NO: 3978884 - RNA, 22 nt, Staphylococcus aureus subsp. aureus Mu50
agcauugagauggucuuuuaau

SEQ ID NO: 3978885 - RNA, 13 nt, Staphylococcus aureus subsp. aureus Mu50
agcauuucauuag

SEQ ID NO: 3978886 - RNA, 16 nt, Staphylococcus aureus subsp. aureus Mu50
agcauuugcuguuaau

SEQ ID NO: 3978887 - RNA, 14 nt, Staphylococcus aureus subsp. aureus Mu50
agcauuuucaaugu

SEQ ID NO: 3978888 - RNA, 19 nt, Staphylococcus aureus subsp. aureus Mu50
agcauuuuuauguuaaauc

SEQ ID NO: 3978889 - RNA, 16 nt, Staphylococcus aureus subsp. aureus Mu50
agcauuuuucaauuau

SEQ ID NO: 3978890 - RNA, 22 nt, Staphylococcus aureus subsp. aureus Mu50
agccaaaucuuuaauaaccuuu

SEQ ID NO: 3978891 - RNA, 14 nt, Staphylococcus aureus subsp. aureus Mu50
agccaauaaaaugu

SEQ ID NO: 3978892 - RNA, 14 nt, Staphylococcus aureus subsp. aureus Mu50
agccacagcgaccu

SEQ ID NO: 3978893 - RNA, 16 nt, Staphylococcus aureus subsp. aureus Mu50
agccaccuaaaucucc

SEQ ID NO: 3978894 - RNA, 12 nt, Staphylococcus aureus subsp. aureus Mu50
agccauaacuga

SEQ ID NO: 3978895 - RNA, 13 nt, Staphylococcus aureus subsp. aureus Mu50
agccaucaauauu

SEQ ID NO: 3978896 - RNA, 14 nt, Staphylococcus aureus subsp. aureus Mu50
agccaucuuucuuu

SEQ ID NO: 3978897 - RNA, 13 nt, Staphylococcus aureus subsp. aureus Mu50
agccauuaaacca

SEQ ID NO: 3978898 - RNA, 22 nt, Staphylococcus aureus subsp. aureus Mu50
agccauuauuauuuuuuucuuu

SEQ ID NO: 3978899 - RNA, 17 nt, Staphylococcus aureus subsp. aureus Mu50
agccauuuguuguaaac

SEQ ID NO: 3978900 - RNA, 23 nt, Staphylococcus aureus subsp. aureus Mu50
agccauuuguuguaaaccagcua

SEQ ID NO: 3978901 - RNA, 18 nt, Staphylococcus aureus subsp. aureus Mu50
agccccuuacaaccuuug

SEQ ID NO: 3978902 - RNA, 22 nt, Staphylococcus aureus subsp. aureus Mu50
agcccuaagcucguuaauuuua

SEQ ID NO: 3978903 - RNA, 14 nt, Staphylococcus aureus subsp. aureus Mu50
agcccuauuuuuaa

SEQ ID NO: 3978904 - RNA, 22 nt, Staphylococcus aureus subsp. aureus Mu50
agccgauaauuugagaaaugaa

SEQ ID NO: 3978905 - RNA, 18 nt, Staphylococcus aureus subsp. aureus Mu50
agcuuucuuuuucaucuu

SEQ ID NO: 3978906 - RNA, 13 nt, Staphylococcus aureus subsp. aureus Mu50
agcuuugacauau

SEQ ID NO: 3978907 - RNA, 18 nt, Staphylococcus aureus subsp. aureus Mu50
agcuuugcucauagauga

SEQ ID NO: 3978908 - RNA, 19 nt, Staphylococcus aureus subsp. aureus Mu50
agcuuugcugcuuuuccag

SEQ ID NO: 3978909 - RNA, 17 nt, Staphylococcus aureus subsp. aureus Mu50
agcuuuguuagcaucug

SEQ ID NO: 3978910 - RNA, 15 nt, Staphylococcus aureus subsp. aureus Mu50
agcuuuucauuuuua

SEQ ID NO: 3978911 - RNA, 23 nt, Staphylococcus aureus subsp. aureus Mu50
agcuuuuuucaauucuagucagg

SEQ ID NO: 3978912 - RNA, 13 nt, Staphylococcus aureus subsp. aureus Mu50
aggaaacuuaaau

SEQ ID NO: 3978913 - RNA, 15 nt, Staphylococcus aureus subsp. aureus Mu50
aggaaauaaaaaaua

SEQ ID NO: 3978914 - RNA, 20 nt, Staphylococcus aureus subsp. aureus Mu50
aggaaauggcuccauuuaau

SEQ ID NO: 3978915 - RNA, 22 nt, Staphylococcus aureus subsp. aureus Mu50
aggaacagcggaauacagauga

SEQ ID NO: 3978916 - RNA, 14 nt, Staphylococcus aureus subsp. aureus Mu50
aggaagcaugagaa

SEQ ID NO: 3978917 - RNA, 16 nt, Staphylococcus aureus subsp. aureus Mu50
aggaagucaccauauu

SEQ ID NO: 3978918 - RNA, 17 nt, Staphylococcus aureus subsp. aureus Mu50
aggaagucaccauauuu

SEQ ID NO: 3978919 - RNA, 19 nt, Staphylococcus aureus subsp. aureus Mu50
aggaauacaugaguaaaac

SEQ ID NO: 3978920 - RNA, 14 nt, Staphylococcus aureus subsp. aureus Mu50
aggaauauaaaacu

SEQ ID NO: 3978921 - RNA, 18 nt, Staphylococcus aureus subsp. aureus Mu50
aggaauaucuuucaaauu

SEQ ID NO: 3978922 - RNA, 21 nt, Staphylococcus aureus subsp. aureus Mu50
aggaauauuucccuaugaaau

SEQ ID NO: 3978923 - RNA, 15 nt, Staphylococcus aureus subsp. aureus Mu50
aggaauccaaagcug

SEQ ID NO: 3978924 - RNA, 22 nt, Staphylococcus aureus subsp. aureus Mu50
aggaaugauauaccuugauuca

SEQ ID NO: 3978925 - RNA, 16 nt, Staphylococcus aureus subsp. aureus Mu50
aggaccacucaauucu

SEQ ID NO: 3978926 - RNA, 21 nt, Staphylococcus aureus subsp. aureus Mu50
aggagauuguuauuauaaacu

SEQ ID NO: 3978927 - RNA, 12 nt, Staphylococcus aureus subsp. aureus Mu50
aggauaagaacg

SEQ ID NO: 3978928 - RNA, 15 nt, Staphylococcus aureus subsp. aureus Mu50
aggauaauuucaauu

SEQ ID NO: 3978929 - RNA, 18 nt, Staphylococcus aureus subsp. aureus Mu50
aggauaguucuuugucug

SEQ ID NO: 3978930 - RNA, 22 nt, Staphylococcus aureus subsp. aureus Mu50
aggauaugcuguguaucaucau

SEQ ID NO: 3978931 - RNA, 14 nt, Staphylococcus aureus subsp. aureus Mu50
aggauauuuuuuaa

SEQ ID NO: 3978932 - RNA, 20 nt, Staphylococcus aureus subsp. aureus Mu50
aggaucacguuuuucuuuaa

SEQ ID NO: 3978933 - RNA, 22 nt, Staphylococcus aureus subsp. aureus Mu50
aggaucacguuuuucuuuaaac

SEQ ID NO: 3978934 - RNA, 14 nt, Staphylococcus aureus subsp. aureus Mu50
aggaucuuuuccau

SEQ ID NO: 3978935 - RNA, 14 nt, Staphylococcus aureus subsp. aureus Mu50
aggaugaguuuaaa

SEQ ID NO: 3978936 - RNA, 17 nt, Staphylococcus aureus subsp. aureus Mu50
aggaugaguuuaaaaau

SEQ ID NO: 3978937 - RNA, 19 nt, Staphylococcus aureus subsp. aureus Mu50
aggauggaaugauacgccu

SEQ ID NO: 3978938 - RNA, 18 nt, Staphylococcus aureus subsp. aureus Mu50
aggauguuauaaaaugaa

SEQ ID NO: 3978939 - RNA, 15 nt, Staphylococcus aureus subsp. aureus Mu50
aggauguucaucaac

SEQ ID NO: 3978940 - RNA, 20 nt, Staphylococcus aureus subsp. aureus Mu50
aggauguucaucaacaugau

SEQ ID NO: 3978941 - RNA, 19 nt, Staphylococcus aureus subsp. aureus Mu50
aggauuuacaccuauaccu

SEQ ID NO: 3978942 - RNA, 20 nt, Staphylococcus aureus subsp. aureus Mu50
aggauuuccggaacaauacc

SEQ ID NO: 3978943 - RNA, 19 nt, Staphylococcus aureus subsp. aureus Mu50
aggauuugcaccuauaccu

SEQ ID NO: 3978944 - RNA, 20 nt, Staphylococcus aureus subsp. aureus Mu50
aggauuugcaccuauaccuc

SEQ ID NO: 3978945 - RNA, 12 nt, Staphylococcus aureus subsp. aureus Mu50
aggauuuuagau

SEQ ID NO: 3978946 - RNA, 20 nt, Staphylococcus aureus subsp. aureus Mu50
aggcaacuuuuauuacuuau

SEQ ID NO: 3978947 - RNA, 14 nt, Staphylococcus aureus subsp. aureus Mu50
aggcaauauuaaaa

SEQ ID NO: 3978948 - RNA, 15 nt, Staphylococcus aureus subsp. aureus Mu50
aggcaauauuaaaau

SEQ ID NO: 3978949 - RNA, 13 nt, Staphylococcus aureus subsp. aureus Mu50
aggcaaugcaagu

SEQ ID NO: 3978950 - RNA, 17 nt, Staphylococcus aureus subsp. aureus Mu50
aggcaaugcaaguuggc

SEQ ID NO: 3978951 - RNA, 23 nt, Staphylococcus aureus subsp. aureus Mu50
aggcaaugcaaguuggcggggcc

SEQ ID NO: 3978952 - RNA, 22 nt, Staphylococcus aureus subsp. aureus Mu50
aggcaauguaaugguuaauaac

SEQ ID NO: 3978953 - RNA, 21 nt, Staphylococcus aureus subsp. aureus Mu50
aggcacaguggauuacagaug

SEQ ID NO: 3978954 - RNA, 22 nt, Staphylococcus aureus subsp. aureus Mu50
aggcacaguggauuacagauga

SEQ ID NO: 3978955 - RNA, 14 nt, Staphylococcus aureus subsp. aureus Mu50
aggcaggaaugaua

SEQ ID NO: 3978956 - RNA, 14 nt, Staphylococcus aureus subsp. aureus Mu50
aggcaggcauaauu

SEQ ID NO: 3978957 - RNA, 14 nt, Staphylococcus aureus subsp. aureus Mu50
aggcauaacuguau

SEQ ID NO: 3978958 - RNA, 23 nt, Staphylococcus aureus subsp. aureus Mu50
aggcauaauuugugguaugacug

SEQ ID NO: 3978959 - RNA, 15 nt, Staphylococcus aureus subsp. aureus Mu50
aggcaucucacaauc

SEQ ID NO: 3978960 - RNA, 19 nt, Staphylococcus aureus subsp. aureus Mu50
aggccauuuuuauuuaaca

SEQ ID NO: 3978961 - RNA, 16 nt, Staphylococcus aureus subsp. aureus Mu50
aggcccauaaauuacu

SEQ ID NO: 3978962 - RNA, 18 nt, Staphylococcus aureus subsp. aureus Mu50
aggcccauaaauuacuug

SEQ ID NO: 3978963 - RNA, 13 nt, Staphylococcus aureus subsp. aureus Mu50
aggcgccauaauc

SEQ ID NO: 3978964 - RNA, 19 nt, Staphylococcus aureus subsp. aureus Mu50
aggcgcuguuccaaauuca

SEQ ID NO: 3978965 - RNA, 14 nt, Staphylococcus aureus subsp. aureus Mu50
aggcgucuuaaauu

SEQ ID NO: 3978966 - RNA, 23 nt, Staphylococcus aureus subsp. aureus Mu50
aggcuuaugggggauuuuuuuau

SEQ ID NO: 3978967 - RNA, 13 nt, Staphylococcus aureus subsp. aureus Mu50
aggcuuuaaaauu

SEQ ID NO: 3978968 - RNA, 21 nt, Staphylococcus aureus subsp. aureus Mu50
agggacagaaaagggcaaaaa

SEQ ID NO: 3978969 - RNA, 13 nt, Staphylococcus aureus subsp. aureus Mu50
agggcaaaaaagg

SEQ ID NO: 3978970 - RNA, 15 nt, Staphylococcus aureus subsp. aureus Mu50
agggcaaaaaaggau

SEQ ID NO: 3978971 - RNA, 18 nt, Staphylococcus aureus subsp. aureus Mu50
agggccccaacacagaag

SEQ ID NO: 3978972 - RNA, 23 nt, Staphylococcus aureus subsp. aureus Mu50
agggcucggcaccauaucaaguu

SEQ ID NO: 3978973 - RNA, 23 nt, Staphylococcus aureus subsp. aureus Mu50
aggggacuuaaccauuuaaaaau

SEQ ID NO: 3978974 - RNA, 21 nt, Staphylococcus aureus subsp. aureus Mu50
aggggccccaacacagagaau

SEQ ID NO: 3978975 - RNA, 15 nt, Staphylococcus aureus subsp. aureus Mu50
aggggcuuuuaugca

SEQ ID NO: 3978976 - RNA, 16 nt, Staphylococcus aureus subsp. aureus Mu50
agggggcuucuuuguu

SEQ ID NO: 3978977 - RNA, 16 nt, Staphylococcus aureus subsp. aureus Mu50
aggggucuuuuuuuaa

SEQ ID NO: 3978978 - RNA, 21 nt, Staphylococcus aureus subsp. aureus Mu50
aggguauugaaauaauauaaa

SEQ ID NO: 3978979 - RNA, 23 nt, Staphylococcus aureus subsp. aureus Mu50
aggguuugccagucauuguauaa

SEQ ID NO: 3978980 - RNA, 23 nt, Staphylococcus aureus subsp. aureus Mu50
agguaaaucuguuuaaauuuaaa

SEQ ID NO: 3978981 - RNA, 12 nt, Staphylococcus aureus subsp. aureus Mu50
agguaaauuuaa

SEQ ID NO: 3978982 - RNA, 13 nt, Staphylococcus aureus subsp. aureus Mu50
agguaaauuuaaa

SEQ ID NO: 3978983 - RNA, 16 nt, Staphylococcus aureus subsp. aureus Mu50
agguaaauuuaaaaua

SEQ ID NO: 3978984 - RNA, 13 nt, Staphylococcus aureus subsp. aureus Mu50
agguaacugcuuu

SEQ ID NO: 3978985 - RNA, 13 nt, Staphylococcus aureus subsp. aureus Mu50
agguaacuuuuua

SEQ ID NO: 3978986 - RNA, 22 nt, Staphylococcus aureus subsp. aureus Mu50
agguaagaaaaauucaucaaua

SEQ ID NO: 3978987 - RNA, 13 nt, Staphylococcus aureus subsp. aureus Mu50
agguaauaaagcu

SEQ ID NO: 3978988 - RNA, 17 nt, Staphylococcus aureus subsp. aureus Mu50
agguaauaaagcugauu

SEQ ID NO: 3978989 - RNA, 13 nt, Staphylococcus aureus subsp. aureus Mu50
agguaauacuuuu

SEQ ID NO: 3978990 - RNA, 13 nt, Staphylococcus aureus subsp. aureus Mu50
agguaaugcaagu

SEQ ID NO: 3978991 - RNA, 17 nt, Staphylococcus aureus subsp. aureus Mu50
agguaaugcaaguuggc

SEQ ID NO: 3978992 - RNA, 20 nt, Staphylococcus aureus subsp. aureus Mu50
agguaaugucccguuuaccu

SEQ ID NO: 3978993 - RNA, 18 nt, Staphylococcus aureus subsp. aureus Mu50
aguacuuuaaaauuguau

SEQ ID NO: 3978994 - RNA, 17 nt, Staphylococcus aureus subsp. aureus Mu50
aguagaaccuauauuaa

SEQ ID NO: 3978995 - RNA, 13 nt, Staphylococcus aureus subsp. aureus Mu50
aguagaauuauuu

SEQ ID NO: 3978996 - RNA, 14 nt, Staphylococcus aureus subsp. aureus Mu50
aguagaauuauuua

SEQ ID NO: 3978997 - RNA, 16 nt, Staphylococcus aureus subsp. aureus Mu50
aguagacauugaaagg

SEQ ID NO: 3978998 - RNA, 21 nt, Staphylococcus aureus subsp. aureus Mu50
aguagacgguaucaucugcau

SEQ ID NO: 3978999 - RNA, 13 nt, Staphylococcus aureus subsp. aureus Mu50
aguagauuuauua

SEQ ID NO: 3979000 - RNA, 19 nt, Staphylococcus aureus subsp. aureus Mu50
aguagauuuauuaaauaua

SEQ ID NO: 3979001 - RNA, 16 nt, Staphylococcus aureus subsp. aureus Mu50
aguagcuagaacagau

SEQ ID NO: 3979002 - RNA, 22 nt, Staphylococcus aureus subsp. aureus Mu50
aguagcucaaaacaauuuaaaa

SEQ ID NO: 3979003 - RNA, 24 nt, Staphylococcus aureus subsp. aureus Mu50
aguagcuuguuuagaagcuucugc

SEQ ID NO: 3979004 - RNA, 23 nt, Staphylococcus aureus subsp. aureus Mu50
aguaggaauuguuaauuucaaca

SEQ ID NO: 3979005 - RNA, 18 nt, Staphylococcus aureus subsp. aureus Mu50
aguaggauaauuucaauu

SEQ ID NO: 3979006 - RNA, 14 nt, Staphylococcus aureus subsp. aureus Mu50
aguagucacuguuu

SEQ ID NO: 3979007 - RNA, 20 nt, Staphylococcus aureus subsp. aureus Mu50
aguaguuaauugaaugaaaa

SEQ ID NO: 3979008 - RNA, 18 nt, Staphylococcus aureus subsp. aureus Mu50
aguaguuaucuaaugauc

SEQ ID NO: 3979009 - RNA, 22 nt, Staphylococcus aureus subsp. aureus Mu50
aguaguucggaugagaaauguu

SEQ ID NO: 3979010 - RNA, 19 nt, Staphylococcus aureus subsp. aureus Mu50
aguaguugacugaacgaaa

SEQ ID NO: 3979011 - RNA, 20 nt, Staphylococcus aureus subsp. aureus Mu50
aguaguugacugaacgaaaa

SEQ ID NO: 3979012 - RNA, 14 nt, Staphylococcus aureus subsp. aureus Mu50
aguauaaaccaaau

SEQ ID NO: 3979013 - RNA, 19 nt, Staphylococcus aureus subsp. aureus Mu50
aguauaaaccaaaucggaa

SEQ ID NO: 3979014 - RNA, 23 nt, Staphylococcus aureus subsp. aureus Mu50
aguauaaaccgccaacuaauguu

SEQ ID NO: 3979015 - RNA, 12 nt, Staphylococcus aureus subsp. aureus Mu50
aguauaaauaaa

SEQ ID NO: 3979016 - RNA, 13 nt, Staphylococcus aureus subsp. aureus Mu50
aguauaaauaaaa

SEQ ID NO: 3979017 - RNA, 14 nt, Staphylococcus aureus subsp. aureus Mu50
aguauaaauaaaaa

SEQ ID NO: 3979018 - RNA, 18 nt, Staphylococcus aureus subsp. aureus Mu50
aguauaagguugaagaag

SEQ ID NO: 3979019 - RNA, 16 nt, Staphylococcus aureus subsp. aureus Mu50
aguauaaucagcaaug

SEQ ID NO: 3979020 - RNA, 13 nt, Staphylococcus aureus subsp. aureus Mu50
aguauaauuaaac

SEQ ID NO: 3979021 - RNA, 17 nt, Staphylococcus aureus subsp. aureus Mu50
aguauaauuaaacuaau

SEQ ID NO: 3979022 - RNA, 15 nt, Staphylococcus aureus subsp. aureus Mu50
aguauaauuuaucuu

SEQ ID NO: 3979023 - RNA, 16 nt, Staphylococcus aureus subsp. aureus Mu50
aguauaauuuucuguc

SEQ ID NO: 3979024 - RNA, 16 nt, Staphylococcus aureus subsp. aureus Mu50
aguauacgaguuauau

SEQ ID NO: 3979025 - RNA, 21 nt, Staphylococcus aureus subsp. aureus Mu50
aguauagcgcagcaaaugcuu

SEQ ID NO: 3979026 - RNA, 15 nt, Staphylococcus aureus subsp. aureus Mu50
aguauauaucaaaua

SEQ ID NO: 3979027 - RNA, 17 nt, Staphylococcus aureus subsp. aureus Mu50
aguaucauaauuuuguu

SEQ ID NO: 3979028 - RNA, 21 nt, Staphylococcus aureus subsp. aureus Mu50
aguaucauguucuuauaaaaa

SEQ ID NO: 3979029 - RNA, 22 nt, Staphylococcus aureus subsp. aureus Mu50
aguaucauuguguccauaaaua

SEQ ID NO: 3979030 - RNA, 23 nt, Staphylococcus aureus subsp. aureus Mu50
aguaucauuguguccauaaauau

SEQ ID NO: 3979031 - RNA, 20 nt, Staphylococcus aureus subsp. aureus Mu50
aguauccagaguuaaaguca

SEQ ID NO: 3979032 - RNA, 15 nt, Staphylococcus aureus subsp. aureus Mu50
aguaucgauuuaaca

SEQ ID NO: 3979033 - RNA, 16 nt, Staphylococcus aureus subsp. aureus Mu50
aguaucuaaauauuaa

SEQ ID NO: 3979034 - RNA, 14 nt, Staphylococcus aureus subsp. aureus Mu50
aguaucucauuuuu

SEQ ID NO: 3979035 - RNA, 21 nt, Staphylococcus aureus subsp. aureus Mu50
aguaucucuuuucuauucaaa

SEQ ID NO: 3979036 - RNA, 18 nt, Staphylococcus aureus subsp. aureus Mu50
aguaucugugaauaugcu

SEQ ID NO: 3979037 - RNA, 19 nt, Staphylococcus aureus subsp. aureus Mu50
aguaucuuauauucuuaaa

SEQ ID NO: 3979038 - RNA, 17 nt, Staphylococcus aureus subsp. aureus Mu50
aguaugacgaaaugaau

SEQ ID NO: 3979039 - RNA, 14 nt, Staphylococcus aureus subsp. aureus Mu50
aguauguugucaua

SEQ ID NO: 3979040 - RNA, 21 nt, Staphylococcus aureus subsp. aureus Mu50
aguauguugucauaccaaaua

SEQ ID NO: 3979041 - RNA, 14 nt, Staphylococcus aureus subsp. aureus Mu50
aguauuaaauuuga

SEQ ID NO: 3979042 - RNA, 14 nt, Staphylococcus aureus subsp. aureus Mu50
aguauuaaauuugu

SEQ ID NO: 3979043 - RNA, 16 nt, Staphylococcus aureus subsp. aureus Mu50
aguauuaaauuugugu

SEQ ID NO: 3979044 - RNA, 23 nt, Staphylococcus aureus subsp. aureus Mu50
aguauuauagccuauccauucaa

SEQ ID NO: 3979045 - RNA, 15 nt, Staphylococcus aureus subsp. aureus Mu50
aguauuaugauugcu

SEQ ID NO: 3979046 - RNA, 14 nt, Staphylococcus aureus subsp. aureus Mu50
aguauucaaaaaau

SEQ ID NO: 3979047 - RNA, 15 nt, Staphylococcus aureus subsp. aureus Mu50
aguauucaaaaaaua

SEQ ID NO: 3979048 - RNA, 14 nt, Staphylococcus aureus subsp. aureus Mu50
aguauucauuuucu

SEQ ID NO: 3979049 - RNA, 20 nt, Staphylococcus aureus subsp. aureus Mu50
aguauugccaaauuucucuu

SEQ ID NO: 3979050 - RNA, 15 nt, Staphylococcus aureus subsp. aureus Mu50
aguauugccguuauu

SEQ ID NO: 3979051 - RNA, 14 nt, Staphylococcus aureus subsp. aureus Mu50
aguauuucaucauu

SEQ ID NO: 3979052 - RNA, 13 nt, Staphylococcus aureus subsp. aureus Mu50
aguauuuucucua

SEQ ID NO: 3979053 - RNA, 19 nt, Staphylococcus aureus subsp. aureus Mu50
aguauuuuugcguuaauaa

SEQ ID NO: 3979054 - RNA, 22 nt, Staphylococcus aureus subsp. aureus Mu50
aguauuuuugcguuaauaauuu

SEQ ID NO: 3979055 - RNA, 16 nt, Staphylococcus aureus subsp. aureus Mu50
aguauuuuuuauguuc

SEQ ID NO: 3979056 - RNA, 15 nt, Staphylococcus aureus subsp. aureus Mu50
agucaaaaaaucgaa

SEQ ID NO: 3979057 - RNA, 23 nt, Staphylococcus aureus subsp. aureus Mu50
agucaaaaaaucgaacaaaugaa

SEQ ID NO: 3979058 - RNA, 22 nt, Staphylococcus aureus subsp. aureus Mu50
agucaacugcugcuaaaauaaa

SEQ ID NO: 3979059 - RNA, 19 nt, Staphylococcus aureus subsp. aureus Mu50
agucaauaauuuuaucuaa

SEQ ID NO: 3979060 - RNA, 13 nt, Staphylococcus aureus subsp. aureus Mu50
agucaaucaaguu

SEQ ID NO: 3979061 - RNA, 16 nt, Staphylococcus aureus subsp. aureus Mu50
agucaauguauauuua

SEQ ID NO: 3979062 - RNA, 23 nt, Staphylococcus aureus subsp. aureus Mu50
agucaauguauauuuaacaucaa

SEQ ID NO: 3979063 - RNA, 17 nt, Staphylococcus aureus subsp. aureus Mu50
agucaauuuaaauaagu

SEQ ID NO: 3979064 - RNA, 15 nt, Staphylococcus aureus subsp. aureus Mu50
agucaauuuuuucau

SEQ ID NO: 3979065 - RNA, 16 nt, Staphylococcus aureus subsp. aureus Mu50
agucaggggccccaac

SEQ ID NO: 3979066 - RNA, 13 nt, Staphylococcus aureus subsp. aureus Mu50
agucauaaauaua

SEQ ID NO: 3979067 - RNA, 21 nt, Staphylococcus aureus subsp. aureus Mu50
agucauacgcaaugauuauaa

SEQ ID NO: 3979068 - RNA, 18 nt, Staphylococcus aureus subsp. aureus Mu50
agucauaggcuugccaau

SEQ ID NO: 3979069 - RNA, 14 nt, Staphylococcus aureus subsp. aureus Mu50
agucauaugcauac

SEQ ID NO: 3979070 - RNA, 19 nt, Staphylococcus aureus subsp. aureus Mu50
agucaucaaccucauuuga

SEQ ID NO: 3979071 - RNA, 22 nt, Staphylococcus aureus subsp. aureus Mu50
agucaucaaccucauuugacau

SEQ ID NO: 3979072 - RNA, 13 nt, Staphylococcus aureus subsp. aureus Mu50
agucauuacaaau

SEQ ID NO: 3979073 - RNA, 17 nt, Staphylococcus aureus subsp. aureus Mu50
agucauuguauaaaaag

SEQ ID NO: 3979074 - RNA, 17 nt, Staphylococcus aureus subsp. aureus Mu50
agucauuugauuuaaaa

SEQ ID NO: 3979075 - RNA, 12 nt, Staphylococcus aureus subsp. aureus Mu50
aguccauuuucu

SEQ ID NO: 3979076 - RNA, 15 nt, Staphylococcus aureus subsp. aureus Mu50
aguccauuuucuuuu

SEQ ID NO: 3979077 - RNA, 14 nt, Staphylococcus aureus subsp. aureus Mu50
aguccggggcccca

SEQ ID NO: 3979078 - RNA, 20 nt, Staphylococcus aureus subsp. aureus Mu50
aguccuucuuugaaaucaau

SEQ ID NO: 3979079 - RNA, 14 nt, Staphylococcus aureus subsp. aureus Mu50
agucgaacaaugau

SEQ ID NO: 3979080 - RNA, 18 nt, Staphylococcus aureus subsp. aureus Mu50
agucgauaaauaugaugu

SEQ ID NO: 3979081 - RNA, 20 nt, Staphylococcus aureus subsp. aureus Mu50
agugucgagauuuuauaagu

SEQ ID NO: 3979082 - RNA, 13 nt, Staphylococcus aureus subsp. aureus Mu50
agugucuauguug

SEQ ID NO: 3979083 - RNA, 14 nt, Staphylococcus aureus subsp. aureus Mu50
agugugucauaaug

SEQ ID NO: 3979084 - RNA, 17 nt, Staphylococcus aureus subsp. aureus Mu50
aguguuauaaauagaga

SEQ ID NO: 3979085 - RNA, 22 nt, Staphylococcus aureus subsp. aureus Mu50
aguguuauaauggcgggccccc

SEQ ID NO: 3979086 - RNA, 19 nt, Staphylococcus aureus subsp. aureus Mu50
aguguucucauuauaauga

SEQ ID NO: 3979087 - RNA, 22 nt, Staphylococcus aureus subsp. aureus Mu50
aguguucucauuauaaugauuu

SEQ ID NO: 3979088 - RNA, 17 nt, Staphylococcus aureus subsp. aureus Mu50
aguguugaauuucaaaa

SEQ ID NO: 3979089 - RNA, 19 nt, Staphylococcus aureus subsp. aureus Mu50
aguguuucauaaucucuuu

SEQ ID NO: 3979090 - RNA, 17 nt, Staphylococcus aureus subsp. aureus Mu50
aguguuuuauagauuca

SEQ ID NO: 3979091 - RNA, 18 nt, Staphylococcus aureus subsp. aureus Mu50
aguuaaaaccuuuucaaa

SEQ ID NO: 3979092 - RNA, 17 nt, Staphylococcus aureus subsp. aureus Mu50
aguuaaaagugguuuua

SEQ ID NO: 3979093 - RNA, 19 nt, Staphylococcus aureus subsp. aureus Mu50
aguuaaaauugguuuggau

SEQ ID NO: 3979094 - RNA, 22 nt, Staphylococcus aureus subsp. aureus Mu50
aguuaaacgaaaaaugccaacu

SEQ ID NO: 3979095 - RNA, 21 nt, Staphylococcus aureus subsp. aureus Mu50
aguuaaagacuagccauaccu

SEQ ID NO: 3979096 - RNA, 16 nt, Staphylococcus aureus subsp. aureus Mu50
aguuaaaguacuuaca

SEQ ID NO: 3979097 - RNA, 23 nt, Staphylococcus aureus subsp. aureus Mu50
aguuaaaguuccaaguuaaugca

SEQ ID NO: 3979098 - RNA, 14 nt, Staphylococcus aureus subsp. aureus Mu50
aguuaaauaguaag

SEQ ID NO: 3979099 - RNA, 18 nt, Staphylococcus aureus subsp. aureus Mu50
aguuaaauaucauaccgu

SEQ ID NO: 3979100 - RNA, 22 nt, Staphylococcus aureus subsp. aureus Mu50
aguuaagucgccuaacuuuuau

SEQ ID NO: 3979101 - RNA, 21 nt, Staphylococcus aureus subsp. aureus Mu50
aguuaauaaacgcuucauagu

SEQ ID NO: 3979102 - RNA, 23 nt, Staphylococcus aureus subsp. aureus Mu50
aguuaauaauuuuggauuuuuuu

SEQ ID NO: 3979103 - RNA, 11 nt, Staphylococcus aureus subsp. aureus Mu50
aguuaauguaa

SEQ ID NO: 3979104 - RNA, 18 nt, Staphylococcus aureus subsp. aureus Mu50
aguuaaugugcauuuauc

SEQ ID NO: 3979105 - RNA, 23 nt, Staphylococcus aureus subsp. aureus Mu50
aguuaauucuccuaauaauuugg

SEQ ID NO: 3979106 - RNA, 17 nt, Staphylococcus aureus subsp. aureus Mu50
aguuaauugaaugaaaa

SEQ ID NO: 3979107 - RNA, 19 nt, Staphylococcus aureus subsp. aureus Mu50
aguuacuauauuuauuagu

SEQ ID NO: 3979108 - RNA, 17 nt, Staphylococcus aureus subsp. aureus Mu50
aguuacucaauauaaaa

SEQ ID NO: 3979109 - RNA, 15 nt, Staphylococcus aureus subsp. aureus Mu50
aguuacuuacgccaa

SEQ ID NO: 3979110 - RNA, 21 nt, Staphylococcus aureus subsp. aureus Mu50
aguuacuuacgccaaucacaa

SEQ ID NO: 3979111 - RNA, 17 nt, Staphylococcus aureus subsp. aureus Mu50
aguuacuucaguuuggu

SEQ ID NO: 3979112 - RNA, 16 nt, Staphylococcus aureus subsp. aureus Mu50
aguuauaaauuauauu

SEQ ID NO: 3979113 - RNA, 22 nt, Staphylococcus aureus subsp. aureus Mu50
aguuauacuaagcgcucauaaa

SEQ ID NO: 3979114 - RNA, 12 nt, Staphylococcus aureus subsp. aureus Mu50
aguuauaucauc

SEQ ID NO: 3979115 - RNA, 14 nt, Staphylococcus aureus subsp. aureus Mu50
aguuauaugugcuu

SEQ ID NO: 3979116 - RNA, 15 nt, Staphylococcus aureus subsp. aureus Mu50
aguuauaugugcuuu

SEQ ID NO: 3979117 - RNA, 17 nt, Staphylococcus aureus subsp. aureus Mu50
aguuaucggcuaaaguu

SEQ ID NO: 3979118 - RNA, 18 nt, Staphylococcus aureus subsp. aureus Mu50
aguuaucggcuaaaguua

SEQ ID NO: 3979119 - RNA, 20 nt, Staphylococcus aureus subsp. aureus Mu50
aguuaugacuaacgaaaaag

SEQ ID NO: 3979120 - RNA, 21 nt, Staphylococcus aureus subsp. aureus Mu50
aguuaugaugggaaaaaaugg

SEQ ID NO: 3979121 - RNA, 18 nt, Staphylococcus aureus subsp. aureus Mu50
aguuaugcugucaaacaa

SEQ ID NO: 3979122 - RNA, 13 nt, Staphylococcus aureus subsp. aureus Mu50
aguuauuaagcca

SEQ ID NO: 3979123 - RNA, 14 nt, Staphylococcus aureus subsp. aureus Mu50
aguucaaacagaaa

SEQ ID NO: 3979124 - RNA, 23 nt, Staphylococcus aureus subsp. aureus Mu50
aguucaaauggacuaacgucauu

SEQ ID NO: 3979125 - RNA, 19 nt, Staphylococcus aureus subsp. aureus Mu50
aguucaaauugaacuucuu

SEQ ID NO: 3979126 - RNA, 18 nt, Staphylococcus aureus subsp. aureus Mu50
aguucacaacaaagugua

SEQ ID NO: 3979127 - RNA, 20 nt, Staphylococcus aureus subsp. aureus Mu50
aguucaccguaaucuuuuaa

SEQ ID NO: 3979128 - RNA, 15 nt, Staphylococcus aureus subsp. aureus Mu50
aguucacuaaauuca

SEQ ID NO: 3979129 - RNA, 18 nt, Staphylococcus aureus subsp. aureus Mu50
aguucaggaucaagugca

SEQ ID NO: 3979130 - RNA, 20 nt, Staphylococcus aureus subsp. aureus Mu50
aguuccguugaauuaacaau

SEQ ID NO: 3979131 - RNA, 16 nt, Staphylococcus aureus subsp. aureus Mu50
aguuccucgguauuca

SEQ ID NO: 3979132 - RNA, 23 nt, Staphylococcus aureus subsp. aureus Mu50
aguuccucgguauucaauucugu

SEQ ID NO: 3979133 - RNA, 23 nt, Staphylococcus aureus subsp. aureus Mu50
aguucgacacgcccgacaucaua

SEQ ID NO: 3979134 - RNA, 18 nt, Staphylococcus aureus subsp. aureus Mu50
aguucggaugagaaaugu

SEQ ID NO: 3979135 - RNA, 22 nt, Staphylococcus aureus subsp. aureus Mu50
aguucggaugagaaauguuaac

SEQ ID NO: 3979136 - RNA, 17 nt, Staphylococcus aureus subsp. aureus Mu50
aguucuagauuauuuaa

SEQ ID NO: 3979137 - RNA, 21 nt, Staphylococcus aureus subsp. aureus Mu50
aguucuaguuuuuuuuauaug

SEQ ID NO: 3979138 - RNA, 22 nt, Staphylococcus aureus subsp. aureus Mu50
aguucuuagauuuucacuaaua

SEQ ID NO: 3979139 - RNA, 12 nt, Staphylococcus aureus subsp. aureus Mu50
aguucuuuaaau

SEQ ID NO: 3979140 - RNA, 13 nt, Staphylococcus aureus subsp. aureus Mu50
aguucuuuuugau

SEQ ID NO: 3979141 - RNA, 17 nt, Staphylococcus aureus subsp. aureus Mu50
aguucuuuuugaugauc

SEQ ID NO: 3979142 - RNA, 21 nt, Staphylococcus aureus subsp. aureus Mu50
aguugaaaaccucuuuuuguu

SEQ ID NO: 3979143 - RNA, 14 nt, Staphylococcus aureus subsp. aureus Mu50
aguugaaaauaauc

SEQ ID NO: 3979144 - RNA, 23 nt, Staphylococcus aureus subsp. aureus Mu50
aguugaaaauaaucgaacagaaa

SEQ ID NO: 3979145 - RNA, 16 nt, Staphylococcus aureus subsp. aureus Mu50
aguugaauauaaaaaa

SEQ ID NO: 3979146 - RNA, 12 nt, Staphylococcus aureus subsp. aureus Mu50
aguugauaaugu

SEQ ID NO: 3979147 - RNA, 21 nt, Staphylococcus aureus subsp. aureus Mu50
aguugauugcaugacagcaaa

SEQ ID NO: 3979148 - RNA, 21 nt, Staphylococcus aureus subsp. aureus Mu50
aguugcacuugguucauaaug

SEQ ID NO: 3979149 - RNA, 24 nt, Staphylococcus aureus subsp. aureus Mu50
aguugcacuugguucauaaugauc

SEQ ID NO: 3979150 - RNA, 18 nt, Staphylococcus aureus subsp. aureus Mu50
aguugcauaaucaauuuc

SEQ ID NO: 3979151 - RNA, 22 nt, Staphylococcus aureus subsp. aureus Mu50
aguugcgaacucguuauagaua

SEQ ID NO: 3979152 - RNA, 16 nt, Staphylococcus aureus subsp. aureus Mu50
aguuggcggggcccca

SEQ ID NO: 3979153 - RNA, 21 nt, Staphylococcus aureus subsp. aureus Mu50
aguuggcugauagaugaaaau

SEQ ID NO: 3979154 - RNA, 18 nt, Staphylococcus aureus subsp. aureus Mu50
aguuggggaugggcccca

SEQ ID NO: 3979155 - RNA, 16 nt, Staphylococcus aureus subsp. aureus Mu50
aguuggggugagggcc

SEQ ID NO: 3979156 - RNA, 14 nt, Staphylococcus aureus subsp. aureus Mu50
aguugguaucgauu

SEQ ID NO: 3979157 - RNA, 18 nt, Staphylococcus aureus subsp. aureus Mu50
aguugguggaugucaugu

SEQ ID NO: 3979158 - RNA, 17 nt, Staphylococcus aureus subsp. aureus Mu50
aguuguaauuuaaaaua

SEQ ID NO: 3979159 - RNA, 13 nt, Staphylococcus aureus subsp. aureus Mu50
aguuguacuucuu

SEQ ID NO: 3979160 - RNA, 15 nt, Staphylococcus aureus subsp. aureus Mu50
aguuguaucauuaau

SEQ ID NO: 3979161 - RNA, 18 nt, Staphylococcus aureus subsp. aureus Mu50
aguugucaucuaauuaca

SEQ ID NO: 3979162 - RNA, 17 nt, Staphylococcus aureus subsp. aureus Mu50
aguuguccauuuuaugc

SEQ ID NO: 3979163 - RNA, 23 nt, Staphylococcus aureus subsp. aureus Mu50
aguuguggucuaaccaucucaac

SEQ ID NO: 3979164 - RNA, 20 nt, Staphylococcus aureus subsp. aureus Mu50
aguugugguuguuaauguau

SEQ ID NO: 3979165 - RNA, 14 nt, Staphylococcus aureus subsp. aureus Mu50
aguuguuauauucu

SEQ ID NO: 3979166 - RNA, 14 nt, Staphylococcus aureus subsp. aureus Mu50
aguuguugaaauuu

SEQ ID NO: 3979167 - RNA, 16 nt, Staphylococcus aureus subsp. aureus Mu50
aguuguugaaauuucu

SEQ ID NO: 3979168 - RNA, 20 nt, Staphylococcus aureus subsp. aureus Mu50
auaaaagccucuaaugauua

SEQ ID NO: 3979169 - RNA, 22 nt, Staphylococcus aureus subsp. aureus Mu50
auaaaaggcuuuguuaaacaca

SEQ ID NO: 3979170 - RNA, 20 nt, Staphylococcus aureus subsp. aureus Mu50
auaaaaggggaaaucauuug

SEQ ID NO: 3979171 - RNA, 21 nt, Staphylococcus aureus subsp. aureus Mu50
auaaaaguacuuuaaaauugu

SEQ ID NO: 3979172 - RNA, 23 nt, Staphylococcus aureus subsp. aureus Mu50
auaaaaguacuuuaaaauuguau

SEQ ID NO: 3979173 - RNA, 20 nt, Staphylococcus aureus subsp. aureus Mu50
auaaaagucgauaaauauga

SEQ ID NO: 3979174 - RNA, 22 nt, Staphylococcus aureus subsp. aureus Mu50
auaaaagucgauaaauaugaug

SEQ ID NO: 3979175 - RNA, 17 nt, Staphylococcus aureus subsp. aureus Mu50
auaaaaguguaauguuc

SEQ ID NO: 3979176 - RNA, 23 nt, Staphylococcus aureus subsp. aureus Mu50
auaaaaguuaccuacuacauucu

SEQ ID NO: 3979177 - RNA, 13 nt, Staphylococcus aureus subsp. aureus Mu50
auaaaauaaaaaa

SEQ ID NO: 3979178 - RNA, 13 nt, Staphylococcus aureus subsp. aureus Mu50
auaaaauaaaaug

SEQ ID NO: 3979179 - RNA, 22 nt, Staphylococcus aureus subsp. aureus Mu50
auaaaauaaucgguaauuacuu

SEQ ID NO: 3979180 - RNA, 13 nt, Staphylococcus aureus subsp. aureus Mu50
auaaaaucauaac

SEQ ID NO: 3979181 - RNA, 20 nt, Staphylococcus aureus subsp. aureus Mu50
auaaaaucaucguauuucau

SEQ ID NO: 3979182 - RNA, 16 nt, Staphylococcus aureus subsp. aureus Mu50
auaaaaucaucuuaac

SEQ ID NO: 3979183 - RNA, 13 nt, Staphylococcus aureus subsp. aureus Mu50
auaaaaucauuaa

SEQ ID NO: 3979184 - RNA, 15 nt, Staphylococcus aureus subsp. aureus Mu50
auaaaaugaauaauu

SEQ ID NO: 3979185 - RNA, 13 nt, Staphylococcus aureus subsp. aureus Mu50
auaaaaugcuaca

SEQ ID NO: 3979186 - RNA, 16 nt, Staphylococcus aureus subsp. aureus Mu50
auaaaaugcuacaauu

SEQ ID NO: 3979187 - RNA, 18 nt, Staphylococcus aureus subsp. aureus Mu50
auaaaaugcuacaauuuc

SEQ ID NO: 3979188 - RNA, 23 nt, Staphylococcus aureus subsp. aureus Mu50
auaaaaugcuacaauuuccuacc

SEQ ID NO: 3979189 - RNA, 17 nt, Staphylococcus aureus subsp. aureus Mu50
auaaaauuagccuaauu

SEQ ID NO: 3979190 - RNA, 19 nt, Staphylococcus aureus subsp. aureus Mu50
auaaaauuuaaaacaauga

SEQ ID NO: 3979191 - RNA, 13 nt, Staphylococcus aureus subsp. aureus Mu50
auaaaauuuugaa

SEQ ID NO: 3979192 - RNA, 12 nt, Staphylococcus aureus subsp. aureus Mu50
auaaacaauaaa

SEQ ID NO: 3979193 - RNA, 15 nt, Staphylococcus aureus subsp. aureus Mu50
auaaacaauaaaaaa

SEQ ID NO: 3979194 - RNA, 13 nt, Staphylococcus aureus subsp. aureus Mu50
auaaacaauaacu

SEQ ID NO: 3979195 - RNA, 23 nt, Staphylococcus aureus subsp. aureus Mu50
auaaaccaaaucggaauaaaaua

SEQ ID NO: 3979196 - RNA, 21 nt, Staphylococcus aureus subsp. aureus Mu50
auaaaccgauuguuucaccag

SEQ ID NO: 3979197 - RNA, 19 nt, Staphylococcus aureus subsp. aureus Mu50
auaaaccuaaugcuuuaau

SEQ ID NO: 3979198 - RNA, 14 nt, Staphylococcus aureus subsp. aureus Mu50
auaaaccuacaaua

SEQ ID NO: 3979199 - RNA, 19 nt, Staphylococcus aureus subsp. aureus Mu50
auaaaccuacaauauagaa

SEQ ID NO: 3979200 - RNA, 17 nt, Staphylococcus aureus subsp. aureus Mu50
auaaacgucacuuuauu

SEQ ID NO: 3979201 - RNA, 12 nt, Staphylococcus aureus subsp. aureus Mu50
auaaacguccaa

SEQ ID NO: 3979202 - RNA, 17 nt, Staphylococcus aureus subsp. aureus Mu50
auaaacguccaaacaca

SEQ ID NO: 3979203 - RNA, 18 nt, Staphylococcus aureus subsp. aureus Mu50
auaaacguccaaacacaa

SEQ ID NO: 3979204 - RNA, 16 nt, Staphylococcus aureus subsp. aureus Mu50
auaaacucaccaaguu

SEQ ID NO: 3979205 - RNA, 21 nt, Staphylococcus aureus subsp. aureus Mu50
auaaacucuaaaagccaucuu

SEQ ID NO: 3979206 - RNA, 15 nt, Staphylococcus aureus subsp. aureus Mu50
auaaacuuuaugaaa

SEQ ID NO: 3979207 - RNA, 15 nt, Staphylococcus aureus subsp. aureus Mu50
auaaagaaauaauuu

SEQ ID NO: 3979208 - RNA, 21 nt, Staphylococcus aureus subsp. aureus Mu50
auaaagacaccuucaauaucu

SEQ ID NO: 3979209 - RNA, 18 nt, Staphylococcus aureus subsp. aureus Mu50
auaaagauagaaugaaua

SEQ ID NO: 3979210 - RNA, 15 nt, Staphylococcus aureus subsp. aureus Mu50
auaaagcuuugacau

SEQ ID NO: 3979211 - RNA, 15 nt, Staphylococcus aureus subsp. aureus Mu50
auaaaggaauagcua

SEQ ID NO: 3979212 - RNA, 21 nt, Staphylococcus aureus subsp. aureus Mu50
auaaaggaauagcuacaauua

SEQ ID NO: 3979213 - RNA, 22 nt, Staphylococcus aureus subsp. aureus Mu50
auaaaguauccagaguuaaagu

SEQ ID NO: 3979214 - RNA, 15 nt, Staphylococcus aureus subsp. aureus Mu50
auaaagucauacuua

SEQ ID NO: 3979215 - RNA, 16 nt, Staphylococcus aureus subsp. aureus Mu50
auaaagucauacuuau

SEQ ID NO: 3979216 - RNA, 15 nt, Staphylococcus aureus subsp. aureus Mu50
auaaaguuuauuuau

SEQ ID NO: 3979217 - RNA, 17 nt, Staphylococcus aureus subsp. aureus Mu50
auaaaguuuguaauauu

SEQ ID NO: 3979218 - RNA, 20 nt, Staphylococcus aureus subsp. aureus Mu50
auaaauaaaaauacauaauu

SEQ ID NO: 3979219 - RNA, 14 nt, Staphylococcus aureus subsp. aureus Mu50
auaaauaaaaugcu

SEQ ID NO: 3979220 - RNA, 12 nt, Staphylococcus aureus subsp. aureus Mu50
auaaauaaaauu

SEQ ID NO: 3979221 - RNA, 13 nt, Staphylococcus aureus subsp. aureus Mu50
auaaauaaaauuu

SEQ ID NO: 3979222 - RNA, 12 nt, Staphylococcus aureus subsp. aureus Mu50
auaaauaaacaa

SEQ ID NO: 3979223 - RNA, 18 nt, Staphylococcus aureus subsp. aureus Mu50
auaaauaaacaacugcaa

SEQ ID NO: 3979224 - RNA, 13 nt, Staphylococcus aureus subsp. aureus Mu50
auaaauaaacuca

SEQ ID NO: 3979225 - RNA, 20 nt, Staphylococcus aureus subsp. aureus Mu50
auaaauaacacgauuugguu

SEQ ID NO: 3979226 - RNA, 22 nt, Staphylococcus aureus subsp. aureus Mu50
auaaauaacuucguuuuaauaa

SEQ ID NO: 3979227 - RNA, 22 nt, Staphylococcus aureus subsp. aureus Mu50
auaaauaacuuuaccaccauuu

SEQ ID NO: 3979228 - RNA, 12 nt, Staphylococcus aureus subsp. aureus Mu50
auaaauaaguua

SEQ ID NO: 3979229 - RNA, 22 nt, Staphylococcus aureus subsp. aureus Mu50
auaaauaauaaguugaauauaa

SEQ ID NO: 3979230 - RNA, 14 nt, Staphylococcus aureus subsp. aureus Mu50
auaaauacaaauau

SEQ ID NO: 3979231 - RNA, 18 nt, Staphylococcus aureus subsp. aureus Mu50
auaaauacaaauauaucu

SEQ ID NO: 3979232 - RNA, 19 nt, Staphylococcus aureus subsp. aureus Mu50
auaaauacaauagaaauga

SEQ ID NO: 3979233 - RNA, 13 nt, Staphylococcus aureus subsp. aureus Mu50
auaaauagauaau

SEQ ID NO: 3979234 - RNA, 17 nt, Staphylococcus aureus subsp. aureus Mu50
auaaauagauaauauau

SEQ ID NO: 3979235 - RNA, 12 nt, Staphylococcus aureus subsp. aureus Mu50
auaaauauaaaa

SEQ ID NO: 3979236 - RNA, 14 nt, Staphylococcus aureus subsp. aureus Mu50
auaaauauaaaaua

SEQ ID NO: 3979237 - RNA, 17 nt, Staphylococcus aureus subsp. aureus Mu50
auaaauaucaauaauuc

SEQ ID NO: 3979238 - RNA, 22 nt, Staphylococcus aureus subsp. aureus Mu50
auaaauaucaauuguugcaaaa

SEQ ID NO: 3979239 - RNA, 21 nt, Staphylococcus aureus subsp. aureus Mu50
auaaauaugauguuaaaaaau

SEQ ID NO: 3979240 - RNA, 12 nt, Staphylococcus aureus subsp. aureus Mu50
auaaauauuaaa

SEQ ID NO: 3979241 - RNA, 16 nt, Staphylococcus aureus subsp. aureus Mu50
auaaauauuaaauuca

SEQ ID NO: 3979242 - RNA, 15 nt, Staphylococcus aureus subsp. aureus Mu50
auaaauauuaagcgu

SEQ ID NO: 3979243 - RNA, 17 nt, Staphylococcus aureus subsp. aureus Mu50
auaaauauugaacaauu

SEQ ID NO: 3979244 - RNA, 19 nt, Staphylococcus aureus subsp. aureus Mu50
auaaauauugaacaauuuu

SEQ ID NO: 3979245 - RNA, 13 nt, Staphylococcus aureus subsp. aureus Mu50
auaaauauuggaa

SEQ ID NO: 3979246 - RNA, 14 nt, Staphylococcus aureus subsp. aureus Mu50
auaaauauuuuuaa

SEQ ID NO: 3979247 - RNA, 15 nt, Staphylococcus aureus subsp. aureus Mu50
auaaauauuuuuaau

SEQ ID NO: 3979248 - RNA, 14 nt, Staphylococcus aureus subsp. aureus Mu50
auaaaucaaacuuu

SEQ ID NO: 3979249 - RNA, 16 nt, Staphylococcus aureus subsp. aureus Mu50
auaaaucaagaaaugu

SEQ ID NO: 3979250 - RNA, 17 nt, Staphylococcus aureus subsp. aureus Mu50
auaaaucaagaaauguu

SEQ ID NO: 3979251 - RNA, 20 nt, Staphylococcus aureus subsp. aureus Mu50
auaaaucaagaaauguuaaa

SEQ ID NO: 3979252 - RNA, 16 nt, Staphylococcus aureus subsp. aureus Mu50
auaaaucacgccauaa

SEQ ID NO: 3979253 - RNA, 19 nt, Staphylococcus aureus subsp. aureus Mu50
auaaaucauacgagaaauu

SEQ ID NO: 3979254 - RNA, 14 nt, Staphylococcus aureus subsp. aureus Mu50
auaaaucaucauuc

SEQ ID NO: 3979255 - RNA, 21 nt, Staphylococcus aureus subsp. aureus Mu50
auaaaucaucauucucaaagg

SEQ ID NO: 3979256 - RNA, 13 nt, Staphylococcus aureus subsp. aureus Mu50
auaaccuuuaaaa

SEQ ID NO: 3979257 - RNA, 19 nt, Staphylococcus aureus subsp. aureus Mu50
auaaccuuuaaaacaucau

SEQ ID NO: 3979258 - RNA, 20 nt, Staphylococcus aureus subsp. aureus Mu50
auaaccuuuaaaacaucauu

SEQ ID NO: 3979259 - RNA, 22 nt, Staphylococcus aureus subsp. aureus Mu50
auaaccuuuaaaacaucauuca

SEQ ID NO: 3979260 - RNA, 23 nt, Staphylococcus aureus subsp. aureus Mu50
auaacgagcaguauauaucaaau

SEQ ID NO: 3979261 - RNA, 19 nt, Staphylococcus aureus subsp. aureus Mu50
auaacguuaauauaauuaa

SEQ ID NO: 3979262 - RNA, 14 nt, Staphylococcus aureus subsp. aureus Mu50
auaacguucacuug

SEQ ID NO: 3979263 - RNA, 13 nt, Staphylococcus aureus subsp. aureus Mu50
auaacuacacuua

SEQ ID NO: 3979264 - RNA, 15 nt, Staphylococcus aureus subsp. aureus Mu50
auaacucaaauaucu

SEQ ID NO: 3979265 - RNA, 14 nt, Staphylococcus aureus subsp. aureus Mu50
auaacuccuccaaa

SEQ ID NO: 3979266 - RNA, 17 nt, Staphylococcus aureus subsp. aureus Mu50
auaacuccuccaaagcu

SEQ ID NO: 3979267 - RNA, 15 nt, Staphylococcus aureus subsp. aureus Mu50
auaacucuaaauaua

SEQ ID NO: 3979268 - RNA, 16 nt, Staphylococcus aureus subsp. aureus Mu50
auaacucuaaauauaa

SEQ ID NO: 3979269 - RNA, 15 nt, Staphylococcus aureus subsp. aureus Mu50
auaacugauaauacu

SEQ ID NO: 3979270 - RNA, 20 nt, Staphylococcus aureus subsp. aureus Mu50
auaacugcauguacaucuuu

SEQ ID NO: 3979271 - RNA, 13 nt, Staphylococcus aureus subsp. aureus Mu50
auaacuguaaaac

SEQ ID NO: 3979272 - RNA, 15 nt, Staphylococcus aureus subsp. aureus Mu50
auaacuguaaaacau

SEQ ID NO: 3979273 - RNA, 22 nt, Staphylococcus aureus subsp. aureus Mu50
auaacuguauaccucuuagcac

SEQ ID NO: 3979274 - RNA, 23 nt, Staphylococcus aureus subsp. aureus Mu50
auaacuguucuuucgucuuguaa

SEQ ID NO: 3979275 - RNA, 18 nt, Staphylococcus aureus subsp. aureus Mu50
auaacuuuaccaccauuu

SEQ ID NO: 3979276 - RNA, 15 nt, Staphylococcus aureus subsp. aureus Mu50
auaacuuuauauaua

SEQ ID NO: 3979277 - RNA, 19 nt, Staphylococcus aureus subsp. aureus Mu50
auaacuuuauauauaaaga

SEQ ID NO: 3979278 - RNA, 15 nt, Staphylococcus aureus subsp. aureus Mu50
auaagaaaauaccua

SEQ ID NO: 3979279 - RNA, 11 nt, Staphylococcus aureus subsp. aureus Mu50
auaagaaucag

SEQ ID NO: 3979280 - RNA, 17 nt, Staphylococcus aureus subsp. aureus Mu50
auaagaaucaucuaaau

SEQ ID NO: 3979281 - RNA, 15 nt, Staphylococcus aureus subsp. aureus Mu50
auaagaauuguugau

SEQ ID NO: 3979282 - RNA, 17 nt, Staphylococcus aureus subsp. aureus Mu50
auaagaauuuaaaagag

SEQ ID NO: 3979283 - RNA, 18 nt, Staphylococcus aureus subsp. aureus Mu50
auaagaauuuaaaagaga

SEQ ID NO: 3979284 - RNA, 13 nt, Staphylococcus aureus subsp. aureus Mu50
auaagacaauagu

SEQ ID NO: 3979285 - RNA, 22 nt, Staphylococcus aureus subsp. aureus Mu50
auaagagaacuuuucaaacaau

SEQ ID NO: 3979286 - RNA, 15 nt, Staphylococcus aureus subsp. aureus Mu50
auaagaugaaauauu

SEQ ID NO: 3979287 - RNA, 19 nt, Staphylococcus aureus subsp. aureus Mu50
auaagauuuugaauuuuau

SEQ ID NO: 3979288 - RNA, 13 nt, Staphylococcus aureus subsp. aureus Mu50
auaagcaaaaauu

SEQ ID NO: 3979289 - RNA, 18 nt, Staphylococcus aureus subsp. aureus Mu50
auaagcacgauaaaaaua

SEQ ID NO: 3979290 - RNA, 16 nt, Staphylococcus aureus subsp. aureus Mu50
auaagcgcaauuaaaa

SEQ ID NO: 3979291 - RNA, 23 nt, Staphylococcus aureus subsp. aureus Mu50
auaagcuacuaagcguuuaauca

SEQ ID NO: 3979292 - RNA, 12 nt, Staphylococcus aureus subsp. aureus Mu50
auaagcugaaaa

SEQ ID NO: 3979293 - RNA, 14 nt, Staphylococcus aureus subsp. aureus Mu50
auaaggacucuguu

SEQ ID NO: 3979294 - RNA, 15 nt, Staphylococcus aureus subsp. aureus Mu50
auaaggauaucugaa

SEQ ID NO: 3979295 - RNA, 21 nt, Staphylococcus aureus subsp. aureus Mu50
auaagggguauauuaaaaauu

SEQ ID NO: 3979296 - RNA, 14 nt, Staphylococcus aureus subsp. aureus Mu50
auaaguaauaauuu

SEQ ID NO: 3979297 - RNA, 17 nt, Staphylococcus aureus subsp. aureus Mu50
auaaguaauaauuuauu

SEQ ID NO: 3979298 - RNA, 16 nt, Staphylococcus aureus subsp. aureus Mu50
auaaguaaucauaaua

SEQ ID NO: 3979299 - RNA, 15 nt, Staphylococcus aureus subsp. aureus Mu50
auaaguacaaauaau

SEQ ID NO: 3979300 - RNA, 16 nt, Staphylococcus aureus subsp. aureus Mu50
auaaguagaaaauaug

SEQ ID NO: 3979301 - RNA, 22 nt, Staphylococcus aureus subsp. aureus Mu50
auaaguagcucaaaacaauuua

SEQ ID NO: 3979302 - RNA, 19 nt, Staphylococcus aureus subsp. aureus Mu50
auaaguagugauuuuuuac

SEQ ID NO: 3979303 - RNA, 19 nt, Staphylococcus aureus subsp. aureus Mu50
auaaguaguucagcaaguu

SEQ ID NO: 3979304 - RNA, 17 nt, Staphylococcus aureus subsp. aureus Mu50
auaagucacauuuauaa

SEQ ID NO: 3979305 - RNA, 24 nt, Staphylococcus aureus subsp. aureus Mu50
auaagucugaugucgaaaauagcu

SEQ ID NO: 3979306 - RNA, 18 nt, Staphylococcus aureus subsp. aureus Mu50
auaagucuuaacaaauua

SEQ ID NO: 3979307 - RNA, 13 nt, Staphylococcus aureus subsp. aureus Mu50
auaagugauguga

SEQ ID NO: 3979308 - RNA, 22 nt, Staphylococcus aureus subsp. aureus Mu50
auaagugauuucuucauuauca

SEQ ID NO: 3979309 - RNA, 17 nt, Staphylococcus aureus subsp. aureus Mu50
auaaguggauuuucucc

SEQ ID NO: 3979310 - RNA, 21 nt, Staphylococcus aureus subsp. aureus Mu50
auaagugguuguucccauuuu

SEQ ID NO: 3979311 - RNA, 17 nt, Staphylococcus aureus subsp. aureus Mu50
auaaguuaaaaauguaa

SEQ ID NO: 3979312 - RNA, 12 nt, Staphylococcus aureus subsp. aureus Mu50
auaaguuaaagu

SEQ ID NO: 3979313 - RNA, 17 nt, Staphylococcus aureus subsp. aureus Mu50
auaaguuacuagcauua

SEQ ID NO: 3979314 - RNA, 15 nt, Staphylococcus aureus subsp. aureus Mu50
auaaguucuagauua

SEQ ID NO: 3979315 - RNA, 21 nt, Staphylococcus aureus subsp. aureus Mu50
auaaguucuagauuauuuaaa

SEQ ID NO: 3979316 - RNA, 16 nt, Staphylococcus aureus subsp. aureus Mu50
auaaguugaauauaaa

SEQ ID NO: 3979317 - RNA, 17 nt, Staphylococcus aureus subsp. aureus Mu50
auaaguugaauauaaaa

SEQ ID NO: 3979318 - RNA, 14 nt, Staphylococcus aureus subsp. aureus Mu50
auaauaaaaaggag

SEQ ID NO: 3979319 - RNA, 17 nt, Staphylococcus aureus subsp. aureus Mu50
auaauaaaacuugugau

SEQ ID NO: 3979320 - RNA, 20 nt, Staphylococcus aureus subsp. aureus Mu50
auaauaaaacuugugauaua

SEQ ID NO: 3979321 - RNA, 14 nt, Staphylococcus aureus subsp. aureus Mu50
auaauaaaccuaaa

SEQ ID NO: 3979322 - RNA, 18 nt, Staphylococcus aureus subsp. aureus Mu50
auaauaaagauuauaucu

SEQ ID NO: 3979323 - RNA, 11 nt, Staphylococcus aureus subsp. aureus Mu50
auaauaaauag

SEQ ID NO: 3979324 - RNA, 23 nt, Staphylococcus aureus subsp. aureus Mu50
auaauaaauagacugccaauaaa

SEQ ID NO: 3979325 - RNA, 12 nt, Staphylococcus aureus subsp. aureus Mu50
auaauaaaucac

SEQ ID NO: 3979326 - RNA, 13 nt, Staphylococcus aureus subsp. aureus Mu50
auaauaaaucacg

SEQ ID NO: 3979327 - RNA, 15 nt, Staphylococcus aureus subsp. aureus Mu50
auaauaaaucgaauu

SEQ ID NO: 3979328 - RNA, 18 nt, Staphylococcus aureus subsp. aureus Mu50
auaauaaaugcuauauuu

SEQ ID NO: 3979329 - RNA, 21 nt, Staphylococcus aureus subsp. aureus Mu50
auaauaacuagaacaagaauu

SEQ ID NO: 3979330 - RNA, 20 nt, Staphylococcus aureus subsp. aureus Mu50
auaauaagagguauagcaag

SEQ ID NO: 3979331 - RNA, 14 nt, Staphylococcus aureus subsp. aureus Mu50
auaauaagauuuuu

SEQ ID NO: 3979332 - RNA, 18 nt, Staphylococcus aureus subsp. aureus Mu50
auaauaaguugaauauaa

SEQ ID NO: 3979333 - RNA, 19 nt, Staphylococcus aureus subsp. aureus Mu50
auaauaaucggacugaugg

SEQ ID NO: 3979334 - RNA, 20 nt, Staphylococcus aureus subsp. aureus Mu50
auaauaauucauaaaugcuu

SEQ ID NO: 3979335 - RNA, 17 nt, Staphylococcus aureus subsp. aureus Mu50
auaauacacgaucaguu

SEQ ID NO: 3979336 - RNA, 14 nt, Staphylococcus aureus subsp. aureus Mu50
auaauaccaauugc

SEQ ID NO: 3979337 - RNA, 17 nt, Staphylococcus aureus subsp. aureus Mu50
auaauaccaauugcuuc

SEQ ID NO: 3979338 - RNA, 20 nt, Staphylococcus aureus subsp. aureus Mu50
auaauaccuaauugcuuaau

SEQ ID NO: 3979339 - RNA, 19 nt, Staphylococcus aureus subsp. aureus Mu50
auaauaccuucaauugaca

SEQ ID NO: 3979340 - RNA, 17 nt, Staphylococcus aureus subsp. aureus Mu50
auaauacgcuugauaaa

SEQ ID NO: 3979341 - RNA, 19 nt, Staphylococcus aureus subsp. aureus Mu50
auaauacgcuugauaaaag

SEQ ID NO: 3979342 - RNA, 18 nt, Staphylococcus aureus subsp. aureus Mu50
auaauacgucguaaugaa

SEQ ID NO: 3979343 - RNA, 22 nt, Staphylococcus aureus subsp. aureus Mu50
auaauacgucguaaugaagauu

SEQ ID NO: 3979344 - RNA, 15 nt, Staphylococcus aureus subsp. aureus Mu50
auaauuaaauaacuu

SEQ ID NO: 3979345 - RNA, 23 nt, Staphylococcus aureus subsp. aureus Mu50
auaauuaacugcggcaugcgauu

SEQ ID NO: 3979346 - RNA, 17 nt, Staphylococcus aureus subsp. aureus Mu50
auaauuaacuuacuuuu

SEQ ID NO: 3979347 - RNA, 21 nt, Staphylococcus aureus subsp. aureus Mu50
auaauuaacuuacuuuuguaa

SEQ ID NO: 3979348 - RNA, 23 nt, Staphylococcus aureus subsp. aureus Mu50
auaauuaacuuacuuuuguaaaa

SEQ ID NO: 3979349 - RNA, 14 nt, Staphylococcus aureus subsp. aureus Mu50
auaauuaauaacau

SEQ ID NO: 3979350 - RNA, 11 nt, Staphylococcus aureus subsp. aureus Mu50
auaauuaaugu

SEQ ID NO: 3979351 - RNA, 21 nt, Staphylococcus aureus subsp. aureus Mu50
auaauuacuaaccuaaagaua

SEQ ID NO: 3979352 - RNA, 15 nt, Staphylococcus aureus subsp. aureus Mu50
auaauuagauuuaaa

SEQ ID NO: 3979353 - RNA, 16 nt, Staphylococcus aureus subsp. aureus Mu50
auaauuagauuuaaaa

SEQ ID NO: 3979354 - RNA, 12 nt, Staphylococcus aureus subsp. aureus Mu50
auaauuagucau

SEQ ID NO: 3979355 - RNA, 13 nt, Staphylococcus aureus subsp. aureus Mu50
auaauuaugaaaa

SEQ ID NO: 3979356 - RNA, 17 nt, Staphylococcus aureus subsp. aureus Mu50
auaauuauuaaacuuug

SEQ ID NO: 3979357 - RNA, 15 nt, Staphylococcus aureus subsp. aureus Mu50
auaauucaaugcuau

SEQ ID NO: 3979358 - RNA, 15 nt, Staphylococcus aureus subsp. aureus Mu50
auaauucagaugaau

SEQ ID NO: 3979359 - RNA, 14 nt, Staphylococcus aureus subsp. aureus Mu50
auaauucauaaaug

SEQ ID NO: 3979360 - RNA, 23 nt, Staphylococcus aureus subsp. aureus Mu50
auaauucaucaaguugauaaugu

SEQ ID NO: 3979361 - RNA, 19 nt, Staphylococcus aureus subsp. aureus Mu50
auaauucgucuguuucaua

SEQ ID NO: 3979362 - RNA, 20 nt, Staphylococcus aureus subsp. aureus Mu50
auaauugauggcuucucuua

SEQ ID NO: 3979363 - RNA, 20 nt, Staphylococcus aureus subsp. aureus Mu50
auaauugcauagcuaaauaa

SEQ ID NO: 3979364 - RNA, 22 nt, Staphylococcus aureus subsp. aureus Mu50
auaauugcauagcuaaauaaau

SEQ ID NO: 3979365 - RNA, 15 nt, Staphylococcus aureus subsp. aureus Mu50
auaauugcuaaaaua

SEQ ID NO: 3979366 - RNA, 17 nt, Staphylococcus aureus subsp. aureus Mu50
auaauuggcagauagaa

SEQ ID NO: 3979367 - RNA, 19 nt, Staphylococcus aureus subsp. aureus Mu50
auaauuggcugaugaacuu

SEQ ID NO: 3979368 - RNA, 19 nt, Staphylococcus aureus subsp. aureus Mu50
auaauuguccaugccuuau

SEQ ID NO: 3979369 - RNA, 12 nt, Staphylococcus aureus subsp. aureus Mu50
auaauuguucau

SEQ ID NO: 3979370 - RNA, 12 nt, Staphylococcus aureus subsp. aureus Mu50
auaauuuaaaag

SEQ ID NO: 3979371 - RNA, 13 nt, Staphylococcus aureus subsp. aureus Mu50
auaauuuaaaaga

SEQ ID NO: 3979372 - RNA, 19 nt, Staphylococcus aureus subsp. aureus Mu50
auaauuuaaagaacuauuu

SEQ ID NO: 3979373 - RNA, 23 nt, Staphylococcus aureus subsp. aureus Mu50
auaauuuaaagaacuauuuuaaa

SEQ ID NO: 3979374 - RNA, 18 nt, Staphylococcus aureus subsp. aureus Mu50
auaauuuaauaacguaca

SEQ ID NO: 3979375 - RNA, 23 nt, Staphylococcus aureus subsp. aureus Mu50
auaauuuaauaacguacauuuau

SEQ ID NO: 3979376 - RNA, 15 nt, Staphylococcus aureus subsp. aureus Mu50
auaauuuacauuaau

SEQ ID NO: 3979377 - RNA, 14 nt, Staphylococcus aureus subsp. aureus Mu50
auaauuuauaaaaa

SEQ ID NO: 3979378 - RNA, 20 nt, Staphylococcus aureus subsp. aureus Mu50
auaauuuaucugcaaaaugc

SEQ ID NO: 3979379 - RNA, 17 nt, Staphylococcus aureus subsp. aureus Mu50
auaauuucaguucuuag

SEQ ID NO: 3979380 - RNA, 21 nt, Staphylococcus aureus subsp. aureus Mu50
auaauuucaguucuuagauuu

SEQ ID NO: 3979381 - RNA, 14 nt, Staphylococcus aureus subsp. aureus Mu50
auaauuuccuaaaa

SEQ ID NO: 3979382 - RNA, 16 nt, Staphylococcus aureus subsp. aureus Mu50
auaauuucuucuucug

SEQ ID NO: 3979383 - RNA, 17 nt, Staphylococcus aureus subsp. aureus Mu50
auaauuugagaaaugaa

SEQ ID NO: 3979384 - RNA, 19 nt, Staphylococcus aureus subsp. aureus Mu50
auaauuugagaaaugaaac

SEQ ID NO: 3979385 - RNA, 16 nt, Staphylococcus aureus subsp. aureus Mu50
auaauuuguaauuccu

SEQ ID NO: 3979386 - RNA, 12 nt, Staphylococcus aureus subsp. aureus Mu50
auaauuuuaaaa

SEQ ID NO: 3979387 - RNA, 14 nt, Staphylococcus aureus subsp. aureus Mu50
auaauuuuaaaaau

SEQ ID NO: 3979388 - RNA, 15 nt, Staphylococcus aureus subsp. aureus Mu50
auaauuuuaaaaaua

SEQ ID NO: 3979389 - RNA, 11 nt, Staphylococcus aureus subsp. aureus Mu50
auaauuuuaau

SEQ ID NO: 3979390 - RNA, 15 nt, Staphylococcus aureus subsp. aureus Mu50
auaauuuuaauauua

SEQ ID NO: 3979391 - RNA, 20 nt, Staphylococcus aureus subsp. aureus Mu50
auaauuuuaucuaaagcuau

SEQ ID NO: 3979392 - RNA, 14 nt, Staphylococcus aureus subsp. aureus Mu50
auaauuuuggauuu

SEQ ID NO: 3979393 - RNA, 17 nt, Staphylococcus aureus subsp. aureus Mu50
auaauuuuguuucacua

SEQ ID NO: 3979394 - RNA, 22 nt, Staphylococcus aureus subsp. aureus Mu50
auaauuuuguuuugcuucuuua

SEQ ID NO: 3979395 - RNA, 21 nt, Staphylococcus aureus subsp. aureus Mu50
auaauuuuucuucuuuuuuau

SEQ ID NO: 3979396 - RNA, 23 nt, Staphylococcus aureus subsp. aureus Mu50
auaauuuuugaguaauuuaauca

SEQ ID NO: 3979397 - RNA, 22 nt, Staphylococcus aureus subsp. aureus Mu50
auacaaaacaccucgauauuau

SEQ ID NO: 3979398 - RNA, 19 nt, Staphylococcus aureus subsp. aureus Mu50
auacaaacccauauaaaug

SEQ ID NO: 3979399 - RNA, 19 nt, Staphylococcus aureus subsp. aureus Mu50
auacaaacccuuuaaacau

SEQ ID NO: 3979400 - RNA, 15 nt, Staphylococcus aureus subsp. aureus Mu50
auacaaagaauuaug

SEQ ID NO: 3979401 - RNA, 12 nt, Staphylococcus aureus subsp. aureus Mu50
auacaaaggauu

SEQ ID NO: 3979402 - RNA, 18 nt, Staphylococcus aureus subsp. aureus Mu50
auacaaaucguaaacaua

SEQ ID NO: 3979403 - RNA, 17 nt, Staphylococcus aureus subsp. aureus Mu50
auacaaauuauaaauuu

SEQ ID NO: 3979404 - RNA, 20 nt, Staphylococcus aureus subsp. aureus Mu50
auacaaauuauaaauuuggu

SEQ ID NO: 3979405 - RNA, 12 nt, Staphylococcus aureus subsp. aureus Mu50
auacaaauugau

SEQ ID NO: 3979406 - RNA, 13 nt, Staphylococcus aureus subsp. aureus Mu50
auacaaauuuuuu

SEQ ID NO: 3979407 - RNA, 17 nt, Staphylococcus aureus subsp. aureus Mu50
auacaacaguaaucaug

SEQ ID NO: 3979408 - RNA, 22 nt, Staphylococcus aureus subsp. aureus Mu50
auacaacgacacgaacaacauu

SEQ ID NO: 3979409 - RNA, 16 nt, Staphylococcus aureus subsp. aureus Mu50
auacaacuucacuucu

SEQ ID NO: 3979410 - RNA, 15 nt, Staphylococcus aureus subsp. aureus Mu50
auacaauagaaauga

SEQ ID NO: 3979411 - RNA, 11 nt, Staphylococcus aureus subsp. aureus Mu50
auacaaugaau

SEQ ID NO: 3979412 - RNA, 21 nt, Staphylococcus aureus subsp. aureus Mu50
auacaaugaauuucuaauuua

SEQ ID NO: 3979413 - RNA, 18 nt, Staphylococcus aureus subsp. aureus Mu50
auacaaugauuacuuuaa

SEQ ID NO: 3979414 - RNA, 22 nt, Staphylococcus aureus subsp. aureus Mu50
auacaauuauggauaaaauuua

SEQ ID NO: 3979415 - RNA, 13 nt, Staphylococcus aureus subsp. aureus Mu50
auacaauuuuacc

SEQ ID NO: 3979416 - RNA, 13 nt, Staphylococcus aureus subsp. aureus Mu50
auacacaaauuuu

SEQ ID NO: 3979417 - RNA, 15 nt, Staphylococcus aureus subsp. aureus Mu50
auacaccuuuacuca

SEQ ID NO: 3979418 - RNA, 22 nt, Staphylococcus aureus subsp. aureus Mu50
auacacuaucauuaucaaauaa

SEQ ID NO: 3979419 - RNA, 23 nt, Staphylococcus aureus subsp. aureus Mu50
auacacuaucauuaucaaauaac

SEQ ID NO: 3979420 - RNA, 17 nt, Staphylococcus aureus subsp. aureus Mu50
auacacugcacaucaua

SEQ ID NO: 3979421 - RNA, 16 nt, Staphylococcus aureus subsp. aureus Mu50
auacacuuacaaauau

SEQ ID NO: 3979422 - RNA, 23 nt, Staphylococcus aureus subsp. aureus Mu50
auacacuuuuugacauauuuuuu

SEQ ID NO: 3979423 - RNA, 19 nt, Staphylococcus aureus subsp. aureus Mu50
auacagaaccaacaauaaa

SEQ ID NO: 3979424 - RNA, 20 nt, Staphylococcus aureus subsp. aureus Mu50
auacagaacuuuaauaauga

SEQ ID NO: 3979425 - RNA, 21 nt, Staphylococcus aureus subsp. aureus Mu50
auacagaucucaauccaauua

SEQ ID NO: 3979426 - RNA, 15 nt, Staphylococcus aureus subsp. aureus Mu50
auacaggaaauugaa

SEQ ID NO: 3979427 - RNA, 20 nt, Staphylococcus aureus subsp. aureus Mu50
auacaggaaauugaagcguu

SEQ ID NO: 3979428 - RNA, 18 nt, Staphylococcus aureus subsp. aureus Mu50
auacaguuguuauuuuug

SEQ ID NO: 3979429 - RNA, 19 nt, Staphylococcus aureus subsp. aureus Mu50
auacaguuguuauuuuugc

SEQ ID NO: 3979430 - RNA, 13 nt, Staphylococcus aureus subsp. aureus Mu50
auacauaaucauu

SEQ ID NO: 3979431 - RNA, 13 nt, Staphylococcus aureus subsp. aureus Mu50
auacauacugauu

SEQ ID NO: 3979432 - RNA, 21 nt, Staphylococcus aureus subsp. aureus Mu50
auacuaacugaagacaccuua

SEQ ID NO: 3979433 - RNA, 23 nt, Staphylococcus aureus subsp. aureus Mu50
auacuaagcgcucauaaacgauu

SEQ ID NO: 3979434 - RNA, 18 nt, Staphylococcus aureus subsp. aureus Mu50
auacuaauaucuucuuua

SEQ ID NO: 3979435 - RNA, 15 nt, Staphylococcus aureus subsp. aureus Mu50
auacuaaucaaagaa

SEQ ID NO: 3979436 - RNA, 19 nt, Staphylococcus aureus subsp. aureus Mu50
auacuaaucaaagaaaaag

SEQ ID NO: 3979437 - RNA, 23 nt, Staphylococcus aureus subsp. aureus Mu50
auacuaaucuucaacuucgauau

SEQ ID NO: 3979438 - RNA, 16 nt, Staphylococcus aureus subsp. aureus Mu50
auacuaccguuuuuau

SEQ ID NO: 3979439 - RNA, 20 nt, Staphylococcus aureus subsp. aureus Mu50
auacuaccuuccauuucgaa

SEQ ID NO: 3979440 - RNA, 17 nt, Staphylococcus aureus subsp. aureus Mu50
auacuacuguugacauu

SEQ ID NO: 3979441 - RNA, 19 nt, Staphylococcus aureus subsp. aureus Mu50
auacuacuuguuuguuuuu

SEQ ID NO: 3979442 - RNA, 22 nt, Staphylococcus aureus subsp. aureus Mu50
auacuauaaauacaaauauauc

SEQ ID NO: 3979443 - RNA, 13 nt, Staphylococcus aureus subsp. aureus Mu50
auacuauaagcaa

SEQ ID NO: 3979444 - RNA, 14 nt, Staphylococcus aureus subsp. aureus Mu50
auacuauacugaug

SEQ ID NO: 3979445 - RNA, 16 nt, Staphylococcus aureus subsp. aureus Mu50
auacuauaugaaaaga

SEQ ID NO: 3979446 - RNA, 22 nt, Staphylococcus aureus subsp. aureus Mu50
auacuauaugucuuaucaauua

SEQ ID NO: 3979447 - RNA, 22 nt, Staphylococcus aureus subsp. aureus Mu50
auacuaucuacaauaaccauuu

SEQ ID NO: 3979448 - RNA, 22 nt, Staphylococcus aureus subsp. aureus Mu50
auacucaacacgauagucauaa

SEQ ID NO: 3979449 - RNA, 13 nt, Staphylococcus aureus subsp. aureus Mu50
auacucaauaaaa

SEQ ID NO: 3979450 - RNA, 16 nt, Staphylococcus aureus subsp. aureus Mu50
auacucaauaaaauug

SEQ ID NO: 3979451 - RNA, 17 nt, Staphylococcus aureus subsp. aureus Mu50
auacuccuuucauacau

SEQ ID NO: 3979452 - RNA, 16 nt, Staphylococcus aureus subsp. aureus Mu50
auacucuaacuuacca

SEQ ID NO: 3979453 - RNA, 18 nt, Staphylococcus aureus subsp. aureus Mu50
auacucugggcauuuuga

SEQ ID NO: 3979454 - RNA, 21 nt, Staphylococcus aureus subsp. aureus Mu50
auacucuucaaucuaccaaua

SEQ ID NO: 3979455 - RNA, 14 nt, Staphylococcus aureus subsp. aureus Mu50
auacugauauuuag

SEQ ID NO: 3979456 - RNA, 19 nt, Staphylococcus aureus subsp. aureus Mu50
auacugccauauguuuuag

SEQ ID NO: 3979457 - RNA, 18 nt, Staphylococcus aureus subsp. aureus Mu50
auacugccccaaauguaa

SEQ ID NO: 3979458 - RNA, 19 nt, Staphylococcus aureus subsp. aureus Mu50
auacugcucuuuauauaua

SEQ ID NO: 3979459 - RNA, 22 nt, Staphylococcus aureus subsp. aureus Mu50
auacugcucuuuauauauaaaa

SEQ ID NO: 3979460 - RNA, 14 nt, Staphylococcus aureus subsp. aureus Mu50
auacuguauuuaua

SEQ ID NO: 3979461 - RNA, 15 nt, Staphylococcus aureus subsp. aureus Mu50
auacugucaucuuuc

SEQ ID NO: 3979462 - RNA, 19 nt, Staphylococcus aureus subsp. aureus Mu50
auacuguuuaaauaaaauu

SEQ ID NO: 3979463 - RNA, 15 nt, Staphylococcus aureus subsp. aureus Mu50
auacuuaaagauuua

SEQ ID NO: 3979464 - RNA, 14 nt, Staphylococcus aureus subsp. aureus Mu50
auacuuaauuuaaa

SEQ ID NO: 3979465 - RNA, 18 nt, Staphylococcus aureus subsp. aureus Mu50
auacuucaccacauaaaa

SEQ ID NO: 3979466 - RNA, 20 nt, Staphylococcus aureus subsp. aureus Mu50
auacuucaccacauaaaaau

SEQ ID NO: 3979467 - RNA, 16 nt, Staphylococcus aureus subsp. aureus Mu50
auacuucaccaucuuu

SEQ ID NO: 3979468 - RNA, 17 nt, Staphylococcus aureus subsp. aureus Mu50
auacuucaccaucuuua

SEQ ID NO: 3979469 - RNA, 13 nt, Staphylococcus aureus subsp. aureus Mu50
auacuucuauuuu

SEQ ID NO: 3979470 - RNA, 17 nt, Staphylococcus aureus subsp. aureus Mu50
auacuucuauuuuauaa

SEQ ID NO: 3979471 - RNA, 19 nt, Staphylococcus aureus subsp. aureus Mu50
auacuucuauuuuauaaua

SEQ ID NO: 3979472 - RNA, 21 nt, Staphylococcus aureus subsp. aureus Mu50
auacuugaagcaucgauuuau

SEQ ID NO: 3979473 - RNA, 16 nt, Staphylococcus aureus subsp. aureus Mu50
auacuugaauuuaaua

SEQ ID NO: 3979474 - RNA, 16 nt, Staphylococcus aureus subsp. aureus Mu50
auacuugaugaaacug

SEQ ID NO: 3979475 - RNA, 21 nt, Staphylococcus aureus subsp. aureus Mu50
auacuugcucuaauucaauga

SEQ ID NO: 3979476 - RNA, 14 nt, Staphylococcus aureus subsp. aureus Mu50
auacuuucaaacaa

SEQ ID NO: 3979477 - RNA, 16 nt, Staphylococcus aureus subsp. aureus Mu50
auacuuucaaacaaau

SEQ ID NO: 3979478 - RNA, 21 nt, Staphylococcus aureus subsp. aureus Mu50
auacuuucacuuuuuauauca

SEQ ID NO: 3979479 - RNA, 18 nt, Staphylococcus aureus subsp. aureus Mu50
auacuuucuaagauacgu

SEQ ID NO: 3979480 - RNA, 14 nt, Staphylococcus aureus subsp. aureus Mu50
auacuuugaaagaa

SEQ ID NO: 3979481 - RNA, 22 nt, Staphylococcus aureus subsp. aureus Mu50
auacuuuuaccauugugaauaa

SEQ ID NO: 3979482 - RNA, 20 nt, Staphylococcus aureus subsp. aureus Mu50
auacuuuuauagaaaauuaa

SEQ ID NO: 3979483 - RNA, 21 nt, Staphylococcus aureus subsp. aureus Mu50
auacuuuuucagaaugaacuu

SEQ ID NO: 3979484 - RNA, 16 nt, Staphylococcus aureus subsp. aureus Mu50
auacuuuuugaugauu

SEQ ID NO: 3979485 - RNA, 13 nt, Staphylococcus aureus subsp. aureus Mu50
auagaaaaauuuc

SEQ ID NO: 3979486 - RNA, 16 nt, Staphylococcus aureus subsp. aureus Mu50
auagaaaaauuucaaa

SEQ ID NO: 3979487 - RNA, 18 nt, Staphylococcus aureus subsp. aureus Mu50
auagaaaaauuucaaaaa

SEQ ID NO: 3979488 - RNA, 19 nt, Staphylococcus aureus subsp. aureus Mu50
auagaaaaauuucaaaaau

SEQ ID NO: 3979489 - RNA, 20 nt, Staphylococcus aureus subsp. aureus Mu50
auagaaaagggacagaaaag

SEQ ID NO: 3979490 - RNA, 20 nt, Staphylococcus aureus subsp. aureus Mu50
auagaaaaugaguacaacau

SEQ ID NO: 3979491 - RNA, 14 nt, Staphylococcus aureus subsp. aureus Mu50
auagaaaauuaacu

SEQ ID NO: 3979492 - RNA, 15 nt, Staphylococcus aureus subsp. aureus Mu50
auagaaagaaauugu

SEQ ID NO: 3979493 - RNA, 15 nt, Staphylococcus aureus subsp. aureus Mu50
auagaaauaaucaca

SEQ ID NO: 3979494 - RNA, 18 nt, Staphylococcus aureus subsp. aureus Mu50
auagaaaugacgauaccu

SEQ ID NO: 3979495 - RNA, 19 nt, Staphylococcus aureus subsp. aureus Mu50
auagaaaugacgauaccuu

SEQ ID NO: 3979496 - RNA, 14 nt, Staphylococcus aureus subsp. aureus Mu50
auagaacaaaaugu

SEQ ID NO: 3979497 - RNA, 23 nt, Staphylococcus aureus subsp. aureus Mu50
auagaaccuauuuuuuauaugau

SEQ ID NO: 3979498 - RNA, 12 nt, Staphylococcus aureus subsp. aureus Mu50
auagaaggggac

SEQ ID NO: 3979499 - RNA, 14 nt, Staphylococcus aureus subsp. aureus Mu50
auagaaguuuuuug

SEQ ID NO: 3979500 - RNA, 18 nt, Staphylococcus aureus subsp. aureus Mu50
auagaaguuuuuugauua

SEQ ID NO: 3979501 - RNA, 15 nt, Staphylococcus aureus subsp. aureus Mu50
auagaaugaauaauu

SEQ ID NO: 3979502 - RNA, 18 nt, Staphylococcus aureus subsp. aureus Mu50
auagaauucacgcaauau

SEQ ID NO: 3979503 - RNA, 13 nt, Staphylococcus aureus subsp. aureus Mu50
auagaauuuuuca

SEQ ID NO: 3979504 - RNA, 18 nt, Staphylococcus aureus subsp. aureus Mu50
auagaccuuuauuuuuau

SEQ ID NO: 3979505 - RNA, 16 nt, Staphylococcus aureus subsp. aureus Mu50
auagacuaauuaucuu

SEQ ID NO: 3979506 - RNA, 19 nt, Staphylococcus aureus subsp. aureus Mu50
auagacuuauauuaaucgu

SEQ ID NO: 3979507 - RNA, 22 nt, Staphylococcus aureus subsp. aureus Mu50
auagacuuucuugaugaauuaa

SEQ ID NO: 3979508 - RNA, 13 nt, Staphylococcus aureus subsp. aureus Mu50
auagagaaagaau

SEQ ID NO: 3979509 - RNA, 19 nt, Staphylococcus aureus subsp. aureus Mu50
auagagaaagaauaaaugu

SEQ ID NO: 3979510 - RNA, 13 nt, Staphylococcus aureus subsp. aureus Mu50
auagagaagggag

SEQ ID NO: 3979511 - RNA, 15 nt, Staphylococcus aureus subsp. aureus Mu50
auagaggauauuuau

SEQ ID NO: 3979512 - RNA, 22 nt, Staphylococcus aureus subsp. aureus Mu50
auagaguaguucggaugagaaa

SEQ ID NO: 3979513 - RNA, 14 nt, Staphylococcus aureus subsp. aureus Mu50
auagauaaugcacc

SEQ ID NO: 3979514 - RNA, 15 nt, Staphylococcus aureus subsp. aureus Mu50
auagauaggauauuu

SEQ ID NO: 3979515 - RNA, 13 nt, Staphylococcus aureus subsp. aureus Mu50
auagaucuuugua

SEQ ID NO: 3979516 - RNA, 16 nt, Staphylococcus aureus subsp. aureus Mu50
auagaugaaaauuuaa

SEQ ID NO: 3979517 - RNA, 20 nt, Staphylococcus aureus subsp. aureus Mu50
auagaugagaaaguaaaagu

SEQ ID NO: 3979518 - RNA, 14 nt, Staphylococcus aureus subsp. aureus Mu50
auagaugcauaaaa

SEQ ID NO: 3979519 - RNA, 16 nt, Staphylococcus aureus subsp. aureus Mu50
auagaugcauaaaaac

SEQ ID NO: 3979520 - RNA, 13 nt, Staphylococcus aureus subsp. aureus Mu50
auaguuuauaaau

SEQ ID NO: 3979521 - RNA, 14 nt, Staphylococcus aureus subsp. aureus Mu50
auaguuuauuaaua

SEQ ID NO: 3979522 - RNA, 21 nt, Staphylococcus aureus subsp. aureus Mu50
auaguuuauuaauauuaguga

SEQ ID NO: 3979523 - RNA, 16 nt, Staphylococcus aureus subsp. aureus Mu50
auaguuucaaugccuu

SEQ ID NO: 3979524 - RNA, 18 nt, Staphylococcus aureus subsp. aureus Mu50
auaguuuuucauauucac

SEQ ID NO: 3979525 - RNA, 21 nt, Staphylococcus aureus subsp. aureus Mu50
auauaaaaaagaucacugcca

SEQ ID NO: 3979526 - RNA, 20 nt, Staphylococcus aureus subsp. aureus Mu50
auauaaaaaauuauuaaaaa

SEQ ID NO: 3979527 - RNA, 23 nt, Staphylococcus aureus subsp. aureus Mu50
auauaaaaaccccuguugaacuu

SEQ ID NO: 3979528 - RNA, 13 nt, Staphylococcus aureus subsp. aureus Mu50
auauaaaaacugu

SEQ ID NO: 3979529 - RNA, 21 nt, Staphylococcus aureus subsp. aureus Mu50
auauaaaaagugaaaguauua

SEQ ID NO: 3979530 - RNA, 19 nt, Staphylococcus aureus subsp. aureus Mu50
auauaaaacgauaagaauu

SEQ ID NO: 3979531 - RNA, 16 nt, Staphylococcus aureus subsp. aureus Mu50
auauaaaacugugcau

SEQ ID NO: 3979532 - RNA, 13 nt, Staphylococcus aureus subsp. aureus Mu50
auauaaaaucauu

SEQ ID NO: 3979533 - RNA, 17 nt, Staphylococcus aureus subsp. aureus Mu50
auauaaaauccuaagca

SEQ ID NO: 3979534 - RNA, 18 nt, Staphylococcus aureus subsp. aureus Mu50
auauaaaggaauagcuac

SEQ ID NO: 3979535 - RNA, 21 nt, Staphylococcus aureus subsp. aureus Mu50
auauaaaggaauagcuacaau

SEQ ID NO: 3979536 - RNA, 13 nt, Staphylococcus aureus subsp. aureus Mu50
auauaaauaggca

SEQ ID NO: 3979537 - RNA, 14 nt, Staphylococcus aureus subsp. aureus Mu50
auauaaauaucaau

SEQ ID NO: 3979538 - RNA, 14 nt, Staphylococcus aureus subsp. aureus Mu50
auauaaauaugguu

SEQ ID NO: 3979539 - RNA, 15 nt, Staphylococcus aureus subsp. aureus Mu50
auauaaaucaaauau

SEQ ID NO: 3979540 - RNA, 19 nt, Staphylococcus aureus subsp. aureus Mu50
auauaaaucaaauauacuu

SEQ ID NO: 3979541 - RNA, 13 nt, Staphylococcus aureus subsp. aureus Mu50
auauaaaucauuu

SEQ ID NO: 3979542 - RNA, 14 nt, Staphylococcus aureus subsp. aureus Mu50
auauaaauguugac

SEQ ID NO: 3979543 - RNA, 18 nt, Staphylococcus aureus subsp. aureus Mu50
auauaaauguuuauaucu

SEQ ID NO: 3979544 - RNA, 16 nt, Staphylococcus aureus subsp. aureus Mu50
auauaacaaguauaaa

SEQ ID NO: 3979545 - RNA, 16 nt, Staphylococcus aureus subsp. aureus Mu50
auauaacacgauaauu

SEQ ID NO: 3979546 - RNA, 15 nt, Staphylococcus aureus subsp. aureus Mu50
auauaacaucaaaua

SEQ ID NO: 3979547 - RNA, 17 nt, Staphylococcus aureus subsp. aureus Mu50
auauaacauuaaaauga

SEQ ID NO: 3979548 - RNA, 17 nt, Staphylococcus aureus subsp. aureus Mu50
auauaaccgugaugaug

SEQ ID NO: 3979549 - RNA, 22 nt, Staphylococcus aureus subsp. aureus Mu50
auauaaccgugaugaugugcaa

SEQ ID NO: 3979550 - RNA, 20 nt, Staphylococcus aureus subsp. aureus Mu50
auauaacuauggucaucaau

SEQ ID NO: 3979551 - RNA, 22 nt, Staphylococcus aureus subsp. aureus Mu50
auauaacugcauguacaucuuu

SEQ ID NO: 3979552 - RNA, 20 nt, Staphylococcus aureus subsp. aureus Mu50
auauaagaauuguugaucau

SEQ ID NO: 3979553 - RNA, 22 nt, Staphylococcus aureus subsp. aureus Mu50
auauaaggcauauccgaaaauu

SEQ ID NO: 3979554 - RNA, 17 nt, Staphylococcus aureus subsp. aureus Mu50
auauaaggcgcucucuu

SEQ ID NO: 3979555 - RNA, 14 nt, Staphylococcus aureus subsp. aureus Mu50
auauaaguaaucau

SEQ ID NO: 3979556 - RNA, 16 nt, Staphylococcus aureus subsp. aureus Mu50
auauaaguauaaugau

SEQ ID NO: 3979557 - RNA, 18 nt, Staphylococcus aureus subsp. aureus Mu50
auauaauaccccaaauag

SEQ ID NO: 3979558 - RNA, 13 nt, Staphylococcus aureus subsp. aureus Mu50
auauaauagaaau

SEQ ID NO: 3979559 - RNA, 20 nt, Staphylococcus aureus subsp. aureus Mu50
auauaauagaaauaaucaca

SEQ ID NO: 3979560 - RNA, 11 nt, Staphylococcus aureus subsp. aureus Mu50
auauaauccag

SEQ ID NO: 3979561 - RNA, 17 nt, Staphylococcus aureus subsp. aureus Mu50
auauaaugcugauaauu

SEQ ID NO: 3979562 - RNA, 16 nt, Staphylococcus aureus subsp. aureus Mu50
auauaauguauaaaac

SEQ ID NO: 3979563 - RNA, 17 nt, Staphylococcus aureus subsp. aureus Mu50
auauaauguauaaaaca

SEQ ID NO: 3979564 - RNA, 22 nt, Staphylococcus aureus subsp. aureus Mu50
auauaauguauaaaacagaauu

SEQ ID NO: 3979565 - RNA, 19 nt, Staphylococcus aureus subsp. aureus Mu50
auauaauucuuguuugauu

SEQ ID NO: 3979566 - RNA, 13 nt, Staphylococcus aureus subsp. aureus Mu50
auauaauuuaaag

SEQ ID NO: 3979567 - RNA, 18 nt, Staphylococcus aureus subsp. aureus Mu50
auauaauuuauaaaaaga

SEQ ID NO: 3979568 - RNA, 24 nt, Staphylococcus aureus subsp. aureus Mu50
auauaauuuccuaaaaacugugau

SEQ ID NO: 3979569 - RNA, 16 nt, Staphylococcus aureus subsp. aureus Mu50
auauacgaauccucau

SEQ ID NO: 3979570 - RNA, 15 nt, Staphylococcus aureus subsp. aureus Mu50
auauacgacauuuuu

SEQ ID NO: 3979571 - RNA, 20 nt, Staphylococcus aureus subsp. aureus Mu50
auauacgacauuuuuagaca

SEQ ID NO: 3979572 - RNA, 18 nt, Staphylococcus aureus subsp. aureus Mu50
auauacuaaaguucaaca

SEQ ID NO: 3979573 - RNA, 14 nt, Staphylococcus aureus subsp. aureus Mu50
auauacuaaauuug

SEQ ID NO: 3979574 - RNA, 14 nt, Staphylococcus aureus subsp. aureus Mu50
auauacucuaaaaa

SEQ ID NO: 3979575 - RNA, 12 nt, Staphylococcus aureus subsp. aureus Mu50
auauacuugaag

SEQ ID NO: 3979576 - RNA, 21 nt, Staphylococcus aureus subsp. aureus Mu50
auauacuugaagcaucgauuu

SEQ ID NO: 3979577 - RNA, 17 nt, Staphylococcus aureus subsp. aureus Mu50
auauacuuguucaacaa

SEQ ID NO: 3979578 - RNA, 11 nt, Staphylococcus aureus subsp. aureus Mu50
auauacuuuuu

SEQ ID NO: 3979579 - RNA, 14 nt, Staphylococcus aureus subsp. aureus Mu50
auauacuuuuuaaa

SEQ ID NO: 3979580 - RNA, 17 nt, Staphylococcus aureus subsp. aureus Mu50
auauacuuuuuaaauga

SEQ ID NO: 3979581 - RNA, 19 nt, Staphylococcus aureus subsp. aureus Mu50
auauacuuuuuaaaugauu

SEQ ID NO: 3979582 - RNA, 22 nt, Staphylococcus aureus subsp. aureus Mu50
auauagaaaacuagaacuuagu

SEQ ID NO: 3979583 - RNA, 11 nt, Staphylococcus aureus subsp. aureus Mu50
auauagaaaau

SEQ ID NO: 3979584 - RNA, 20 nt, Staphylococcus aureus subsp. aureus Mu50
auauagaagauauaacaugu

SEQ ID NO: 3979585 - RNA, 22 nt, Staphylococcus aureus subsp. aureus Mu50
auauagaagauauaacauguau

SEQ ID NO: 3979586 - RNA, 14 nt, Staphylococcus aureus subsp. aureus Mu50
auauagaaggggac

SEQ ID NO: 3979587 - RNA, 22 nt, Staphylococcus aureus subsp. aureus Mu50
auauagaaggggacuuaaccau

SEQ ID NO: 3979588 - RNA, 18 nt, Staphylococcus aureus subsp. aureus Mu50
auauagagccaugaaaag

SEQ ID NO: 3979589 - RNA, 21 nt, Staphylococcus aureus subsp. aureus Mu50
auauagagccaugaaaaggaa

SEQ ID NO: 3979590 - RNA, 13 nt, Staphylococcus aureus subsp. aureus Mu50
auauagauuaaac

SEQ ID NO: 3979591 - RNA, 23 nt, Staphylococcus aureus subsp. aureus Mu50
auauagauuugaauuaaagugga

SEQ ID NO: 3979592 - RNA, 15 nt, Staphylococcus aureus subsp. aureus Mu50
auauagcauaaaauu

SEQ ID NO: 3979593 - RNA, 22 nt, Staphylococcus aureus subsp. aureus Mu50
auauagcauaaaauuucugcuu

SEQ ID NO: 3979594 - RNA, 17 nt, Staphylococcus aureus subsp. aureus Mu50
auauagcaucuaugauu

SEQ ID NO: 3979595 - RNA, 17 nt, Staphylococcus aureus subsp. aureus Mu50
auauagucuaugaauaa

SEQ ID NO: 3979596 - RNA, 21 nt, Staphylococcus aureus subsp. aureus Mu50
auauaguggugguacuuuuuu

SEQ ID NO: 3979597 - RNA, 18 nt, Staphylococcus aureus subsp. aureus Mu50
auauaguuauaugugcuu

SEQ ID NO: 3979598 - RNA, 15 nt, Staphylococcus aureus subsp. aureus Mu50
auauaguugaucaaa

SEQ ID NO: 3979599 - RNA, 11 nt, Staphylococcus aureus subsp. aureus Mu50
auauauaaaag

SEQ ID NO: 3979600 - RNA, 18 nt, Staphylococcus aureus subsp. aureus Mu50
auauauaaggcgcucucu

SEQ ID NO: 3979601 - RNA, 13 nt, Staphylococcus aureus subsp. aureus Mu50
auauauagauuaa

SEQ ID NO: 3979602 - RNA, 14 nt, Staphylococcus aureus subsp. aureus Mu50
auauauauauuaaa

SEQ ID NO: 3979603 - RNA, 16 nt, Staphylococcus aureus subsp. aureus Mu50
auauaucaacguuaau

SEQ ID NO: 3979604 - RNA, 18 nt, Staphylococcus aureus subsp. aureus Mu50
auauauccugccaauaua

SEQ ID NO: 3979605 - RNA, 23 nt, Staphylococcus aureus subsp. aureus Mu50
auauauccugccaauauauucac

SEQ ID NO: 3979606 - RNA, 19 nt, Staphylococcus aureus subsp. aureus Mu50
auauaucuagccugaaaua

SEQ ID NO: 3979607 - RNA, 22 nt, Staphylococcus aureus subsp. aureus Mu50
auauaucuagccugaaauagaa

SEQ ID NO: 3979608 - RNA, 14 nt, Staphylococcus aureus subsp. aureus Mu50
auaucuuuguugca

SEQ ID NO: 3979609 - RNA, 22 nt, Staphylococcus aureus subsp. aureus Mu50
auaucuuuuuuuuuauaguggu

SEQ ID NO: 3979610 - RNA, 12 nt, Staphylococcus aureus subsp. aureus Mu50
auaugaaaagag

SEQ ID NO: 3979611 - RNA, 14 nt, Staphylococcus aureus subsp. aureus Mu50
auaugaaaagagaa

SEQ ID NO: 3979612 - RNA, 13 nt, Staphylococcus aureus subsp. aureus Mu50
auaugaacaaaaa

SEQ ID NO: 3979613 - RNA, 21 nt, Staphylococcus aureus subsp. aureus Mu50
auaugaagcguuuuuauuaca

SEQ ID NO: 3979614 - RNA, 17 nt, Staphylococcus aureus subsp. aureus Mu50
auaugaaucuagaauau

SEQ ID NO: 3979615 - RNA, 13 nt, Staphylococcus aureus subsp. aureus Mu50
auaugaauugagu

SEQ ID NO: 3979616 - RNA, 17 nt, Staphylococcus aureus subsp. aureus Mu50
auaugaauugaguauua

SEQ ID NO: 3979617 - RNA, 22 nt, Staphylococcus aureus subsp. aureus Mu50
auaugaauugcuuguuuuaaau

SEQ ID NO: 3979618 - RNA, 13 nt, Staphylococcus aureus subsp. aureus Mu50
auaugaauuuuau

SEQ ID NO: 3979619 - RNA, 16 nt, Staphylococcus aureus subsp. aureus Mu50
auaugacacauacacc

SEQ ID NO: 3979620 - RNA, 17 nt, Staphylococcus aureus subsp. aureus Mu50
auaugacgcgugaauua

SEQ ID NO: 3979621 - RNA, 23 nt, Staphylococcus aureus subsp. aureus Mu50
auaugacgcgugaauuaaaaaau

SEQ ID NO: 3979622 - RNA, 16 nt, Staphylococcus aureus subsp. aureus Mu50
auaugacuuuauuucu

SEQ ID NO: 3979623 - RNA, 13 nt, Staphylococcus aureus subsp. aureus Mu50
auaugauaaauau

SEQ ID NO: 3979624 - RNA, 15 nt, Staphylococcus aureus subsp. aureus Mu50
auaugauaaccaaac

SEQ ID NO: 3979625 - RNA, 20 nt, Staphylococcus aureus subsp. aureus Mu50
auaugauaaccaaaccauaa

SEQ ID NO: 3979626 - RNA, 20 nt, Staphylococcus aureus subsp. aureus Mu50
auaugauuacaacuuauucu

SEQ ID NO: 3979627 - RNA, 14 nt, Staphylococcus aureus subsp. aureus Mu50
auaugauugcaaau

SEQ ID NO: 3979628 - RNA, 18 nt, Staphylococcus aureus subsp. aureus Mu50
auaugauugcaaauuauc

SEQ ID NO: 3979629 - RNA, 13 nt, Staphylococcus aureus subsp. aureus Mu50
auaugauugguuu

SEQ ID NO: 3979630 - RNA, 12 nt, Staphylococcus aureus subsp. aureus Mu50
auaugauuuaaa

SEQ ID NO: 3979631 - RNA, 21 nt, Staphylococcus aureus subsp. aureus Mu50
auaugauuuaaaauauaaauu

SEQ ID NO: 3979632 - RNA, 15 nt, Staphylococcus aureus subsp. aureus Mu50
auaugcaacuuauaa

SEQ ID NO: 3979633 - RNA, 17 nt, Staphylococcus aureus subsp. aureus Mu50
auaugcaacuuauaaua

SEQ ID NO: 3979634 - RNA, 12 nt, Staphylococcus aureus subsp. aureus Mu50
auaugcauauau

SEQ ID NO: 3979635 - RNA, 15 nt, Staphylococcus aureus subsp. aureus Mu50
auaugcauccuaaaa

SEQ ID NO: 3979636 - RNA, 16 nt, Staphylococcus aureus subsp. aureus Mu50
auaugccauaguaaua

SEQ ID NO: 3979637 - RNA, 15 nt, Staphylococcus aureus subsp. aureus Mu50
auauggaaaauguau

SEQ ID NO: 3979638 - RNA, 14 nt, Staphylococcus aureus subsp. aureus Mu50
auauggaauacuac

SEQ ID NO: 3979639 - RNA, 14 nt, Staphylococcus aureus subsp. aureus Mu50
auauggaauuguau

SEQ ID NO: 3979640 - RNA, 16 nt, Staphylococcus aureus subsp. aureus Mu50
auauggaauuucauau

SEQ ID NO: 3979641 - RNA, 14 nt, Staphylococcus aureus subsp. aureus Mu50
auauggauuuugaa

SEQ ID NO: 3979642 - RNA, 23 nt, Staphylococcus aureus subsp. aureus Mu50
auauggcaucaucaccauacuaa

SEQ ID NO: 3979643 - RNA, 21 nt, Staphylococcus aureus subsp. aureus Mu50
auaugguuagagaaaaaucug

SEQ ID NO: 3979644 - RNA, 22 nt, Staphylococcus aureus subsp. aureus Mu50
auaugguucguccauucaaagu

SEQ ID NO: 3979645 - RNA, 15 nt, Staphylococcus aureus subsp. aureus Mu50
auauguaaaugaaau

SEQ ID NO: 3979646 - RNA, 16 nt, Staphylococcus aureus subsp. aureus Mu50
auauguaaaugaaaua

SEQ ID NO: 3979647 - RNA, 19 nt, Staphylococcus aureus subsp. aureus Mu50
auauguauaacauuauuaa

SEQ ID NO: 3979648 - RNA, 23 nt, Staphylococcus aureus subsp. aureus Mu50
auauguauagaggauauuuauuc

SEQ ID NO: 3979649 - RNA, 22 nt, Staphylococcus aureus subsp. aureus Mu50
auaugucucucuuucuuauuca

SEQ ID NO: 3979650 - RNA, 20 nt, Staphylococcus aureus subsp. aureus Mu50
auauguggcacucauaaccg

SEQ ID NO: 3979651 - RNA, 23 nt, Staphylococcus aureus subsp. aureus Mu50
auauguggguguaccaauugauu

SEQ ID NO: 3979652 - RNA, 19 nt, Staphylococcus aureus subsp. aureus Mu50
auaugugguggcuauauaa

SEQ ID NO: 3979653 - RNA, 16 nt, Staphylococcus aureus subsp. aureus Mu50
auauguuguuucuaau

SEQ ID NO: 3979654 - RNA, 22 nt, Staphylococcus aureus subsp. aureus Mu50
auauguuuauauugcaaaaaua

SEQ ID NO: 3979655 - RNA, 15 nt, Staphylococcus aureus subsp. aureus Mu50
auauguuuuauaaua

SEQ ID NO: 3979656 - RNA, 17 nt, Staphylococcus aureus subsp. aureus Mu50
auauuaaaaauuucaau

SEQ ID NO: 3979657 - RNA, 13 nt, Staphylococcus aureus subsp. aureus Mu50
auauuaaaacaau

SEQ ID NO: 3979658 - RNA, 15 nt, Staphylococcus aureus subsp. aureus Mu50
auauuaaaacaauga

SEQ ID NO: 3979659 - RNA, 21 nt, Staphylococcus aureus subsp. aureus Mu50
auauuaaaauuaaaacuuuca

SEQ ID NO: 3979660 - RNA, 15 nt, Staphylococcus aureus subsp. aureus Mu50
auauuaaacuuauaa

SEQ ID NO: 3979661 - RNA, 17 nt, Staphylococcus aureus subsp. aureus Mu50
auauuaaacuuauaacu

SEQ ID NO: 3979662 - RNA, 13 nt, Staphylococcus aureus subsp. aureus Mu50
auauuaaaguaaa

SEQ ID NO: 3979663 - RNA, 16 nt, Staphylococcus aureus subsp. aureus Mu50
auauuaaaguaaaaua

SEQ ID NO: 3979664 - RNA, 18 nt, Staphylococcus aureus subsp. aureus Mu50
auauuaaauuauggagcg

SEQ ID NO: 3979665 - RNA, 20 nt, Staphylococcus aureus subsp. aureus Mu50
auauuaaauuauuguuuuaa

SEQ ID NO: 3979666 - RNA, 12 nt, Staphylococcus aureus subsp. aureus Mu50
auauuaaauuca

SEQ ID NO: 3979667 - RNA, 15 nt, Staphylococcus aureus subsp. aureus Mu50
auauuaacaacuuua

SEQ ID NO: 3979668 - RNA, 22 nt, Staphylococcus aureus subsp. aureus Mu50
auauuaacaacuuuauuauacu

SEQ ID NO: 3979669 - RNA, 14 nt, Staphylococcus aureus subsp. aureus Mu50
auauuaacaccaga

SEQ ID NO: 3979670 - RNA, 15 nt, Staphylococcus aureus subsp. aureus Mu50
auauuaacaccagau

SEQ ID NO: 3979671 - RNA, 19 nt, Staphylococcus aureus subsp. aureus Mu50
auauuaacguuaguauaaa

SEQ ID NO: 3979672 - RNA, 18 nt, Staphylococcus aureus subsp. aureus Mu50
auauuaacuguuagacuu

SEQ ID NO: 3979673 - RNA, 15 nt, Staphylococcus aureus subsp. aureus Mu50
auauuaagauguaua

SEQ ID NO: 3979674 - RNA, 18 nt, Staphylococcus aureus subsp. aureus Mu50
auauuaagcgucuaucuc

SEQ ID NO: 3979675 - RNA, 21 nt, Staphylococcus aureus subsp. aureus Mu50
auauuaaggucauuuuuaauu

SEQ ID NO: 3979676 - RNA, 16 nt, Staphylococcus aureus subsp. aureus Mu50
auauuaagucuagcau

SEQ ID NO: 3979677 - RNA, 17 nt, Staphylococcus aureus subsp. aureus Mu50
auauuaauauaaaauaa

SEQ ID NO: 3979678 - RNA, 17 nt, Staphylococcus aureus subsp. aureus Mu50
auauuaaucauaaugaa

SEQ ID NO: 3979679 - RNA, 20 nt, Staphylococcus aureus subsp. aureus Mu50
auauuaaucguuaauguaua

SEQ ID NO: 3979680 - RNA, 22 nt, Staphylococcus aureus subsp. aureus Mu50
auauuaaucguuaauguauaaa

SEQ ID NO: 3979681 - RNA, 14 nt, Staphylococcus aureus subsp. aureus Mu50
auauuaauugaaaa

SEQ ID NO: 3979682 - RNA, 19 nt, Staphylococcus aureus subsp. aureus Mu50
auauuacuaaccuauuaaa

SEQ ID NO: 3979683 - RNA, 21 nt, Staphylococcus aureus subsp. aureus Mu50
auauuacucaaaauuaaagcu

SEQ ID NO: 3979684 - RNA, 18 nt, Staphylococcus aureus subsp. aureus Mu50
auauuacuucucaucgaa

SEQ ID NO: 3979685 - RNA, 19 nt, Staphylococcus aureus subsp. aureus Mu50
auauuacuucucaucgaau

SEQ ID NO: 3979686 - RNA, 19 nt, Staphylococcus aureus subsp. aureus Mu50
auauuagugauauuuuucg

SEQ ID NO: 3979687 - RNA, 20 nt, Staphylococcus aureus subsp. aureus Mu50
auauuauaaaccuaaugcuu

SEQ ID NO: 3979688 - RNA, 21 nt, Staphylococcus aureus subsp. aureus Mu50
auauuauaaccaccaguauaa

SEQ ID NO: 3979689 - RNA, 23 nt, Staphylococcus aureus subsp. aureus Mu50
auauuauaacccucguaggcaua

SEQ ID NO: 3979690 - RNA, 23 nt, Staphylococcus aureus subsp. aureus Mu50
auauuauaaguugcauauaaaaa

SEQ ID NO: 3979691 - RNA, 15 nt, Staphylococcus aureus subsp. aureus Mu50
auauuauauauauuc

SEQ ID NO: 3979692 - RNA, 18 nt, Staphylococcus aureus subsp. aureus Mu50
auauuaugccauucauua

SEQ ID NO: 3979693 - RNA, 17 nt, Staphylococcus aureus subsp. aureus Mu50
auauuauucauaauaua

SEQ ID NO: 3979694 - RNA, 20 nt, Staphylococcus aureus subsp. aureus Mu50
auauuauugugaaaucuauu

SEQ ID NO: 3979695 - RNA, 12 nt, Staphylococcus aureus subsp. aureus Mu50
auauuauuuuua

SEQ ID NO: 3979696 - RNA, 15 nt, Staphylococcus aureus subsp. aureus Mu50
auauuuuguuaauaa

SEQ ID NO: 3979697 - RNA, 20 nt, Staphylococcus aureus subsp. aureus Mu50
auauuuuuaauuauuuuaaa

SEQ ID NO: 3979698 - RNA, 18 nt, Staphylococcus aureus subsp. aureus Mu50
auauuuuuacauauuuau

SEQ ID NO: 3979699 - RNA, 13 nt, Staphylococcus aureus subsp. aureus Mu50
auauuuuuagaaa

SEQ ID NO: 3979700 - RNA, 17 nt, Staphylococcus aureus subsp. aureus Mu50
auauuuuuaucaucuuc

SEQ ID NO: 3979701 - RNA, 13 nt, Staphylococcus aureus subsp. aureus Mu50
auauuuuuauuaa

SEQ ID NO: 3979702 - RNA, 12 nt, Staphylococcus aureus subsp. aureus Mu50
auauuuuucuuc

SEQ ID NO: 3979703 - RNA, 19 nt, Staphylococcus aureus subsp. aureus Mu50
auauuuuucuucaguuaaa

SEQ ID NO: 3979704 - RNA, 20 nt, Staphylococcus aureus subsp. aureus Mu50
auauuuuuguauuuauguuu

SEQ ID NO: 3979705 - RNA, 13 nt, Staphylococcus aureus subsp. aureus Mu50
auauuuuuuaaaa

SEQ ID NO: 3979706 - RNA, 21 nt, Staphylococcus aureus subsp. aureus Mu50
auauuuuuuaaaaugauagcu

SEQ ID NO: 3979707 - RNA, 14 nt, Staphylococcus aureus subsp. aureus Mu50
auauuuuuuaaauu

SEQ ID NO: 3979708 - RNA, 12 nt, Staphylococcus aureus subsp. aureus Mu50
auauuuuuuaau

SEQ ID NO: 3979709 - RNA, 13 nt, Staphylococcus aureus subsp. aureus Mu50
aucaaaaauaaaa

SEQ ID NO: 3979710 - RNA, 14 nt, Staphylococcus aureus subsp. aureus Mu50
aucaaaaauaaaaa

SEQ ID NO: 3979711 - RNA, 12 nt, Staphylococcus aureus subsp. aureus Mu50
aucaaaaccgcu

SEQ ID NO: 3979712 - RNA, 12 nt, Staphylococcus aureus subsp. aureus Mu50
aucaaaauauaa

SEQ ID NO: 3979713 - RNA, 23 nt, Staphylococcus aureus subsp. aureus Mu50
aucaaaauauaaaauccuaagca

SEQ ID NO: 3979714 - RNA, 22 nt, Staphylococcus aureus subsp. aureus Mu50
aucaaaaucgguuugauuaaaa

SEQ ID NO: 3979715 - RNA, 18 nt, Staphylococcus aureus subsp. aureus Mu50
aucaaaaugguaucaaua

SEQ ID NO: 3979716 - RNA, 15 nt, Staphylococcus aureus subsp. aureus Mu50
aucaaaauuuucuac

SEQ ID NO: 3979717 - RNA, 15 nt, Staphylococcus aureus subsp. aureus Mu50
aucaaacaacaucac

SEQ ID NO: 3979718 - RNA, 17 nt, Staphylococcus aureus subsp. aureus Mu50
aucaaacaacaucacuu

SEQ ID NO: 3979719 - RNA, 15 nt, Staphylococcus aureus subsp. aureus Mu50
aucaaaccaccaaaa

SEQ ID NO: 3979720 - RNA, 21 nt, Staphylococcus aureus subsp. aureus Mu50
aucaaacuuggcaaugaaauu

SEQ ID NO: 3979721 - RNA, 22 nt, Staphylococcus aureus subsp. aureus Mu50
aucaaagaaaaagugauaauua

SEQ ID NO: 3979722 - RNA, 14 nt, Staphylococcus aureus subsp. aureus Mu50
aucaaagaggaaca

SEQ ID NO: 3979723 - RNA, 14 nt, Staphylococcus aureus subsp. aureus Mu50
aucaaagaggcaca

SEQ ID NO: 3979724 - RNA, 20 nt, Staphylococcus aureus subsp. aureus Mu50
aucaaagaggcacagcggaa

SEQ ID NO: 3979725 - RNA, 20 nt, Staphylococcus aureus subsp. aureus Mu50
aucaaagaggcuuuaaaauu

SEQ ID NO: 3979726 - RNA, 18 nt, Staphylococcus aureus subsp. aureus Mu50
aucaaagauuuuguugaa

SEQ ID NO: 3979727 - RNA, 18 nt, Staphylococcus aureus subsp. aureus Mu50
aucaaagcuauauaugaa

SEQ ID NO: 3979728 - RNA, 19 nt, Staphylococcus aureus subsp. aureus Mu50
aucaaaguacuaacguuuu

SEQ ID NO: 3979729 - RNA, 14 nt, Staphylococcus aureus subsp. aureus Mu50
aucaaaguaucagu

SEQ ID NO: 3979730 - RNA, 21 nt, Staphylococcus aureus subsp. aureus Mu50
aucaaaguaucagucauugca

SEQ ID NO: 3979731 - RNA, 24 nt, Staphylococcus aureus subsp. aureus Mu50
aucaaaguuuucaggaauuguuaa

SEQ ID NO: 3979732 - RNA, 17 nt, Staphylococcus aureus subsp. aureus Mu50
aucaaauacauuucaaa

SEQ ID NO: 3979733 - RNA, 18 nt, Staphylococcus aureus subsp. aureus Mu50
aucaaauagacaccaaaa

SEQ ID NO: 3979734 - RNA, 19 nt, Staphylococcus aureus subsp. aureus Mu50
aucaaauagacaccaaaaa

SEQ ID NO: 3979735 - RNA, 13 nt, Staphylococcus aureus subsp. aureus Mu50
aucaaauuaccau

SEQ ID NO: 3979736 - RNA, 18 nt, Staphylococcus aureus subsp. aureus Mu50
aucaaauuaccauucauc

SEQ ID NO: 3979737 - RNA, 14 nt, Staphylococcus aureus subsp. aureus Mu50
aucaaauuaucugu

SEQ ID NO: 3979738 - RNA, 23 nt, Staphylococcus aureus subsp. aureus Mu50
aucaaauugaccgacaaaacuug

SEQ ID NO: 3979739 - RNA, 13 nt, Staphylococcus aureus subsp. aureus Mu50
aucaaauuuuucg

SEQ ID NO: 3979740 - RNA, 17 nt, Staphylococcus aureus subsp. aureus Mu50
aucaacaaauuuaacuu

SEQ ID NO: 3979741 - RNA, 13 nt, Staphylococcus aureus subsp. aureus Mu50
aucaacaauuuaa

SEQ ID NO: 3979742 - RNA, 15 nt, Staphylococcus aureus subsp. aureus Mu50
aucaacaauuuaaac

SEQ ID NO: 3979743 - RNA, 12 nt, Staphylococcus aureus subsp. aureus Mu50
aucaacacacac

SEQ ID NO: 3979744 - RNA, 23 nt, Staphylococcus aureus subsp. aureus Mu50
aucaacacacacaguuuauaaua

SEQ ID NO: 3979745 - RNA, 20 nt, Staphylococcus aureus subsp. aureus Mu50
aucaacaguuuuauuaucuu

SEQ ID NO: 3979746 - RNA, 21 nt, Staphylococcus aureus subsp. aureus Mu50
aucaacaguuuuauuaucuuu

SEQ ID NO: 3979747 - RNA, 16 nt, Staphylococcus aureus subsp. aureus Mu50
aucaacauaaaauuua

SEQ ID NO: 3979748 - RNA, 15 nt, Staphylococcus aureus subsp. aureus Mu50
aucaacauaauauuu

SEQ ID NO: 3979749 - RNA, 23 nt, Staphylococcus aureus subsp. aureus Mu50
aucaacauauuuaucucuuucuu

SEQ ID NO: 3979750 - RNA, 21 nt, Staphylococcus aureus subsp. aureus Mu50
aucaacauuaauaaauaauaa

SEQ ID NO: 3979751 - RNA, 14 nt, Staphylococcus aureus subsp. aureus Mu50
aucaaccguuuuau

SEQ ID NO: 3979752 - RNA, 18 nt, Staphylococcus aureus subsp. aureus Mu50
aucaaccuguucuuuauu

SEQ ID NO: 3979753 - RNA, 19 nt, Staphylococcus aureus subsp. aureus Mu50
aucaacgagucauaaauau

SEQ ID NO: 3979754 - RNA, 20 nt, Staphylococcus aureus subsp. aureus Mu50
aucaacgagucauaaauaua

SEQ ID NO: 3979755 - RNA, 20 nt, Staphylococcus aureus subsp. aureus Mu50
aucaacgauguccuuuagug

SEQ ID NO: 3979756 - RNA, 19 nt, Staphylococcus aureus subsp. aureus Mu50
aucaacgauugaauuguag

SEQ ID NO: 3979757 - RNA, 18 nt, Staphylococcus aureus subsp. aureus Mu50
aucaacgauuuugucuuu

SEQ ID NO: 3979758 - RNA, 17 nt, Staphylococcus aureus subsp. aureus Mu50
aucaacgccauauuuau

SEQ ID NO: 3979759 - RNA, 19 nt, Staphylococcus aureus subsp. aureus Mu50
aucaacgccauauuuauuu

SEQ ID NO: 3979760 - RNA, 17 nt, Staphylococcus aureus subsp. aureus Mu50
aucaacguauauaaguu

SEQ ID NO: 3979761 - RNA, 14 nt, Staphylococcus aureus subsp. aureus Mu50
aucaacuauauaua

SEQ ID NO: 3979762 - RNA, 14 nt, Staphylococcus aureus subsp. aureus Mu50
aucaagaaaaaguu

SEQ ID NO: 3979763 - RNA, 13 nt, Staphylococcus aureus subsp. aureus Mu50
aucaagaaauguu

SEQ ID NO: 3979764 - RNA, 13 nt, Staphylococcus aureus subsp. aureus Mu50
aucaagaauauaa

SEQ ID NO: 3979765 - RNA, 20 nt, Staphylococcus aureus subsp. aureus Mu50
aucaagaauauaagugauuu

SEQ ID NO: 3979766 - RNA, 16 nt, Staphylococcus aureus subsp. aureus Mu50
aucaagagguaaaucu

SEQ ID NO: 3979767 - RNA, 23 nt, Staphylococcus aureus subsp. aureus Mu50
aucaagauguuugcaacauauuu

SEQ ID NO: 3979768 - RNA, 16 nt, Staphylococcus aureus subsp. aureus Mu50
aucaagcuagcaucau

SEQ ID NO: 3979769 - RNA, 15 nt, Staphylococcus aureus subsp. aureus Mu50
aucaagcugagcuuu

SEQ ID NO: 3979770 - RNA, 16 nt, Staphylococcus aureus subsp. aureus Mu50
aucaagcugagcuuua

SEQ ID NO: 3979771 - RNA, 23 nt, Staphylococcus aureus subsp. aureus Mu50
aucaagcugagcuuuaauuuuuu

SEQ ID NO: 3979772 - RNA, 16 nt, Staphylococcus aureus subsp. aureus Mu50
aucaaguauaaauguu

SEQ ID NO: 3979773 - RNA, 20 nt, Staphylococcus aureus subsp. aureus Mu50
aucaaguuuacgaucauaaa

SEQ ID NO: 3979774 - RNA, 15 nt, Staphylococcus aureus subsp. aureus Mu50
aucaauaccauaauu

SEQ ID NO: 3979775 - RNA, 15 nt, Staphylococcus aureus subsp. aureus Mu50
aucaauagaugaaaa

SEQ ID NO: 3979776 - RNA, 20 nt, Staphylococcus aureus subsp. aureus Mu50
aucaauagaugaaaauuuaa

SEQ ID NO: 3979777 - RNA, 16 nt, Staphylococcus aureus subsp. aureus Mu50
aucaauaguuuauaaa

SEQ ID NO: 3979778 - RNA, 20 nt, Staphylococcus aureus subsp. aureus Mu50
aucaauaguuuauaaauuaa

SEQ ID NO: 3979779 - RNA, 21 nt, Staphylococcus aureus subsp. aureus Mu50
aucaauaguuuauaaauuaau

SEQ ID NO: 3979780 - RNA, 13 nt, Staphylococcus aureus subsp. aureus Mu50
aucaauauaaccg

SEQ ID NO: 3979781 - RNA, 17 nt, Staphylococcus aureus subsp. aureus Mu50
aucaauaucaaauuugg

SEQ ID NO: 3979782 - RNA, 19 nt, Staphylococcus aureus subsp. aureus Mu50
aucaauaucacuaucagcu

SEQ ID NO: 3979783 - RNA, 19 nt, Staphylococcus aureus subsp. aureus Mu50
aucaauaugaccuuuaugu

SEQ ID NO: 3979784 - RNA, 23 nt, Staphylococcus aureus subsp. aureus Mu50
aucauauaaugguugaauaacac

SEQ ID NO: 3979785 - RNA, 13 nt, Staphylococcus aureus subsp. aureus Mu50
aucauauauugac

SEQ ID NO: 3979786 - RNA, 12 nt, Staphylococcus aureus subsp. aureus Mu50
aucauaucauac

SEQ ID NO: 3979787 - RNA, 15 nt, Staphylococcus aureus subsp. aureus Mu50
aucauaugucuuaac

SEQ ID NO: 3979788 - RNA, 16 nt, Staphylococcus aureus subsp. aureus Mu50
aucaucaaaguuuaau

SEQ ID NO: 3979789 - RNA, 21 nt, Staphylococcus aureus subsp. aureus Mu50
aucaucaacaaucuuuuucau

SEQ ID NO: 3979790 - RNA, 22 nt, Staphylococcus aureus subsp. aureus Mu50
aucaucaaguucaccguaaucu

SEQ ID NO: 3979791 - RNA, 17 nt, Staphylococcus aureus subsp. aureus Mu50
aucaucacacucucccc

SEQ ID NO: 3979792 - RNA, 21 nt, Staphylococcus aureus subsp. aureus Mu50
aucaucacuguagauucaaau

SEQ ID NO: 3979793 - RNA, 12 nt, Staphylococcus aureus subsp. aureus Mu50
aucaucauacuu

SEQ ID NO: 3979794 - RNA, 18 nt, Staphylococcus aureus subsp. aureus Mu50
aucauccauaaaaauacg

SEQ ID NO: 3979795 - RNA, 14 nt, Staphylococcus aureus subsp. aureus Mu50
aucaucgaacauga

SEQ ID NO: 3979796 - RNA, 19 nt, Staphylococcus aureus subsp. aureus Mu50
aucaucguauuucauauau

SEQ ID NO: 3979797 - RNA, 16 nt, Staphylococcus aureus subsp. aureus Mu50
aucaucuauauuuaau

SEQ ID NO: 3979798 - RNA, 11 nt, Staphylococcus aureus subsp. aureus Mu50
aucaucuauuc

SEQ ID NO: 3979799 - RNA, 15 nt, Staphylococcus aureus subsp. aureus Mu50
aucaucuauuuuuaa

SEQ ID NO: 3979800 - RNA, 23 nt, Staphylococcus aureus subsp. aureus Mu50
aucaucuccuugguuauuaaaau

SEQ ID NO: 3979801 - RNA, 18 nt, Staphylococcus aureus subsp. aureus Mu50
aucaucucugcuuuaaua

SEQ ID NO: 3979802 - RNA, 21 nt, Staphylococcus aureus subsp. aureus Mu50
aucaucucugcuuuaauauaa

SEQ ID NO: 3979803 - RNA, 19 nt, Staphylococcus aureus subsp. aureus Mu50
aucaucuuuaauuuucuug

SEQ ID NO: 3979804 - RNA, 20 nt, Staphylococcus aureus subsp. aureus Mu50
aucaucuuuuugaaauuucg

SEQ ID NO: 3979805 - RNA, 16 nt, Staphylococcus aureus subsp. aureus Mu50
aucaugacauaaaacu

SEQ ID NO: 3979806 - RNA, 19 nt, Staphylococcus aureus subsp. aureus Mu50
aucaugacuauuucgcuuu

SEQ ID NO: 3979807 - RNA, 24 nt, Staphylococcus aureus subsp. aureus Mu50
aucaugacuauuuuccaucacaua

SEQ ID NO: 3979808 - RNA, 17 nt, Staphylococcus aureus subsp. aureus Mu50
aucaugauagccgcuuc

SEQ ID NO: 3979809 - RNA, 15 nt, Staphylococcus aureus subsp. aureus Mu50
aucaugcaaaacuaa

SEQ ID NO: 3979810 - RNA, 16 nt, Staphylococcus aureus subsp. aureus Mu50
aucaugcaaaacuaau

SEQ ID NO: 3979811 - RNA, 13 nt, Staphylococcus aureus subsp. aureus Mu50
aucaugcaaaaua

SEQ ID NO: 3979812 - RNA, 13 nt, Staphylococcus aureus subsp. aureus Mu50
aucaugcauaauc

SEQ ID NO: 3979813 - RNA, 16 nt, Staphylococcus aureus subsp. aureus Mu50
aucaugccuucaugaa

SEQ ID NO: 3979814 - RNA, 17 nt, Staphylococcus aureus subsp. aureus Mu50
aucaugcucguuuuuau

SEQ ID NO: 3979815 - RNA, 11 nt, Staphylococcus aureus subsp. aureus Mu50
aucaugcuuuu

SEQ ID NO: 3979816 - RNA, 18 nt, Staphylococcus aureus subsp. aureus Mu50
aucaugcuuuuaauauua

SEQ ID NO: 3979817 - RNA, 20 nt, Staphylococcus aureus subsp. aureus Mu50
aucaugcuuuuaauauuaua

SEQ ID NO: 3979818 - RNA, 21 nt, Staphylococcus aureus subsp. aureus Mu50
aucaugggcaguaauuuucau

SEQ ID NO: 3979819 - RNA, 21 nt, Staphylococcus aureus subsp. aureus Mu50
aucauggucaacuuuuuuaac

SEQ ID NO: 3979820 - RNA, 22 nt, Staphylococcus aureus subsp. aureus Mu50
aucauggucaacuuuuuuaacu

SEQ ID NO: 3979821 - RNA, 22 nt, Staphylococcus aureus subsp. aureus Mu50
aucauguaaugcuuaaaaacaa

SEQ ID NO: 3979822 - RNA, 22 nt, Staphylococcus aureus subsp. aureus Mu50
aucauguauauggcaucaucac

SEQ ID NO: 3979823 - RNA, 15 nt, Staphylococcus aureus subsp. aureus Mu50
aucaugugacauaac

SEQ ID NO: 3979824 - RNA, 23 nt, Staphylococcus aureus subsp. aureus Mu50
aucaugugcuuuguuuaucaauu

SEQ ID NO: 3979825 - RNA, 23 nt, Staphylococcus aureus subsp. aureus Mu50
aucauguuccccauuaauuaaca

SEQ ID NO: 3979826 - RNA, 20 nt, Staphylococcus aureus subsp. aureus Mu50
aucauguucuaaugcugcuu

SEQ ID NO: 3979827 - RNA, 22 nt, Staphylococcus aureus subsp. aureus Mu50
aucauguucuuauaaaaaacaa

SEQ ID NO: 3979828 - RNA, 22 nt, Staphylococcus aureus subsp. aureus Mu50
aucauuaaauugcuugaaauua

SEQ ID NO: 3979829 - RNA, 15 nt, Staphylococcus aureus subsp. aureus Mu50
aucauuaauaauuaa

SEQ ID NO: 3979830 - RNA, 14 nt, Staphylococcus aureus subsp. aureus Mu50
aucauuagauaaua

SEQ ID NO: 3979831 - RNA, 15 nt, Staphylococcus aureus subsp. aureus Mu50
aucauuagauaauaa

SEQ ID NO: 3979832 - RNA, 20 nt, Staphylococcus aureus subsp. aureus Mu50
aucauuaguguagaaaauag

SEQ ID NO: 3979833 - RNA, 16 nt, Staphylococcus aureus subsp. aureus Mu50
aucauuauaaaauggu

SEQ ID NO: 3979834 - RNA, 16 nt, Staphylococcus aureus subsp. aureus Mu50
aucauuauacgugcuu

SEQ ID NO: 3979835 - RNA, 23 nt, Staphylococcus aureus subsp. aureus Mu50
aucauucaaacuccuuucuaaga

SEQ ID NO: 3979836 - RNA, 15 nt, Staphylococcus aureus subsp. aureus Mu50
aucauucauggccaa

SEQ ID NO: 3979837 - RNA, 20 nt, Staphylococcus aureus subsp. aureus Mu50
aucauucuguguaaauauaa

SEQ ID NO: 3979838 - RNA, 22 nt, Staphylococcus aureus subsp. aureus Mu50
aucauucuguguaaauauaaau

SEQ ID NO: 3979839 - RNA, 17 nt, Staphylococcus aureus subsp. aureus Mu50
aucauucuuuauagaaa

SEQ ID NO: 3979840 - RNA, 22 nt, Staphylococcus aureus subsp. aureus Mu50
aucauucuuuauagaaaccaaa

SEQ ID NO: 3979841 - RNA, 18 nt, Staphylococcus aureus subsp. aureus Mu50
aucauugaauguuggauc

SEQ ID NO: 3979842 - RNA, 24 nt, Staphylococcus aureus subsp. aureus Mu50
aucauugaauguuggaucggcauu

SEQ ID NO: 3979843 - RNA, 15 nt, Staphylococcus aureus subsp. aureus Mu50
aucauugguuucauc

SEQ ID NO: 3979844 - RNA, 16 nt, Staphylococcus aureus subsp. aureus Mu50
aucauugguuucauca

SEQ ID NO: 3979845 - RNA, 15 nt, Staphylococcus aureus subsp. aureus Mu50
aucauuguaaaacaa

SEQ ID NO: 3979846 - RNA, 16 nt, Staphylococcus aureus subsp. aureus Mu50
aucauuguaaaacaaa

SEQ ID NO: 3979847 - RNA, 19 nt, Staphylococcus aureus subsp. aureus Mu50
aucauuguggcuuuuuuua

SEQ ID NO: 3979848 - RNA, 23 nt, Staphylococcus aureus subsp. aureus Mu50
aucauuguguccauaaauauuaa

SEQ ID NO: 3979849 - RNA, 19 nt, Staphylococcus aureus subsp. aureus Mu50
aucauuuaaauuaguuaua

SEQ ID NO: 3979850 - RNA, 23 nt, Staphylococcus aureus subsp. aureus Mu50
aucauuuaaauuaguuauacuaa

SEQ ID NO: 3979851 - RNA, 14 nt, Staphylococcus aureus subsp. aureus Mu50
aucauuucaaauaa

SEQ ID NO: 3979852 - RNA, 16 nt, Staphylococcus aureus subsp. aureus Mu50
aucauuucaaauaaga

SEQ ID NO: 3979853 - RNA, 19 nt, Staphylococcus aureus subsp. aureus Mu50
aucauuucugucccacucc

SEQ ID NO: 3979854 - RNA, 15 nt, Staphylococcus aureus subsp. aureus Mu50
aucauuugaugcuuu

SEQ ID NO: 3979855 - RNA, 18 nt, Staphylococcus aureus subsp. aureus Mu50
aucauuuggcguucaaca

SEQ ID NO: 3979856 - RNA, 22 nt, Staphylococcus aureus subsp. aureus Mu50
aucauuugugcguuucaaugag

SEQ ID NO: 3979857 - RNA, 12 nt, Staphylococcus aureus subsp. aureus Mu50
aucauuuguguu

SEQ ID NO: 3979858 - RNA, 17 nt, Staphylococcus aureus subsp. aureus Mu50
aucauuuguguuuuuaa

SEQ ID NO: 3979859 - RNA, 18 nt, Staphylococcus aureus subsp. aureus Mu50
aucauuuguguuuuuaau

SEQ ID NO: 3979860 - RNA, 22 nt, Staphylococcus aureus subsp. aureus Mu50
aucauuuucaacauaauauuuc

SEQ ID NO: 3979861 - RNA, 15 nt, Staphylococcus aureus subsp. aureus Mu50
aucauuuucaauacu

SEQ ID NO: 3979862 - RNA, 20 nt, Staphylococcus aureus subsp. aureus Mu50
aucauuuugccucguccauu

SEQ ID NO: 3979863 - RNA, 18 nt, Staphylococcus aureus subsp. aureus Mu50
aucauuuuuaauuuugac

SEQ ID NO: 3979864 - RNA, 14 nt, Staphylococcus aureus subsp. aureus Mu50
auccaaaacauuuu

SEQ ID NO: 3979865 - RNA, 18 nt, Staphylococcus aureus subsp. aureus Mu50
auccaaaauccugaaauu

SEQ ID NO: 3979866 - RNA, 11 nt, Staphylococcus aureus subsp. aureus Mu50
auccaaaccaa

SEQ ID NO: 3979867 - RNA, 18 nt, Staphylococcus aureus subsp. aureus Mu50
auccaaaccaauuuuaac

SEQ ID NO: 3979868 - RNA, 16 nt, Staphylococcus aureus subsp. aureus Mu50
auccaaagacauacag

SEQ ID NO: 3979869 - RNA, 24 nt, Staphylococcus aureus subsp. aureus Mu50
auccaagcgcuucaggcauaacug

SEQ ID NO: 3979870 - RNA, 21 nt, Staphylococcus aureus subsp. aureus Mu50
auccaaggauguuauaaaaug

SEQ ID NO: 3979871 - RNA, 23 nt, Staphylococcus aureus subsp. aureus Mu50
aucggcuauacauugauaaauuu

SEQ ID NO: 3979872 - RNA, 14 nt, Staphylococcus aureus subsp. aureus Mu50
aucggcuuucuaag

SEQ ID NO: 3979873 - RNA, 22 nt, Staphylococcus aureus subsp. aureus Mu50
aucguaaaaaaacgucuauacu

SEQ ID NO: 3979874 - RNA, 15 nt, Staphylococcus aureus subsp. aureus Mu50
aucguaaaaaacaaa

SEQ ID NO: 3979875 - RNA, 13 nt, Staphylococcus aureus subsp. aureus Mu50
aucguaaacauaa

SEQ ID NO: 3979876 - RNA, 19 nt, Staphylococcus aureus subsp. aureus Mu50
aucguauagaugugucuuu

SEQ ID NO: 3979877 - RNA, 16 nt, Staphylococcus aureus subsp. aureus Mu50
aucguauguaacaauu

SEQ ID NO: 3979878 - RNA, 18 nt, Staphylococcus aureus subsp. aureus Mu50
aucgucaucacuuuuuaa

SEQ ID NO: 3979879 - RNA, 14 nt, Staphylococcus aureus subsp. aureus Mu50
aucgucgcuaauaa

SEQ ID NO: 3979880 - RNA, 16 nt, Staphylococcus aureus subsp. aureus Mu50
aucgugcccauaugau

SEQ ID NO: 3979881 - RNA, 17 nt, Staphylococcus aureus subsp. aureus Mu50
aucgugcccauaugauu

SEQ ID NO: 3979882 - RNA, 23 nt, Staphylococcus aureus subsp. aureus Mu50
aucguggggugccuuuuacauuu

SEQ ID NO: 3979883 - RNA, 21 nt, Staphylococcus aureus subsp. aureus Mu50
aucguuaaaacacccugcuua

SEQ ID NO: 3979884 - RNA, 21 nt, Staphylococcus aureus subsp. aureus Mu50
aucguuaauaaaccuacaaua

SEQ ID NO: 3979885 - RNA, 18 nt, Staphylococcus aureus subsp. aureus Mu50
aucguuaauguauaaaaa

SEQ ID NO: 3979886 - RNA, 20 nt, Staphylococcus aureus subsp. aureus Mu50
aucguuaauuuccaauaucu

SEQ ID NO: 3979887 - RNA, 14 nt, Staphylococcus aureus subsp. aureus Mu50
aucguugaaaaaua

SEQ ID NO: 3979888 - RNA, 13 nt, Staphylococcus aureus subsp. aureus Mu50
aucguuguaccac

SEQ ID NO: 3979889 - RNA, 16 nt, Staphylococcus aureus subsp. aureus Mu50
aucguuguaccacccc

SEQ ID NO: 3979890 - RNA, 12 nt, Staphylococcus aureus subsp. aureus Mu50
aucguuucuucc

SEQ ID NO: 3979891 - RNA, 12 nt, Staphylococcus aureus subsp. aureus Mu50
aucuaaaaugag

SEQ ID NO: 3979892 - RNA, 22 nt, Staphylococcus aureus subsp. aureus Mu50
aucuaaaaugaguuguucagau

SEQ ID NO: 3979893 - RNA, 15 nt, Staphylococcus aureus subsp. aureus Mu50
aucuaaacuauaaua

SEQ ID NO: 3979894 - RNA, 15 nt, Staphylococcus aureus subsp. aureus Mu50
aucuaaagauuucag

SEQ ID NO: 3979895 - RNA, 17 nt, Staphylococcus aureus subsp. aureus Mu50
aucuaaagcuauaaaaa

SEQ ID NO: 3979896 - RNA, 21 nt, Staphylococcus aureus subsp. aureus Mu50
aucuaaagcuauaaaaaaucu

SEQ ID NO: 3979897 - RNA, 21 nt, Staphylococcus aureus subsp. aureus Mu50
aucuaaaugcacgagcaacau

SEQ ID NO: 3979898 - RNA, 14 nt, Staphylococcus aureus subsp. aureus Mu50
aucuaacaaucguu

SEQ ID NO: 3979899 - RNA, 22 nt, Staphylococcus aureus subsp. aureus Mu50
aucuaacaaucguuuuaaugcc

SEQ ID NO: 3979900 - RNA, 21 nt, Staphylococcus aureus subsp. aureus Mu50
aucuaacuggaaaugauaauu

SEQ ID NO: 3979901 - RNA, 18 nt, Staphylococcus aureus subsp. aureus Mu50
aucuaacugugcaacaaa

SEQ ID NO: 3979902 - RNA, 13 nt, Staphylococcus aureus subsp. aureus Mu50
aucuaauaaauau

SEQ ID NO: 3979903 - RNA, 22 nt, Staphylococcus aureus subsp. aureus Mu50
aucuaauacuucaccacauaaa

SEQ ID NO: 3979904 - RNA, 15 nt, Staphylococcus aureus subsp. aureus Mu50
aucuaauacuuucac

SEQ ID NO: 3979905 - RNA, 19 nt, Staphylococcus aureus subsp. aureus Mu50
aucuaauccugguauaaug

SEQ ID NO: 3979906 - RNA, 23 nt, Staphylococcus aureus subsp. aureus Mu50
aucuaaugcaacuugaucauuau

SEQ ID NO: 3979907 - RNA, 20 nt, Staphylococcus aureus subsp. aureus Mu50
aucuaaugggucaaugacug

SEQ ID NO: 3979908 - RNA, 19 nt, Staphylococcus aureus subsp. aureus Mu50
aucuaauuauucaugaauc

SEQ ID NO: 3979909 - RNA, 14 nt, Staphylococcus aureus subsp. aureus Mu50
aucuaauucguaau

SEQ ID NO: 3979910 - RNA, 22 nt, Staphylococcus aureus subsp. aureus Mu50
aucuaauucuguuucaaagcug

SEQ ID NO: 3979911 - RNA, 23 nt, Staphylococcus aureus subsp. aureus Mu50
aucuacaauaaccauuucaucau

SEQ ID NO: 3979912 - RNA, 14 nt, Staphylococcus aureus subsp. aureus Mu50
aucuacaauauuaa

SEQ ID NO: 3979913 - RNA, 19 nt, Staphylococcus aureus subsp. aureus Mu50
aucuacaauauucaauaau

SEQ ID NO: 3979914 - RNA, 20 nt, Staphylococcus aureus subsp. aureus Mu50
aucuacaauauucaauaauu

SEQ ID NO: 3979915 - RNA, 18 nt, Staphylococcus aureus subsp. aureus Mu50
aucuacagagaaucaauu

SEQ ID NO: 3979916 - RNA, 20 nt, Staphylococcus aureus subsp. aureus Mu50
aucuacauaauuugaauuag

SEQ ID NO: 3979917 - RNA, 14 nt, Staphylococcus aureus subsp. aureus Mu50
aucuacaucaaauu

SEQ ID NO: 3979918 - RNA, 17 nt, Staphylococcus aureus subsp. aureus Mu50
aucuacaucaaauuuuu

SEQ ID NO: 3979919 - RNA, 19 nt, Staphylococcus aureus subsp. aureus Mu50
aucuacaucaaauuuuucg

SEQ ID NO: 3979920 - RNA, 21 nt, Staphylococcus aureus subsp. aureus Mu50
aucuacuaaagagaaucgaac

SEQ ID NO: 3979921 - RNA, 14 nt, Staphylococcus aureus subsp. aureus Mu50
aucuacuaagugcc

SEQ ID NO: 3979922 - RNA, 18 nt, Staphylococcus aureus subsp. aureus Mu50
aucuacucaaauauaaau

SEQ ID NO: 3979923 - RNA, 21 nt, Staphylococcus aureus subsp. aureus Mu50
aucuacucaaauauaaauaaa

SEQ ID NO: 3979924 - RNA, 14 nt, Staphylococcus aureus subsp. aureus Mu50
aucuagaauauaac

SEQ ID NO: 3979925 - RNA, 19 nt, Staphylococcus aureus subsp. aureus Mu50
aucuagccugaaauagaaa

SEQ ID NO: 3979926 - RNA, 16 nt, Staphylococcus aureus subsp. aureus Mu50
aucuagcugcuucugc

SEQ ID NO: 3979927 - RNA, 14 nt, Staphylococcus aureus subsp. aureus Mu50
aucuauaaaaagaa

SEQ ID NO: 3979928 - RNA, 15 nt, Staphylococcus aureus subsp. aureus Mu50
aucuauaaaaagaau

SEQ ID NO: 3979929 - RNA, 23 nt, Staphylococcus aureus subsp. aureus Mu50
aucuauaaaaagaauaugauauu

SEQ ID NO: 3979930 - RNA, 13 nt, Staphylococcus aureus subsp. aureus Mu50
aucuauaaauggc

SEQ ID NO: 3979931 - RNA, 17 nt, Staphylococcus aureus subsp. aureus Mu50
aucuauaauaccuaauu

SEQ ID NO: 3979932 - RNA, 21 nt, Staphylococcus aureus subsp. aureus Mu50
aucuauaauaccuaauugcuu

SEQ ID NO: 3979933 - RNA, 23 nt, Staphylococcus aureus subsp. aureus Mu50
aucuauacaauuauggauaaaau

SEQ ID NO: 3979934 - RNA, 13 nt, Staphylococcus aureus subsp. aureus Mu50
aucuauauaaaaa

SEQ ID NO: 3979935 - RNA, 12 nt, Staphylococcus aureus subsp. aureus Mu50
aucuauaugcau

SEQ ID NO: 3979936 - RNA, 14 nt, Staphylococcus aureus subsp. aureus Mu50
aucuauauuuaauu

SEQ ID NO: 3979937 - RNA, 13 nt, Staphylococcus aureus subsp. aureus Mu50
aucuaucuugugc

SEQ ID NO: 3979938 - RNA, 15 nt, Staphylococcus aureus subsp. aureus Mu50
aucuaugaaauuuuu

SEQ ID NO: 3979939 - RNA, 17 nt, Staphylococcus aureus subsp. aureus Mu50
aucuaugaaauuuuuua

SEQ ID NO: 3979940 - RNA, 20 nt, Staphylococcus aureus subsp. aureus Mu50
aucuaugcccgugaugggua

SEQ ID NO: 3979941 - RNA, 12 nt, Staphylococcus aureus subsp. aureus Mu50
aucuauucaacu

SEQ ID NO: 3979942 - RNA, 21 nt, Staphylococcus aureus subsp. aureus Mu50
aucuauugugauauaugaaau

SEQ ID NO: 3979943 - RNA, 18 nt, Staphylococcus aureus subsp. aureus Mu50
aucuauuuaauaauguau

SEQ ID NO: 3979944 - RNA, 12 nt, Staphylococcus aureus subsp. aureus Mu50
aucuauuuagcu

SEQ ID NO: 3979945 - RNA, 16 nt, Staphylococcus aureus subsp. aureus Mu50
aucuauuuaucauacu

SEQ ID NO: 3979946 - RNA, 18 nt, Staphylococcus aureus subsp. aureus Mu50
aucuauuuuaaacucauc

SEQ ID NO: 3979947 - RNA, 19 nt, Staphylococcus aureus subsp. aureus Mu50
aucuauuuuaaacucaucc

SEQ ID NO: 3979948 - RNA, 15 nt, Staphylococcus aureus subsp. aureus Mu50
aucuauuuuucgauu

SEQ ID NO: 3979949 - RNA, 20 nt, Staphylococcus aureus subsp. aureus Mu50
aucucaauccaauuaaauau

SEQ ID NO: 3979950 - RNA, 21 nt, Staphylococcus aureus subsp. aureus Mu50
aucucaauccaauuaaauauu

SEQ ID NO: 3979951 - RNA, 14 nt, Staphylococcus aureus subsp. aureus Mu50
aucucauaauaauu

SEQ ID NO: 3979952 - RNA, 20 nt, Staphylococcus aureus subsp. aureus Mu50
aucucauucuuuaauauaaa

SEQ ID NO: 3979953 - RNA, 22 nt, Staphylococcus aureus subsp. aureus Mu50
aucucauuuuuucgagaugaua

SEQ ID NO: 3979954 - RNA, 16 nt, Staphylococcus aureus subsp. aureus Mu50
aucuccauuagaacua

SEQ ID NO: 3979955 - RNA, 16 nt, Staphylococcus aureus subsp. aureus Mu50
aucucggcauuuuuau

SEQ ID NO: 3979956 - RNA, 16 nt, Staphylococcus aureus subsp. aureus Mu50
aucucguuuuuacaug

SEQ ID NO: 3979957 - RNA, 18 nt, Staphylococcus aureus subsp. aureus Mu50
aucucuaccauuucaacc

SEQ ID NO: 3979958 - RNA, 22 nt, Staphylococcus aureus subsp. aureus Mu50
aucuuuaacuucugauucuuca

SEQ ID NO: 3979959 - RNA, 18 nt, Staphylococcus aureus subsp. aureus Mu50
aucuuuaauaaccuuuaa

SEQ ID NO: 3979960 - RNA, 24 nt, Staphylococcus aureus subsp. aureus Mu50
aucuuuaaucaaaggaucauguuc

SEQ ID NO: 3979961 - RNA, 21 nt, Staphylococcus aureus subsp. aureus Mu50
aucuuuaauuuacaauuaauu

SEQ ID NO: 3979962 - RNA, 15 nt, Staphylococcus aureus subsp. aureus Mu50
aucuuuaauuucauu

SEQ ID NO: 3979963 - RNA, 21 nt, Staphylococcus aureus subsp. aureus Mu50
aucuuuaauuuucuugccauc

SEQ ID NO: 3979964 - RNA, 13 nt, Staphylococcus aureus subsp. aureus Mu50
aucuuuaccauau

SEQ ID NO: 3979965 - RNA, 22 nt, Staphylococcus aureus subsp. aureus Mu50
aucuuuagagacuuauuuuaua

SEQ ID NO: 3979966 - RNA, 20 nt, Staphylococcus aureus subsp. aureus Mu50
aucuuuagcuauguaaaauu

SEQ ID NO: 3979967 - RNA, 18 nt, Staphylococcus aureus subsp. aureus Mu50
aucuuuaguauuucauca

SEQ ID NO: 3979968 - RNA, 11 nt, Staphylococcus aureus subsp. aureus Mu50
aucuuuaucag

SEQ ID NO: 3979969 - RNA, 16 nt, Staphylococcus aureus subsp. aureus Mu50
aucuuuaucauuauuc

SEQ ID NO: 3979970 - RNA, 21 nt, Staphylococcus aureus subsp. aureus Mu50
aucuuuaucauuauucgcauc

SEQ ID NO: 3979971 - RNA, 16 nt, Staphylococcus aureus subsp. aureus Mu50
aucuuuaugcaaaauu

SEQ ID NO: 3979972 - RNA, 18 nt, Staphylococcus aureus subsp. aureus Mu50
aucuuuauugguaggagg

SEQ ID NO: 3979973 - RNA, 14 nt, Staphylococcus aureus subsp. aureus Mu50
aucuuuauuuuuua

SEQ ID NO: 3979974 - RNA, 14 nt, Staphylococcus aureus subsp. aureus Mu50
aucuuucaaaguau

SEQ ID NO: 3979975 - RNA, 15 nt, Staphylococcus aureus subsp. aureus Mu50
aucuuucaaaugcuu

SEQ ID NO: 3979976 - RNA, 15 nt, Staphylococcus aureus subsp. aureus Mu50
aucuuucaauuaauu

SEQ ID NO: 3979977 - RNA, 13 nt, Staphylococcus aureus subsp. aureus Mu50
aucuuucacaauu

SEQ ID NO: 3979978 - RNA, 22 nt, Staphylococcus aureus subsp. aureus Mu50
aucuuucacaauuguauaaugu

SEQ ID NO: 3979979 - RNA, 18 nt, Staphylococcus aureus subsp. aureus Mu50
aucuuuccacggcauuua

SEQ ID NO: 3979980 - RNA, 19 nt, Staphylococcus aureus subsp. aureus Mu50
aucuuucgagguaauuuca

SEQ ID NO: 3979981 - RNA, 15 nt, Staphylococcus aureus subsp. aureus Mu50
aucuuucuuuguguu

SEQ ID NO: 3979982 - RNA, 18 nt, Staphylococcus aureus subsp. aureus Mu50
aucuuugacauguguuaa

SEQ ID NO: 3979983 - RNA, 17 nt, Staphylococcus aureus subsp. aureus Mu50
aucuuuguaaauuuuua

SEQ ID NO: 3979984 - RNA, 19 nt, Staphylococcus aureus subsp. aureus Mu50
aucuuuguaaauuuuuaag

SEQ ID NO: 3979985 - RNA, 21 nt, Staphylococcus aureus subsp. aureus Mu50
aucuuuguaaccuaaaaacaa

SEQ ID NO: 3979986 - RNA, 22 nt, Staphylococcus aureus subsp. aureus Mu50
aucuuuguaaccuaaaaacaaa

SEQ ID NO: 3979987 - RNA, 23 nt, Staphylococcus aureus subsp. aureus Mu50
aucuuuguaugcaucaguuaaua

SEQ ID NO: 3979988 - RNA, 19 nt, Staphylococcus aureus subsp. aureus Mu50
aucuuuguuauauuuuuag

SEQ ID NO: 3979989 - RNA, 18 nt, Staphylococcus aureus subsp. aureus Mu50
aucuuuguugcaaugcau

SEQ ID NO: 3979990 - RNA, 14 nt, Staphylococcus aureus subsp. aureus Mu50
aucuuuuaaauuua

SEQ ID NO: 3979991 - RNA, 17 nt, Staphylococcus aureus subsp. aureus Mu50
aucuuuuaauucuuaau

SEQ ID NO: 3979992 - RNA, 11 nt, Staphylococcus aureus subsp. aureus Mu50
aucuuuuacua

SEQ ID NO: 3979993 - RNA, 18 nt, Staphylococcus aureus subsp. aureus Mu50
aucuuuuacuaaaugaau

SEQ ID NO: 3979994 - RNA, 16 nt, Staphylococcus aureus subsp. aureus Mu50
aucuuuuauaaugaac

SEQ ID NO: 3979995 - RNA, 21 nt, Staphylococcus aureus subsp. aureus Mu50
aucuuuuauaaugaacaacaa

SEQ ID NO: 3979996 - RNA, 23 nt, Staphylococcus aureus subsp. aureus Mu50
aucuuuuauccaauguauaaaac

SEQ ID NO: 3979997 - RNA, 11 nt, Staphylococcus aureus subsp. aureus Mu50
aucuuuuaugg

SEQ ID NO: 3979998 - RNA, 18 nt, Staphylococcus aureus subsp. aureus Mu50
aucuuuuccauucauaaa

SEQ ID NO: 3979999 - RNA, 19 nt, Staphylococcus aureus subsp. aureus Mu50
aucuuuuccauucauaaaa

SEQ ID NO: 3980000 - RNA, 23 nt, Staphylococcus aureus subsp. aureus Mu50
aucuuuugcguccucaugacauu

SEQ ID NO: 3980001 - RNA, 19 nt, Staphylococcus aureus subsp. aureus Mu50
aucuuuugcuguaucuuca

SEQ ID NO: 3980002 - RNA, 19 nt, Staphylococcus aureus subsp. aureus Mu50
aucuuuugucuuacuaauu

SEQ ID NO: 3980003 - RNA, 13 nt, Staphylococcus aureus subsp. aureus Mu50
aucuuuuguuguu

SEQ ID NO: 3980004 - RNA, 14 nt, Staphylococcus aureus subsp. aureus Mu50
aucuuuuucaugcu

SEQ ID NO: 3980005 - RNA, 18 nt, Staphylococcus aureus subsp. aureus Mu50
aucuuuuucaugcuauuu

SEQ ID NO: 3980006 - RNA, 16 nt, Staphylococcus aureus subsp. aureus Mu50
aucuuuuuuacuaaaa

SEQ ID NO: 3980007 - RNA, 17 nt, Staphylococcus aureus subsp. aureus Mu50
aucuuuuuuacuaaaau

SEQ ID NO: 3980008 - RNA, 13 nt, Staphylococcus aureus subsp. aureus Mu50
aucuuuuuuuaau

SEQ ID NO: 3980009 - RNA, 22 nt, Staphylococcus aureus subsp. aureus Mu50
aucuuuuuuuaauuaaguuaaa

SEQ ID NO: 3980010 - RNA, 14 nt, Staphylococcus aureus subsp. aureus Mu50
aucuuuuuuuuuau

SEQ ID NO: 3980011 - RNA, 18 nt, Staphylococcus aureus subsp. aureus Mu50
augaaaacuuaaaaauga

SEQ ID NO: 3980012 - RNA, 11 nt, Staphylococcus aureus subsp. aureus Mu50
augaaaaguug

SEQ ID NO: 3980013 - RNA, 17 nt, Staphylococcus aureus subsp. aureus Mu50
augaaaauaagcuugua

SEQ ID NO: 3980014 - RNA, 20 nt, Staphylococcus aureus subsp. aureus Mu50
augaaaauaagcuuguaaca

SEQ ID NO: 3980015 - RNA, 18 nt, Staphylococcus aureus subsp. aureus Mu50
augaaaauaccucuacau

SEQ ID NO: 3980016 - RNA, 19 nt, Staphylococcus aureus subsp. aureus Mu50
augaaaauaccucuacauu

SEQ ID NO: 3980017 - RNA, 22 nt, Staphylococcus aureus subsp. aureus Mu50
augaaaauaccucuacauuaua

SEQ ID NO: 3980018 - RNA, 23 nt, Staphylococcus aureus subsp. aureus Mu50
augaaaauaccucuacauuauau

SEQ ID NO: 3980019 - RNA, 16 nt, Staphylococcus aureus subsp. aureus Mu50
augaaagcaucuugca

SEQ ID NO: 3980020 - RNA, 18 nt, Staphylococcus aureus subsp. aureus Mu50
augaaaguaccuaaaaua

SEQ ID NO: 3980021 - RNA, 22 nt, Staphylococcus aureus subsp. aureus Mu50
augaaaguaccuaaaauagaaa

SEQ ID NO: 3980022 - RNA, 15 nt, Staphylococcus aureus subsp. aureus Mu50
augaaauaacaauag

SEQ ID NO: 3980023 - RNA, 22 nt, Staphylococcus aureus subsp. aureus Mu50
augaaauaacaauagugacuuu

SEQ ID NO: 3980024 - RNA, 16 nt, Staphylococcus aureus subsp. aureus Mu50
augaaauuagauuuua

SEQ ID NO: 3980025 - RNA, 22 nt, Staphylococcus aureus subsp. aureus Mu50
augaaauuggaauagauguuga

SEQ ID NO: 3980026 - RNA, 21 nt, Staphylococcus aureus subsp. aureus Mu50
augaaauuguguugaaucaac

SEQ ID NO: 3980027 - RNA, 14 nt, Staphylococcus aureus subsp. aureus Mu50
augaaauuuuuuau

SEQ ID NO: 3980028 - RNA, 14 nt, Staphylococcus aureus subsp. aureus Mu50
augaacaaaauaac

SEQ ID NO: 3980029 - RNA, 18 nt, Staphylococcus aureus subsp. aureus Mu50
augaacaaaauaacaugu

SEQ ID NO: 3980030 - RNA, 20 nt, Staphylococcus aureus subsp. aureus Mu50
augaacaaaauaacauguuu

SEQ ID NO: 3980031 - RNA, 15 nt, Staphylococcus aureus subsp. aureus Mu50
augaacaacaaauug

SEQ ID NO: 3980032 - RNA, 14 nt, Staphylococcus aureus subsp. aureus Mu50
augaacauaccugc

SEQ ID NO: 3980033 - RNA, 21 nt, Staphylococcus aureus subsp. aureus Mu50
augaaccagcuaaccaaauaa

SEQ ID NO: 3980034 - RNA, 20 nt, Staphylococcus aureus subsp. aureus Mu50
augaacuuaaugcuucaaau

SEQ ID NO: 3980035 - RNA, 22 nt, Staphylococcus aureus subsp. aureus Mu50
augaacuucuacaguuggaggu

SEQ ID NO: 3980036 - RNA, 12 nt, Staphylococcus aureus subsp. aureus Mu50
augaacuuuuau

SEQ ID NO: 3980037 - RNA, 17 nt, Staphylococcus aureus subsp. aureus Mu50
augaacuuuuauugcca

SEQ ID NO: 3980038 - RNA, 14 nt, Staphylococcus aureus subsp. aureus Mu50
augaagaauacaaa

SEQ ID NO: 3980039 - RNA, 13 nt, Staphylococcus aureus subsp. aureus Mu50
augaaggcuuuga

SEQ ID NO: 3980040 - RNA, 19 nt, Staphylococcus aureus subsp. aureus Mu50
augaaggcuuuuuguuuug

SEQ ID NO: 3980041 - RNA, 21 nt, Staphylococcus aureus subsp. aureus Mu50
augaaggcuuuuuguuuugaa

SEQ ID NO: 3980042 - RNA, 22 nt, Staphylococcus aureus subsp. aureus Mu50
augaaguaauauauaaaagucg

SEQ ID NO: 3980043 - RNA, 17 nt, Staphylococcus aureus subsp. aureus Mu50
augaagugaaaucauuu

SEQ ID NO: 3980044 - RNA, 16 nt, Staphylococcus aureus subsp. aureus Mu50
augaaguugguuuaga

SEQ ID NO: 3980045 - RNA, 17 nt, Staphylococcus aureus subsp. aureus Mu50
augauaauuuaauaacg

SEQ ID NO: 3980046 - RNA, 12 nt, Staphylococcus aureus subsp. aureus Mu50
augauacauuau

SEQ ID NO: 3980047 - RNA, 20 nt, Staphylococcus aureus subsp. aureus Mu50
augauacauuauuaaauaga

SEQ ID NO: 3980048 - RNA, 18 nt, Staphylococcus aureus subsp. aureus Mu50
augauacgccuaaauauu

SEQ ID NO: 3980049 - RNA, 18 nt, Staphylococcus aureus subsp. aureus Mu50
augauacgcuuuuuaaaa

SEQ ID NO: 3980050 - RNA, 21 nt, Staphylococcus aureus subsp. aureus Mu50
augauacgcuuuuuaaaaaau

SEQ ID NO: 3980051 - RNA, 22 nt, Staphylococcus aureus subsp. aureus Mu50
augauacgcuuuuuaaaaaauu

SEQ ID NO: 3980052 - RNA, 19 nt, Staphylococcus aureus subsp. aureus Mu50
augauacgugguuuuauuu

SEQ ID NO: 3980053 - RNA, 16 nt, Staphylococcus aureus subsp. aureus Mu50
augauacucaauaaaa

SEQ ID NO: 3980054 - RNA, 18 nt, Staphylococcus aureus subsp. aureus Mu50
augauacucaauaaaauu

SEQ ID NO: 3980055 - RNA, 17 nt, Staphylococcus aureus subsp. aureus Mu50
augauacugauauuuag

SEQ ID NO: 3980056 - RNA, 14 nt, Staphylococcus aureus subsp. aureus Mu50
augauacuguauuu

SEQ ID NO: 3980057 - RNA, 22 nt, Staphylococcus aureus subsp. aureus Mu50
augauagaauacuaaaaguguu

SEQ ID NO: 3980058 - RNA, 16 nt, Staphylococcus aureus subsp. aureus Mu50
augauagcaaugaauu

SEQ ID NO: 3980059 - RNA, 19 nt, Staphylococcus aureus subsp. aureus Mu50
augauagcaaugaauuaau

SEQ ID NO: 3980060 - RNA, 19 nt, Staphylococcus aureus subsp. aureus Mu50
augauagcgugauuuuuca

SEQ ID NO: 3980061 - RNA, 18 nt, Staphylococcus aureus subsp. aureus Mu50
augauagcuaaacauuuu

SEQ ID NO: 3980062 - RNA, 15 nt, Staphylococcus aureus subsp. aureus Mu50
augauaguacauuua

SEQ ID NO: 3980063 - RNA, 19 nt, Staphylococcus aureus subsp. aureus Mu50
augauaguguauguuuuug

SEQ ID NO: 3980064 - RNA, 17 nt, Staphylococcus aureus subsp. aureus Mu50
augauaucuuuuccaaa

SEQ ID NO: 3980065 - RNA, 15 nt, Staphylococcus aureus subsp. aureus Mu50
augauauguucgcuu

SEQ ID NO: 3980066 - RNA, 20 nt, Staphylococcus aureus subsp. aureus Mu50
augauauuaggcuuaaauau

SEQ ID NO: 3980067 - RNA, 22 nt, Staphylococcus aureus subsp. aureus Mu50
augauauugaaaguguaugcau

SEQ ID NO: 3980068 - RNA, 20 nt, Staphylococcus aureus subsp. aureus Mu50
augauauugauuugauucau

SEQ ID NO: 3980069 - RNA, 22 nt, Staphylococcus aureus subsp. aureus Mu50
augauauugauuugauucauua

SEQ ID NO: 3980070 - RNA, 15 nt, Staphylococcus aureus subsp. aureus Mu50
augauauuuaacaaa

SEQ ID NO: 3980071 - RNA, 16 nt, Staphylococcus aureus subsp. aureus Mu50
augauauuuaacaaaa

SEQ ID NO: 3980072 - RNA, 18 nt, Staphylococcus aureus subsp. aureus Mu50
augauauuuaacaaaauu

SEQ ID NO: 3980073 - RNA, 14 nt, Staphylococcus aureus subsp. aureus Mu50
augauauuucuaaa

SEQ ID NO: 3980074 - RNA, 22 nt, Staphylococcus aureus subsp. aureus Mu50
augaucaagcugagcuuuaauu

SEQ ID NO: 3980075 - RNA, 15 nt, Staphylococcus aureus subsp. aureus Mu50
augauccuuuaaugc

SEQ ID NO: 3980076 - RNA, 22 nt, Staphylococcus aureus subsp. aureus Mu50
augaucuuuguagccuucaacu

SEQ ID NO: 3980077 - RNA, 21 nt, Staphylococcus aureus subsp. aureus Mu50
augaugaauuguuguacaugu

SEQ ID NO: 3980078 - RNA, 15 nt, Staphylococcus aureus subsp. aureus Mu50
augaugacaucaaua

SEQ ID NO: 3980079 - RNA, 15 nt, Staphylococcus aureus subsp. aureus Mu50
augaugagauaaaau

SEQ ID NO: 3980080 - RNA, 19 nt, Staphylococcus aureus subsp. aureus Mu50
augaugagauaaaaucaua

SEQ ID NO: 3980081 - RNA, 16 nt, Staphylococcus aureus subsp. aureus Mu50
augaugauuuauaaaa

SEQ ID NO: 3980082 - RNA, 11 nt, Staphylococcus aureus subsp. aureus Mu50
augaugcacua

SEQ ID NO: 3980083 - RNA, 13 nt, Staphylococcus aureus subsp. aureus Mu50
augaugcauaaga

SEQ ID NO: 3980084 - RNA, 15 nt, Staphylococcus aureus subsp. aureus Mu50
augaugcgcuucuaa

SEQ ID NO: 3980085 - RNA, 20 nt, Staphylococcus aureus subsp. aureus Mu50
augaugcgcuucuaacucac

SEQ ID NO: 3980086 - RNA, 21 nt, Staphylococcus aureus subsp. aureus Mu50
augaugcuucgcaucacugca

SEQ ID NO: 3980087 - RNA, 21 nt, Staphylococcus aureus subsp. aureus Mu50
augaugcuucuaacugaauua

SEQ ID NO: 3980088 - RNA, 21 nt, Staphylococcus aureus subsp. aureus Mu50
augaugcuucucacaacugca

SEQ ID NO: 3980089 - RNA, 22 nt, Staphylococcus aureus subsp. aureus Mu50
augauggguauuuuguucaguu

SEQ ID NO: 3980090 - RNA, 16 nt, Staphylococcus aureus subsp. aureus Mu50
augaugucauguauug

SEQ ID NO: 3980091 - RNA, 23 nt, Staphylococcus aureus subsp. aureus Mu50
augaugugcuuuaucaacaaauu

SEQ ID NO: 3980092 - RNA, 17 nt, Staphylococcus aureus subsp. aureus Mu50
augauuaaaaaucaaag

SEQ ID NO: 3980093 - RNA, 18 nt, Staphylococcus aureus subsp. aureus Mu50
augauuaaaaaucaaaga

SEQ ID NO: 3980094 - RNA, 16 nt, Staphylococcus aureus subsp. aureus Mu50
augauuaacuuucuaa

SEQ ID NO: 3980095 - RNA, 14 nt, Staphylococcus aureus subsp. aureus Mu50
augauuaauaacau

SEQ ID NO: 3980096 - RNA, 16 nt, Staphylococcus aureus subsp. aureus Mu50
augauuaauuaaagau

SEQ ID NO: 3980097 - RNA, 18 nt, Staphylococcus aureus subsp. aureus Mu50
augauuacaacuuauucu

SEQ ID NO: 3980098 - RNA, 23 nt, Staphylococcus aureus subsp. aureus Mu50
augauuacguugguuuaaaaauu

SEQ ID NO: 3980099 - RNA, 23 nt, Staphylococcus aureus subsp. aureus Mu50
augauuagcgcaccaauuaucaa

SEQ ID NO: 3980100 - RNA, 14 nt, Staphylococcus aureus subsp. aureus Mu50
augauuaguaauga

SEQ ID NO: 3980101 - RNA, 17 nt, Staphylococcus aureus subsp. aureus Mu50
augauuauauuuucuca

SEQ ID NO: 3980102 - RNA, 14 nt, Staphylococcus aureus subsp. aureus Mu50
augauucguauuca

SEQ ID NO: 3980103 - RNA, 16 nt, Staphylococcus aureus subsp. aureus Mu50
augauucguauucaaa

SEQ ID NO: 3980104 - RNA, 18 nt, Staphylococcus aureus subsp. aureus Mu50
augauucguauucaaagu

SEQ ID NO: 3980105 - RNA, 17 nt, Staphylococcus aureus subsp. aureus Mu50
augauugcaaauuauca

SEQ ID NO: 3980106 - RNA, 16 nt, Staphylococcus aureus subsp. aureus Mu50
augauugguauacagu

SEQ ID NO: 3980107 - RNA, 23 nt, Staphylococcus aureus subsp. aureus Mu50
augauugguuugugauuuuuuga

SEQ ID NO: 3980108 - RNA, 15 nt, Staphylococcus aureus subsp. aureus Mu50
augauuguaauaucu

SEQ ID NO: 3980109 - RNA, 22 nt, Staphylococcus aureus subsp. aureus Mu50
augauuguaauaucuaaagauu

SEQ ID NO: 3980110 - RNA, 14 nt, Staphylococcus aureus subsp. aureus Mu50
augauuuacuaaug

SEQ ID NO: 3980111 - RNA, 14 nt, Staphylococcus aureus subsp. aureus Mu50
augauuuauaaaaa

SEQ ID NO: 3980112 - RNA, 16 nt, Staphylococcus aureus subsp. aureus Mu50
augauuuauaaaaacu

SEQ ID NO: 3980113 - RNA, 21 nt, Staphylococcus aureus subsp. aureus Mu50
augauuucacuucauaaagcg

SEQ ID NO: 3980114 - RNA, 12 nt, Staphylococcus aureus subsp. aureus Mu50
augauuugauuu

SEQ ID NO: 3980115 - RNA, 14 nt, Staphylococcus aureus subsp. aureus Mu50
augauuuucuuuaa

SEQ ID NO: 3980116 - RNA, 22 nt, Staphylococcus aureus subsp. aureus Mu50
augauuuuuauuauugucauca

SEQ ID NO: 3980117 - RNA, 22 nt, Staphylococcus aureus subsp. aureus Mu50
augcaaaucucgucacauauaa

SEQ ID NO: 3980118 - RNA, 20 nt, Staphylococcus aureus subsp. aureus Mu50
augcaaguuggcggggcccc

SEQ ID NO: 3980119 - RNA, 12 nt, Staphylococcus aureus subsp. aureus Mu50
augcaauacauu

SEQ ID NO: 3980120 - RNA, 18 nt, Staphylococcus aureus subsp. aureus Mu50
augcaauacauuaauaua

SEQ ID NO: 3980121 - RNA, 13 nt, Staphylococcus aureus subsp. aureus Mu50
augcacaauauuc

SEQ ID NO: 3980122 - RNA, 19 nt, Staphylococcus aureus subsp. aureus Mu50
augcacaauauucguagca

SEQ ID NO: 3980123 - RNA, 22 nt, Staphylococcus aureus subsp. aureus Mu50
augcacaccagccucuauaagu

SEQ ID NO: 3980124 - RNA, 15 nt, Staphylococcus aureus subsp. aureus Mu50
augcaccaacaauag

SEQ ID NO: 3980125 - RNA, 20 nt, Staphylococcus aureus subsp. aureus Mu50
augcacuaaauuagcaacga

SEQ ID NO: 3980126 - RNA, 14 nt, Staphylococcus aureus subsp. aureus Mu50
augcacuccuauug

SEQ ID NO: 3980127 - RNA, 14 nt, Staphylococcus aureus subsp. aureus Mu50
augcacugcuaaua

SEQ ID NO: 3980128 - RNA, 17 nt, Staphylococcus aureus subsp. aureus Mu50
augcacuuuaacauaac

SEQ ID NO: 3980129 - RNA, 15 nt, Staphylococcus aureus subsp. aureus Mu50
augcaguaaaaccaa

SEQ ID NO: 3980130 - RNA, 14 nt, Staphylococcus aureus subsp. aureus Mu50
augcauaauaccaa

SEQ ID NO: 3980131 - RNA, 13 nt, Staphylococcus aureus subsp. aureus Mu50
augcauauauaua

SEQ ID NO: 3980132 - RNA, 18 nt, Staphylococcus aureus subsp. aureus Mu50
auggcgcaauuuuuaaca

SEQ ID NO: 3980133 - RNA, 21 nt, Staphylococcus aureus subsp. aureus Mu50
auggcgcaauuuuuaacaaaa

SEQ ID NO: 3980134 - RNA, 20 nt, Staphylococcus aureus subsp. aureus Mu50
auggcgggcccccaacacaa

SEQ ID NO: 3980135 - RNA, 15 nt, Staphylococcus aureus subsp. aureus Mu50
auggcuucgcuaaua

SEQ ID NO: 3980136 - RNA, 20 nt, Staphylococcus aureus subsp. aureus Mu50
auggcuucucuuaguuuuaa

SEQ ID NO: 3980137 - RNA, 18 nt, Staphylococcus aureus subsp. aureus Mu50
auggcuugguuauuuuca

SEQ ID NO: 3980138 - RNA, 22 nt, Staphylococcus aureus subsp. aureus Mu50
augggaauuguauuagcaauuu

SEQ ID NO: 3980139 - RNA, 13 nt, Staphylococcus aureus subsp. aureus Mu50
augggagaaauuu

SEQ ID NO: 3980140 - RNA, 17 nt, Staphylococcus aureus subsp. aureus Mu50
augggagaaauuuuuca

SEQ ID NO: 3980141 - RNA, 20 nt, Staphylococcus aureus subsp. aureus Mu50
augggccccaacaaagagaa

SEQ ID NO: 3980142 - RNA, 19 nt, Staphylococcus aureus subsp. aureus Mu50
augggggauuuuuuuaugu

SEQ ID NO: 3980143 - RNA, 17 nt, Staphylococcus aureus subsp. aureus Mu50
auggguaaucuuuagga

SEQ ID NO: 3980144 - RNA, 15 nt, Staphylococcus aureus subsp. aureus Mu50
auggguaguuaauau

SEQ ID NO: 3980145 - RNA, 21 nt, Staphylococcus aureus subsp. aureus Mu50
auggguauccuucucaucauu

SEQ ID NO: 3980146 - RNA, 22 nt, Staphylococcus aureus subsp. aureus Mu50
auggguauuuuguucaguuaaa

SEQ ID NO: 3980147 - RNA, 23 nt, Staphylococcus aureus subsp. aureus Mu50
augggucaaugacugagaaaaau

SEQ ID NO: 3980148 - RNA, 18 nt, Staphylococcus aureus subsp. aureus Mu50
augguaaguauaauuaaa

SEQ ID NO: 3980149 - RNA, 14 nt, Staphylococcus aureus subsp. aureus Mu50
augguaucuuuaau

SEQ ID NO: 3980150 - RNA, 22 nt, Staphylococcus aureus subsp. aureus Mu50
augguaucuuuaauuucauuua

SEQ ID NO: 3980151 - RNA, 20 nt, Staphylococcus aureus subsp. aureus Mu50
augguauugcuuuacuaauu

SEQ ID NO: 3980152 - RNA, 17 nt, Staphylococcus aureus subsp. aureus Mu50
auggucaacuuuuuuaa

SEQ ID NO: 3980153 - RNA, 21 nt, Staphylococcus aureus subsp. aureus Mu50
auggucaaucacuccucuauu

SEQ ID NO: 3980154 - RNA, 20 nt, Staphylococcus aureus subsp. aureus Mu50
auggucuuuuaauuaaaagu

SEQ ID NO: 3980155 - RNA, 15 nt, Staphylococcus aureus subsp. aureus Mu50
auggugaacuguuaa

SEQ ID NO: 3980156 - RNA, 18 nt, Staphylococcus aureus subsp. aureus Mu50
auggugaacuguuaaacu

SEQ ID NO: 3980157 - RNA, 13 nt, Staphylococcus aureus subsp. aureus Mu50
augguguuaaguu

SEQ ID NO: 3980158 - RNA, 14 nt, Staphylococcus aureus subsp. aureus Mu50
augguguuaaguuu

SEQ ID NO: 3980159 - RNA, 23 nt, Staphylococcus aureus subsp. aureus Mu50
augguuaauaacccauuuucaaa

SEQ ID NO: 3980160 - RNA, 16 nt, Staphylococcus aureus subsp. aureus Mu50
augguuagagaaaaau

SEQ ID NO: 3980161 - RNA, 20 nt, Staphylococcus aureus subsp. aureus Mu50
augguuaucuuaucgaaaga

SEQ ID NO: 3980162 - RNA, 17 nt, Staphylococcus aureus subsp. aureus Mu50
augguuccaaguauuuu

SEQ ID NO: 3980163 - RNA, 19 nt, Staphylococcus aureus subsp. aureus Mu50
augguuccaaguauuuucu

SEQ ID NO: 3980164 - RNA, 15 nt, Staphylococcus aureus subsp. aureus Mu50
augguugaucgaaua

SEQ ID NO: 3980165 - RNA, 20 nt, Staphylococcus aureus subsp. aureus Mu50
augguugauuacaauuguuc

SEQ ID NO: 3980166 - RNA, 13 nt, Staphylococcus aureus subsp. aureus Mu50
augguugucucca

SEQ ID NO: 3980167 - RNA, 13 nt, Staphylococcus aureus subsp. aureus Mu50
augguuucuuauu

SEQ ID NO: 3980168 - RNA, 21 nt, Staphylococcus aureus subsp. aureus Mu50
augguuuucuuuuuaucauga

SEQ ID NO: 3980169 - RNA, 13 nt, Staphylococcus aureus subsp. aureus Mu50
auguaaaaaauau

SEQ ID NO: 3980170 - RNA, 18 nt, Staphylococcus aureus subsp. aureus Mu50
auguaaaaaauaucuugu

SEQ ID NO: 3980171 - RNA, 15 nt, Staphylococcus aureus subsp. aureus Mu50
auguaaaauuagcaa

SEQ ID NO: 3980172 - RNA, 20 nt, Staphylococcus aureus subsp. aureus Mu50
auguaaagcuaauuuuuuau

SEQ ID NO: 3980173 - RNA, 17 nt, Staphylococcus aureus subsp. aureus Mu50
auguaaauaguuaguuu

SEQ ID NO: 3980174 - RNA, 18 nt, Staphylococcus aureus subsp. aureus Mu50
auguaaaugaaauaggcg

SEQ ID NO: 3980175 - RNA, 16 nt, Staphylococcus aureus subsp. aureus Mu50
auguaacaauuuagca

SEQ ID NO: 3980176 - RNA, 13 nt, Staphylococcus aureus subsp. aureus Mu50
auguaacauaaag

SEQ ID NO: 3980177 - RNA, 22 nt, Staphylococcus aureus subsp. aureus Mu50
auguaacauaaagcuguuuauu

SEQ ID NO: 3980178 - RNA, 19 nt, Staphylococcus aureus subsp. aureus Mu50
auguaacauuaaaaauaaa

SEQ ID NO: 3980179 - RNA, 17 nt, Staphylococcus aureus subsp. aureus Mu50
auguaagcuaucguaaa

SEQ ID NO: 3980180 - RNA, 15 nt, Staphylococcus aureus subsp. aureus Mu50
auguaauagagaagg

SEQ ID NO: 3980181 - RNA, 21 nt, Staphylococcus aureus subsp. aureus Mu50
auguaaugauacaaacccaua

SEQ ID NO: 3980182 - RNA, 15 nt, Staphylococcus aureus subsp. aureus Mu50
auguacaauuuuuaa

SEQ ID NO: 3980183 - RNA, 18 nt, Staphylococcus aureus subsp. aureus Mu50
auguacaauuuuuaaaaa

SEQ ID NO: 3980184 - RNA, 15 nt, Staphylococcus aureus subsp. aureus Mu50
auguacaauuuuuua

SEQ ID NO: 3980185 - RNA, 14 nt, Staphylococcus aureus subsp. aureus Mu50
auguacacuuuuga

SEQ ID NO: 3980186 - RNA, 14 nt, Staphylococcus aureus subsp. aureus Mu50
auguacaguuacuu

SEQ ID NO: 3980187 - RNA, 22 nt, Staphylococcus aureus subsp. aureus Mu50
auguaccacucauaaucaaguc

SEQ ID NO: 3980188 - RNA, 22 nt, Staphylococcus aureus subsp. aureus Mu50
auguaccgaauccuucaucaau

SEQ ID NO: 3980189 - RNA, 23 nt, Staphylococcus aureus subsp. aureus Mu50
auguaccgaauccuucaucaaua

SEQ ID NO: 3980190 - RNA, 16 nt, Staphylococcus aureus subsp. aureus Mu50
auguacuacuuuauuu

SEQ ID NO: 3980191 - RNA, 12 nt, Staphylococcus aureus subsp. aureus Mu50
auguacuauaaa

SEQ ID NO: 3980192 - RNA, 16 nt, Staphylococcus aureus subsp. aureus Mu50
auguacuauaaauccu

SEQ ID NO: 3980193 - RNA, 22 nt, Staphylococcus aureus subsp. aureus Mu50
auguacuauuaucuauccauuu

SEQ ID NO: 3980194 - RNA, 14 nt, Staphylococcus aureus subsp. aureus Mu50
auguacuucaauuu

SEQ ID NO: 3980195 - RNA, 22 nt, Staphylococcus aureus subsp. aureus Mu50
auguacuuuucugucuguaaau

SEQ ID NO: 3980196 - RNA, 18 nt, Staphylococcus aureus subsp. aureus Mu50
auguagauggacaguuuu

SEQ ID NO: 3980197 - RNA, 19 nt, Staphylococcus aureus subsp. aureus Mu50
auguagcaggcaacuuuua

SEQ ID NO: 3980198 - RNA, 19 nt, Staphylococcus aureus subsp. aureus Mu50
auguaggcgccauaaucau

SEQ ID NO: 3980199 - RNA, 20 nt, Staphylococcus aureus subsp. aureus Mu50
auguaggcgccauaaucauu

SEQ ID NO: 3980200 - RNA, 19 nt, Staphylococcus aureus subsp. aureus Mu50
auguauaaaacagaauuuc

SEQ ID NO: 3980201 - RNA, 20 nt, Staphylococcus aureus subsp. aureus Mu50
auguauaaaaccuucaauca

SEQ ID NO: 3980202 - RNA, 16 nt, Staphylococcus aureus subsp. aureus Mu50
auguauaacauuauua

SEQ ID NO: 3980203 - RNA, 20 nt, Staphylococcus aureus subsp. aureus Mu50
auguauaacauuauuaaaca

SEQ ID NO: 3980204 - RNA, 19 nt, Staphylococcus aureus subsp. aureus Mu50
auguauaucgacaccauuu

SEQ ID NO: 3980205 - RNA, 15 nt, Staphylococcus aureus subsp. aureus Mu50
auguauaucuuuauu

SEQ ID NO: 3980206 - RNA, 14 nt, Staphylococcus aureus subsp. aureus Mu50
auguauaugaauuu

SEQ ID NO: 3980207 - RNA, 22 nt, Staphylococcus aureus subsp. aureus Mu50
auguauaugaauuuuauaaauu

SEQ ID NO: 3980208 - RNA, 20 nt, Staphylococcus aureus subsp. aureus Mu50
auguauauuuaacaucaauu

SEQ ID NO: 3980209 - RNA, 15 nt, Staphylococcus aureus subsp. aureus Mu50
auguaucaccuaauu

SEQ ID NO: 3980210 - RNA, 16 nt, Staphylococcus aureus subsp. aureus Mu50
auguaugagucaaauu

SEQ ID NO: 3980211 - RNA, 22 nt, Staphylococcus aureus subsp. aureus Mu50
auguauguuuuaucaauauuag

SEQ ID NO: 3980212 - RNA, 22 nt, Staphylococcus aureus subsp. aureus Mu50
auguauugcuauaagaacuaau

SEQ ID NO: 3980213 - RNA, 13 nt, Staphylococcus aureus subsp. aureus Mu50
auguauuguaaug

SEQ ID NO: 3980214 - RNA, 19 nt, Staphylococcus aureus subsp. aureus Mu50
auguauuuaguaucaugau

SEQ ID NO: 3980215 - RNA, 15 nt, Staphylococcus aureus subsp. aureus Mu50
auguauuuuucuuaa

SEQ ID NO: 3980216 - RNA, 20 nt, Staphylococcus aureus subsp. aureus Mu50
auguauuuuucuuaauuauc

SEQ ID NO: 3980217 - RNA, 19 nt, Staphylococcus aureus subsp. aureus Mu50
augucaauuuuuucaugau

SEQ ID NO: 3980218 - RNA, 15 nt, Staphylococcus aureus subsp. aureus Mu50
augucacauaugacu

SEQ ID NO: 3980219 - RNA, 22 nt, Staphylococcus aureus subsp. aureus Mu50
auguugaagggaguauuuuuua

SEQ ID NO: 3980220 - RNA, 21 nt, Staphylococcus aureus subsp. aureus Mu50
auguugaauguggaacaugau

SEQ ID NO: 3980221 - RNA, 15 nt, Staphylococcus aureus subsp. aureus Mu50
auguugauucguuau

SEQ ID NO: 3980222 - RNA, 16 nt, Staphylococcus aureus subsp. aureus Mu50
auguugcuuaucaaca

SEQ ID NO: 3980223 - RNA, 20 nt, Staphylococcus aureus subsp. aureus Mu50
auguuggaaaaggucaaaaa

SEQ ID NO: 3980224 - RNA, 22 nt, Staphylococcus aureus subsp. aureus Mu50
auguuggaucggcauuguaaaa

SEQ ID NO: 3980225 - RNA, 18 nt, Staphylococcus aureus subsp. aureus Mu50
auguugguucaucaaaca

SEQ ID NO: 3980226 - RNA, 20 nt, Staphylococcus aureus subsp. aureus Mu50
auguugguucaucaaacaac

SEQ ID NO: 3980227 - RNA, 18 nt, Staphylococcus aureus subsp. aureus Mu50
auguugucacuuggauuc

SEQ ID NO: 3980228 - RNA, 15 nt, Staphylococcus aureus subsp. aureus Mu50
auguuguuauauaaa

SEQ ID NO: 3980229 - RNA, 16 nt, Staphylococcus aureus subsp. aureus Mu50
auguuguuauauaaau

SEQ ID NO: 3980230 - RNA, 17 nt, Staphylococcus aureus subsp. aureus Mu50
auguuguuauauaaaua

SEQ ID NO: 3980231 - RNA, 19 nt, Staphylococcus aureus subsp. aureus Mu50
auguuguuauauaaauaug

SEQ ID NO: 3980232 - RNA, 23 nt, Staphylococcus aureus subsp. aureus Mu50
auguuguuauauaaauaugguuu

SEQ ID NO: 3980233 - RNA, 21 nt, Staphylococcus aureus subsp. aureus Mu50
auguuguuucuaaugcucauu

SEQ ID NO: 3980234 - RNA, 13 nt, Staphylococcus aureus subsp. aureus Mu50
auguuuaaacauu

SEQ ID NO: 3980235 - RNA, 14 nt, Staphylococcus aureus subsp. aureus Mu50
auguuuaaacauuu

SEQ ID NO: 3980236 - RNA, 15 nt, Staphylococcus aureus subsp. aureus Mu50
auguuuaaacauuuu

SEQ ID NO: 3980237 - RNA, 15 nt, Staphylococcus aureus subsp. aureus Mu50
auguuuaauuuucua

SEQ ID NO: 3980238 - RNA, 16 nt, Staphylococcus aureus subsp. aureus Mu50
auguuuaauuuucuaa

SEQ ID NO: 3980239 - RNA, 17 nt, Staphylococcus aureus subsp. aureus Mu50
auguuuaauuuucuaaa

SEQ ID NO: 3980240 - RNA, 19 nt, Staphylococcus aureus subsp. aureus Mu50
auguuuauauugcaaaaau

SEQ ID NO: 3980241 - RNA, 22 nt, Staphylococcus aureus subsp. aureus Mu50
auguuuauauugcaaaaauaau

SEQ ID NO: 3980242 - RNA, 14 nt, Staphylococcus aureus subsp. aureus Mu50
auguuuaugacaaa

SEQ ID NO: 3980243 - RNA, 16 nt, Staphylococcus aureus subsp. aureus Mu50
auguuucaaaauaauu

SEQ ID NO: 3980244 - RNA, 12 nt, Staphylococcus aureus subsp. aureus Mu50
auguuuccauuu

SEQ ID NO: 3980245 - RNA, 20 nt, Staphylococcus aureus subsp. aureus Mu50
auguuuccucuuuaaagcua

SEQ ID NO: 3980246 - RNA, 18 nt, Staphylococcus aureus subsp. aureus Mu50
auguuucuccuacuauaa

SEQ ID NO: 3980247 - RNA, 18 nt, Staphylococcus aureus subsp. aureus Mu50
auguuucuucguuaguga

SEQ ID NO: 3980248 - RNA, 19 nt, Staphylococcus aureus subsp. aureus Mu50
auguuugauucuaaauaau

SEQ ID NO: 3980249 - RNA, 22 nt, Staphylococcus aureus subsp. aureus Mu50
auguuugauuuuauucacuuuu

SEQ ID NO: 3980250 - RNA, 18 nt, Staphylococcus aureus subsp. aureus Mu50
auguuugcaacauauuuu

SEQ ID NO: 3980251 - RNA, 20 nt, Staphylococcus aureus subsp. aureus Mu50
auguuugcaacauauuuuca

SEQ ID NO: 3980252 - RNA, 16 nt, Staphylococcus aureus subsp. aureus Mu50
auguuugccagguaaa

SEQ ID NO: 3980253 - RNA, 16 nt, Staphylococcus aureus subsp. aureus Mu50
auguuuggaugaacaa

SEQ ID NO: 3980254 - RNA, 17 nt, Staphylococcus aureus subsp. aureus Mu50
auguuuggaugaacaaa

SEQ ID NO: 3980255 - RNA, 17 nt, Staphylococcus aureus subsp. aureus Mu50
auguuuggcauaauaau

SEQ ID NO: 3980256 - RNA, 19 nt, Staphylococcus aureus subsp. aureus Mu50
auguuugggauauagaaaa

SEQ ID NO: 3980257 - RNA, 22 nt, Staphylococcus aureus subsp. aureus Mu50
auguuugucguuacuaccuauu

SEQ ID NO: 3980258 - RNA, 19 nt, Staphylococcus aureus subsp. aureus Mu50
auguuuucguuugcaauca

SEQ ID NO: 3980259 - RNA, 22 nt, Staphylococcus aureus subsp. aureus Mu50
auguuuucguuugcaaucaucu

SEQ ID NO: 3980260 - RNA, 17 nt, Staphylococcus aureus subsp. aureus Mu50
auguuuucuaguuuaac

SEQ ID NO: 3980261 - RNA, 19 nt, Staphylococcus aureus subsp. aureus Mu50
auguuuucuauaauauuua

SEQ ID NO: 3980262 - RNA, 18 nt, Staphylococcus aureus subsp. aureus Mu50
auguuuugagcaauaaug

SEQ ID NO: 3980263 - RNA, 16 nt, Staphylococcus aureus subsp. aureus Mu50
auguuuuuauuauaca

SEQ ID NO: 3980264 - RNA, 14 nt, Staphylococcus aureus subsp. aureus Mu50
auuaaaaaacaaaa

SEQ ID NO: 3980265 - RNA, 15 nt, Staphylococcus aureus subsp. aureus Mu50
auuaaaaaacaaaac

SEQ ID NO: 3980266 - RNA, 13 nt, Staphylococcus aureus subsp. aureus Mu50
auuaaaaaucaaa

SEQ ID NO: 3980267 - RNA, 15 nt, Staphylococcus aureus subsp. aureus Mu50
auuaaaaaucaaaga

SEQ ID NO: 3980268 - RNA, 14 nt, Staphylococcus aureus subsp. aureus Mu50
auuaaaaauuucaa

SEQ ID NO: 3980269 - RNA, 15 nt, Staphylococcus aureus subsp. aureus Mu50
auuaaaagcaucuuu

SEQ ID NO: 3980270 - RNA, 20 nt, Staphylococcus aureus subsp. aureus Mu50
auuaaaaguguugacuuuau

SEQ ID NO: 3980271 - RNA, 13 nt, Staphylococcus aureus subsp. aureus Mu50
auuaaaauacaaa

SEQ ID NO: 3980272 - RNA, 15 nt, Staphylococcus aureus subsp. aureus Mu50
auuaaaaucugcuuu

SEQ ID NO: 3980273 - RNA, 12 nt, Staphylococcus aureus subsp. aureus Mu50
auuaaaaugaua

SEQ ID NO: 3980274 - RNA, 12 nt, Staphylococcus aureus subsp. aureus Mu50
auuaaaauguua

SEQ ID NO: 3980275 - RNA, 18 nt, Staphylococcus aureus subsp. aureus Mu50
auuaaaauuaaauaauga

SEQ ID NO: 3980276 - RNA, 16 nt, Staphylococcus aureus subsp. aureus Mu50
auuaaaauucucuuuu

SEQ ID NO: 3980277 - RNA, 14 nt, Staphylococcus aureus subsp. aureus Mu50
auuaaaauuuguua

SEQ ID NO: 3980278 - RNA, 15 nt, Staphylococcus aureus subsp. aureus Mu50
auuaaaauuuguuaa

SEQ ID NO: 3980279 - RNA, 22 nt, Staphylococcus aureus subsp. aureus Mu50
auuaaacacgcgguaaaacgaa

SEQ ID NO: 3980280 - RNA, 20 nt, Staphylococcus aureus subsp. aureus Mu50
auuaaacauuuagauuucau

SEQ ID NO: 3980281 - RNA, 17 nt, Staphylococcus aureus subsp. aureus Mu50
auuaaacccaauuaacc

SEQ ID NO: 3980282 - RNA, 21 nt, Staphylococcus aureus subsp. aureus Mu50
auuaaacuacgaauucucgau

SEQ ID NO: 3980283 - RNA, 19 nt, Staphylococcus aureus subsp. aureus Mu50
auuaaacucaaaaagccaa

SEQ ID NO: 3980284 - RNA, 12 nt, Staphylococcus aureus subsp. aureus Mu50
auuaaacuuaua

SEQ ID NO: 3980285 - RNA, 20 nt, Staphylococcus aureus subsp. aureus Mu50
auuaaagcaucgaacaaucg

SEQ ID NO: 3980286 - RNA, 20 nt, Staphylococcus aureus subsp. aureus Mu50
auuaaagcaucuucaauauu

SEQ ID NO: 3980287 - RNA, 20 nt, Staphylococcus aureus subsp. aureus Mu50
auuaaagcuaucuucagauu

SEQ ID NO: 3980288 - RNA, 16 nt, Staphylococcus aureus subsp. aureus Mu50
auuaaaggaaaucaau

SEQ ID NO: 3980289 - RNA, 15 nt, Staphylococcus aureus subsp. aureus Mu50
auuaaagugaauauu

SEQ ID NO: 3980290 - RNA, 17 nt, Staphylococcus aureus subsp. aureus Mu50
auuaaaguguuucaaca

SEQ ID NO: 3980291 - RNA, 21 nt, Staphylococcus aureus subsp. aureus Mu50
auuaaaguguuucaacauauu

SEQ ID NO: 3980292 - RNA, 17 nt, Staphylococcus aureus subsp. aureus Mu50
auuaaauaacacaugca

SEQ ID NO: 3980293 - RNA, 21 nt, Staphylococcus aureus subsp. aureus Mu50
auuaaauaagaugaaauauuc

SEQ ID NO: 3980294 - RNA, 22 nt, Staphylococcus aureus subsp. aureus Mu50
auuaaauauuuaaccuuuaaaa

SEQ ID NO: 3980295 - RNA, 15 nt, Staphylococcus aureus subsp. aureus Mu50
auuaaauauuuagau

SEQ ID NO: 3980296 - RNA, 16 nt, Staphylococcus aureus subsp. aureus Mu50
auuaaaucgauuaaga

SEQ ID NO: 3980297 - RNA, 18 nt, Staphylococcus aureus subsp. aureus Mu50
auuaaaucugauucauua

SEQ ID NO: 3980298 - RNA, 13 nt, Staphylococcus aureus subsp. aureus Mu50
auuaaaucugcuu

SEQ ID NO: 3980299 - RNA, 17 nt, Staphylococcus aureus subsp. aureus Mu50
auuaaaugcaauacauu

SEQ ID NO: 3980300 - RNA, 22 nt, Staphylococcus aureus subsp. aureus Mu50
auuaaauuauauguuuuuauua

SEQ ID NO: 3980301 - RNA, 16 nt, Staphylococcus aureus subsp. aureus Mu50
auuaaauucaaaucug

SEQ ID NO: 3980302 - RNA, 13 nt, Staphylococcus aureus subsp. aureus Mu50
auuaaauucaucu

SEQ ID NO: 3980303 - RNA, 20 nt, Staphylococcus aureus subsp. aureus Mu50
auuaaauuccaugucaauuu

SEQ ID NO: 3980304 - RNA, 23 nt, Staphylococcus aureus subsp. aureus Mu50
auuaaauucuuuucaagaaauuc

SEQ ID NO: 3980305 - RNA, 18 nt, Staphylococcus aureus subsp. aureus Mu50
auuaaauuugaaaguaaa

SEQ ID NO: 3980306 - RNA, 15 nt, Staphylococcus aureus subsp. aureus Mu50
auuacaauauaauuu

SEQ ID NO: 3980307 - RNA, 15 nt, Staphylococcus aureus subsp. aureus Mu50
auuacaaugaaaaaa

SEQ ID NO: 3980308 - RNA, 20 nt, Staphylococcus aureus subsp. aureus Mu50
auuacacccuuuaaauuuaa

SEQ ID NO: 3980309 - RNA, 22 nt, Staphylococcus aureus subsp. aureus Mu50
auuacacccuuuaaauuuaacu

SEQ ID NO: 3980310 - RNA, 22 nt, Staphylococcus aureus subsp. aureus Mu50
auuacacuacgcugaugaauga

SEQ ID NO: 3980311 - RNA, 12 nt, Staphylococcus aureus subsp. aureus Mu50
auuacagaugau

SEQ ID NO: 3980312 - RNA, 15 nt, Staphylococcus aureus subsp. aureus Mu50
auuacagaugaugcu

SEQ ID NO: 3980313 - RNA, 16 nt, Staphylococcus aureus subsp. aureus Mu50
auuacagaugaugcuu

SEQ ID NO: 3980314 - RNA, 24 nt, Staphylococcus aureus subsp. aureus Mu50
auuacaggaaauccgcauaaauua

SEQ ID NO: 3980315 - RNA, 18 nt, Staphylococcus aureus subsp. aureus Mu50
auuacaguucuauagguu

SEQ ID NO: 3980316 - RNA, 16 nt, Staphylococcus aureus subsp. aureus Mu50
auuacauaauuuaucu

SEQ ID NO: 3980317 - RNA, 22 nt, Staphylococcus aureus subsp. aureus Mu50
auuacauaauuuaucugcaaaa

SEQ ID NO: 3980318 - RNA, 19 nt, Staphylococcus aureus subsp. aureus Mu50
auuacauauaagauagaua

SEQ ID NO: 3980319 - RNA, 19 nt, Staphylococcus aureus subsp. aureus Mu50
auuacauauacgacauuuu

SEQ ID NO: 3980320 - RNA, 19 nt, Staphylococcus aureus subsp. aureus Mu50
auuacaucuauauuuguuu

SEQ ID NO: 3980321 - RNA, 17 nt, Staphylococcus aureus subsp. aureus Mu50
auuacauuuuaugucca

SEQ ID NO: 3980322 - RNA, 21 nt, Staphylococcus aureus subsp. aureus Mu50
auuaccaacaagguucuaaau

SEQ ID NO: 3980323 - RNA, 14 nt, Staphylococcus aureus subsp. aureus Mu50
auuaccaaugaaua

SEQ ID NO: 3980324 - RNA, 16 nt, Staphylococcus aureus subsp. aureus Mu50
auuaccaaugaauaaa

SEQ ID NO: 3980325 - RNA, 13 nt, Staphylococcus aureus subsp. aureus Mu50
auuaccagcaauu

SEQ ID NO: 3980326 - RNA, 16 nt, Staphylococcus aureus subsp. aureus Mu50
auuaccauaacuuuau

SEQ ID NO: 3980327 - RNA, 22 nt, Staphylococcus aureus subsp. aureus Mu50
auuacccacaucuuuuuaaaag

SEQ ID NO: 3980328 - RNA, 23 nt, Staphylococcus aureus subsp. aureus Mu50
auuaccccaagaugguauugcuu

SEQ ID NO: 3980329 - RNA, 14 nt, Staphylococcus aureus subsp. aureus Mu50
auuaccguuuauuu

SEQ ID NO: 3980330 - RNA, 21 nt, Staphylococcus aureus subsp. aureus Mu50
auuacgcugucucauuaaugu

SEQ ID NO: 3980331 - RNA, 23 nt, Staphylococcus aureus subsp. aureus Mu50
auuacgguuugcuuuuuuguuau

SEQ ID NO: 3980332 - RNA, 16 nt, Staphylococcus aureus subsp. aureus Mu50
auuacguuuacuagaa

SEQ ID NO: 3980333 - RNA, 18 nt, Staphylococcus aureus subsp. aureus Mu50
auuacuaaaacaaauuca

SEQ ID NO: 3980334 - RNA, 13 nt, Staphylococcus aureus subsp. aureus Mu50
auuacuaaccuau

SEQ ID NO: 3980335 - RNA, 16 nt, Staphylococcus aureus subsp. aureus Mu50
auuacuaauugaucag

SEQ ID NO: 3980336 - RNA, 20 nt, Staphylococcus aureus subsp. aureus Mu50
auuacuacuuuauaaauauc

SEQ ID NO: 3980337 - RNA, 23 nt, Staphylococcus aureus subsp. aureus Mu50
auuacuacuuuauaaauaucuuu

SEQ ID NO: 3980338 - RNA, 13 nt, Staphylococcus aureus subsp. aureus Mu50
auuacuauaaaaa

SEQ ID NO: 3980339 - RNA, 17 nt, Staphylococcus aureus subsp. aureus Mu50
auuacuauaaaaaacag

SEQ ID NO: 3980340 - RNA, 16 nt, Staphylococcus aureus subsp. aureus Mu50
auuacuauauuuaaau

SEQ ID NO: 3980341 - RNA, 17 nt, Staphylococcus aureus subsp. aureus Mu50
auuacuaucuucaucau

SEQ ID NO: 3980342 - RNA, 22 nt, Staphylococcus aureus subsp. aureus Mu50
auuacucaaaauuaaagcuuaa

SEQ ID NO: 3980343 - RNA, 15 nt, Staphylococcus aureus subsp. aureus Mu50
auuacucuuuuucuu

SEQ ID NO: 3980344 - RNA, 19 nt, Staphylococcus aureus subsp. aureus Mu50
auuacugcagcaucauaau

SEQ ID NO: 3980345 - RNA, 17 nt, Staphylococcus aureus subsp. aureus Mu50
auuacuguaaauaugaa

SEQ ID NO: 3980346 - RNA, 23 nt, Staphylococcus aureus subsp. aureus Mu50
auuacugucuuuccauaauaaug

SEQ ID NO: 3980347 - RNA, 21 nt, Staphylococcus aureus subsp. aureus Mu50
auuacuguuugcuuuaucaau

SEQ ID NO: 3980348 - RNA, 20 nt, Staphylococcus aureus subsp. aureus Mu50
auuacuuauuucuuuucauu

SEQ ID NO: 3980349 - RNA, 22 nt, Staphylococcus aureus subsp. aureus Mu50
auuacuuauuucuuuucauuau

SEQ ID NO: 3980350 - RNA, 16 nt, Staphylococcus aureus subsp. aureus Mu50
auuacuuccauugcuu

SEQ ID NO: 3980351 - RNA, 15 nt, Staphylococcus aureus subsp. aureus Mu50
auuacuugaauauua

SEQ ID NO: 3980352 - RNA, 18 nt, Staphylococcus aureus subsp. aureus Mu50
auuacuugaauauuauuc

SEQ ID NO: 3980353 - RNA, 13 nt, Staphylococcus aureus subsp. aureus Mu50
auuacuuuagaaa

SEQ ID NO: 3980354 - RNA, 18 nt, Staphylococcus aureus subsp. aureus Mu50
auuacuuuagaaagugau

SEQ ID NO: 3980355 - RNA, 17 nt, Staphylococcus aureus subsp. aureus Mu50
auuacuuuaucguugua

SEQ ID NO: 3980356 - RNA, 17 nt, Staphylococcus aureus subsp. aureus Mu50
auuacuuucauuguaaa

SEQ ID NO: 3980357 - RNA, 15 nt, Staphylococcus aureus subsp. aureus Mu50
auuacuuuggaaauu

SEQ ID NO: 3980358 - RNA, 17 nt, Staphylococcus aureus subsp. aureus Mu50
auuacuuuggaaauuua

SEQ ID NO: 3980359 - RNA, 16 nt, Staphylococcus aureus subsp. aureus Mu50
auuagaaaauuucuca

SEQ ID NO: 3980360 - RNA, 14 nt, Staphylococcus aureus subsp. aureus Mu50
auuagaaccaucau

SEQ ID NO: 3980361 - RNA, 14 nt, Staphylococcus aureus subsp. aureus Mu50
auuagaauauaugu

SEQ ID NO: 3980362 - RNA, 19 nt, Staphylococcus aureus subsp. aureus Mu50
auuagacguguaaauguua

SEQ ID NO: 3980363 - RNA, 22 nt, Staphylococcus aureus subsp. aureus Mu50
auuagauaaaauaauuguucuu

SEQ ID NO: 3980364 - RNA, 22 nt, Staphylococcus aureus subsp. aureus Mu50
auuagauaucuuaaucuaaaaa

SEQ ID NO: 3980365 - RNA, 14 nt, Staphylococcus aureus subsp. aureus Mu50
auuagauuuaaaau

SEQ ID NO: 3980366 - RNA, 13 nt, Staphylococcus aureus subsp. aureus Mu50
auuagauuuuaug

SEQ ID NO: 3980367 - RNA, 14 nt, Staphylococcus aureus subsp. aureus Mu50
auuagauuuuaugc

SEQ ID NO: 3980368 - RNA, 15 nt, Staphylococcus aureus subsp. aureus Mu50
auuagauuuuguugu

SEQ ID NO: 3980369 - RNA, 16 nt, Staphylococcus aureus subsp. aureus Mu50
auuagauuuuguugua

SEQ ID NO: 3980370 - RNA, 21 nt, Staphylococcus aureus subsp. aureus Mu50
auuagcaaauauuauuaaauc

SEQ ID NO: 3980371 - RNA, 23 nt, Staphylococcus aureus subsp. aureus Mu50
auuagccgaaaaacaucauuucu

SEQ ID NO: 3980372 - RNA, 22 nt, Staphylococcus aureus subsp. aureus Mu50
auuagcgaaaaccucuguuuug

SEQ ID NO: 3980373 - RNA, 21 nt, Staphylococcus aureus subsp. aureus Mu50
auuagcgcaccaauuaucaac

SEQ ID NO: 3980374 - RNA, 22 nt, Staphylococcus aureus subsp. aureus Mu50
auuagcgcaccaauuaucaaca

SEQ ID NO: 3980375 - RNA, 14 nt, Staphylococcus aureus subsp. aureus Mu50
auuaggauguucag

SEQ ID NO: 3980376 - RNA, 17 nt, Staphylococcus aureus subsp. aureus Mu50
auuaggauucaauaaua

SEQ ID NO: 3980377 - RNA, 17 nt, Staphylococcus aureus subsp. aureus Mu50
auuagguuacuuauuga

SEQ ID NO: 3980378 - RNA, 19 nt, Staphylococcus aureus subsp. aureus Mu50
auuagguuacuuauugacg

SEQ ID NO: 3980379 - RNA, 12 nt, Staphylococcus aureus subsp. aureus Mu50
auuaguaaauau

SEQ ID NO: 3980380 - RNA, 18 nt, Staphylococcus aureus subsp. aureus Mu50
auuaguaaugauuaacuu

SEQ ID NO: 3980381 - RNA, 19 nt, Staphylococcus aureus subsp. aureus Mu50
auuaguaauuuuuaaaucu

SEQ ID NO: 3980382 - RNA, 17 nt, Staphylococcus aureus subsp. aureus Mu50
auuaguagccacaauuu

SEQ ID NO: 3980383 - RNA, 21 nt, Staphylococcus aureus subsp. aureus Mu50
auuaguagccacaauuuugac

SEQ ID NO: 3980384 - RNA, 19 nt, Staphylococcus aureus subsp. aureus Mu50
auuaguaugacuuaccuaa

SEQ ID NO: 3980385 - RNA, 19 nt, Staphylococcus aureus subsp. aureus Mu50
auuaguauucaaaaaauau

SEQ ID NO: 3980386 - RNA, 15 nt, Staphylococcus aureus subsp. aureus Mu50
auuagucaucaaccu

SEQ ID NO: 3980387 - RNA, 17 nt, Staphylococcus aureus subsp. aureus Mu50
auuagugucacaaagaa

SEQ ID NO: 3980388 - RNA, 20 nt, Staphylococcus aureus subsp. aureus Mu50
auuagugucacaaagaaauu

SEQ ID NO: 3980389 - RNA, 13 nt, Staphylococcus aureus subsp. aureus Mu50
auuaguuauacua

SEQ ID NO: 3980390 - RNA, 17 nt, Staphylococcus aureus subsp. aureus Mu50
auuaguucuggcaaaga

SEQ ID NO: 3980391 - RNA, 20 nt, Staphylococcus aureus subsp. aureus Mu50
auuaguucuguugauauuuc

SEQ ID NO: 3980392 - RNA, 15 nt, Staphylococcus aureus subsp. aureus Mu50
auuaguuuuuaaaau

SEQ ID NO: 3980393 - RNA, 14 nt, Staphylococcus aureus subsp. aureus Mu50
auuauuaacgcaaa

SEQ ID NO: 3980394 - RNA, 14 nt, Staphylococcus aureus subsp. aureus Mu50
auuauuaacuguac

SEQ ID NO: 3980395 - RNA, 21 nt, Staphylococcus aureus subsp. aureus Mu50
auuauuaacuuuaauauaagu

SEQ ID NO: 3980396 - RNA, 19 nt, Staphylococcus aureus subsp. aureus Mu50
auuauuaagugaguuuuau

SEQ ID NO: 3980397 - RNA, 14 nt, Staphylococcus aureus subsp. aureus Mu50
auuauuaccauaac

SEQ ID NO: 3980398 - RNA, 22 nt, Staphylococcus aureus subsp. aureus Mu50
auuauuaggcggccaguccauu

SEQ ID NO: 3980399 - RNA, 15 nt, Staphylococcus aureus subsp. aureus Mu50
auuauuauaauaaau

SEQ ID NO: 3980400 - RNA, 17 nt, Staphylococcus aureus subsp. aureus Mu50
auuauuauaauuuuguu

SEQ ID NO: 3980401 - RNA, 14 nt, Staphylococcus aureus subsp. aureus Mu50
auuauuaucaaaga

SEQ ID NO: 3980402 - RNA, 14 nt, Staphylococcus aureus subsp. aureus Mu50
auuauuauuaaauu

SEQ ID NO: 3980403 - RNA, 17 nt, Staphylococcus aureus subsp. aureus Mu50
auuauuauuaaauuaug

SEQ ID NO: 3980404 - RNA, 14 nt, Staphylococcus aureus subsp. aureus Mu50
auuauuauugaaau

SEQ ID NO: 3980405 - RNA, 14 nt, Staphylococcus aureus subsp. aureus Mu50
auuauuauuuuaau

SEQ ID NO: 3980406 - RNA, 16 nt, Staphylococcus aureus subsp. aureus Mu50
auuauuccauugaugu

SEQ ID NO: 3980407 - RNA, 17 nt, Staphylococcus aureus subsp. aureus Mu50
auuauuccauugaugua

SEQ ID NO: 3980408 - RNA, 14 nt, Staphylococcus aureus subsp. aureus Mu50
auuauucucuuuau

SEQ ID NO: 3980409 - RNA, 22 nt, Staphylococcus aureus subsp. aureus Mu50
auuauucugagauugagaauuc

SEQ ID NO: 3980410 - RNA, 16 nt, Staphylococcus aureus subsp. aureus Mu50
auuauucuuuauauuu

SEQ ID NO: 3980411 - RNA, 12 nt, Staphylococcus aureus subsp. aureus Mu50
auuauugaaacu

SEQ ID NO: 3980412 - RNA, 14 nt, Staphylococcus aureus subsp. aureus Mu50
auuauugaaacuaa

SEQ ID NO: 3980413 - RNA, 16 nt, Staphylococcus aureus subsp. aureus Mu50
auuauugaaacuaaua

SEQ ID NO: 3980414 - RNA, 18 nt, Staphylococcus aureus subsp. aureus Mu50
auuauugaaacuaauaau

SEQ ID NO: 3980415 - RNA, 15 nt, Staphylococcus aureus subsp. aureus Mu50
auuauuggauuugaa

SEQ ID NO: 3980416 - RNA, 17 nt, Staphylococcus aureus subsp. aureus Mu50
auuauugguugaaauua

SEQ ID NO: 3980417 - RNA, 18 nt, Staphylococcus aureus subsp. aureus Mu50
auuauugguugaaauuaa

SEQ ID NO: 3980418 - RNA, 18 nt, Staphylococcus aureus subsp. aureus Mu50
auuauugucaucauguuc

SEQ ID NO: 3980419 - RNA, 14 nt, Staphylococcus aureus subsp. aureus Mu50
auuauuuaaaacuu

SEQ ID NO: 3980420 - RNA, 15 nt, Staphylococcus aureus subsp. aureus Mu50
auuauuuaaaaugcu

SEQ ID NO: 3980421 - RNA, 16 nt, Staphylococcus aureus subsp. aureus Mu50
auuauuuaaaaugcuu

SEQ ID NO: 3980422 - RNA, 16 nt, Staphylococcus aureus subsp. aureus Mu50
auuauuuaaauuuuca

SEQ ID NO: 3980423 - RNA, 15 nt, Staphylococcus aureus subsp. aureus Mu50
auuauuuaacgucua

SEQ ID NO: 3980424 - RNA, 15 nt, Staphylococcus aureus subsp. aureus Mu50
auuauuuaaucuauu

SEQ ID NO: 3980425 - RNA, 19 nt, Staphylococcus aureus subsp. aureus Mu50
auuauuuaauuuuucuaaa

SEQ ID NO: 3980426 - RNA, 20 nt, Staphylococcus aureus subsp. aureus Mu50
auuauuuaauuuuucuaaau

SEQ ID NO: 3980427 - RNA, 14 nt, Staphylococcus aureus subsp. aureus Mu50
auuauuuagaauuc

SEQ ID NO: 3980428 - RNA, 22 nt, Staphylococcus aureus subsp. aureus Mu50
auuauuuagaauucuaaaagaa

SEQ ID NO: 3980429 - RNA, 17 nt, Staphylococcus aureus subsp. aureus Mu50
auuauuuagauaaaaau

SEQ ID NO: 3980430 - RNA, 21 nt, Staphylococcus aureus subsp. aureus Mu50
auuauuuagauaaaaauuacu

SEQ ID NO: 3980431 - RNA, 14 nt, Staphylococcus aureus subsp. aureus Mu50
auuauuuauucauu

SEQ ID NO: 3980432 - RNA, 22 nt, Staphylococcus aureus subsp. aureus Mu50
auuauuucccuggaaaaugauu

SEQ ID NO: 3980433 - RNA, 21 nt, Staphylococcus aureus subsp. aureus Mu50
auuauuucuagcauguaagcu

SEQ ID NO: 3980434 - RNA, 22 nt, Staphylococcus aureus subsp. aureus Mu50
auuauuucucuuuccacugcaa

SEQ ID NO: 3980435 - RNA, 23 nt, Staphylococcus aureus subsp. aureus Mu50
auuauuuggcucuauaucaaauu

SEQ ID NO: 3980436 - RNA, 12 nt, Staphylococcus aureus subsp. aureus Mu50
auuauuuucaau

SEQ ID NO: 3980437 - RNA, 23 nt, Staphylococcus aureus subsp. aureus Mu50
auuauuuugcaauugcaaugaau

SEQ ID NO: 3980438 - RNA, 19 nt, Staphylococcus aureus subsp. aureus Mu50
auuauuuuguauuuuucaa

SEQ ID NO: 3980439 - RNA, 22 nt, Staphylococcus aureus subsp. aureus Mu50
auuauuuuguauuuuucaaaua

SEQ ID NO: 3980440 - RNA, 14 nt, Staphylococcus aureus subsp. aureus Mu50
auuauuuuucaaau

SEQ ID NO: 3980441 - RNA, 15 nt, Staphylococcus aureus subsp. aureus Mu50
auuauuuuucaaaua

SEQ ID NO: 3980442 - RNA, 14 nt, Staphylococcus aureus subsp. aureus Mu50
auucaaaauaacuu

SEQ ID NO: 3980443 - RNA, 18 nt, Staphylococcus aureus subsp. aureus Mu50
auucaaaauucaauauua

SEQ ID NO: 3980444 - RNA, 19 nt, Staphylococcus aureus subsp. aureus Mu50
auucaaaauucaauauuaa

SEQ ID NO: 3980445 - RNA, 14 nt, Staphylococcus aureus subsp. aureus Mu50
auucaaauaaacac

SEQ ID NO: 3980446 - RNA, 18 nt, Staphylococcus aureus subsp. aureus Mu50
auucaaauaaaucaaacu

SEQ ID NO: 3980447 - RNA, 19 nt, Staphylococcus aureus subsp. aureus Mu50
auucaaauaaaucaaacuu

SEQ ID NO: 3980448 - RNA, 21 nt, Staphylococcus aureus subsp. aureus Mu50
auucaaauaaaucaaacuuuu

SEQ ID NO: 3980449 - RNA, 23 nt, Staphylococcus aureus subsp. aureus Mu50
auucaaauaaaucaaacuuuuca

SEQ ID NO: 3980450 - RNA, 22 nt, Staphylococcus aureus subsp. aureus Mu50
auucaaauaaaugacauuuaau

SEQ ID NO: 3980451 - RNA, 13 nt, Staphylococcus aureus subsp. aureus Mu50
auucaaaucauaa

SEQ ID NO: 3980452 - RNA, 12 nt, Staphylococcus aureus subsp. aureus Mu50
auucaaccaauu

SEQ ID NO: 3980453 - RNA, 17 nt, Staphylococcus aureus subsp. aureus Mu50
auucaaccaauuauuaa

SEQ ID NO: 3980454 - RNA, 17 nt, Staphylococcus aureus subsp. aureus Mu50
auucaaccuuaauagga

SEQ ID NO: 3980455 - RNA, 22 nt, Staphylococcus aureus subsp. aureus Mu50
auucaacguauaagugauauca

SEQ ID NO: 3980456 - RNA, 18 nt, Staphylococcus aureus subsp. aureus Mu50
auucaacgucaucaaaac

SEQ ID NO: 3980457 - RNA, 17 nt, Staphylococcus aureus subsp. aureus Mu50
auucaacuaauuuaaag

SEQ ID NO: 3980458 - RNA, 17 nt, Staphylococcus aureus subsp. aureus Mu50
auucaacuaugaaauug

SEQ ID NO: 3980459 - RNA, 12 nt, Staphylococcus aureus subsp. aureus Mu50
auucaacuuaaa

SEQ ID NO: 3980460 - RNA, 15 nt, Staphylococcus aureus subsp. aureus Mu50
auucaacuuauuauu

SEQ ID NO: 3980461 - RNA, 19 nt, Staphylococcus aureus subsp. aureus Mu50
auucaacuuuaaucaaaaa

SEQ ID NO: 3980462 - RNA, 16 nt, Staphylococcus aureus subsp. aureus Mu50
auucaagcaucauuuu

SEQ ID NO: 3980463 - RNA, 18 nt, Staphylococcus aureus subsp. aureus Mu50
auucaagcaucauuuuuc

SEQ ID NO: 3980464 - RNA, 15 nt, Staphylococcus aureus subsp. aureus Mu50
auucaauaauuauua

SEQ ID NO: 3980465 - RNA, 17 nt, Staphylococcus aureus subsp. aureus Mu50
auucaauaauuauuaau

SEQ ID NO: 3980466 - RNA, 20 nt, Staphylococcus aureus subsp. aureus Mu50
auucaauaauucaucaaguu

SEQ ID NO: 3980467 - RNA, 19 nt, Staphylococcus aureus subsp. aureus Mu50
auucaauauuaaucauaau

SEQ ID NO: 3980468 - RNA, 14 nt, Staphylococcus aureus subsp. aureus Mu50
auucaauauuuuuu

SEQ ID NO: 3980469 - RNA, 16 nt, Staphylococcus aureus subsp. aureus Mu50
auucaauauuuuuucu

SEQ ID NO: 3980470 - RNA, 16 nt, Staphylococcus aureus subsp. aureus Mu50
auucaaugauuuuuaa

SEQ ID NO: 3980471 - RNA, 17 nt, Staphylococcus aureus subsp. aureus Mu50
auucaaugauuuuuaaa

SEQ ID NO: 3980472 - RNA, 18 nt, Staphylococcus aureus subsp. aureus Mu50
auucaaugauuuuuaaaa

SEQ ID NO: 3980473 - RNA, 17 nt, Staphylococcus aureus subsp. aureus Mu50
auucaauguaauuuuca

SEQ ID NO: 3980474 - RNA, 14 nt, Staphylococcus aureus subsp. aureus Mu50
auucaauucuguga

SEQ ID NO: 3980475 - RNA, 18 nt, Staphylococcus aureus subsp. aureus Mu50
auucaauugauuacacca

SEQ ID NO: 3980476 - RNA, 13 nt, Staphylococcus aureus subsp. aureus Mu50
auucaauuuaguu

SEQ ID NO: 3980477 - RNA, 13 nt, Staphylococcus aureus subsp. aureus Mu50
auucaauuucuca

SEQ ID NO: 3980478 - RNA, 18 nt, Staphylococcus aureus subsp. aureus Mu50
auucaccagguuuuuuau

SEQ ID NO: 3980479 - RNA, 23 nt, Staphylococcus aureus subsp. aureus Mu50
auucaccagguuuuuuauuuuca

SEQ ID NO: 3980480 - RNA, 18 nt, Staphylococcus aureus subsp. aureus Mu50
auucaccuaucaacgauu

SEQ ID NO: 3980481 - RNA, 15 nt, Staphylococcus aureus subsp. aureus Mu50
auucucaauuaauuu

SEQ ID NO: 3980482 - RNA, 20 nt, Staphylococcus aureus subsp. aureus Mu50
auucucagucucuuugaagg

SEQ ID NO: 3980483 - RNA, 14 nt, Staphylococcus aureus subsp. aureus Mu50
auucucauuuacuu

SEQ ID NO: 3980484 - RNA, 20 nt, Staphylococcus aureus subsp. aureus Mu50
auucuccaguggaaaugaua

SEQ ID NO: 3980485 - RNA, 16 nt, Staphylococcus aureus subsp. aureus Mu50
auucuccuaauaauuu

SEQ ID NO: 3980486 - RNA, 13 nt, Staphylococcus aureus subsp. aureus Mu50
auucucgauuuuu

SEQ ID NO: 3980487 - RNA, 14 nt, Staphylococcus aureus subsp. aureus Mu50
auucucgauuuuuu

SEQ ID NO: 3980488 - RNA, 14 nt, Staphylococcus aureus subsp. aureus Mu50
auucucgguuuuuu

SEQ ID NO: 3980489 - RNA, 17 nt, Staphylococcus aureus subsp. aureus Mu50
auucucuaacuuuacca

SEQ ID NO: 3980490 - RNA, 22 nt, Staphylococcus aureus subsp. aureus Mu50
auucucuaacuuuaccaauauc

SEQ ID NO: 3980491 - RNA, 23 nt, Staphylococcus aureus subsp. aureus Mu50
auucucuaacuuuaccaauauca

SEQ ID NO: 3980492 - RNA, 19 nt, Staphylococcus aureus subsp. aureus Mu50
auucucuagugcuuugucu

SEQ ID NO: 3980493 - RNA, 12 nt, Staphylococcus aureus subsp. aureus Mu50
auucucuuuuaa

SEQ ID NO: 3980494 - RNA, 16 nt, Staphylococcus aureus subsp. aureus Mu50
auucugaaacuuuaau

SEQ ID NO: 3980495 - RNA, 18 nt, Staphylococcus aureus subsp. aureus Mu50
auucugauucgauggaua

SEQ ID NO: 3980496 - RNA, 19 nt, Staphylococcus aureus subsp. aureus Mu50
auucugauucgauggauac

SEQ ID NO: 3980497 - RNA, 14 nt, Staphylococcus aureus subsp. aureus Mu50
auucuggaugguua

SEQ ID NO: 3980498 - RNA, 19 nt, Staphylococcus aureus subsp. aureus Mu50
auucugugagguaaaacua

SEQ ID NO: 3980499 - RNA, 21 nt, Staphylococcus aureus subsp. aureus Mu50
auucuuaaaaagcagcaguaa

SEQ ID NO: 3980500 - RNA, 15 nt, Staphylococcus aureus subsp. aureus Mu50
auucuuaauuuaagu

SEQ ID NO: 3980501 - RNA, 15 nt, Staphylococcus aureus subsp. aureus Mu50
auucuuacaccugca

SEQ ID NO: 3980502 - RNA, 14 nt, Staphylococcus aureus subsp. aureus Mu50
auucuuagauauua

SEQ ID NO: 3980503 - RNA, 15 nt, Staphylococcus aureus subsp. aureus Mu50
auucuuagauauuau

SEQ ID NO: 3980504 - RNA, 14 nt, Staphylococcus aureus subsp. aureus Mu50
auucuuauaaaaua

SEQ ID NO: 3980505 - RNA, 17 nt, Staphylococcus aureus subsp. aureus Mu50
auucuuauauguuuuau

SEQ ID NO: 3980506 - RNA, 21 nt, Staphylococcus aureus subsp. aureus Mu50
auucuuauauguuuuaugauu

SEQ ID NO: 3980507 - RNA, 19 nt, Staphylococcus aureus subsp. aureus Mu50
auucuuaucauucauuacu

SEQ ID NO: 3980508 - RNA, 18 nt, Staphylococcus aureus subsp. aureus Mu50
auucuucaaaaaauaaua

SEQ ID NO: 3980509 - RNA, 13 nt, Staphylococcus aureus subsp. aureus Mu50
auucuucaauaac

SEQ ID NO: 3980510 - RNA, 16 nt, Staphylococcus aureus subsp. aureus Mu50
auucuucaauuucauu

SEQ ID NO: 3980511 - RNA, 22 nt, Staphylococcus aureus subsp. aureus Mu50
auucuucaauuucauuuuugau

SEQ ID NO: 3980512 - RNA, 22 nt, Staphylococcus aureus subsp. aureus Mu50
auucuucaccaacuuuuuuaac

SEQ ID NO: 3980513 - RNA, 18 nt, Staphylococcus aureus subsp. aureus Mu50
auucuucaccaguuugug

SEQ ID NO: 3980514 - RNA, 16 nt, Staphylococcus aureus subsp. aureus Mu50
auucuucacuaaaaau

SEQ ID NO: 3980515 - RNA, 22 nt, Staphylococcus aureus subsp. aureus Mu50
auucuucacuaaaaauauauuu

SEQ ID NO: 3980516 - RNA, 17 nt, Staphylococcus aureus subsp. aureus Mu50
auucuucaguuuguugg

SEQ ID NO: 3980517 - RNA, 12 nt, Staphylococcus aureus subsp. aureus Mu50
auucuucauuua

SEQ ID NO: 3980518 - RNA, 17 nt, Staphylococcus aureus subsp. aureus Mu50
auucuucauuuauaaca

SEQ ID NO: 3980519 - RNA, 21 nt, Staphylococcus aureus subsp. aureus Mu50
auucuucccaaaaauuguuca

SEQ ID NO: 3980520 - RNA, 15 nt, Staphylococcus aureus subsp. aureus Mu50
auucuugaaaaguuu

SEQ ID NO: 3980521 - RNA, 14 nt, Staphylococcus aureus subsp. aureus Mu50
auucuugaauaaau

SEQ ID NO: 3980522 - RNA, 18 nt, Staphylococcus aureus subsp. aureus Mu50
auucuugaauaaauuuua

SEQ ID NO: 3980523 - RNA, 19 nt, Staphylococcus aureus subsp. aureus Mu50
auucuugaauaaauuuuau

SEQ ID NO: 3980524 - RNA, 17 nt, Staphylococcus aureus subsp. aureus Mu50
auucuuggcguauuuuu

SEQ ID NO: 3980525 - RNA, 18 nt, Staphylococcus aureus subsp. aureus Mu50
auucuuguuugauuuuag

SEQ ID NO: 3980526 - RNA, 14 nt, Staphylococcus aureus subsp. aureus Mu50
auucuuuaauauaa

SEQ ID NO: 3980527 - RNA, 23 nt, Staphylococcus aureus subsp. aureus Mu50
auucuuuaccuuuaccaguauca

SEQ ID NO: 3980528 - RNA, 13 nt, Staphylococcus aureus subsp. aureus Mu50
auucuuucucuau

SEQ ID NO: 3980529 - RNA, 19 nt, Staphylococcus aureus subsp. aureus Mu50
auucuuuguauuuauacua

SEQ ID NO: 3980530 - RNA, 21 nt, Staphylococcus aureus subsp. aureus Mu50
auucuuuuaauagaucuuugu

SEQ ID NO: 3980531 - RNA, 14 nt, Staphylococcus aureus subsp. aureus Mu50
auucuuuucaagaa

SEQ ID NO: 3980532 - RNA, 14 nt, Staphylococcus aureus subsp. aureus Mu50
auucuuuuuaacua

SEQ ID NO: 3980533 - RNA, 16 nt, Staphylococcus aureus subsp. aureus Mu50
auucuuuuuaacuaug

SEQ ID NO: 3980534 - RNA, 16 nt, Staphylococcus aureus subsp. aureus Mu50
auugaaauaauauaaa

SEQ ID NO: 3980535 - RNA, 14 nt, Staphylococcus aureus subsp. aureus Mu50
auugaaaugagcuu

SEQ ID NO: 3980536 - RNA, 20 nt, Staphylococcus aureus subsp. aureus Mu50
auugaaaugagcuuaaguua

SEQ ID NO: 3980537 - RNA, 18 nt, Staphylococcus aureus subsp. aureus Mu50
auugaaauguuuaucaau

SEQ ID NO: 3980538 - RNA, 14 nt, Staphylococcus aureus subsp. aureus Mu50
auugaaauuuuuaa

SEQ ID NO: 3980539 - RNA, 17 nt, Staphylococcus aureus subsp. aureus Mu50
auugaacaauaauaugc

SEQ ID NO: 3980540 - RNA, 13 nt, Staphylococcus aureus subsp. aureus Mu50
auugaacuucuaa

SEQ ID NO: 3980541 - RNA, 14 nt, Staphylococcus aureus subsp. aureus Mu50
auugaacuucuaac

SEQ ID NO: 3980542 - RNA, 13 nt, Staphylococcus aureus subsp. aureus Mu50
auugaaucaaaua

SEQ ID NO: 3980543 - RNA, 16 nt, Staphylococcus aureus subsp. aureus Mu50
auugaaucuuuguuau

SEQ ID NO: 3980544 - RNA, 17 nt, Staphylococcus aureus subsp. aureus Mu50
auugaauucucgccaac

SEQ ID NO: 3980545 - RNA, 15 nt, Staphylococcus aureus subsp. aureus Mu50
auugaauugaaaaau

SEQ ID NO: 3980546 - RNA, 13 nt, Staphylococcus aureus subsp. aureus Mu50
auugaccaccuuu

SEQ ID NO: 3980547 - RNA, 21 nt, Staphylococcus aureus subsp. aureus Mu50
auugaccgacaaaacuuguaa

SEQ ID NO: 3980548 - RNA, 18 nt, Staphylococcus aureus subsp. aureus Mu50
auugacguggucuacuuc

SEQ ID NO: 3980549 - RNA, 22 nt, Staphylococcus aureus subsp. aureus Mu50
auugacucgaccuuuauaugaa

SEQ ID NO: 3980550 - RNA, 13 nt, Staphylococcus aureus subsp. aureus Mu50
auugacuuacauu

SEQ ID NO: 3980551 - RNA, 21 nt, Staphylococcus aureus subsp. aureus Mu50
auugagaauauuaagauguau

SEQ ID NO: 3980552 - RNA, 17 nt, Staphylococcus aureus subsp. aureus Mu50
auugagaauauuuauug

SEQ ID NO: 3980553 - RNA, 13 nt, Staphylococcus aureus subsp. aureus Mu50
auugagagaaguu

SEQ ID NO: 3980554 - RNA, 18 nt, Staphylococcus aureus subsp. aureus Mu50
auugagauggucuuuuaa

SEQ ID NO: 3980555 - RNA, 15 nt, Staphylococcus aureus subsp. aureus Mu50
auugaggauaauuau

SEQ ID NO: 3980556 - RNA, 23 nt, Staphylococcus aureus subsp. aureus Mu50
auugaggauaauuauuaggggag

SEQ ID NO: 3980557 - RNA, 14 nt, Staphylococcus aureus subsp. aureus Mu50
auugaguuguugca

SEQ ID NO: 3980558 - RNA, 16 nt, Staphylococcus aureus subsp. aureus Mu50
auugauaccuuuugcu

SEQ ID NO: 3980559 - RNA, 15 nt, Staphylococcus aureus subsp. aureus Mu50
auugauagauagaaa

SEQ ID NO: 3980560 - RNA, 17 nt, Staphylococcus aureus subsp. aureus Mu50
auugauagauagaaauu

SEQ ID NO: 3980561 - RNA, 12 nt, Staphylococcus aureus subsp. aureus Mu50
auugauagucac

SEQ ID NO: 3980562 - RNA, 21 nt, Staphylococcus aureus subsp. aureus Mu50
auugauauaaauuaucagaau

SEQ ID NO: 3980563 - RNA, 18 nt, Staphylococcus aureus subsp. aureus Mu50
auugauauggaucauaau

SEQ ID NO: 3980564 - RNA, 15 nt, Staphylococcus aureus subsp. aureus Mu50
auugaucugauuuca

SEQ ID NO: 3980565 - RNA, 15 nt, Staphylococcus aureus subsp. aureus Mu50
auugaugaauaaaua

SEQ ID NO: 3980566 - RNA, 21 nt, Staphylococcus aureus subsp. aureus Mu50
auugaugaauaaauagauaau

SEQ ID NO: 3980567 - RNA, 20 nt, Staphylococcus aureus subsp. aureus Mu50
auugaugucaauuucacgcu

SEQ ID NO: 3980568 - RNA, 18 nt, Staphylococcus aureus subsp. aureus Mu50
auugaugucacauaugac

SEQ ID NO: 3980569 - RNA, 20 nt, Staphylococcus aureus subsp. aureus Mu50
auuguugcaaaauacgauuu

SEQ ID NO: 3980570 - RNA, 16 nt, Staphylococcus aureus subsp. aureus Mu50
auuguugcaaugauua

SEQ ID NO: 3980571 - RNA, 18 nt, Staphylococcus aureus subsp. aureus Mu50
auuguugcaaugauuaau

SEQ ID NO: 3980572 - RNA, 14 nt, Staphylococcus aureus subsp. aureus Mu50
auuguuguaaauga

SEQ ID NO: 3980573 - RNA, 20 nt, Staphylococcus aureus subsp. aureus Mu50
auuguuguaauucuuuuuca

SEQ ID NO: 3980574 - RNA, 18 nt, Staphylococcus aureus subsp. aureus Mu50
auuguuuaauaacaaaau

SEQ ID NO: 3980575 - RNA, 20 nt, Staphylococcus aureus subsp. aureus Mu50
auuguuuaauaacaaaauua

SEQ ID NO: 3980576 - RNA, 14 nt, Staphylococcus aureus subsp. aureus Mu50
auuguuuacaaagu

SEQ ID NO: 3980577 - RNA, 17 nt, Staphylococcus aureus subsp. aureus Mu50
auuguuuagucuucuuu

SEQ ID NO: 3980578 - RNA, 20 nt, Staphylococcus aureus subsp. aureus Mu50
auuguuuuagcaauuugcug

SEQ ID NO: 3980579 - RNA, 19 nt, Staphylococcus aureus subsp. aureus Mu50
auuguuuuggcuuugagug

SEQ ID NO: 3980580 - RNA, 13 nt, Staphylococcus aureus subsp. aureus Mu50
auuguuuuuaaaa

SEQ ID NO: 3980581 - RNA, 14 nt, Staphylococcus aureus subsp. aureus Mu50
auuuaaaaaaugcg

SEQ ID NO: 3980582 - RNA, 14 nt, Staphylococcus aureus subsp. aureus Mu50
auuuaaaaaauuua

SEQ ID NO: 3980583 - RNA, 21 nt, Staphylococcus aureus subsp. aureus Mu50
auuuaaaaagcaguaaguuga

SEQ ID NO: 3980584 - RNA, 14 nt, Staphylococcus aureus subsp. aureus Mu50
auuuaaaaaucaaa

SEQ ID NO: 3980585 - RNA, 16 nt, Staphylococcus aureus subsp. aureus Mu50
auuuaaaaaucaaaga

SEQ ID NO: 3980586 - RNA, 17 nt, Staphylococcus aureus subsp. aureus Mu50
auuuaaaaaucgaauuu

SEQ ID NO: 3980587 - RNA, 12 nt, Staphylococcus aureus subsp. aureus Mu50
auuuaaaagaaa

SEQ ID NO: 3980588 - RNA, 12 nt, Staphylococcus aureus subsp. aureus Mu50
auuuaaaagaga

SEQ ID NO: 3980589 - RNA, 14 nt, Staphylococcus aureus subsp. aureus Mu50
auuuaaaagagaau

SEQ ID NO: 3980590 - RNA, 13 nt, Staphylococcus aureus subsp. aureus Mu50
auuuaaaagauua

SEQ ID NO: 3980591 - RNA, 22 nt, Staphylococcus aureus subsp. aureus Mu50
auuuaaaagauuagaugauauu

SEQ ID NO: 3980592 - RNA, 21 nt, Staphylococcus aureus subsp. aureus Mu50
auuuaaaauaguucuuuaaau

SEQ ID NO: 3980593 - RNA, 22 nt, Staphylococcus aureus subsp. aureus Mu50
auuuaaaauaguucuuuaaauu

SEQ ID NO: 3980594 - RNA, 14 nt, Staphylococcus aureus subsp. aureus Mu50
auuuaaaauauaaa

SEQ ID NO: 3980595 - RNA, 22 nt, Staphylococcus aureus subsp. aureus Mu50
auuuaaaauauaaauuucuuca

SEQ ID NO: 3980596 - RNA, 17 nt, Staphylococcus aureus subsp. aureus Mu50
auuuaaaauauuauuuu

SEQ ID NO: 3980597 - RNA, 21 nt, Staphylococcus aureus subsp. aureus Mu50
auuuaaaaucggacaacugag

SEQ ID NO: 3980598 - RNA, 20 nt, Staphylococcus aureus subsp. aureus Mu50
auuuaaacauccaauuaugu

SEQ ID NO: 3980599 - RNA, 22 nt, Staphylococcus aureus subsp. aureus Mu50
auuuaaacgaucuucccaucuu

SEQ ID NO: 3980600 - RNA, 13 nt, Staphylococcus aureus subsp. aureus Mu50
auuuaaacuagua

SEQ ID NO: 3980601 - RNA, 14 nt, Staphylococcus aureus subsp. aureus Mu50
auuuaaacuaguaa

SEQ ID NO: 3980602 - RNA, 17 nt, Staphylococcus aureus subsp. aureus Mu50
auuuaaagaacuauuuu

SEQ ID NO: 3980603 - RNA, 14 nt, Staphylococcus aureus subsp. aureus Mu50
auuuaaagcaucau

SEQ ID NO: 3980604 - RNA, 18 nt, Staphylococcus aureus subsp. aureus Mu50
auuuaaaggcauaauaac

SEQ ID NO: 3980605 - RNA, 20 nt, Staphylococcus aureus subsp. aureus Mu50
auuuaaaggcauaauaacca

SEQ ID NO: 3980606 - RNA, 17 nt, Staphylococcus aureus subsp. aureus Mu50
auuuaaagucuucaucu

SEQ ID NO: 3980607 - RNA, 15 nt, Staphylococcus aureus subsp. aureus Mu50
auuuaaauaacaagu

SEQ ID NO: 3980608 - RNA, 21 nt, Staphylococcus aureus subsp. aureus Mu50
auuuaaaucuaagugguugaa

SEQ ID NO: 3980609 - RNA, 13 nt, Staphylococcus aureus subsp. aureus Mu50
auuuaaaugucuu

SEQ ID NO: 3980610 - RNA, 21 nt, Staphylococcus aureus subsp. aureus Mu50
auuuaaaugucuuucaaauac

SEQ ID NO: 3980611 - RNA, 18 nt, Staphylococcus aureus subsp. aureus Mu50
auuuaaauugacuuuaau

SEQ ID NO: 3980612 - RNA, 14 nt, Staphylococcus aureus subsp. aureus Mu50
auuuaacaaaauua

SEQ ID NO: 3980613 - RNA, 14 nt, Staphylococcus aureus subsp. aureus Mu50
auuuaacauaaaaa

SEQ ID NO: 3980614 - RNA, 17 nt, Staphylococcus aureus subsp. aureus Mu50
auuuaacauaaaaaugc

SEQ ID NO: 3980615 - RNA, 14 nt, Staphylococcus aureus subsp. aureus Mu50
auuuaacaucaauu

SEQ ID NO: 3980616 - RNA, 23 nt, Staphylococcus aureus subsp. aureus Mu50
auuuaaccaguucgaaaauuaua

SEQ ID NO: 3980617 - RNA, 23 nt, Staphylococcus aureus subsp. aureus Mu50
auuuaacggaaauacaaugaauu

SEQ ID NO: 3980618 - RNA, 17 nt, Staphylococcus aureus subsp. aureus Mu50
auuuaacucaacuuaaa

SEQ ID NO: 3980619 - RNA, 20 nt, Staphylococcus aureus subsp. aureus Mu50
auuuaacucaacuuaaauau

SEQ ID NO: 3980620 - RNA, 23 nt, Staphylococcus aureus subsp. aureus Mu50
auuuaagaaugcgaagauuuuua

SEQ ID NO: 3980621 - RNA, 18 nt, Staphylococcus aureus subsp. aureus Mu50
auuuaagggucacaccca

SEQ ID NO: 3980622 - RNA, 22 nt, Staphylococcus aureus subsp. aureus Mu50
auuuaagggucacacccauacu

SEQ ID NO: 3980623 - RNA, 23 nt, Staphylococcus aureus subsp. aureus Mu50
auuuaagggucacacccauacuc

SEQ ID NO: 3980624 - RNA, 17 nt, Staphylococcus aureus subsp. aureus Mu50
auuuaaguuuauaauca

SEQ ID NO: 3980625 - RNA, 21 nt, Staphylococcus aureus subsp. aureus Mu50
auuuaauaaaaaccaauauuu

SEQ ID NO: 3980626 - RNA, 14 nt, Staphylococcus aureus subsp. aureus Mu50
auuuaauaaaccag

SEQ ID NO: 3980627 - RNA, 20 nt, Staphylococcus aureus subsp. aureus Mu50
auuuaauaacguacauuuau

SEQ ID NO: 3980628 - RNA, 20 nt, Staphylococcus aureus subsp. aureus Mu50
auuuaauaaguuaauguaau

SEQ ID NO: 3980629 - RNA, 21 nt, Staphylococcus aureus subsp. aureus Mu50
auuuaauacuauaguaagaaa

SEQ ID NO: 3980630 - RNA, 16 nt, Staphylococcus aureus subsp. aureus Mu50
auuuaauacuuuucuc

SEQ ID NO: 3980631 - RNA, 20 nt, Staphylococcus aureus subsp. aureus Mu50
auuuaauacuuuucucgauu

SEQ ID NO: 3980632 - RNA, 23 nt, Staphylococcus aureus subsp. aureus Mu50
auuuaauaggcuauguaaaucgu

SEQ ID NO: 3980633 - RNA, 19 nt, Staphylococcus aureus subsp. aureus Mu50
auuuaauaucacgaucuuu

SEQ ID NO: 3980634 - RNA, 23 nt, Staphylococcus aureus subsp. aureus Mu50
auuuaauaucacgaucuuuaaag

SEQ ID NO: 3980635 - RNA, 15 nt, Staphylococcus aureus subsp. aureus Mu50
auuuaauauuguuaa

SEQ ID NO: 3980636 - RNA, 19 nt, Staphylococcus aureus subsp. aureus Mu50
auuuaauauuuagauacug

SEQ ID NO: 3980637 - RNA, 14 nt, Staphylococcus aureus subsp. aureus Mu50
auuuaauccuucuc

SEQ ID NO: 3980638 - RNA, 12 nt, Staphylococcus aureus subsp. aureus Mu50
auuuaaucuauu

SEQ ID NO: 3980639 - RNA, 13 nt, Staphylococcus aureus subsp. aureus Mu50
auuuaaugcguug

SEQ ID NO: 3980640 - RNA, 23 nt, Staphylococcus aureus subsp. aureus Mu50
auuuaauggucuaauaucaauuu

SEQ ID NO: 3980641 - RNA, 21 nt, Staphylococcus aureus subsp. aureus Mu50
auuuaauguuuuagugacaaa

SEQ ID NO: 3980642 - RNA, 18 nt, Staphylococcus aureus subsp. aureus Mu50
auuuaauuccauuaaguu

SEQ ID NO: 3980643 - RNA, 18 nt, Staphylococcus aureus subsp. aureus Mu50
auuuaauucugguuuaau

SEQ ID NO: 3980644 - RNA, 14 nt, Staphylococcus aureus subsp. aureus Mu50
auuuaauugaaaua

SEQ ID NO: 3980645 - RNA, 16 nt, Staphylococcus aureus subsp. aureus Mu50
auuuaauuuaauuuua

SEQ ID NO: 3980646 - RNA, 14 nt, Staphylococcus aureus subsp. aureus Mu50
auuuaauuuuucua

SEQ ID NO: 3980647 - RNA, 20 nt, Staphylococcus aureus subsp. aureus Mu50
auuuaauuuuucuaaaugau

SEQ ID NO: 3980648 - RNA, 21 nt, Staphylococcus aureus subsp. aureus Mu50
auuuaauuuuucuaaaugauu

SEQ ID NO: 3980649 - RNA, 19 nt, Staphylococcus aureus subsp. aureus Mu50
auuuacaaauguauaaaua

SEQ ID NO: 3980650 - RNA, 17 nt, Staphylococcus aureus subsp. aureus Mu50
auuuacaauguuaucuu

SEQ ID NO: 3980651 - RNA, 21 nt, Staphylococcus aureus subsp. aureus Mu50
auuuacaauguuaucuugcuu

SEQ ID NO: 3980652 - RNA, 23 nt, Staphylococcus aureus subsp. aureus Mu50
auuuacaauuaauuacuguaaau

SEQ ID NO: 3980653 - RNA, 19 nt, Staphylococcus aureus subsp. aureus Mu50
auuuacacacaugauaauu

SEQ ID NO: 3980654 - RNA, 15 nt, Staphylococcus aureus subsp. aureus Mu50
auuuacaccuauacc

SEQ ID NO: 3980655 - RNA, 18 nt, Staphylococcus aureus subsp. aureus Mu50
auuuacaccuauaccuca

SEQ ID NO: 3980656 - RNA, 17 nt, Staphylococcus aureus subsp. aureus Mu50
auuucaacaaacauaaa

SEQ ID NO: 3980657 - RNA, 20 nt, Staphylococcus aureus subsp. aureus Mu50
auuucaacuuuuuaauaaua

SEQ ID NO: 3980658 - RNA, 16 nt, Staphylococcus aureus subsp. aureus Mu50
auuucaagguauacac

SEQ ID NO: 3980659 - RNA, 13 nt, Staphylococcus aureus subsp. aureus Mu50
auuucaauuugga

SEQ ID NO: 3980660 - RNA, 14 nt, Staphylococcus aureus subsp. aureus Mu50
auuucaauuuggaa

SEQ ID NO: 3980661 - RNA, 17 nt, Staphylococcus aureus subsp. aureus Mu50
auuucaauuuggaaaua

SEQ ID NO: 3980662 - RNA, 23 nt, Staphylococcus aureus subsp. aureus Mu50
auuucaauuuggaaauaucuuac

SEQ ID NO: 3980663 - RNA, 15 nt, Staphylococcus aureus subsp. aureus Mu50
auuucaccgcuuuca

SEQ ID NO: 3980664 - RNA, 22 nt, Staphylococcus aureus subsp. aureus Mu50
auuucaccgcuuucaaucgcuu

SEQ ID NO: 3980665 - RNA, 18 nt, Staphylococcus aureus subsp. aureus Mu50
auuucacgcugaaauuuu

SEQ ID NO: 3980666 - RNA, 16 nt, Staphylococcus aureus subsp. aureus Mu50
auuucacucuacaauc

SEQ ID NO: 3980667 - RNA, 11 nt, Staphylococcus aureus subsp. aureus Mu50
auuucacuuua

SEQ ID NO: 3980668 - RNA, 19 nt, Staphylococcus aureus subsp. aureus Mu50
auuucagaaauacauccau

SEQ ID NO: 3980669 - RNA, 19 nt, Staphylococcus aureus subsp. aureus Mu50
auuucagcuuauuaagcuu

SEQ ID NO: 3980670 - RNA, 15 nt, Staphylococcus aureus subsp. aureus Mu50
auuucaguucaucau

SEQ ID NO: 3980671 - RNA, 16 nt, Staphylococcus aureus subsp. aureus Mu50
auuucaguucaucaua

SEQ ID NO: 3980672 - RNA, 20 nt, Staphylococcus aureus subsp. aureus Mu50
auuucaguucuuagauuuuc

SEQ ID NO: 3980673 - RNA, 21 nt, Staphylococcus aureus subsp. aureus Mu50
auuucauaaaguuuauuuaug

SEQ ID NO: 3980674 - RNA, 17 nt, Staphylococcus aureus subsp. aureus Mu50
auuucauaguguuugua

SEQ ID NO: 3980675 - RNA, 11 nt, Staphylococcus aureus subsp. aureus Mu50
auuucaucaaa

SEQ ID NO: 3980676 - RNA, 13 nt, Staphylococcus aureus subsp. aureus Mu50
auuucaucaaauc

SEQ ID NO: 3980677 - RNA, 13 nt, Staphylococcus aureus subsp. aureus Mu50
auuucaucaauaa

SEQ ID NO: 3980678 - RNA, 15 nt, Staphylococcus aureus subsp. aureus Mu50
auuucaucaauaauu

SEQ ID NO: 3980679 - RNA, 20 nt, Staphylococcus aureus subsp. aureus Mu50
auuucaucaugugcuuuguu

SEQ ID NO: 3980680 - RNA, 18 nt, Staphylococcus aureus subsp. aureus Mu50
auuucaugugcaagcuuu

SEQ ID NO: 3980681 - RNA, 21 nt, Staphylococcus aureus subsp. aureus Mu50
auuucaugugcaagcuuuuua

SEQ ID NO: 3980682 - RNA, 13 nt, Staphylococcus aureus subsp. aureus Mu50
auuucauuuaugc

SEQ ID NO: 3980683 - RNA, 17 nt, Staphylococcus aureus subsp. aureus Mu50
auuucauuuaugcgauu

SEQ ID NO: 3980684 - RNA, 21 nt, Staphylococcus aureus subsp. aureus Mu50
auuucauuugaaauaguuaaa

SEQ ID NO: 3980685 - RNA, 13 nt, Staphylococcus aureus subsp. aureus Mu50
auuuccaucauuu

SEQ ID NO: 3980686 - RNA, 18 nt, Staphylococcus aureus subsp. aureus Mu50
auuuccuaaaaacuguga

SEQ ID NO: 3980687 - RNA, 21 nt, Staphylococcus aureus subsp. aureus Mu50
auuuccucaccuucauuuuca

SEQ ID NO: 3980688 - RNA, 16 nt, Staphylococcus aureus subsp. aureus Mu50
auuuccucgguuuuau

SEQ ID NO: 3980689 - RNA, 15 nt, Staphylococcus aureus subsp. aureus Mu50
auuuccuuaauaugc

SEQ ID NO: 3980690 - RNA, 14 nt, Staphylococcus aureus subsp. aureus Mu50
auuucgaaaagaaa

SEQ ID NO: 3980691 - RNA, 16 nt, Staphylococcus aureus subsp. aureus Mu50
auuucgaaaagaaauu

SEQ ID NO: 3980692 - RNA, 17 nt, Staphylococcus aureus subsp. aureus Mu50
auuucgaaaagaaauuc

SEQ ID NO: 3980693 - RNA, 18 nt, Staphylococcus aureus subsp. aureus Mu50
auuucgaaaagaaauucu

SEQ ID NO: 3980694 - RNA, 21 nt, Staphylococcus aureus subsp. aureus Mu50
auuucgaaaagaaauucuaca

SEQ ID NO: 3980695 - RNA, 16 nt, Staphylococcus aureus subsp. aureus Mu50
auuucgacaucuagau

SEQ ID NO: 3980696 - RNA, 20 nt, Staphylococcus aureus subsp. aureus Mu50
auuucgacaucuagaugaaa

SEQ ID NO: 3980697 - RNA, 20 nt, Staphylococcus aureus subsp. aureus Mu50
auuucgauaccuaaaauacc

SEQ ID NO: 3980698 - RNA, 15 nt, Staphylococcus aureus subsp. aureus Mu50
auuucgccucaucua

SEQ ID NO: 3980699 - RNA, 18 nt, Staphylococcus aureus subsp. aureus Mu50
auuucgccucaucuaauu

SEQ ID NO: 3980700 - RNA, 19 nt, Staphylococcus aureus subsp. aureus Mu50
auuucgccucaucuaauuu

SEQ ID NO: 3980701 - RNA, 12 nt, Staphylococcus aureus subsp. aureus Mu50
auuucgcuuuuu

SEQ ID NO: 3980702 - RNA, 15 nt, Staphylococcus aureus subsp. aureus Mu50
auuucgcuuuuuuua

SEQ ID NO: 3980703 - RNA, 22 nt, Staphylococcus aureus subsp. aureus Mu50
auuucgcuuuuuuuauuuuucu

SEQ ID NO: 3980704 - RNA, 15 nt, Staphylococcus aureus subsp. aureus Mu50
auuucgguauuuuaa

SEQ ID NO: 3980705 - RNA, 17 nt, Staphylococcus aureus subsp. aureus Mu50
auuucgguauuuuaaau

SEQ ID NO: 3980706 - RNA, 18 nt, Staphylococcus aureus subsp. aureus Mu50
auuucgguauuuuaaauu

SEQ ID NO: 3980707 - RNA, 20 nt, Staphylococcus aureus subsp. aureus Mu50
auuucguggaccuauuguau

SEQ ID NO: 3980708 - RNA, 13 nt, Staphylococcus aureus subsp. aureus Mu50
auuucuaaauuau

SEQ ID NO: 3980709 - RNA, 14 nt, Staphylococcus aureus subsp. aureus Mu50
auuucuacucgaaa

SEQ ID NO: 3980710 - RNA, 15 nt, Staphylococcus aureus subsp. aureus Mu50
auuucuacucgaaac

SEQ ID NO: 3980711 - RNA, 20 nt, Staphylococcus aureus subsp. aureus Mu50
auuucuauaucuauuuauca

SEQ ID NO: 3980712 - RNA, 13 nt, Staphylococcus aureus subsp. aureus Mu50
auuucuaucaaau

SEQ ID NO: 3980713 - RNA, 14 nt, Staphylococcus aureus subsp. aureus Mu50
auuucuaucaaaua

SEQ ID NO: 3980714 - RNA, 15 nt, Staphylococcus aureus subsp. aureus Mu50
auuucuaucaaauaa

SEQ ID NO: 3980715 - RNA, 16 nt, Staphylococcus aureus subsp. aureus Mu50
auuucuaucaaauaau

SEQ ID NO: 3980716 - RNA, 20 nt, Staphylococcus aureus subsp. aureus Mu50
auuucuaucaaauaaugaau

SEQ ID NO: 3980717 - RNA, 16 nt, Staphylococcus aureus subsp. aureus Mu50
auuucuaugaaaaaaa

SEQ ID NO: 3980718 - RNA, 21 nt, Staphylococcus aureus subsp. aureus Mu50
auuucuauuuauugagauaga

SEQ ID NO: 3980719 - RNA, 23 nt, Staphylococcus aureus subsp. aureus Mu50
auuucucauacuauaagcaauuu

SEQ ID NO: 3980720 - RNA, 20 nt, Staphylococcus aureus subsp. aureus Mu50
auuucucguuucgucagauu

SEQ ID NO: 3980721 - RNA, 13 nt, Staphylococcus aureus subsp. aureus Mu50
auuucucuuucaa

SEQ ID NO: 3980722 - RNA, 19 nt, Staphylococcus aureus subsp. aureus Mu50
auuucugaacauaaaaaau

SEQ ID NO: 3980723 - RNA, 14 nt, Staphylococcus aureus subsp. aureus Mu50
auuucugaauuuuu

SEQ ID NO: 3980724 - RNA, 16 nt, Staphylococcus aureus subsp. aureus Mu50
auuucugaauuuuuca

SEQ ID NO: 3980725 - RNA, 16 nt, Staphylococcus aureus subsp. aureus Mu50
auuucugacaacuuaa

SEQ ID NO: 3980726 - RNA, 14 nt, Staphylococcus aureus subsp. aureus Mu50
auuucugaugcuag

SEQ ID NO: 3980727 - RNA, 15 nt, Staphylococcus aureus subsp. aureus Mu50
auuucugcuucuuuu

SEQ ID NO: 3980728 - RNA, 19 nt, Staphylococcus aureus subsp. aureus Mu50
auuucuggcguacauauaa

SEQ ID NO: 3980729 - RNA, 14 nt, Staphylococcus aureus subsp. aureus Mu50
auuucuguaccaaa

SEQ ID NO: 3980730 - RNA, 18 nt, Staphylococcus aureus subsp. aureus Mu50
auuucuguaccaaauuug

SEQ ID NO: 3980731 - RNA, 19 nt, Staphylococcus aureus subsp. aureus Mu50
auuucuuaacauccuuuga

SEQ ID NO: 3980732 - RNA, 23 nt, Staphylococcus aureus subsp. aureus Mu50
auuucuuagauuuuauauaaaaa

SEQ ID NO: 3980733 - RNA, 19 nt, Staphylococcus aureus subsp. aureus Mu50
auuucuugauggauauuca

SEQ ID NO: 3980734 - RNA, 13 nt, Staphylococcus aureus subsp. aureus Mu50
auuucuugcuuca

SEQ ID NO: 3980735 - RNA, 17 nt, Staphylococcus aureus subsp. aureus Mu50
auuucuuuucauuauca

SEQ ID NO: 3980736 - RNA, 15 nt, Staphylococcus aureus subsp. aureus Mu50
auuucuuuucgaaau

SEQ ID NO: 3980737 - RNA, 19 nt, Staphylococcus aureus subsp. aureus Mu50
auuucuuuuuaaaaucguu

SEQ ID NO: 3980738 - RNA, 21 nt, Staphylococcus aureus subsp. aureus Mu50
auuucuuuuuaaaaucguuaa

SEQ ID NO: 3980739 - RNA, 14 nt, Staphylococcus aureus subsp. aureus Mu50
auuugaaaauauua

SEQ ID NO: 3980740 - RNA, 22 nt, Staphylococcus aureus subsp. aureus Mu50
auuugaaaauauuacuaacaac

SEQ ID NO: 3980741 - RNA, 16 nt, Staphylococcus aureus subsp. aureus Mu50
auuugaaagacauuua

SEQ ID NO: 3980742 - RNA, 15 nt, Staphylococcus aureus subsp. aureus Mu50
auuugaaauauacca

SEQ ID NO: 3980743 - RNA, 16 nt, Staphylococcus aureus subsp. aureus Mu50
auuugaacaucauuua

SEQ ID NO: 3980744 - RNA, 21 nt, Staphylococcus aureus subsp. aureus Mu50
auuuuaauauugaaaugagcu

SEQ ID NO: 3980745 - RNA, 18 nt, Staphylococcus aureus subsp. aureus Mu50
auuuuaauuaauuaucau

SEQ ID NO: 3980746 - RNA, 19 nt, Staphylococcus aureus subsp. aureus Mu50
auuuuaauuaauuauuaua

SEQ ID NO: 3980747 - RNA, 18 nt, Staphylococcus aureus subsp. aureus Mu50
auuuuacaaaauauggaa

SEQ ID NO: 3980748 - RNA, 19 nt, Staphylococcus aureus subsp. aureus Mu50
auuuuaccaucaaugagca

SEQ ID NO: 3980749 - RNA, 16 nt, Staphylococcus aureus subsp. aureus Mu50
auuuuaccauguuuua

SEQ ID NO: 3980750 - RNA, 17 nt, Staphylococcus aureus subsp. aureus Mu50
auuuuaccauguuuuac

SEQ ID NO: 3980751 - RNA, 21 nt, Staphylococcus aureus subsp. aureus Mu50
auuuuaccuguuucuuuacuu

SEQ ID NO: 3980752 - RNA, 21 nt, Staphylococcus aureus subsp. aureus Mu50
auuuuaccuucgcauacuuuu

SEQ ID NO: 3980753 - RNA, 21 nt, Staphylococcus aureus subsp. aureus Mu50
auuuuaccuugagcagcauca

SEQ ID NO: 3980754 - RNA, 23 nt, Staphylococcus aureus subsp. aureus Mu50
auuuuaccuugagcagcaucaau

SEQ ID NO: 3980755 - RNA, 19 nt, Staphylococcus aureus subsp. aureus Mu50
auuuuacgaaaauaucauu

SEQ ID NO: 3980756 - RNA, 13 nt, Staphylococcus aureus subsp. aureus Mu50
auuuuacucugua

SEQ ID NO: 3980757 - RNA, 18 nt, Staphylococcus aureus subsp. aureus Mu50
auuuuacuuacuuuucua

SEQ ID NO: 3980758 - RNA, 19 nt, Staphylococcus aureus subsp. aureus Mu50
auuuuagcaaaagcuuuua

SEQ ID NO: 3980759 - RNA, 16 nt, Staphylococcus aureus subsp. aureus Mu50
auuuuaggcaauguaa

SEQ ID NO: 3980760 - RNA, 19 nt, Staphylococcus aureus subsp. aureus Mu50
auuuuaggcaauguaaugg

SEQ ID NO: 3980761 - RNA, 21 nt, Staphylococcus aureus subsp. aureus Mu50
auuuuagucgucgaaaugccu

SEQ ID NO: 3980762 - RNA, 18 nt, Staphylococcus aureus subsp. aureus Mu50
auuuuagugccgagcuuu

SEQ ID NO: 3980763 - RNA, 20 nt, Staphylococcus aureus subsp. aureus Mu50
auuuuaguucacaugaauuu

SEQ ID NO: 3980764 - RNA, 15 nt, Staphylococcus aureus subsp. aureus Mu50
auuuuauaaaucaaa

SEQ ID NO: 3980765 - RNA, 18 nt, Staphylococcus aureus subsp. aureus Mu50
auuuuauaagaauuuaaa

SEQ ID NO: 3980766 - RNA, 22 nt, Staphylococcus aureus subsp. aureus Mu50
auuuuauaagaauuuaaaagag

SEQ ID NO: 3980767 - RNA, 13 nt, Staphylococcus aureus subsp. aureus Mu50
auuuuauacauaa

SEQ ID NO: 3980768 - RNA, 14 nt, Staphylococcus aureus subsp. aureus Mu50
auuuuauauaaaaa

SEQ ID NO: 3980769 - RNA, 18 nt, Staphylococcus aureus subsp. aureus Mu50
auuuuauauaaaaagaag

SEQ ID NO: 3980770 - RNA, 12 nt, Staphylococcus aureus subsp. aureus Mu50
auuuuauauuuu

SEQ ID NO: 3980771 - RNA, 14 nt, Staphylococcus aureus subsp. aureus Mu50
auuuuauauuuuag

SEQ ID NO: 3980772 - RNA, 14 nt, Staphylococcus aureus subsp. aureus Mu50
auuuuaucaaauuc

SEQ ID NO: 3980773 - RNA, 15 nt, Staphylococcus aureus subsp. aureus Mu50
auuuuaucaaauuca

SEQ ID NO: 3980774 - RNA, 18 nt, Staphylococcus aureus subsp. aureus Mu50
auuuuaucaaauucauca

SEQ ID NO: 3980775 - RNA, 14 nt, Staphylococcus aureus subsp. aureus Mu50
auuuuaucaucuau

SEQ ID NO: 3980776 - RNA, 22 nt, Staphylococcus aureus subsp. aureus Mu50
auuuuauccaaaccaauuuuaa

SEQ ID NO: 3980777 - RNA, 23 nt, Staphylococcus aureus subsp. aureus Mu50
auuuuauccaaaccaauuuuaac

SEQ ID NO: 3980778 - RNA, 20 nt, Staphylococcus aureus subsp. aureus Mu50
auuuuaucuaaagcuauaaa

SEQ ID NO: 3980779 - RNA, 23 nt, Staphylococcus aureus subsp. aureus Mu50
auuuuaucuaaagcuauaaaaaa

SEQ ID NO: 3980780 - RNA, 15 nt, Staphylococcus aureus subsp. aureus Mu50
auuuuaucugaaaau

SEQ ID NO: 3980781 - RNA, 15 nt, Staphylococcus aureus subsp. aureus Mu50
auuuuaucuuauuau

SEQ ID NO: 3980782 - RNA, 12 nt, Staphylococcus aureus subsp. aureus Mu50
auuuuaugauuu

SEQ ID NO: 3980783 - RNA, 16 nt, Staphylococcus aureus subsp. aureus Mu50
auuuuaugauuugauu

SEQ ID NO: 3980784 - RNA, 15 nt, Staphylococcus aureus subsp. aureus Mu50
auuuuaugcacuuuu

SEQ ID NO: 3980785 - RNA, 14 nt, Staphylococcus aureus subsp. aureus Mu50
auuuuauuagaaua

SEQ ID NO: 3980786 - RNA, 21 nt, Staphylococcus aureus subsp. aureus Mu50
auuuuauuagguaauacuuuu

SEQ ID NO: 3980787 - RNA, 18 nt, Staphylococcus aureus subsp. aureus Mu50
auuuuauucacuuuuuuu

SEQ ID NO: 3980788 - RNA, 13 nt, Staphylococcus aureus subsp. aureus Mu50
auuuuauucuuca

SEQ ID NO: 3980789 - RNA, 16 nt, Staphylococcus aureus subsp. aureus Mu50
auuuuauuuauuuuga

SEQ ID NO: 3980790 - RNA, 11 nt, Staphylococcus aureus subsp. aureus Mu50
auuuucaaaac

SEQ ID NO: 3980791 - RNA, 16 nt, Staphylococcus aureus subsp. aureus Mu50
auuuucaaaacugcca

SEQ ID NO: 3980792 - RNA, 18 nt, Staphylococcus aureus subsp. aureus Mu50
auuuucaaaacugccaaa

SEQ ID NO: 3980793 - RNA, 14 nt, Staphylococcus aureus subsp. aureus Mu50
auuuucaacacacu

SEQ ID NO: 3980794 - RNA, 16 nt, Staphylococcus aureus subsp. aureus Mu50
auuuucaacacacuau

SEQ ID NO: 3980795 - RNA, 21 nt, Staphylococcus aureus subsp. aureus Mu50
auuuucaacacacuauuauag

SEQ ID NO: 3980796 - RNA, 19 nt, Staphylococcus aureus subsp. aureus Mu50
auuuucaagaccaaauauu

SEQ ID NO: 3980797 - RNA, 23 nt, Staphylococcus aureus subsp. aureus Mu50
auuuucaagaccaaauauuuuau

SEQ ID NO: 3980798 - RNA, 18 nt, Staphylococcus aureus subsp. aureus Mu50
auuuucaaguuuaaaaua

SEQ ID NO: 3980799 - RNA, 15 nt, Staphylococcus aureus subsp. aureus Mu50
auuuucaauaaauuu

SEQ ID NO: 3980800 - RNA, 18 nt, Staphylococcus aureus subsp. aureus Mu50
auuuucaauaaauuuuau

SEQ ID NO: 3980801 - RNA, 21 nt, Staphylococcus aureus subsp. aureus Mu50
auuuucaauaaauuuuauaua

SEQ ID NO: 3980802 - RNA, 16 nt, Staphylococcus aureus subsp. aureus Mu50
auuuucaauuagaaaa

SEQ ID NO: 3980803 - RNA, 22 nt, Staphylococcus aureus subsp. aureus Mu50
auuuucaauuagaaaacaucuu

SEQ ID NO: 3980804 - RNA, 21 nt, Staphylococcus aureus subsp. aureus Mu50
auuuucacaaucauagauaua

SEQ ID NO: 3980805 - RNA, 23 nt, Staphylococcus aureus subsp. aureus Mu50
auuuucacaaucauagauauaag

SEQ ID NO: 3980806 - RNA, 15 nt, Staphylococcus aureus subsp. aureus Mu50
auuuucacuuucaau

SEQ ID NO: 3980807 - RNA, 15 nt, Staphylococcus aureus subsp. aureus Mu50
auuuucauaaacucu

SEQ ID NO: 3980808 - RNA, 15 nt, Staphylococcus aureus subsp. aureus Mu50
auuuucauauaaaua

SEQ ID NO: 3980809 - RNA, 14 nt, Staphylococcus aureus subsp. aureus Mu50
auuuucaucauuaa

SEQ ID NO: 3980810 - RNA, 19 nt, Staphylococcus aureus subsp. aureus Mu50
auuuucauuuaauccuucu

SEQ ID NO: 3980811 - RNA, 11 nt, Staphylococcus aureus subsp. aureus Mu50
auuuucauuuu

SEQ ID NO: 3980812 - RNA, 13 nt, Staphylococcus aureus subsp. aureus Mu50
auuuucauuuuag

SEQ ID NO: 3980813 - RNA, 15 nt, Staphylococcus aureus subsp. aureus Mu50
auuuuccaucacaua

SEQ ID NO: 3980814 - RNA, 16 nt, Staphylococcus aureus subsp. aureus Mu50
auuuucucuauaauuu

SEQ ID NO: 3980815 - RNA, 14 nt, Staphylococcus aureus subsp. aureus Mu50
auuuucuguccaaa

SEQ ID NO: 3980816 - RNA, 17 nt, Staphylococcus aureus subsp. aureus Mu50
auuuucuguccaaaaag

SEQ ID NO: 3980817 - RNA, 23 nt, Staphylococcus aureus subsp. aureus Mu50
auuuucuguugcaguuucaaucg

SEQ ID NO: 3980818 - RNA, 21 nt, Staphylococcus aureus subsp. aureus Mu50
auuuucuguuuaauuaaaaua

SEQ ID NO: 3980819 - RNA, 20 nt, Staphylococcus aureus subsp. aureus Mu50
auuuucuucaccaguuucug

SEQ ID NO: 3980820 - RNA, 17 nt, Staphylococcus aureus subsp. aureus Mu50
auuuucuugccaucaau

SEQ ID NO: 3980821 - RNA, 17 nt, Staphylococcus aureus subsp. aureus Mu50
auuuucuuuaauaacua

SEQ ID NO: 3980822 - RNA, 15 nt, Staphylococcus aureus subsp. aureus Mu50
auuuucuuuuucuaa

SEQ ID NO: 3980823 - RNA, 21 nt, Staphylococcus aureus subsp. aureus Mu50
auuuucuuuuucuaaauaaac

SEQ ID NO: 3980824 - RNA, 16 nt, Staphylococcus aureus subsp. aureus Mu50
auuuucuuuuuuaauu

SEQ ID NO: 3980825 - RNA, 21 nt, Staphylococcus aureus subsp. aureus Mu50
auuuucuuuuuuuauggauuu

SEQ ID NO: 3980826 - RNA, 15 nt, Staphylococcus aureus subsp. aureus Mu50
auuuugaagaagugc

SEQ ID NO: 3980827 - RNA, 16 nt, Staphylococcus aureus subsp. aureus Mu50
auuuugaauaaaaaaa

SEQ ID NO: 3980828 - RNA, 17 nt, Staphylococcus aureus subsp. aureus Mu50
auuuugaauaugauauu

SEQ ID NO: 3980829 - RNA, 16 nt, Staphylococcus aureus subsp. aureus Mu50
auuuugaaucauacga

SEQ ID NO: 3980830 - RNA, 17 nt, Staphylococcus aureus subsp. aureus Mu50
auuuugacauaaaaaau

SEQ ID NO: 3980831 - RNA, 20 nt, Staphylococcus aureus subsp. aureus Mu50
auuuugacgccagaauaaau

SEQ ID NO: 3980832 - RNA, 22 nt, Staphylococcus aureus subsp. aureus Mu50
caaaaagcccuauuguuuuuua

SEQ ID NO: 3980833 - RNA, 20 nt, Staphylococcus aureus subsp. aureus Mu50
caaaaagguauucaaauaaa

SEQ ID NO: 3980834 - RNA, 13 nt, Staphylococcus aureus subsp. aureus Mu50
caaaaauaaaaau

SEQ ID NO: 3980835 - RNA, 18 nt, Staphylococcus aureus subsp. aureus Mu50
caaaaauaauuaaauccg

SEQ ID NO: 3980836 - RNA, 17 nt, Staphylococcus aureus subsp. aureus Mu50
caaaaauagauugaaaa

SEQ ID NO: 3980837 - RNA, 14 nt, Staphylococcus aureus subsp. aureus Mu50
caaaaaugaagaau

SEQ ID NO: 3980838 - RNA, 19 nt, Staphylococcus aureus subsp. aureus Mu50
caaaaaugaagaauacaaa

SEQ ID NO: 3980839 - RNA, 17 nt, Staphylococcus aureus subsp. aureus Mu50
caaaaauuguaaaaccu

SEQ ID NO: 3980840 - RNA, 15 nt, Staphylococcus aureus subsp. aureus Mu50
caaaacaaaaaauau

SEQ ID NO: 3980841 - RNA, 16 nt, Staphylococcus aureus subsp. aureus Mu50
caaaacaauaugaauu

SEQ ID NO: 3980842 - RNA, 21 nt, Staphylococcus aureus subsp. aureus Mu50
caaaacaccucgauauuaugu

SEQ ID NO: 3980843 - RNA, 13 nt, Staphylococcus aureus subsp. aureus Mu50
caaaacauauuca

SEQ ID NO: 3980844 - RNA, 18 nt, Staphylococcus aureus subsp. aureus Mu50
caaaacauauucaguaua

SEQ ID NO: 3980845 - RNA, 18 nt, Staphylococcus aureus subsp. aureus Mu50
caaaacauuuugugacuu

SEQ ID NO: 3980846 - RNA, 21 nt, Staphylococcus aureus subsp. aureus Mu50
caaaacauuuugugacuuugu

SEQ ID NO: 3980847 - RNA, 15 nt, Staphylococcus aureus subsp. aureus Mu50
caaaaccaaaugaac

SEQ ID NO: 3980848 - RNA, 20 nt, Staphylococcus aureus subsp. aureus Mu50
caaaaccgcuauaaaauuuu

SEQ ID NO: 3980849 - RNA, 22 nt, Staphylococcus aureus subsp. aureus Mu50
caaaaccgcuauaaaauuuuga

SEQ ID NO: 3980850 - RNA, 15 nt, Staphylococcus aureus subsp. aureus Mu50
caaaacgcauuucau

SEQ ID NO: 3980851 - RNA, 17 nt, Staphylococcus aureus subsp. aureus Mu50
caaaacgcauuucaugu

SEQ ID NO: 3980852 - RNA, 16 nt, Staphylococcus aureus subsp. aureus Mu50
caaaacuugcgcaugc

SEQ ID NO: 3980853 - RNA, 19 nt, Staphylococcus aureus subsp. aureus Mu50
caaaacuuuuacuuucuca

SEQ ID NO: 3980854 - RNA, 18 nt, Staphylococcus aureus subsp. aureus Mu50
caaaagaaaguuaauuau

SEQ ID NO: 3980855 - RNA, 21 nt, Staphylococcus aureus subsp. aureus Mu50
caaaagauguuucaaaauaau

SEQ ID NO: 3980856 - RNA, 23 nt, Staphylococcus aureus subsp. aureus Mu50
caaaagauguuucaaaauaauuu

SEQ ID NO: 3980857 - RNA, 24 nt, Staphylococcus aureus subsp. aureus Mu50
caaaauacucaacacgauagucau

SEQ ID NO: 3980858 - RNA, 13 nt, Staphylococcus aureus subsp. aureus Mu50
caaaauaguaaag

SEQ ID NO: 3980859 - RNA, 16 nt, Staphylococcus aureus subsp. aureus Mu50
caaaauauaaaauccu

SEQ ID NO: 3980860 - RNA, 20 nt, Staphylococcus aureus subsp. aureus Mu50
caaaauauacuaaauuugaa

SEQ ID NO: 3980861 - RNA, 18 nt, Staphylococcus aureus subsp. aureus Mu50
caaaauauggaauuucau

SEQ ID NO: 3980862 - RNA, 15 nt, Staphylococcus aureus subsp. aureus Mu50
caaaaucuuuacuug

SEQ ID NO: 3980863 - RNA, 15 nt, Staphylococcus aureus subsp. aureus Mu50
caaaaugguaucaau

SEQ ID NO: 3980864 - RNA, 16 nt, Staphylococcus aureus subsp. aureus Mu50
caaaaugguuaaaauc

SEQ ID NO: 3980865 - RNA, 22 nt, Staphylococcus aureus subsp. aureus Mu50
caaaaugguuaaaaucgcagca

SEQ ID NO: 3980866 - RNA, 17 nt, Staphylococcus aureus subsp. aureus Mu50
caaaauguuuaacaaua

SEQ ID NO: 3980867 - RNA, 18 nt, Staphylococcus aureus subsp. aureus Mu50
caaaauguuuaacaauaa

SEQ ID NO: 3980868 - RNA, 18 nt, Staphylococcus aureus subsp. aureus Mu50
caaaauuauguaaaaaau

SEQ ID NO: 3980869 - RNA, 17 nt, Staphylococcus aureus subsp. aureus Mu50
caaaauucaauauuaau

SEQ ID NO: 3980870 - RNA, 17 nt, Staphylococcus aureus subsp. aureus Mu50
caaaauuugaaauauac

SEQ ID NO: 3980871 - RNA, 12 nt, Staphylococcus aureus subsp. aureus Mu50
caaaauuuucua

SEQ ID NO: 3980872 - RNA, 11 nt, Staphylococcus aureus subsp. aureus Mu50
caaacaaaggg

SEQ ID NO: 3980873 - RNA, 21 nt, Staphylococcus aureus subsp. aureus Mu50
caaacaaaucuuuuaaauuua

SEQ ID NO: 3980874 - RNA, 22 nt, Staphylococcus aureus subsp. aureus Mu50
caaacaacaucacuuuaggguu

SEQ ID NO: 3980875 - RNA, 22 nt, Staphylococcus aureus subsp. aureus Mu50
caaacaaccugugauaaaaauc

SEQ ID NO: 3980876 - RNA, 12 nt, Staphylococcus aureus subsp. aureus Mu50
caaacaauacau

SEQ ID NO: 3980877 - RNA, 24 nt, Staphylococcus aureus subsp. aureus Mu50
caaacacaguacaaauaacaaaca

SEQ ID NO: 3980878 - RNA, 23 nt, Staphylococcus aureus subsp. aureus Mu50
caaacauuucgguaugauauuuc

SEQ ID NO: 3980879 - RNA, 12 nt, Staphylococcus aureus subsp. aureus Mu50
caaacauuuguu

SEQ ID NO: 3980880 - RNA, 14 nt, Staphylococcus aureus subsp. aureus Mu50
caaaccaccaaaaa

SEQ ID NO: 3980881 - RNA, 18 nt, Staphylococcus aureus subsp. aureus Mu50
caaaccauaaguaaaacu

SEQ ID NO: 3980882 - RNA, 18 nt, Staphylococcus aureus subsp. aureus Mu50
caaaccauuccaauuuca

SEQ ID NO: 3980883 - RNA, 16 nt, Staphylococcus aureus subsp. aureus Mu50
caaacccuuuaaacau

SEQ ID NO: 3980884 - RNA, 23 nt, Staphylococcus aureus subsp. aureus Mu50
caaaccuaucaucaaucguuaau

SEQ ID NO: 3980885 - RNA, 23 nt, Staphylococcus aureus subsp. aureus Mu50
caaacgacuaaccacauuauaau

SEQ ID NO: 3980886 - RNA, 17 nt, Staphylococcus aureus subsp. aureus Mu50
caaacgcacuaucaaug

SEQ ID NO: 3980887 - RNA, 12 nt, Staphylococcus aureus subsp. aureus Mu50
caaacguaugua

SEQ ID NO: 3980888 - RNA, 14 nt, Staphylococcus aureus subsp. aureus Mu50
caaacguauguaca

SEQ ID NO: 3980889 - RNA, 20 nt, Staphylococcus aureus subsp. aureus Mu50
caaacuaaaaggucaucuga

SEQ ID NO: 3980890 - RNA, 14 nt, Staphylococcus aureus subsp. aureus Mu50
caaacuauuaaugg

SEQ ID NO: 3980891 - RNA, 19 nt, Staphylococcus aureus subsp. aureus Mu50
caaagaaacggaaaugacu

SEQ ID NO: 3980892 - RNA, 20 nt, Staphylococcus aureus subsp. aureus Mu50
caaagaaagcuaauaucaau

SEQ ID NO: 3980893 - RNA, 23 nt, Staphylococcus aureus subsp. aureus Mu50
caaagaaagcuaauaucaauaau

SEQ ID NO: 3980894 - RNA, 15 nt, Staphylococcus aureus subsp. aureus Mu50
caaagaauuucgaaa

SEQ ID NO: 3980895 - RNA, 16 nt, Staphylococcus aureus subsp. aureus Mu50
caaagaauuucgaaaa

SEQ ID NO: 3980896 - RNA, 15 nt, Staphylococcus aureus subsp. aureus Mu50
caaagacauacaguc

SEQ ID NO: 3980897 - RNA, 19 nt, Staphylococcus aureus subsp. aureus Mu50
caaagacauacagucaaua

SEQ ID NO: 3980898 - RNA, 22 nt, Staphylococcus aureus subsp. aureus Mu50
caaagacauacagucaauacaa

SEQ ID NO: 3980899 - RNA, 17 nt, Staphylococcus aureus subsp. aureus Mu50
caaagacuaaaaagaag

SEQ ID NO: 3980900 - RNA, 16 nt, Staphylococcus aureus subsp. aureus Mu50
caaagacucaauuuca

SEQ ID NO: 3980901 - RNA, 21 nt, Staphylococcus aureus subsp. aureus Mu50
caaagacucaauuucauuuga

SEQ ID NO: 3980902 - RNA, 22 nt, Staphylococcus aureus subsp. aureus Mu50
caaagcccuaagcucguuaauu

SEQ ID NO: 3980903 - RNA, 14 nt, Staphylococcus aureus subsp. aureus Mu50
caaagccuuaauau

SEQ ID NO: 3980904 - RNA, 19 nt, Staphylococcus aureus subsp. aureus Mu50
caaagcuaaguuugaagga

SEQ ID NO: 3980905 - RNA, 18 nt, Staphylococcus aureus subsp. aureus Mu50
caaagcuauauaugaauu

SEQ ID NO: 3980906 - RNA, 17 nt, Staphylococcus aureus subsp. aureus Mu50
caaagcucaauaaauua

SEQ ID NO: 3980907 - RNA, 16 nt, Staphylococcus aureus subsp. aureus Mu50
caaagcuugauuuaac

SEQ ID NO: 3980908 - RNA, 18 nt, Staphylococcus aureus subsp. aureus Mu50
caaagcuugauuuaacaa

SEQ ID NO: 3980909 - RNA, 23 nt, Staphylococcus aureus subsp. aureus Mu50
caaaggcgcaccaugugccuuug

SEQ ID NO: 3980910 - RNA, 17 nt, Staphylococcus aureus subsp. aureus Mu50
caaagggcgaaauggau

SEQ ID NO: 3980911 - RNA, 17 nt, Staphylococcus aureus subsp. aureus Mu50
caaaguacaguuagugg

SEQ ID NO: 3980912 - RNA, 17 nt, Staphylococcus aureus subsp. aureus Mu50
caaaguagacauugaaa

SEQ ID NO: 3980913 - RNA, 16 nt, Staphylococcus aureus subsp. aureus Mu50
caaaguagauauugaa

SEQ ID NO: 3980914 - RNA, 18 nt, Staphylococcus aureus subsp. aureus Mu50
caaaguagauauugaaug

SEQ ID NO: 3980915 - RNA, 17 nt, Staphylococcus aureus subsp. aureus Mu50
caaagucauuaaaugua

SEQ ID NO: 3980916 - RNA, 14 nt, Staphylococcus aureus subsp. aureus Mu50
caaaguuauaaugg

SEQ ID NO: 3980917 - RNA, 17 nt, Staphylococcus aureus subsp. aureus Mu50
caaaguucguaauuguc

SEQ ID NO: 3980918 - RNA, 19 nt, Staphylococcus aureus subsp. aureus Mu50
caaaguuuauacuuaauau

SEQ ID NO: 3980919 - RNA, 18 nt, Staphylococcus aureus subsp. aureus Mu50
caacaaagugcaauuauu

SEQ ID NO: 3980920 - RNA, 12 nt, Staphylococcus aureus subsp. aureus Mu50
caacaaauuuaa

SEQ ID NO: 3980921 - RNA, 18 nt, Staphylococcus aureus subsp. aureus Mu50
caacaacuaagauauauu

SEQ ID NO: 3980922 - RNA, 19 nt, Staphylococcus aureus subsp. aureus Mu50
caacaacuaagauauauug

SEQ ID NO: 3980923 - RNA, 14 nt, Staphylococcus aureus subsp. aureus Mu50
caacaagguuucaa

SEQ ID NO: 3980924 - RNA, 15 nt, Staphylococcus aureus subsp. aureus Mu50
caacaauaaaucuuu

SEQ ID NO: 3980925 - RNA, 14 nt, Staphylococcus aureus subsp. aureus Mu50
caacaaucaaauua

SEQ ID NO: 3980926 - RNA, 18 nt, Staphylococcus aureus subsp. aureus Mu50
caacaaucacgauuaaug

SEQ ID NO: 3980927 - RNA, 22 nt, Staphylococcus aureus subsp. aureus Mu50
caacaaugcauccaaauauuaa

SEQ ID NO: 3980928 - RNA, 12 nt, Staphylococcus aureus subsp. aureus Mu50
caacaauucgau

SEQ ID NO: 3980929 - RNA, 12 nt, Staphylococcus aureus subsp. aureus Mu50
caacaauugcua

SEQ ID NO: 3980930 - RNA, 13 nt, Staphylococcus aureus subsp. aureus Mu50
caacaauugcuaa

SEQ ID NO: 3980931 - RNA, 17 nt, Staphylococcus aureus subsp. aureus Mu50
caacaauugcuaaucca

SEQ ID NO: 3980932 - RNA, 20 nt, Staphylococcus aureus subsp. aureus Mu50
caacaauugcuaauccauac

SEQ ID NO: 3980933 - RNA, 13 nt, Staphylococcus aureus subsp. aureus Mu50
caacacagagaau

SEQ ID NO: 3980934 - RNA, 16 nt, Staphylococcus aureus subsp. aureus Mu50
caacacagagaauuuc

SEQ ID NO: 3980935 - RNA, 14 nt, Staphylococcus aureus subsp. aureus Mu50
caacacauaaauua

SEQ ID NO: 3980936 - RNA, 19 nt, Staphylococcus aureus subsp. aureus Mu50
caacacauaaauuaagcau

SEQ ID NO: 3980937 - RNA, 15 nt, Staphylococcus aureus subsp. aureus Mu50
caacacccauauaau

SEQ ID NO: 3980938 - RNA, 16 nt, Staphylococcus aureus subsp. aureus Mu50
caacacccauauaauu

SEQ ID NO: 3980939 - RNA, 19 nt, Staphylococcus aureus subsp. aureus Mu50
caacacccauauaauuugg

SEQ ID NO: 3980940 - RNA, 15 nt, Staphylococcus aureus subsp. aureus Mu50
caacaccuaauauuu

SEQ ID NO: 3980941 - RNA, 22 nt, Staphylococcus aureus subsp. aureus Mu50
caacacguuguuguugaccacc

SEQ ID NO: 3980942 - RNA, 18 nt, Staphylococcus aureus subsp. aureus Mu50
caacagggguuuuuauau

SEQ ID NO: 3980943 - RNA, 11 nt, Staphylococcus aureus subsp. aureus Mu50
caacaguaauu

SEQ ID NO: 3980944 - RNA, 23 nt, Staphylococcus aureus subsp. aureus Mu50
caacaguuucuuggucugcugua

SEQ ID NO: 3980945 - RNA, 15 nt, Staphylococcus aureus subsp. aureus Mu50
caacaguuuuaaaga

SEQ ID NO: 3980946 - RNA, 21 nt, Staphylococcus aureus subsp. aureus Mu50
caacaguuuuauuaucuuugu

SEQ ID NO: 3980947 - RNA, 16 nt, Staphylococcus aureus subsp. aureus Mu50
caacauaauauuucuu

SEQ ID NO: 3980948 - RNA, 15 nt, Staphylococcus aureus subsp. aureus Mu50
caacauauaaaucau

SEQ ID NO: 3980949 - RNA, 17 nt, Staphylococcus aureus subsp. aureus Mu50
caacauauuauauauau

SEQ ID NO: 3980950 - RNA, 13 nt, Staphylococcus aureus subsp. aureus Mu50
caacauauuuuca

SEQ ID NO: 3980951 - RNA, 13 nt, Staphylococcus aureus subsp. aureus Mu50
caacaucgauuua

SEQ ID NO: 3980952 - RNA, 22 nt, Staphylococcus aureus subsp. aureus Mu50
caacaucgauuuaucauuauuu

SEQ ID NO: 3980953 - RNA, 14 nt, Staphylococcus aureus subsp. aureus Mu50
caacaucuuuuguu

SEQ ID NO: 3980954 - RNA, 22 nt, Staphylococcus aureus subsp. aureus Mu50
caacaucuuuuguugcucagug

SEQ ID NO: 3980955 - RNA, 18 nt, Staphylococcus aureus subsp. aureus Mu50
caacaucuuuuguuguuu

SEQ ID NO: 3980956 - RNA, 21 nt, Staphylococcus aureus subsp. aureus Mu50
caacauguuuggaugaacaaa

SEQ ID NO: 3980957 - RNA, 22 nt, Staphylococcus aureus subsp. aureus Mu50
caacauguuuggaugaacaaaa

SEQ ID NO: 3980958 - RNA, 15 nt, Staphylococcus aureus subsp. aureus Mu50
caacauuaauaaaua

SEQ ID NO: 3980959 - RNA, 17 nt, Staphylococcus aureus subsp. aureus Mu50
caacauuaauaaauaau

SEQ ID NO: 3980960 - RNA, 19 nt, Staphylococcus aureus subsp. aureus Mu50
caacauuaauaaauaauaa

SEQ ID NO: 3980961 - RNA, 15 nt, Staphylococcus aureus subsp. aureus Mu50
caacauuauuuauau

SEQ ID NO: 3980962 - RNA, 15 nt, Staphylococcus aureus subsp. aureus Mu50
caacauuauuuuugu

SEQ ID NO: 3980963 - RNA, 17 nt, Staphylococcus aureus subsp. aureus Mu50
caacauugagauuaucu

SEQ ID NO: 3980964 - RNA, 20 nt, Staphylococcus aureus subsp. aureus Mu50
caacauugagauuaucuuua

SEQ ID NO: 3980965 - RNA, 13 nt, Staphylococcus aureus subsp. aureus Mu50
caacauuuuuuau

SEQ ID NO: 3980966 - RNA, 18 nt, Staphylococcus aureus subsp. aureus Mu50
caaccaaaaccaaaugaa

SEQ ID NO: 3980967 - RNA, 13 nt, Staphylococcus aureus subsp. aureus Mu50
caaccaauuauua

SEQ ID NO: 3980968 - RNA, 22 nt, Staphylococcus aureus subsp. aureus Mu50
caaccgcuugggcugacauuuu

SEQ ID NO: 3980969 - RNA, 18 nt, Staphylococcus aureus subsp. aureus Mu50
caaccucugauguguuau

SEQ ID NO: 3980970 - RNA, 17 nt, Staphylococcus aureus subsp. aureus Mu50
caaccugugauaaaaau

SEQ ID NO: 3980971 - RNA, 19 nt, Staphylococcus aureus subsp. aureus Mu50
caacgacacgaacaacauu

SEQ ID NO: 3980972 - RNA, 17 nt, Staphylococcus aureus subsp. aureus Mu50
caacgagucauaaauau

SEQ ID NO: 3980973 - RNA, 14 nt, Staphylococcus aureus subsp. aureus Mu50
caacgauaccaaau

SEQ ID NO: 3980974 - RNA, 17 nt, Staphylococcus aureus subsp. aureus Mu50
caacgccauauuuauuu

SEQ ID NO: 3980975 - RNA, 21 nt, Staphylococcus aureus subsp. aureus Mu50
caacguauauaaguuaaaauu

SEQ ID NO: 3980976 - RNA, 18 nt, Staphylococcus aureus subsp. aureus Mu50
caacgucaucugcuugua

SEQ ID NO: 3980977 - RNA, 20 nt, Staphylococcus aureus subsp. aureus Mu50
caacguuauucguuaacaau

SEQ ID NO: 3980978 - RNA, 12 nt, Staphylococcus aureus subsp. aureus Mu50
caacuaagauau

SEQ ID NO: 3980979 - RNA, 16 nt, Staphylococcus aureus subsp. aureus Mu50
caacuaagaugacuga

SEQ ID NO: 3980980 - RNA, 16 nt, Staphylococcus aureus subsp. aureus Mu50
caacuaauaacaaaua

SEQ ID NO: 3980981 - RNA, 17 nt, Staphylococcus aureus subsp. aureus Mu50
caacuaauaacaaauag

SEQ ID NO: 3980982 - RNA, 20 nt, Staphylococcus aureus subsp. aureus Mu50
caacuaauuuaaagcaucau

SEQ ID NO: 3980983 - RNA, 15 nt, Staphylococcus aureus subsp. aureus Mu50
caacuacuuaaauua

SEQ ID NO: 3980984 - RNA, 18 nt, Staphylococcus aureus subsp. aureus Mu50
caacuauauauaguugau

SEQ ID NO: 3980985 - RNA, 19 nt, Staphylococcus aureus subsp. aureus Mu50
caacuauauauaguugauc

SEQ ID NO: 3980986 - RNA, 14 nt, Staphylococcus aureus subsp. aureus Mu50
caacucguuuuucc

SEQ ID NO: 3980987 - RNA, 14 nt, Staphylococcus aureus subsp. aureus Mu50
caacucuaacagcu

SEQ ID NO: 3980988 - RNA, 13 nt, Staphylococcus aureus subsp. aureus Mu50
caacugagaaauc

SEQ ID NO: 3980989 - RNA, 17 nt, Staphylococcus aureus subsp. aureus Mu50
caacugagaaaucuuaa

SEQ ID NO: 3980990 - RNA, 18 nt, Staphylococcus aureus subsp. aureus Mu50
caacugaucauuuucauu

SEQ ID NO: 3980991 - RNA, 16 nt, Staphylococcus aureus subsp. aureus Mu50
caacugcgacaugucc

SEQ ID NO: 3980992 - RNA, 18 nt, Staphylococcus aureus subsp. aureus Mu50
caacugcugcuaaaauaa

SEQ ID NO: 3980993 - RNA, 16 nt, Staphylococcus aureus subsp. aureus Mu50
caacugcuuuuuauua

SEQ ID NO: 3980994 - RNA, 20 nt, Staphylococcus aureus subsp. aureus Mu50
caacuguaguggaagacaau

SEQ ID NO: 3980995 - RNA, 21 nt, Staphylococcus aureus subsp. aureus Mu50
caacuuaaauaucgacaaauu

SEQ ID NO: 3980996 - RNA, 13 nt, Staphylococcus aureus subsp. aureus Mu50
caacuuaauagaa

SEQ ID NO: 3980997 - RNA, 17 nt, Staphylococcus aureus subsp. aureus Mu50
caacuuagaauuuacaa

SEQ ID NO: 3980998 - RNA, 13 nt, Staphylococcus aureus subsp. aureus Mu50
caacuuagcuuag

SEQ ID NO: 3980999 - RNA, 15 nt, Staphylococcus aureus subsp. aureus Mu50
caacuuauucuucac

SEQ ID NO: 3981000 - RNA, 14 nt, Staphylococcus aureus subsp. aureus Mu50
caacuucauuaguu

SEQ ID NO: 3981001 - RNA, 15 nt, Staphylococcus aureus subsp. aureus Mu50
caacuucgauaugau

SEQ ID NO: 3981002 - RNA, 23 nt, Staphylococcus aureus subsp. aureus Mu50
caacuucuucuccguauuuaccu

SEQ ID NO: 3981003 - RNA, 15 nt, Staphylococcus aureus subsp. aureus Mu50
caacuugaacuaaaa

SEQ ID NO: 3981004 - RNA, 22 nt, Staphylococcus aureus subsp. aureus Mu50
caacuugagcauuuuuauguua

SEQ ID NO: 3981005 - RNA, 19 nt, Staphylococcus aureus subsp. aureus Mu50
caacuugaucauuauaaaa

SEQ ID NO: 3981006 - RNA, 17 nt, Staphylococcus aureus subsp. aureus Mu50
caacuugcauugucugu

SEQ ID NO: 3981007 - RNA, 24 nt, Staphylococcus aureus subsp. aureus Mu50
caauaauugaugaaagacugacua

SEQ ID NO: 3981008 - RNA, 12 nt, Staphylococcus aureus subsp. aureus Mu50
caauaauuuaau

SEQ ID NO: 3981009 - RNA, 14 nt, Staphylococcus aureus subsp. aureus Mu50
caauaauuuuaucu

SEQ ID NO: 3981010 - RNA, 18 nt, Staphylococcus aureus subsp. aureus Mu50
caauacaccuauuacacu

SEQ ID NO: 3981011 - RNA, 19 nt, Staphylococcus aureus subsp. aureus Mu50
caauacagaacuuuaauaa

SEQ ID NO: 3981012 - RNA, 14 nt, Staphylococcus aureus subsp. aureus Mu50
caauaccauaauua

SEQ ID NO: 3981013 - RNA, 19 nt, Staphylococcus aureus subsp. aureus Mu50
caauaccgcgauaaauaac

SEQ ID NO: 3981014 - RNA, 14 nt, Staphylococcus aureus subsp. aureus Mu50
caauacgaaaucaa

SEQ ID NO: 3981015 - RNA, 19 nt, Staphylococcus aureus subsp. aureus Mu50
caauacgaaguguuauaaa

SEQ ID NO: 3981016 - RNA, 15 nt, Staphylococcus aureus subsp. aureus Mu50
caauacgaauaucug

SEQ ID NO: 3981017 - RNA, 13 nt, Staphylococcus aureus subsp. aureus Mu50
caauacgcaaugu

SEQ ID NO: 3981018 - RNA, 15 nt, Staphylococcus aureus subsp. aureus Mu50
caauaggaugaaacu

SEQ ID NO: 3981019 - RNA, 18 nt, Staphylococcus aureus subsp. aureus Mu50
caauagguacaacuaaau

SEQ ID NO: 3981020 - RNA, 20 nt, Staphylococcus aureus subsp. aureus Mu50
caauagguacaacuaaauau

SEQ ID NO: 3981021 - RNA, 14 nt, Staphylococcus aureus subsp. aureus Mu50
caauagguucauua

SEQ ID NO: 3981022 - RNA, 22 nt, Staphylococcus aureus subsp. aureus Mu50
caauagguucauuauuuaaaua

SEQ ID NO: 3981023 - RNA, 16 nt, Staphylococcus aureus subsp. aureus Mu50
caauaguauaaauauc

SEQ ID NO: 3981024 - RNA, 12 nt, Staphylococcus aureus subsp. aureus Mu50
caauauacuuuu

SEQ ID NO: 3981025 - RNA, 17 nt, Staphylococcus aureus subsp. aureus Mu50
caauauacuuuuuaaau

SEQ ID NO: 3981026 - RNA, 19 nt, Staphylococcus aureus subsp. aureus Mu50
caauauacuuuuuaaauga

SEQ ID NO: 3981027 - RNA, 14 nt, Staphylococcus aureus subsp. aureus Mu50
caauauaguaccaa

SEQ ID NO: 3981028 - RNA, 20 nt, Staphylococcus aureus subsp. aureus Mu50
caauauauucaccuacaaca

SEQ ID NO: 3981029 - RNA, 14 nt, Staphylococcus aureus subsp. aureus Mu50
caauaucauauuug

SEQ ID NO: 3981030 - RNA, 17 nt, Staphylococcus aureus subsp. aureus Mu50
caauaucaucauuuaaa

SEQ ID NO: 3981031 - RNA, 19 nt, Staphylococcus aureus subsp. aureus Mu50
caauaucaucauuuaaaua

SEQ ID NO: 3981032 - RNA, 20 nt, Staphylococcus aureus subsp. aureus Mu50
caauaucaucauuuaaauau

SEQ ID NO: 3981033 - RNA, 16 nt, Staphylococcus aureus subsp. aureus Mu50
caauaucuucuuuuaa

SEQ ID NO: 3981034 - RNA, 24 nt, Staphylococcus aureus subsp. aureus Mu50
caauaucuucuuuuaauauuugau

SEQ ID NO: 3981035 - RNA, 20 nt, Staphylococcus aureus subsp. aureus Mu50
caauaugaccuuuaugugca

SEQ ID NO: 3981036 - RNA, 16 nt, Staphylococcus aureus subsp. aureus Mu50
caauaugauuaauaaa

SEQ ID NO: 3981037 - RNA, 21 nt, Staphylococcus aureus subsp. aureus Mu50
caauauguggcgcucuuauaa

SEQ ID NO: 3981038 - RNA, 13 nt, Staphylococcus aureus subsp. aureus Mu50
caauauuaaaauc

SEQ ID NO: 3981039 - RNA, 23 nt, Staphylococcus aureus subsp. aureus Mu50
caauauuaaucauaaugaauaau

SEQ ID NO: 3981040 - RNA, 13 nt, Staphylococcus aureus subsp. aureus Mu50
caauauucguaaa

SEQ ID NO: 3981041 - RNA, 18 nt, Staphylococcus aureus subsp. aureus Mu50
caauauucguaaauccuu

SEQ ID NO: 3981042 - RNA, 18 nt, Staphylococcus aureus subsp. aureus Mu50
caauauucuuaucauuca

SEQ ID NO: 3981043 - RNA, 15 nt, Staphylococcus aureus subsp. aureus Mu50
caauauugauaucga

SEQ ID NO: 3981044 - RNA, 12 nt, Staphylococcus aureus subsp. aureus Mu50
caauauuucugg

SEQ ID NO: 3981045 - RNA, 12 nt, Staphylococcus aureus subsp. aureus Mu50
caauauuucuug

SEQ ID NO: 3981046 - RNA, 22 nt, Staphylococcus aureus subsp. aureus Mu50
caauauuugauaaguagaaaau

SEQ ID NO: 3981047 - RNA, 15 nt, Staphylococcus aureus subsp. aureus Mu50
caauauuuuuacaua

SEQ ID NO: 3981048 - RNA, 20 nt, Staphylococcus aureus subsp. aureus Mu50
caauauuuuuacauauuuau

SEQ ID NO: 3981049 - RNA, 21 nt, Staphylococcus aureus subsp. aureus Mu50
caaucaaauuacaaauuaucu

SEQ ID NO: 3981050 - RNA, 21 nt, Staphylococcus aureus subsp. aureus Mu50
caaucaacgagucauaaauau

SEQ ID NO: 3981051 - RNA, 13 nt, Staphylococcus aureus subsp. aureus Mu50
caaucacaauaua

SEQ ID NO: 3981052 - RNA, 17 nt, Staphylococcus aureus subsp. aureus Mu50
caaucacaauauaacau

SEQ ID NO: 3981053 - RNA, 14 nt, Staphylococcus aureus subsp. aureus Mu50
caaucacagcaaua

SEQ ID NO: 3981054 - RNA, 16 nt, Staphylococcus aureus subsp. aureus Mu50
caaucacuauauuuca

SEQ ID NO: 3981055 - RNA, 20 nt, Staphylococcus aureus subsp. aureus Mu50
caaucacuccucuauuuuau

SEQ ID NO: 3981056 - RNA, 12 nt, Staphylococcus aureus subsp. aureus Mu50
caaucauaauac

SEQ ID NO: 3981057 - RNA, 15 nt, Staphylococcus aureus subsp. aureus Mu50
caaucaucauuaaau

SEQ ID NO: 3981058 - RNA, 17 nt, Staphylococcus aureus subsp. aureus Mu50
caaucaucgcaaauaca

SEQ ID NO: 3981059 - RNA, 18 nt, Staphylococcus aureus subsp. aureus Mu50
caaucauuguaaaugauc

SEQ ID NO: 3981060 - RNA, 23 nt, Staphylococcus aureus subsp. aureus Mu50
caaucauuguaaaugaucaucgu

SEQ ID NO: 3981061 - RNA, 23 nt, Staphylococcus aureus subsp. aureus Mu50
caaucgaggggucuuuuuuuaau

SEQ ID NO: 3981062 - RNA, 14 nt, Staphylococcus aureus subsp. aureus Mu50
caaucgcauuuugu

SEQ ID NO: 3981063 - RNA, 19 nt, Staphylococcus aureus subsp. aureus Mu50
caaucgcauuuuguuucaa

SEQ ID NO: 3981064 - RNA, 19 nt, Staphylococcus aureus subsp. aureus Mu50
caaucgcuuuagcaauuga

SEQ ID NO: 3981065 - RNA, 22 nt, Staphylococcus aureus subsp. aureus Mu50
caaucggaagcauauuucuaaa

SEQ ID NO: 3981066 - RNA, 14 nt, Staphylococcus aureus subsp. aureus Mu50
caaucguugaaaaa

SEQ ID NO: 3981067 - RNA, 19 nt, Staphylococcus aureus subsp. aureus Mu50
caaucguugaaaaauaucc

SEQ ID NO: 3981068 - RNA, 21 nt, Staphylococcus aureus subsp. aureus Mu50
caaucguugaaaaauauccug

SEQ ID NO: 3981069 - RNA, 23 nt, Staphylococcus aureus subsp. aureus Mu50
caaucguuucuuccgcacugccu

SEQ ID NO: 3981070 - RNA, 14 nt, Staphylococcus aureus subsp. aureus Mu50
caaucuauuuuaaa

SEQ ID NO: 3981071 - RNA, 14 nt, Staphylococcus aureus subsp. aureus Mu50
caaucuguucauaa

SEQ ID NO: 3981072 - RNA, 15 nt, Staphylococcus aureus subsp. aureus Mu50
caaucuguucauaau

SEQ ID NO: 3981073 - RNA, 12 nt, Staphylococcus aureus subsp. aureus Mu50
caaucuuuuuaa

SEQ ID NO: 3981074 - RNA, 13 nt, Staphylococcus aureus subsp. aureus Mu50
caaugaauaaauu

SEQ ID NO: 3981075 - RNA, 18 nt, Staphylococcus aureus subsp. aureus Mu50
caaugaauaacaagaaaa

SEQ ID NO: 3981076 - RNA, 19 nt, Staphylococcus aureus subsp. aureus Mu50
caaugaauaacaagaaaaa

SEQ ID NO: 3981077 - RNA, 16 nt, Staphylococcus aureus subsp. aureus Mu50
caaugaauuguuaguu

SEQ ID NO: 3981078 - RNA, 17 nt, Staphylococcus aureus subsp. aureus Mu50
caaugacagcagacuuc

SEQ ID NO: 3981079 - RNA, 19 nt, Staphylococcus aureus subsp. aureus Mu50
caaugacugagaaaaauau

SEQ ID NO: 3981080 - RNA, 20 nt, Staphylococcus aureus subsp. aureus Mu50
caaugagcaagucuucuaaa

SEQ ID NO: 3981081 - RNA, 13 nt, Staphylococcus aureus subsp. aureus Mu50
caaugagcaucuu

SEQ ID NO: 3981082 - RNA, 22 nt, Staphylococcus aureus subsp. aureus Mu50
caaugaugggaaaucaguaaua

SEQ ID NO: 3981083 - RNA, 15 nt, Staphylococcus aureus subsp. aureus Mu50
caaugauguuacaau

SEQ ID NO: 3981084 - RNA, 11 nt, Staphylococcus aureus subsp. aureus Mu50
caaugauuaau

SEQ ID NO: 3981085 - RNA, 23 nt, Staphylococcus aureus subsp. aureus Mu50
caaugauuaguaaugauuaacuu

SEQ ID NO: 3981086 - RNA, 18 nt, Staphylococcus aureus subsp. aureus Mu50
caaugauugaauauuguu

SEQ ID NO: 3981087 - RNA, 21 nt, Staphylococcus aureus subsp. aureus Mu50
caaugauuuuauaauauuauu

SEQ ID NO: 3981088 - RNA, 15 nt, Staphylococcus aureus subsp. aureus Mu50
caaugauuuuuaaaa

SEQ ID NO: 3981089 - RNA, 16 nt, Staphylococcus aureus subsp. aureus Mu50
caaugcaccuauaaua

SEQ ID NO: 3981090 - RNA, 20 nt, Staphylococcus aureus subsp. aureus Mu50
caaugcagcuguauuuaaua

SEQ ID NO: 3981091 - RNA, 22 nt, Staphylococcus aureus subsp. aureus Mu50
caaugcagcuguauuuaauaaa

SEQ ID NO: 3981092 - RNA, 22 nt, Staphylococcus aureus subsp. aureus Mu50
caaugccacgcucauuuucugu

SEQ ID NO: 3981093 - RNA, 19 nt, Staphylococcus aureus subsp. aureus Mu50
caaugcuuccaucacauca

SEQ ID NO: 3981094 - RNA, 19 nt, Staphylococcus aureus subsp. aureus Mu50
caauguaaugguuaauaac

SEQ ID NO: 3981095 - RNA, 16 nt, Staphylococcus aureus subsp. aureus Mu50
cacauucaauauuuga

SEQ ID NO: 3981096 - RNA, 22 nt, Staphylococcus aureus subsp. aureus Mu50
cacauucugcccugcaaugcaa

SEQ ID NO: 3981097 - RNA, 19 nt, Staphylococcus aureus subsp. aureus Mu50
cacauucuuauuugaaaug

SEQ ID NO: 3981098 - RNA, 17 nt, Staphylococcus aureus subsp. aureus Mu50
cacauuguuuacaaagu

SEQ ID NO: 3981099 - RNA, 18 nt, Staphylococcus aureus subsp. aureus Mu50
cacauuuacuuaagaacu

SEQ ID NO: 3981100 - RNA, 23 nt, Staphylococcus aureus subsp. aureus Mu50
cacauuuauaacauacguuauuu

SEQ ID NO: 3981101 - RNA, 13 nt, Staphylococcus aureus subsp. aureus Mu50
caccaacaacuuu

SEQ ID NO: 3981102 - RNA, 23 nt, Staphylococcus aureus subsp. aureus Mu50
caccaacaauagguacaacuaaa

SEQ ID NO: 3981103 - RNA, 15 nt, Staphylococcus aureus subsp. aureus Mu50
caccaacauauuuua

SEQ ID NO: 3981104 - RNA, 21 nt, Staphylococcus aureus subsp. aureus Mu50
caccaaugauagugaauaaug

SEQ ID NO: 3981105 - RNA, 21 nt, Staphylococcus aureus subsp. aureus Mu50
caccaauuaaaucgauuaaga

SEQ ID NO: 3981106 - RNA, 14 nt, Staphylococcus aureus subsp. aureus Mu50
caccaccugugaca

SEQ ID NO: 3981107 - RNA, 18 nt, Staphylococcus aureus subsp. aureus Mu50
caccacuuaggauaaacu

SEQ ID NO: 3981108 - RNA, 17 nt, Staphylococcus aureus subsp. aureus Mu50
caccacuuucaguaauu

SEQ ID NO: 3981109 - RNA, 18 nt, Staphylococcus aureus subsp. aureus Mu50
caccacuuucaguaauug

SEQ ID NO: 3981110 - RNA, 16 nt, Staphylococcus aureus subsp. aureus Mu50
caccagaacaauucaa

SEQ ID NO: 3981111 - RNA, 18 nt, Staphylococcus aureus subsp. aureus Mu50
caccagauaucauaauau

SEQ ID NO: 3981112 - RNA, 17 nt, Staphylococcus aureus subsp. aureus Mu50
caccagccccaauuagc

SEQ ID NO: 3981113 - RNA, 14 nt, Staphylococcus aureus subsp. aureus Mu50
caccaguuucaagu

SEQ ID NO: 3981114 - RNA, 21 nt, Staphylococcus aureus subsp. aureus Mu50
caccaguuugugguaaugauu

SEQ ID NO: 3981115 - RNA, 20 nt, Staphylococcus aureus subsp. aureus Mu50
caccauacuucguugucacu

SEQ ID NO: 3981116 - RNA, 14 nt, Staphylococcus aureus subsp. aureus Mu50
caccauaugcuaaa

SEQ ID NO: 3981117 - RNA, 18 nt, Staphylococcus aureus subsp. aureus Mu50
caccauauuuaacauuuu

SEQ ID NO: 3981118 - RNA, 15 nt, Staphylococcus aureus subsp. aureus Mu50
caccaucccauuaaa

SEQ ID NO: 3981119 - RNA, 23 nt, Staphylococcus aureus subsp. aureus Mu50
caccaucuguaacuaauaugauu

SEQ ID NO: 3981120 - RNA, 19 nt, Staphylococcus aureus subsp. aureus Mu50
caccauuuacuucauaagu

SEQ ID NO: 3981121 - RNA, 14 nt, Staphylococcus aureus subsp. aureus Mu50
cacccaaauuuagg

SEQ ID NO: 3981122 - RNA, 15 nt, Staphylococcus aureus subsp. aureus Mu50
cacccauuugucuua

SEQ ID NO: 3981123 - RNA, 18 nt, Staphylococcus aureus subsp. aureus Mu50
caccccaacuugcauugu

SEQ ID NO: 3981124 - RNA, 17 nt, Staphylococcus aureus subsp. aureus Mu50
cacccugcuuaucauua

SEQ ID NO: 3981125 - RNA, 20 nt, Staphylococcus aureus subsp. aureus Mu50
caccgcguguuuuuaacaua

SEQ ID NO: 3981126 - RNA, 18 nt, Staphylococcus aureus subsp. aureus Mu50
caccguaaucuuuuaacu

SEQ ID NO: 3981127 - RNA, 13 nt, Staphylococcus aureus subsp. aureus Mu50
caccuaaaugauu

SEQ ID NO: 3981128 - RNA, 13 nt, Staphylococcus aureus subsp. aureus Mu50
caccuaauaccau

SEQ ID NO: 3981129 - RNA, 19 nt, Staphylococcus aureus subsp. aureus Mu50
caccuacaaauauuucuaa

SEQ ID NO: 3981130 - RNA, 14 nt, Staphylococcus aureus subsp. aureus Mu50
caccuauuaggauc

SEQ ID NO: 3981131 - RNA, 14 nt, Staphylococcus aureus subsp. aureus Mu50
caccucgauauuau

SEQ ID NO: 3981132 - RNA, 17 nt, Staphylococcus aureus subsp. aureus Mu50
caccucuaaguucaccu

SEQ ID NO: 3981133 - RNA, 18 nt, Staphylococcus aureus subsp. aureus Mu50
caccucuaaguucaccua

SEQ ID NO: 3981134 - RNA, 19 nt, Staphylococcus aureus subsp. aureus Mu50
caccucuaaguucaccuaa

SEQ ID NO: 3981135 - RNA, 17 nt, Staphylococcus aureus subsp. aureus Mu50
caccugauugacaaugu

SEQ ID NO: 3981136 - RNA, 13 nt, Staphylococcus aureus subsp. aureus Mu50
caccugcaauaua

SEQ ID NO: 3981137 - RNA, 12 nt, Staphylococcus aureus subsp. aureus Mu50
caccugcaauuu

SEQ ID NO: 3981138 - RNA, 20 nt, Staphylococcus aureus subsp. aureus Mu50
caccugcaauuuguaauaca

SEQ ID NO: 3981139 - RNA, 20 nt, Staphylococcus aureus subsp. aureus Mu50
caccugcuaguucagcuucu

SEQ ID NO: 3981140 - RNA, 23 nt, Staphylococcus aureus subsp. aureus Mu50
caccuggucguacuuucaaauaa

SEQ ID NO: 3981141 - RNA, 17 nt, Staphylococcus aureus subsp. aureus Mu50
caccuuaccuacuuuuu

SEQ ID NO: 3981142 - RNA, 14 nt, Staphylococcus aureus subsp. aureus Mu50
caccuucaauaucu

SEQ ID NO: 3981143 - RNA, 18 nt, Staphylococcus aureus subsp. aureus Mu50
caccuuguaaauugaauu

SEQ ID NO: 3981144 - RNA, 16 nt, Staphylococcus aureus subsp. aureus Mu50
caccuuuacaacauac

SEQ ID NO: 3981145 - RNA, 17 nt, Staphylococcus aureus subsp. aureus Mu50
caccuuuagacaauauu

SEQ ID NO: 3981146 - RNA, 13 nt, Staphylococcus aureus subsp. aureus Mu50
caccuuuaucugu

SEQ ID NO: 3981147 - RNA, 13 nt, Staphylococcus aureus subsp. aureus Mu50
caccuuugaauau

SEQ ID NO: 3981148 - RNA, 14 nt, Staphylococcus aureus subsp. aureus Mu50
cacgaacaacauua

SEQ ID NO: 3981149 - RNA, 15 nt, Staphylococcus aureus subsp. aureus Mu50
cacgaacaacauuag

SEQ ID NO: 3981150 - RNA, 17 nt, Staphylococcus aureus subsp. aureus Mu50
cacgaacaagucuugca

SEQ ID NO: 3981151 - RNA, 17 nt, Staphylococcus aureus subsp. aureus Mu50
cacgaauaccaagacca

SEQ ID NO: 3981152 - RNA, 20 nt, Staphylococcus aureus subsp. aureus Mu50
cacgacgcuaaacaaagggg

SEQ ID NO: 3981153 - RNA, 11 nt, Staphylococcus aureus subsp. aureus Mu50
cacgagaaaug

SEQ ID NO: 3981154 - RNA, 18 nt, Staphylococcus aureus subsp. aureus Mu50
cacgagcaacaucuuuug

SEQ ID NO: 3981155 - RNA, 14 nt, Staphylococcus aureus subsp. aureus Mu50
cacgagcugcuuca

SEQ ID NO: 3981156 - RNA, 17 nt, Staphylococcus aureus subsp. aureus Mu50
cacgagcugcuucaacu

SEQ ID NO: 3981157 - RNA, 13 nt, Staphylococcus aureus subsp. aureus Mu50
cacgauaaaaaua

SEQ ID NO: 3981158 - RNA, 14 nt, Staphylococcus aureus subsp. aureus Mu50
cacgauaauugaua

SEQ ID NO: 3981159 - RNA, 18 nt, Staphylococcus aureus subsp. aureus Mu50
cacgauaucuagcugcuu

SEQ ID NO: 3981160 - RNA, 20 nt, Staphylococcus aureus subsp. aureus Mu50
cacgauaucuagcugcuucu

SEQ ID NO: 3981161 - RNA, 23 nt, Staphylococcus aureus subsp. aureus Mu50
cacgauuacgcucauaugucugu

SEQ ID NO: 3981162 - RNA, 16 nt, Staphylococcus aureus subsp. aureus Mu50
cacgcauuacuuuaga

SEQ ID NO: 3981163 - RNA, 13 nt, Staphylococcus aureus subsp. aureus Mu50
cacgcguucaaau

SEQ ID NO: 3981164 - RNA, 21 nt, Staphylococcus aureus subsp. aureus Mu50
cacgcucauuuucuguugcag

SEQ ID NO: 3981165 - RNA, 14 nt, Staphylococcus aureus subsp. aureus Mu50
cacgcugaaauuuu

SEQ ID NO: 3981166 - RNA, 17 nt, Staphylococcus aureus subsp. aureus Mu50
cacgcugaaauuuuuua

SEQ ID NO: 3981167 - RNA, 13 nt, Staphylococcus aureus subsp. aureus Mu50
cacggucccaaga

SEQ ID NO: 3981168 - RNA, 18 nt, Staphylococcus aureus subsp. aureus Mu50
cacggucuugauauugac

SEQ ID NO: 3981169 - RNA, 12 nt, Staphylococcus aureus subsp. aureus Mu50
cacguaaaauau

SEQ ID NO: 3981170 - RNA, 20 nt, Staphylococcus aureus subsp. aureus Mu50
cacguaauugaguuguugca

SEQ ID NO: 3981171 - RNA, 23 nt, Staphylococcus aureus subsp. aureus Mu50
cacguugugcaauaccuguucca

SEQ ID NO: 3981172 - RNA, 15 nt, Staphylococcus aureus subsp. aureus Mu50
cacuaaaguaaauaa

SEQ ID NO: 3981173 - RNA, 14 nt, Staphylococcus aureus subsp. aureus Mu50
cacuaaauucaaua

SEQ ID NO: 3981174 - RNA, 19 nt, Staphylococcus aureus subsp. aureus Mu50
cacuaaugauuuauuaugu

SEQ ID NO: 3981175 - RNA, 18 nt, Staphylococcus aureus subsp. aureus Mu50
cacuaauggauaugauaa

SEQ ID NO: 3981176 - RNA, 13 nt, Staphylococcus aureus subsp. aureus Mu50
cacuacaaucaua

SEQ ID NO: 3981177 - RNA, 17 nt, Staphylococcus aureus subsp. aureus Mu50
cacuaccauagauuaua

SEQ ID NO: 3981178 - RNA, 24 nt, Staphylococcus aureus subsp. aureus Mu50
cacuacgcugaugaaugauugcau

SEQ ID NO: 3981179 - RNA, 18 nt, Staphylococcus aureus subsp. aureus Mu50
cacuagauaguuuauacu

SEQ ID NO: 3981180 - RNA, 18 nt, Staphylococcus aureus subsp. aureus Mu50
cacuaggauguucaucaa

SEQ ID NO: 3981181 - RNA, 18 nt, Staphylococcus aureus subsp. aureus Mu50
cacuagucuuuuuauuuu

SEQ ID NO: 3981182 - RNA, 13 nt, Staphylococcus aureus subsp. aureus Mu50
cacuauaauuucu

SEQ ID NO: 3981183 - RNA, 15 nt, Staphylococcus aureus subsp. aureus Mu50
cagagccauaaugag

SEQ ID NO: 3981184 - RNA, 21 nt, Staphylococcus aureus subsp. aureus Mu50
cagauaaguaauaauauaaau

SEQ ID NO: 3981185 - RNA, 13 nt, Staphylococcus aureus subsp. aureus Mu50
cagauaauuauuu

SEQ ID NO: 3981186 - RNA, 22 nt, Staphylococcus aureus subsp. aureus Mu50
cagauagaaugucgauauuucu

SEQ ID NO: 3981187 - RNA, 23 nt, Staphylococcus aureus subsp. aureus Mu50
cagauagaaugucgauauuucua

SEQ ID NO: 3981188 - RNA, 17 nt, Staphylococcus aureus subsp. aureus Mu50
cagauaggaaacuuaaa

SEQ ID NO: 3981189 - RNA, 16 nt, Staphylococcus aureus subsp. aureus Mu50
cagaugaaccaaaaaa

SEQ ID NO: 3981190 - RNA, 13 nt, Staphylococcus aureus subsp. aureus Mu50
cagaugaauaaug

SEQ ID NO: 3981191 - RNA, 22 nt, Staphylococcus aureus subsp. aureus Mu50
cagaugaauaauguuuccauuu

SEQ ID NO: 3981192 - RNA, 21 nt, Staphylococcus aureus subsp. aureus Mu50
cagaugaugcuucgcaucacu

SEQ ID NO: 3981193 - RNA, 14 nt, Staphylococcus aureus subsp. aureus Mu50
cagauguugguuca

SEQ ID NO: 3981194 - RNA, 22 nt, Staphylococcus aureus subsp. aureus Mu50
cagauucaaacguuuucacuuc

SEQ ID NO: 3981195 - RNA, 17 nt, Staphylococcus aureus subsp. aureus Mu50
cagauucauaucuuuca

SEQ ID NO: 3981196 - RNA, 22 nt, Staphylococcus aureus subsp. aureus Mu50
cagauucauaucuuucaauuaa

SEQ ID NO: 3981197 - RNA, 15 nt, Staphylococcus aureus subsp. aureus Mu50
cagauucuucaccaa

SEQ ID NO: 3981198 - RNA, 15 nt, Staphylococcus aureus subsp. aureus Mu50
cagauuuuaaaaauu

SEQ ID NO: 3981199 - RNA, 21 nt, Staphylococcus aureus subsp. aureus Mu50
cagauuuuaaaaauucauaau

SEQ ID NO: 3981200 - RNA, 23 nt, Staphylococcus aureus subsp. aureus Mu50
cagauuuuaaaaauucauaaucg

SEQ ID NO: 3981201 - RNA, 13 nt, Staphylococcus aureus subsp. aureus Mu50
cagauuuuaagug

SEQ ID NO: 3981202 - RNA, 11 nt, Staphylococcus aureus subsp. aureus Mu50
cagcaaauaaa

SEQ ID NO: 3981203 - RNA, 18 nt, Staphylococcus aureus subsp. aureus Mu50
cagcaacgcgauugcuaa

SEQ ID NO: 3981204 - RNA, 14 nt, Staphylococcus aureus subsp. aureus Mu50
cagcacauuuuuag

SEQ ID NO: 3981205 - RNA, 22 nt, Staphylococcus aureus subsp. aureus Mu50
cagcaccgacaauuauaauaaa

SEQ ID NO: 3981206 - RNA, 17 nt, Staphylococcus aureus subsp. aureus Mu50
cagcaguaagauuauuu

SEQ ID NO: 3981207 - RNA, 14 nt, Staphylococcus aureus subsp. aureus Mu50
cagcaguaggauaa

SEQ ID NO: 3981208 - RNA, 19 nt, Staphylococcus aureus subsp. aureus Mu50
cagcagugaaguuaacuau

SEQ ID NO: 3981209 - RNA, 22 nt, Staphylococcus aureus subsp. aureus Mu50
cagcaguugacuguaaaacaau

SEQ ID NO: 3981210 - RNA, 13 nt, Staphylococcus aureus subsp. aureus Mu50
cagcauauaaugg

SEQ ID NO: 3981211 - RNA, 22 nt, Staphylococcus aureus subsp. aureus Mu50
cagcaugaaucgcauuuaaaua

SEQ ID NO: 3981212 - RNA, 23 nt, Staphylococcus aureus subsp. aureus Mu50
cagcaugaaucgcauuuaaauau

SEQ ID NO: 3981213 - RNA, 20 nt, Staphylococcus aureus subsp. aureus Mu50
cagcauuaaucguauuuuua

SEQ ID NO: 3981214 - RNA, 22 nt, Staphylococcus aureus subsp. aureus Mu50
cagcauuaccagcaauuucgau

SEQ ID NO: 3981215 - RNA, 17 nt, Staphylococcus aureus subsp. aureus Mu50
cagcauugggacauaaa

SEQ ID NO: 3981216 - RNA, 16 nt, Staphylococcus aureus subsp. aureus Mu50
cagcauuuucaaugua

SEQ ID NO: 3981217 - RNA, 17 nt, Staphylococcus aureus subsp. aureus Mu50
cagccagcuuagcauag

SEQ ID NO: 3981218 - RNA, 15 nt, Staphylococcus aureus subsp. aureus Mu50
cagccucuauaagua

SEQ ID NO: 3981219 - RNA, 12 nt, Staphylococcus aureus subsp. aureus Mu50
cagcgaaauuug

SEQ ID NO: 3981220 - RNA, 14 nt, Staphylococcus aureus subsp. aureus Mu50
cagcgaaauuugua

SEQ ID NO: 3981221 - RNA, 20 nt, Staphylococcus aureus subsp. aureus Mu50
cagcgauaacguacaaugua

SEQ ID NO: 3981222 - RNA, 22 nt, Staphylococcus aureus subsp. aureus Mu50
cagcgaucuuuuuuauuuaauu

SEQ ID NO: 3981223 - RNA, 16 nt, Staphylococcus aureus subsp. aureus Mu50
cagcgauuaaaugaug

SEQ ID NO: 3981224 - RNA, 15 nt, Staphylococcus aureus subsp. aureus Mu50
cagcuaaaaaguaua

SEQ ID NO: 3981225 - RNA, 19 nt, Staphylococcus aureus subsp. aureus Mu50
cagcuaaugucaugaaaau

SEQ ID NO: 3981226 - RNA, 21 nt, Staphylococcus aureus subsp. aureus Mu50
cagcuaaugucaugaaaauaa

SEQ ID NO: 3981227 - RNA, 13 nt, Staphylococcus aureus subsp. aureus Mu50
cagcuaauugucg

SEQ ID NO: 3981228 - RNA, 19 nt, Staphylococcus aureus subsp. aureus Mu50
cagcucuuaaaucacuagc

SEQ ID NO: 3981229 - RNA, 17 nt, Staphylococcus aureus subsp. aureus Mu50
cagcuguauuuaauaaa

SEQ ID NO: 3981230 - RNA, 16 nt, Staphylococcus aureus subsp. aureus Mu50
cagcuguccgauuuuu

SEQ ID NO: 3981231 - RNA, 15 nt, Staphylococcus aureus subsp. aureus Mu50
cagcuucaaaaucaa

SEQ ID NO: 3981232 - RNA, 14 nt, Staphylococcus aureus subsp. aureus Mu50
cagcuucuuuaaca

SEQ ID NO: 3981233 - RNA, 20 nt, Staphylococcus aureus subsp. aureus Mu50
cagcuucuuuaacaauugau

SEQ ID NO: 3981234 - RNA, 20 nt, Staphylococcus aureus subsp. aureus Mu50
cagcuugaccgccuaugaua

SEQ ID NO: 3981235 - RNA, 13 nt, Staphylococcus aureus subsp. aureus Mu50
cagcuuuaauaau

SEQ ID NO: 3981236 - RNA, 14 nt, Staphylococcus aureus subsp. aureus Mu50
cagcuuuaauaaua

SEQ ID NO: 3981237 - RNA, 14 nt, Staphylococcus aureus subsp. aureus Mu50
cagcuuuuucauuc

SEQ ID NO: 3981238 - RNA, 12 nt, Staphylococcus aureus subsp. aureus Mu50
cagcuuuuucua

SEQ ID NO: 3981239 - RNA, 20 nt, Staphylococcus aureus subsp. aureus Mu50
caggaauaucuuucaaauua

SEQ ID NO: 3981240 - RNA, 20 nt, Staphylococcus aureus subsp. aureus Mu50
caggaccacucaauucucua

SEQ ID NO: 3981241 - RNA, 19 nt, Staphylococcus aureus subsp. aureus Mu50
caggagcgagccauuauua

SEQ ID NO: 3981242 - RNA, 22 nt, Staphylococcus aureus subsp. aureus Mu50
caggagcgagccauuauuauuu

SEQ ID NO: 3981243 - RNA, 18 nt, Staphylococcus aureus subsp. aureus Mu50
caggcaaugcgaguuggg

SEQ ID NO: 3981244 - RNA, 17 nt, Staphylococcus aureus subsp. aureus Mu50
caggcgaaccgaagcgc

SEQ ID NO: 3981245 - RNA, 20 nt, Staphylococcus aureus subsp. aureus Mu50
caggcgaaccgaagcgcagu

SEQ ID NO: 3981246 - RNA, 16 nt, Staphylococcus aureus subsp. aureus Mu50
cagguaaauuuaaaau

SEQ ID NO: 3981247 - RNA, 19 nt, Staphylococcus aureus subsp. aureus Mu50
cagguaaugcaaguuggcg

SEQ ID NO: 3981248 - RNA, 13 nt, Staphylococcus aureus subsp. aureus Mu50
caggugauugacg

SEQ ID NO: 3981249 - RNA, 15 nt, Staphylococcus aureus subsp. aureus Mu50
caggugcuuacuuuu

SEQ ID NO: 3981250 - RNA, 20 nt, Staphylococcus aureus subsp. aureus Mu50
cagguguuuuaccuuuaauu

SEQ ID NO: 3981251 - RNA, 13 nt, Staphylococcus aureus subsp. aureus Mu50
cagguuaacauuu

SEQ ID NO: 3981252 - RNA, 17 nt, Staphylococcus aureus subsp. aureus Mu50
cagguuguuaggggcuu

SEQ ID NO: 3981253 - RNA, 13 nt, Staphylococcus aureus subsp. aureus Mu50
cagguuuaauaaa

SEQ ID NO: 3981254 - RNA, 16 nt, Staphylococcus aureus subsp. aureus Mu50
cagguuuaauaaauuu

SEQ ID NO: 3981255 - RNA, 15 nt, Staphylococcus aureus subsp. aureus Mu50
cagguuuuaugaauu

SEQ ID NO: 3981256 - RNA, 23 nt, Staphylococcus aureus subsp. aureus Mu50
caguaaaaagauaagaagagcca

SEQ ID NO: 3981257 - RNA, 14 nt, Staphylococcus aureus subsp. aureus Mu50
caguaaauugauuc

SEQ ID NO: 3981258 - RNA, 22 nt, Staphylococcus aureus subsp. aureus Mu50
caguaaauugauucuuugguga

SEQ ID NO: 3981259 - RNA, 17 nt, Staphylococcus aureus subsp. aureus Mu50
caguaacaauaacaccu

SEQ ID NO: 3981260 - RNA, 14 nt, Staphylococcus aureus subsp. aureus Mu50
caguaagauuauuu

SEQ ID NO: 3981261 - RNA, 19 nt, Staphylococcus aureus subsp. aureus Mu50
caguaaguaauaaaauaaa

SEQ ID NO: 3981262 - RNA, 11 nt, Staphylococcus aureus subsp. aureus Mu50
caguaauaaug

SEQ ID NO: 3981263 - RNA, 15 nt, Staphylococcus aureus subsp. aureus Mu50
caguaauauguugcu

SEQ ID NO: 3981264 - RNA, 15 nt, Staphylococcus aureus subsp. aureus Mu50
caguaaucaaaguau

SEQ ID NO: 3981265 - RNA, 16 nt, Staphylococcus aureus subsp. aureus Mu50
caguaaucaaaguauc

SEQ ID NO: 3981266 - RNA, 19 nt, Staphylococcus aureus subsp. aureus Mu50
caguaaucaugcauucuau

SEQ ID NO: 3981267 - RNA, 23 nt, Staphylococcus aureus subsp. aureus Mu50
caguaaucuuguuuucauuuaaa

SEQ ID NO: 3981268 - RNA, 21 nt, Staphylococcus aureus subsp. aureus Mu50
caguaauugugacgaccgugu

SEQ ID NO: 3981269 - RNA, 15 nt, Staphylococcus aureus subsp. aureus Mu50
caguaauuucuccaa

SEQ ID NO: 3981270 - RNA, 16 nt, Staphylococcus aureus subsp. aureus Mu50
caguacgaacaacuaa

SEQ ID NO: 3981271 - RNA, 22 nt, Staphylococcus aureus subsp. aureus Mu50
cauaacgagcaguauauaucaa

SEQ ID NO: 3981272 - RNA, 14 nt, Staphylococcus aureus subsp. aureus Mu50
cauaacugaauaaa

SEQ ID NO: 3981273 - RNA, 18 nt, Staphylococcus aureus subsp. aureus Mu50
cauaacuuuauauauaaa

SEQ ID NO: 3981274 - RNA, 14 nt, Staphylococcus aureus subsp. aureus Mu50
cauaagaaaauacu

SEQ ID NO: 3981275 - RNA, 18 nt, Staphylococcus aureus subsp. aureus Mu50
cauaaggacucuguuuaa

SEQ ID NO: 3981276 - RNA, 22 nt, Staphylococcus aureus subsp. aureus Mu50
cauaaggucuuggacuaauaau

SEQ ID NO: 3981277 - RNA, 18 nt, Staphylococcus aureus subsp. aureus Mu50
cauaaguaaaacugcaau

SEQ ID NO: 3981278 - RNA, 16 nt, Staphylococcus aureus subsp. aureus Mu50
cauaagucacauuuau

SEQ ID NO: 3981279 - RNA, 16 nt, Staphylococcus aureus subsp. aureus Mu50
cauaauaaaucuaucu

SEQ ID NO: 3981280 - RNA, 17 nt, Staphylococcus aureus subsp. aureus Mu50
cauaauaaucguaaaca

SEQ ID NO: 3981281 - RNA, 17 nt, Staphylococcus aureus subsp. aureus Mu50
cauaauacuucucaauu

SEQ ID NO: 3981282 - RNA, 19 nt, Staphylococcus aureus subsp. aureus Mu50
cauaauacuucucaauuua

SEQ ID NO: 3981283 - RNA, 20 nt, Staphylococcus aureus subsp. aureus Mu50
cauaauagacuuauauuaau

SEQ ID NO: 3981284 - RNA, 16 nt, Staphylococcus aureus subsp. aureus Mu50
cauaauagauaaugca

SEQ ID NO: 3981285 - RNA, 14 nt, Staphylococcus aureus subsp. aureus Mu50
cauaauauauuaac

SEQ ID NO: 3981286 - RNA, 22 nt, Staphylococcus aureus subsp. aureus Mu50
cauaauauauuaacaacuuuau

SEQ ID NO: 3981287 - RNA, 17 nt, Staphylococcus aureus subsp. aureus Mu50
cauaauauugaugaaua

SEQ ID NO: 3981288 - RNA, 19 nt, Staphylococcus aureus subsp. aureus Mu50
cauaauauugaugaauaaa

SEQ ID NO: 3981289 - RNA, 22 nt, Staphylococcus aureus subsp. aureus Mu50
cauaauauugaugaauaaauag

SEQ ID NO: 3981290 - RNA, 15 nt, Staphylococcus aureus subsp. aureus Mu50
cauaaucaagucugc

SEQ ID NO: 3981291 - RNA, 21 nt, Staphylococcus aureus subsp. aureus Mu50
cauaaucaagucugcauuaau

SEQ ID NO: 3981292 - RNA, 13 nt, Staphylococcus aureus subsp. aureus Mu50
cauaaucaauuuc

SEQ ID NO: 3981293 - RNA, 22 nt, Staphylococcus aureus subsp. aureus Mu50
cauaaucauuaguuaugugcua

SEQ ID NO: 3981294 - RNA, 19 nt, Staphylococcus aureus subsp. aureus Mu50
cauaauccauucuucuugu

SEQ ID NO: 3981295 - RNA, 20 nt, Staphylococcus aureus subsp. aureus Mu50
cauaaucgggaugauaacca

SEQ ID NO: 3981296 - RNA, 21 nt, Staphylococcus aureus subsp. aureus Mu50
cauaaucguauucauaucauu

SEQ ID NO: 3981297 - RNA, 19 nt, Staphylococcus aureus subsp. aureus Mu50
cauaaugaauaauuaaaaa

SEQ ID NO: 3981298 - RNA, 21 nt, Staphylococcus aureus subsp. aureus Mu50
cauaaugaauaauuaaaaaac

SEQ ID NO: 3981299 - RNA, 19 nt, Staphylococcus aureus subsp. aureus Mu50
cauaaugaauucauucaau

SEQ ID NO: 3981300 - RNA, 20 nt, Staphylococcus aureus subsp. aureus Mu50
cauaaugaauucauucaaua

SEQ ID NO: 3981301 - RNA, 22 nt, Staphylococcus aureus subsp. aureus Mu50
cauaaugacaucauguucaugu

SEQ ID NO: 3981302 - RNA, 15 nt, Staphylococcus aureus subsp. aureus Mu50
cauaaugaucaagua

SEQ ID NO: 3981303 - RNA, 15 nt, Staphylococcus aureus subsp. aureus Mu50
cauaauuaaauaacu

SEQ ID NO: 3981304 - RNA, 18 nt, Staphylococcus aureus subsp. aureus Mu50
cauaauuaccuuuccauu

SEQ ID NO: 3981305 - RNA, 14 nt, Staphylococcus aureus subsp. aureus Mu50
cauaauuaucauau

SEQ ID NO: 3981306 - RNA, 14 nt, Staphylococcus aureus subsp. aureus Mu50
cauaauucuagaga

SEQ ID NO: 3981307 - RNA, 15 nt, Staphylococcus aureus subsp. aureus Mu50
cauaauuuaaaagau

SEQ ID NO: 3981308 - RNA, 15 nt, Staphylococcus aureus subsp. aureus Mu50
cauaauuuaaaugau

SEQ ID NO: 3981309 - RNA, 14 nt, Staphylococcus aureus subsp. aureus Mu50
cauaauuuaucaau

SEQ ID NO: 3981310 - RNA, 12 nt, Staphylococcus aureus subsp. aureus Mu50
cauaauuuaucu

SEQ ID NO: 3981311 - RNA, 15 nt, Staphylococcus aureus subsp. aureus Mu50
cauaauuuguugaua

SEQ ID NO: 3981312 - RNA, 18 nt, Staphylococcus aureus subsp. aureus Mu50
cauacaaauuuuuuuuau

SEQ ID NO: 3981313 - RNA, 23 nt, Staphylococcus aureus subsp. aureus Mu50
cauacacaaugcccuuaaagcac

SEQ ID NO: 3981314 - RNA, 23 nt, Staphylococcus aureus subsp. aureus Mu50
cauacacugcacaucauaauaaa

SEQ ID NO: 3981315 - RNA, 19 nt, Staphylococcus aureus subsp. aureus Mu50
cauacacuugauuaucauu

SEQ ID NO: 3981316 - RNA, 17 nt, Staphylococcus aureus subsp. aureus Mu50
cauacagucaauacaaa

SEQ ID NO: 3981317 - RNA, 15 nt, Staphylococcus aureus subsp. aureus Mu50
cauacauaacacaag

SEQ ID NO: 3981318 - RNA, 13 nt, Staphylococcus aureus subsp. aureus Mu50
cauacauaugcua

SEQ ID NO: 3981319 - RNA, 15 nt, Staphylococcus aureus subsp. aureus Mu50
cauacauaugcuaua

SEQ ID NO: 3981320 - RNA, 19 nt, Staphylococcus aureus subsp. aureus Mu50
cauaccaaauaaauaagug

SEQ ID NO: 3981321 - RNA, 21 nt, Staphylococcus aureus subsp. aureus Mu50
cauaccaguggaaauuaugua

SEQ ID NO: 3981322 - RNA, 17 nt, Staphylococcus aureus subsp. aureus Mu50
cauacccauauuaaauu

SEQ ID NO: 3981323 - RNA, 17 nt, Staphylococcus aureus subsp. aureus Mu50
cauaccggcaaauaaca

SEQ ID NO: 3981324 - RNA, 17 nt, Staphylococcus aureus subsp. aureus Mu50
cauaccuaauaacgcau

SEQ ID NO: 3981325 - RNA, 20 nt, Staphylococcus aureus subsp. aureus Mu50
cauaccuaauaacgcauaua

SEQ ID NO: 3981326 - RNA, 13 nt, Staphylococcus aureus subsp. aureus Mu50
cauaccuacaaau

SEQ ID NO: 3981327 - RNA, 19 nt, Staphylococcus aureus subsp. aureus Mu50
cauaccuauaaacauaucu

SEQ ID NO: 3981328 - RNA, 14 nt, Staphylococcus aureus subsp. aureus Mu50
cauaccugcauauu

SEQ ID NO: 3981329 - RNA, 17 nt, Staphylococcus aureus subsp. aureus Mu50
cauaccuuuauuauuua

SEQ ID NO: 3981330 - RNA, 18 nt, Staphylococcus aureus subsp. aureus Mu50
cauacgaauuaaaauaac

SEQ ID NO: 3981331 - RNA, 19 nt, Staphylococcus aureus subsp. aureus Mu50
cauacguuccuaaagucgu

SEQ ID NO: 3981332 - RNA, 13 nt, Staphylococcus aureus subsp. aureus Mu50
cauacuauaaaaa

SEQ ID NO: 3981333 - RNA, 16 nt, Staphylococcus aureus subsp. aureus Mu50
cauacucacaaaaaac

SEQ ID NO: 3981334 - RNA, 17 nt, Staphylococcus aureus subsp. aureus Mu50
cauacugauuaaacugu

SEQ ID NO: 3981335 - RNA, 21 nt, Staphylococcus aureus subsp. aureus Mu50
cauacugauuaaacuguuugu

SEQ ID NO: 3981336 - RNA, 12 nt, Staphylococcus aureus subsp. aureus Mu50
cauacuucaaac

SEQ ID NO: 3981337 - RNA, 15 nt, Staphylococcus aureus subsp. aureus Mu50
cauacuucguuguca

SEQ ID NO: 3981338 - RNA, 20 nt, Staphylococcus aureus subsp. aureus Mu50
cauacuucguugucacuauu

SEQ ID NO: 3981339 - RNA, 16 nt, Staphylococcus aureus subsp. aureus Mu50
cauacuucuauuuuau

SEQ ID NO: 3981340 - RNA, 17 nt, Staphylococcus aureus subsp. aureus Mu50
cauacuucuauuuuaua

SEQ ID NO: 3981341 - RNA, 21 nt, Staphylococcus aureus subsp. aureus Mu50
cauacuucuauuuuauaauaa

SEQ ID NO: 3981342 - RNA, 22 nt, Staphylococcus aureus subsp. aureus Mu50
cauacuuuuagcaacaguauuu

SEQ ID NO: 3981343 - RNA, 12 nt, Staphylococcus aureus subsp. aureus Mu50
cauagaaauuuu

SEQ ID NO: 3981344 - RNA, 13 nt, Staphylococcus aureus subsp. aureus Mu50
cauagaguaauuu

SEQ ID NO: 3981345 - RNA, 14 nt, Staphylococcus aureus subsp. aureus Mu50
cauagauacaaagu

SEQ ID NO: 3981346 - RNA, 17 nt, Staphylococcus aureus subsp. aureus Mu50
cauagaugcauaaaaac

SEQ ID NO: 3981347 - RNA, 15 nt, Staphylococcus aureus subsp. aureus Mu50
cauagauuauauuau

SEQ ID NO: 3981348 - RNA, 16 nt, Staphylococcus aureus subsp. aureus Mu50
cauagcauuaagauga

SEQ ID NO: 3981349 - RNA, 22 nt, Staphylococcus aureus subsp. aureus Mu50
cauagcauuaagaugauugucu

SEQ ID NO: 3981350 - RNA, 19 nt, Staphylococcus aureus subsp. aureus Mu50
cauagcgcucuggauuuuu

SEQ ID NO: 3981351 - RNA, 16 nt, Staphylococcus aureus subsp. aureus Mu50
cauagcucuucuuuuu

SEQ ID NO: 3981352 - RNA, 15 nt, Staphylococcus aureus subsp. aureus Mu50
cauaggcgcuuuuuu

SEQ ID NO: 3981353 - RNA, 21 nt, Staphylococcus aureus subsp. aureus Mu50
cauaggcgcuuuuuuuuauaa

SEQ ID NO: 3981354 - RNA, 22 nt, Staphylococcus aureus subsp. aureus Mu50
cauaggcuuaugggggauuuuu

SEQ ID NO: 3981355 - RNA, 19 nt, Staphylococcus aureus subsp. aureus Mu50
cauaggcuugccaauguga

SEQ ID NO: 3981356 - RNA, 13 nt, Staphylococcus aureus subsp. aureus Mu50
cauagguaaccuu

SEQ ID NO: 3981357 - RNA, 16 nt, Staphylococcus aureus subsp. aureus Mu50
cauaguaauaaaauga

SEQ ID NO: 3981358 - RNA, 21 nt, Staphylococcus aureus subsp. aureus Mu50
cauaguaauaaaaugaugaua

SEQ ID NO: 3981359 - RNA, 14 nt, Staphylococcus aureus subsp. aureus Mu50
caucuuuuauggug

SEQ ID NO: 3981360 - RNA, 17 nt, Staphylococcus aureus subsp. aureus Mu50
caucuuuugguuuaucu

SEQ ID NO: 3981361 - RNA, 19 nt, Staphylococcus aureus subsp. aureus Mu50
caucuuuugguuuaucugu

SEQ ID NO: 3981362 - RNA, 13 nt, Staphylococcus aureus subsp. aureus Mu50
caucuuuuuaaaa

SEQ ID NO: 3981363 - RNA, 19 nt, Staphylococcus aureus subsp. aureus Mu50
caucuuuuugauaauguuc

SEQ ID NO: 3981364 - RNA, 18 nt, Staphylococcus aureus subsp. aureus Mu50
caugaaaaggaaaaacuu

SEQ ID NO: 3981365 - RNA, 17 nt, Staphylococcus aureus subsp. aureus Mu50
caugaacaaauaauuua

SEQ ID NO: 3981366 - RNA, 15 nt, Staphylococcus aureus subsp. aureus Mu50
caugaauaaauacaa

SEQ ID NO: 3981367 - RNA, 20 nt, Staphylococcus aureus subsp. aureus Mu50
caugaaucaacaauuuaaac

SEQ ID NO: 3981368 - RNA, 21 nt, Staphylococcus aureus subsp. aureus Mu50
caugaaucaacaauuuaaacg

SEQ ID NO: 3981369 - RNA, 17 nt, Staphylococcus aureus subsp. aureus Mu50
caugaaucgcauuuaaa

SEQ ID NO: 3981370 - RNA, 18 nt, Staphylococcus aureus subsp. aureus Mu50
caugaaucgcauuuaaau

SEQ ID NO: 3981371 - RNA, 21 nt, Staphylococcus aureus subsp. aureus Mu50
caugaaucgcauuuaaauaua

SEQ ID NO: 3981372 - RNA, 23 nt, Staphylococcus aureus subsp. aureus Mu50
caugaaugucagucguuguaaaa

SEQ ID NO: 3981373 - RNA, 18 nt, Staphylococcus aureus subsp. aureus Mu50
caugaauuuuaauauauu

SEQ ID NO: 3981374 - RNA, 20 nt, Staphylococcus aureus subsp. aureus Mu50
caugacacucauucaauuua

SEQ ID NO: 3981375 - RNA, 16 nt, Staphylococcus aureus subsp. aureus Mu50
caugacagcaucauca

SEQ ID NO: 3981376 - RNA, 21 nt, Staphylococcus aureus subsp. aureus Mu50
caugacagcaucaucaauuua

SEQ ID NO: 3981377 - RNA, 20 nt, Staphylococcus aureus subsp. aureus Mu50
caugacauaaaacuuacauu

SEQ ID NO: 3981378 - RNA, 15 nt, Staphylococcus aureus subsp. aureus Mu50
caugacauucauuua

SEQ ID NO: 3981379 - RNA, 23 nt, Staphylococcus aureus subsp. aureus Mu50
caugacgaacgauagauucugau

SEQ ID NO: 3981380 - RNA, 17 nt, Staphylococcus aureus subsp. aureus Mu50
caugacucacuaaucuc

SEQ ID NO: 3981381 - RNA, 21 nt, Staphylococcus aureus subsp. aureus Mu50
caugagauuauuuuuuuaaau

SEQ ID NO: 3981382 - RNA, 20 nt, Staphylococcus aureus subsp. aureus Mu50
caugauaaaguauguuguca

SEQ ID NO: 3981383 - RNA, 16 nt, Staphylococcus aureus subsp. aureus Mu50
caugauacucaauaaa

SEQ ID NO: 3981384 - RNA, 20 nt, Staphylococcus aureus subsp. aureus Mu50
caugauacucaauaaaauug

SEQ ID NO: 3981385 - RNA, 12 nt, Staphylococcus aureus subsp. aureus Mu50
caugaugauaaa

SEQ ID NO: 3981386 - RNA, 14 nt, Staphylococcus aureus subsp. aureus Mu50
caugauucaugaua

SEQ ID NO: 3981387 - RNA, 14 nt, Staphylococcus aureus subsp. aureus Mu50
caugauuucuucuc

SEQ ID NO: 3981388 - RNA, 19 nt, Staphylococcus aureus subsp. aureus Mu50
caugcaccuuuacaacaua

SEQ ID NO: 3981389 - RNA, 16 nt, Staphylococcus aureus subsp. aureus Mu50
caugcacuuuauuaaa

SEQ ID NO: 3981390 - RNA, 18 nt, Staphylococcus aureus subsp. aureus Mu50
caugcccgauaaaaccac

SEQ ID NO: 3981391 - RNA, 18 nt, Staphylococcus aureus subsp. aureus Mu50
caugccuuaugucauaua

SEQ ID NO: 3981392 - RNA, 13 nt, Staphylococcus aureus subsp. aureus Mu50
caugccuucauga

SEQ ID NO: 3981393 - RNA, 18 nt, Staphylococcus aureus subsp. aureus Mu50
caugcgauugaugcguuu

SEQ ID NO: 3981394 - RNA, 13 nt, Staphylococcus aureus subsp. aureus Mu50
caugcuuaauuua

SEQ ID NO: 3981395 - RNA, 15 nt, Staphylococcus aureus subsp. aureus Mu50
caugcuuuuaauauu

SEQ ID NO: 3981396 - RNA, 12 nt, Staphylococcus aureus subsp. aureus Mu50
cauggaaaagug

SEQ ID NO: 3981397 - RNA, 13 nt, Staphylococcus aureus subsp. aureus Mu50
caugguuuaauuc

SEQ ID NO: 3981398 - RNA, 19 nt, Staphylococcus aureus subsp. aureus Mu50
cauguaaauaguuaguuua

SEQ ID NO: 3981399 - RNA, 20 nt, Staphylococcus aureus subsp. aureus Mu50
cauguaaauaguuaguuuau

SEQ ID NO: 3981400 - RNA, 15 nt, Staphylococcus aureus subsp. aureus Mu50
cauguaacaaaauac

SEQ ID NO: 3981401 - RNA, 22 nt, Staphylococcus aureus subsp. aureus Mu50
cauguaacaaaauacccugcuu

SEQ ID NO: 3981402 - RNA, 17 nt, Staphylococcus aureus subsp. aureus Mu50
cauguaaugcuuaaaaa

SEQ ID NO: 3981403 - RNA, 19 nt, Staphylococcus aureus subsp. aureus Mu50
cauguaaugcuuaaaaaca

SEQ ID NO: 3981404 - RNA, 21 nt, Staphylococcus aureus subsp. aureus Mu50
cauguaaugcuuaaaaacaau

SEQ ID NO: 3981405 - RNA, 15 nt, Staphylococcus aureus subsp. aureus Mu50
cauguacaguuacuu

SEQ ID NO: 3981406 - RNA, 19 nt, Staphylococcus aureus subsp. aureus Mu50
cauguacauugguuuuuac

SEQ ID NO: 3981407 - RNA, 21 nt, Staphylococcus aureus subsp. aureus Mu50
cauguacguuuuuuuaaauac

SEQ ID NO: 3981408 - RNA, 12 nt, Staphylococcus aureus subsp. aureus Mu50
cauguauaaaag

SEQ ID NO: 3981409 - RNA, 19 nt, Staphylococcus aureus subsp. aureus Mu50
cauguauaaaagauauaaa

SEQ ID NO: 3981410 - RNA, 16 nt, Staphylococcus aureus subsp. aureus Mu50
cauguauaucuaauac

SEQ ID NO: 3981411 - RNA, 21 nt, Staphylococcus aureus subsp. aureus Mu50
caugucaauuuuuucaugauu

SEQ ID NO: 3981412 - RNA, 18 nt, Staphylococcus aureus subsp. aureus Mu50
caugucuagauuuuaaau

SEQ ID NO: 3981413 - RNA, 22 nt, Staphylococcus aureus subsp. aureus Mu50
caugucuagauuuuaaaucaau

SEQ ID NO: 3981414 - RNA, 12 nt, Staphylococcus aureus subsp. aureus Mu50
cauguucauaau

SEQ ID NO: 3981415 - RNA, 14 nt, Staphylococcus aureus subsp. aureus Mu50
cauguucauaauau

SEQ ID NO: 3981416 - RNA, 16 nt, Staphylococcus aureus subsp. aureus Mu50
cauguucauaauauaa

SEQ ID NO: 3981417 - RNA, 19 nt, Staphylococcus aureus subsp. aureus Mu50
cauguuccgcuacaaaaca

SEQ ID NO: 3981418 - RNA, 20 nt, Staphylococcus aureus subsp. aureus Mu50
cauguuugauucuaaauaau

SEQ ID NO: 3981419 - RNA, 18 nt, Staphylococcus aureus subsp. aureus Mu50
cauguuuggaugaacaaa

SEQ ID NO: 3981420 - RNA, 23 nt, Staphylococcus aureus subsp. aureus Mu50
cauguuuuguaccugcuucugua

SEQ ID NO: 3981421 - RNA, 15 nt, Staphylococcus aureus subsp. aureus Mu50
cauguuuuuuaagua

SEQ ID NO: 3981422 - RNA, 23 nt, Staphylococcus aureus subsp. aureus Mu50
cauuaaaaaaucgaacuagacaa

SEQ ID NO: 3981423 - RNA, 17 nt, Staphylococcus aureus subsp. aureus Mu50
cauuaaaaacgauucau

SEQ ID NO: 3981424 - RNA, 13 nt, Staphylococcus aureus subsp. aureus Mu50
cauuaaaaauaaa

SEQ ID NO: 3981425 - RNA, 18 nt, Staphylococcus aureus subsp. aureus Mu50
cauuaaaaauaaaagcaa

SEQ ID NO: 3981426 - RNA, 22 nt, Staphylococcus aureus subsp. aureus Mu50
cauuaaaaggaugugacaaaua

SEQ ID NO: 3981427 - RNA, 13 nt, Staphylococcus aureus subsp. aureus Mu50
cauuaaaauaauu

SEQ ID NO: 3981428 - RNA, 13 nt, Staphylococcus aureus subsp. aureus Mu50
cauuaaaaugaua

SEQ ID NO: 3981429 - RNA, 14 nt, Staphylococcus aureus subsp. aureus Mu50
cauuaaaaugauau

SEQ ID NO: 3981430 - RNA, 19 nt, Staphylococcus aureus subsp. aureus Mu50
cauuaaaauguguuuucaa

SEQ ID NO: 3981431 - RNA, 16 nt, Staphylococcus aureus subsp. aureus Mu50
cauuaaaauugcagcu

SEQ ID NO: 3981432 - RNA, 19 nt, Staphylococcus aureus subsp. aureus Mu50
cauuaaauauuauuuugca

SEQ ID NO: 3981433 - RNA, 20 nt, Staphylococcus aureus subsp. aureus Mu50
cauuaaauauuauuuugcaa

SEQ ID NO: 3981434 - RNA, 15 nt, Staphylococcus aureus subsp. aureus Mu50
cauuaaaucugauuc

SEQ ID NO: 3981435 - RNA, 21 nt, Staphylococcus aureus subsp. aureus Mu50
cauuaaaucugauucauuaaa

SEQ ID NO: 3981436 - RNA, 14 nt, Staphylococcus aureus subsp. aureus Mu50
cauuaaauguacau

SEQ ID NO: 3981437 - RNA, 13 nt, Staphylococcus aureus subsp. aureus Mu50
cauuaaauuauua

SEQ ID NO: 3981438 - RNA, 23 nt, Staphylococcus aureus subsp. aureus Mu50
cauuaaccaguauaauuuucugu

SEQ ID NO: 3981439 - RNA, 13 nt, Staphylococcus aureus subsp. aureus Mu50
cauuaagaugauu

SEQ ID NO: 3981440 - RNA, 14 nt, Staphylococcus aureus subsp. aureus Mu50
cauuaaguacuuuu

SEQ ID NO: 3981441 - RNA, 18 nt, Staphylococcus aureus subsp. aureus Mu50
cauuaaguacuuuuacaa

SEQ ID NO: 3981442 - RNA, 14 nt, Staphylococcus aureus subsp. aureus Mu50
cauuaaguugaaaa

SEQ ID NO: 3981443 - RNA, 17 nt, Staphylococcus aureus subsp. aureus Mu50
cauuaauaaauaauaac

SEQ ID NO: 3981444 - RNA, 13 nt, Staphylococcus aureus subsp. aureus Mu50
cauuaauaauuaa

SEQ ID NO: 3981445 - RNA, 16 nt, Staphylococcus aureus subsp. aureus Mu50
cauuaaucuauauaaa

SEQ ID NO: 3981446 - RNA, 17 nt, Staphylococcus aureus subsp. aureus Mu50
cauuaaucuauauaaaa

SEQ ID NO: 3981447 - RNA, 19 nt, Staphylococcus aureus subsp. aureus Mu50
cauugaucuuuuauaauga

SEQ ID NO: 3981448 - RNA, 20 nt, Staphylococcus aureus subsp. aureus Mu50
cauugccuguagaauuucuu

SEQ ID NO: 3981449 - RNA, 23 nt, Staphylococcus aureus subsp. aureus Mu50
cauugcuagugcucuugcaauag

SEQ ID NO: 3981450 - RNA, 14 nt, Staphylococcus aureus subsp. aureus Mu50
cauugcuuaacuuc

SEQ ID NO: 3981451 - RNA, 19 nt, Staphylococcus aureus subsp. aureus Mu50
cauugcuucuuggcauuuu

SEQ ID NO: 3981452 - RNA, 21 nt, Staphylococcus aureus subsp. aureus Mu50
cauuggauuacuuccauugcu

SEQ ID NO: 3981453 - RNA, 22 nt, Staphylococcus aureus subsp. aureus Mu50
cauuggcaauauacuuuuuaaa

SEQ ID NO: 3981454 - RNA, 17 nt, Staphylococcus aureus subsp. aureus Mu50
cauugguaccuuuuuau

SEQ ID NO: 3981455 - RNA, 15 nt, Staphylococcus aureus subsp. aureus Mu50
cauugguuucaucau

SEQ ID NO: 3981456 - RNA, 15 nt, Staphylococcus aureus subsp. aureus Mu50
cauuguaaaaugcuc

SEQ ID NO: 3981457 - RNA, 13 nt, Staphylococcus aureus subsp. aureus Mu50
cauuguaaaaugu

SEQ ID NO: 3981458 - RNA, 22 nt, Staphylococcus aureus subsp. aureus Mu50
cauuguaaauauaguaauaaaa

SEQ ID NO: 3981459 - RNA, 20 nt, Staphylococcus aureus subsp. aureus Mu50
cauuguaaauuuguuaucuu

SEQ ID NO: 3981460 - RNA, 13 nt, Staphylococcus aureus subsp. aureus Mu50
cauuguaacucaa

SEQ ID NO: 3981461 - RNA, 12 nt, Staphylococcus aureus subsp. aureus Mu50
cauuguaauaau

SEQ ID NO: 3981462 - RNA, 18 nt, Staphylococcus aureus subsp. aureus Mu50
cauuguaauaauaaucuu

SEQ ID NO: 3981463 - RNA, 15 nt, Staphylococcus aureus subsp. aureus Mu50
cauuguauguugaaa

SEQ ID NO: 3981464 - RNA, 17 nt, Staphylococcus aureus subsp. aureus Mu50
cauugucaugccuucau

SEQ ID NO: 3981465 - RNA, 22 nt, Staphylococcus aureus subsp. aureus Mu50
cauugucaugccuucauuagcc

SEQ ID NO: 3981466 - RNA, 22 nt, Staphylococcus aureus subsp. aureus Mu50
cauuguggcuuuuuuuauggug

SEQ ID NO: 3981467 - RNA, 16 nt, Staphylococcus aureus subsp. aureus Mu50
cauuguguauuguuuu

SEQ ID NO: 3981468 - RNA, 22 nt, Staphylococcus aureus subsp. aureus Mu50
cauuguguauuguuuuacuuuc

SEQ ID NO: 3981469 - RNA, 17 nt, Staphylococcus aureus subsp. aureus Mu50
cauuguucauacgcuca

SEQ ID NO: 3981470 - RNA, 12 nt, Staphylococcus aureus subsp. aureus Mu50
cauuuaaaaaau

SEQ ID NO: 3981471 - RNA, 15 nt, Staphylococcus aureus subsp. aureus Mu50
cauuuaaaaaucaaa

SEQ ID NO: 3981472 - RNA, 14 nt, Staphylococcus aureus subsp. aureus Mu50
cauuuaaaauauuu

SEQ ID NO: 3981473 - RNA, 18 nt, Staphylococcus aureus subsp. aureus Mu50
cauuuaaaauauuuuuuc

SEQ ID NO: 3981474 - RNA, 20 nt, Staphylococcus aureus subsp. aureus Mu50
cauuuaaaauauuuuuucug

SEQ ID NO: 3981475 - RNA, 11 nt, Staphylococcus aureus subsp. aureus Mu50
cauuuaagccu

SEQ ID NO: 3981476 - RNA, 22 nt, Staphylococcus aureus subsp. aureus Mu50
cauuuaaggauuuccucgguuu

SEQ ID NO: 3981477 - RNA, 14 nt, Staphylococcus aureus subsp. aureus Mu50
cauuuaauacuuuu

SEQ ID NO: 3981478 - RNA, 22 nt, Staphylococcus aureus subsp. aureus Mu50
cauuuaauggucuaauaucaau

SEQ ID NO: 3981479 - RNA, 20 nt, Staphylococcus aureus subsp. aureus Mu50
cauuuaauuggaguucaucu

SEQ ID NO: 3981480 - RNA, 14 nt, Staphylococcus aureus subsp. aureus Mu50
cauuuaauuuguua

SEQ ID NO: 3981481 - RNA, 21 nt, Staphylococcus aureus subsp. aureus Mu50
cauuuagauagcggauuuauu

SEQ ID NO: 3981482 - RNA, 21 nt, Staphylococcus aureus subsp. aureus Mu50
cauuuauaacauacguuauuu

SEQ ID NO: 3981483 - RNA, 20 nt, Staphylococcus aureus subsp. aureus Mu50
cauuuauguguuggcuuuua

SEQ ID NO: 3981484 - RNA, 17 nt, Staphylococcus aureus subsp. aureus Mu50
cauuuauucuuucucua

SEQ ID NO: 3981485 - RNA, 14 nt, Staphylococcus aureus subsp. aureus Mu50
cauuuauuuucaau

SEQ ID NO: 3981486 - RNA, 20 nt, Staphylococcus aureus subsp. aureus Mu50
cauuuauuuucaauaaauaa

SEQ ID NO: 3981487 - RNA, 22 nt, Staphylococcus aureus subsp. aureus Mu50
cauuuauuuucaauaaauaaac

SEQ ID NO: 3981488 - RNA, 23 nt, Staphylococcus aureus subsp. aureus Mu50
cauuuauuuucuuuggugaaagu

SEQ ID NO: 3981489 - RNA, 14 nt, Staphylococcus aureus subsp. aureus Mu50
cauuucaauauuaa

SEQ ID NO: 3981490 - RNA, 16 nt, Staphylococcus aureus subsp. aureus Mu50
cauuucagaaauacau

SEQ ID NO: 3981491 - RNA, 21 nt, Staphylococcus aureus subsp. aureus Mu50
cauuucaucaauaauuucuug

SEQ ID NO: 3981492 - RNA, 11 nt, Staphylococcus aureus subsp. aureus Mu50
cauuucaucau

SEQ ID NO: 3981493 - RNA, 15 nt, Staphylococcus aureus subsp. aureus Mu50
cauuucaucauaauu

SEQ ID NO: 3981494 - RNA, 14 nt, Staphylococcus aureus subsp. aureus Mu50
cauuucauguguca

SEQ ID NO: 3981495 - RNA, 17 nt, Staphylococcus aureus subsp. aureus Mu50
cauuucaugugucacaa

SEQ ID NO: 3981496 - RNA, 20 nt, Staphylococcus aureus subsp. aureus Mu50
cauuucaugugucacaauga

SEQ ID NO: 3981497 - RNA, 15 nt, Staphylococcus aureus subsp. aureus Mu50
cauuucguauauaua

SEQ ID NO: 3981498 - RNA, 20 nt, Staphylococcus aureus subsp. aureus Mu50
cauuucugaugcuagcuuuc

SEQ ID NO: 3981499 - RNA, 13 nt, Staphylococcus aureus subsp. aureus Mu50
cauuugaccaagu

SEQ ID NO: 3981500 - RNA, 12 nt, Staphylococcus aureus subsp. aureus Mu50
cauuugauuuuu

SEQ ID NO: 3981501 - RNA, 19 nt, Staphylococcus aureus subsp. aureus Mu50
cauuugcaacaauauaaua

SEQ ID NO: 3981502 - RNA, 16 nt, Staphylococcus aureus subsp. aureus Mu50
cauuuggcguaaugau

SEQ ID NO: 3981503 - RNA, 21 nt, Staphylococcus aureus subsp. aureus Mu50
cauuugguggagaaccaaaaa

SEQ ID NO: 3981504 - RNA, 23 nt, Staphylococcus aureus subsp. aureus Mu50
cauuugguggagaaccuuuaaaa

SEQ ID NO: 3981505 - RNA, 18 nt, Staphylococcus aureus subsp. aureus Mu50
cauuugguuuaacuuuau

SEQ ID NO: 3981506 - RNA, 14 nt, Staphylococcus aureus subsp. aureus Mu50
cauuuguauagauu

SEQ ID NO: 3981507 - RNA, 15 nt, Staphylococcus aureus subsp. aureus Mu50
cauuuguauuaauuu

SEQ ID NO: 3981508 - RNA, 23 nt, Staphylococcus aureus subsp. aureus Mu50
cauuugucaucguauuucuagcu

SEQ ID NO: 3981509 - RNA, 16 nt, Staphylococcus aureus subsp. aureus Mu50
cauuuguguaaaugaa

SEQ ID NO: 3981510 - RNA, 19 nt, Staphylococcus aureus subsp. aureus Mu50
cauuuguguauaaauguca

SEQ ID NO: 3981511 - RNA, 17 nt, Staphylococcus aureus subsp. aureus Mu50
cauuuguucugcagagu

SEQ ID NO: 3981512 - RNA, 14 nt, Staphylococcus aureus subsp. aureus Mu50
cauuuuaaauaaaa

SEQ ID NO: 3981513 - RNA, 19 nt, Staphylococcus aureus subsp. aureus Mu50
cauuuuaaauaaaaugcau

SEQ ID NO: 3981514 - RNA, 15 nt, Staphylococcus aureus subsp. aureus Mu50
cauuuuauauuuuag

SEQ ID NO: 3981515 - RNA, 15 nt, Staphylococcus aureus subsp. aureus Mu50
cauuuuaucugaaaa

SEQ ID NO: 3981516 - RNA, 16 nt, Staphylococcus aureus subsp. aureus Mu50
cauuuuaugcacuuuu

SEQ ID NO: 3981517 - RNA, 19 nt, Staphylococcus aureus subsp. aureus Mu50
cauuuucaacauaauauuu

SEQ ID NO: 3981518 - RNA, 14 nt, Staphylococcus aureus subsp. aureus Mu50
cauuuucaagagga

SEQ ID NO: 3981519 - RNA, 20 nt, Staphylococcus aureus subsp. aureus Mu50
cauuuugacgccagaauaaa

SEQ ID NO: 3981520 - RNA, 12 nt, Staphylococcus aureus subsp. aureus Mu50
cauuuuguuuca

SEQ ID NO: 3981521 - RNA, 11 nt, Staphylococcus aureus subsp. aureus Mu50
cauuuuuaaaa

SEQ ID NO: 3981522 - RNA, 19 nt, Staphylococcus aureus subsp. aureus Mu50
cauuuuuaaauuacuauau

SEQ ID NO: 3981523 - RNA, 15 nt, Staphylococcus aureus subsp. aureus Mu50
cauuuuuagaaauag

SEQ ID NO: 3981524 - RNA, 17 nt, Staphylococcus aureus subsp. aureus Mu50
cauuuuuagaaucaaaa

SEQ ID NO: 3981525 - RNA, 23 nt, Staphylococcus aureus subsp. aureus Mu50
cauuuuuagaaucaaaaaagaca

SEQ ID NO: 3981526 - RNA, 16 nt, Staphylococcus aureus subsp. aureus Mu50
cauuuuuauaaauuuu

SEQ ID NO: 3981527 - RNA, 14 nt, Staphylococcus aureus subsp. aureus Mu50
cauuuuuauauuga

SEQ ID NO: 3981528 - RNA, 20 nt, Staphylococcus aureus subsp. aureus Mu50
cauuuuuaucccacuccuua

SEQ ID NO: 3981529 - RNA, 23 nt, Staphylococcus aureus subsp. aureus Mu50
cauuuuuauguuaaaucgauacu

SEQ ID NO: 3981530 - RNA, 22 nt, Staphylococcus aureus subsp. aureus Mu50
cauuuuucguuguucauaauca

SEQ ID NO: 3981531 - RNA, 23 nt, Staphylococcus aureus subsp. aureus Mu50
cauuuuuuauuuuacuuacuuuu

SEQ ID NO: 3981532 - RNA, 18 nt, Staphylococcus aureus subsp. aureus Mu50
cauuuuuucgagaugaua

SEQ ID NO: 3981533 - RNA, 12 nt, Staphylococcus aureus subsp. aureus Mu50
ccaaaaaguauu

SEQ ID NO: 3981534 - RNA, 22 nt, Staphylococcus aureus subsp. aureus Mu50
ccaaaaauagauugaaaaaaua

SEQ ID NO: 3981535 - RNA, 22 nt, Staphylococcus aureus subsp. aureus Mu50
ccaaaaaucauccauaaaaaua

SEQ ID NO: 3981536 - RNA, 12 nt, Staphylococcus aureus subsp. aureus Mu50
ccaaaaauugua

SEQ ID NO: 3981537 - RNA, 21 nt, Staphylococcus aureus subsp. aureus Mu50
ccaaaaauuguaaaaccuuac

SEQ ID NO: 3981538 - RNA, 21 nt, Staphylococcus aureus subsp. aureus Mu50
ccaaaaguuauauaaauuugu

SEQ ID NO: 3981539 - RNA, 18 nt, Staphylococcus aureus subsp. aureus Mu50
ccaaaaugguuaaaaucg

SEQ ID NO: 3981540 - RNA, 19 nt, Staphylococcus aureus subsp. aureus Mu50
ccaaacugccuaauacacu

SEQ ID NO: 3981541 - RNA, 20 nt, Staphylococcus aureus subsp. aureus Mu50
ccaaagaaacggaaaugacu

SEQ ID NO: 3981542 - RNA, 20 nt, Staphylococcus aureus subsp. aureus Mu50
ccaaagaaagcuaauaucaa

SEQ ID NO: 3981543 - RNA, 21 nt, Staphylococcus aureus subsp. aureus Mu50
ccaaagaaagcuaauaucaau

SEQ ID NO: 3981544 - RNA, 20 nt, Staphylococcus aureus subsp. aureus Mu50
ccaaagaaaucaccagauuu

SEQ ID NO: 3981545 - RNA, 16 nt, Staphylococcus aureus subsp. aureus Mu50
ccaaagcugaauuuua

SEQ ID NO: 3981546 - RNA, 22 nt, Staphylococcus aureus subsp. aureus Mu50
ccaaaguaccaucucuauuuuu

SEQ ID NO: 3981547 - RNA, 20 nt, Staphylococcus aureus subsp. aureus Mu50
ccaaauaaauuaaauuuugu

SEQ ID NO: 3981548 - RNA, 19 nt, Staphylococcus aureus subsp. aureus Mu50
ccaaauaacguuaauauaa

SEQ ID NO: 3981549 - RNA, 20 nt, Staphylococcus aureus subsp. aureus Mu50
ccaaauaacguuaauauaau

SEQ ID NO: 3981550 - RNA, 13 nt, Staphylococcus aureus subsp. aureus Mu50
ccaaauaauaucu

SEQ ID NO: 3981551 - RNA, 19 nt, Staphylococcus aureus subsp. aureus Mu50
ccaaauagagaaauacuau

SEQ ID NO: 3981552 - RNA, 20 nt, Staphylococcus aureus subsp. aureus Mu50
ccaaauauaguaauuguuau

SEQ ID NO: 3981553 - RNA, 20 nt, Staphylococcus aureus subsp. aureus Mu50
ccaaauauauuuuuauuaau

SEQ ID NO: 3981554 - RNA, 18 nt, Staphylococcus aureus subsp. aureus Mu50
ccaaauaucaguaauaau

SEQ ID NO: 3981555 - RNA, 16 nt, Staphylococcus aureus subsp. aureus Mu50
ccaaauauuaaaaaca

SEQ ID NO: 3981556 - RNA, 15 nt, Staphylococcus aureus subsp. aureus Mu50
ccaaauccaucuaau

SEQ ID NO: 3981557 - RNA, 16 nt, Staphylococcus aureus subsp. aureus Mu50
ccaaauccaucuaauu

SEQ ID NO: 3981558 - RNA, 18 nt, Staphylococcus aureus subsp. aureus Mu50
ccaaaucuuuaauaaccu

SEQ ID NO: 3981559 - RNA, 23 nt, Staphylococcus aureus subsp. aureus Mu50
ccaaaugugguggguauauaauu

SEQ ID NO: 3981560 - RNA, 15 nt, Staphylococcus aureus subsp. aureus Mu50
ccaaauguugauaau

SEQ ID NO: 3981561 - RNA, 21 nt, Staphylococcus aureus subsp. aureus Mu50
ccaaauugaugacuuacuaau

SEQ ID NO: 3981562 - RNA, 22 nt, Staphylococcus aureus subsp. aureus Mu50
ccaaauuucucuuucaagaccu

SEQ ID NO: 3981563 - RNA, 23 nt, Staphylococcus aureus subsp. aureus Mu50
ccaaauuucucuuucaagaccuu

SEQ ID NO: 3981564 - RNA, 14 nt, Staphylococcus aureus subsp. aureus Mu50
ccaacaaaaagaau

SEQ ID NO: 3981565 - RNA, 12 nt, Staphylococcus aureus subsp. aureus Mu50
ccaacaacuaag

SEQ ID NO: 3981566 - RNA, 21 nt, Staphylococcus aureus subsp. aureus Mu50
ccaacaauagguacaacuaaa

SEQ ID NO: 3981567 - RNA, 22 nt, Staphylococcus aureus subsp. aureus Mu50
ccaacaauagguacaacuaaau

SEQ ID NO: 3981568 - RNA, 22 nt, Staphylococcus aureus subsp. aureus Mu50
ccaacacaaagaauuucgaaaa

SEQ ID NO: 3981569 - RNA, 13 nt, Staphylococcus aureus subsp. aureus Mu50
ccaacacauaaau

SEQ ID NO: 3981570 - RNA, 16 nt, Staphylococcus aureus subsp. aureus Mu50
ccaacacccauauaau

SEQ ID NO: 3981571 - RNA, 18 nt, Staphylococcus aureus subsp. aureus Mu50
ccaacacccauauaauuu

SEQ ID NO: 3981572 - RNA, 23 nt, Staphylococcus aureus subsp. aureus Mu50
ccaacauauuuuaacuaugaaug

SEQ ID NO: 3981573 - RNA, 14 nt, Staphylococcus aureus subsp. aureus Mu50
ccaacuaauguuaa

SEQ ID NO: 3981574 - RNA, 17 nt, Staphylococcus aureus subsp. aureus Mu50
ccaacuaauguuaaaau

SEQ ID NO: 3981575 - RNA, 22 nt, Staphylococcus aureus subsp. aureus Mu50
ccaacucgcauugccuguagaa

SEQ ID NO: 3981576 - RNA, 20 nt, Staphylococcus aureus subsp. aureus Mu50
ccaacugucgguucaucuaa

SEQ ID NO: 3981577 - RNA, 22 nt, Staphylococcus aureus subsp. aureus Mu50
ccaacugucgguucaucuaaaa

SEQ ID NO: 3981578 - RNA, 13 nt, Staphylococcus aureus subsp. aureus Mu50
ccaacuuaauaac

SEQ ID NO: 3981579 - RNA, 14 nt, Staphylococcus aureus subsp. aureus Mu50
ccaacuugcacauu

SEQ ID NO: 3981580 - RNA, 22 nt, Staphylococcus aureus subsp. aureus Mu50
ccaacuugcauugucuguagaa

SEQ ID NO: 3981581 - RNA, 13 nt, Staphylococcus aureus subsp. aureus Mu50
ccaacuuuuuuaa

SEQ ID NO: 3981582 - RNA, 17 nt, Staphylococcus aureus subsp. aureus Mu50
ccaagaacguguuugaa

SEQ ID NO: 3981583 - RNA, 21 nt, Staphylococcus aureus subsp. aureus Mu50
ccaagaagacauuggauuacu

SEQ ID NO: 3981584 - RNA, 23 nt, Staphylococcus aureus subsp. aureus Mu50
ccaagagaauuaauaauuuuuuu

SEQ ID NO: 3981585 - RNA, 15 nt, Staphylococcus aureus subsp. aureus Mu50
ccaagauauauaacu

SEQ ID NO: 3981586 - RNA, 16 nt, Staphylococcus aureus subsp. aureus Mu50
ccaagaugguauugcu

SEQ ID NO: 3981587 - RNA, 16 nt, Staphylococcus aureus subsp. aureus Mu50
ccaagauuaugacaac

SEQ ID NO: 3981588 - RNA, 16 nt, Staphylococcus aureus subsp. aureus Mu50
ccaagcaucauugaau

SEQ ID NO: 3981589 - RNA, 19 nt, Staphylococcus aureus subsp. aureus Mu50
ccaaguacgcaauuuaaua

SEQ ID NO: 3981590 - RNA, 17 nt, Staphylococcus aureus subsp. aureus Mu50
ccaaguccaauuccaau

SEQ ID NO: 3981591 - RNA, 18 nt, Staphylococcus aureus subsp. aureus Mu50
ccaaguccaauuccaaua

SEQ ID NO: 3981592 - RNA, 20 nt, Staphylococcus aureus subsp. aureus Mu50
ccaagucuaacaguuaauau

SEQ ID NO: 3981593 - RNA, 23 nt, Staphylococcus aureus subsp. aureus Mu50
ccaaguucacuaaauucaauaau

SEQ ID NO: 3981594 - RNA, 19 nt, Staphylococcus aureus subsp. aureus Mu50
ccaauaaaaugcaauuuuu

SEQ ID NO: 3981595 - RNA, 14 nt, Staphylococcus aureus subsp. aureus Mu50
ccaauaaaauguca

SEQ ID NO: 3981596 - RNA, 23 nt, Staphylococcus aureus subsp. aureus Mu50
ccaauaaaaugucagcaacuucu

SEQ ID NO: 3981597 - RNA, 13 nt, Staphylococcus aureus subsp. aureus Mu50
ccaauaaacaacu

SEQ ID NO: 3981598 - RNA, 14 nt, Staphylococcus aureus subsp. aureus Mu50
ccaauaauaaauca

SEQ ID NO: 3981599 - RNA, 18 nt, Staphylococcus aureus subsp. aureus Mu50
ccaauacagaacuuuaau

SEQ ID NO: 3981600 - RNA, 20 nt, Staphylococcus aureus subsp. aureus Mu50
ccaauacagaacuuuaauaa

SEQ ID NO: 3981601 - RNA, 21 nt, Staphylococcus aureus subsp. aureus Mu50
ccaauaccgaauaauuuugau

SEQ ID NO: 3981602 - RNA, 24 nt, Staphylococcus aureus subsp. aureus Mu50
ccaauacguuuccaaucuauuaau

SEQ ID NO: 3981603 - RNA, 18 nt, Staphylococcus aureus subsp. aureus Mu50
ccaauagguucauuauuu

SEQ ID NO: 3981604 - RNA, 21 nt, Staphylococcus aureus subsp. aureus Mu50
ccaauauauucaccuacaaca

SEQ ID NO: 3981605 - RNA, 16 nt, Staphylococcus aureus subsp. aureus Mu50
ccaauaucauauuuga

SEQ ID NO: 3981606 - RNA, 17 nt, Staphylococcus aureus subsp. aureus Mu50
ccaauaucauauuugaa

SEQ ID NO: 3981607 - RNA, 17 nt, Staphylococcus aureus subsp. aureus Mu50
ccaaucauucguuuaau

SEQ ID NO: 3981608 - RNA, 17 nt, Staphylococcus aureus subsp. aureus Mu50
ccaaugaauaaauugau

SEQ ID NO: 3981609 - RNA, 18 nt, Staphylococcus aureus subsp. aureus Mu50
ccaaugcugaauaaauaa

SEQ ID NO: 3981610 - RNA, 14 nt, Staphylococcus aureus subsp. aureus Mu50
ccaauguguuuaac

SEQ ID NO: 3981611 - RNA, 17 nt, Staphylococcus aureus subsp. aureus Mu50
ccaauuaaauauuuaac

SEQ ID NO: 3981612 - RNA, 21 nt, Staphylococcus aureus subsp. aureus Mu50
ccaauuaaccuugauuuaauu

SEQ ID NO: 3981613 - RNA, 14 nt, Staphylococcus aureus subsp. aureus Mu50
ccaauuaauaaaca

SEQ ID NO: 3981614 - RNA, 21 nt, Staphylococcus aureus subsp. aureus Mu50
ccaauuaauuguaaagcauga

SEQ ID NO: 3981615 - RNA, 23 nt, Staphylococcus aureus subsp. aureus Mu50
ccaauucauuuuauaaaucaaag

SEQ ID NO: 3981616 - RNA, 16 nt, Staphylococcus aureus subsp. aureus Mu50
ccaauuccgccacacc

SEQ ID NO: 3981617 - RNA, 20 nt, Staphylococcus aureus subsp. aureus Mu50
ccaauuuaauagcuuguaca

SEQ ID NO: 3981618 - RNA, 17 nt, Staphylococcus aureus subsp. aureus Mu50
ccaauuugauuaguaau

SEQ ID NO: 3981619 - RNA, 13 nt, Staphylococcus aureus subsp. aureus Mu50
ccacaacauguuu

SEQ ID NO: 3981620 - RNA, 20 nt, Staphylococcus aureus subsp. aureus Mu50
ccaccacauuugguggagaa

SEQ ID NO: 3981621 - RNA, 22 nt, Staphylococcus aureus subsp. aureus Mu50
cccaacacugagaauuucuaau

SEQ ID NO: 3981622 - RNA, 19 nt, Staphylococcus aureus subsp. aureus Mu50
cccaaccacgauaucuagc

SEQ ID NO: 3981623 - RNA, 16 nt, Staphylococcus aureus subsp. aureus Mu50
cccaacgaugaaacuc

SEQ ID NO: 3981624 - RNA, 22 nt, Staphylococcus aureus subsp. aureus Mu50
cccaaucgauuuuauaucuuuc

SEQ ID NO: 3981625 - RNA, 11 nt, Staphylococcus aureus subsp. aureus Mu50
cccacacccca

SEQ ID NO: 3981626 - RNA, 12 nt, Staphylococcus aureus subsp. aureus Mu50
cccacaccccaa

SEQ ID NO: 3981627 - RNA, 16 nt, Staphylococcus aureus subsp. aureus Mu50
cccacaucuuuuuaaa

SEQ ID NO: 3981628 - RNA, 15 nt, Staphylococcus aureus subsp. aureus Mu50
cccacuuauaaacaa

SEQ ID NO: 3981629 - RNA, 17 nt, Staphylococcus aureus subsp. aureus Mu50
cccagaugaauuuuuau

SEQ ID NO: 3981630 - RNA, 21 nt, Staphylococcus aureus subsp. aureus Mu50
cccagauucauaucuuucaau

SEQ ID NO: 3981631 - RNA, 21 nt, Staphylococcus aureus subsp. aureus Mu50
cccauaacaccuacugauuga

SEQ ID NO: 3981632 - RNA, 16 nt, Staphylococcus aureus subsp. aureus Mu50
cccauaccuacaaaua

SEQ ID NO: 3981633 - RNA, 13 nt, Staphylococcus aureus subsp. aureus Mu50
cccauacugauua

SEQ ID NO: 3981634 - RNA, 21 nt, Staphylococcus aureus subsp. aureus Mu50
cccaucuuuuagguaauaauu

SEQ ID NO: 3981635 - RNA, 14 nt, Staphylococcus aureus subsp. aureus Mu50
cccauggauucuga

SEQ ID NO: 3981636 - RNA, 16 nt, Staphylococcus aureus subsp. aureus Mu50
cccauguauaaggaua

SEQ ID NO: 3981637 - RNA, 17 nt, Staphylococcus aureus subsp. aureus Mu50
cccauucacuacuuuuu

SEQ ID NO: 3981638 - RNA, 19 nt, Staphylococcus aureus subsp. aureus Mu50
cccauugcuuguccucuaa

SEQ ID NO: 3981639 - RNA, 15 nt, Staphylococcus aureus subsp. aureus Mu50
cccauuugucuuaau

SEQ ID NO: 3981640 - RNA, 13 nt, Staphylococcus aureus subsp. aureus Mu50
cccauuuuaaagu

SEQ ID NO: 3981641 - RNA, 16 nt, Staphylococcus aureus subsp. aureus Mu50
ccccaacacagagaaa

SEQ ID NO: 3981642 - RNA, 15 nt, Staphylococcus aureus subsp. aureus Mu50
ccccaacuugcauug

SEQ ID NO: 3981643 - RNA, 20 nt, Staphylococcus aureus subsp. aureus Mu50
ccccaacuugcauugucugu

SEQ ID NO: 3981644 - RNA, 21 nt, Staphylococcus aureus subsp. aureus Mu50
ccccauuuauguguuggcuuu

SEQ ID NO: 3981645 - RNA, 11 nt, Staphylococcus aureus subsp. aureus Mu50
cccccaacaca

SEQ ID NO: 3981646 - RNA, 12 nt, Staphylococcus aureus subsp. aureus Mu50
cccccaacacaa

SEQ ID NO: 3981647 - RNA, 16 nt, Staphylococcus aureus subsp. aureus Mu50
cccccgccacuaugug

SEQ ID NO: 3981648 - RNA, 14 nt, Staphylococcus aureus subsp. aureus Mu50
ccccuagcaaaaau

SEQ ID NO: 3981649 - RNA, 21 nt, Staphylococcus aureus subsp. aureus Mu50
ccccuagcaaaaauacuuuuu

SEQ ID NO: 3981650 - RNA, 20 nt, Staphylococcus aureus subsp. aureus Mu50
cccgagacauaaauuaauau

SEQ ID NO: 3981651 - RNA, 18 nt, Staphylococcus aureus subsp. aureus Mu50
cccguaauaauuuacagg

SEQ ID NO: 3981652 - RNA, 17 nt, Staphylococcus aureus subsp. aureus Mu50
cccguuuuuugguucua

SEQ ID NO: 3981653 - RNA, 15 nt, Staphylococcus aureus subsp. aureus Mu50
cccuaaagcuaaugc

SEQ ID NO: 3981654 - RNA, 21 nt, Staphylococcus aureus subsp. aureus Mu50
cccuacugcaccgauaucaua

SEQ ID NO: 3981655 - RNA, 23 nt, Staphylococcus aureus subsp. aureus Mu50
cccuagcaaaaauacuuuuugau

SEQ ID NO: 3981656 - RNA, 16 nt, Staphylococcus aureus subsp. aureus Mu50
cccuaugaaauaacua

SEQ ID NO: 3981657 - RNA, 15 nt, Staphylococcus aureus subsp. aureus Mu50
cccugcuuaucauua

SEQ ID NO: 3981658 - RNA, 14 nt, Staphylococcus aureus subsp. aureus Mu50
cccuggaaaaugau

SEQ ID NO: 3981659 - RNA, 13 nt, Staphylococcus aureus subsp. aureus Mu50
cccuguaaaacca

SEQ ID NO: 3981660 - RNA, 14 nt, Staphylococcus aureus subsp. aureus Mu50
cccuuuagucaugu

SEQ ID NO: 3981661 - RNA, 19 nt, Staphylococcus aureus subsp. aureus Mu50
cccuuuuugucucucaaca

SEQ ID NO: 3981662 - RNA, 20 nt, Staphylococcus aureus subsp. aureus Mu50
ccgaaaauugcuaaaaaaau

SEQ ID NO: 3981663 - RNA, 21 nt, Staphylococcus aureus subsp. aureus Mu50
ccgaaaauugcuaaaaaaauu

SEQ ID NO: 3981664 - RNA, 19 nt, Staphylococcus aureus subsp. aureus Mu50
ccgaacaucugaaaaaauu

SEQ ID NO: 3981665 - RNA, 15 nt, Staphylococcus aureus subsp. aureus Mu50
ccgaagcgcagugac

SEQ ID NO: 3981666 - RNA, 20 nt, Staphylococcus aureus subsp. aureus Mu50
ccgaauucuccguuaauuua

SEQ ID NO: 3981667 - RNA, 20 nt, Staphylococcus aureus subsp. aureus Mu50
ccgacuugauaaaaaaugaa

SEQ ID NO: 3981668 - RNA, 21 nt, Staphylococcus aureus subsp. aureus Mu50
ccgacuuuugauuuugaauaa

SEQ ID NO: 3981669 - RNA, 16 nt, Staphylococcus aureus subsp. aureus Mu50
ccgaggcuaauuuuaa

SEQ ID NO: 3981670 - RNA, 20 nt, Staphylococcus aureus subsp. aureus Mu50
ccgaggcuaauuuuaauuuu

SEQ ID NO: 3981671 - RNA, 15 nt, Staphylococcus aureus subsp. aureus Mu50
ccgauaucauauaau

SEQ ID NO: 3981672 - RNA, 16 nt, Staphylococcus aureus subsp. aureus Mu50
ccgaugaauggauuuu

SEQ ID NO: 3981673 - RNA, 22 nt, Staphylococcus aureus subsp. aureus Mu50
ccgauuguuaauuuaaagucuu

SEQ ID NO: 3981674 - RNA, 20 nt, Staphylococcus aureus subsp. aureus Mu50
ccgauuuauuuauaaaauaa

SEQ ID NO: 3981675 - RNA, 23 nt, Staphylococcus aureus subsp. aureus Mu50
ccgauuuauuuauaaaauaaaau

SEQ ID NO: 3981676 - RNA, 18 nt, Staphylococcus aureus subsp. aureus Mu50
ccgauuuugauauaaaaa

SEQ ID NO: 3981677 - RNA, 23 nt, Staphylococcus aureus subsp. aureus Mu50
ccgauuuuuuuacguaaucuaau

SEQ ID NO: 3981678 - RNA, 15 nt, Staphylococcus aureus subsp. aureus Mu50
ccgcaaauauuaaau

SEQ ID NO: 3981679 - RNA, 15 nt, Staphylococcus aureus subsp. aureus Mu50
ccgcacuucuauauu

SEQ ID NO: 3981680 - RNA, 19 nt, Staphylococcus aureus subsp. aureus Mu50
ccgcacuucuauauuaaua

SEQ ID NO: 3981681 - RNA, 17 nt, Staphylococcus aureus subsp. aureus Mu50
ccgcauuauuauuaaau

SEQ ID NO: 3981682 - RNA, 19 nt, Staphylococcus aureus subsp. aureus Mu50
ccgccuugauuuuuugaaa

SEQ ID NO: 3981683 - RNA, 12 nt, Staphylococcus aureus subsp. aureus Mu50
ccgcuauaaaau

SEQ ID NO: 3981684 - RNA, 23 nt, Staphylococcus aureus subsp. aureus Mu50
ccgcuucuuuuaaguuaucaaau

SEQ ID NO: 3981685 - RNA, 13 nt, Staphylococcus aureus subsp. aureus Mu50
ccggaaauuaaau

SEQ ID NO: 3981686 - RNA, 16 nt, Staphylococcus aureus subsp. aureus Mu50
ccggaacauuaaaagg

SEQ ID NO: 3981687 - RNA, 21 nt, Staphylococcus aureus subsp. aureus Mu50
ccgguuaaauuauuuaauuuu

SEQ ID NO: 3981688 - RNA, 22 nt, Staphylococcus aureus subsp. aureus Mu50
ccguaaaaucagucauucacau

SEQ ID NO: 3981689 - RNA, 17 nt, Staphylococcus aureus subsp. aureus Mu50
ccguauccuguguaaaa

SEQ ID NO: 3981690 - RNA, 13 nt, Staphylococcus aureus subsp. aureus Mu50
ccguauuucaaau

SEQ ID NO: 3981691 - RNA, 16 nt, Staphylococcus aureus subsp. aureus Mu50
ccguauuuuaauauug

SEQ ID NO: 3981692 - RNA, 18 nt, Staphylococcus aureus subsp. aureus Mu50
ccguauuuuaauauugaa

SEQ ID NO: 3981693 - RNA, 20 nt, Staphylococcus aureus subsp. aureus Mu50
ccgucgaauauaauuuuuug

SEQ ID NO: 3981694 - RNA, 18 nt, Staphylococcus aureus subsp. aureus Mu50
ccgugaggaauaugaauu

SEQ ID NO: 3981695 - RNA, 20 nt, Staphylococcus aureus subsp. aureus Mu50
ccguuaaaauuuuaauuaau

SEQ ID NO: 3981696 - RNA, 14 nt, Staphylococcus aureus subsp. aureus Mu50
ccguuauuuucaau

SEQ ID NO: 3981697 - RNA, 13 nt, Staphylococcus aureus subsp. aureus Mu50
ccguuauuuuuuu

SEQ ID NO: 3981698 - RNA, 21 nt, Staphylococcus aureus subsp. aureus Mu50
ccguuugaagucuguuuagaa

SEQ ID NO: 3981699 - RNA, 23 nt, Staphylococcus aureus subsp. aureus Mu50
ccguuuuaaguacagcauauaau

SEQ ID NO: 3981700 - RNA, 17 nt, Staphylococcus aureus subsp. aureus Mu50
ccguuuuucaucaaucc

SEQ ID NO: 3981701 - RNA, 18 nt, Staphylococcus aureus subsp. aureus Mu50
ccguuuuuuauaaaucau

SEQ ID NO: 3981702 - RNA, 22 nt, Staphylococcus aureus subsp. aureus Mu50
ccguuuuuuauaaaucauucuu

SEQ ID NO: 3981703 - RNA, 17 nt, Staphylococcus aureus subsp. aureus Mu50
ccuaaaaauaaaaucaa

SEQ ID NO: 3981704 - RNA, 21 nt, Staphylococcus aureus subsp. aureus Mu50
ccuaaaauagaaaaauuucaa

SEQ ID NO: 3981705 - RNA, 19 nt, Staphylococcus aureus subsp. aureus Mu50
ccuaaaccucuaaauaaaa

SEQ ID NO: 3981706 - RNA, 15 nt, Staphylococcus aureus subsp. aureus Mu50
ccuaaacgaucaacu

SEQ ID NO: 3981707 - RNA, 18 nt, Staphylococcus aureus subsp. aureus Mu50
ccuaaagcuaaugcaagc

SEQ ID NO: 3981708 - RNA, 19 nt, Staphylococcus aureus subsp. aureus Mu50
ccuguucuuuauuuaaagg

SEQ ID NO: 3981709 - RNA, 16 nt, Staphylococcus aureus subsp. aureus Mu50
ccuuaacuucauaaua

SEQ ID NO: 3981710 - RNA, 15 nt, Staphylococcus aureus subsp. aureus Mu50
ccuuaauaauaagua

SEQ ID NO: 3981711 - RNA, 16 nt, Staphylococcus aureus subsp. aureus Mu50
ccuuaauaauaaguau

SEQ ID NO: 3981712 - RNA, 17 nt, Staphylococcus aureus subsp. aureus Mu50
ccuuaauaucaugcaca

SEQ ID NO: 3981713 - RNA, 18 nt, Staphylococcus aureus subsp. aureus Mu50
ccuuacaauaaagacaua

SEQ ID NO: 3981714 - RNA, 20 nt, Staphylococcus aureus subsp. aureus Mu50
ccuuaucaaaaccgcuauaa

SEQ ID NO: 3981715 - RNA, 20 nt, Staphylococcus aureus subsp. aureus Mu50
ccuuaugucauauacuauau

SEQ ID NO: 3981716 - RNA, 23 nt, Staphylococcus aureus subsp. aureus Mu50
ccuucaaauucucaauuaauuua

SEQ ID NO: 3981717 - RNA, 16 nt, Staphylococcus aureus subsp. aureus Mu50
ccuucaauccaagcaa

SEQ ID NO: 3981718 - RNA, 18 nt, Staphylococcus aureus subsp. aureus Mu50
ccuucaauguucaauuca

SEQ ID NO: 3981719 - RNA, 15 nt, Staphylococcus aureus subsp. aureus Mu50
ccuucaguuucuacu

SEQ ID NO: 3981720 - RNA, 20 nt, Staphylococcus aureus subsp. aureus Mu50
ccuucaguuucuacuguaua

SEQ ID NO: 3981721 - RNA, 15 nt, Staphylococcus aureus subsp. aureus Mu50
ccuucauuagccaaa

SEQ ID NO: 3981722 - RNA, 17 nt, Staphylococcus aureus subsp. aureus Mu50
ccuucauuagccaaauc

SEQ ID NO: 3981723 - RNA, 23 nt, Staphylococcus aureus subsp. aureus Mu50
ccuucgagugcuuuuaaucaaau

SEQ ID NO: 3981724 - RNA, 21 nt, Staphylococcus aureus subsp. aureus Mu50
ccuucuauagcaccauuauua

SEQ ID NO: 3981725 - RNA, 17 nt, Staphylococcus aureus subsp. aureus Mu50
ccuucuauauaguaaaa

SEQ ID NO: 3981726 - RNA, 22 nt, Staphylococcus aureus subsp. aureus Mu50
ccuucuauauaguaaaauaaau

SEQ ID NO: 3981727 - RNA, 17 nt, Staphylococcus aureus subsp. aureus Mu50
ccuucuugagcaucacu

SEQ ID NO: 3981728 - RNA, 21 nt, Staphylococcus aureus subsp. aureus Mu50
ccuugaccuacuuuuucaaua

SEQ ID NO: 3981729 - RNA, 18 nt, Staphylococcus aureus subsp. aureus Mu50
ccuugauuuaauuuuuaa

SEQ ID NO: 3981730 - RNA, 20 nt, Staphylococcus aureus subsp. aureus Mu50
ccuuguucuccgaucaugcc

SEQ ID NO: 3981731 - RNA, 18 nt, Staphylococcus aureus subsp. aureus Mu50
ccuuguuggcuuuuuuaa

SEQ ID NO: 3981732 - RNA, 19 nt, Staphylococcus aureus subsp. aureus Mu50
ccuuguuuuaaacuuauua

SEQ ID NO: 3981733 - RNA, 12 nt, Staphylococcus aureus subsp. aureus Mu50
ccuuuaaaacau

SEQ ID NO: 3981734 - RNA, 18 nt, Staphylococcus aureus subsp. aureus Mu50
ccuuuaaaacaucauuca

SEQ ID NO: 3981735 - RNA, 20 nt, Staphylococcus aureus subsp. aureus Mu50
ccuuuaaaucuacuuuguuc

SEQ ID NO: 3981736 - RNA, 22 nt, Staphylococcus aureus subsp. aureus Mu50
ccuuuaagaagucgaauucacc

SEQ ID NO: 3981737 - RNA, 13 nt, Staphylococcus aureus subsp. aureus Mu50
ccuuuaauaucua

SEQ ID NO: 3981738 - RNA, 15 nt, Staphylococcus aureus subsp. aureus Mu50
ccuuuaauaucuaau

SEQ ID NO: 3981739 - RNA, 19 nt, Staphylococcus aureus subsp. aureus Mu50
ccuuuaauuguuaaaucac

SEQ ID NO: 3981740 - RNA, 20 nt, Staphylococcus aureus subsp. aureus Mu50
ccuuuaauuguuaaaucacc

SEQ ID NO: 3981741 - RNA, 15 nt, Staphylococcus aureus subsp. aureus Mu50
ccuuuaccaguauca

SEQ ID NO: 3981742 - RNA, 20 nt, Staphylococcus aureus subsp. aureus Mu50
ccuuuacgccauucaucauc

SEQ ID NO: 3981743 - RNA, 16 nt, Staphylococcus aureus subsp. aureus Mu50
ccuuuagccaaugcuu

SEQ ID NO: 3981744 - RNA, 22 nt, Staphylococcus aureus subsp. aureus Mu50
ccuuuaguguguuuaaaaggaa

SEQ ID NO: 3981745 - RNA, 19 nt, Staphylococcus aureus subsp. aureus Mu50
ccuuuauauucuaauauuc

SEQ ID NO: 3981746 - RNA, 18 nt, Staphylococcus aureus subsp. aureus Mu50
ccuuuauauuuaguuagc

SEQ ID NO: 3981747 - RNA, 19 nt, Staphylococcus aureus subsp. aureus Mu50
ccuuuaugugcaucauuua

SEQ ID NO: 3981748 - RNA, 13 nt, Staphylococcus aureus subsp. aureus Mu50
ccuuuauuauuua

SEQ ID NO: 3981749 - RNA, 14 nt, Staphylococcus aureus subsp. aureus Mu50
ccuuuauuuuuaug

SEQ ID NO: 3981750 - RNA, 20 nt, Staphylococcus aureus subsp. aureus Mu50
ccuuucauuuuagcaaaagc

SEQ ID NO: 3981751 - RNA, 20 nt, Staphylococcus aureus subsp. aureus Mu50
ccuuuccauucguauaagaa

SEQ ID NO: 3981752 - RNA, 19 nt, Staphylococcus aureus subsp. aureus Mu50
ccuuugccguauuucaaau

SEQ ID NO: 3981753 - RNA, 17 nt, Staphylococcus aureus subsp. aureus Mu50
ccuuugcuuaaaccuua

SEQ ID NO: 3981754 - RNA, 15 nt, Staphylococcus aureus subsp. aureus Mu50
ccuuugguucaauca

SEQ ID NO: 3981755 - RNA, 18 nt, Staphylococcus aureus subsp. aureus Mu50
ccuuuuaauuuaguuaua

SEQ ID NO: 3981756 - RNA, 14 nt, Staphylococcus aureus subsp. aureus Mu50
ccuuuugaauaauu

SEQ ID NO: 3981757 - RNA, 19 nt, Staphylococcus aureus subsp. aureus Mu50
ccuuuuuauuaucuuuaau

SEQ ID NO: 3981758 - RNA, 12 nt, Staphylococcus aureus subsp. aureus Mu50
ccuuuuucuaaa

SEQ ID NO: 3981759 - RNA, 11 nt, Staphylococcus aureus subsp. aureus Mu50
ccuuuuuucuc

SEQ ID NO: 3981760 - RNA, 19 nt, Staphylococcus aureus subsp. aureus Mu50
ccuuuuuuuaagguucuuu

SEQ ID NO: 3981761 - RNA, 23 nt, Staphylococcus aureus subsp. aureus Mu50
cgaaaaccucuguuuuguuggug

SEQ ID NO: 3981762 - RNA, 10 nt, Staphylococcus aureus subsp. aureus Mu50
cgaaaagaaa

SEQ ID NO: 3981763 - RNA, 23 nt, Staphylococcus aureus subsp. aureus Mu50
cgaaaagaaauucuacagguaau

SEQ ID NO: 3981764 - RNA, 14 nt, Staphylococcus aureus subsp. aureus Mu50
cgaaaauaaaacaa

SEQ ID NO: 3981765 - RNA, 22 nt, Staphylococcus aureus subsp. aureus Mu50
cgaaaauagcuauuaaaauaga

SEQ ID NO: 3981766 - RNA, 13 nt, Staphylococcus aureus subsp. aureus Mu50
cgaaaauaucauu

SEQ ID NO: 3981767 - RNA, 23 nt, Staphylococcus aureus subsp. aureus Mu50
cgaaaauucgcuuguaacaagcu

SEQ ID NO: 3981768 - RNA, 18 nt, Staphylococcus aureus subsp. aureus Mu50
cgaaaauugcuaaaaaaa

SEQ ID NO: 3981769 - RNA, 20 nt, Staphylococcus aureus subsp. aureus Mu50
cgaaaauugcuaaaaaaauu

SEQ ID NO: 3981770 - RNA, 23 nt, Staphylococcus aureus subsp. aureus Mu50
cgaaaauuucaggcguuaauaca

SEQ ID NO: 3981771 - RNA, 21 nt, Staphylococcus aureus subsp. aureus Mu50
cgaaagaugauauauucaucu

SEQ ID NO: 3981772 - RNA, 23 nt, Staphylococcus aureus subsp. aureus Mu50
cgaaagguauaucuucauuuaaa

SEQ ID NO: 3981773 - RNA, 17 nt, Staphylococcus aureus subsp. aureus Mu50
cgaaaguagaauuauuu

SEQ ID NO: 3981774 - RNA, 15 nt, Staphylococcus aureus subsp. aureus Mu50
cgaaaguaucuauga

SEQ ID NO: 3981775 - RNA, 17 nt, Staphylococcus aureus subsp. aureus Mu50
cgaaaguuagacuaaaa

SEQ ID NO: 3981776 - RNA, 19 nt, Staphylococcus aureus subsp. aureus Mu50
cgaaauaguucaaaauacu

SEQ ID NO: 3981777 - RNA, 20 nt, Staphylococcus aureus subsp. aureus Mu50
cgaaauuacuguuaggauaa

SEQ ID NO: 3981778 - RNA, 13 nt, Staphylococcus aureus subsp. aureus Mu50
cgaaauucucuuu

SEQ ID NO: 3981779 - RNA, 13 nt, Staphylococcus aureus subsp. aureus Mu50
cgaacaaaugaaa

SEQ ID NO: 3981780 - RNA, 23 nt, Staphylococcus aureus subsp. aureus Mu50
cgaacaaucggaagcauauuucu

SEQ ID NO: 3981781 - RNA, 19 nt, Staphylococcus aureus subsp. aureus Mu50
cgaacaucuaauacauuau

SEQ ID NO: 3981782 - RNA, 22 nt, Staphylococcus aureus subsp. aureus Mu50
cgaacaucugaaaaaauuaaua

SEQ ID NO: 3981783 - RNA, 14 nt, Staphylococcus aureus subsp. aureus Mu50
cgaacaugaaugau

SEQ ID NO: 3981784 - RNA, 16 nt, Staphylococcus aureus subsp. aureus Mu50
cgaacaugaaugauau

SEQ ID NO: 3981785 - RNA, 12 nt, Staphylococcus aureus subsp. aureus Mu50
cgaaccgacacu

SEQ ID NO: 3981786 - RNA, 15 nt, Staphylococcus aureus subsp. aureus Mu50
cgaacuaucaauaua

SEQ ID NO: 3981787 - RNA, 23 nt, Staphylococcus aureus subsp. aureus Mu50
cgaagggcggucaauuuuaccau

SEQ ID NO: 3981788 - RNA, 21 nt, Staphylococcus aureus subsp. aureus Mu50
cgaagucagucaauucaaacu

SEQ ID NO: 3981789 - RNA, 12 nt, Staphylococcus aureus subsp. aureus Mu50
cgaaguuuaaau

SEQ ID NO: 3981790 - RNA, 20 nt, Staphylococcus aureus subsp. aureus Mu50
cgaauaacguuggaaacuuc

SEQ ID NO: 3981791 - RNA, 22 nt, Staphylococcus aureus subsp. aureus Mu50
cgaauaacuguuuaucaugaug

SEQ ID NO: 3981792 - RNA, 15 nt, Staphylococcus aureus subsp. aureus Mu50
cgaauaccaagacca

SEQ ID NO: 3981793 - RNA, 14 nt, Staphylococcus aureus subsp. aureus Mu50
cgaauuaaaauaac

SEQ ID NO: 3981794 - RNA, 15 nt, Staphylococcus aureus subsp. aureus Mu50
cgaauuaaaauaacu

SEQ ID NO: 3981795 - RNA, 19 nt, Staphylococcus aureus subsp. aureus Mu50
cgcaaguagucuacaguaa

SEQ ID NO: 3981796 - RNA, 18 nt, Staphylococcus aureus subsp. aureus Mu50
cgcaauacgaauaucugu

SEQ ID NO: 3981797 - RNA, 21 nt, Staphylococcus aureus subsp. aureus Mu50
cgcaaucauuagcgaaaaccu

SEQ ID NO: 3981798 - RNA, 14 nt, Staphylococcus aureus subsp. aureus Mu50
cgcaaugaaaacag

SEQ ID NO: 3981799 - RNA, 15 nt, Staphylococcus aureus subsp. aureus Mu50
cgcaaugauuauaaa

SEQ ID NO: 3981800 - RNA, 20 nt, Staphylococcus aureus subsp. aureus Mu50
cgcaaugauuauaaauacau

SEQ ID NO: 3981801 - RNA, 22 nt, Staphylococcus aureus subsp. aureus Mu50
cgcaauuuggugaaguaugaua

SEQ ID NO: 3981802 - RNA, 18 nt, Staphylococcus aureus subsp. aureus Mu50
cgcacaucuaagugauau

SEQ ID NO: 3981803 - RNA, 17 nt, Staphylococcus aureus subsp. aureus Mu50
cgcacuucuauauuaau

SEQ ID NO: 3981804 - RNA, 20 nt, Staphylococcus aureus subsp. aureus Mu50
cgcauaacgagcaguauaua

SEQ ID NO: 3981805 - RNA, 13 nt, Staphylococcus aureus subsp. aureus Mu50
cgcauacaggaaa

SEQ ID NO: 3981806 - RNA, 11 nt, Staphylococcus aureus subsp. aureus Mu50
cgcauacuuuu

SEQ ID NO: 3981807 - RNA, 15 nt, Staphylococcus aureus subsp. aureus Mu50
cgcaucaaaaaugag

SEQ ID NO: 3981808 - RNA, 13 nt, Staphylococcus aureus subsp. aureus Mu50
cgcaucauguaua

SEQ ID NO: 3981809 - RNA, 16 nt, Staphylococcus aureus subsp. aureus Mu50
cgccaacuaauguuaa

SEQ ID NO: 3981810 - RNA, 22 nt, Staphylococcus aureus subsp. aureus Mu50
cgccaauacagaacuuuaauaa

SEQ ID NO: 3981811 - RNA, 23 nt, Staphylococcus aureus subsp. aureus Mu50
cgccaauacagaacuuuaauaau

SEQ ID NO: 3981812 - RNA, 12 nt, Staphylococcus aureus subsp. aureus Mu50
cgccauaaucau

SEQ ID NO: 3981813 - RNA, 18 nt, Staphylococcus aureus subsp. aureus Mu50
cgccauaaucuucauuaa

SEQ ID NO: 3981814 - RNA, 13 nt, Staphylococcus aureus subsp. aureus Mu50
cgcgucugauucu

SEQ ID NO: 3981815 - RNA, 17 nt, Staphylococcus aureus subsp. aureus Mu50
cgcgucugauucucuaa

SEQ ID NO: 3981816 - RNA, 14 nt, Staphylococcus aureus subsp. aureus Mu50
cgcuaaauuuauau

SEQ ID NO: 3981817 - RNA, 19 nt, Staphylococcus aureus subsp. aureus Mu50
cgcuaauuuuacucuguau

SEQ ID NO: 3981818 - RNA, 18 nt, Staphylococcus aureus subsp. aureus Mu50
cgcuacaauuauaaauga

SEQ ID NO: 3981819 - RNA, 16 nt, Staphylococcus aureus subsp. aureus Mu50
cgcuccaagauuauga

SEQ ID NO: 3981820 - RNA, 13 nt, Staphylococcus aureus subsp. aureus Mu50
cgcucucuuuuua

SEQ ID NO: 3981821 - RNA, 16 nt, Staphylococcus aureus subsp. aureus Mu50
cgcucuggauuuuucu

SEQ ID NO: 3981822 - RNA, 14 nt, Staphylococcus aureus subsp. aureus Mu50
cgcugcuacaccac

SEQ ID NO: 3981823 - RNA, 18 nt, Staphylococcus aureus subsp. aureus Mu50
cgcugguaauauuuuugu

SEQ ID NO: 3981824 - RNA, 22 nt, Staphylococcus aureus subsp. aureus Mu50
cgcuguaauaccuuuacuuuca

SEQ ID NO: 3981825 - RNA, 19 nt, Staphylococcus aureus subsp. aureus Mu50
cgcuguggcucgaaaauaa

SEQ ID NO: 3981826 - RNA, 13 nt, Staphylococcus aureus subsp. aureus Mu50
cgcuguuuuaaau

SEQ ID NO: 3981827 - RNA, 11 nt, Staphylococcus aureus subsp. aureus Mu50
cgcuuaauucu

SEQ ID NO: 3981828 - RNA, 14 nt, Staphylococcus aureus subsp. aureus Mu50
cgcuuaauucuuca

SEQ ID NO: 3981829 - RNA, 15 nt, Staphylococcus aureus subsp. aureus Mu50
cgcuuagauaaauua

SEQ ID NO: 3981830 - RNA, 21 nt, Staphylococcus aureus subsp. aureus Mu50
cgcuuagauaaauuaauauga

SEQ ID NO: 3981831 - RNA, 14 nt, Staphylococcus aureus subsp. aureus Mu50
cgcuucaauuauuu

SEQ ID NO: 3981832 - RNA, 20 nt, Staphylococcus aureus subsp. aureus Mu50
cgcuucauagucacuuuuaa

SEQ ID NO: 3981833 - RNA, 21 nt, Staphylococcus aureus subsp. aureus Mu50
cgcuucauugaugaugugcua

SEQ ID NO: 3981834 - RNA, 15 nt, Staphylococcus aureus subsp. aureus Mu50
cgcuuccaauuuaaa

SEQ ID NO: 3981835 - RNA, 20 nt, Staphylococcus aureus subsp. aureus Mu50
cgcuucuucuucagaaauac

SEQ ID NO: 3981836 - RNA, 16 nt, Staphylococcus aureus subsp. aureus Mu50
cgcuugggcugacauu

SEQ ID NO: 3981837 - RNA, 15 nt, Staphylococcus aureus subsp. aureus Mu50
cgcuuuauuacuuua

SEQ ID NO: 3981838 - RNA, 12 nt, Staphylococcus aureus subsp. aureus Mu50
cgcuuuuuaaaa

SEQ ID NO: 3981839 - RNA, 20 nt, Staphylococcus aureus subsp. aureus Mu50
cgcuuuuuaaaaaauuuaaa

SEQ ID NO: 3981840 - RNA, 23 nt, Staphylococcus aureus subsp. aureus Mu50
cgcuuuuuuuauuuuucuuuuug

SEQ ID NO: 3981841 - RNA, 17 nt, Staphylococcus aureus subsp. aureus Mu50
cggaaaaagaugaaaaa

SEQ ID NO: 3981842 - RNA, 14 nt, Staphylococcus aureus subsp. aureus Mu50
cggaacuaauuuag

SEQ ID NO: 3981843 - RNA, 15 nt, Staphylococcus aureus subsp. aureus Mu50
cggaagauaggauuu

SEQ ID NO: 3981844 - RNA, 14 nt, Staphylococcus aureus subsp. aureus Mu50
cggaauaaaauaaa

SEQ ID NO: 3981845 - RNA, 15 nt, Staphylococcus aureus subsp. aureus Mu50
cggaauaacuuuuua

SEQ ID NO: 3981846 - RNA, 22 nt, Staphylococcus aureus subsp. aureus Mu50
cggaauugguuuuuagugaaaa

SEQ ID NO: 3981847 - RNA, 19 nt, Staphylococcus aureus subsp. aureus Mu50
cggacaaguugcacauuau

SEQ ID NO: 3981848 - RNA, 17 nt, Staphylococcus aureus subsp. aureus Mu50
cggaccuuguaaauuua

SEQ ID NO: 3981849 - RNA, 13 nt, Staphylococcus aureus subsp. aureus Mu50
cggaugagaaaug

SEQ ID NO: 3981850 - RNA, 14 nt, Staphylococcus aureus subsp. aureus Mu50
cggcacauucauac

SEQ ID NO: 3981851 - RNA, 14 nt, Staphylococcus aureus subsp. aureus Mu50
cggcauuuuuauau

SEQ ID NO: 3981852 - RNA, 18 nt, Staphylococcus aureus subsp. aureus Mu50
cggcauuuuuauauugau

SEQ ID NO: 3981853 - RNA, 21 nt, Staphylococcus aureus subsp. aureus Mu50
cggcucuuuuuguuuaucuga

SEQ ID NO: 3981854 - RNA, 13 nt, Staphylococcus aureus subsp. aureus Mu50
cggcuuuggauuu

SEQ ID NO: 3981855 - RNA, 13 nt, Staphylococcus aureus subsp. aureus Mu50
cggcuuuguaaaa

SEQ ID NO: 3981856 - RNA, 15 nt, Staphylococcus aureus subsp. aureus Mu50
cgggaacaucauaau

SEQ ID NO: 3981857 - RNA, 10 nt, Staphylococcus aureus subsp. aureus Mu50
cgggaaggaa

SEQ ID NO: 3981858 - RNA, 16 nt, Staphylococcus aureus subsp. aureus Mu50
cgggcccccaacacaa

SEQ ID NO: 3981859 - RNA, 20 nt, Staphylococcus aureus subsp. aureus Mu50
cgguaaccauuuuuuuaucu

SEQ ID NO: 3981860 - RNA, 17 nt, Staphylococcus aureus subsp. aureus Mu50
cgguaauuacuuguaau

SEQ ID NO: 3981861 - RNA, 22 nt, Staphylococcus aureus subsp. aureus Mu50
cgguacagauaggaaacuuaaa

SEQ ID NO: 3981862 - RNA, 18 nt, Staphylococcus aureus subsp. aureus Mu50
cgguaggaccucuuauuu

SEQ ID NO: 3981863 - RNA, 15 nt, Staphylococcus aureus subsp. aureus Mu50
cgguauuuaauguuu

SEQ ID NO: 3981864 - RNA, 14 nt, Staphylococcus aureus subsp. aureus Mu50
cgguauuuucaaaa

SEQ ID NO: 3981865 - RNA, 15 nt, Staphylococcus aureus subsp. aureus Mu50
cgguauuuucauuuu

SEQ ID NO: 3981866 - RNA, 16 nt, Staphylococcus aureus subsp. aureus Mu50
cggucucaacuugccu

SEQ ID NO: 3981867 - RNA, 16 nt, Staphylococcus aureus subsp. aureus Mu50
cggugcuugccuuuuu

SEQ ID NO: 3981868 - RNA, 18 nt, Staphylococcus aureus subsp. aureus Mu50
cggugucaauauuguagg

SEQ ID NO: 3981869 - RNA, 14 nt, Staphylococcus aureus subsp. aureus Mu50
cgguucaucuaaaa

SEQ ID NO: 3981870 - RNA, 17 nt, Staphylococcus aureus subsp. aureus Mu50
cgguucaucuaaaauga

SEQ ID NO: 3981871 - RNA, 16 nt, Staphylococcus aureus subsp. aureus Mu50
cgguuuauuuaauaac

SEQ ID NO: 3981872 - RNA, 15 nt, Staphylococcus aureus subsp. aureus Mu50
cgguuugaaaaugac

SEQ ID NO: 3981873 - RNA, 16 nt, Staphylococcus aureus subsp. aureus Mu50
cgguuugaaaaugacg

SEQ ID NO: 3981874 - RNA, 20 nt, Staphylococcus aureus subsp. aureus Mu50
cguaaaaucagucauucaca

SEQ ID NO: 3981875 - RNA, 12 nt, Staphylococcus aureus subsp. aureus Mu50
cguaaaaucaug

SEQ ID NO: 3981876 - RNA, 13 nt, Staphylococcus aureus subsp. aureus Mu50
cguaaacaacauc

SEQ ID NO: 3981877 - RNA, 18 nt, Staphylococcus aureus subsp. aureus Mu50
cguaaacauaaugacauc

SEQ ID NO: 3981878 - RNA, 10 nt, Staphylococcus aureus subsp. aureus Mu50
cguaaaguuu

SEQ ID NO: 3981879 - RNA, 22 nt, Staphylococcus aureus subsp. aureus Mu50
cguaacauauguacuauuaucu

SEQ ID NO: 3981880 - RNA, 14 nt, Staphylococcus aureus subsp. aureus Mu50
cguaacuauaugaa

SEQ ID NO: 3981881 - RNA, 15 nt, Staphylococcus aureus subsp. aureus Mu50
cguaacuauaugaaa

SEQ ID NO: 3981882 - RNA, 17 nt, Staphylococcus aureus subsp. aureus Mu50
cguaagcaguuaauaag

SEQ ID NO: 3981883 - RNA, 22 nt, Staphylococcus aureus subsp. aureus Mu50
cuaaaaguuguaauuuaaaaua

SEQ ID NO: 3981884 - RNA, 17 nt, Staphylococcus aureus subsp. aureus Mu50
cuaaaaguuucccaagc

SEQ ID NO: 3981885 - RNA, 13 nt, Staphylococcus aureus subsp. aureus Mu50
cuaaaauaaaauu

SEQ ID NO: 3981886 - RNA, 19 nt, Staphylococcus aureus subsp. aureus Mu50
cuaaaauagaaaaauuuca

SEQ ID NO: 3981887 - RNA, 15 nt, Staphylococcus aureus subsp. aureus Mu50
cuaaaauaucaaaau

SEQ ID NO: 3981888 - RNA, 23 nt, Staphylococcus aureus subsp. aureus Mu50
cuaaaauaucaaaauauaaaauc

SEQ ID NO: 3981889 - RNA, 15 nt, Staphylococcus aureus subsp. aureus Mu50
cuaaaaugucuuuga

SEQ ID NO: 3981890 - RNA, 19 nt, Staphylococcus aureus subsp. aureus Mu50
cuaaaaugucuuugaaaaa

SEQ ID NO: 3981891 - RNA, 16 nt, Staphylococcus aureus subsp. aureus Mu50
cuaaaauucuuucagc

SEQ ID NO: 3981892 - RNA, 14 nt, Staphylococcus aureus subsp. aureus Mu50
cuaaaauuuccuca

SEQ ID NO: 3981893 - RNA, 19 nt, Staphylococcus aureus subsp. aureus Mu50
cuaaacauugcuuaacuuc

SEQ ID NO: 3981894 - RNA, 13 nt, Staphylococcus aureus subsp. aureus Mu50
cuaaacauuuuau

SEQ ID NO: 3981895 - RNA, 17 nt, Staphylococcus aureus subsp. aureus Mu50
cuaaacauuuuauacuc

SEQ ID NO: 3981896 - RNA, 19 nt, Staphylococcus aureus subsp. aureus Mu50
cuaaacauuuuauacucug

SEQ ID NO: 3981897 - RNA, 21 nt, Staphylococcus aureus subsp. aureus Mu50
cuaaaccaucugugucagcau

SEQ ID NO: 3981898 - RNA, 19 nt, Staphylococcus aureus subsp. aureus Mu50
cuaaaccgauuaauauaau

SEQ ID NO: 3981899 - RNA, 18 nt, Staphylococcus aureus subsp. aureus Mu50
cuaaaccucuaaauaaaa

SEQ ID NO: 3981900 - RNA, 17 nt, Staphylococcus aureus subsp. aureus Mu50
cuaaacgauaaauuaac

SEQ ID NO: 3981901 - RNA, 19 nt, Staphylococcus aureus subsp. aureus Mu50
cuaaacuauaauaauugga

SEQ ID NO: 3981902 - RNA, 16 nt, Staphylococcus aureus subsp. aureus Mu50
cuaaacuuuucuucaa

SEQ ID NO: 3981903 - RNA, 21 nt, Staphylococcus aureus subsp. aureus Mu50
cuaaagcgauuuccaucauuu

SEQ ID NO: 3981904 - RNA, 17 nt, Staphylococcus aureus subsp. aureus Mu50
cuaaagcuauaaaaaau

SEQ ID NO: 3981905 - RNA, 21 nt, Staphylococcus aureus subsp. aureus Mu50
cuaaagcuugcuguucaacau

SEQ ID NO: 3981906 - RNA, 23 nt, Staphylococcus aureus subsp. aureus Mu50
cuaaagcuugcuguucaacaucu

SEQ ID NO: 3981907 - RNA, 18 nt, Staphylococcus aureus subsp. aureus Mu50
cuaaagcuuuaucgaauu

SEQ ID NO: 3981908 - RNA, 19 nt, Staphylococcus aureus subsp. aureus Mu50
cuaaagguauucuauuuuu

SEQ ID NO: 3981909 - RNA, 13 nt, Staphylococcus aureus subsp. aureus Mu50
cuaaaguaaauaa

SEQ ID NO: 3981910 - RNA, 17 nt, Staphylococcus aureus subsp. aureus Mu50
cuaaaguuauaaauuau

SEQ ID NO: 3981911 - RNA, 16 nt, Staphylococcus aureus subsp. aureus Mu50
cuaaauaaaauuaaaa

SEQ ID NO: 3981912 - RNA, 13 nt, Staphylococcus aureus subsp. aureus Mu50
cuaaaucuuuaaa

SEQ ID NO: 3981913 - RNA, 21 nt, Staphylococcus aureus subsp. aureus Mu50
cuaaaugauggguaguuaaua

SEQ ID NO: 3981914 - RNA, 10 nt, Staphylococcus aureus subsp. aureus Mu50
cuaaaugauu

SEQ ID NO: 3981915 - RNA, 17 nt, Staphylococcus aureus subsp. aureus Mu50
cuaaaugauuuauucua

SEQ ID NO: 3981916 - RNA, 23 nt, Staphylococcus aureus subsp. aureus Mu50
cuaaaugauuuauucuaaauaua

SEQ ID NO: 3981917 - RNA, 21 nt, Staphylococcus aureus subsp. aureus Mu50
cuaaaugcacgagcaacaucu

SEQ ID NO: 3981918 - RNA, 22 nt, Staphylococcus aureus subsp. aureus Mu50
cuaaauuauuuauucauuauag

SEQ ID NO: 3981919 - RNA, 14 nt, Staphylococcus aureus subsp. aureus Mu50
cuaaauucaauaau

SEQ ID NO: 3981920 - RNA, 14 nt, Staphylococcus aureus subsp. aureus Mu50
cuaaauucuuuuug

SEQ ID NO: 3981921 - RNA, 14 nt, Staphylococcus aureus subsp. aureus Mu50
cuaaauuuacgaaa

SEQ ID NO: 3981922 - RNA, 15 nt, Staphylococcus aureus subsp. aureus Mu50
cuaaauuuacgaaag

SEQ ID NO: 3981923 - RNA, 16 nt, Staphylococcus aureus subsp. aureus Mu50
cuaacagcuuaauuuu

SEQ ID NO: 3981924 - RNA, 18 nt, Staphylococcus aureus subsp. aureus Mu50
cuaacagcuuaauuuuau

SEQ ID NO: 3981925 - RNA, 13 nt, Staphylococcus aureus subsp. aureus Mu50
cuaacauugguac

SEQ ID NO: 3981926 - RNA, 23 nt, Staphylococcus aureus subsp. aureus Mu50
cuaacauugguaccuuuuuauua

SEQ ID NO: 3981927 - RNA, 12 nt, Staphylococcus aureus subsp. aureus Mu50
cuaaccaaauaa

SEQ ID NO: 3981928 - RNA, 14 nt, Staphylococcus aureus subsp. aureus Mu50
cuaaccaaauaauu

SEQ ID NO: 3981929 - RNA, 15 nt, Staphylococcus aureus subsp. aureus Mu50
cuaaccacuucuuca

SEQ ID NO: 3981930 - RNA, 17 nt, Staphylococcus aureus subsp. aureus Mu50
cuaaccaucauaaaugu

SEQ ID NO: 3981931 - RNA, 19 nt, Staphylococcus aureus subsp. aureus Mu50
cuaaccaucauaaauguua

SEQ ID NO: 3981932 - RNA, 19 nt, Staphylococcus aureus subsp. aureus Mu50
cuaacggcguuuguuucuu

SEQ ID NO: 3981933 - RNA, 22 nt, Staphylococcus aureus subsp. aureus Mu50
cuaacguuuuaaagguuaaaua

SEQ ID NO: 3981934 - RNA, 17 nt, Staphylococcus aureus subsp. aureus Mu50
cuaacuaaguauagugu

SEQ ID NO: 3981935 - RNA, 18 nt, Staphylococcus aureus subsp. aureus Mu50
cuaacuaaguauaguguu

SEQ ID NO: 3981936 - RNA, 12 nt, Staphylococcus aureus subsp. aureus Mu50
cuaacuauauug

SEQ ID NO: 3981937 - RNA, 14 nt, Staphylococcus aureus subsp. aureus Mu50
cuaacuauauugug

SEQ ID NO: 3981938 - RNA, 15 nt, Staphylococcus aureus subsp. aureus Mu50
cuaacucgaagucag

SEQ ID NO: 3981939 - RNA, 15 nt, Staphylococcus aureus subsp. aureus Mu50
cuaacugugcaacaa

SEQ ID NO: 3981940 - RNA, 19 nt, Staphylococcus aureus subsp. aureus Mu50
cuaacuuuagggugcuuuu

SEQ ID NO: 3981941 - RNA, 16 nt, Staphylococcus aureus subsp. aureus Mu50
cuaagaauguaaugag

SEQ ID NO: 3981942 - RNA, 18 nt, Staphylococcus aureus subsp. aureus Mu50
cuaagagguauacaguua

SEQ ID NO: 3981943 - RNA, 17 nt, Staphylococcus aureus subsp. aureus Mu50
cuaagauacuuuuaaau

SEQ ID NO: 3981944 - RNA, 12 nt, Staphylococcus aureus subsp. aureus Mu50
cuaagauuaaug

SEQ ID NO: 3981945 - RNA, 12 nt, Staphylococcus aureus subsp. aureus Mu50
cuaagcagucug

SEQ ID NO: 3981946 - RNA, 17 nt, Staphylococcus aureus subsp. aureus Mu50
cuaagcaucguaaaaaa

SEQ ID NO: 3981947 - RNA, 21 nt, Staphylococcus aureus subsp. aureus Mu50
cuaagcaucguaaaaaacaaa

SEQ ID NO: 3981948 - RNA, 15 nt, Staphylococcus aureus subsp. aureus Mu50
cuaagcgcucauaaa

SEQ ID NO: 3981949 - RNA, 20 nt, Staphylococcus aureus subsp. aureus Mu50
cuaagcugauuaaaauguua

SEQ ID NO: 3981950 - RNA, 16 nt, Staphylococcus aureus subsp. aureus Mu50
cuaaggacuuuaugcc

SEQ ID NO: 3981951 - RNA, 14 nt, Staphylococcus aureus subsp. aureus Mu50
cuaaggcuaaugau

SEQ ID NO: 3981952 - RNA, 15 nt, Staphylococcus aureus subsp. aureus Mu50
cuaaggcuaaugaua

SEQ ID NO: 3981953 - RNA, 22 nt, Staphylococcus aureus subsp. aureus Mu50
cuaagguaagaccccgaaaaga

SEQ ID NO: 3981954 - RNA, 14 nt, Staphylococcus aureus subsp. aureus Mu50
cuaagguuguucua

SEQ ID NO: 3981955 - RNA, 18 nt, Staphylococcus aureus subsp. aureus Mu50
cuaagguuguucuauaca

SEQ ID NO: 3981956 - RNA, 19 nt, Staphylococcus aureus subsp. aureus Mu50
cuaagucuuuuaaaugaug

SEQ ID NO: 3981957 - RNA, 13 nt, Staphylococcus aureus subsp. aureus Mu50
cuaagugguugaa

SEQ ID NO: 3981958 - RNA, 13 nt, Staphylococcus aureus subsp. aureus Mu50
cuaaguguuuuau

SEQ ID NO: 3981959 - RNA, 15 nt, Staphylococcus aureus subsp. aureus Mu50
cuaaguguuuuauag

SEQ ID NO: 3981960 - RNA, 15 nt, Staphylococcus aureus subsp. aureus Mu50
cuaaguuaauuuauc

SEQ ID NO: 3981961 - RNA, 15 nt, Staphylococcus aureus subsp. aureus Mu50
cuaaguuaugacuaa

SEQ ID NO: 3981962 - RNA, 12 nt, Staphylococcus aureus subsp. aureus Mu50
cuaauaauuguc

SEQ ID NO: 3981963 - RNA, 19 nt, Staphylococcus aureus subsp. aureus Mu50
cuaauaauuuguaauuccu

SEQ ID NO: 3981964 - RNA, 23 nt, Staphylococcus aureus subsp. aureus Mu50
cuaauacacuugauaaaacuaau

SEQ ID NO: 3981965 - RNA, 22 nt, Staphylococcus aureus subsp. aureus Mu50
cuaauacauacggcaaauucaa

SEQ ID NO: 3981966 - RNA, 16 nt, Staphylococcus aureus subsp. aureus Mu50
cuaauaccauugugau

SEQ ID NO: 3981967 - RNA, 16 nt, Staphylococcus aureus subsp. aureus Mu50
cuaauacuuucacuuu

SEQ ID NO: 3981968 - RNA, 22 nt, Staphylococcus aureus subsp. aureus Mu50
cuaauacuuucacuuuuuauau

SEQ ID NO: 3981969 - RNA, 15 nt, Staphylococcus aureus subsp. aureus Mu50
cuaauaucaauuuuu

SEQ ID NO: 3981970 - RNA, 13 nt, Staphylococcus aureus subsp. aureus Mu50
cuaauaugucuag

SEQ ID NO: 3981971 - RNA, 20 nt, Staphylococcus aureus subsp. aureus Mu50
cuacgucauacuaucuacaa

SEQ ID NO: 3981972 - RNA, 23 nt, Staphylococcus aureus subsp. aureus Mu50
cuacguguguaguagcaccgauu

SEQ ID NO: 3981973 - RNA, 13 nt, Staphylococcus aureus subsp. aureus Mu50
cuacuauuaaaua

SEQ ID NO: 3981974 - RNA, 15 nt, Staphylococcus aureus subsp. aureus Mu50
cuacuauuaaauaau

SEQ ID NO: 3981975 - RNA, 23 nt, Staphylococcus aureus subsp. aureus Mu50
cuacucccgcaaauauuaaauua

SEQ ID NO: 3981976 - RNA, 14 nt, Staphylococcus aureus subsp. aureus Mu50
cuacugucucaucu

SEQ ID NO: 3981977 - RNA, 18 nt, Staphylococcus aureus subsp. aureus Mu50
cuacugucucaucuucua

SEQ ID NO: 3981978 - RNA, 24 nt, Staphylococcus aureus subsp. aureus Mu50
cuacuuaaauuaagaauaaucgaa

SEQ ID NO: 3981979 - RNA, 19 nt, Staphylococcus aureus subsp. aureus Mu50
cuacuuccuuacagacaaa

SEQ ID NO: 3981980 - RNA, 14 nt, Staphylococcus aureus subsp. aureus Mu50
cuacuugaauaccu

SEQ ID NO: 3981981 - RNA, 21 nt, Staphylococcus aureus subsp. aureus Mu50
cuacuugauucuacuucaccu

SEQ ID NO: 3981982 - RNA, 20 nt, Staphylococcus aureus subsp. aureus Mu50
cuacuuuauaaauaucuuuu

SEQ ID NO: 3981983 - RNA, 19 nt, Staphylococcus aureus subsp. aureus Mu50
cuacuuugauauguuuccu

SEQ ID NO: 3981984 - RNA, 21 nt, Staphylococcus aureus subsp. aureus Mu50
cuacuuugauauguuuccucu

SEQ ID NO: 3981985 - RNA, 18 nt, Staphylococcus aureus subsp. aureus Mu50
cuacuuugucugcaauuu

SEQ ID NO: 3981986 - RNA, 15 nt, Staphylococcus aureus subsp. aureus Mu50
cuacuuuuucaucuu

SEQ ID NO: 3981987 - RNA, 14 nt, Staphylococcus aureus subsp. aureus Mu50
cuagaaaguaaugc

SEQ ID NO: 3981988 - RNA, 17 nt, Staphylococcus aureus subsp. aureus Mu50
cuagaauauaacaacua

SEQ ID NO: 3981989 - RNA, 17 nt, Staphylococcus aureus subsp. aureus Mu50
cuagauaccaaacugcc

SEQ ID NO: 3981990 - RNA, 23 nt, Staphylococcus aureus subsp. aureus Mu50
cuagauucauauuuauauuuaca

SEQ ID NO: 3981991 - RNA, 21 nt, Staphylococcus aureus subsp. aureus Mu50
cuagauuuuaaaucaauacca

SEQ ID NO: 3981992 - RNA, 11 nt, Staphylococcus aureus subsp. aureus Mu50
cuagcaaaaau

SEQ ID NO: 3981993 - RNA, 17 nt, Staphylococcus aureus subsp. aureus Mu50
cuagcaaaaauacuuuu

SEQ ID NO: 3981994 - RNA, 21 nt, Staphylococcus aureus subsp. aureus Mu50
cuagcaaaaauacuuuuugau

SEQ ID NO: 3981995 - RNA, 22 nt, Staphylococcus aureus subsp. aureus Mu50
cuagcaaaaauacuuuuugaug

SEQ ID NO: 3981996 - RNA, 22 nt, Staphylococcus aureus subsp. aureus Mu50
cuagcauguuuugagcaauaau

SEQ ID NO: 3981997 - RNA, 17 nt, Staphylococcus aureus subsp. aureus Mu50
cuagccguuauuuuuuu

SEQ ID NO: 3981998 - RNA, 18 nt, Staphylococcus aureus subsp. aureus Mu50
cuagccguuauuuuuuug

SEQ ID NO: 3981999 - RNA, 18 nt, Staphylococcus aureus subsp. aureus Mu50
cuagccuucaauauuucu

SEQ ID NO: 3982000 - RNA, 19 nt, Staphylococcus aureus subsp. aureus Mu50
cuagccuucaauauuucuu

SEQ ID NO: 3982001 - RNA, 13 nt, Staphylococcus aureus subsp. aureus Mu50
cuagcuuguuugu

SEQ ID NO: 3982002 - RNA, 16 nt, Staphylococcus aureus subsp. aureus Mu50
cuagcuuguuuguuac

SEQ ID NO: 3982003 - RNA, 17 nt, Staphylococcus aureus subsp. aureus Mu50
cuaggaaauaaaaaaua

SEQ ID NO: 3982004 - RNA, 18 nt, Staphylococcus aureus subsp. aureus Mu50
cuaggaauauaaaacugu

SEQ ID NO: 3982005 - RNA, 17 nt, Staphylococcus aureus subsp. aureus Mu50
cuaggauguucaucaac

SEQ ID NO: 3982006 - RNA, 23 nt, Staphylococcus aureus subsp. aureus Mu50
cuaggauguucaucaacaugaua

SEQ ID NO: 3982007 - RNA, 17 nt, Staphylococcus aureus subsp. aureus Mu50
cuaggauuaaaagcauc

SEQ ID NO: 3982008 - RNA, 17 nt, Staphylococcus aureus subsp. aureus Mu50
cuaggucacuuuuaugg

SEQ ID NO: 3982009 - RNA, 16 nt, Staphylococcus aureus subsp. aureus Mu50
cuaguaauucuucauc

SEQ ID NO: 3982010 - RNA, 18 nt, Staphylococcus aureus subsp. aureus Mu50
cuaguagcuagaacagau

SEQ ID NO: 3982011 - RNA, 14 nt, Staphylococcus aureus subsp. aureus Mu50
cuaguagcuugaau

SEQ ID NO: 3982012 - RNA, 14 nt, Staphylococcus aureus subsp. aureus Mu50
cuagucauaauuua

SEQ ID NO: 3982013 - RNA, 16 nt, Staphylococcus aureus subsp. aureus Mu50
cuagucuuuaacuuua

SEQ ID NO: 3982014 - RNA, 22 nt, Staphylococcus aureus subsp. aureus Mu50
cuagucuuuaacuuuaauuaaa

SEQ ID NO: 3982015 - RNA, 18 nt, Staphylococcus aureus subsp. aureus Mu50
cuagugcgcgauaaauaa

SEQ ID NO: 3982016 - RNA, 19 nt, Staphylococcus aureus subsp. aureus Mu50
cuagugcgcgauaaauaau

SEQ ID NO: 3982017 - RNA, 13 nt, Staphylococcus aureus subsp. aureus Mu50
cuagugcuuccau

SEQ ID NO: 3982018 - RNA, 12 nt, Staphylococcus aureus subsp. aureus Mu50
cuaguucaacuc

SEQ ID NO: 3982019 - RNA, 21 nt, Staphylococcus aureus subsp. aureus Mu50
cuaguucuaaguguugaccau

SEQ ID NO: 3982020 - RNA, 22 nt, Staphylococcus aureus subsp. aureus Mu50
cuaguuguuuuauagcauuucu

SEQ ID NO: 3982021 - RNA, 17 nt, Staphylococcus aureus subsp. aureus Mu50
cuaguuuaacaauacua

SEQ ID NO: 3982022 - RNA, 21 nt, Staphylococcus aureus subsp. aureus Mu50
cuaguuuaacaauacuacuua

SEQ ID NO: 3982023 - RNA, 14 nt, Staphylococcus aureus subsp. aureus Mu50
cuaguuuaucuuca

SEQ ID NO: 3982024 - RNA, 16 nt, Staphylococcus aureus subsp. aureus Mu50
cuaguuuguaauaauu

SEQ ID NO: 3982025 - RNA, 16 nt, Staphylococcus aureus subsp. aureus Mu50
cuaguuuuuuuuauau

SEQ ID NO: 3982026 - RNA, 19 nt, Staphylococcus aureus subsp. aureus Mu50
cuauaaaaauuuauucaaa

SEQ ID NO: 3982027 - RNA, 20 nt, Staphylococcus aureus subsp. aureus Mu50
cuauaaaaauuuauucaaaa

SEQ ID NO: 3982028 - RNA, 17 nt, Staphylococcus aureus subsp. aureus Mu50
cuauaaaaguacuuuaa

SEQ ID NO: 3982029 - RNA, 11 nt, Staphylococcus aureus subsp. aureus Mu50
cuauaaacaua

SEQ ID NO: 3982030 - RNA, 23 nt, Staphylococcus aureus subsp. aureus Mu50
cuauaaagaaugauuuauaaaaa

SEQ ID NO: 3982031 - RNA, 16 nt, Staphylococcus aureus subsp. aureus Mu50
cuauaaauacaaauau

SEQ ID NO: 3982032 - RNA, 17 nt, Staphylococcus aureus subsp. aureus Mu50
cuauaaauacgucaucu

SEQ ID NO: 3982033 - RNA, 16 nt, Staphylococcus aureus subsp. aureus Mu50
cuauaaccuauuaaau

SEQ ID NO: 3982034 - RNA, 18 nt, Staphylococcus aureus subsp. aureus Mu50
cuauaacucuaaauauaa

SEQ ID NO: 3982035 - RNA, 13 nt, Staphylococcus aureus subsp. aureus Mu50
cuauaauaauuaa

SEQ ID NO: 3982036 - RNA, 21 nt, Staphylococcus aureus subsp. aureus Mu50
cuauaauaccuaauugcuuaa

SEQ ID NO: 3982037 - RNA, 15 nt, Staphylococcus aureus subsp. aureus Mu50
cuauaauagcgucau

SEQ ID NO: 3982038 - RNA, 17 nt, Staphylococcus aureus subsp. aureus Mu50
cuauaaucauuaaguaa

SEQ ID NO: 3982039 - RNA, 14 nt, Staphylococcus aureus subsp. aureus Mu50
cuauaauucacuuu

SEQ ID NO: 3982040 - RNA, 15 nt, Staphylococcus aureus subsp. aureus Mu50
cuauaauucacuuua

SEQ ID NO: 3982041 - RNA, 17 nt, Staphylococcus aureus subsp. aureus Mu50
cuauaauuucuuaauua

SEQ ID NO: 3982042 - RNA, 17 nt, Staphylococcus aureus subsp. aureus Mu50
cuauaauuuuaauuauu

SEQ ID NO: 3982043 - RNA, 18 nt, Staphylococcus aureus subsp. aureus Mu50
cuauaauuuuaauuauuu

SEQ ID NO: 3982044 - RNA, 21 nt, Staphylococcus aureus subsp. aureus Mu50
cuauacaaugaauuucuaauu

SEQ ID NO: 3982045 - RNA, 22 nt, Staphylococcus aureus subsp. aureus Mu50
cuauacaauuauggauaaaauu

SEQ ID NO: 3982046 - RNA, 18 nt, Staphylococcus aureus subsp. aureus Mu50
cuauacuccaguuuauaa

SEQ ID NO: 3982047 - RNA, 18 nt, Staphylococcus aureus subsp. aureus Mu50
cuauacugaugaaaacuu

SEQ ID NO: 3982048 - RNA, 21 nt, Staphylococcus aureus subsp. aureus Mu50
cuauagauaggauauuuuuua

SEQ ID NO: 3982049 - RNA, 21 nt, Staphylococcus aureus subsp. aureus Mu50
cuauagccaaaggcaaaaugu

SEQ ID NO: 3982050 - RNA, 14 nt, Staphylococcus aureus subsp. aureus Mu50
cuauaguaagaaaa

SEQ ID NO: 3982051 - RNA, 16 nt, Staphylococcus aureus subsp. aureus Mu50
cuauagucauucauaa

SEQ ID NO: 3982052 - RNA, 13 nt, Staphylococcus aureus subsp. aureus Mu50
cuauauaaaguug

SEQ ID NO: 3982053 - RNA, 14 nt, Staphylococcus aureus subsp. aureus Mu50
cuauauaaaguuga

SEQ ID NO: 3982054 - RNA, 23 nt, Staphylococcus aureus subsp. aureus Mu50
cuauauaaauguuuauaucuuuu

SEQ ID NO: 3982055 - RNA, 13 nt, Staphylococcus aureus subsp. aureus Mu50
cuauauaauuuau

SEQ ID NO: 3982056 - RNA, 13 nt, Staphylococcus aureus subsp. aureus Mu50
cuauauaguaaaa

SEQ ID NO: 3982057 - RNA, 14 nt, Staphylococcus aureus subsp. aureus Mu50
cuauauaguaaaau

SEQ ID NO: 3982058 - RNA, 14 nt, Staphylococcus aureus subsp. aureus Mu50
cucaauuuaguaua

SEQ ID NO: 3982059 - RNA, 19 nt, Staphylococcus aureus subsp. aureus Mu50
cucaauuuaguauaaauaa

SEQ ID NO: 3982060 - RNA, 24 nt, Staphylococcus aureus subsp. aureus Mu50
cucaauuucauuugaaauaguuaa

SEQ ID NO: 3982061 - RNA, 18 nt, Staphylococcus aureus subsp. aureus Mu50
cucacagacuuuuuacua

SEQ ID NO: 3982062 - RNA, 17 nt, Staphylococcus aureus subsp. aureus Mu50
cucacgauuaauaaaau

SEQ ID NO: 3982063 - RNA, 13 nt, Staphylococcus aureus subsp. aureus Mu50
cucacuucuuaaa

SEQ ID NO: 3982064 - RNA, 20 nt, Staphylococcus aureus subsp. aureus Mu50
cucagguauaggugcaguua

SEQ ID NO: 3982065 - RNA, 18 nt, Staphylococcus aureus subsp. aureus Mu50
cucagguuguuaggggcu

SEQ ID NO: 3982066 - RNA, 17 nt, Staphylococcus aureus subsp. aureus Mu50
cucagugcauuuuuuau

SEQ ID NO: 3982067 - RNA, 17 nt, Staphylococcus aureus subsp. aureus Mu50
cucaguguugggggcca

SEQ ID NO: 3982068 - RNA, 10 nt, Staphylococcus aureus subsp. aureus Mu50
cucauaauaa

SEQ ID NO: 3982069 - RNA, 12 nt, Staphylococcus aureus subsp. aureus Mu50
cucauaauaauu

SEQ ID NO: 3982070 - RNA, 14 nt, Staphylococcus aureus subsp. aureus Mu50
cucauacaaauuuu

SEQ ID NO: 3982071 - RNA, 16 nt, Staphylococcus aureus subsp. aureus Mu50
cucauaccaaaaacau

SEQ ID NO: 3982072 - RNA, 18 nt, Staphylococcus aureus subsp. aureus Mu50
cucauaccaaaaacauua

SEQ ID NO: 3982073 - RNA, 20 nt, Staphylococcus aureus subsp. aureus Mu50
cucauccgccaauuaaaauu

SEQ ID NO: 3982074 - RNA, 17 nt, Staphylococcus aureus subsp. aureus Mu50
cucaucgaauucauuug

SEQ ID NO: 3982075 - RNA, 20 nt, Staphylococcus aureus subsp. aureus Mu50
cucaucgaguuuguuucuaa

SEQ ID NO: 3982076 - RNA, 12 nt, Staphylococcus aureus subsp. aureus Mu50
cucaucuaauuu

SEQ ID NO: 3982077 - RNA, 22 nt, Staphylococcus aureus subsp. aureus Mu50
cucaucuauuuaauaauguauc

SEQ ID NO: 3982078 - RNA, 12 nt, Staphylococcus aureus subsp. aureus Mu50
cucaucuucuaa

SEQ ID NO: 3982079 - RNA, 17 nt, Staphylococcus aureus subsp. aureus Mu50
cucaucuucuaaaucaa

SEQ ID NO: 3982080 - RNA, 18 nt, Staphylococcus aureus subsp. aureus Mu50
cucaugagcacaaacuaa

SEQ ID NO: 3982081 - RNA, 16 nt, Staphylococcus aureus subsp. aureus Mu50
cucauuaaccuuacau

SEQ ID NO: 3982082 - RNA, 23 nt, Staphylococcus aureus subsp. aureus Mu50
cucauuaaccuuacauaggauau

SEQ ID NO: 3982083 - RNA, 14 nt, Staphylococcus aureus subsp. aureus Mu50
cucauuagcgcaag

SEQ ID NO: 3982084 - RNA, 20 nt, Staphylococcus aureus subsp. aureus Mu50
cucauuccaggaaggaaugu

SEQ ID NO: 3982085 - RNA, 16 nt, Staphylococcus aureus subsp. aureus Mu50
cucauuucaauauuaa

SEQ ID NO: 3982086 - RNA, 22 nt, Staphylococcus aureus subsp. aureus Mu50
cucauuuuuuuaauuauuuccc

SEQ ID NO: 3982087 - RNA, 17 nt, Staphylococcus aureus subsp. aureus Mu50
cuccaaaaauaauuaaa

SEQ ID NO: 3982088 - RNA, 20 nt, Staphylococcus aureus subsp. aureus Mu50
cuccaaaaauaauuaaaucc

SEQ ID NO: 3982089 - RNA, 22 nt, Staphylococcus aureus subsp. aureus Mu50
cuccaagauuaugacaacauaa

SEQ ID NO: 3982090 - RNA, 15 nt, Staphylococcus aureus subsp. aureus Mu50
cuccaaucaucauua

SEQ ID NO: 3982091 - RNA, 21 nt, Staphylococcus aureus subsp. aureus Mu50
cuccaauuaccaaugaauaaa

SEQ ID NO: 3982092 - RNA, 18 nt, Staphylococcus aureus subsp. aureus Mu50
cuccaccaccugcaauuu

SEQ ID NO: 3982093 - RNA, 18 nt, Staphylococcus aureus subsp. aureus Mu50
cuccauuauauagucugc

SEQ ID NO: 3982094 - RNA, 18 nt, Staphylococcus aureus subsp. aureus Mu50
cuccauuuaauuuguuag

SEQ ID NO: 3982095 - RNA, 14 nt, Staphylococcus aureus subsp. aureus Mu50
cuccccaacuuaau

SEQ ID NO: 3982096 - RNA, 18 nt, Staphylococcus aureus subsp. aureus Mu50
cucccuuaaauacaauuu

SEQ ID NO: 3982097 - RNA, 22 nt, Staphylococcus aureus subsp. aureus Mu50
cucccuuaaauacaauuucuuc

SEQ ID NO: 3982098 - RNA, 18 nt, Staphylococcus aureus subsp. aureus Mu50
cucccuucaaaguuuuca

SEQ ID NO: 3982099 - RNA, 14 nt, Staphylococcus aureus subsp. aureus Mu50
cuccguuaauuuaa

SEQ ID NO: 3982100 - RNA, 15 nt, Staphylococcus aureus subsp. aureus Mu50
cuccguugaauucaa

SEQ ID NO: 3982101 - RNA, 18 nt, Staphylococcus aureus subsp. aureus Mu50
cuccuaagcuaguguuuu

SEQ ID NO: 3982102 - RNA, 18 nt, Staphylococcus aureus subsp. aureus Mu50
cuccucaaaagcuguagu

SEQ ID NO: 3982103 - RNA, 20 nt, Staphylococcus aureus subsp. aureus Mu50
cuccuuaaacaaauaaaugu

SEQ ID NO: 3982104 - RNA, 13 nt, Staphylococcus aureus subsp. aureus Mu50
cuccuuacaauaa

SEQ ID NO: 3982105 - RNA, 20 nt, Staphylococcus aureus subsp. aureus Mu50
cuccuucaauguucaauuca

SEQ ID NO: 3982106 - RNA, 14 nt, Staphylococcus aureus subsp. aureus Mu50
cucgaccuuuauau

SEQ ID NO: 3982107 - RNA, 16 nt, Staphylococcus aureus subsp. aureus Mu50
cucgauaacuuacuau

SEQ ID NO: 3982108 - RNA, 21 nt, Staphylococcus aureus subsp. aureus Mu50
cucgauacaaaggauuauuaa

SEQ ID NO: 3982109 - RNA, 18 nt, Staphylococcus aureus subsp. aureus Mu50
cucgauuuuuuuauauuu

SEQ ID NO: 3982110 - RNA, 12 nt, Staphylococcus aureus subsp. aureus Mu50
cucgcuuacuca

SEQ ID NO: 3982111 - RNA, 12 nt, Staphylococcus aureus subsp. aureus Mu50
cucgguuuuuuc

SEQ ID NO: 3982112 - RNA, 18 nt, Staphylococcus aureus subsp. aureus Mu50
cucguaaauuuuaucuaa

SEQ ID NO: 3982113 - RNA, 14 nt, Staphylococcus aureus subsp. aureus Mu50
cucguaguucgaca

SEQ ID NO: 3982114 - RNA, 17 nt, Staphylococcus aureus subsp. aureus Mu50
cucguuaaaucacauau

SEQ ID NO: 3982115 - RNA, 15 nt, Staphylococcus aureus subsp. aureus Mu50
cucguuuuuccaugu

SEQ ID NO: 3982116 - RNA, 15 nt, Staphylococcus aureus subsp. aureus Mu50
cucuaaaagccaucu

SEQ ID NO: 3982117 - RNA, 20 nt, Staphylococcus aureus subsp. aureus Mu50
cucuaaacuucuauuaauaa

SEQ ID NO: 3982118 - RNA, 22 nt, Staphylococcus aureus subsp. aureus Mu50
cucuaaacuucuauuaauaauu

SEQ ID NO: 3982119 - RNA, 19 nt, Staphylococcus aureus subsp. aureus Mu50
cucuaaaggaaagccauua

SEQ ID NO: 3982120 - RNA, 12 nt, Staphylococcus aureus subsp. aureus Mu50
cucuaaauaaaa

SEQ ID NO: 3982121 - RNA, 16 nt, Staphylococcus aureus subsp. aureus Mu50
cucuaaauaaaauuaa

SEQ ID NO: 3982122 - RNA, 20 nt, Staphylococcus aureus subsp. aureus Mu50
cucuaacuuuaccaauauca

SEQ ID NO: 3982123 - RNA, 16 nt, Staphylococcus aureus subsp. aureus Mu50
cucuaauccaaaauaa

SEQ ID NO: 3982124 - RNA, 20 nt, Staphylococcus aureus subsp. aureus Mu50
cucuaaugauuaaaaaucaa

SEQ ID NO: 3982125 - RNA, 22 nt, Staphylococcus aureus subsp. aureus Mu50
cucuaauucaaugauuuuuaaa

SEQ ID NO: 3982126 - RNA, 20 nt, Staphylococcus aureus subsp. aureus Mu50
cucuauggcuucgcuaauaa

SEQ ID NO: 3982127 - RNA, 16 nt, Staphylococcus aureus subsp. aureus Mu50
cucuauuaauuuacuc

SEQ ID NO: 3982128 - RNA, 17 nt, Staphylococcus aureus subsp. aureus Mu50
cucuauuuauaacacuu

SEQ ID NO: 3982129 - RNA, 17 nt, Staphylococcus aureus subsp. aureus Mu50
cucuauuuuuuauguuu

SEQ ID NO: 3982130 - RNA, 16 nt, Staphylococcus aureus subsp. aureus Mu50
cucucaacauuuugau

SEQ ID NO: 3982131 - RNA, 18 nt, Staphylococcus aureus subsp. aureus Mu50
cucucaaugcauuuaauu

SEQ ID NO: 3982132 - RNA, 20 nt, Staphylococcus aureus subsp. aureus Mu50
cucucaaugcauuuaauuua

SEQ ID NO: 3982133 - RNA, 12 nt, Staphylococcus aureus subsp. aureus Mu50
cucucguaaauu

SEQ ID NO: 3982134 - RNA, 17 nt, Staphylococcus aureus subsp. aureus Mu50
cucugaaaaacuucuua

SEQ ID NO: 3982135 - RNA, 23 nt, Staphylococcus aureus subsp. aureus Mu50
cucugaaggagacauuucccauu

SEQ ID NO: 3982136 - RNA, 19 nt, Staphylococcus aureus subsp. aureus Mu50
cucugauacuucaccaucu

SEQ ID NO: 3982137 - RNA, 14 nt, Staphylococcus aureus subsp. aureus Mu50
cucugauauugauc

SEQ ID NO: 3982138 - RNA, 23 nt, Staphylococcus aureus subsp. aureus Mu50
cucugauuacauauacgacauuu

SEQ ID NO: 3982139 - RNA, 15 nt, Staphylococcus aureus subsp. aureus Mu50
cucuggaacuuuaau

SEQ ID NO: 3982140 - RNA, 15 nt, Staphylococcus aureus subsp. aureus Mu50
cucuggauuuuucuu

SEQ ID NO: 3982141 - RNA, 22 nt, Staphylococcus aureus subsp. aureus Mu50
cucuggauuuuucuuauaaaaa

SEQ ID NO: 3982142 - RNA, 21 nt, Staphylococcus aureus subsp. aureus Mu50
cucuuauaaagacaccuucaa

SEQ ID NO: 3982143 - RNA, 22 nt, Staphylococcus aureus subsp. aureus Mu50
cucuuauuaaaaaagaacauaa

SEQ ID NO: 3982144 - RNA, 16 nt, Staphylococcus aureus subsp. aureus Mu50
cucuucaaaguagaua

SEQ ID NO: 3982145 - RNA, 15 nt, Staphylococcus aureus subsp. aureus Mu50
cugcaguugauugca

SEQ ID NO: 3982146 - RNA, 19 nt, Staphylococcus aureus subsp. aureus Mu50
cugcauagcgcucuggauu

SEQ ID NO: 3982147 - RNA, 21 nt, Staphylococcus aureus subsp. aureus Mu50
cugcauagcgcucuggauuuu

SEQ ID NO: 3982148 - RNA, 13 nt, Staphylococcus aureus subsp. aureus Mu50
cugcauauaaagu

SEQ ID NO: 3982149 - RNA, 23 nt, Staphylococcus aureus subsp. aureus Mu50
cugcauauucacgauauaacauu

SEQ ID NO: 3982150 - RNA, 21 nt, Staphylococcus aureus subsp. aureus Mu50
cugcaucaauaugaccuuuau

SEQ ID NO: 3982151 - RNA, 13 nt, Staphylococcus aureus subsp. aureus Mu50
cugcauuaauuuc

SEQ ID NO: 3982152 - RNA, 18 nt, Staphylococcus aureus subsp. aureus Mu50
cugcauuacgcugucuca

SEQ ID NO: 3982153 - RNA, 13 nt, Staphylococcus aureus subsp. aureus Mu50
cugccaaaaagua

SEQ ID NO: 3982154 - RNA, 23 nt, Staphylococcus aureus subsp. aureus Mu50
cugccaauaaaaugcaauuuuuc

SEQ ID NO: 3982155 - RNA, 14 nt, Staphylococcus aureus subsp. aureus Mu50
cugccaauauauuc

SEQ ID NO: 3982156 - RNA, 19 nt, Staphylococcus aureus subsp. aureus Mu50
cugccauaaacauggucaa

SEQ ID NO: 3982157 - RNA, 15 nt, Staphylococcus aureus subsp. aureus Mu50
cugccauauagauau

SEQ ID NO: 3982158 - RNA, 15 nt, Staphylococcus aureus subsp. aureus Mu50
cugccauuaaacgaa

SEQ ID NO: 3982159 - RNA, 24 nt, Staphylococcus aureus subsp. aureus Mu50
cugccauucuuuuucucaauguga

SEQ ID NO: 3982160 - RNA, 19 nt, Staphylococcus aureus subsp. aureus Mu50
cugcccuuuagucauguuu

SEQ ID NO: 3982161 - RNA, 19 nt, Staphylococcus aureus subsp. aureus Mu50
cugccuaaucgcacucugc

SEQ ID NO: 3982162 - RNA, 15 nt, Staphylococcus aureus subsp. aureus Mu50
cugcuaaaauaaaau

SEQ ID NO: 3982163 - RNA, 20 nt, Staphylococcus aureus subsp. aureus Mu50
cugcuaauauuagauaucuu

SEQ ID NO: 3982164 - RNA, 14 nt, Staphylococcus aureus subsp. aureus Mu50
cugcuaauuuuuuc

SEQ ID NO: 3982165 - RNA, 20 nt, Staphylococcus aureus subsp. aureus Mu50
cugcuaauuuuuucaucauu

SEQ ID NO: 3982166 - RNA, 21 nt, Staphylococcus aureus subsp. aureus Mu50
cugcuaauuuuuucaucauuc

SEQ ID NO: 3982167 - RNA, 18 nt, Staphylococcus aureus subsp. aureus Mu50
cugcuacaacuucuucuc

SEQ ID NO: 3982168 - RNA, 17 nt, Staphylococcus aureus subsp. aureus Mu50
cugcuaguucagcuucu

SEQ ID NO: 3982169 - RNA, 21 nt, Staphylococcus aureus subsp. aureus Mu50
cugcucuuuauauauaaaauc

SEQ ID NO: 3982170 - RNA, 22 nt, Staphylococcus aureus subsp. aureus Mu50
cugcugcuuucauagaaccauu

SEQ ID NO: 3982171 - RNA, 23 nt, Staphylococcus aureus subsp. aureus Mu50
cugcugcuuucauagaaccauuu

SEQ ID NO: 3982172 - RNA, 20 nt, Staphylococcus aureus subsp. aureus Mu50
cugcugguaacucuucagua

SEQ ID NO: 3982173 - RNA, 14 nt, Staphylococcus aureus subsp. aureus Mu50
cugcuguacguuua

SEQ ID NO: 3982174 - RNA, 19 nt, Staphylococcus aureus subsp. aureus Mu50
cugcuucaacuacuucauc

SEQ ID NO: 3982175 - RNA, 16 nt, Staphylococcus aureus subsp. aureus Mu50
cugcuucgcuaauauc

SEQ ID NO: 3982176 - RNA, 17 nt, Staphylococcus aureus subsp. aureus Mu50
cugcuucuacccuugca

SEQ ID NO: 3982177 - RNA, 14 nt, Staphylococcus aureus subsp. aureus Mu50
cugcuucugcugua

SEQ ID NO: 3982178 - RNA, 21 nt, Staphylococcus aureus subsp. aureus Mu50
cugcuucuucagguguuuuac

SEQ ID NO: 3982179 - RNA, 14 nt, Staphylococcus aureus subsp. aureus Mu50
cugcuuuaacugua

SEQ ID NO: 3982180 - RNA, 16 nt, Staphylococcus aureus subsp. aureus Mu50
cugcuuuauuuuauca

SEQ ID NO: 3982181 - RNA, 21 nt, Staphylococcus aureus subsp. aureus Mu50
cugcuuuauuuuaucaucuau

SEQ ID NO: 3982182 - RNA, 19 nt, Staphylococcus aureus subsp. aureus Mu50
cugcuuuuaauaucuucua

SEQ ID NO: 3982183 - RNA, 20 nt, Staphylococcus aureus subsp. aureus Mu50
cugcuuuuuauuauuaugug

SEQ ID NO: 3982184 - RNA, 23 nt, Staphylococcus aureus subsp. aureus Mu50
cugcuuuuuuauucuaauacaaa

SEQ ID NO: 3982185 - RNA, 14 nt, Staphylococcus aureus subsp. aureus Mu50
cuggaauaccuaac

SEQ ID NO: 3982186 - RNA, 21 nt, Staphylococcus aureus subsp. aureus Mu50
cuggaaucgaaaauaucaauu

SEQ ID NO: 3982187 - RNA, 14 nt, Staphylococcus aureus subsp. aureus Mu50
cuggaauugggaaa

SEQ ID NO: 3982188 - RNA, 19 nt, Staphylococcus aureus subsp. aureus Mu50
cuggaauugggaaauauuu

SEQ ID NO: 3982189 - RNA, 20 nt, Staphylococcus aureus subsp. aureus Mu50
cuggaucgcccauacuaaau

SEQ ID NO: 3982190 - RNA, 20 nt, Staphylococcus aureus subsp. aureus Mu50
cuggauuuuucuuauaaaaa

SEQ ID NO: 3982191 - RNA, 21 nt, Staphylococcus aureus subsp. aureus Mu50
cuggauuuuucuuauaaaaau

SEQ ID NO: 3982192 - RNA, 15 nt, Staphylococcus aureus subsp. aureus Mu50
cuggcaaauugccuu

SEQ ID NO: 3982193 - RNA, 23 nt, Staphylococcus aureus subsp. aureus Mu50
cuggcaaauugccuuucauuuua

SEQ ID NO: 3982194 - RNA, 19 nt, Staphylococcus aureus subsp. aureus Mu50
cuggcaacguucuacucua

SEQ ID NO: 3982195 - RNA, 13 nt, Staphylococcus aureus subsp. aureus Mu50
cuggcucuucuua

SEQ ID NO: 3982196 - RNA, 12 nt, Staphylococcus aureus subsp. aureus Mu50
cuggcuuuuuaa

SEQ ID NO: 3982197 - RNA, 20 nt, Staphylococcus aureus subsp. aureus Mu50
cuggggaagaccauuuuaua

SEQ ID NO: 3982198 - RNA, 14 nt, Staphylococcus aureus subsp. aureus Mu50
cuggguaauaaauu

SEQ ID NO: 3982199 - RNA, 16 nt, Staphylococcus aureus subsp. aureus Mu50
cugguaauauuuuugu

SEQ ID NO: 3982200 - RNA, 16 nt, Staphylococcus aureus subsp. aureus Mu50
cugguacuacuaucca

SEQ ID NO: 3982201 - RNA, 15 nt, Staphylococcus aureus subsp. aureus Mu50
cuggucguacuuuca

SEQ ID NO: 3982202 - RNA, 22 nt, Staphylococcus aureus subsp. aureus Mu50
cuggugcaggcaucauaucaua

SEQ ID NO: 3982203 - RNA, 19 nt, Staphylococcus aureus subsp. aureus Mu50
cuggugguaacguaaacau

SEQ ID NO: 3982204 - RNA, 15 nt, Staphylococcus aureus subsp. aureus Mu50
cugguugauaaauaa

SEQ ID NO: 3982205 - RNA, 22 nt, Staphylococcus aureus subsp. aureus Mu50
cuguaaaacauucccuuaauaa

SEQ ID NO: 3982206 - RNA, 20 nt, Staphylococcus aureus subsp. aureus Mu50
cuguaaaaccauagauaauu

SEQ ID NO: 3982207 - RNA, 14 nt, Staphylococcus aureus subsp. aureus Mu50
cuguaaauuaucua

SEQ ID NO: 3982208 - RNA, 20 nt, Staphylococcus aureus subsp. aureus Mu50
cuguaacaaagucucuagua

SEQ ID NO: 3982209 - RNA, 15 nt, Staphylococcus aureus subsp. aureus Mu50
cuguaaccaaaagaa

SEQ ID NO: 3982210 - RNA, 23 nt, Staphylococcus aureus subsp. aureus Mu50
cuguaaccaaaagaaauucgcuu

SEQ ID NO: 3982211 - RNA, 23 nt, Staphylococcus aureus subsp. aureus Mu50
cuguaacgaguccauuuucuuuu

SEQ ID NO: 3982212 - RNA, 15 nt, Staphylococcus aureus subsp. aureus Mu50
cuguaauaauaucac

SEQ ID NO: 3982213 - RNA, 21 nt, Staphylococcus aureus subsp. aureus Mu50
cuguaccaucacuaaaguaaa

SEQ ID NO: 3982214 - RNA, 17 nt, Staphylococcus aureus subsp. aureus Mu50
cuguacgauucaauuua

SEQ ID NO: 3982215 - RNA, 18 nt, Staphylococcus aureus subsp. aureus Mu50
cuguacgauucaauuuaa

SEQ ID NO: 3982216 - RNA, 18 nt, Staphylococcus aureus subsp. aureus Mu50
cuguacguuuuaaauaaa

SEQ ID NO: 3982217 - RNA, 23 nt, Staphylococcus aureus subsp. aureus Mu50
cuguacuuuuauguuguuauaaa

SEQ ID NO: 3982218 - RNA, 13 nt, Staphylococcus aureus subsp. aureus Mu50
cuguagauaucaa

SEQ ID NO: 3982219 - RNA, 15 nt, Staphylococcus aureus subsp. aureus Mu50
cuguagguaagaaaa

SEQ ID NO: 3982220 - RNA, 14 nt, Staphylococcus aureus subsp. aureus Mu50
cuguaguuucuuaa

SEQ ID NO: 3982221 - RNA, 18 nt, Staphylococcus aureus subsp. aureus Mu50
cuguauaaccauaaugaa

SEQ ID NO: 3982222 - RNA, 17 nt, Staphylococcus aureus subsp. aureus Mu50
cuguauagcgguguuuu

SEQ ID NO: 3982223 - RNA, 19 nt, Staphylococcus aureus subsp. aureus Mu50
cuguauagcuggcuuuuua

SEQ ID NO: 3982224 - RNA, 22 nt, Staphylococcus aureus subsp. aureus Mu50
cuguauauggcgauaacaagaa

SEQ ID NO: 3982225 - RNA, 20 nt, Staphylococcus aureus subsp. aureus Mu50
cuguaugccgccuaauaaua

SEQ ID NO: 3982226 - RNA, 21 nt, Staphylococcus aureus subsp. aureus Mu50
cuguauucgguuaauauucuu

SEQ ID NO: 3982227 - RNA, 13 nt, Staphylococcus aureus subsp. aureus Mu50
cuguauuuaauaa

SEQ ID NO: 3982228 - RNA, 14 nt, Staphylococcus aureus subsp. aureus Mu50
cuguauuuaauaaa

SEQ ID NO: 3982229 - RNA, 14 nt, Staphylococcus aureus subsp. aureus Mu50
cuguccauuuaucu

SEQ ID NO: 3982230 - RNA, 19 nt, Staphylococcus aureus subsp. aureus Mu50
cugucucaucuucuaaauc

SEQ ID NO: 3982231 - RNA, 17 nt, Staphylococcus aureus subsp. aureus Mu50
cugucuuuccauaauaa

SEQ ID NO: 3982232 - RNA, 23 nt, Staphylococcus aureus subsp. aureus Mu50
cuuacugaaacuaaauuaaaagu

SEQ ID NO: 3982233 - RNA, 22 nt, Staphylococcus aureus subsp. aureus Mu50
cuuacugcuguuuuuuauagua

SEQ ID NO: 3982234 - RNA, 17 nt, Staphylococcus aureus subsp. aureus Mu50
cuuacugugaaaauacc

SEQ ID NO: 3982235 - RNA, 20 nt, Staphylococcus aureus subsp. aureus Mu50
cuuacuuuucuaaacaacuu

SEQ ID NO: 3982236 - RNA, 16 nt, Staphylococcus aureus subsp. aureus Mu50
cuuagaauuuacaagu

SEQ ID NO: 3982237 - RNA, 20 nt, Staphylococcus aureus subsp. aureus Mu50
cuuagacaaacgacuaacca

SEQ ID NO: 3982238 - RNA, 14 nt, Staphylococcus aureus subsp. aureus Mu50
cuuagauaaauuaa

SEQ ID NO: 3982239 - RNA, 19 nt, Staphylococcus aureus subsp. aureus Mu50
cuuagauaaauuaauauga

SEQ ID NO: 3982240 - RNA, 22 nt, Staphylococcus aureus subsp. aureus Mu50
cuuagcacuuggauuuuaauua

SEQ ID NO: 3982241 - RNA, 22 nt, Staphylococcus aureus subsp. aureus Mu50
cuuaggugucaucgcuuuaauu

SEQ ID NO: 3982242 - RNA, 12 nt, Staphylococcus aureus subsp. aureus Mu50
cuuaguaauaag

SEQ ID NO: 3982243 - RNA, 16 nt, Staphylococcus aureus subsp. aureus Mu50
cuuaguacaaaauugu

SEQ ID NO: 3982244 - RNA, 19 nt, Staphylococcus aureus subsp. aureus Mu50
cuuaguaguuguacuucuu

SEQ ID NO: 3982245 - RNA, 17 nt, Staphylococcus aureus subsp. aureus Mu50
cuuaguuugacaucuau

SEQ ID NO: 3982246 - RNA, 13 nt, Staphylococcus aureus subsp. aureus Mu50
cuuauaaaauaaa

SEQ ID NO: 3982247 - RNA, 22 nt, Staphylococcus aureus subsp. aureus Mu50
cuuauaaacaaaagaucgauac

SEQ ID NO: 3982248 - RNA, 21 nt, Staphylococcus aureus subsp. aureus Mu50
cuuauaaagacaccuucaaua

SEQ ID NO: 3982249 - RNA, 17 nt, Staphylococcus aureus subsp. aureus Mu50
cuuauaacaaaaauugc

SEQ ID NO: 3982250 - RNA, 15 nt, Staphylococcus aureus subsp. aureus Mu50
cuuauaacauucuuc

SEQ ID NO: 3982251 - RNA, 17 nt, Staphylococcus aureus subsp. aureus Mu50
cuuauaacauucuucaa

SEQ ID NO: 3982252 - RNA, 17 nt, Staphylococcus aureus subsp. aureus Mu50
cuuauaagauauagaag

SEQ ID NO: 3982253 - RNA, 21 nt, Staphylococcus aureus subsp. aureus Mu50
cuuauaaguucaaccauauga

SEQ ID NO: 3982254 - RNA, 14 nt, Staphylococcus aureus subsp. aureus Mu50
cuuauaauauuaaa

SEQ ID NO: 3982255 - RNA, 20 nt, Staphylococcus aureus subsp. aureus Mu50
cuuauacacuuacaaauauu

SEQ ID NO: 3982256 - RNA, 21 nt, Staphylococcus aureus subsp. aureus Mu50
cuuauacguuacggcuuugua

SEQ ID NO: 3982257 - RNA, 14 nt, Staphylococcus aureus subsp. aureus Mu50
cuuauauaaacaaa

SEQ ID NO: 3982258 - RNA, 15 nt, Staphylococcus aureus subsp. aureus Mu50
cuuauauaaacaaaa

SEQ ID NO: 3982259 - RNA, 22 nt, Staphylococcus aureus subsp. aureus Mu50
cuuauauacguugauuaacaca

SEQ ID NO: 3982260 - RNA, 16 nt, Staphylococcus aureus subsp. aureus Mu50
cuuauauauucaauaa

SEQ ID NO: 3982261 - RNA, 22 nt, Staphylococcus aureus subsp. aureus Mu50
cuuauauauucaauaauuauua

SEQ ID NO: 3982262 - RNA, 14 nt, Staphylococcus aureus subsp. aureus Mu50
cuuaucaaaaccgc

SEQ ID NO: 3982263 - RNA, 14 nt, Staphylococcus aureus subsp. aureus Mu50
cuuaucaacaacaa

SEQ ID NO: 3982264 - RNA, 16 nt, Staphylococcus aureus subsp. aureus Mu50
cuuaucaacagcuuca

SEQ ID NO: 3982265 - RNA, 23 nt, Staphylococcus aureus subsp. aureus Mu50
cuuaucaacagcuucaaaaucaa

SEQ ID NO: 3982266 - RNA, 16 nt, Staphylococcus aureus subsp. aureus Mu50
cuuaucaagaauauaa

SEQ ID NO: 3982267 - RNA, 21 nt, Staphylococcus aureus subsp. aureus Mu50
cuuaucagcauuaaucguauu

SEQ ID NO: 3982268 - RNA, 12 nt, Staphylococcus aureus subsp. aureus Mu50
cuuaucagugua

SEQ ID NO: 3982269 - RNA, 23 nt, Staphylococcus aureus subsp. aureus Mu50
cuuaucgccuggugcaggcauca

SEQ ID NO: 3982270 - RNA, 15 nt, Staphylococcus aureus subsp. aureus Mu50
cuuaugacugcuuuu

SEQ ID NO: 3982271 - RNA, 14 nt, Staphylococcus aureus subsp. aureus Mu50
cuuaugagcaaagc

SEQ ID NO: 3982272 - RNA, 21 nt, Staphylococcus aureus subsp. aureus Mu50
cuuauggguucaauaucgauu

SEQ ID NO: 3982273 - RNA, 16 nt, Staphylococcus aureus subsp. aureus Mu50
cuuaugucauauacua

SEQ ID NO: 3982274 - RNA, 19 nt, Staphylococcus aureus subsp. aureus Mu50
cuuaugucauauacuauau

SEQ ID NO: 3982275 - RNA, 13 nt, Staphylococcus aureus subsp. aureus Mu50
cuuauuaaauaag

SEQ ID NO: 3982276 - RNA, 11 nt, Staphylococcus aureus subsp. aureus Mu50
cuuauuaacuu

SEQ ID NO: 3982277 - RNA, 13 nt, Staphylococcus aureus subsp. aureus Mu50
cuuauuaauuguu

SEQ ID NO: 3982278 - RNA, 20 nt, Staphylococcus aureus subsp. aureus Mu50
cuuauuauagggcuguuuuu

SEQ ID NO: 3982279 - RNA, 13 nt, Staphylococcus aureus subsp. aureus Mu50
cuuauuauuaauu

SEQ ID NO: 3982280 - RNA, 12 nt, Staphylococcus aureus subsp. aureus Mu50
cuuauuauuuau

SEQ ID NO: 3982281 - RNA, 14 nt, Staphylococcus aureus subsp. aureus Mu50
cuuauuauuuaucg

SEQ ID NO: 3982282 - RNA, 13 nt, Staphylococcus aureus subsp. aureus Mu50
cuuauucaaauua

SEQ ID NO: 3982283 - RNA, 16 nt, Staphylococcus aureus subsp. aureus Mu50
cuuauucgaacgauau

SEQ ID NO: 3982284 - RNA, 17 nt, Staphylococcus aureus subsp. aureus Mu50
cuuauucgcaccacugg

SEQ ID NO: 3982285 - RNA, 21 nt, Staphylococcus aureus subsp. aureus Mu50
cuuauucgcaccacuggccuu

SEQ ID NO: 3982286 - RNA, 12 nt, Staphylococcus aureus subsp. aureus Mu50
cuuauugaaaag

SEQ ID NO: 3982287 - RNA, 17 nt, Staphylococcus aureus subsp. aureus Mu50
cuuauugaaaagauaaa

SEQ ID NO: 3982288 - RNA, 22 nt, Staphylococcus aureus subsp. aureus Mu50
cuuauuugaaugcaaaucaaau

SEQ ID NO: 3982289 - RNA, 24 nt, Staphylococcus aureus subsp. aureus Mu50
cuuauuuggaugguaaguauaauu

SEQ ID NO: 3982290 - RNA, 14 nt, Staphylococcus aureus subsp. aureus Mu50
cuuauuuguuuaau

SEQ ID NO: 3982291 - RNA, 20 nt, Staphylococcus aureus subsp. aureus Mu50
cuuauuuguuuaauuaucuu

SEQ ID NO: 3982292 - RNA, 13 nt, Staphylococcus aureus subsp. aureus Mu50
cuuauuuuauacg

SEQ ID NO: 3982293 - RNA, 15 nt, Staphylococcus aureus subsp. aureus Mu50
cuuauuuuguuuuaa

SEQ ID NO: 3982294 - RNA, 17 nt, Staphylococcus aureus subsp. aureus Mu50
cuucaaaaaauaauagc

SEQ ID NO: 3982295 - RNA, 19 nt, Staphylococcus aureus subsp. aureus Mu50
cuucaaaaaauaauagcaa

SEQ ID NO: 3982296 - RNA, 15 nt, Staphylococcus aureus subsp. aureus Mu50
cuucaaaauuuugac

SEQ ID NO: 3982297 - RNA, 15 nt, Staphylococcus aureus subsp. aureus Mu50
cuucaaacaaagggg

SEQ ID NO: 3982298 - RNA, 21 nt, Staphylococcus aureus subsp. aureus Mu50
cuucaaacagacuuaacuguc

SEQ ID NO: 3982299 - RNA, 14 nt, Staphylococcus aureus subsp. aureus Mu50
cuucaaacuuucac

SEQ ID NO: 3982300 - RNA, 19 nt, Staphylococcus aureus subsp. aureus Mu50
cuucaaaguagauauugaa

SEQ ID NO: 3982301 - RNA, 14 nt, Staphylococcus aureus subsp. aureus Mu50
cuucaaaguuuuca

SEQ ID NO: 3982302 - RNA, 18 nt, Staphylococcus aureus subsp. aureus Mu50
cuucaaaguuuucauuuu

SEQ ID NO: 3982303 - RNA, 23 nt, Staphylococcus aureus subsp. aureus Mu50
cuucaaaguuuucauuuuuucaa

SEQ ID NO: 3982304 - RNA, 17 nt, Staphylococcus aureus subsp. aureus Mu50
cuucaaauguaacauua

SEQ ID NO: 3982305 - RNA, 15 nt, Staphylococcus aureus subsp. aureus Mu50
cuucaacauaacuca

SEQ ID NO: 3982306 - RNA, 23 nt, Staphylococcus aureus subsp. aureus Mu50
cuucaacauaacucaaauaucua

SEQ ID NO: 3982307 - RNA, 17 nt, Staphylococcus aureus subsp. aureus Mu50
cuucaaccauuuguucu

SEQ ID NO: 3982308 - RNA, 16 nt, Staphylococcus aureus subsp. aureus Mu50
cuucaacgucaucugc

SEQ ID NO: 3982309 - RNA, 13 nt, Staphylococcus aureus subsp. aureus Mu50
cuucaacuaaugu

SEQ ID NO: 3982310 - RNA, 19 nt, Staphylococcus aureus subsp. aureus Mu50
cuucaagagaaccaccuac

SEQ ID NO: 3982311 - RNA, 19 nt, Staphylococcus aureus subsp. aureus Mu50
cuucaagugccauuuuuaa

SEQ ID NO: 3982312 - RNA, 19 nt, Staphylococcus aureus subsp. aureus Mu50
cuucaauauucuuaucauu

SEQ ID NO: 3982313 - RNA, 14 nt, Staphylococcus aureus subsp. aureus Mu50
cuucaauauuuaaa

SEQ ID NO: 3982314 - RNA, 16 nt, Staphylococcus aureus subsp. aureus Mu50
cuucaauccaagcaau

SEQ ID NO: 3982315 - RNA, 12 nt, Staphylococcus aureus subsp. aureus Mu50
cuucaauuauuu

SEQ ID NO: 3982316 - RNA, 18 nt, Staphylococcus aureus subsp. aureus Mu50
cuucaauucuuacaccug

SEQ ID NO: 3982317 - RNA, 21 nt, Staphylococcus aureus subsp. aureus Mu50
cuucaauucuuacaccugcaa

SEQ ID NO: 3982318 - RNA, 16 nt, Staphylococcus aureus subsp. aureus Mu50
cuucaauugucucaau

SEQ ID NO: 3982319 - RNA, 21 nt, Staphylococcus aureus subsp. aureus Mu50
cuucaauuuauuuuuauauga

SEQ ID NO: 3982320 - RNA, 23 nt, Staphylococcus aureus subsp. aureus Mu50
cuucuuuuugcguuuuuaaauaa

SEQ ID NO: 3982321 - RNA, 20 nt, Staphylococcus aureus subsp. aureus Mu50
cuucuuuuuguccccagccc

SEQ ID NO: 3982322 - RNA, 17 nt, Staphylococcus aureus subsp. aureus Mu50
cuucuuuuuuaucuaca

SEQ ID NO: 3982323 - RNA, 16 nt, Staphylococcus aureus subsp. aureus Mu50
cuucuuuuuuuaacuu

SEQ ID NO: 3982324 - RNA, 22 nt, Staphylococcus aureus subsp. aureus Mu50
cuugaaaauagccauauucaua

SEQ ID NO: 3982325 - RNA, 22 nt, Staphylococcus aureus subsp. aureus Mu50
cuugaaacaucuugauauucau

SEQ ID NO: 3982326 - RNA, 15 nt, Staphylococcus aureus subsp. aureus Mu50
cuugaaauuauuauu

SEQ ID NO: 3982327 - RNA, 17 nt, Staphylococcus aureus subsp. aureus Mu50
cuugaaauuauuauuua

SEQ ID NO: 3982328 - RNA, 16 nt, Staphylococcus aureus subsp. aureus Mu50
cuugaaccccauucac

SEQ ID NO: 3982329 - RNA, 17 nt, Staphylococcus aureus subsp. aureus Mu50
cuugaaccccauucacu

SEQ ID NO: 3982330 - RNA, 20 nt, Staphylococcus aureus subsp. aureus Mu50
cuugaaguacuuuaccacga

SEQ ID NO: 3982331 - RNA, 22 nt, Staphylococcus aureus subsp. aureus Mu50
cuugaaguuguuucuccaguuu

SEQ ID NO: 3982332 - RNA, 16 nt, Staphylococcus aureus subsp. aureus Mu50
cuugaauaauauauuu

SEQ ID NO: 3982333 - RNA, 22 nt, Staphylococcus aureus subsp. aureus Mu50
cuugaauaccuuuuauuauuuu

SEQ ID NO: 3982334 - RNA, 22 nt, Staphylococcus aureus subsp. aureus Mu50
cuugaauagugagcguauuauu

SEQ ID NO: 3982335 - RNA, 14 nt, Staphylococcus aureus subsp. aureus Mu50
cuugaauauuauuc

SEQ ID NO: 3982336 - RNA, 15 nt, Staphylococcus aureus subsp. aureus Mu50
cuugaauuuaauaag

SEQ ID NO: 3982337 - RNA, 18 nt, Staphylococcus aureus subsp. aureus Mu50
cuugaccacuuuuguuaa

SEQ ID NO: 3982338 - RNA, 23 nt, Staphylococcus aureus subsp. aureus Mu50
cuugaccacuuuuguuaaaaaau

SEQ ID NO: 3982339 - RNA, 15 nt, Staphylococcus aureus subsp. aureus Mu50
cuugaccuucaguuu

SEQ ID NO: 3982340 - RNA, 14 nt, Staphylococcus aureus subsp. aureus Mu50
cuugagcaucacuc

SEQ ID NO: 3982341 - RNA, 17 nt, Staphylococcus aureus subsp. aureus Mu50
cuugagcaucacucaac

SEQ ID NO: 3982342 - RNA, 13 nt, Staphylococcus aureus subsp. aureus Mu50
cuugauaaaaaau

SEQ ID NO: 3982343 - RNA, 23 nt, Staphylococcus aureus subsp. aureus Mu50
cuugauaucaucugcaagugcuu

SEQ ID NO: 3982344 - RNA, 20 nt, Staphylococcus aureus subsp. aureus Mu50
cuugaucauuauaaaauggu

SEQ ID NO: 3982345 - RNA, 16 nt, Staphylococcus aureus subsp. aureus Mu50
cuugaugaaacugauu

SEQ ID NO: 3982346 - RNA, 17 nt, Staphylococcus aureus subsp. aureus Mu50
cuugauggauauucaau

SEQ ID NO: 3982347 - RNA, 21 nt, Staphylococcus aureus subsp. aureus Mu50
cuugauucauuucgauuaauu

SEQ ID NO: 3982348 - RNA, 12 nt, Staphylococcus aureus subsp. aureus Mu50
cuugauucuuau

SEQ ID NO: 3982349 - RNA, 14 nt, Staphylococcus aureus subsp. aureus Mu50
cuugauuuaauuuu

SEQ ID NO: 3982350 - RNA, 17 nt, Staphylococcus aureus subsp. aureus Mu50
cuugauuuaauuuuuaa

SEQ ID NO: 3982351 - RNA, 19 nt, Staphylococcus aureus subsp. aureus Mu50
cuugcaaagacucaauuuc

SEQ ID NO: 3982352 - RNA, 21 nt, Staphylococcus aureus subsp. aureus Mu50
cuugcaaauauaucaucucua

SEQ ID NO: 3982353 - RNA, 16 nt, Staphylococcus aureus subsp. aureus Mu50
cuugcaagccaucaau

SEQ ID NO: 3982354 - RNA, 20 nt, Staphylococcus aureus subsp. aureus Mu50
cuugcauacgaauuaaaaua

SEQ ID NO: 3982355 - RNA, 22 nt, Staphylococcus aureus subsp. aureus Mu50
cuugccuggcaacguucuacuc

SEQ ID NO: 3982356 - RNA, 20 nt, Staphylococcus aureus subsp. aureus Mu50
cuugccuucaaauucucaau

SEQ ID NO: 3982357 - RNA, 16 nt, Staphylococcus aureus subsp. aureus Mu50
cuugcucaugagcaca

SEQ ID NO: 3982358 - RNA, 18 nt, Staphylococcus aureus subsp. aureus Mu50
cuugcuguucaacaucuu

SEQ ID NO: 3982359 - RNA, 22 nt, Staphylococcus aureus subsp. aureus Mu50
cuugcuucauuauauaauucuu

SEQ ID NO: 3982360 - RNA, 21 nt, Staphylococcus aureus subsp. aureus Mu50
cuugcuuugcauacauaucuu

SEQ ID NO: 3982361 - RNA, 20 nt, Staphylococcus aureus subsp. aureus Mu50
cuuggaaaauacuauacuga

SEQ ID NO: 3982362 - RNA, 21 nt, Staphylococcus aureus subsp. aureus Mu50
cuuggaaguaucugugaauau

SEQ ID NO: 3982363 - RNA, 22 nt, Staphylococcus aureus subsp. aureus Mu50
cuuggaauaauacguuuugcua

SEQ ID NO: 3982364 - RNA, 16 nt, Staphylococcus aureus subsp. aureus Mu50
cuuggacuaauaauug

SEQ ID NO: 3982365 - RNA, 15 nt, Staphylococcus aureus subsp. aureus Mu50
cuuggauaauugcau

SEQ ID NO: 3982366 - RNA, 17 nt, Staphylococcus aureus subsp. aureus Mu50
cuuggauuuuuugguuu

SEQ ID NO: 3982367 - RNA, 16 nt, Staphylococcus aureus subsp. aureus Mu50
cuuggcguauuuuuug

SEQ ID NO: 3982368 - RNA, 17 nt, Staphylococcus aureus subsp. aureus Mu50
cuuggcuuaaucucuuu

SEQ ID NO: 3982369 - RNA, 18 nt, Staphylococcus aureus subsp. aureus Mu50
cuugggacagaaaacaaa

SEQ ID NO: 3982370 - RNA, 17 nt, Staphylococcus aureus subsp. aureus Mu50
cuugggcugacauuuuu

SEQ ID NO: 3982371 - RNA, 19 nt, Staphylococcus aureus subsp. aureus Mu50
cuugggcugacauuuuugg

SEQ ID NO: 3982372 - RNA, 23 nt, Staphylococcus aureus subsp. aureus Mu50
cuugguacaccuacaaauauuuc

SEQ ID NO: 3982373 - RNA, 23 nt, Staphylococcus aureus subsp. aureus Mu50
cuugguauaagaggauuucuagc

SEQ ID NO: 3982374 - RNA, 23 nt, Staphylococcus aureus subsp. aureus Mu50
cuugguuauuaaaauuaaauaau

SEQ ID NO: 3982375 - RNA, 16 nt, Staphylococcus aureus subsp. aureus Mu50
cuugguucauaaugau

SEQ ID NO: 3982376 - RNA, 13 nt, Staphylococcus aureus subsp. aureus Mu50
cuuguaaaauuuu

SEQ ID NO: 3982377 - RNA, 19 nt, Staphylococcus aureus subsp. aureus Mu50
cuuguaaauuuauuuuuaa

SEQ ID NO: 3982378 - RNA, 23 nt, Staphylococcus aureus subsp. aureus Mu50
cuuguaaauuuauuuuuaauuuc

SEQ ID NO: 3982379 - RNA, 12 nt, Staphylococcus aureus subsp. aureus Mu50
cuuguaacaagc

SEQ ID NO: 3982380 - RNA, 17 nt, Staphylococcus aureus subsp. aureus Mu50
cuuguaacaagcauuuu

SEQ ID NO: 3982381 - RNA, 21 nt, Staphylococcus aureus subsp. aureus Mu50
cuuguaacaagcauuuuucaa

SEQ ID NO: 3982382 - RNA, 17 nt, Staphylococcus aureus subsp. aureus Mu50
cuuguaacaagcuuuuu

SEQ ID NO: 3982383 - RNA, 15 nt, Staphylococcus aureus subsp. aureus Mu50
cuuguaauauaacaa

SEQ ID NO: 3982384 - RNA, 22 nt, Staphylococcus aureus subsp. aureus Mu50
cuuguaauauuauaaccaccag

SEQ ID NO: 3982385 - RNA, 20 nt, Staphylococcus aureus subsp. aureus Mu50
cuuguaucaacauuaauaaa

SEQ ID NO: 3982386 - RNA, 18 nt, Staphylococcus aureus subsp. aureus Mu50
cuuguauuuccuuaauau

SEQ ID NO: 3982387 - RNA, 15 nt, Staphylococcus aureus subsp. aureus Mu50
cuugucaguuuuuuu

SEQ ID NO: 3982388 - RNA, 19 nt, Staphylococcus aureus subsp. aureus Mu50
cuuguccguuuuauauuua

SEQ ID NO: 3982389 - RNA, 17 nt, Staphylococcus aureus subsp. aureus Mu50
cuuguccucuaaaacau

SEQ ID NO: 3982390 - RNA, 15 nt, Staphylococcus aureus subsp. aureus Mu50
cuugugauaauucuu

SEQ ID NO: 3982391 - RNA, 19 nt, Staphylococcus aureus subsp. aureus Mu50
cuugugauaauucuucaac

SEQ ID NO: 3982392 - RNA, 15 nt, Staphylococcus aureus subsp. aureus Mu50
cuugugcuuaagaac

SEQ ID NO: 3982393 - RNA, 19 nt, Staphylococcus aureus subsp. aureus Mu50
cuugugguuggaagucugc

SEQ ID NO: 3982394 - RNA, 13 nt, Staphylococcus aureus subsp. aureus Mu50
cuuguuaaaauaa

SEQ ID NO: 3982395 - RNA, 23 nt, Staphylococcus aureus subsp. aureus Mu50
cuuguuacacaugaguuaaacga

SEQ ID NO: 3982396 - RNA, 13 nt, Staphylococcus aureus subsp. aureus Mu50
cuuguucuaauug

SEQ ID NO: 3982397 - RNA, 15 nt, Staphylococcus aureus subsp. aureus Mu50
cuuguucuaauuguu

SEQ ID NO: 3982398 - RNA, 19 nt, Staphylococcus aureus subsp. aureus Mu50
cuuguucuccgaucaugcc

SEQ ID NO: 3982399 - RNA, 13 nt, Staphylococcus aureus subsp. aureus Mu50
cuuguucuuuacu

SEQ ID NO: 3982400 - RNA, 16 nt, Staphylococcus aureus subsp. aureus Mu50
cuuguuggauuuuaac

SEQ ID NO: 3982401 - RNA, 18 nt, Staphylococcus aureus subsp. aureus Mu50
cuuguuggcuuuuuuaau

SEQ ID NO: 3982402 - RNA, 20 nt, Staphylococcus aureus subsp. aureus Mu50
cuuguugugaauaaaauugu

SEQ ID NO: 3982403 - RNA, 21 nt, Staphylococcus aureus subsp. aureus Mu50
cuuguuguucuguaaugauau

SEQ ID NO: 3982404 - RNA, 17 nt, Staphylococcus aureus subsp. aureus Mu50
cuuguuucaaacaaagc

SEQ ID NO: 3982405 - RNA, 18 nt, Staphylococcus aureus subsp. aureus Mu50
cuuguuuggaugacguuu

SEQ ID NO: 3982406 - RNA, 13 nt, Staphylococcus aureus subsp. aureus Mu50
cuuguuuuaaacu

SEQ ID NO: 3982407 - RNA, 22 nt, Staphylococcus aureus subsp. aureus Mu50
cuuucuugaugaauuaaacuga

SEQ ID NO: 3982408 - RNA, 13 nt, Staphylococcus aureus subsp. aureus Mu50
cuuucuuuuucau

SEQ ID NO: 3982409 - RNA, 16 nt, Staphylococcus aureus subsp. aureus Mu50
cuuucuuuuucaucuu

SEQ ID NO: 3982410 - RNA, 18 nt, Staphylococcus aureus subsp. aureus Mu50
cuuugaagggagcauuuc

SEQ ID NO: 3982411 - RNA, 19 nt, Staphylococcus aureus subsp. aureus Mu50
cuuugaagggagcauuuca

SEQ ID NO: 3982412 - RNA, 20 nt, Staphylococcus aureus subsp. aureus Mu50
cuuugaagggagcauuucac

SEQ ID NO: 3982413 - RNA, 18 nt, Staphylococcus aureus subsp. aureus Mu50
cuuugaagggguuuuuuc

SEQ ID NO: 3982414 - RNA, 19 nt, Staphylococcus aureus subsp. aureus Mu50
cuuugaagggguuuuuucu

SEQ ID NO: 3982415 - RNA, 22 nt, Staphylococcus aureus subsp. aureus Mu50
cuuugaagggguuuuuucuuau

SEQ ID NO: 3982416 - RNA, 20 nt, Staphylococcus aureus subsp. aureus Mu50
cuuugaauggcucguuuuuu

SEQ ID NO: 3982417 - RNA, 21 nt, Staphylococcus aureus subsp. aureus Mu50
cuuugaauugguugaucaauu

SEQ ID NO: 3982418 - RNA, 22 nt, Staphylococcus aureus subsp. aureus Mu50
cuuugacguuuugguuguucuu

SEQ ID NO: 3982419 - RNA, 19 nt, Staphylococcus aureus subsp. aureus Mu50
cuuugauaacaauuuuaaa

SEQ ID NO: 3982420 - RNA, 17 nt, Staphylococcus aureus subsp. aureus Mu50
cuuugauauguuuccuc

SEQ ID NO: 3982421 - RNA, 21 nt, Staphylococcus aureus subsp. aureus Mu50
cuuugauguucacuaaaugug

SEQ ID NO: 3982422 - RNA, 15 nt, Staphylococcus aureus subsp. aureus Mu50
cuuugauguuuucua

SEQ ID NO: 3982423 - RNA, 20 nt, Staphylococcus aureus subsp. aureus Mu50
cuuugccguauuucaaaugu

SEQ ID NO: 3982424 - RNA, 21 nt, Staphylococcus aureus subsp. aureus Mu50
cuuugcucaccuuuagacaau

SEQ ID NO: 3982425 - RNA, 21 nt, Staphylococcus aureus subsp. aureus Mu50
cuuugcuuaaaccuuaauaau

SEQ ID NO: 3982426 - RNA, 16 nt, Staphylococcus aureus subsp. aureus Mu50
cuuuggacuuuaaagu

SEQ ID NO: 3982427 - RNA, 18 nt, Staphylococcus aureus subsp. aureus Mu50
cuuuggauuucuuuuuaa

SEQ ID NO: 3982428 - RNA, 14 nt, Staphylococcus aureus subsp. aureus Mu50
cuuuggcaccagua

SEQ ID NO: 3982429 - RNA, 14 nt, Staphylococcus aureus subsp. aureus Mu50
cuuuggcuauuuua

SEQ ID NO: 3982430 - RNA, 21 nt, Staphylococcus aureus subsp. aureus Mu50
cuuuggugaaaguacuuggaa

SEQ ID NO: 3982431 - RNA, 14 nt, Staphylococcus aureus subsp. aureus Mu50
cuuuguaaauuuuu

SEQ ID NO: 3982432 - RNA, 18 nt, Staphylococcus aureus subsp. aureus Mu50
cuuuguaaccuaaaaaca

SEQ ID NO: 3982433 - RNA, 18 nt, Staphylococcus aureus subsp. aureus Mu50
cuuugucauacuaacuau

SEQ ID NO: 3982434 - RNA, 14 nt, Staphylococcus aureus subsp. aureus Mu50
cuuuguguuugcuu

SEQ ID NO: 3982435 - RNA, 17 nt, Staphylococcus aureus subsp. aureus Mu50
cuuuguguuugcuuuuu

SEQ ID NO: 3982436 - RNA, 19 nt, Staphylococcus aureus subsp. aureus Mu50
cuuuguuaggaucaaggaa

SEQ ID NO: 3982437 - RNA, 18 nt, Staphylococcus aureus subsp. aureus Mu50
cuuuguuauauuuuuagg

SEQ ID NO: 3982438 - RNA, 13 nt, Staphylococcus aureus subsp. aureus Mu50
cuuuguucugcuu

SEQ ID NO: 3982439 - RNA, 18 nt, Staphylococcus aureus subsp. aureus Mu50
cuuuguucugcuuuuucu

SEQ ID NO: 3982440 - RNA, 14 nt, Staphylococcus aureus subsp. aureus Mu50
cuuuguuggggccc

SEQ ID NO: 3982441 - RNA, 21 nt, Staphylococcus aureus subsp. aureus Mu50
cuuuguuggggcccacacccc

SEQ ID NO: 3982442 - RNA, 22 nt, Staphylococcus aureus subsp. aureus Mu50
cuuuguuggggcccacacccca

SEQ ID NO: 3982443 - RNA, 16 nt, Staphylococcus aureus subsp. aureus Mu50
cuuuguuuucaguaac

SEQ ID NO: 3982444 - RNA, 18 nt, Staphylococcus aureus subsp. aureus Mu50
cuuuuaaaccguguucuu

SEQ ID NO: 3982445 - RNA, 22 nt, Staphylococcus aureus subsp. aureus Mu50
cuuuuaaaccguguucuuuaau

SEQ ID NO: 3982446 - RNA, 16 nt, Staphylococcus aureus subsp. aureus Mu50
cuuuuaaauucuuaua

SEQ ID NO: 3982447 - RNA, 11 nt, Staphylococcus aureus subsp. aureus Mu50
cuuuuaaauuu

SEQ ID NO: 3982448 - RNA, 16 nt, Staphylococcus aureus subsp. aureus Mu50
cuuuuaauaucuucua

SEQ ID NO: 3982449 - RNA, 13 nt, Staphylococcus aureus subsp. aureus Mu50
cuuuuaaucaaau

SEQ ID NO: 3982450 - RNA, 20 nt, Staphylococcus aureus subsp. aureus Mu50
cuuuuaaucaaauuaucugu

SEQ ID NO: 3982451 - RNA, 18 nt, Staphylococcus aureus subsp. aureus Mu50
cuuuuacaaacuucacau

SEQ ID NO: 3982452 - RNA, 21 nt, Staphylococcus aureus subsp. aureus Mu50
cuuuuacagaacguucauaua

SEQ ID NO: 3982453 - RNA, 17 nt, Staphylococcus aureus subsp. aureus Mu50
cuuuuacgccuucuuua

SEQ ID NO: 3982454 - RNA, 12 nt, Staphylococcus aureus subsp. aureus Mu50
cuuuuagauuau

SEQ ID NO: 3982455 - RNA, 15 nt, Staphylococcus aureus subsp. aureus Mu50
cuuuuagauuaucuu

SEQ ID NO: 3982456 - RNA, 18 nt, Staphylococcus aureus subsp. aureus Mu50
cuuuuagauuaucuuuca

SEQ ID NO: 3982457 - RNA, 23 nt, Staphylococcus aureus subsp. aureus Mu50
cuuuuauacauguacauuaucac

SEQ ID NO: 3982458 - RNA, 13 nt, Staphylococcus aureus subsp. aureus Mu50
cuuuuauauuuuu

SEQ ID NO: 3982459 - RNA, 15 nt, Staphylococcus aureus subsp. aureus Mu50
cuuuuauauuuuuau

SEQ ID NO: 3982460 - RNA, 20 nt, Staphylococcus aureus subsp. aureus Mu50
cuuuuauccaauguauaaaa

SEQ ID NO: 3982461 - RNA, 15 nt, Staphylococcus aureus subsp. aureus Mu50
cuuuuaugcaugcgc

SEQ ID NO: 3982462 - RNA, 17 nt, Staphylococcus aureus subsp. aureus Mu50
cuuuuauggagugauau

SEQ ID NO: 3982463 - RNA, 23 nt, Staphylococcus aureus subsp. aureus Mu50
cuuuuauuaaagaaacaugauug

SEQ ID NO: 3982464 - RNA, 14 nt, Staphylococcus aureus subsp. aureus Mu50
cuuuuauuacuuau

SEQ ID NO: 3982465 - RNA, 17 nt, Staphylococcus aureus subsp. aureus Mu50
cuuuuauuuaucuuuua

SEQ ID NO: 3982466 - RNA, 19 nt, Staphylococcus aureus subsp. aureus Mu50
cuuuuauuuuuuauaaaga

SEQ ID NO: 3982467 - RNA, 17 nt, Staphylococcus aureus subsp. aureus Mu50
cuuuucaaacauauuca

SEQ ID NO: 3982468 - RNA, 18 nt, Staphylococcus aureus subsp. aureus Mu50
cuuuucaaacauauucau

SEQ ID NO: 3982469 - RNA, 22 nt, Staphylococcus aureus subsp. aureus Mu50
cuuuucaaacauauucauucua

SEQ ID NO: 3982470 - RNA, 18 nt, Staphylococcus aureus subsp. aureus Mu50
cuuuucaucguucauaua

SEQ ID NO: 3982471 - RNA, 19 nt, Staphylococcus aureus subsp. aureus Mu50
cuuuucauuaucauuaagu

SEQ ID NO: 3982472 - RNA, 21 nt, Staphylococcus aureus subsp. aureus Mu50
cuuuuccauaaauauuuaaaa

SEQ ID NO: 3982473 - RNA, 16 nt, Staphylococcus aureus subsp. aureus Mu50
cuuuuccuugauucuu

SEQ ID NO: 3982474 - RNA, 19 nt, Staphylococcus aureus subsp. aureus Mu50
cuuuuccuugauucuuaua

SEQ ID NO: 3982475 - RNA, 20 nt, Staphylococcus aureus subsp. aureus Mu50
cuuuucgcaaaucccuucuc

SEQ ID NO: 3982476 - RNA, 18 nt, Staphylococcus aureus subsp. aureus Mu50
cuuuucugucuguaaauu

SEQ ID NO: 3982477 - RNA, 18 nt, Staphylococcus aureus subsp. aureus Mu50
cuuuucuuugauaacaau

SEQ ID NO: 3982478 - RNA, 21 nt, Staphylococcus aureus subsp. aureus Mu50
cuuuugagacguuuuccauga

SEQ ID NO: 3982479 - RNA, 13 nt, Staphylococcus aureus subsp. aureus Mu50
cuuuugauagcua

SEQ ID NO: 3982480 - RNA, 15 nt, Staphylococcus aureus subsp. aureus Mu50
cuuuugauagcuaau

SEQ ID NO: 3982481 - RNA, 19 nt, Staphylococcus aureus subsp. aureus Mu50
cuuuugauagcuaaugcau

SEQ ID NO: 3982482 - RNA, 19 nt, Staphylococcus aureus subsp. aureus Mu50
cuuuugauccaaaguacuc

SEQ ID NO: 3982483 - RNA, 19 nt, Staphylococcus aureus subsp. aureus Mu50
cuuuugauuuuuuuguucu

SEQ ID NO: 3982484 - RNA, 16 nt, Staphylococcus aureus subsp. aureus Mu50
cuuuugcuguaucuuc

SEQ ID NO: 3982485 - RNA, 23 nt, Staphylococcus aureus subsp. aureus Mu50
cuuuuguaaagcuuuaguuaaau

SEQ ID NO: 3982486 - RNA, 13 nt, Staphylococcus aureus subsp. aureus Mu50
cuuuuguaaaugg

SEQ ID NO: 3982487 - RNA, 15 nt, Staphylococcus aureus subsp. aureus Mu50
cuuuuguaauugaaa

SEQ ID NO: 3982488 - RNA, 19 nt, Staphylococcus aureus subsp. aureus Mu50
cuuuuguaauugaaaugau

SEQ ID NO: 3982489 - RNA, 13 nt, Staphylococcus aureus subsp. aureus Mu50
cuuuuguuaaaaa

SEQ ID NO: 3982490 - RNA, 16 nt, Staphylococcus aureus subsp. aureus Mu50
cuuuuguuuaguaugg

SEQ ID NO: 3982491 - RNA, 19 nt, Staphylococcus aureus subsp. aureus Mu50
cuuuuguuuaguauggaau

SEQ ID NO: 3982492 - RNA, 18 nt, Staphylococcus aureus subsp. aureus Mu50
cuuuuguuuucacuguuu

SEQ ID NO: 3982493 - RNA, 16 nt, Staphylococcus aureus subsp. aureus Mu50
cuuuuuaaaaucguua

SEQ ID NO: 3982494 - RNA, 17 nt, Staphylococcus aureus subsp. aureus Mu50
gaaaauuauacaaauua

SEQ ID NO: 3982495 - RNA, 21 nt, Staphylococcus aureus subsp. aureus Mu50
gaaaauuauuugauauuucau

SEQ ID NO: 3982496 - RNA, 18 nt, Staphylococcus aureus subsp. aureus Mu50
gaaaauugaguauauuca

SEQ ID NO: 3982497 - RNA, 14 nt, Staphylococcus aureus subsp. aureus Mu50
gaaaauugcuaaaa

SEQ ID NO: 3982498 - RNA, 19 nt, Staphylococcus aureus subsp. aureus Mu50
gaaacaaaacaaaaaauau

SEQ ID NO: 3982499 - RNA, 13 nt, Staphylococcus aureus subsp. aureus Mu50
gaaacaaauuagu

SEQ ID NO: 3982500 - RNA, 16 nt, Staphylococcus aureus subsp. aureus Mu50
gaaacacacuaaaagc

SEQ ID NO: 3982501 - RNA, 21 nt, Staphylococcus aureus subsp. aureus Mu50
gaaaccgcuucucgccuaauu

SEQ ID NO: 3982502 - RNA, 17 nt, Staphylococcus aureus subsp. aureus Mu50
gaaaccuuguuuuacaa

SEQ ID NO: 3982503 - RNA, 21 nt, Staphylococcus aureus subsp. aureus Mu50
gaaaccuuucgauaaacuaca

SEQ ID NO: 3982504 - RNA, 14 nt, Staphylococcus aureus subsp. aureus Mu50
gaaacuuaaauauu

SEQ ID NO: 3982505 - RNA, 17 nt, Staphylococcus aureus subsp. aureus Mu50
gaaacuuccaacauaua

SEQ ID NO: 3982506 - RNA, 13 nt, Staphylococcus aureus subsp. aureus Mu50
gaaacuuguccgu

SEQ ID NO: 3982507 - RNA, 23 nt, Staphylococcus aureus subsp. aureus Mu50
gaaacuuuaagcugucauaccuu

SEQ ID NO: 3982508 - RNA, 23 nt, Staphylococcus aureus subsp. aureus Mu50
gaaagauuuguagcuugaauaau

SEQ ID NO: 3982509 - RNA, 14 nt, Staphylococcus aureus subsp. aureus Mu50
gaaaggaacauuuc

SEQ ID NO: 3982510 - RNA, 21 nt, Staphylococcus aureus subsp. aureus Mu50
gaaagguauaucuucauuuaa

SEQ ID NO: 3982511 - RNA, 14 nt, Staphylococcus aureus subsp. aureus Mu50
gaaaguaauaagua

SEQ ID NO: 3982512 - RNA, 22 nt, Staphylococcus aureus subsp. aureus Mu50
gaaaguaccuaaaauagaaaaa

SEQ ID NO: 3982513 - RNA, 20 nt, Staphylococcus aureus subsp. aureus Mu50
gaaagucaacaauugcuaau

SEQ ID NO: 3982514 - RNA, 18 nt, Staphylococcus aureus subsp. aureus Mu50
gaaagucguuguugaaau

SEQ ID NO: 3982515 - RNA, 23 nt, Staphylococcus aureus subsp. aureus Mu50
gaaagucuuuaacccaaauugau

SEQ ID NO: 3982516 - RNA, 16 nt, Staphylococcus aureus subsp. aureus Mu50
gaaagugauucccaaa

SEQ ID NO: 3982517 - RNA, 15 nt, Staphylococcus aureus subsp. aureus Mu50
gaaaguguaugcaug

SEQ ID NO: 3982518 - RNA, 19 nt, Staphylococcus aureus subsp. aureus Mu50
gaaaguuucgacguaccaa

SEQ ID NO: 3982519 - RNA, 20 nt, Staphylococcus aureus subsp. aureus Mu50
gaaaguuugaaggugauaau

SEQ ID NO: 3982520 - RNA, 14 nt, Staphylococcus aureus subsp. aureus Mu50
gaaauaaaaaauaa

SEQ ID NO: 3982521 - RNA, 22 nt, Staphylococcus aureus subsp. aureus Mu50
gaaauaaaacaagacuacgaau

SEQ ID NO: 3982522 - RNA, 19 nt, Staphylococcus aureus subsp. aureus Mu50
gaaauaauuuaaaggcaua

SEQ ID NO: 3982523 - RNA, 13 nt, Staphylococcus aureus subsp. aureus Mu50
gaaauacauccau

SEQ ID NO: 3982524 - RNA, 16 nt, Staphylococcus aureus subsp. aureus Mu50
gaaauaccuccugauu

SEQ ID NO: 3982525 - RNA, 23 nt, Staphylococcus aureus subsp. aureus Mu50
gaaauacgaugucagacgaauca

SEQ ID NO: 3982526 - RNA, 22 nt, Staphylococcus aureus subsp. aureus Mu50
gaaauacuugaauuuaauaagu

SEQ ID NO: 3982527 - RNA, 14 nt, Staphylococcus aureus subsp. aureus Mu50
gaaauagaaauguc

SEQ ID NO: 3982528 - RNA, 18 nt, Staphylococcus aureus subsp. aureus Mu50
gaaauaggcgcuuguaaa

SEQ ID NO: 3982529 - RNA, 21 nt, Staphylococcus aureus subsp. aureus Mu50
gaaauaggcgcuuguaaaauu

SEQ ID NO: 3982530 - RNA, 21 nt, Staphylococcus aureus subsp. aureus Mu50
gaaauagguaucuuaaagcau

SEQ ID NO: 3982531 - RNA, 15 nt, Staphylococcus aureus subsp. aureus Mu50
gaaauauaccaacca

SEQ ID NO: 3982532 - RNA, 16 nt, Staphylococcus aureus subsp. aureus Mu50
gaaauauauugucgac

SEQ ID NO: 3982533 - RNA, 13 nt, Staphylococcus aureus subsp. aureus Mu50
gaaauauuuaucu

SEQ ID NO: 3982534 - RNA, 15 nt, Staphylococcus aureus subsp. aureus Mu50
gaaauauuugaaaau

SEQ ID NO: 3982535 - RNA, 19 nt, Staphylococcus aureus subsp. aureus Mu50
gaaauauuugaaaauuuca

SEQ ID NO: 3982536 - RNA, 14 nt, Staphylococcus aureus subsp. aureus Mu50
gaaaucaaaaauaa

SEQ ID NO: 3982537 - RNA, 20 nt, Staphylococcus aureus subsp. aureus Mu50
gaaaucaaaaauaauuauga

SEQ ID NO: 3982538 - RNA, 16 nt, Staphylococcus aureus subsp. aureus Mu50
gaaaucaccagauuuu

SEQ ID NO: 3982539 - RNA, 17 nt, Staphylococcus aureus subsp. aureus Mu50
gaaaucaccagauuuua

SEQ ID NO: 3982540 - RNA, 18 nt, Staphylococcus aureus subsp. aureus Mu50
gaaaucaguuuuugaaua

SEQ ID NO: 3982541 - RNA, 16 nt, Staphylococcus aureus subsp. aureus Mu50
gaaauccgcauaaauu

SEQ ID NO: 3982542 - RNA, 19 nt, Staphylococcus aureus subsp. aureus Mu50
gaaauccgcauaaauuaga

SEQ ID NO: 3982543 - RNA, 21 nt, Staphylococcus aureus subsp. aureus Mu50
gaaauccucuuauaccaaggg

SEQ ID NO: 3982544 - RNA, 17 nt, Staphylococcus aureus subsp. aureus Mu50
gaaaucuuaaagauuuu

SEQ ID NO: 3982545 - RNA, 19 nt, Staphylococcus aureus subsp. aureus Mu50
gaaaucuuuuguaagacuu

SEQ ID NO: 3982546 - RNA, 13 nt, Staphylococcus aureus subsp. aureus Mu50
gaaauggaaagua

SEQ ID NO: 3982547 - RNA, 11 nt, Staphylococcus aureus subsp. aureus Mu50
gaaauggcucc

SEQ ID NO: 3982548 - RNA, 15 nt, Staphylococcus aureus subsp. aureus Mu50
gaaauguagauuacu

SEQ ID NO: 3982549 - RNA, 21 nt, Staphylococcus aureus subsp. aureus Mu50
gaaauguaugauauaaaccau

SEQ ID NO: 3982550 - RNA, 22 nt, Staphylococcus aureus subsp. aureus Mu50
gaaaugucauagccuauuuaaa

SEQ ID NO: 3982551 - RNA, 21 nt, Staphylococcus aureus subsp. aureus Mu50
gaaauguuuaucaauucccug

SEQ ID NO: 3982552 - RNA, 18 nt, Staphylococcus aureus subsp. aureus Mu50
gaaauguuuuggaaaaau

SEQ ID NO: 3982553 - RNA, 14 nt, Staphylococcus aureus subsp. aureus Mu50
gaaauuaaaucgac

SEQ ID NO: 3982554 - RNA, 14 nt, Staphylococcus aureus subsp. aureus Mu50
gaaauuagauuuua

SEQ ID NO: 3982555 - RNA, 16 nt, Staphylococcus aureus subsp. aureus Mu50
gaaauuauuauuuaaa

SEQ ID NO: 3982556 - RNA, 21 nt, Staphylococcus aureus subsp. aureus Mu50
gaaauucuacaaacaaugcaa

SEQ ID NO: 3982557 - RNA, 16 nt, Staphylococcus aureus subsp. aureus Mu50
gaaauucuacaggcaa

SEQ ID NO: 3982558 - RNA, 21 nt, Staphylococcus aureus subsp. aureus Mu50
gaaauucuacaggcaaugcaa

SEQ ID NO: 3982559 - RNA, 23 nt, Staphylococcus aureus subsp. aureus Mu50
gaaauucuacaggcaaugcaagu

SEQ ID NO: 3982560 - RNA, 16 nt, Staphylococcus aureus subsp. aureus Mu50
gaaauucuacagguaa

SEQ ID NO: 3982561 - RNA, 21 nt, Staphylococcus aureus subsp. aureus Mu50
gaaauucuacagguaaugcaa

SEQ ID NO: 3982562 - RNA, 23 nt, Staphylococcus aureus subsp. aureus Mu50
gaaauucuacagguaaugcaagu

SEQ ID NO: 3982563 - RNA, 20 nt, Staphylococcus aureus subsp. aureus Mu50
gaaauucucaguguuggggg

SEQ ID NO: 3982564 - RNA, 20 nt, Staphylococcus aureus subsp. aureus Mu50
gaaauucucuuuguuggggc

SEQ ID NO: 3982565 - RNA, 21 nt, Staphylococcus aureus subsp. aureus Mu50
gaaauucucuuuguuggggcc

SEQ ID NO: 3982566 - RNA, 16 nt, Staphylococcus aureus subsp. aureus Mu50
gaaauucuuuuguaau

SEQ ID NO: 3982567 - RNA, 14 nt, Staphylococcus aureus subsp. aureus Mu50
gaaauugaagcguu

SEQ ID NO: 3982568 - RNA, 18 nt, Staphylococcus aureus subsp. aureus Mu50
gaaauuguguuucuuuua

SEQ ID NO: 3982569 - RNA, 13 nt, Staphylococcus aureus subsp. aureus Mu50
gaaauuuauuaua

SEQ ID NO: 3982570 - RNA, 21 nt, Staphylococcus aureus subsp. aureus Mu50
gaaauuuauuauaaaauagaa

SEQ ID NO: 3982571 - RNA, 16 nt, Staphylococcus aureus subsp. aureus Mu50
gaaauuuauuauaauu

SEQ ID NO: 3982572 - RNA, 22 nt, Staphylococcus aureus subsp. aureus Mu50
gaaauuuuucacuucaaacaaa

SEQ ID NO: 3982573 - RNA, 17 nt, Staphylococcus aureus subsp. aureus Mu50
gaaauuuuuuagugaaa

SEQ ID NO: 3982574 - RNA, 15 nt, Staphylococcus aureus subsp. aureus Mu50
gaacaaaaaauaaaa

SEQ ID NO: 3982575 - RNA, 16 nt, Staphylococcus aureus subsp. aureus Mu50
gaacaagucuugcaau

SEQ ID NO: 3982576 - RNA, 13 nt, Staphylococcus aureus subsp. aureus Mu50
gaacaauaauaug

SEQ ID NO: 3982577 - RNA, 19 nt, Staphylococcus aureus subsp. aureus Mu50
gaacaauaccgccuacugu

SEQ ID NO: 3982578 - RNA, 17 nt, Staphylococcus aureus subsp. aureus Mu50
gaacacgaaauggugaa

SEQ ID NO: 3982579 - RNA, 19 nt, Staphylococcus aureus subsp. aureus Mu50
gaacagcaucuuguucuuc

SEQ ID NO: 3982580 - RNA, 19 nt, Staphylococcus aureus subsp. aureus Mu50
gaacagcggaauacagaug

SEQ ID NO: 3982581 - RNA, 15 nt, Staphylococcus aureus subsp. aureus Mu50
gaauauucagauuuu

SEQ ID NO: 3982582 - RNA, 16 nt, Staphylococcus aureus subsp. aureus Mu50
gaauauuguauugauc

SEQ ID NO: 3982583 - RNA, 23 nt, Staphylococcus aureus subsp. aureus Mu50
gaauauuuauuguuuuuaaaauc

SEQ ID NO: 3982584 - RNA, 22 nt, Staphylococcus aureus subsp. aureus Mu50
gaaucaacaauuuaaacgcacu

SEQ ID NO: 3982585 - RNA, 12 nt, Staphylococcus aureus subsp. aureus Mu50
gaaucacauuaa

SEQ ID NO: 3982586 - RNA, 21 nt, Staphylococcus aureus subsp. aureus Mu50
gaaucagaugauuuaauucug

SEQ ID NO: 3982587 - RNA, 19 nt, Staphylococcus aureus subsp. aureus Mu50
gaaucccauaacaaucauu

SEQ ID NO: 3982588 - RNA, 14 nt, Staphylococcus aureus subsp. aureus Mu50
gaaucccauaauga

SEQ ID NO: 3982589 - RNA, 14 nt, Staphylococcus aureus subsp. aureus Mu50
gaauccuaaaaagc

SEQ ID NO: 3982590 - RNA, 12 nt, Staphylococcus aureus subsp. aureus Mu50
gaauccuuaauu

SEQ ID NO: 3982591 - RNA, 13 nt, Staphylococcus aureus subsp. aureus Mu50
gaauccuucauca

SEQ ID NO: 3982592 - RNA, 18 nt, Staphylococcus aureus subsp. aureus Mu50
gaaucgaaaauaucaauu

SEQ ID NO: 3982593 - RNA, 14 nt, Staphylococcus aureus subsp. aureus Mu50
gaaucggugucuuu

SEQ ID NO: 3982594 - RNA, 15 nt, Staphylococcus aureus subsp. aureus Mu50
gaaucuaaacuauaa

SEQ ID NO: 3982595 - RNA, 21 nt, Staphylococcus aureus subsp. aureus Mu50
gaaugaaaauaagcuuguaac

SEQ ID NO: 3982596 - RNA, 14 nt, Staphylococcus aureus subsp. aureus Mu50
gaaugaaguaauau

SEQ ID NO: 3982597 - RNA, 14 nt, Staphylococcus aureus subsp. aureus Mu50
gaaugaauaauucc

SEQ ID NO: 3982598 - RNA, 19 nt, Staphylococcus aureus subsp. aureus Mu50
gaaugagugucaugcuuaa

SEQ ID NO: 3982599 - RNA, 18 nt, Staphylococcus aureus subsp. aureus Mu50
gaaugauacgccuaaaua

SEQ ID NO: 3982600 - RNA, 14 nt, Staphylococcus aureus subsp. aureus Mu50
gaaugauagauuua

SEQ ID NO: 3982601 - RNA, 17 nt, Staphylococcus aureus subsp. aureus Mu50
gaaugaugaguauacuu

SEQ ID NO: 3982602 - RNA, 14 nt, Staphylococcus aureus subsp. aureus Mu50
gaaugauuuauaaa

SEQ ID NO: 3982603 - RNA, 21 nt, Staphylococcus aureus subsp. aureus Mu50
gaaugcaaaucaaauacauca

SEQ ID NO: 3982604 - RNA, 13 nt, Staphylococcus aureus subsp. aureus Mu50
gaaugguauaauu

SEQ ID NO: 3982605 - RNA, 19 nt, Staphylococcus aureus subsp. aureus Mu50
gaaugguugucuccacacu

SEQ ID NO: 3982606 - RNA, 18 nt, Staphylococcus aureus subsp. aureus Mu50
gaauguauucuaagaguu

SEQ ID NO: 3982607 - RNA, 13 nt, Staphylococcus aureus subsp. aureus Mu50
gaauguuccuugu

SEQ ID NO: 3982608 - RNA, 15 nt, Staphylococcus aureus subsp. aureus Mu50
gaauuaacaacaaau

SEQ ID NO: 3982609 - RNA, 23 nt, Staphylococcus aureus subsp. aureus Mu50
gaauuaauaauuuuuuuccuuuc

SEQ ID NO: 3982610 - RNA, 16 nt, Staphylococcus aureus subsp. aureus Mu50
gaauuaguacuugaaa

SEQ ID NO: 3982611 - RNA, 17 nt, Staphylococcus aureus subsp. aureus Mu50
gaauuaucuuuacgaua

SEQ ID NO: 3982612 - RNA, 17 nt, Staphylococcus aureus subsp. aureus Mu50
gaauuauucaaguaaua

SEQ ID NO: 3982613 - RNA, 16 nt, Staphylococcus aureus subsp. aureus Mu50
gaauuauuuagaaacu

SEQ ID NO: 3982614 - RNA, 16 nt, Staphylococcus aureus subsp. aureus Mu50
gaauucaaccaauuau

SEQ ID NO: 3982615 - RNA, 22 nt, Staphylococcus aureus subsp. aureus Mu50
gaauucaaccaauuauuaaagc

SEQ ID NO: 3982616 - RNA, 11 nt, Staphylococcus aureus subsp. aureus Mu50
gaauucaacgu

SEQ ID NO: 3982617 - RNA, 22 nt, Staphylococcus aureus subsp. aureus Mu50
gaauucaacgucgaauguuucu

SEQ ID NO: 3982618 - RNA, 13 nt, Staphylococcus aureus subsp. aureus Mu50
gaauucauucaau

SEQ ID NO: 3982619 - RNA, 18 nt, Staphylococcus aureus subsp. aureus Mu50
gaauucauucaauacgaa

SEQ ID NO: 3982620 - RNA, 14 nt, Staphylococcus aureus subsp. aureus Mu50
gaauucuaaaagaa

SEQ ID NO: 3982621 - RNA, 21 nt, Staphylococcus aureus subsp. aureus Mu50
gaauucuaaaagaauuauuca

SEQ ID NO: 3982622 - RNA, 17 nt, Staphylococcus aureus subsp. aureus Mu50
gaauugaaaaauuaaaa

SEQ ID NO: 3982623 - RNA, 13 nt, Staphylococcus aureus subsp. aureus Mu50
gaauugaguauua

SEQ ID NO: 3982624 - RNA, 20 nt, Staphylococcus aureus subsp. aureus Mu50
gaauugauggaaaaguuuuu

SEQ ID NO: 3982625 - RNA, 19 nt, Staphylococcus aureus subsp. aureus Mu50
gaauugccagaauucccaa

SEQ ID NO: 3982626 - RNA, 16 nt, Staphylococcus aureus subsp. aureus Mu50
gaauuguauuagcaau

SEQ ID NO: 3982627 - RNA, 19 nt, Staphylococcus aureus subsp. aureus Mu50
gaauugucuuaauaugcaa

SEQ ID NO: 3982628 - RNA, 23 nt, Staphylococcus aureus subsp. aureus Mu50
gaauuuacuccuuacaauaaaga

SEQ ID NO: 3982629 - RNA, 23 nt, Staphylococcus aureus subsp. aureus Mu50
gaauuuagaugcauaaaaaaaga

SEQ ID NO: 3982630 - RNA, 22 nt, Staphylococcus aureus subsp. aureus Mu50
gaauuuagcaucaaaaauaaaa

SEQ ID NO: 3982631 - RNA, 21 nt, Staphylococcus aureus subsp. aureus Mu50
gaauuuagggaauugaucgaa

SEQ ID NO: 3982632 - RNA, 15 nt, Staphylococcus aureus subsp. aureus Mu50
gaauuucgaaaagaa

SEQ ID NO: 3982633 - RNA, 17 nt, Staphylococcus aureus subsp. aureus Mu50
gaauuucgaaaagaaau

SEQ ID NO: 3982634 - RNA, 18 nt, Staphylococcus aureus subsp. aureus Mu50
gaauuucgaaaagaaauu

SEQ ID NO: 3982635 - RNA, 23 nt, Staphylococcus aureus subsp. aureus Mu50
gaauuucguuauuaaacuacgaa

SEQ ID NO: 3982636 - RNA, 18 nt, Staphylococcus aureus subsp. aureus Mu50
gaauuucuaauuaaacgc

SEQ ID NO: 3982637 - RNA, 12 nt, Staphylococcus aureus subsp. aureus Mu50
gaauuuuauaaa

SEQ ID NO: 3982638 - RNA, 23 nt, Staphylococcus aureus subsp. aureus Mu50
gaauuuuuauuuuuaguaauagu

SEQ ID NO: 3982639 - RNA, 15 nt, Staphylococcus aureus subsp. aureus Mu50
gacaaaacuuguaau

SEQ ID NO: 3982640 - RNA, 13 nt, Staphylococcus aureus subsp. aureus Mu50
gacaaauguucua

SEQ ID NO: 3982641 - RNA, 18 nt, Staphylococcus aureus subsp. aureus Mu50
gacaaauguucuauagaa

SEQ ID NO: 3982642 - RNA, 13 nt, Staphylococcus aureus subsp. aureus Mu50
gacaaauuaaaaa

SEQ ID NO: 3982643 - RNA, 23 nt, Staphylococcus aureus subsp. aureus Mu50
gacaacuaauaacaaauaguuca

SEQ ID NO: 3982644 - RNA, 14 nt, Staphylococcus aureus subsp. aureus Mu50
gacaacugauuuaa

SEQ ID NO: 3982645 - RNA, 15 nt, Staphylococcus aureus subsp. aureus Mu50
gacaacugauuuaau

SEQ ID NO: 3982646 - RNA, 13 nt, Staphylococcus aureus subsp. aureus Mu50
gacaacuucacgc

SEQ ID NO: 3982647 - RNA, 23 nt, Staphylococcus aureus subsp. aureus Mu50
gacaaguauacuugaagaaucag

SEQ ID NO: 3982648 - RNA, 14 nt, Staphylococcus aureus subsp. aureus Mu50
gacaaguaugucau

SEQ ID NO: 3982649 - RNA, 19 nt, Staphylococcus aureus subsp. aureus Mu50
gacaaguugcugaauaaaa

SEQ ID NO: 3982650 - RNA, 22 nt, Staphylococcus aureus subsp. aureus Mu50
gacaaguugcugaauaaaauau

SEQ ID NO: 3982651 - RNA, 17 nt, Staphylococcus aureus subsp. aureus Mu50
gacaaucuuaucauaau

SEQ ID NO: 3982652 - RNA, 12 nt, Staphylococcus aureus subsp. aureus Mu50
gacaauuauaau

SEQ ID NO: 3982653 - RNA, 19 nt, Staphylococcus aureus subsp. aureus Mu50
gacaauuauaauaaaacuu

SEQ ID NO: 3982654 - RNA, 23 nt, Staphylococcus aureus subsp. aureus Mu50
gacaauugcgaccauuaguacua

SEQ ID NO: 3982655 - RNA, 22 nt, Staphylococcus aureus subsp. aureus Mu50
gacagcaguaggauaauuucaa

SEQ ID NO: 3982656 - RNA, 13 nt, Staphylococcus aureus subsp. aureus Mu50
gacagcuacaauu

SEQ ID NO: 3982657 - RNA, 11 nt, Staphylococcus aureus subsp. aureus Mu50
gacaguuuuua

SEQ ID NO: 3982658 - RNA, 16 nt, Staphylococcus aureus subsp. aureus Mu50
gacauaaaacuuacau

SEQ ID NO: 3982659 - RNA, 13 nt, Staphylococcus aureus subsp. aureus Mu50
gacauaaauaugg

SEQ ID NO: 3982660 - RNA, 15 nt, Staphylococcus aureus subsp. aureus Mu50
gacauaaauauggau

SEQ ID NO: 3982661 - RNA, 14 nt, Staphylococcus aureus subsp. aureus Mu50
gacauaaggucuug

SEQ ID NO: 3982662 - RNA, 22 nt, Staphylococcus aureus subsp. aureus Mu50
gacauacucacaaaaaacacua

SEQ ID NO: 3982663 - RNA, 18 nt, Staphylococcus aureus subsp. aureus Mu50
gacauagaucaauauucu

SEQ ID NO: 3982664 - RNA, 15 nt, Staphylococcus aureus subsp. aureus Mu50
gacauauaaauguug

SEQ ID NO: 3982665 - RNA, 18 nt, Staphylococcus aureus subsp. aureus Mu50
gacaucaauaucuucuuc

SEQ ID NO: 3982666 - RNA, 15 nt, Staphylococcus aureus subsp. aureus Mu50
gacaucaucuauaau

SEQ ID NO: 3982667 - RNA, 15 nt, Staphylococcus aureus subsp. aureus Mu50
gacaucauuguuuua

SEQ ID NO: 3982668 - RNA, 22 nt, Staphylococcus aureus subsp. aureus Mu50
gacaucgucuucuuuuuguccc

SEQ ID NO: 3982669 - RNA, 17 nt, Staphylococcus aureus subsp. aureus Mu50
gagagauguauaaaacu

SEQ ID NO: 3982670 - RNA, 22 nt, Staphylococcus aureus subsp. aureus Mu50
gagagauuauuuaaaacuugua

SEQ ID NO: 3982671 - RNA, 20 nt, Staphylococcus aureus subsp. aureus Mu50
gagaugaggcgauaaaagaa

SEQ ID NO: 3982672 - RNA, 15 nt, Staphylococcus aureus subsp. aureus Mu50
gagauuguaagaauu

SEQ ID NO: 3982673 - RNA, 21 nt, Staphylococcus aureus subsp. aureus Mu50
gagauuguuauuauaaacuac

SEQ ID NO: 3982674 - RNA, 14 nt, Staphylococcus aureus subsp. aureus Mu50
gagauuuucaacac

SEQ ID NO: 3982675 - RNA, 20 nt, Staphylococcus aureus subsp. aureus Mu50
gagcaaagcuuuuuugcuuu

SEQ ID NO: 3982676 - RNA, 16 nt, Staphylococcus aureus subsp. aureus Mu50
gagcaacgauaccaaa

SEQ ID NO: 3982677 - RNA, 19 nt, Staphylococcus aureus subsp. aureus Mu50
gagcaauucuucaauuuca

SEQ ID NO: 3982678 - RNA, 20 nt, Staphylococcus aureus subsp. aureus Mu50
gagcaauucuugaaaaguuu

SEQ ID NO: 3982679 - RNA, 15 nt, Staphylococcus aureus subsp. aureus Mu50
gagcacuaucuuuug

SEQ ID NO: 3982680 - RNA, 19 nt, Staphylococcus aureus subsp. aureus Mu50
gagcacuaucuuuugcuuc

SEQ ID NO: 3982681 - RNA, 22 nt, Staphylococcus aureus subsp. aureus Mu50
gagcaguauauaucaaauacau

SEQ ID NO: 3982682 - RNA, 21 nt, Staphylococcus aureus subsp. aureus Mu50
gagcauuuuuauauccaucuc

SEQ ID NO: 3982683 - RNA, 18 nt, Staphylococcus aureus subsp. aureus Mu50
gagccauuauuauuuuuu

SEQ ID NO: 3982684 - RNA, 22 nt, Staphylococcus aureus subsp. aureus Mu50
gagccauuauuauuuuuuucuu

SEQ ID NO: 3982685 - RNA, 20 nt, Staphylococcus aureus subsp. aureus Mu50
gagcgaccgugguucaaaaa

SEQ ID NO: 3982686 - RNA, 14 nt, Staphylococcus aureus subsp. aureus Mu50
gagcggaagauagg

SEQ ID NO: 3982687 - RNA, 15 nt, Staphylococcus aureus subsp. aureus Mu50
gagcggaagauagga

SEQ ID NO: 3982688 - RNA, 20 nt, Staphylococcus aureus subsp. aureus Mu50
gagcuaauaugucuagacuu

SEQ ID NO: 3982689 - RNA, 22 nt, Staphylococcus aureus subsp. aureus Mu50
gaggauuguguaaugagauuau

SEQ ID NO: 3982690 - RNA, 13 nt, Staphylococcus aureus subsp. aureus Mu50
gaggauuucuagc

SEQ ID NO: 3982691 - RNA, 22 nt, Staphylococcus aureus subsp. aureus Mu50
gaggcacagcggaauacagaug

SEQ ID NO: 3982692 - RNA, 14 nt, Staphylococcus aureus subsp. aureus Mu50
gaggcgauaaaaga

SEQ ID NO: 3982693 - RNA, 17 nt, Staphylococcus aureus subsp. aureus Mu50
gaggucaucaaaaguuu

SEQ ID NO: 3982694 - RNA, 19 nt, Staphylococcus aureus subsp. aureus Mu50
gaguaaauuaauagagaaa

SEQ ID NO: 3982695 - RNA, 21 nt, Staphylococcus aureus subsp. aureus Mu50
gaguaaugaccggcauauaau

SEQ ID NO: 3982696 - RNA, 21 nt, Staphylococcus aureus subsp. aureus Mu50
gaguaguucggaugagaaaug

SEQ ID NO: 3982697 - RNA, 20 nt, Staphylococcus aureus subsp. aureus Mu50
gaguauacuuacugaaacua

SEQ ID NO: 3982698 - RNA, 13 nt, Staphylococcus aureus subsp. aureus Mu50
gaguauaucagcu

SEQ ID NO: 3982699 - RNA, 18 nt, Staphylococcus aureus subsp. aureus Mu50
gaguaucaugcuuuuaau

SEQ ID NO: 3982700 - RNA, 16 nt, Staphylococcus aureus subsp. aureus Mu50
gaguauuuuuuauguu

SEQ ID NO: 3982701 - RNA, 12 nt, Staphylococcus aureus subsp. aureus Mu50
gagugauagaaa

SEQ ID NO: 3982702 - RNA, 15 nt, Staphylococcus aureus subsp. aureus Mu50
gagugcacuuguaau

SEQ ID NO: 3982703 - RNA, 14 nt, Staphylococcus aureus subsp. aureus Mu50
gaguuaauccucau

SEQ ID NO: 3982704 - RNA, 12 nt, Staphylococcus aureus subsp. aureus Mu50
gaguuauaucuu

SEQ ID NO: 3982705 - RNA, 16 nt, Staphylococcus aureus subsp. aureus Mu50
gaguucaauuaaauua

SEQ ID NO: 3982706 - RNA, 17 nt, Staphylococcus aureus subsp. aureus Mu50
gaguuuaaucgcauugu

SEQ ID NO: 3982707 - RNA, 13 nt, Staphylococcus aureus subsp. aureus Mu50
gauaaaacuaaug

SEQ ID NO: 3982708 - RNA, 15 nt, Staphylococcus aureus subsp. aureus Mu50
gauaaaaguuguauu

SEQ ID NO: 3982709 - RNA, 13 nt, Staphylococcus aureus subsp. aureus Mu50
gauaaaaugauau

SEQ ID NO: 3982710 - RNA, 21 nt, Staphylococcus aureus subsp. aureus Mu50
gauaaacaagccaagauaaau

SEQ ID NO: 3982711 - RNA, 14 nt, Staphylococcus aureus subsp. aureus Mu50
gauaaacuacacac

SEQ ID NO: 3982712 - RNA, 15 nt, Staphylococcus aureus subsp. aureus Mu50
gauaaacuacacacg

SEQ ID NO: 3982713 - RNA, 17 nt, Staphylococcus aureus subsp. aureus Mu50
gauaaauaaaaggcauu

SEQ ID NO: 3982714 - RNA, 13 nt, Staphylococcus aureus subsp. aureus Mu50
gauaaauaaugca

SEQ ID NO: 3982715 - RNA, 19 nt, Staphylococcus aureus subsp. aureus Mu50
gauaaaugaauugucuuaa

SEQ ID NO: 3982716 - RNA, 17 nt, Staphylococcus aureus subsp. aureus Mu50
gauaaauguauuaaaca

SEQ ID NO: 3982717 - RNA, 21 nt, Staphylococcus aureus subsp. aureus Mu50
gauaaauuaacuuagguuauu

SEQ ID NO: 3982718 - RNA, 16 nt, Staphylococcus aureus subsp. aureus Mu50
gauaaauuaauaugaa

SEQ ID NO: 3982719 - RNA, 22 nt, Staphylococcus aureus subsp. aureus Mu50
gauaaauugaguuuuuuaaaau

SEQ ID NO: 3982720 - RNA, 20 nt, Staphylococcus aureus subsp. aureus Mu50
gauaaauuuuuaguuaaagu

SEQ ID NO: 3982721 - RNA, 21 nt, Staphylococcus aureus subsp. aureus Mu50
gauaacaauuuuaaaucuuuu

SEQ ID NO: 3982722 - RNA, 22 nt, Staphylococcus aureus subsp. aureus Mu50
gauaacaauuuuaaaucuuuua

SEQ ID NO: 3982723 - RNA, 17 nt, Staphylococcus aureus subsp. aureus Mu50
gauaacgagugaaaaua

SEQ ID NO: 3982724 - RNA, 13 nt, Staphylococcus aureus subsp. aureus Mu50
gauaagaaaauac

SEQ ID NO: 3982725 - RNA, 20 nt, Staphylococcus aureus subsp. aureus Mu50
gauaagaagagccagaaacc

SEQ ID NO: 3982726 - RNA, 21 nt, Staphylococcus aureus subsp. aureus Mu50
gauaagaaucaucuaaaugca

SEQ ID NO: 3982727 - RNA, 23 nt, Staphylococcus aureus subsp. aureus Mu50
gauaagaauuaacaacaaauaua

SEQ ID NO: 3982728 - RNA, 19 nt, Staphylococcus aureus subsp. aureus Mu50
gauaaguggauuuucuccc

SEQ ID NO: 3982729 - RNA, 18 nt, Staphylococcus aureus subsp. aureus Mu50
gauaauaaggaagcguau

SEQ ID NO: 3982730 - RNA, 17 nt, Staphylococcus aureus subsp. aureus Mu50
gauaauacuguuuaaau

SEQ ID NO: 3982731 - RNA, 23 nt, Staphylococcus aureus subsp. aureus Mu50
gauaauagccauucgaugcuaaa

SEQ ID NO: 3982732 - RNA, 18 nt, Staphylococcus aureus subsp. aureus Mu50
gauaauagcuugagcauc

SEQ ID NO: 3982733 - RNA, 18 nt, Staphylococcus aureus subsp. aureus Mu50
gauaauccaccaaauaca

SEQ ID NO: 3982734 - RNA, 21 nt, Staphylococcus aureus subsp. aureus Mu50
gauaaugauaguguaugaaug

SEQ ID NO: 3982735 - RNA, 21 nt, Staphylococcus aureus subsp. aureus Mu50
gauaaugcaccugugauaacu

SEQ ID NO: 3982736 - RNA, 22 nt, Staphylococcus aureus subsp. aureus Mu50
gauaauguaauuguuuuuucuu

SEQ ID NO: 3982737 - RNA, 19 nt, Staphylococcus aureus subsp. aureus Mu50
gauaauuaaaauaagauau

SEQ ID NO: 3982738 - RNA, 12 nt, Staphylococcus aureus subsp. aureus Mu50
gauaauuauuag

SEQ ID NO: 3982739 - RNA, 13 nt, Staphylococcus aureus subsp. aureus Mu50
gauaauuucuucu

SEQ ID NO: 3982740 - RNA, 18 nt, Staphylococcus aureus subsp. aureus Mu50
gauaauuugagaaaugaa

SEQ ID NO: 3982741 - RNA, 19 nt, Staphylococcus aureus subsp. aureus Mu50
gauaauuugagaaaugaaa

SEQ ID NO: 3982742 - RNA, 15 nt, Staphylococcus aureus subsp. aureus Mu50
gauaauuuuuaacag

SEQ ID NO: 3982743 - RNA, 18 nt, Staphylococcus aureus subsp. aureus Mu50
gauacaaacccauauaaa

SEQ ID NO: 3982744 - RNA, 13 nt, Staphylococcus aureus subsp. aureus Mu50
gauacaaaccuaa

SEQ ID NO: 3982745 - RNA, 17 nt, Staphylococcus aureus subsp. aureus Mu50
gauacaaaccuaacacu

SEQ ID NO: 3982746 - RNA, 18 nt, Staphylococcus aureus subsp. aureus Mu50
gauacaaaggauuauuaa

SEQ ID NO: 3982747 - RNA, 21 nt, Staphylococcus aureus subsp. aureus Mu50
gauacacguaacgcaguugaa

SEQ ID NO: 3982748 - RNA, 13 nt, Staphylococcus aureus subsp. aureus Mu50
gauacagaaccaa

SEQ ID NO: 3982749 - RNA, 15 nt, Staphylococcus aureus subsp. aureus Mu50
gauacauucuauuaa

SEQ ID NO: 3982750 - RNA, 16 nt, Staphylococcus aureus subsp. aureus Mu50
gauaccaaacugccua

SEQ ID NO: 3982751 - RNA, 23 nt, Staphylococcus aureus subsp. aureus Mu50
gauaccaaacugccuaauacacu

SEQ ID NO: 3982752 - RNA, 15 nt, Staphylococcus aureus subsp. aureus Mu50
gauaccaaauauauu

SEQ ID NO: 3982753 - RNA, 22 nt, Staphylococcus aureus subsp. aureus Mu50
gauaccagccagcuuagcauag

SEQ ID NO: 3982754 - RNA, 14 nt, Staphylococcus aureus subsp. aureus Mu50
gauaccuaaaauac

SEQ ID NO: 3982755 - RNA, 23 nt, Staphylococcus aureus subsp. aureus Mu50
gauaccucauccgccaauuaaaa

SEQ ID NO: 3982756 - RNA, 14 nt, Staphylococcus aureus subsp. aureus Mu50
gaugauucuuauca

SEQ ID NO: 3982757 - RNA, 23 nt, Staphylococcus aureus subsp. aureus Mu50
gaugcauauauauauagauuaaa

SEQ ID NO: 3982758 - RNA, 19 nt, Staphylococcus aureus subsp. aureus Mu50
gaugcgugcgaagucacuu

SEQ ID NO: 3982759 - RNA, 16 nt, Staphylococcus aureus subsp. aureus Mu50
gaugcuaaaaauauug

SEQ ID NO: 3982760 - RNA, 23 nt, Staphylococcus aureus subsp. aureus Mu50
gaugcuaaaaauauugaauaauc

SEQ ID NO: 3982761 - RNA, 20 nt, Staphylococcus aureus subsp. aureus Mu50
gaugcuaauguaaucugaac

SEQ ID NO: 3982762 - RNA, 13 nt, Staphylococcus aureus subsp. aureus Mu50
gaugcuuccuuuu

SEQ ID NO: 3982763 - RNA, 22 nt, Staphylococcus aureus subsp. aureus Mu50
gaugcuucgaauuuaacaucuu

SEQ ID NO: 3982764 - RNA, 22 nt, Staphylococcus aureus subsp. aureus Mu50
gauggcuucucuuaguuuuaac

SEQ ID NO: 3982765 - RNA, 22 nt, Staphylococcus aureus subsp. aureus Mu50
gaugggaaaucaguaauaucaa

SEQ ID NO: 3982766 - RNA, 16 nt, Staphylococcus aureus subsp. aureus Mu50
gaugguacuaaaguug

SEQ ID NO: 3982767 - RNA, 13 nt, Staphylococcus aureus subsp. aureus Mu50
gauggucuuuuaa

SEQ ID NO: 3982768 - RNA, 22 nt, Staphylococcus aureus subsp. aureus Mu50
gaugguguuaaguuuucaauuc

SEQ ID NO: 3982769 - RNA, 16 nt, Staphylococcus aureus subsp. aureus Mu50
gaugguuaaugacuau

SEQ ID NO: 3982770 - RNA, 14 nt, Staphylococcus aureus subsp. aureus Mu50
gaugguuaucacuu

SEQ ID NO: 3982771 - RNA, 13 nt, Staphylococcus aureus subsp. aureus Mu50
gaugguugcuuca

SEQ ID NO: 3982772 - RNA, 13 nt, Staphylococcus aureus subsp. aureus Mu50
gauguaauucugu

SEQ ID NO: 3982773 - RNA, 17 nt, Staphylococcus aureus subsp. aureus Mu50
gauguaccacucauaau

SEQ ID NO: 3982774 - RNA, 16 nt, Staphylococcus aureus subsp. aureus Mu50
gaugucagacgaauca

SEQ ID NO: 3982775 - RNA, 13 nt, Staphylococcus aureus subsp. aureus Mu50
gaugucauguauu

SEQ ID NO: 3982776 - RNA, 18 nt, Staphylococcus aureus subsp. aureus Mu50
gaugucaugucuagauuu

SEQ ID NO: 3982777 - RNA, 15 nt, Staphylococcus aureus subsp. aureus Mu50
gaugucgaaaaguau

SEQ ID NO: 3982778 - RNA, 20 nt, Staphylococcus aureus subsp. aureus Mu50
gaugucgaaaaguauaugaa

SEQ ID NO: 3982779 - RNA, 16 nt, Staphylococcus aureus subsp. aureus Mu50
gaugucuguacuuuua

SEQ ID NO: 3982780 - RNA, 16 nt, Staphylococcus aureus subsp. aureus Mu50
gaugugaauguuuugu

SEQ ID NO: 3982781 - RNA, 18 nt, Staphylococcus aureus subsp. aureus Mu50
gaugugaauguuuugugu

SEQ ID NO: 3982782 - RNA, 14 nt, Staphylococcus aureus subsp. aureus Mu50
gaugugacaaauac

SEQ ID NO: 3982783 - RNA, 13 nt, Staphylococcus aureus subsp. aureus Mu50
gauguguugaaac

SEQ ID NO: 3982784 - RNA, 22 nt, Staphylococcus aureus subsp. aureus Mu50
gauguguuuuaauaauaucuuu

SEQ ID NO: 3982785 - RNA, 16 nt, Staphylococcus aureus subsp. aureus Mu50
gauguucacuaaaugu

SEQ ID NO: 3982786 - RNA, 17 nt, Staphylococcus aureus subsp. aureus Mu50
gauguucaguuguuuuu

SEQ ID NO: 3982787 - RNA, 15 nt, Staphylococcus aureus subsp. aureus Mu50
gauguucaucaacau

SEQ ID NO: 3982788 - RNA, 16 nt, Staphylococcus aureus subsp. aureus Mu50
gauguugguucaucaa

SEQ ID NO: 3982789 - RNA, 16 nt, Staphylococcus aureus subsp. aureus Mu50
gauguuugcaacauau

SEQ ID NO: 3982790 - RNA, 17 nt, Staphylococcus aureus subsp. aureus Mu50
gauuaaaagcaucuuua

SEQ ID NO: 3982791 - RNA, 17 nt, Staphylococcus aureus subsp. aureus Mu50
gauuaaaauaugacaca

SEQ ID NO: 3982792 - RNA, 18 nt, Staphylococcus aureus subsp. aureus Mu50
gauuaaaauaugacacau

SEQ ID NO: 3982793 - RNA, 18 nt, Staphylococcus aureus subsp. aureus Mu50
gauuaaagcgauaauaga

SEQ ID NO: 3982794 - RNA, 20 nt, Staphylococcus aureus subsp. aureus Mu50
gauuaacaaggaagcaugag

SEQ ID NO: 3982795 - RNA, 12 nt, Staphylococcus aureus subsp. aureus Mu50
gauuaacauuau

SEQ ID NO: 3982796 - RNA, 15 nt, Staphylococcus aureus subsp. aureus Mu50
gauuaacuuucuaau

SEQ ID NO: 3982797 - RNA, 19 nt, Staphylococcus aureus subsp. aureus Mu50
gauuaauccaguaaucaaa

SEQ ID NO: 3982798 - RNA, 22 nt, Staphylococcus aureus subsp. aureus Mu50
gauuaauccuacacggacugca

SEQ ID NO: 3982799 - RNA, 22 nt, Staphylococcus aureus subsp. aureus Mu50
gauuaauuaaagauuaaaauau

SEQ ID NO: 3982800 - RNA, 20 nt, Staphylococcus aureus subsp. aureus Mu50
gauuaauuauaaguagugau

SEQ ID NO: 3982801 - RNA, 22 nt, Staphylococcus aureus subsp. aureus Mu50
gauuaauuuaauugaaguaugc

SEQ ID NO: 3982802 - RNA, 22 nt, Staphylococcus aureus subsp. aureus Mu50
gauuaauuucauguucauaaua

SEQ ID NO: 3982803 - RNA, 23 nt, Staphylococcus aureus subsp. aureus Mu50
gauuaauuuuaucuuauuauuaa

SEQ ID NO: 3982804 - RNA, 17 nt, Staphylococcus aureus subsp. aureus Mu50
gauuacagcguaacuaa

SEQ ID NO: 3982805 - RNA, 14 nt, Staphylococcus aureus subsp. aureus Mu50
gauuacuuugcuaa

SEQ ID NO: 3982806 - RNA, 14 nt, Staphylococcus aureus subsp. aureus Mu50
gauuagaugauauu

SEQ ID NO: 3982807 - RNA, 22 nt, Staphylococcus aureus subsp. aureus Mu50
gauuaguaauuuuuaaaucuac

SEQ ID NO: 3982808 - RNA, 21 nt, Staphylococcus aureus subsp. aureus Mu50
gauuagugucacaaagaaauu

SEQ ID NO: 3982809 - RNA, 16 nt, Staphylococcus aureus subsp. aureus Mu50
gauuauaaugauuguc

SEQ ID NO: 3982810 - RNA, 18 nt, Staphylococcus aureus subsp. aureus Mu50
gauuauagguauaagaau

SEQ ID NO: 3982811 - RNA, 21 nt, Staphylococcus aureus subsp. aureus Mu50
gauuauauuuagauuuauaac

SEQ ID NO: 3982812 - RNA, 14 nt, Staphylococcus aureus subsp. aureus Mu50
gauuauauuuuucu

SEQ ID NO: 3982813 - RNA, 18 nt, Staphylococcus aureus subsp. aureus Mu50
gauuauauuuuucuucag

SEQ ID NO: 3982814 - RNA, 23 nt, Staphylococcus aureus subsp. aureus Mu50
gauuaucauaugaacaauaagug

SEQ ID NO: 3982815 - RNA, 22 nt, Staphylococcus aureus subsp. aureus Mu50
gauuaucuguaauuaauccauc

SEQ ID NO: 3982816 - RNA, 20 nt, Staphylococcus aureus subsp. aureus Mu50
gauuaugacaacauaacaaa

SEQ ID NO: 3982817 - RNA, 16 nt, Staphylococcus aureus subsp. aureus Mu50
gauuauuaacuuuaau

SEQ ID NO: 3982818 - RNA, 15 nt, Staphylococcus aureus subsp. aureus Mu50
gauuauuaccauaua

SEQ ID NO: 3982819 - RNA, 22 nt, Staphylococcus aureus subsp. aureus Mu50
gauuauuauuacaaugaaaaaa

SEQ ID NO: 3982820 - RNA, 12 nt, Staphylococcus aureus subsp. aureus Mu50
gauuauucuuca

SEQ ID NO: 3982821 - RNA, 15 nt, Staphylococcus aureus subsp. aureus Mu50
gauuauuuagauaaa

SEQ ID NO: 3982822 - RNA, 20 nt, Staphylococcus aureus subsp. aureus Mu50
gauuauuuuuuuaaaucuau

SEQ ID NO: 3982823 - RNA, 22 nt, Staphylococcus aureus subsp. aureus Mu50
gauucaaauaaaucaaacuuuu

SEQ ID NO: 3982824 - RNA, 13 nt, Staphylococcus aureus subsp. aureus Mu50
gauucaaaugaca

SEQ ID NO: 3982825 - RNA, 16 nt, Staphylococcus aureus subsp. aureus Mu50
gauucaacuuguuucc

SEQ ID NO: 3982826 - RNA, 20 nt, Staphylococcus aureus subsp. aureus Mu50
gauucauaucuuucaauuaa

SEQ ID NO: 3982827 - RNA, 15 nt, Staphylococcus aureus subsp. aureus Mu50
gauucauauuuauau

SEQ ID NO: 3982828 - RNA, 19 nt, Staphylococcus aureus subsp. aureus Mu50
gauucauuucgauuaauuu

SEQ ID NO: 3982829 - RNA, 18 nt, Staphylococcus aureus subsp. aureus Mu50
gauuccaaucuauuuuaa

SEQ ID NO: 3982830 - RNA, 18 nt, Staphylococcus aureus subsp. aureus Mu50
gauuccuguaacaagaac

SEQ ID NO: 3982831 - RNA, 20 nt, Staphylococcus aureus subsp. aureus Mu50
gauucgauuauuuagauaaa

SEQ ID NO: 3982832 - RNA, 14 nt, Staphylococcus aureus subsp. aureus Mu50
gauucggaaaauau

SEQ ID NO: 3982833 - RNA, 22 nt, Staphylococcus aureus subsp. aureus Mu50
gauucuaacggcguuuguuucu

SEQ ID NO: 3982834 - RNA, 16 nt, Staphylococcus aureus subsp. aureus Mu50
gauucuacagcacuga

SEQ ID NO: 3982835 - RNA, 19 nt, Staphylococcus aureus subsp. aureus Mu50
gauucuccaguggaaauga

SEQ ID NO: 3982836 - RNA, 21 nt, Staphylococcus aureus subsp. aureus Mu50
gauucucuaacgauuucuagu

SEQ ID NO: 3982837 - RNA, 17 nt, Staphylococcus aureus subsp. aureus Mu50
gauucuuaucauuucaa

SEQ ID NO: 3982838 - RNA, 19 nt, Staphylococcus aureus subsp. aureus Mu50
gauucuucacuaaaaauau

SEQ ID NO: 3982839 - RNA, 12 nt, Staphylococcus aureus subsp. aureus Mu50
gauugaaaaaau

SEQ ID NO: 3982840 - RNA, 14 nt, Staphylococcus aureus subsp. aureus Mu50
gauugaaaaaauaa

SEQ ID NO: 3982841 - RNA, 15 nt, Staphylococcus aureus subsp. aureus Mu50
gauugacgauuuaau

SEQ ID NO: 3982842 - RNA, 14 nt, Staphylococcus aureus subsp. aureus Mu50
gauugacguggucu

SEQ ID NO: 3982843 - RNA, 12 nt, Staphylococcus aureus subsp. aureus Mu50
gcaaguugggga

SEQ ID NO: 3982844 - RNA, 13 nt, Staphylococcus aureus subsp. aureus Mu50
gcaaguuggggau

SEQ ID NO: 3982845 - RNA, 20 nt, Staphylococcus aureus subsp. aureus Mu50
gcaauaacaccaauugaaua

SEQ ID NO: 3982846 - RNA, 15 nt, Staphylococcus aureus subsp. aureus Mu50
gcaauacuaacugaa

SEQ ID NO: 3982847 - RNA, 16 nt, Staphylococcus aureus subsp. aureus Mu50
gcaauagcaacacguu

SEQ ID NO: 3982848 - RNA, 18 nt, Staphylococcus aureus subsp. aureus Mu50
gcaauagcuauaacucua

SEQ ID NO: 3982849 - RNA, 21 nt, Staphylococcus aureus subsp. aureus Mu50
gcaauauacuuuuuaaaugau

SEQ ID NO: 3982850 - RNA, 14 nt, Staphylococcus aureus subsp. aureus Mu50
gcaaucauaauacu

SEQ ID NO: 3982851 - RNA, 14 nt, Staphylococcus aureus subsp. aureus Mu50
gcaaucguugaaaa

SEQ ID NO: 3982852 - RNA, 14 nt, Staphylococcus aureus subsp. aureus Mu50
gcaaucuuaguaca

SEQ ID NO: 3982853 - RNA, 13 nt, Staphylococcus aureus subsp. aureus Mu50
gcaaugaaauuac

SEQ ID NO: 3982854 - RNA, 18 nt, Staphylococcus aureus subsp. aureus Mu50
gcaaugauuauaaauaca

SEQ ID NO: 3982855 - RNA, 14 nt, Staphylococcus aureus subsp. aureus Mu50
gcaaugcauauugu

SEQ ID NO: 3982856 - RNA, 15 nt, Staphylococcus aureus subsp. aureus Mu50
gcaaugcaugcuucu

SEQ ID NO: 3982857 - RNA, 22 nt, Staphylococcus aureus subsp. aureus Mu50
gcaauuaaaacuauaauaaaga

SEQ ID NO: 3982858 - RNA, 14 nt, Staphylococcus aureus subsp. aureus Mu50
gcaauuaaaaguac

SEQ ID NO: 3982859 - RNA, 14 nt, Staphylococcus aureus subsp. aureus Mu50
gcaauuagaauaua

SEQ ID NO: 3982860 - RNA, 21 nt, Staphylococcus aureus subsp. aureus Mu50
gcaauuagaauauauguauaa

SEQ ID NO: 3982861 - RNA, 18 nt, Staphylococcus aureus subsp. aureus Mu50
gcaauuauuuuucaaaua

SEQ ID NO: 3982862 - RNA, 19 nt, Staphylococcus aureus subsp. aureus Mu50
gcaauugaaucaaauacau

SEQ ID NO: 3982863 - RNA, 16 nt, Staphylococcus aureus subsp. aureus Mu50
gcaauugcaaugaaua

SEQ ID NO: 3982864 - RNA, 18 nt, Staphylococcus aureus subsp. aureus Mu50
gcaauuuaauauuauaag

SEQ ID NO: 3982865 - RNA, 13 nt, Staphylococcus aureus subsp. aureus Mu50
gcaauuucauagu

SEQ ID NO: 3982866 - RNA, 13 nt, Staphylococcus aureus subsp. aureus Mu50
gcaauuuguaaua

SEQ ID NO: 3982867 - RNA, 14 nt, Staphylococcus aureus subsp. aureus Mu50
gcaauuuuagccaa

SEQ ID NO: 3982868 - RNA, 20 nt, Staphylococcus aureus subsp. aureus Mu50
gcaauuuuagccaaauuacu

SEQ ID NO: 3982869 - RNA, 13 nt, Staphylococcus aureus subsp. aureus Mu50
gcacaaaugaaug

SEQ ID NO: 3982870 - RNA, 19 nt, Staphylococcus aureus subsp. aureus Mu50
gcacaacugcauaaaagcc

SEQ ID NO: 3982871 - RNA, 19 nt, Staphylococcus aureus subsp. aureus Mu50
gcacagcgauuaaaugaug

SEQ ID NO: 3982872 - RNA, 19 nt, Staphylococcus aureus subsp. aureus Mu50
gcacagcggaauacagaug

SEQ ID NO: 3982873 - RNA, 19 nt, Staphylococcus aureus subsp. aureus Mu50
gcacaguggauuacagaug

SEQ ID NO: 3982874 - RNA, 16 nt, Staphylococcus aureus subsp. aureus Mu50
gcacaucauaauaaau

SEQ ID NO: 3982875 - RNA, 16 nt, Staphylococcus aureus subsp. aureus Mu50
gcacaucauugauaga

SEQ ID NO: 3982876 - RNA, 14 nt, Staphylococcus aureus subsp. aureus Mu50
gcaccaaugacgac

SEQ ID NO: 3982877 - RNA, 13 nt, Staphylococcus aureus subsp. aureus Mu50
gcaccaugugccu

SEQ ID NO: 3982878 - RNA, 21 nt, Staphylococcus aureus subsp. aureus Mu50
gcaccgucaaacuuaaaacua

SEQ ID NO: 3982879 - RNA, 14 nt, Staphylococcus aureus subsp. aureus Mu50
gcacgagaaauguc

SEQ ID NO: 3982880 - RNA, 17 nt, Staphylococcus aureus subsp. aureus Mu50
gcacgauaaaaauaaaa

SEQ ID NO: 3982881 - RNA, 12 nt, Staphylococcus aureus subsp. aureus Mu50
gcacuaucuuuu

SEQ ID NO: 3982882 - RNA, 13 nt, Staphylococcus aureus subsp. aureus Mu50
gcacuaucuuuug

SEQ ID NO: 3982883 - RNA, 19 nt, Staphylococcus aureus subsp. aureus Mu50
gcacuaugcauaauaccaa

SEQ ID NO: 3982884 - RNA, 15 nt, Staphylococcus aureus subsp. aureus Mu50
gcacugagcaacaaa

SEQ ID NO: 3982885 - RNA, 23 nt, Staphylococcus aureus subsp. aureus Mu50
gcacuuauuuggaugguaaguau

SEQ ID NO: 3982886 - RNA, 16 nt, Staphylococcus aureus subsp. aureus Mu50
gcacuucaaaagaaau

SEQ ID NO: 3982887 - RNA, 18 nt, Staphylococcus aureus subsp. aureus Mu50
gcacuucuauauuaauag

SEQ ID NO: 3982888 - RNA, 20 nt, Staphylococcus aureus subsp. aureus Mu50
gcacuucuauauuaauagaa

SEQ ID NO: 3982889 - RNA, 19 nt, Staphylococcus aureus subsp. aureus Mu50
gcacuuggauuuuaauuau

SEQ ID NO: 3982890 - RNA, 20 nt, Staphylococcus aureus subsp. aureus Mu50
gcacuugguucauaaugauc

SEQ ID NO: 3982891 - RNA, 15 nt, Staphylococcus aureus subsp. aureus Mu50
gcacuuuaacauaac

SEQ ID NO: 3982892 - RNA, 14 nt, Staphylococcus aureus subsp. aureus Mu50
gcacuuuauuaaaa

SEQ ID NO: 3982893 - RNA, 22 nt, Staphylococcus aureus subsp. aureus Mu50
gcacuuuauuaaaaauccucac

SEQ ID NO: 3982894 - RNA, 23 nt, Staphylococcus aureus subsp. aureus Mu50
gcagaagaaaacuauuuuaaaaa

SEQ ID NO: 3982895 - RNA, 14 nt, Staphylococcus aureus subsp. aureus Mu50
gcagacguaucauc

SEQ ID NO: 3982896 - RNA, 15 nt, Staphylococcus aureus subsp. aureus Mu50
gcagagaauauagau

SEQ ID NO: 3982897 - RNA, 19 nt, Staphylococcus aureus subsp. aureus Mu50
gcagauguugguucaucaa

SEQ ID NO: 3982898 - RNA, 15 nt, Staphylococcus aureus subsp. aureus Mu50
gcagauugauauaaa

SEQ ID NO: 3982899 - RNA, 14 nt, Staphylococcus aureus subsp. aureus Mu50
gcagcgaucuuuuu

SEQ ID NO: 3982900 - RNA, 15 nt, Staphylococcus aureus subsp. aureus Mu50
gcagcuaaaaaguau

SEQ ID NO: 3982901 - RNA, 13 nt, Staphylococcus aureus subsp. aureus Mu50
gcagcuucuuuaa

SEQ ID NO: 3982902 - RNA, 21 nt, Staphylococcus aureus subsp. aureus Mu50
gcagcuugaucuaaaugaucu

SEQ ID NO: 3982903 - RNA, 13 nt, Staphylococcus aureus subsp. aureus Mu50
gcagggugcuaaa

SEQ ID NO: 3982904 - RNA, 12 nt, Staphylococcus aureus subsp. aureus Mu50
gcaguaaaacca

SEQ ID NO: 3982905 - RNA, 14 nt, Staphylococcus aureus subsp. aureus Mu50
gcaguaauuuucau

SEQ ID NO: 3982906 - RNA, 22 nt, Staphylococcus aureus subsp. aureus Mu50
gcaguaguugacugaacgaaaa

SEQ ID NO: 3982907 - RNA, 19 nt, Staphylococcus aureus subsp. aureus Mu50
gcaguauauaucaaauaca

SEQ ID NO: 3982908 - RNA, 17 nt, Staphylococcus aureus subsp. aureus Mu50
gcagucaaacauagaua

SEQ ID NO: 3982909 - RNA, 22 nt, Staphylococcus aureus subsp. aureus Mu50
gcagugaucuuuuuuauauuca

SEQ ID NO: 3982910 - RNA, 14 nt, Staphylococcus aureus subsp. aureus Mu50
gcaguuaauaagaa

SEQ ID NO: 3982911 - RNA, 17 nt, Staphylococcus aureus subsp. aureus Mu50
gcaguuucugagaagaa

SEQ ID NO: 3982912 - RNA, 14 nt, Staphylococcus aureus subsp. aureus Mu50
gcauaaaaaaagaa

SEQ ID NO: 3982913 - RNA, 15 nt, Staphylococcus aureus subsp. aureus Mu50
gcauaaaagccucua

SEQ ID NO: 3982914 - RNA, 22 nt, Staphylococcus aureus subsp. aureus Mu50
gcauaacgagcaguauauauca

SEQ ID NO: 3982915 - RNA, 14 nt, Staphylococcus aureus subsp. aureus Mu50
gcauaagaaauacu

SEQ ID NO: 3982916 - RNA, 17 nt, Staphylococcus aureus subsp. aureus Mu50
gcauaagauuuugaauu

SEQ ID NO: 3982917 - RNA, 19 nt, Staphylococcus aureus subsp. aureus Mu50
gcauaauuaggauuaacau

SEQ ID NO: 3982918 - RNA, 16 nt, Staphylococcus aureus subsp. aureus Mu50
gcauaauucaacuuaa

SEQ ID NO: 3982919 - RNA, 18 nt, Staphylococcus aureus subsp. aureus Mu50
gcauacaggaaauugaag

SEQ ID NO: 3982920 - RNA, 16 nt, Staphylococcus aureus subsp. aureus Mu50
gcauaccuauaaacau

SEQ ID NO: 3982921 - RNA, 18 nt, Staphylococcus aureus subsp. aureus Mu50
gcauacgaauuaaaauaa

SEQ ID NO: 3982922 - RNA, 13 nt, Staphylococcus aureus subsp. aureus Mu50
gcauacguaaaug

SEQ ID NO: 3982923 - RNA, 19 nt, Staphylococcus aureus subsp. aureus Mu50
gcauauaaagucauacuua

SEQ ID NO: 3982924 - RNA, 22 nt, Staphylococcus aureus subsp. aureus Mu50
gcauauaaagucauacuuauga

SEQ ID NO: 3982925 - RNA, 18 nt, Staphylococcus aureus subsp. aureus Mu50
gcauaucgauaaauguau

SEQ ID NO: 3982926 - RNA, 13 nt, Staphylococcus aureus subsp. aureus Mu50
gcaucaaaaauga

SEQ ID NO: 3982927 - RNA, 15 nt, Staphylococcus aureus subsp. aureus Mu50
gcaucacaaaauugu

SEQ ID NO: 3982928 - RNA, 16 nt, Staphylococcus aureus subsp. aureus Mu50
gcaucacugcauauaa

SEQ ID NO: 3982929 - RNA, 14 nt, Staphylococcus aureus subsp. aureus Mu50
gcaucccgaaaguu

SEQ ID NO: 3982930 - RNA, 15 nt, Staphylococcus aureus subsp. aureus Mu50
gcaucuaugauugua

SEQ ID NO: 3982931 - RNA, 12 nt, Staphylococcus aureus subsp. aureus Mu50
gccuuaaaauau

SEQ ID NO: 3982932 - RNA, 14 nt, Staphylococcus aureus subsp. aureus Mu50
gccuuaaaauauuu

SEQ ID NO: 3982933 - RNA, 17 nt, Staphylococcus aureus subsp. aureus Mu50
gccuuaacuucauaaua

SEQ ID NO: 3982934 - RNA, 18 nt, Staphylococcus aureus subsp. aureus Mu50
gccuuaacuucauaauau

SEQ ID NO: 3982935 - RNA, 16 nt, Staphylococcus aureus subsp. aureus Mu50
gccuucaauauuucuu

SEQ ID NO: 3982936 - RNA, 13 nt, Staphylococcus aureus subsp. aureus Mu50
gccuucauuagcc

SEQ ID NO: 3982937 - RNA, 15 nt, Staphylococcus aureus subsp. aureus Mu50
gccuucuauauagua

SEQ ID NO: 3982938 - RNA, 17 nt, Staphylococcus aureus subsp. aureus Mu50
gccuucuaucucuuuag

SEQ ID NO: 3982939 - RNA, 22 nt, Staphylococcus aureus subsp. aureus Mu50
gccuucuguacguuuuaaauaa

SEQ ID NO: 3982940 - RNA, 23 nt, Staphylococcus aureus subsp. aureus Mu50
gccuugaccuacuuuuucaauau

SEQ ID NO: 3982941 - RNA, 19 nt, Staphylococcus aureus subsp. aureus Mu50
gccuugauuuuuugaaaug

SEQ ID NO: 3982942 - RNA, 14 nt, Staphylococcus aureus subsp. aureus Mu50
gccuuguucaauuc

SEQ ID NO: 3982943 - RNA, 20 nt, Staphylococcus aureus subsp. aureus Mu50
gccuuuccauuguugauaaa

SEQ ID NO: 3982944 - RNA, 20 nt, Staphylococcus aureus subsp. aureus Mu50
gccuuuuuaggaugcauaua

SEQ ID NO: 3982945 - RNA, 23 nt, Staphylococcus aureus subsp. aureus Mu50
gcgaaaacguugaguauuacuug

SEQ ID NO: 3982946 - RNA, 15 nt, Staphylococcus aureus subsp. aureus Mu50
gcgaaaguaucuaug

SEQ ID NO: 3982947 - RNA, 15 nt, Staphylococcus aureus subsp. aureus Mu50
gcgaagaaaccuuuu

SEQ ID NO: 3982948 - RNA, 18 nt, Staphylococcus aureus subsp. aureus Mu50
gcgacauuuguaaauauu

SEQ ID NO: 3982949 - RNA, 16 nt, Staphylococcus aureus subsp. aureus Mu50
gcgacuuaacuuaagc

SEQ ID NO: 3982950 - RNA, 13 nt, Staphylococcus aureus subsp. aureus Mu50
gcgagaauucaau

SEQ ID NO: 3982951 - RNA, 15 nt, Staphylococcus aureus subsp. aureus Mu50
gcgauaaaaguugua

SEQ ID NO: 3982952 - RNA, 15 nt, Staphylococcus aureus subsp. aureus Mu50
gcgauacguuuauau

SEQ ID NO: 3982953 - RNA, 18 nt, Staphylococcus aureus subsp. aureus Mu50
gcgauacguuuauaucuu

SEQ ID NO: 3982954 - RNA, 13 nt, Staphylococcus aureus subsp. aureus Mu50
gcgcaaaagcgca

SEQ ID NO: 3982955 - RNA, 21 nt, Staphylococcus aureus subsp. aureus Mu50
gcgcucuggauuuuucuuaua

SEQ ID NO: 3982956 - RNA, 23 nt, Staphylococcus aureus subsp. aureus Mu50
gcgcucuggauuuuucuuauaaa

SEQ ID NO: 3982957 - RNA, 19 nt, Staphylococcus aureus subsp. aureus Mu50
gcgcuguuccaaauucauu

SEQ ID NO: 3982958 - RNA, 17 nt, Staphylococcus aureus subsp. aureus Mu50
gcgcuucuaacucaccu

SEQ ID NO: 3982959 - RNA, 17 nt, Staphylococcus aureus subsp. aureus Mu50
gcgcuuuuuuuuauaag

SEQ ID NO: 3982960 - RNA, 19 nt, Staphylococcus aureus subsp. aureus Mu50
gcggggccccaacacagag

SEQ ID NO: 3982961 - RNA, 23 nt, Staphylococcus aureus subsp. aureus Mu50
gcggucaauuuuaccauguuuua

SEQ ID NO: 3982962 - RNA, 13 nt, Staphylococcus aureus subsp. aureus Mu50
gcguaauuauuau

SEQ ID NO: 3982963 - RNA, 13 nt, Staphylococcus aureus subsp. aureus Mu50
gcguacauauaau

SEQ ID NO: 3982964 - RNA, 18 nt, Staphylococcus aureus subsp. aureus Mu50
gcguauccccauuuaugu

SEQ ID NO: 3982965 - RNA, 23 nt, Staphylococcus aureus subsp. aureus Mu50
gcguauugauucaagcaucauuu

SEQ ID NO: 3982966 - RNA, 11 nt, Staphylococcus aureus subsp. aureus Mu50
gcguauuuuuu

SEQ ID NO: 3982967 - RNA, 23 nt, Staphylococcus aureus subsp. aureus Mu50
gcgucuaucuccgcuacaauuau

SEQ ID NO: 3982968 - RNA, 16 nt, Staphylococcus aureus subsp. aureus Mu50
gcgucugauucucuaa

SEQ ID NO: 3982969 - RNA, 19 nt, Staphylococcus aureus subsp. aureus Mu50
gcgugcuuaauuacaauau

SEQ ID NO: 3982970 - RNA, 14 nt, Staphylococcus aureus subsp. aureus Mu50
gcguucaacauuac

SEQ ID NO: 3982971 - RNA, 21 nt, Staphylococcus aureus subsp. aureus Mu50
gcguucgugauagaaguuuuu

SEQ ID NO: 3982972 - RNA, 15 nt, Staphylococcus aureus subsp. aureus Mu50
gcguugguauucauc

SEQ ID NO: 3982973 - RNA, 16 nt, Staphylococcus aureus subsp. aureus Mu50
gcguuguguaacuuua

SEQ ID NO: 3982974 - RNA, 11 nt, Staphylococcus aureus subsp. aureus Mu50
gcuaaaaaaau

SEQ ID NO: 3982975 - RNA, 16 nt, Staphylococcus aureus subsp. aureus Mu50
gcuaaaauaaaauuaa

SEQ ID NO: 3982976 - RNA, 14 nt, Staphylococcus aureus subsp. aureus Mu50
gcuaaaauaucaaa

SEQ ID NO: 3982977 - RNA, 12 nt, Staphylococcus aureus subsp. aureus Mu50
gcuaaacaaagg

SEQ ID NO: 3982978 - RNA, 18 nt, Staphylococcus aureus subsp. aureus Mu50
gcuaaacaaugaugggaa

SEQ ID NO: 3982979 - RNA, 19 nt, Staphylococcus aureus subsp. aureus Mu50
gcuaaauuuacgaaaguag

SEQ ID NO: 3982980 - RNA, 16 nt, Staphylococcus aureus subsp. aureus Mu50
gcuaacauaccuaaua

SEQ ID NO: 3982981 - RNA, 18 nt, Staphylococcus aureus subsp. aureus Mu50
gcuaacauucagugcaau

SEQ ID NO: 3982982 - RNA, 15 nt, Staphylococcus aureus subsp. aureus Mu50
gcuaaccaucauaaa

SEQ ID NO: 3982983 - RNA, 18 nt, Staphylococcus aureus subsp. aureus Mu50
gcuaauaacgcugcaccu

SEQ ID NO: 3982984 - RNA, 16 nt, Staphylococcus aureus subsp. aureus Mu50
gcuaauccauacguau

SEQ ID NO: 3982985 - RNA, 18 nt, Staphylococcus aureus subsp. aureus Mu50
gcuaauccauacguauca

SEQ ID NO: 3982986 - RNA, 20 nt, Staphylococcus aureus subsp. aureus Mu50
gcuaaucguuugccauaauu

SEQ ID NO: 3982987 - RNA, 16 nt, Staphylococcus aureus subsp. aureus Mu50
gcuaaucuauuuagcu

SEQ ID NO: 3982988 - RNA, 20 nt, Staphylococcus aureus subsp. aureus Mu50
gcuaaugcaacuaaaacuau

SEQ ID NO: 3982989 - RNA, 23 nt, Staphylococcus aureus subsp. aureus Mu50
gcuaaugcaacuaaaacuaucug

SEQ ID NO: 3982990 - RNA, 15 nt, Staphylococcus aureus subsp. aureus Mu50
gcuaaugucaugaaa

SEQ ID NO: 3982991 - RNA, 18 nt, Staphylococcus aureus subsp. aureus Mu50
gcuaauguguacuuaaaa

SEQ ID NO: 3982992 - RNA, 21 nt, Staphylococcus aureus subsp. aureus Mu50
gcuaauguguacuuaaaaaua

SEQ ID NO: 3982993 - RNA, 20 nt, Staphylococcus aureus subsp. aureus Mu50
gcuaauuuuaauuuucagaa

SEQ ID NO: 3982994 - RNA, 17 nt, Staphylococcus aureus subsp. aureus Mu50
gcuacaaaacauauuca

SEQ ID NO: 3982995 - RNA, 23 nt, Staphylococcus aureus subsp. aureus Mu50
gcuaccuacuuguucaauacuuc

SEQ ID NO: 3982996 - RNA, 15 nt, Staphylococcus aureus subsp. aureus Mu50
gcuacuauuaaauaa

SEQ ID NO: 3982997 - RNA, 19 nt, Staphylococcus aureus subsp. aureus Mu50
gcuacuuuuucaucuuuca

SEQ ID NO: 3982998 - RNA, 16 nt, Staphylococcus aureus subsp. aureus Mu50
gcuagaacagauauac

SEQ ID NO: 3982999 - RNA, 15 nt, Staphylococcus aureus subsp. aureus Mu50
gcuagcauaucuuua

SEQ ID NO: 3983000 - RNA, 19 nt, Staphylococcus aureus subsp. aureus Mu50
gcuagucauaauuuaaaag

SEQ ID NO: 3983001 - RNA, 20 nt, Staphylococcus aureus subsp. aureus Mu50
gcuagucauaauuuaaaaga

SEQ ID NO: 3983002 - RNA, 15 nt, Staphylococcus aureus subsp. aureus Mu50
gcuaguucagcuucu

SEQ ID NO: 3983003 - RNA, 18 nt, Staphylococcus aureus subsp. aureus Mu50
gcuauaaaaaaucuuuug

SEQ ID NO: 3983004 - RNA, 19 nt, Staphylococcus aureus subsp. aureus Mu50
gcuauaaaaaaucuuuuga

SEQ ID NO: 3983005 - RNA, 11 nt, Staphylococcus aureus subsp. aureus Mu50
gcuauaaaagu

SEQ ID NO: 3983006 - RNA, 20 nt, Staphylococcus aureus subsp. aureus Mu50
gcuauaaaauuuugaagaag

SEQ ID NO: 3983007 - RNA, 17 nt, Staphylococcus aureus subsp. aureus Mu50
gcuauaacucuaaauau

SEQ ID NO: 3983008 - RNA, 18 nt, Staphylococcus aureus subsp. aureus Mu50
gcuauaaucuaucuugug

SEQ ID NO: 3983009 - RNA, 20 nt, Staphylococcus aureus subsp. aureus Mu50
gcuauauuuuuguauuuaug

SEQ ID NO: 3983010 - RNA, 21 nt, Staphylococcus aureus subsp. aureus Mu50
gcuauauuuuuguauuuaugu

SEQ ID NO: 3983011 - RNA, 19 nt, Staphylococcus aureus subsp. aureus Mu50
gcuauccauguauuuuucu

SEQ ID NO: 3983012 - RNA, 20 nt, Staphylococcus aureus subsp. aureus Mu50
gcuaucucuaccauuucaac

SEQ ID NO: 3983013 - RNA, 17 nt, Staphylococcus aureus subsp. aureus Mu50
gcuauguaaaauuauug

SEQ ID NO: 3983014 - RNA, 15 nt, Staphylococcus aureus subsp. aureus Mu50
gcuauguauuuuucu

SEQ ID NO: 3983015 - RNA, 13 nt, Staphylococcus aureus subsp. aureus Mu50
gcuauuaaaauag

SEQ ID NO: 3983016 - RNA, 22 nt, Staphylococcus aureus subsp. aureus Mu50
gcuauuacuauaaaaaacagca

SEQ ID NO: 3983017 - RNA, 12 nt, Staphylococcus aureus subsp. aureus Mu50
gcuauuucaaca

SEQ ID NO: 3983018 - RNA, 19 nt, Staphylococcus aureus subsp. aureus Mu50
gcuauuucaacaaacauaa

SEQ ID NO: 3983019 - RNA, 15 nt, Staphylococcus aureus subsp. aureus Mu50
gcuuguaaaauuuuc

SEQ ID NO: 3983020 - RNA, 17 nt, Staphylococcus aureus subsp. aureus Mu50
gcuuguaacaagcauuu

SEQ ID NO: 3983021 - RNA, 21 nt, Staphylococcus aureus subsp. aureus Mu50
gcuuguaacaagcuuuucauu

SEQ ID NO: 3983022 - RNA, 22 nt, Staphylococcus aureus subsp. aureus Mu50
gcuuguacaaaaaauuguaagu

SEQ ID NO: 3983023 - RNA, 23 nt, Staphylococcus aureus subsp. aureus Mu50
gcuuguacgauaacuacacuuaa

SEQ ID NO: 3983024 - RNA, 15 nt, Staphylococcus aureus subsp. aureus Mu50
gcuugugugaaauua

SEQ ID NO: 3983025 - RNA, 17 nt, Staphylococcus aureus subsp. aureus Mu50
gcuugugugaaauuaga

SEQ ID NO: 3983026 - RNA, 13 nt, Staphylococcus aureus subsp. aureus Mu50
gcuuguucaacua

SEQ ID NO: 3983027 - RNA, 19 nt, Staphylococcus aureus subsp. aureus Mu50
gcuuguucaacuaaauuuu

SEQ ID NO: 3983028 - RNA, 13 nt, Staphylococcus aureus subsp. aureus Mu50
gcuuuaauuaaag

SEQ ID NO: 3983029 - RNA, 13 nt, Staphylococcus aureus subsp. aureus Mu50
gcuuuaauuuuuu

SEQ ID NO: 3983030 - RNA, 22 nt, Staphylococcus aureus subsp. aureus Mu50
gcuuuacguccaaaaugaacaa

SEQ ID NO: 3983031 - RNA, 16 nt, Staphylococcus aureus subsp. aureus Mu50
gcuuuagcucuuuuuu

SEQ ID NO: 3983032 - RNA, 20 nt, Staphylococcus aureus subsp. aureus Mu50
gcuuuagucgguguuuucuu

SEQ ID NO: 3983033 - RNA, 13 nt, Staphylococcus aureus subsp. aureus Mu50
gcuuuaugaauca

SEQ ID NO: 3983034 - RNA, 17 nt, Staphylococcus aureus subsp. aureus Mu50
gcuuuaugaaucauuuu

SEQ ID NO: 3983035 - RNA, 23 nt, Staphylococcus aureus subsp. aureus Mu50
gcuuuauuuucuuguguauuuuu

SEQ ID NO: 3983036 - RNA, 19 nt, Staphylococcus aureus subsp. aureus Mu50
gcuuucauuaauuuuucaa

SEQ ID NO: 3983037 - RNA, 20 nt, Staphylococcus aureus subsp. aureus Mu50
gcuuucuuuuucaucuuuca

SEQ ID NO: 3983038 - RNA, 22 nt, Staphylococcus aureus subsp. aureus Mu50
gcuuugaguguguccaucauuu

SEQ ID NO: 3983039 - RNA, 20 nt, Staphylococcus aureus subsp. aureus Mu50
gcuuugucacgauagauuua

SEQ ID NO: 3983040 - RNA, 19 nt, Staphylococcus aureus subsp. aureus Mu50
gcuuugucuuggauguuuu

SEQ ID NO: 3983041 - RNA, 14 nt, Staphylococcus aureus subsp. aureus Mu50
gcuuuguuuuucac

SEQ ID NO: 3983042 - RNA, 20 nt, Staphylococcus aureus subsp. aureus Mu50
gcuuuuaauauuauaaaccu

SEQ ID NO: 3983043 - RNA, 19 nt, Staphylococcus aureus subsp. aureus Mu50
gcuuuuaugcaugcgcaaa

SEQ ID NO: 3983044 - RNA, 14 nt, Staphylococcus aureus subsp. aureus Mu50
gcuuuuauuuauau

SEQ ID NO: 3983045 - RNA, 20 nt, Staphylococcus aureus subsp. aureus Mu50
gcuuuuauuuauauuauuac

SEQ ID NO: 3983046 - RNA, 13 nt, Staphylococcus aureus subsp. aureus Mu50
gcuuuuuaaaaaa

SEQ ID NO: 3983047 - RNA, 18 nt, Staphylococcus aureus subsp. aureus Mu50
gcuuuuucaaaaucuuua

SEQ ID NO: 3983048 - RNA, 18 nt, Staphylococcus aureus subsp. aureus Mu50
gcuuuuucuacaccuaca

SEQ ID NO: 3983049 - RNA, 17 nt, Staphylococcus aureus subsp. aureus Mu50
gcuuuuucuuuuguuuu

SEQ ID NO: 3983050 - RNA, 12 nt, Staphylococcus aureus subsp. aureus Mu50
gcuuuuuguuuu

SEQ ID NO: 3983051 - RNA, 21 nt, Staphylococcus aureus subsp. aureus Mu50
gcuuuuuuauucuaauacaaa

SEQ ID NO: 3983052 - RNA, 14 nt, Staphylococcus aureus subsp. aureus Mu50
gcuuuuuucaauuc

SEQ ID NO: 3983053 - RNA, 20 nt, Staphylococcus aureus subsp. aureus Mu50
gcuuuuuucaauucuaguca

SEQ ID NO: 3983054 - RNA, 15 nt, Staphylococcus aureus subsp. aureus Mu50
gcuuuuuuuacaaua

SEQ ID NO: 3983055 - RNA, 17 nt, Staphylococcus aureus subsp. aureus Mu50
gcuuuuuuuauggugug

SEQ ID NO: 3983056 - RNA, 15 nt, Staphylococcus aureus subsp. aureus Mu50
gcuuuuuuuuauaag

SEQ ID NO: 3983057 - RNA, 15 nt, Staphylococcus aureus subsp. aureus Mu50
ggaaaaagaugaaaa

SEQ ID NO: 3983058 - RNA, 16 nt, Staphylococcus aureus subsp. aureus Mu50
ggaaaaagaugaaaaa

SEQ ID NO: 3983059 - RNA, 17 nt, Staphylococcus aureus subsp. aureus Mu50
ggaaaaagaugaaaaag

SEQ ID NO: 3983060 - RNA, 15 nt, Staphylococcus aureus subsp. aureus Mu50
ggaaaauacuauacu

SEQ ID NO: 3983061 - RNA, 23 nt, Staphylococcus aureus subsp. aureus Mu50
ggaaaauacuauacugaugaaaa

SEQ ID NO: 3983062 - RNA, 22 nt, Staphylococcus aureus subsp. aureus Mu50
ggaaaauuauuugauauuucau

SEQ ID NO: 3983063 - RNA, 17 nt, Staphylococcus aureus subsp. aureus Mu50
ggaaaguaauaaguaau

SEQ ID NO: 3983064 - RNA, 13 nt, Staphylococcus aureus subsp. aureus Mu50
ggaaagucagcuu

SEQ ID NO: 3983065 - RNA, 16 nt, Staphylococcus aureus subsp. aureus Mu50
ggaaauaucuuacugc

SEQ ID NO: 3983066 - RNA, 16 nt, Staphylococcus aureus subsp. aureus Mu50
ggaaaucaguaauauc

SEQ ID NO: 3983067 - RNA, 12 nt, Staphylococcus aureus subsp. aureus Mu50
ggaacauauuca

SEQ ID NO: 3983068 - RNA, 18 nt, Staphylococcus aureus subsp. aureus Mu50
ggaacuacuacauuauua

SEQ ID NO: 3983069 - RNA, 22 nt, Staphylococcus aureus subsp. aureus Mu50
ggaacuacuacauuauuacuga

SEQ ID NO: 3983070 - RNA, 15 nt, Staphylococcus aureus subsp. aureus Mu50
ggaagaccauuuuau

SEQ ID NO: 3983071 - RNA, 14 nt, Staphylococcus aureus subsp. aureus Mu50
ggaagcauauuucu

SEQ ID NO: 3983072 - RNA, 15 nt, Staphylococcus aureus subsp. aureus Mu50
ggaagcauauuucua

SEQ ID NO: 3983073 - RNA, 14 nt, Staphylococcus aureus subsp. aureus Mu50
ggaaggacaggaau

SEQ ID NO: 3983074 - RNA, 18 nt, Staphylococcus aureus subsp. aureus Mu50
ggaaguuaggcaacuaaa

SEQ ID NO: 3983075 - RNA, 21 nt, Staphylococcus aureus subsp. aureus Mu50
ggaauaauuuuaaaaauaaaa

SEQ ID NO: 3983076 - RNA, 20 nt, Staphylococcus aureus subsp. aureus Mu50
ggaauacagaugaugcuucg

SEQ ID NO: 3983077 - RNA, 20 nt, Staphylococcus aureus subsp. aureus Mu50
ggaauacagaugaugcuucu

SEQ ID NO: 3983078 - RNA, 16 nt, Staphylococcus aureus subsp. aureus Mu50
ggaauaccuuuuucua

SEQ ID NO: 3983079 - RNA, 15 nt, Staphylococcus aureus subsp. aureus Mu50
ggaauauaaaacugu

SEQ ID NO: 3983080 - RNA, 16 nt, Staphylococcus aureus subsp. aureus Mu50
ggaauauuaacaccag

SEQ ID NO: 3983081 - RNA, 20 nt, Staphylococcus aureus subsp. aureus Mu50
ggaauauuucccuaugaaau

SEQ ID NO: 3983082 - RNA, 19 nt, Staphylococcus aureus subsp. aureus Mu50
ggaauugggaaauauuuga

SEQ ID NO: 3983083 - RNA, 21 nt, Staphylococcus aureus subsp. aureus Mu50
ggaauugguuuuuagugaaaa

SEQ ID NO: 3983084 - RNA, 14 nt, Staphylococcus aureus subsp. aureus Mu50
ggaauuuaccauuu

SEQ ID NO: 3983085 - RNA, 19 nt, Staphylococcus aureus subsp. aureus Mu50
ggacaacuaauaacaaaua

SEQ ID NO: 3983086 - RNA, 10 nt, Staphylococcus aureus subsp. aureus Mu50
ggacaaguuu

SEQ ID NO: 3983087 - RNA, 20 nt, Staphylococcus aureus subsp. aureus Mu50
ggacagaaaagggcaaaaaa

SEQ ID NO: 3983088 - RNA, 20 nt, Staphylococcus aureus subsp. aureus Mu50
ggacaguuuuuauauuaaga

SEQ ID NO: 3983089 - RNA, 17 nt, Staphylococcus aureus subsp. aureus Mu50
ggaccuuguaaauuuaa

SEQ ID NO: 3983090 - RNA, 18 nt, Staphylococcus aureus subsp. aureus Mu50
ggacuaacgucauuauau

SEQ ID NO: 3983091 - RNA, 12 nt, Staphylococcus aureus subsp. aureus Mu50
ggacugaaagaa

SEQ ID NO: 3983092 - RNA, 12 nt, Staphylococcus aureus subsp. aureus Mu50
ggagaaccuuua

SEQ ID NO: 3983093 - RNA, 12 nt, Staphylococcus aureus subsp. aureus Mu50
ggagaaccuuuu

SEQ ID NO: 3983094 - RNA, 14 nt, Staphylococcus aureus subsp. aureus Mu50
ggagauuagagaag

SEQ ID NO: 3983095 - RNA, 17 nt, Staphylococcus aureus subsp. aureus Mu50
ggagcacuaucuuuugc

SEQ ID NO: 3983096 - RNA, 13 nt, Staphylococcus aureus subsp. aureus Mu50
ggauaaaaauuua

SEQ ID NO: 3983097 - RNA, 12 nt, Staphylococcus aureus subsp. aureus Mu50
ggauaaagaugu

SEQ ID NO: 3983098 - RNA, 20 nt, Staphylococcus aureus subsp. aureus Mu50
ggauaauuuuuaacagcgug

SEQ ID NO: 3983099 - RNA, 19 nt, Staphylococcus aureus subsp. aureus Mu50
ggaucauuauuuagaauuc

SEQ ID NO: 3983100 - RNA, 13 nt, Staphylococcus aureus subsp. aureus Mu50
ggaucggcauugu

SEQ ID NO: 3983101 - RNA, 17 nt, Staphylococcus aureus subsp. aureus Mu50
ggaugaguuuaaaaaua

SEQ ID NO: 3983102 - RNA, 22 nt, Staphylococcus aureus subsp. aureus Mu50
ggaugggccccaacaaagagaa

SEQ ID NO: 3983103 - RNA, 16 nt, Staphylococcus aureus subsp. aureus Mu50
ggauguaauagagaag

SEQ ID NO: 3983104 - RNA, 22 nt, Staphylococcus aureus subsp. aureus Mu50
ggauguuauaaaaugaauaauu

SEQ ID NO: 3983105 - RNA, 20 nt, Staphylococcus aureus subsp. aureus Mu50
ggauguucaucaacaugaua

SEQ ID NO: 3983106 - RNA, 13 nt, Staphylococcus aureus subsp. aureus Mu50
ggauucaaaugac

SEQ ID NO: 3983107 - RNA, 15 nt, Staphylococcus aureus subsp. aureus Mu50
gguuaccaucuuuaa

SEQ ID NO: 3983108 - RNA, 18 nt, Staphylococcus aureus subsp. aureus Mu50
gguuaucacuuauuauuu

SEQ ID NO: 3983109 - RNA, 14 nt, Staphylococcus aureus subsp. aureus Mu50
gguuauuaaaauua

SEQ ID NO: 3983110 - RNA, 12 nt, Staphylococcus aureus subsp. aureus Mu50
gguuauuugaua

SEQ ID NO: 3983111 - RNA, 12 nt, Staphylococcus aureus subsp. aureus Mu50
gguucaucuaaa

SEQ ID NO: 3983112 - RNA, 13 nt, Staphylococcus aureus subsp. aureus Mu50
gguucgaaucccu

SEQ ID NO: 3983113 - RNA, 13 nt, Staphylococcus aureus subsp. aureus Mu50
gguucuauaauaa

SEQ ID NO: 3983114 - RNA, 14 nt, Staphylococcus aureus subsp. aureus Mu50
gguucuauaauuca

SEQ ID NO: 3983115 - RNA, 15 nt, Staphylococcus aureus subsp. aureus Mu50
gguucuucaauaugc

SEQ ID NO: 3983116 - RNA, 15 nt, Staphylococcus aureus subsp. aureus Mu50
gguuguuaggggcuu

SEQ ID NO: 3983117 - RNA, 14 nt, Staphylococcus aureus subsp. aureus Mu50
gguuuaaaaaugcu

SEQ ID NO: 3983118 - RNA, 21 nt, Staphylococcus aureus subsp. aureus Mu50
gguuuaaacaguuuaauucgu

SEQ ID NO: 3983119 - RNA, 13 nt, Staphylococcus aureus subsp. aureus Mu50
gguuuauuuaaua

SEQ ID NO: 3983120 - RNA, 11 nt, Staphylococcus aureus subsp. aureus Mu50
gguuugagaau

SEQ ID NO: 3983121 - RNA, 19 nt, Staphylococcus aureus subsp. aureus Mu50
gguuuucuuaauuauggua

SEQ ID NO: 3983122 - RNA, 20 nt, Staphylococcus aureus subsp. aureus Mu50
guaaaaaaagacaugagauu

SEQ ID NO: 3983123 - RNA, 15 nt, Staphylococcus aureus subsp. aureus Mu50
guaaaacugcaauaa

SEQ ID NO: 3983124 - RNA, 20 nt, Staphylococcus aureus subsp. aureus Mu50
guaaaaguuuugagccaagu

SEQ ID NO: 3983125 - RNA, 14 nt, Staphylococcus aureus subsp. aureus Mu50
guaaaauaaaucau

SEQ ID NO: 3983126 - RNA, 17 nt, Staphylococcus aureus subsp. aureus Mu50
guaaaauauacuugaag

SEQ ID NO: 3983127 - RNA, 21 nt, Staphylococcus aureus subsp. aureus Mu50
guaaaaugcucccuucaaagu

SEQ ID NO: 3983128 - RNA, 23 nt, Staphylococcus aureus subsp. aureus Mu50
guaaaauuuucguguuaauaacc

SEQ ID NO: 3983129 - RNA, 21 nt, Staphylococcus aureus subsp. aureus Mu50
guaaacaacaucgauuuauca

SEQ ID NO: 3983130 - RNA, 23 nt, Staphylococcus aureus subsp. aureus Mu50
guaaacaacaucgauuuaucauu

SEQ ID NO: 3983131 - RNA, 20 nt, Staphylococcus aureus subsp. aureus Mu50
guaaacacuuuaguauuaua

SEQ ID NO: 3983132 - RNA, 17 nt, Staphylococcus aureus subsp. aureus Mu50
guaaacauaaugacauc

SEQ ID NO: 3983133 - RNA, 20 nt, Staphylococcus aureus subsp. aureus Mu50
guaaacaugguuuucuuuuu

SEQ ID NO: 3983134 - RNA, 18 nt, Staphylococcus aureus subsp. aureus Mu50
guaaaccagcuaaaccau

SEQ ID NO: 3983135 - RNA, 19 nt, Staphylococcus aureus subsp. aureus Mu50
guaaaccuacuaauauauu

SEQ ID NO: 3983136 - RNA, 17 nt, Staphylococcus aureus subsp. aureus Mu50
guaaacgauacugcuuu

SEQ ID NO: 3983137 - RNA, 18 nt, Staphylococcus aureus subsp. aureus Mu50
guaaacggaauaacuuuu

SEQ ID NO: 3983138 - RNA, 19 nt, Staphylococcus aureus subsp. aureus Mu50
guaaacggaauaacuuuuu

SEQ ID NO: 3983139 - RNA, 19 nt, Staphylococcus aureus subsp. aureus Mu50
guaaagcuuuaguuaaaua

SEQ ID NO: 3983140 - RNA, 14 nt, Staphylococcus aureus subsp. aureus Mu50
guaaaggugauauu

SEQ ID NO: 3983141 - RNA, 15 nt, Staphylococcus aureus subsp. aureus Mu50
guaaaggugauauuu

SEQ ID NO: 3983142 - RNA, 21 nt, Staphylococcus aureus subsp. aureus Mu50
guaaaggugauauuugcuagu

SEQ ID NO: 3983143 - RNA, 20 nt, Staphylococcus aureus subsp. aureus Mu50
guaaauaaaaauuauauaaa

SEQ ID NO: 3983144 - RNA, 12 nt, Staphylococcus aureus subsp. aureus Mu50
guaaauauaaau

SEQ ID NO: 3983145 - RNA, 18 nt, Staphylococcus aureus subsp. aureus Mu50
guaaaucacgauuuucaa

SEQ ID NO: 3983146 - RNA, 13 nt, Staphylococcus aureus subsp. aureus Mu50
guaaaucaucaua

SEQ ID NO: 3983147 - RNA, 14 nt, Staphylococcus aureus subsp. aureus Mu50
guaaaucaugacau

SEQ ID NO: 3983148 - RNA, 21 nt, Staphylococcus aureus subsp. aureus Mu50
guaaauccuuuauauucuaau

SEQ ID NO: 3983149 - RNA, 21 nt, Staphylococcus aureus subsp. aureus Mu50
guaaaucgugcuguuaucaug

SEQ ID NO: 3983150 - RNA, 20 nt, Staphylococcus aureus subsp. aureus Mu50
guaaaucuuguuggauuuua

SEQ ID NO: 3983151 - RNA, 16 nt, Staphylococcus aureus subsp. aureus Mu50
guaaauguuaaauucu

SEQ ID NO: 3983152 - RNA, 22 nt, Staphylococcus aureus subsp. aureus Mu50
guaaauuaauagagaaagaaua

SEQ ID NO: 3983153 - RNA, 14 nt, Staphylococcus aureus subsp. aureus Mu50
guaaauuuaaaaua

SEQ ID NO: 3983154 - RNA, 12 nt, Staphylococcus aureus subsp. aureus Mu50
guaaauuuauca

SEQ ID NO: 3983155 - RNA, 14 nt, Staphylococcus aureus subsp. aureus Mu50
guaaauuuaucauu

SEQ ID NO: 3983156 - RNA, 17 nt, Staphylococcus aureus subsp. aureus Mu50
guaaauuuaucauuuua

SEQ ID NO: 3983157 - RNA, 19 nt, Staphylococcus aureus subsp. aureus Mu50
guaaauuuuaucuaaacau

SEQ ID NO: 3983158 - RNA, 13 nt, Staphylococcus aureus subsp. aureus Mu50
guaacaagcauuu

SEQ ID NO: 3983159 - RNA, 18 nt, Staphylococcus aureus subsp. aureus Mu50
guaacaauuuagcaaaua

SEQ ID NO: 3983160 - RNA, 23 nt, Staphylococcus aureus subsp. aureus Mu50
guaacaauuuagcaaauauuucu

SEQ ID NO: 3983161 - RNA, 23 nt, Staphylococcus aureus subsp. aureus Mu50
guaacacacuuauaaucuauaaa

SEQ ID NO: 3983162 - RNA, 17 nt, Staphylococcus aureus subsp. aureus Mu50
guaacacgcucuuuuca

SEQ ID NO: 3983163 - RNA, 15 nt, Staphylococcus aureus subsp. aureus Mu50
guaacagugacugau

SEQ ID NO: 3983164 - RNA, 12 nt, Staphylococcus aureus subsp. aureus Mu50
guaacauaaaca

SEQ ID NO: 3983165 - RNA, 15 nt, Staphylococcus aureus subsp. aureus Mu50
guaacauaucagcuu

SEQ ID NO: 3983166 - RNA, 16 nt, Staphylococcus aureus subsp. aureus Mu50
guaacauuaaaaauaa

SEQ ID NO: 3983167 - RNA, 18 nt, Staphylococcus aureus subsp. aureus Mu50
guaacauuaaaaauaaaa

SEQ ID NO: 3983168 - RNA, 18 nt, Staphylococcus aureus subsp. aureus Mu50
guaacauuuaaaaaaugc

SEQ ID NO: 3983169 - RNA, 19 nt, Staphylococcus aureus subsp. aureus Mu50
guaacauuuaaaaaaugcg

SEQ ID NO: 3983170 - RNA, 17 nt, Staphylococcus aureus subsp. aureus Mu50
guaaccauuuuuuuauc

SEQ ID NO: 3983171 - RNA, 15 nt, Staphylococcus aureus subsp. aureus Mu50
guaaccuuaaauaua

SEQ ID NO: 3983172 - RNA, 15 nt, Staphylococcus aureus subsp. aureus Mu50
guaacgcgcaaugag

SEQ ID NO: 3983173 - RNA, 22 nt, Staphylococcus aureus subsp. aureus Mu50
guaacgcucaugaguuucucau

SEQ ID NO: 3983174 - RNA, 13 nt, Staphylococcus aureus subsp. aureus Mu50
guaacuaaaaugu

SEQ ID NO: 3983175 - RNA, 14 nt, Staphylococcus aureus subsp. aureus Mu50
guaacuaaaauguc

SEQ ID NO: 3983176 - RNA, 15 nt, Staphylococcus aureus subsp. aureus Mu50
guaacuaaaaugucu

SEQ ID NO: 3983177 - RNA, 23 nt, Staphylococcus aureus subsp. aureus Mu50
guaacuaacauguuauugcuuau

SEQ ID NO: 3983178 - RNA, 22 nt, Staphylococcus aureus subsp. aureus Mu50
guaacuauaugaaauguucccu

SEQ ID NO: 3983179 - RNA, 13 nt, Staphylococcus aureus subsp. aureus Mu50
guaacuauugaaa

SEQ ID NO: 3983180 - RNA, 23 nt, Staphylococcus aureus subsp. aureus Mu50
guaacugauuuuguuucaaacgu

SEQ ID NO: 3983181 - RNA, 17 nt, Staphylococcus aureus subsp. aureus Mu50
guaacuuuaucacugua

SEQ ID NO: 3983182 - RNA, 20 nt, Staphylococcus aureus subsp. aureus Mu50
guaacuuuuuacauuuucaa

SEQ ID NO: 3983183 - RNA, 14 nt, Staphylococcus aureus subsp. aureus Mu50
guaagaacgaaacu

SEQ ID NO: 3983184 - RNA, 18 nt, Staphylococcus aureus subsp. aureus Mu50
guaagaccccgaaaagag

SEQ ID NO: 3983185 - RNA, 19 nt, Staphylococcus aureus subsp. aureus Mu50
guaagaccccgaaaagagg

SEQ ID NO: 3983186 - RNA, 15 nt, Staphylococcus aureus subsp. aureus Mu50
guaagacuucccaau

SEQ ID NO: 3983187 - RNA, 18 nt, Staphylococcus aureus subsp. aureus Mu50
guaagauaacgagugaaa

SEQ ID NO: 3983188 - RNA, 17 nt, Staphylococcus aureus subsp. aureus Mu50
guaagcagagccauaau

SEQ ID NO: 3983189 - RNA, 20 nt, Staphylococcus aureus subsp. aureus Mu50
guaagcuucuguguuggggc

SEQ ID NO: 3983190 - RNA, 21 nt, Staphylococcus aureus subsp. aureus Mu50
guaaguaaaauaaaaaaugca

SEQ ID NO: 3983191 - RNA, 23 nt, Staphylococcus aureus subsp. aureus Mu50
guaaguaaaauaaaaaaugcacu

SEQ ID NO: 3983192 - RNA, 16 nt, Staphylococcus aureus subsp. aureus Mu50
guaaguaauaaaauaa

SEQ ID NO: 3983193 - RNA, 13 nt, Staphylococcus aureus subsp. aureus Mu50
guaagugcucaaa

SEQ ID NO: 3983194 - RNA, 15 nt, Staphylococcus aureus subsp. aureus Mu50
guaaguguaaaugaa

SEQ ID NO: 3983195 - RNA, 18 nt, Staphylococcus aureus subsp. aureus Mu50
guagcuaaugcaacuaaa

SEQ ID NO: 3983196 - RNA, 22 nt, Staphylococcus aureus subsp. aureus Mu50
guagcuuaacguugcagagaau

SEQ ID NO: 3983197 - RNA, 18 nt, Staphylococcus aureus subsp. aureus Mu50
guagcuugaauaauauau

SEQ ID NO: 3983198 - RNA, 21 nt, Staphylococcus aureus subsp. aureus Mu50
guagcuugaauaauauauuua

SEQ ID NO: 3983199 - RNA, 15 nt, Staphylococcus aureus subsp. aureus Mu50
guaggacauauaaau

SEQ ID NO: 3983200 - RNA, 16 nt, Staphylococcus aureus subsp. aureus Mu50
guaggauaauuucaau

SEQ ID NO: 3983201 - RNA, 22 nt, Staphylococcus aureus subsp. aureus Mu50
guaggaugcuuccuuuuuguua

SEQ ID NO: 3983202 - RNA, 23 nt, Staphylococcus aureus subsp. aureus Mu50
guagggaguauuguuuuauauuu

SEQ ID NO: 3983203 - RNA, 13 nt, Staphylococcus aureus subsp. aureus Mu50
guagguaagaaaa

SEQ ID NO: 3983204 - RNA, 20 nt, Staphylococcus aureus subsp. aureus Mu50
guaguacacgaauucauuaa

SEQ ID NO: 3983205 - RNA, 16 nt, Staphylococcus aureus subsp. aureus Mu50
guaguacuauagucau

SEQ ID NO: 3983206 - RNA, 15 nt, Staphylococcus aureus subsp. aureus Mu50
guagucaaaauugug

SEQ ID NO: 3983207 - RNA, 23 nt, Staphylococcus aureus subsp. aureus Mu50
guaguguauucauuuuaaauuca

SEQ ID NO: 3983208 - RNA, 13 nt, Staphylococcus aureus subsp. aureus Mu50
guaguuaauauaa

SEQ ID NO: 3983209 - RNA, 20 nt, Staphylococcus aureus subsp. aureus Mu50
guaguuccucgguauucaau

SEQ ID NO: 3983210 - RNA, 18 nt, Staphylococcus aureus subsp. aureus Mu50
guaguucggaugagaaau

SEQ ID NO: 3983211 - RNA, 14 nt, Staphylococcus aureus subsp. aureus Mu50
guauaaaacagaau

SEQ ID NO: 3983212 - RNA, 15 nt, Staphylococcus aureus subsp. aureus Mu50
guauaaaacuaauua

SEQ ID NO: 3983213 - RNA, 15 nt, Staphylococcus aureus subsp. aureus Mu50
guauaaauaaaaaua

SEQ ID NO: 3983214 - RNA, 18 nt, Staphylococcus aureus subsp. aureus Mu50
guauaaauaaaaauacau

SEQ ID NO: 3983215 - RNA, 13 nt, Staphylococcus aureus subsp. aureus Mu50
guauaaaugcagc

SEQ ID NO: 3983216 - RNA, 17 nt, Staphylococcus aureus subsp. aureus Mu50
guauaaccauguauauc

SEQ ID NO: 3983217 - RNA, 20 nt, Staphylococcus aureus subsp. aureus Mu50
guauaaccauguauaucuaa

SEQ ID NO: 3983218 - RNA, 22 nt, Staphylococcus aureus subsp. aureus Mu50
guauaauggacgguauuuucaa

SEQ ID NO: 3983219 - RNA, 20 nt, Staphylococcus aureus subsp. aureus Mu50
guauaauuaaacuaauagca

SEQ ID NO: 3983220 - RNA, 16 nt, Staphylococcus aureus subsp. aureus Mu50
guauacaaauugauuu

SEQ ID NO: 3983221 - RNA, 22 nt, Staphylococcus aureus subsp. aureus Mu50
guauacaguuuuacuauaauga

SEQ ID NO: 3983222 - RNA, 20 nt, Staphylococcus aureus subsp. aureus Mu50
guauacuaaacuuuuuucaa

SEQ ID NO: 3983223 - RNA, 22 nt, Staphylococcus aureus subsp. aureus Mu50
guauauaaguuaaaauugguuu

SEQ ID NO: 3983224 - RNA, 15 nt, Staphylococcus aureus subsp. aureus Mu50
guauauaauugauug

SEQ ID NO: 3983225 - RNA, 20 nt, Staphylococcus aureus subsp. aureus Mu50
guauauauauauuaaaacaa

SEQ ID NO: 3983226 - RNA, 21 nt, Staphylococcus aureus subsp. aureus Mu50
guauauaucaaauacauuuca

SEQ ID NO: 3983227 - RNA, 19 nt, Staphylococcus aureus subsp. aureus Mu50
guauaugaauuuuauaaau

SEQ ID NO: 3983228 - RNA, 22 nt, Staphylococcus aureus subsp. aureus Mu50
guauaugaauuuuauaaauuaa

SEQ ID NO: 3983229 - RNA, 17 nt, Staphylococcus aureus subsp. aureus Mu50
guauauggcgauaacaa

SEQ ID NO: 3983230 - RNA, 19 nt, Staphylococcus aureus subsp. aureus Mu50
guauauuaaaaauuucaau

SEQ ID NO: 3983231 - RNA, 18 nt, Staphylococcus aureus subsp. aureus Mu50
guauauugcuuauguaca

SEQ ID NO: 3983232 - RNA, 16 nt, Staphylococcus aureus subsp. aureus Mu50
guaucaacauuaauaa

SEQ ID NO: 3983233 - RNA, 17 nt, Staphylococcus aureus subsp. aureus Mu50
guaucaacauuaauaaa

SEQ ID NO: 3983234 - RNA, 20 nt, Staphylococcus aureus subsp. aureus Mu50
guaucauuguguccauaaau

SEQ ID NO: 3983235 - RNA, 12 nt, Staphylococcus aureus subsp. aureus Mu50
guaucauuuaaa

SEQ ID NO: 3983236 - RNA, 20 nt, Staphylococcus aureus subsp. aureus Mu50
guauccccauuuauguguug

SEQ ID NO: 3983237 - RNA, 21 nt, Staphylococcus aureus subsp. aureus Mu50
guauccuguguaaaauaaauc

SEQ ID NO: 3983238 - RNA, 20 nt, Staphylococcus aureus subsp. aureus Mu50
guaucgauaguucuauauaa

SEQ ID NO: 3983239 - RNA, 15 nt, Staphylococcus aureus subsp. aureus Mu50
guaucgccaaucuau

SEQ ID NO: 3983240 - RNA, 15 nt, Staphylococcus aureus subsp. aureus Mu50
guaucguuaccuuuu

SEQ ID NO: 3983241 - RNA, 14 nt, Staphylococcus aureus subsp. aureus Mu50
guaucuauaaaaag

SEQ ID NO: 3983242 - RNA, 16 nt, Staphylococcus aureus subsp. aureus Mu50
guaucuauacaauuau

SEQ ID NO: 3983243 - RNA, 18 nt, Staphylococcus aureus subsp. aureus Mu50
guaucuaugaaauuuuuu

SEQ ID NO: 3983244 - RNA, 19 nt, Staphylococcus aureus subsp. aureus Mu50
guaucuaugaaauuuuuua

SEQ ID NO: 3983245 - RNA, 21 nt, Staphylococcus aureus subsp. aureus Mu50
guaucucugaaaaacuucuua

SEQ ID NO: 3983246 - RNA, 20 nt, Staphylococcus aureus subsp. aureus Mu50
guaucugugaauaugcuuuu

SEQ ID NO: 3983247 - RNA, 16 nt, Staphylococcus aureus subsp. aureus Mu50
guaucuugucauuuga

SEQ ID NO: 3983248 - RNA, 14 nt, Staphylococcus aureus subsp. aureus Mu50
guaugagucaaauu

SEQ ID NO: 3983249 - RNA, 19 nt, Staphylococcus aureus subsp. aureus Mu50
guaugauagaauacuaaaa

SEQ ID NO: 3983250 - RNA, 20 nt, Staphylococcus aureus subsp. aureus Mu50
guaugcaucaguuaauaauu

SEQ ID NO: 3983251 - RNA, 14 nt, Staphylococcus aureus subsp. aureus Mu50
guaugcgguuauau

SEQ ID NO: 3983252 - RNA, 18 nt, Staphylococcus aureus subsp. aureus Mu50
guaugcgguuauaucauu

SEQ ID NO: 3983253 - RNA, 13 nt, Staphylococcus aureus subsp. aureus Mu50
guauggaauaaau

SEQ ID NO: 3983254 - RNA, 18 nt, Staphylococcus aureus subsp. aureus Mu50
guauggaauaaaugguuu

SEQ ID NO: 3983255 - RNA, 16 nt, Staphylococcus aureus subsp. aureus Mu50
guauggacuaagauau

SEQ ID NO: 3983256 - RNA, 22 nt, Staphylococcus aureus subsp. aureus Mu50
guauuagcaauuuggucauaua

SEQ ID NO: 3983257 - RNA, 22 nt, Staphylococcus aureus subsp. aureus Mu50
guauuaugauugcuuauuuauu

SEQ ID NO: 3983258 - RNA, 20 nt, Staphylococcus aureus subsp. aureus Mu50
guauucaaaguuuucauuua

SEQ ID NO: 3983259 - RNA, 22 nt, Staphylococcus aureus subsp. aureus Mu50
guauucaaauaaacacaucuau

SEQ ID NO: 3983260 - RNA, 23 nt, Staphylococcus aureus subsp. aureus Mu50
guauucagucaguaaaaauacau

SEQ ID NO: 3983261 - RNA, 15 nt, Staphylococcus aureus subsp. aureus Mu50
guauucuauuuuuca

SEQ ID NO: 3983262 - RNA, 19 nt, Staphylococcus aureus subsp. aureus Mu50
guauucuauuuuucaauuc

SEQ ID NO: 3983263 - RNA, 19 nt, Staphylococcus aureus subsp. aureus Mu50
guauucuuggcguauuuuu

SEQ ID NO: 3983264 - RNA, 23 nt, Staphylococcus aureus subsp. aureus Mu50
guauucuuggcguauuuuuuguu

SEQ ID NO: 3983265 - RNA, 16 nt, Staphylococcus aureus subsp. aureus Mu50
guauucuuuuaauaga

SEQ ID NO: 3983266 - RNA, 12 nt, Staphylococcus aureus subsp. aureus Mu50
guauugauucaa

SEQ ID NO: 3983267 - RNA, 21 nt, Staphylococcus aureus subsp. aureus Mu50
guauugcauguuuaaauauca

SEQ ID NO: 3983268 - RNA, 17 nt, Staphylococcus aureus subsp. aureus Mu50
guauugccaaauuucuc

SEQ ID NO: 3983269 - RNA, 19 nt, Staphylococcus aureus subsp. aureus Mu50
guauugccguuauuuucaa

SEQ ID NO: 3983270 - RNA, 18 nt, Staphylococcus aureus subsp. aureus Mu50
guauuguccauagauaca

SEQ ID NO: 3983271 - RNA, 14 nt, Staphylococcus aureus subsp. aureus Mu50
guauuuaauguuuu

SEQ ID NO: 3983272 - RNA, 15 nt, Staphylococcus aureus subsp. aureus Mu50
guauuuaauguuuua

SEQ ID NO: 3983273 - RNA, 16 nt, Staphylococcus aureus subsp. aureus Mu50
guauuuaccuucuucu

SEQ ID NO: 3983274 - RNA, 13 nt, Staphylococcus aureus subsp. aureus Mu50
guauuuacuuuuc

SEQ ID NO: 3983275 - RNA, 18 nt, Staphylococcus aureus subsp. aureus Mu50
guauuuaguaucaugaua

SEQ ID NO: 3983276 - RNA, 18 nt, Staphylococcus aureus subsp. aureus Mu50
guauuuauacuauaaaua

SEQ ID NO: 3983277 - RNA, 15 nt, Staphylococcus aureus subsp. aureus Mu50
guauuuauagauuua

SEQ ID NO: 3983278 - RNA, 22 nt, Staphylococcus aureus subsp. aureus Mu50
guauuucugaaaugauacauua

SEQ ID NO: 3983279 - RNA, 18 nt, Staphylococcus aureus subsp. aureus Mu50
guauuugccuuuugaaua

SEQ ID NO: 3983280 - RNA, 13 nt, Staphylococcus aureus subsp. aureus Mu50
guauuuuaauauu

SEQ ID NO: 3983281 - RNA, 17 nt, Staphylococcus aureus subsp. aureus Mu50
guauuuuaaugauuuuu

SEQ ID NO: 3983282 - RNA, 21 nt, Staphylococcus aureus subsp. aureus Mu50
gucuccacacuaaauguucug

SEQ ID NO: 3983283 - RNA, 18 nt, Staphylococcus aureus subsp. aureus Mu50
gucucuaaaacuuuuuca

SEQ ID NO: 3983284 - RNA, 18 nt, Staphylococcus aureus subsp. aureus Mu50
gucucuugucauuucaau

SEQ ID NO: 3983285 - RNA, 20 nt, Staphylococcus aureus subsp. aureus Mu50
gucugaauuagauuuuguug

SEQ ID NO: 3983286 - RNA, 20 nt, Staphylococcus aureus subsp. aureus Mu50
gucugaugucgaaaauagcu

SEQ ID NO: 3983287 - RNA, 18 nt, Staphylococcus aureus subsp. aureus Mu50
gucugcauuaauuucaug

SEQ ID NO: 3983288 - RNA, 11 nt, Staphylococcus aureus subsp. aureus Mu50
gucuuaaacau

SEQ ID NO: 3983289 - RNA, 12 nt, Staphylococcus aureus subsp. aureus Mu50
gucuuaaacaua

SEQ ID NO: 3983290 - RNA, 13 nt, Staphylococcus aureus subsp. aureus Mu50
gucuuaauucauu

SEQ ID NO: 3983291 - RNA, 13 nt, Staphylococcus aureus subsp. aureus Mu50
gucuuucuaaguu

SEQ ID NO: 3983292 - RNA, 13 nt, Staphylococcus aureus subsp. aureus Mu50
gucuuugaaaaac

SEQ ID NO: 3983293 - RNA, 13 nt, Staphylococcus aureus subsp. aureus Mu50
gucuuuuauuaug

SEQ ID NO: 3983294 - RNA, 14 nt, Staphylococcus aureus subsp. aureus Mu50
gucuuuugauuuuu

SEQ ID NO: 3983295 - RNA, 22 nt, Staphylococcus aureus subsp. aureus Mu50
gucuuuuuacugacucuuaauu

SEQ ID NO: 3983296 - RNA, 17 nt, Staphylococcus aureus subsp. aureus Mu50
gugaaaacccugaagau

SEQ ID NO: 3983297 - RNA, 12 nt, Staphylococcus aureus subsp. aureus Mu50
gugaaaaguguu

SEQ ID NO: 3983298 - RNA, 21 nt, Staphylococcus aureus subsp. aureus Mu50
gugaaaauuuauucaaaucau

SEQ ID NO: 3983299 - RNA, 19 nt, Staphylococcus aureus subsp. aureus Mu50
gugaaaguuuuugucuuaa

SEQ ID NO: 3983300 - RNA, 14 nt, Staphylococcus aureus subsp. aureus Mu50
gugaaauaucaaga

SEQ ID NO: 3983301 - RNA, 21 nt, Staphylococcus aureus subsp. aureus Mu50
gugaaauuagaaaaauaugau

SEQ ID NO: 3983302 - RNA, 20 nt, Staphylococcus aureus subsp. aureus Mu50
gugaaauucgaacuaucaau

SEQ ID NO: 3983303 - RNA, 17 nt, Staphylococcus aureus subsp. aureus Mu50
gugaagagaugaaagau

SEQ ID NO: 3983304 - RNA, 23 nt, Staphylococcus aureus subsp. aureus Mu50
gugaaggagauuaagcaauguaa

SEQ ID NO: 3983305 - RNA, 15 nt, Staphylococcus aureus subsp. aureus Mu50
gugaaguaugauaga

SEQ ID NO: 3983306 - RNA, 23 nt, Staphylococcus aureus subsp. aureus Mu50
gugaaucuuauuuuguuuuaaaa

SEQ ID NO: 3983307 - RNA, 12 nt, Staphylococcus aureus subsp. aureus Mu50
gugaaugguuga

SEQ ID NO: 3983308 - RNA, 17 nt, Staphylococcus aureus subsp. aureus Mu50
gugaaugguugauuaua

SEQ ID NO: 3983309 - RNA, 20 nt, Staphylococcus aureus subsp. aureus Mu50
gugaaugguugauuauauuu

SEQ ID NO: 3983310 - RNA, 13 nt, Staphylococcus aureus subsp. aureus Mu50
gugacaaacauuu

SEQ ID NO: 3983311 - RNA, 23 nt, Staphylococcus aureus subsp. aureus Mu50
gugacacuguaacgaguccauuu

SEQ ID NO: 3983312 - RNA, 21 nt, Staphylococcus aureus subsp. aureus Mu50
gugaccaauagaauucauuaa

SEQ ID NO: 3983313 - RNA, 15 nt, Staphylococcus aureus subsp. aureus Mu50
gugacucaaugaauu

SEQ ID NO: 3983314 - RNA, 16 nt, Staphylococcus aureus subsp. aureus Mu50
gugacucaaugaauuu

SEQ ID NO: 3983315 - RNA, 18 nt, Staphylococcus aureus subsp. aureus Mu50
gugacucggggaauuuuu

SEQ ID NO: 3983316 - RNA, 15 nt, Staphylococcus aureus subsp. aureus Mu50
gugacuuguaucauc

SEQ ID NO: 3983317 - RNA, 17 nt, Staphylococcus aureus subsp. aureus Mu50
gugacuuuuauaauucu

SEQ ID NO: 3983318 - RNA, 15 nt, Staphylococcus aureus subsp. aureus Mu50
gugaggcccauaaau

SEQ ID NO: 3983319 - RNA, 20 nt, Staphylococcus aureus subsp. aureus Mu50
gugaguuuccauauuuuuua

SEQ ID NO: 3983320 - RNA, 11 nt, Staphylococcus aureus subsp. aureus Mu50
gugauaaaaau

SEQ ID NO: 3983321 - RNA, 16 nt, Staphylococcus aureus subsp. aureus Mu50
gugauaaauaaugcau

SEQ ID NO: 3983322 - RNA, 22 nt, Staphylococcus aureus subsp. aureus Mu50
gugauaauuaaaauaagauaua

SEQ ID NO: 3983323 - RNA, 21 nt, Staphylococcus aureus subsp. aureus Mu50
gugauagaaguuuuuugauua

SEQ ID NO: 3983324 - RNA, 21 nt, Staphylococcus aureus subsp. aureus Mu50
gugauauuaauugaaaaacca

SEQ ID NO: 3983325 - RNA, 23 nt, Staphylococcus aureus subsp. aureus Mu50
gugauauuaauugaaaaaccaag

SEQ ID NO: 3983326 - RNA, 19 nt, Staphylococcus aureus subsp. aureus Mu50
gugaucuuuuuuauauuca

SEQ ID NO: 3983327 - RNA, 18 nt, Staphylococcus aureus subsp. aureus Mu50
gugaugcuugaauguuug

SEQ ID NO: 3983328 - RNA, 14 nt, Staphylococcus aureus subsp. aureus Mu50
gugauuaauuucau

SEQ ID NO: 3983329 - RNA, 13 nt, Staphylococcus aureus subsp. aureus Mu50
gugauucaucuau

SEQ ID NO: 3983330 - RNA, 17 nt, Staphylococcus aureus subsp. aureus Mu50
gugauuuaaaaaauuua

SEQ ID NO: 3983331 - RNA, 19 nt, Staphylococcus aureus subsp. aureus Mu50
gugauuuaaaaaauuuaau

SEQ ID NO: 3983332 - RNA, 17 nt, Staphylococcus aureus subsp. aureus Mu50
gugauuuguuacuucua

SEQ ID NO: 3983333 - RNA, 16 nt, Staphylococcus aureus subsp. aureus Mu50
gugauuuuuaauaauu

SEQ ID NO: 3983334 - RNA, 16 nt, Staphylococcus aureus subsp. aureus Mu50
gugcaaguauaaucca

SEQ ID NO: 3983335 - RNA, 22 nt, Staphylococcus aureus subsp. aureus Mu50
gugcaauaauaaauaggaugaa

SEQ ID NO: 3983336 - RNA, 19 nt, Staphylococcus aureus subsp. aureus Mu50
gugcacuuguaauauuaua

SEQ ID NO: 3983337 - RNA, 17 nt, Staphylococcus aureus subsp. aureus Mu50
gugcaggauaacguuca

SEQ ID NO: 3983338 - RNA, 22 nt, Staphylococcus aureus subsp. aureus Mu50
gugcauuuagaugauucuuauc

SEQ ID NO: 3983339 - RNA, 15 nt, Staphylococcus aureus subsp. aureus Mu50
gugccuuugcuuuuu

SEQ ID NO: 3983340 - RNA, 21 nt, Staphylococcus aureus subsp. aureus Mu50
gugcgugaagagaugaaagau

SEQ ID NO: 3983341 - RNA, 15 nt, Staphylococcus aureus subsp. aureus Mu50
gugcuaaguuagggc

SEQ ID NO: 3983342 - RNA, 16 nt, Staphylococcus aureus subsp. aureus Mu50
gugcuaccuacuuguu

SEQ ID NO: 3983343 - RNA, 20 nt, Staphylococcus aureus subsp. aureus Mu50
gugcuauuaauuugauaaau

SEQ ID NO: 3983344 - RNA, 13 nt, Staphylococcus aureus subsp. aureus Mu50
gugcuuacuuuua

SEQ ID NO: 3983345 - RNA, 14 nt, Staphylococcus aureus subsp. aureus Mu50
gugcuuuaaaguug

SEQ ID NO: 3983346 - RNA, 23 nt, Staphylococcus aureus subsp. aureus Mu50
gugcuuucaccuuugaauauagu

SEQ ID NO: 3983347 - RNA, 15 nt, Staphylococcus aureus subsp. aureus Mu50
gugcuuuguuuauca

SEQ ID NO: 3983348 - RNA, 16 nt, Staphylococcus aureus subsp. aureus Mu50
gugcuuuguuuaucaa

SEQ ID NO: 3983349 - RNA, 21 nt, Staphylococcus aureus subsp. aureus Mu50
gugcuuuuccauaaauauuua

SEQ ID NO: 3983350 - RNA, 20 nt, Staphylococcus aureus subsp. aureus Mu50
guggaaaucucggcauuuuu

SEQ ID NO: 3983351 - RNA, 17 nt, Staphylococcus aureus subsp. aureus Mu50
guggagaaccuuuaaaa

SEQ ID NO: 3983352 - RNA, 20 nt, Staphylococcus aureus subsp. aureus Mu50
guggauuacagaugaugcuu

SEQ ID NO: 3983353 - RNA, 22 nt, Staphylococcus aureus subsp. aureus Mu50
guggcaccucuuuuguuuagua

SEQ ID NO: 3983354 - RNA, 21 nt, Staphylococcus aureus subsp. aureus Mu50
guggcuacuugaauaccuuuu

SEQ ID NO: 3983355 - RNA, 19 nt, Staphylococcus aureus subsp. aureus Mu50
guggcuuuuuuuauggugu

SEQ ID NO: 3983356 - RNA, 20 nt, Staphylococcus aureus subsp. aureus Mu50
guggcuuuuuuuauggugug

SEQ ID NO: 3983357 - RNA, 13 nt, Staphylococcus aureus subsp. aureus Mu50
gugguguuuauau

SEQ ID NO: 3983358 - RNA, 20 nt, Staphylococcus aureus subsp. aureus Mu50
guguaacuuuaucacuguau

SEQ ID NO: 3983359 - RNA, 18 nt, Staphylococcus aureus subsp. aureus Mu50
guguaauaaagcaauguu

SEQ ID NO: 3983360 - RNA, 22 nt, Staphylococcus aureus subsp. aureus Mu50
guguacguuaaucagugaaaua

SEQ ID NO: 3983361 - RNA, 19 nt, Staphylococcus aureus subsp. aureus Mu50
guguagauaaaucgauaaa

SEQ ID NO: 3983362 - RNA, 22 nt, Staphylococcus aureus subsp. aureus Mu50
guguauauuauuuugcuuuaau

SEQ ID NO: 3983363 - RNA, 14 nt, Staphylococcus aureus subsp. aureus Mu50
guguaugauagaau

SEQ ID NO: 3983364 - RNA, 22 nt, Staphylococcus aureus subsp. aureus Mu50
guguaugauagaauacuaaaag

SEQ ID NO: 3983365 - RNA, 17 nt, Staphylococcus aureus subsp. aureus Mu50
guguauucauuuuaaau

SEQ ID NO: 3983366 - RNA, 15 nt, Staphylococcus aureus subsp. aureus Mu50
gugucacaaagaaau

SEQ ID NO: 3983367 - RNA, 16 nt, Staphylococcus aureus subsp. aureus Mu50
gugucauaauccauuc

SEQ ID NO: 3983368 - RNA, 14 nt, Staphylococcus aureus subsp. aureus Mu50
gugucaugcugaau

SEQ ID NO: 3983369 - RNA, 17 nt, Staphylococcus aureus subsp. aureus Mu50
guucggaauuugcacaa

SEQ ID NO: 3983370 - RNA, 14 nt, Staphylococcus aureus subsp. aureus Mu50
guucggaugagaaa

SEQ ID NO: 3983371 - RNA, 13 nt, Staphylococcus aureus subsp. aureus Mu50
guucuaaguguuu

SEQ ID NO: 3983372 - RNA, 18 nt, Staphylococcus aureus subsp. aureus Mu50
guucuauauaauuuauuu

SEQ ID NO: 3983373 - RNA, 14 nt, Staphylococcus aureus subsp. aureus Mu50
guucuauugcagaa

SEQ ID NO: 3983374 - RNA, 19 nt, Staphylococcus aureus subsp. aureus Mu50
guucucauuauaaugauuu

SEQ ID NO: 3983375 - RNA, 17 nt, Staphylococcus aureus subsp. aureus Mu50
guucuccaccaaaugug

SEQ ID NO: 3983376 - RNA, 17 nt, Staphylococcus aureus subsp. aureus Mu50
guucucguguaaaaugc

SEQ ID NO: 3983377 - RNA, 14 nt, Staphylococcus aureus subsp. aureus Mu50
guucugcuuuuucu

SEQ ID NO: 3983378 - RNA, 19 nt, Staphylococcus aureus subsp. aureus Mu50
guucugcuuuuucuuuauc

SEQ ID NO: 3983379 - RNA, 14 nt, Staphylococcus aureus subsp. aureus Mu50
guucuuauaaaaaa

SEQ ID NO: 3983380 - RNA, 21 nt, Staphylococcus aureus subsp. aureus Mu50
guucuucaucuuuuauggugg

SEQ ID NO: 3983381 - RNA, 17 nt, Staphylococcus aureus subsp. aureus Mu50
guucuugguauuuuuua

SEQ ID NO: 3983382 - RNA, 18 nt, Staphylococcus aureus subsp. aureus Mu50
guucuugguauuuuuuaa

SEQ ID NO: 3983383 - RNA, 13 nt, Staphylococcus aureus subsp. aureus Mu50
guugaacgguugu

SEQ ID NO: 3983384 - RNA, 21 nt, Staphylococcus aureus subsp. aureus Mu50
guugaacgguuguauuucauc

SEQ ID NO: 3983385 - RNA, 15 nt, Staphylococcus aureus subsp. aureus Mu50
guugaagcuaauuca

SEQ ID NO: 3983386 - RNA, 18 nt, Staphylococcus aureus subsp. aureus Mu50
guugaauacuucguuaua

SEQ ID NO: 3983387 - RNA, 19 nt, Staphylococcus aureus subsp. aureus Mu50
guugaauguggaacaugau

SEQ ID NO: 3983388 - RNA, 16 nt, Staphylococcus aureus subsp. aureus Mu50
guugaauuaacaauau

SEQ ID NO: 3983389 - RNA, 17 nt, Staphylococcus aureus subsp. aureus Mu50
guugaauuucuuuaagu

SEQ ID NO: 3983390 - RNA, 17 nt, Staphylococcus aureus subsp. aureus Mu50
guugaccuuguucuuuc

SEQ ID NO: 3983391 - RNA, 23 nt, Staphylococcus aureus subsp. aureus Mu50
guugacguugugucaugcugaau

SEQ ID NO: 3983392 - RNA, 15 nt, Staphylococcus aureus subsp. aureus Mu50
guugacugaacgaaa

SEQ ID NO: 3983393 - RNA, 14 nt, Staphylococcus aureus subsp. aureus Mu50
guugauaaauaaac

SEQ ID NO: 3983394 - RNA, 19 nt, Staphylococcus aureus subsp. aureus Mu50
guugauaauagccauucga

SEQ ID NO: 3983395 - RNA, 19 nt, Staphylococcus aureus subsp. aureus Mu50
guugauauauauuuugcaa

SEQ ID NO: 3983396 - RNA, 21 nt, Staphylococcus aureus subsp. aureus Mu50
guugaucuuugacauguguua

SEQ ID NO: 3983397 - RNA, 16 nt, Staphylococcus aureus subsp. aureus Mu50
guugauguguugcauu

SEQ ID NO: 3983398 - RNA, 15 nt, Staphylococcus aureus subsp. aureus Mu50
guugauuauauuucu

SEQ ID NO: 3983399 - RNA, 21 nt, Staphylococcus aureus subsp. aureus Mu50
guugauugcaugacagcaaau

SEQ ID NO: 3983400 - RNA, 22 nt, Staphylococcus aureus subsp. aureus Mu50
guugcaaauuggauaauuucuu

SEQ ID NO: 3983401 - RNA, 15 nt, Staphylococcus aureus subsp. aureus Mu50
guugcacucuuuucu

SEQ ID NO: 3983402 - RNA, 14 nt, Staphylococcus aureus subsp. aureus Mu50
guugcaguuucaau

SEQ ID NO: 3983403 - RNA, 18 nt, Staphylococcus aureus subsp. aureus Mu50
guugcauaaucaauuuca

SEQ ID NO: 3983404 - RNA, 21 nt, Staphylococcus aureus subsp. aureus Mu50
guugcauuaagugcaauaaca

SEQ ID NO: 3983405 - RNA, 22 nt, Staphylococcus aureus subsp. aureus Mu50
guugccauuaguucuguugaua

SEQ ID NO: 3983406 - RNA, 13 nt, Staphylococcus aureus subsp. aureus Mu50
guugcucgugcau

SEQ ID NO: 3983407 - RNA, 13 nt, Staphylococcus aureus subsp. aureus Mu50
guugcuucuuauc

SEQ ID NO: 3983408 - RNA, 14 nt, Staphylococcus aureus subsp. aureus Mu50
guugcuucuuauca

SEQ ID NO: 3983409 - RNA, 18 nt, Staphylococcus aureus subsp. aureus Mu50
guuggcggggccccaaca

SEQ ID NO: 3983410 - RNA, 20 nt, Staphylococcus aureus subsp. aureus Mu50
guuggggaugggccccaaca

SEQ ID NO: 3983411 - RNA, 12 nt, Staphylococcus aureus subsp. aureus Mu50
guuggggcccac

SEQ ID NO: 3983412 - RNA, 15 nt, Staphylococcus aureus subsp. aureus Mu50
guuggggcccacacc

SEQ ID NO: 3983413 - RNA, 18 nt, Staphylococcus aureus subsp. aureus Mu50
guuggggcccacacccca

SEQ ID NO: 3983414 - RNA, 16 nt, Staphylococcus aureus subsp. aureus Mu50
guugguucaucaaaca

SEQ ID NO: 3983415 - RNA, 15 nt, Staphylococcus aureus subsp. aureus Mu50
guuguaauuuaaaau

SEQ ID NO: 3983416 - RNA, 24 nt, Staphylococcus aureus subsp. aureus Mu50
guuguaauuuaaaauaguucuuua

SEQ ID NO: 3983417 - RNA, 16 nt, Staphylococcus aureus subsp. aureus Mu50
guuguacuucuuuggu

SEQ ID NO: 3983418 - RNA, 19 nt, Staphylococcus aureus subsp. aureus Mu50
guugucacuauugcagcaa

SEQ ID NO: 3983419 - RNA, 22 nt, Staphylococcus aureus subsp. aureus Mu50
guugucacuuggauucaaauga

SEQ ID NO: 3983420 - RNA, 20 nt, Staphylococcus aureus subsp. aureus Mu50
guugucauaccaaauaaaua

SEQ ID NO: 3983421 - RNA, 14 nt, Staphylococcus aureus subsp. aureus Mu50
guugucuucuuuuu

SEQ ID NO: 3983422 - RNA, 23 nt, Staphylococcus aureus subsp. aureus Mu50
guugugauauauaguaggguauu

SEQ ID NO: 3983423 - RNA, 22 nt, Staphylococcus aureus subsp. aureus Mu50
guuguuauuuuugcuauuucaa

SEQ ID NO: 3983424 - RNA, 21 nt, Staphylococcus aureus subsp. aureus Mu50
guuguucccauuuuuaaaauu

SEQ ID NO: 3983425 - RNA, 12 nt, Staphylococcus aureus subsp. aureus Mu50
guuguucuuuuu

SEQ ID NO: 3983426 - RNA, 20 nt, Staphylococcus aureus subsp. aureus Mu50
guuguugcaacuugugguug

SEQ ID NO: 3983427 - RNA, 13 nt, Staphylococcus aureus subsp. aureus Mu50
guuguuucuccag

SEQ ID NO: 3983428 - RNA, 18 nt, Staphylococcus aureus subsp. aureus Mu50
guuguuuuuuguuuucaa

SEQ ID NO: 3983429 - RNA, 13 nt, Staphylococcus aureus subsp. aureus Mu50
guuguuuuuuugu

SEQ ID NO: 3983430 - RNA, 18 nt, Staphylococcus aureus subsp. aureus Mu50
guuuaaaugugcaauuag

SEQ ID NO: 3983431 - RNA, 19 nt, Staphylococcus aureus subsp. aureus Mu50
guuuaaauuuaaaagaaaa

SEQ ID NO: 3983432 - RNA, 15 nt, Staphylococcus aureus subsp. aureus Mu50
guuuaacaacacuac

SEQ ID NO: 3983433 - RNA, 16 nt, Staphylococcus aureus subsp. aureus Mu50
guuuaacaauaauagg

SEQ ID NO: 3983434 - RNA, 14 nt, Staphylococcus aureus subsp. aureus Mu50
guuuaacuuuaucu

SEQ ID NO: 3983435 - RNA, 15 nt, Staphylococcus aureus subsp. aureus Mu50
guuuaagaaaucaac

SEQ ID NO: 3983436 - RNA, 14 nt, Staphylococcus aureus subsp. aureus Mu50
guuuaagaauguac

SEQ ID NO: 3983437 - RNA, 15 nt, Staphylococcus aureus subsp. aureus Mu50
guuuaaguuuuucag

SEQ ID NO: 3983438 - RNA, 15 nt, Staphylococcus aureus subsp. aureus Mu50
guuuaauaaugguuc

SEQ ID NO: 3983439 - RNA, 17 nt, Staphylococcus aureus subsp. aureus Mu50
guuuaaucgcauuguua

SEQ ID NO: 3983440 - RNA, 19 nt, Staphylococcus aureus subsp. aureus Mu50
guuuaaucgcauuguuaaa

SEQ ID NO: 3983441 - RNA, 14 nt, Staphylococcus aureus subsp. aureus Mu50
guuuaauuaaaaua

SEQ ID NO: 3983442 - RNA, 20 nt, Staphylococcus aureus subsp. aureus Mu50
guuuaauuaaaauacaaauu

SEQ ID NO: 3983443 - RNA, 23 nt, Staphylococcus aureus subsp. aureus Mu50
guuuaauuaaaauacaaauuaca

SEQ ID NO: 3983444 - RNA, 16 nt, Staphylococcus aureus subsp. aureus Mu50
guuuaauucguuuuac

SEQ ID NO: 3983445 - RNA, 15 nt, Staphylococcus aureus subsp. aureus Mu50
guuuaauuuuaaaua

SEQ ID NO: 3983446 - RNA, 16 nt, Staphylococcus aureus subsp. aureus Mu50
guuuaauuuuaaauau

SEQ ID NO: 3983447 - RNA, 15 nt, Staphylococcus aureus subsp. aureus Mu50
guuuacgaucauaaa

SEQ ID NO: 3983448 - RNA, 19 nt, Staphylococcus aureus subsp. aureus Mu50
guuuacgaucauaaauauu

SEQ ID NO: 3983449 - RNA, 15 nt, Staphylococcus aureus subsp. aureus Mu50
guuuauaaaaaauca

SEQ ID NO: 3983450 - RNA, 18 nt, Staphylococcus aureus subsp. aureus Mu50
guuuauaaauuaauugcu

SEQ ID NO: 3983451 - RNA, 15 nt, Staphylococcus aureus subsp. aureus Mu50
guuuauaaucaguuu

SEQ ID NO: 3983452 - RNA, 15 nt, Staphylococcus aureus subsp. aureus Mu50
guuuauaaucuuuuu

SEQ ID NO: 3983453 - RNA, 23 nt, Staphylococcus aureus subsp. aureus Mu50
guuuauaaucuuuuuuacuaaaa

SEQ ID NO: 3983454 - RNA, 14 nt, Staphylococcus aureus subsp. aureus Mu50
guuuauaucuuugu

SEQ ID NO: 3983455 - RNA, 18 nt, Staphylococcus aureus subsp. aureus Mu50
guuuauauugcaaaaaua

SEQ ID NO: 3983456 - RNA, 19 nt, Staphylococcus aureus subsp. aureus Mu50
guuuauauugcaaaaauaa

SEQ ID NO: 3983457 - RNA, 12 nt, Staphylococcus aureus subsp. aureus Mu50
guuuuuccaugu

SEQ ID NO: 3983458 - RNA, 14 nt, Staphylococcus aureus subsp. aureus Mu50
guuuuucuuuaaac

SEQ ID NO: 3983459 - RNA, 18 nt, Staphylococcus aureus subsp. aureus Mu50
guuuuuguggaaaauuga

SEQ ID NO: 3983460 - RNA, 21 nt, Staphylococcus aureus subsp. aureus Mu50
guuuuuuagauuugaaauuua

SEQ ID NO: 3983461 - RNA, 21 nt, Staphylococcus aureus subsp. aureus Mu50
guuuuuucauuguaauaauaa

SEQ ID NO: 3983462 - RNA, 18 nt, Staphylococcus aureus subsp. aureus Mu50
guuuuuugauuaguaaau

SEQ ID NO: 3983463 - RNA, 21 nt, Staphylococcus aureus subsp. aureus Mu50
guuuuuugauuaguaaauaua

SEQ ID NO: 3983464 - RNA, 12 nt, Staphylococcus aureus subsp. aureus Mu50
guuuuuuuaaau

SEQ ID NO: 3983465 - RNA, 14 nt, Staphylococcus aureus subsp. aureus Mu50
uaaaaaaaaccacg

SEQ ID NO: 3983466 - RNA, 12 nt, Staphylococcus aureus subsp. aureus Mu50
uaaaaaaauaau

SEQ ID NO: 3983467 - RNA, 20 nt, Staphylococcus aureus subsp. aureus Mu50
uaaaaaaaucccucaauccg

SEQ ID NO: 3983468 - RNA, 15 nt, Staphylococcus aureus subsp. aureus Mu50
uaaaaaaauuaaaau

SEQ ID NO: 3983469 - RNA, 13 nt, Staphylococcus aureus subsp. aureus Mu50
uaaaaaacaauag

SEQ ID NO: 3983470 - RNA, 14 nt, Staphylococcus aureus subsp. aureus Mu50
uaaaaaacaauagg

SEQ ID NO: 3983471 - RNA, 13 nt, Staphylococcus aureus subsp. aureus Mu50
uaaaaaacauacc

SEQ ID NO: 3983472 - RNA, 16 nt, Staphylococcus aureus subsp. aureus Mu50
uaaaaaaccugaaaca

SEQ ID NO: 3983473 - RNA, 23 nt, Staphylococcus aureus subsp. aureus Mu50
uaaaaaaccugaaacaaauuagu

SEQ ID NO: 3983474 - RNA, 19 nt, Staphylococcus aureus subsp. aureus Mu50
uaaaaaagaacauaaaaaa

SEQ ID NO: 3983475 - RNA, 18 nt, Staphylococcus aureus subsp. aureus Mu50
uaaaaaaguugauuaaaa

SEQ ID NO: 3983476 - RNA, 19 nt, Staphylococcus aureus subsp. aureus Mu50
uaaaaaaguugauuaaaag

SEQ ID NO: 3983477 - RNA, 13 nt, Staphylococcus aureus subsp. aureus Mu50
uaaaaaauaacuc

SEQ ID NO: 3983478 - RNA, 18 nt, Staphylococcus aureus subsp. aureus Mu50
uaaaaaaucaguuuuuaa

SEQ ID NO: 3983479 - RNA, 20 nt, Staphylococcus aureus subsp. aureus Mu50
uaaaaaaucaguuuuuaaau

SEQ ID NO: 3983480 - RNA, 13 nt, Staphylococcus aureus subsp. aureus Mu50
uaaaaaaugaaug

SEQ ID NO: 3983481 - RNA, 18 nt, Staphylococcus aureus subsp. aureus Mu50
uaaaaaaugcgcuuccaa

SEQ ID NO: 3983482 - RNA, 13 nt, Staphylococcus aureus subsp. aureus Mu50
uaaaaaauuaaaa

SEQ ID NO: 3983483 - RNA, 12 nt, Staphylococcus aureus subsp. aureus Mu50
uaaaaaauuauu

SEQ ID NO: 3983484 - RNA, 13 nt, Staphylococcus aureus subsp. aureus Mu50
uaaaaaauuauua

SEQ ID NO: 3983485 - RNA, 16 nt, Staphylococcus aureus subsp. aureus Mu50
uaaaaaauuauuaaaa

SEQ ID NO: 3983486 - RNA, 21 nt, Staphylococcus aureus subsp. aureus Mu50
uaaaaaauuccuagcuuuuau

SEQ ID NO: 3983487 - RNA, 18 nt, Staphylococcus aureus subsp. aureus Mu50
uaaaaaauuuaaauaaua

SEQ ID NO: 3983488 - RNA, 23 nt, Staphylococcus aureus subsp. aureus Mu50
uaaaaacaaagguuuguaagaca

SEQ ID NO: 3983489 - RNA, 14 nt, Staphylococcus aureus subsp. aureus Mu50
uaaaaaccuauucc

SEQ ID NO: 3983490 - RNA, 23 nt, Staphylococcus aureus subsp. aureus Mu50
uaaaaacggacaaguugcacauu

SEQ ID NO: 3983491 - RNA, 22 nt, Staphylococcus aureus subsp. aureus Mu50
uaaaaacgucucuauagcaaca

SEQ ID NO: 3983492 - RNA, 20 nt, Staphylococcus aureus subsp. aureus Mu50
uaaaaacugugauucauucg

SEQ ID NO: 3983493 - RNA, 13 nt, Staphylococcus aureus subsp. aureus Mu50
uaaaaacuguuca

SEQ ID NO: 3983494 - RNA, 20 nt, Staphylococcus aureus subsp. aureus Mu50
uaaaaacuuauuugccauau

SEQ ID NO: 3983495 - RNA, 19 nt, Staphylococcus aureus subsp. aureus Mu50
uaaaaagaagaucccucaa

SEQ ID NO: 3983496 - RNA, 23 nt, Staphylococcus aureus subsp. aureus Mu50
uaaaaagaagcucccauuaauga

SEQ ID NO: 3983497 - RNA, 19 nt, Staphylococcus aureus subsp. aureus Mu50
uaaaaagagguuuucauua

SEQ ID NO: 3983498 - RNA, 15 nt, Staphylococcus aureus subsp. aureus Mu50
uaaaaagaucauuaa

SEQ ID NO: 3983499 - RNA, 15 nt, Staphylococcus aureus subsp. aureus Mu50
uaaaaagguacuaau

SEQ ID NO: 3983500 - RNA, 16 nt, Staphylococcus aureus subsp. aureus Mu50
uaaaaaguaauuaauu

SEQ ID NO: 3983501 - RNA, 20 nt, Staphylococcus aureus subsp. aureus Mu50
uaaaaaguauacuaaacuuu

SEQ ID NO: 3983502 - RNA, 12 nt, Staphylococcus aureus subsp. aureus Mu50
uaaaaaguuuaa

SEQ ID NO: 3983503 - RNA, 19 nt, Staphylococcus aureus subsp. aureus Mu50
uaaaaaguuuaaaguauaa

SEQ ID NO: 3983504 - RNA, 14 nt, Staphylococcus aureus subsp. aureus Mu50
uaaaaauaaucccg

SEQ ID NO: 3983505 - RNA, 20 nt, Staphylococcus aureus subsp. aureus Mu50
uaaaaauacauaauaaaaag

SEQ ID NO: 3983506 - RNA, 21 nt, Staphylococcus aureus subsp. aureus Mu50
uaaaaauacauaauaaaaagg

SEQ ID NO: 3983507 - RNA, 19 nt, Staphylococcus aureus subsp. aureus Mu50
uaaaaauaggaauacauga

SEQ ID NO: 3983508 - RNA, 13 nt, Staphylococcus aureus subsp. aureus Mu50
uaaaaauauauuu

SEQ ID NO: 3983509 - RNA, 15 nt, Staphylococcus aureus subsp. aureus Mu50
uaaaaauauugaaua

SEQ ID NO: 3983510 - RNA, 14 nt, Staphylococcus aureus subsp. aureus Mu50
uaaaaaucauaaau

SEQ ID NO: 3983511 - RNA, 19 nt, Staphylococcus aureus subsp. aureus Mu50
uaaaaauccacacauuaag

SEQ ID NO: 3983512 - RNA, 18 nt, Staphylococcus aureus subsp. aureus Mu50
uaaaaaucuuaugauguc

SEQ ID NO: 3983513 - RNA, 20 nt, Staphylococcus aureus subsp. aureus Mu50
uaaaaaugcucaaguugauu

SEQ ID NO: 3983514 - RNA, 12 nt, Staphylococcus aureus subsp. aureus Mu50
uaaaaauguaaa

SEQ ID NO: 3983515 - RNA, 13 nt, Staphylococcus aureus subsp. aureus Mu50
uaaaaauguaaau

SEQ ID NO: 3983516 - RNA, 16 nt, Staphylococcus aureus subsp. aureus Mu50
uaaaaauuaaguaaua

SEQ ID NO: 3983517 - RNA, 17 nt, Staphylococcus aureus subsp. aureus Mu50
uaaaaauuaaguaauag

SEQ ID NO: 3983518 - RNA, 17 nt, Staphylococcus aureus subsp. aureus Mu50
uaaaaauuuauucaaaa

SEQ ID NO: 3983519 - RNA, 14 nt, Staphylococcus aureus subsp. aureus Mu50
uaaaaauuucaaua

SEQ ID NO: 3983520 - RNA, 14 nt, Staphylococcus aureus subsp. aureus Mu50
uaaaacaaauuauu

SEQ ID NO: 3983521 - RNA, 18 nt, Staphylococcus aureus subsp. aureus Mu50
uaaaacaaauucauauua

SEQ ID NO: 3983522 - RNA, 20 nt, Staphylococcus aureus subsp. aureus Mu50
uaaaacaaauucauauuaac

SEQ ID NO: 3983523 - RNA, 21 nt, Staphylococcus aureus subsp. aureus Mu50
uaaaacaaauucauauuaacu

SEQ ID NO: 3983524 - RNA, 18 nt, Staphylococcus aureus subsp. aureus Mu50
uaaaacaagacuacgaau

SEQ ID NO: 3983525 - RNA, 16 nt, Staphylococcus aureus subsp. aureus Mu50
uaaaacaauaauuuaa

SEQ ID NO: 3983526 - RNA, 15 nt, Staphylococcus aureus subsp. aureus Mu50
uaaaacaaugauuaa

SEQ ID NO: 3983527 - RNA, 20 nt, Staphylococcus aureus subsp. aureus Mu50
uaaaacagaauuucaucaaa

SEQ ID NO: 3983528 - RNA, 21 nt, Staphylococcus aureus subsp. aureus Mu50
uaaaacagaauuucaucaaau

SEQ ID NO: 3983529 - RNA, 14 nt, Staphylococcus aureus subsp. aureus Mu50
uaaaacagcaaaua

SEQ ID NO: 3983530 - RNA, 21 nt, Staphylococcus aureus subsp. aureus Mu50
uaaaacagcaaauaaaaucau

SEQ ID NO: 3983531 - RNA, 22 nt, Staphylococcus aureus subsp. aureus Mu50
uaaaacaguaaguaauaaaaua

SEQ ID NO: 3983532 - RNA, 14 nt, Staphylococcus aureus subsp. aureus Mu50
uaaaacauguugau

SEQ ID NO: 3983533 - RNA, 21 nt, Staphylococcus aureus subsp. aureus Mu50
uaaaacauguugauaaaaagg

SEQ ID NO: 3983534 - RNA, 19 nt, Staphylococcus aureus subsp. aureus Mu50
uaaaaccgguacuuucauu

SEQ ID NO: 3983535 - RNA, 23 nt, Staphylococcus aureus subsp. aureus Mu50
uaaaaccuuacccaaaaaauugu

SEQ ID NO: 3983536 - RNA, 14 nt, Staphylococcus aureus subsp. aureus Mu50
uaaaaccuucaauc

SEQ ID NO: 3983537 - RNA, 16 nt, Staphylococcus aureus subsp. aureus Mu50
uaaaaccuuuucaaau

SEQ ID NO: 3983538 - RNA, 19 nt, Staphylococcus aureus subsp. aureus Mu50
uaaaacgaaguuauuuauu

SEQ ID NO: 3983539 - RNA, 15 nt, Staphylococcus aureus subsp. aureus Mu50
uaaaacgauaauaau

SEQ ID NO: 3983540 - RNA, 19 nt, Staphylococcus aureus subsp. aureus Mu50
uaaaacggaaauaaccacc

SEQ ID NO: 3983541 - RNA, 20 nt, Staphylococcus aureus subsp. aureus Mu50
uaaaacgugcaaauaaaaaa

SEQ ID NO: 3983542 - RNA, 17 nt, Staphylococcus aureus subsp. aureus Mu50
uaaaacguuaguacuuu

SEQ ID NO: 3983543 - RNA, 15 nt, Staphylococcus aureus subsp. aureus Mu50
uaaaacuaaugauag

SEQ ID NO: 3983544 - RNA, 19 nt, Staphylococcus aureus subsp. aureus Mu50
uaaaacuaaugauaguaca

SEQ ID NO: 3983545 - RNA, 20 nt, Staphylococcus aureus subsp. aureus Mu50
uaaaauguguuuucaacagu

SEQ ID NO: 3983546 - RNA, 16 nt, Staphylococcus aureus subsp. aureus Mu50
uaaaauguuaauaaug

SEQ ID NO: 3983547 - RNA, 14 nt, Staphylococcus aureus subsp. aureus Mu50
uaaaauuaaaacag

SEQ ID NO: 3983548 - RNA, 14 nt, Staphylococcus aureus subsp. aureus Mu50
uaaaauuaaaacuu

SEQ ID NO: 3983549 - RNA, 14 nt, Staphylococcus aureus subsp. aureus Mu50
uaaaauuaaauaau

SEQ ID NO: 3983550 - RNA, 18 nt, Staphylococcus aureus subsp. aureus Mu50
uaaaauuacuugaauauu

SEQ ID NO: 3983551 - RNA, 13 nt, Staphylococcus aureus subsp. aureus Mu50
uaaaauuaugauu

SEQ ID NO: 3983552 - RNA, 18 nt, Staphylococcus aureus subsp. aureus Mu50
uaaaauuaugauuauauu

SEQ ID NO: 3983553 - RNA, 14 nt, Staphylococcus aureus subsp. aureus Mu50
uaaaauucucuuuu

SEQ ID NO: 3983554 - RNA, 22 nt, Staphylococcus aureus subsp. aureus Mu50
uaaaauucucuuuuaaauucuu

SEQ ID NO: 3983555 - RNA, 11 nt, Staphylococcus aureus subsp. aureus Mu50
uaaaauucuuu

SEQ ID NO: 3983556 - RNA, 22 nt, Staphylococcus aureus subsp. aureus Mu50
uaaaauugccaguaucucuuuu

SEQ ID NO: 3983557 - RNA, 23 nt, Staphylococcus aureus subsp. aureus Mu50
uaaaauugguuuggauaaaauga

SEQ ID NO: 3983558 - RNA, 15 nt, Staphylococcus aureus subsp. aureus Mu50
uaaaauuguauagaa

SEQ ID NO: 3983559 - RNA, 16 nt, Staphylococcus aureus subsp. aureus Mu50
uaaaauuguauagaau

SEQ ID NO: 3983560 - RNA, 23 nt, Staphylococcus aureus subsp. aureus Mu50
uaaaauuguugagucuuagacau

SEQ ID NO: 3983561 - RNA, 15 nt, Staphylococcus aureus subsp. aureus Mu50
uaaaauuuaaaacaa

SEQ ID NO: 3983562 - RNA, 18 nt, Staphylococcus aureus subsp. aureus Mu50
uaaaauuuaaauauugaa

SEQ ID NO: 3983563 - RNA, 15 nt, Staphylococcus aureus subsp. aureus Mu50
uaaaauuuacaaaug

SEQ ID NO: 3983564 - RNA, 22 nt, Staphylococcus aureus subsp. aureus Mu50
uaaaauuugaauugacuuacau

SEQ ID NO: 3983565 - RNA, 15 nt, Staphylococcus aureus subsp. aureus Mu50
uaaaauuuguuaauu

SEQ ID NO: 3983566 - RNA, 16 nt, Staphylococcus aureus subsp. aureus Mu50
uaaaauuuguuaauuu

SEQ ID NO: 3983567 - RNA, 18 nt, Staphylococcus aureus subsp. aureus Mu50
uaaaauuuguuaauuuaa

SEQ ID NO: 3983568 - RNA, 12 nt, Staphylococcus aureus subsp. aureus Mu50
uaaaauuuuaau

SEQ ID NO: 3983569 - RNA, 15 nt, Staphylococcus aureus subsp. aureus Mu50
uaaaauuuuaauuaa

SEQ ID NO: 3983570 - RNA, 21 nt, Staphylococcus aureus subsp. aureus Mu50
uaaaauuuucguguuaauaac

SEQ ID NO: 3983571 - RNA, 22 nt, Staphylococcus aureus subsp. aureus Mu50
uaaaauuuuuuucauaauuaau

SEQ ID NO: 3983572 - RNA, 17 nt, Staphylococcus aureus subsp. aureus Mu50
uaaacaaauaaaugucc

SEQ ID NO: 3983573 - RNA, 14 nt, Staphylococcus aureus subsp. aureus Mu50
uaaacaacauacag

SEQ ID NO: 3983574 - RNA, 22 nt, Staphylococcus aureus subsp. aureus Mu50
uaaacaacaucgauuuaucauu

SEQ ID NO: 3983575 - RNA, 19 nt, Staphylococcus aureus subsp. aureus Mu50
uaaacaagcaucaugaaau

SEQ ID NO: 3983576 - RNA, 20 nt, Staphylococcus aureus subsp. aureus Mu50
uaaacaagcaucaugaaauu

SEQ ID NO: 3983577 - RNA, 21 nt, Staphylococcus aureus subsp. aureus Mu50
uaaacaagccaagauaaauca

SEQ ID NO: 3983578 - RNA, 13 nt, Staphylococcus aureus subsp. aureus Mu50
uaaacaauaacug

SEQ ID NO: 3983579 - RNA, 17 nt, Staphylococcus aureus subsp. aureus Mu50
uaaacaauacguuuucg

SEQ ID NO: 3983580 - RNA, 23 nt, Staphylococcus aureus subsp. aureus Mu50
uaaacacuauaaaagccaugaua

SEQ ID NO: 3983581 - RNA, 18 nt, Staphylococcus aureus subsp. aureus Mu50
uaaacacuuuaguauuau

SEQ ID NO: 3983582 - RNA, 17 nt, Staphylococcus aureus subsp. aureus Mu50
uaaacauaaugacauca

SEQ ID NO: 3983583 - RNA, 18 nt, Staphylococcus aureus subsp. aureus Mu50
uaaacauaucuucugaua

SEQ ID NO: 3983584 - RNA, 16 nt, Staphylococcus aureus subsp. aureus Mu50
uaaacauccaauuaug

SEQ ID NO: 3983585 - RNA, 18 nt, Staphylococcus aureus subsp. aureus Mu50
uaaacaugaacaaucaga

SEQ ID NO: 3983586 - RNA, 15 nt, Staphylococcus aureus subsp. aureus Mu50
uaaacauguacaauu

SEQ ID NO: 3983587 - RNA, 14 nt, Staphylococcus aureus subsp. aureus Mu50
uaaacauugcuuaa

SEQ ID NO: 3983588 - RNA, 22 nt, Staphylococcus aureus subsp. aureus Mu50
uaaacauugcuuaacuuccuuu

SEQ ID NO: 3983589 - RNA, 18 nt, Staphylococcus aureus subsp. aureus Mu50
uaaacauuuagauuucau

SEQ ID NO: 3983590 - RNA, 19 nt, Staphylococcus aureus subsp. aureus Mu50
uaaacauuuagauuucaug

SEQ ID NO: 3983591 - RNA, 18 nt, Staphylococcus aureus subsp. aureus Mu50
uaaacauuuauauagauu

SEQ ID NO: 3983592 - RNA, 23 nt, Staphylococcus aureus subsp. aureus Mu50
uaaacauuuauauagauugccau

SEQ ID NO: 3983593 - RNA, 11 nt, Staphylococcus aureus subsp. aureus Mu50
uaaacauuuuu

SEQ ID NO: 3983594 - RNA, 18 nt, Staphylococcus aureus subsp. aureus Mu50
uaaaccaacuuucucaag

SEQ ID NO: 3983595 - RNA, 18 nt, Staphylococcus aureus subsp. aureus Mu50
uaaaccagcuaaaccauc

SEQ ID NO: 3983596 - RNA, 20 nt, Staphylococcus aureus subsp. aureus Mu50
uaaaccaucugugucagcau

SEQ ID NO: 3983597 - RNA, 14 nt, Staphylococcus aureus subsp. aureus Mu50
uaaacccaaagcuc

SEQ ID NO: 3983598 - RNA, 23 nt, Staphylococcus aureus subsp. aureus Mu50
uaaaccgcacuucuauauuaaua

SEQ ID NO: 3983599 - RNA, 17 nt, Staphylococcus aureus subsp. aureus Mu50
uaaaccguauagucauu

SEQ ID NO: 3983600 - RNA, 20 nt, Staphylococcus aureus subsp. aureus Mu50
uaaaccguauagucauuaca

SEQ ID NO: 3983601 - RNA, 16 nt, Staphylococcus aureus subsp. aureus Mu50
uaaaccuaaugcuuua

SEQ ID NO: 3983602 - RNA, 16 nt, Staphylococcus aureus subsp. aureus Mu50
uaaaccuacaauauag

SEQ ID NO: 3983603 - RNA, 22 nt, Staphylococcus aureus subsp. aureus Mu50
uaaaccuacuaauauauuaauu

SEQ ID NO: 3983604 - RNA, 14 nt, Staphylococcus aureus subsp. aureus Mu50
uaaaccucaacauu

SEQ ID NO: 3983605 - RNA, 18 nt, Staphylococcus aureus subsp. aureus Mu50
uaaaccucuaaauaaaau

SEQ ID NO: 3983606 - RNA, 15 nt, Staphylococcus aureus subsp. aureus Mu50
uaaaccuuaauaaug

SEQ ID NO: 3983607 - RNA, 14 nt, Staphylococcus aureus subsp. aureus Mu50
uaaacgauacugcu

SEQ ID NO: 3983608 - RNA, 13 nt, Staphylococcus aureus subsp. aureus Mu50
uaaacgaucaacu

SEQ ID NO: 3983609 - RNA, 14 nt, Staphylococcus aureus subsp. aureus Mu50
uaaacgcuaaaauu

SEQ ID NO: 3983610 - RNA, 16 nt, Staphylococcus aureus subsp. aureus Mu50
uaaacgcuaaaauuuc

SEQ ID NO: 3983611 - RNA, 18 nt, Staphylococcus aureus subsp. aureus Mu50
uaaacggaauaacuuuuu

SEQ ID NO: 3983612 - RNA, 17 nt, Staphylococcus aureus subsp. aureus Mu50
uaaacguacauuuuuau

SEQ ID NO: 3983613 - RNA, 13 nt, Staphylococcus aureus subsp. aureus Mu50
uaaacguugcacc

SEQ ID NO: 3983614 - RNA, 18 nt, Staphylococcus aureus subsp. aureus Mu50
uaaacguugcaccuauuu

SEQ ID NO: 3983615 - RNA, 20 nt, Staphylococcus aureus subsp. aureus Mu50
uaaacuagaaaacauaaaua

SEQ ID NO: 3983616 - RNA, 23 nt, Staphylococcus aureus subsp. aureus Mu50
uaaacuagaaaacauaaauacaa

SEQ ID NO: 3983617 - RNA, 14 nt, Staphylococcus aureus subsp. aureus Mu50
uaaacuaguaauag

SEQ ID NO: 3983618 - RNA, 14 nt, Staphylococcus aureus subsp. aureus Mu50
uaaacuauaauaau

SEQ ID NO: 3983619 - RNA, 16 nt, Staphylococcus aureus subsp. aureus Mu50
uaaacuauaauaauug

SEQ ID NO: 3983620 - RNA, 24 nt, Staphylococcus aureus subsp. aureus Mu50
uaaacucaaaaagccaacacauuc

SEQ ID NO: 3983621 - RNA, 14 nt, Staphylococcus aureus subsp. aureus Mu50
uaaacucauaccaa

SEQ ID NO: 3983622 - RNA, 15 nt, Staphylococcus aureus subsp. aureus Mu50
uaaacucauaccaaa

SEQ ID NO: 3983623 - RNA, 16 nt, Staphylococcus aureus subsp. aureus Mu50
uaaacucauaccaaaa

SEQ ID NO: 3983624 - RNA, 16 nt, Staphylococcus aureus subsp. aureus Mu50
uaaacuuauaacuuua

SEQ ID NO: 3983625 - RNA, 13 nt, Staphylococcus aureus subsp. aureus Mu50
uaaacuuauuaau

SEQ ID NO: 3983626 - RNA, 19 nt, Staphylococcus aureus subsp. aureus Mu50
uaaacuuauuaauuaauag

SEQ ID NO: 3983627 - RNA, 16 nt, Staphylococcus aureus subsp. aureus Mu50
uaaacuucuauuaaua

SEQ ID NO: 3983628 - RNA, 18 nt, Staphylococcus aureus subsp. aureus Mu50
uaaacuuuggcaaaguca

SEQ ID NO: 3983629 - RNA, 21 nt, Staphylococcus aureus subsp. aureus Mu50
uaaacuuuucuucaaguuguu

SEQ ID NO: 3983630 - RNA, 16 nt, Staphylococcus aureus subsp. aureus Mu50
uaaagaaauaauuuaa

SEQ ID NO: 3983631 - RNA, 17 nt, Staphylococcus aureus subsp. aureus Mu50
uaaagaacuauuuuaaa

SEQ ID NO: 3983632 - RNA, 20 nt, Staphylococcus aureus subsp. aureus Mu50
uaaagaacuauuuuaaauua

SEQ ID NO: 3983633 - RNA, 17 nt, Staphylococcus aureus subsp. aureus Mu50
uaaauaucaauaauucg

SEQ ID NO: 3983634 - RNA, 20 nt, Staphylococcus aureus subsp. aureus Mu50
uaaauaucauaaaugcauac

SEQ ID NO: 3983635 - RNA, 21 nt, Staphylococcus aureus subsp. aureus Mu50
uaaauaucauaccguacaaag

SEQ ID NO: 3983636 - RNA, 12 nt, Staphylococcus aureus subsp. aureus Mu50
uaaauaucaugc

SEQ ID NO: 3983637 - RNA, 16 nt, Staphylococcus aureus subsp. aureus Mu50
uaaauaucaugcaaaa

SEQ ID NO: 3983638 - RNA, 18 nt, Staphylococcus aureus subsp. aureus Mu50
uaaauaugaaucuagaau

SEQ ID NO: 3983639 - RNA, 21 nt, Staphylococcus aureus subsp. aureus Mu50
uaaauaugacgcgugaauuaa

SEQ ID NO: 3983640 - RNA, 16 nt, Staphylococcus aureus subsp. aureus Mu50
uaaauauuaaauuauu

SEQ ID NO: 3983641 - RNA, 14 nt, Staphylococcus aureus subsp. aureus Mu50
uaaauauucuuauc

SEQ ID NO: 3983642 - RNA, 13 nt, Staphylococcus aureus subsp. aureus Mu50
uaaauauugaaga

SEQ ID NO: 3983643 - RNA, 14 nt, Staphylococcus aureus subsp. aureus Mu50
uaaauauugauaua

SEQ ID NO: 3983644 - RNA, 19 nt, Staphylococcus aureus subsp. aureus Mu50
uaaauauuggaauacucuu

SEQ ID NO: 3983645 - RNA, 22 nt, Staphylococcus aureus subsp. aureus Mu50
uaaauauuggaauacucuucaa

SEQ ID NO: 3983646 - RNA, 21 nt, Staphylococcus aureus subsp. aureus Mu50
uaaauauuuaaaauauuauuu

SEQ ID NO: 3983647 - RNA, 13 nt, Staphylococcus aureus subsp. aureus Mu50
uaaauauuuaauu

SEQ ID NO: 3983648 - RNA, 14 nt, Staphylococcus aureus subsp. aureus Mu50
uaaauauuuagauu

SEQ ID NO: 3983649 - RNA, 15 nt, Staphylococcus aureus subsp. aureus Mu50
uaaauauuuuuuaaa

SEQ ID NO: 3983650 - RNA, 16 nt, Staphylococcus aureus subsp. aureus Mu50
uaaauauuuuuuaaaa

SEQ ID NO: 3983651 - RNA, 12 nt, Staphylococcus aureus subsp. aureus Mu50
uaaaucaaagag

SEQ ID NO: 3983652 - RNA, 16 nt, Staphylococcus aureus subsp. aureus Mu50
uaaaucaaagaggaac

SEQ ID NO: 3983653 - RNA, 22 nt, Staphylococcus aureus subsp. aureus Mu50
uaaaucaaagcuauauaugaau

SEQ ID NO: 3983654 - RNA, 22 nt, Staphylococcus aureus subsp. aureus Mu50
uaaaucaaagggcuucgauuca

SEQ ID NO: 3983655 - RNA, 14 nt, Staphylococcus aureus subsp. aureus Mu50
uaaaucaagaaaug

SEQ ID NO: 3983656 - RNA, 14 nt, Staphylococcus aureus subsp. aureus Mu50
uaaaucaccaacaa

SEQ ID NO: 3983657 - RNA, 14 nt, Staphylococcus aureus subsp. aureus Mu50
uaaaucacgauuuu

SEQ ID NO: 3983658 - RNA, 16 nt, Staphylococcus aureus subsp. aureus Mu50
uaaaucacgauuuuca

SEQ ID NO: 3983659 - RNA, 19 nt, Staphylococcus aureus subsp. aureus Mu50
uaaaucacgauuuucaagu

SEQ ID NO: 3983660 - RNA, 20 nt, Staphylococcus aureus subsp. aureus Mu50
uaaaucacgauuuucaagua

SEQ ID NO: 3983661 - RNA, 23 nt, Staphylococcus aureus subsp. aureus Mu50
uaaaucacgccauaaucuucauu

SEQ ID NO: 3983662 - RNA, 15 nt, Staphylococcus aureus subsp. aureus Mu50
uaaaucaguaguuuu

SEQ ID NO: 3983663 - RNA, 22 nt, Staphylococcus aureus subsp. aureus Mu50
uaaaucauacgagaaauuagaa

SEQ ID NO: 3983664 - RNA, 16 nt, Staphylococcus aureus subsp. aureus Mu50
uaaaucauagaggcac

SEQ ID NO: 3983665 - RNA, 17 nt, Staphylococcus aureus subsp. aureus Mu50
uaaaucauagaggcaca

SEQ ID NO: 3983666 - RNA, 13 nt, Staphylococcus aureus subsp. aureus Mu50
uaaaucaucauaa

SEQ ID NO: 3983667 - RNA, 12 nt, Staphylococcus aureus subsp. aureus Mu50
uaaaucaucauu

SEQ ID NO: 3983668 - RNA, 14 nt, Staphylococcus aureus subsp. aureus Mu50
uaaaucaugacaua

SEQ ID NO: 3983669 - RNA, 12 nt, Staphylococcus aureus subsp. aureus Mu50
uaaaucauucuu

SEQ ID NO: 3983670 - RNA, 14 nt, Staphylococcus aureus subsp. aureus Mu50
uaaaucauucuuua

SEQ ID NO: 3983671 - RNA, 23 nt, Staphylococcus aureus subsp. aureus Mu50
uaaaucauuucguucauauggca

SEQ ID NO: 3983672 - RNA, 14 nt, Staphylococcus aureus subsp. aureus Mu50
uaaauccuuuauau

SEQ ID NO: 3983673 - RNA, 19 nt, Staphylococcus aureus subsp. aureus Mu50
uaaaucgaauugauggaaa

SEQ ID NO: 3983674 - RNA, 16 nt, Staphylococcus aureus subsp. aureus Mu50
uaaaucgggcaaccuc

SEQ ID NO: 3983675 - RNA, 20 nt, Staphylococcus aureus subsp. aureus Mu50
uaaaucgugcuguuaucaug

SEQ ID NO: 3983676 - RNA, 21 nt, Staphylococcus aureus subsp. aureus Mu50
uaaaucgugcuguuaucaugg

SEQ ID NO: 3983677 - RNA, 22 nt, Staphylococcus aureus subsp. aureus Mu50
uaaaucuaauacuuucaaacaa

SEQ ID NO: 3983678 - RNA, 16 nt, Staphylococcus aureus subsp. aureus Mu50
uaaaucuauauaaagu

SEQ ID NO: 3983679 - RNA, 15 nt, Staphylococcus aureus subsp. aureus Mu50
uaaaucugauucauu

SEQ ID NO: 3983680 - RNA, 20 nt, Staphylococcus aureus subsp. aureus Mu50
uaaaucuguacuucuaauuu

SEQ ID NO: 3983681 - RNA, 21 nt, Staphylococcus aureus subsp. aureus Mu50
uaaaucuguuuaaauuuaaaa

SEQ ID NO: 3983682 - RNA, 17 nt, Staphylococcus aureus subsp. aureus Mu50
uaaaucuucuaguaauu

SEQ ID NO: 3983683 - RNA, 18 nt, Staphylococcus aureus subsp. aureus Mu50
uaaaucuucuauuuucau

SEQ ID NO: 3983684 - RNA, 20 nt, Staphylococcus aureus subsp. aureus Mu50
uaaaucuuuccacggcauuu

SEQ ID NO: 3983685 - RNA, 20 nt, Staphylococcus aureus subsp. aureus Mu50
uaaaucuuuuacuaaaugaa

SEQ ID NO: 3983686 - RNA, 21 nt, Staphylococcus aureus subsp. aureus Mu50
uaaaugaaaguaccuaaaaua

SEQ ID NO: 3983687 - RNA, 18 nt, Staphylococcus aureus subsp. aureus Mu50
uaaaugaccuuuacgcca

SEQ ID NO: 3983688 - RNA, 13 nt, Staphylococcus aureus subsp. aureus Mu50
uaaaugacugaau

SEQ ID NO: 3983689 - RNA, 18 nt, Staphylococcus aureus subsp. aureus Mu50
uaaaugacugaauuaaua

SEQ ID NO: 3983690 - RNA, 21 nt, Staphylococcus aureus subsp. aureus Mu50
uaaaugacuucacauuuaucc

SEQ ID NO: 3983691 - RNA, 14 nt, Staphylococcus aureus subsp. aureus Mu50
uaaaugagcuauua

SEQ ID NO: 3983692 - RNA, 17 nt, Staphylococcus aureus subsp. aureus Mu50
uaaaugaugcaguaaaa

SEQ ID NO: 3983693 - RNA, 23 nt, Staphylococcus aureus subsp. aureus Mu50
uaaaugauggguaguuaauauaa

SEQ ID NO: 3983694 - RNA, 14 nt, Staphylococcus aureus subsp. aureus Mu50
uaaaugauuaauaa

SEQ ID NO: 3983695 - RNA, 18 nt, Staphylococcus aureus subsp. aureus Mu50
uaaaugauuaauaacaua

SEQ ID NO: 3983696 - RNA, 12 nt, Staphylococcus aureus subsp. aureus Mu50
uaaaugauuuaa

SEQ ID NO: 3983697 - RNA, 14 nt, Staphylococcus aureus subsp. aureus Mu50
uaaaugauuuaaua

SEQ ID NO: 3983698 - RNA, 16 nt, Staphylococcus aureus subsp. aureus Mu50
uaaaugauuuaauaaa

SEQ ID NO: 3983699 - RNA, 16 nt, Staphylococcus aureus subsp. aureus Mu50
uaaaugcaauacauua

SEQ ID NO: 3983700 - RNA, 22 nt, Staphylococcus aureus subsp. aureus Mu50
uaaaugcaauacauuaauauaa

SEQ ID NO: 3983701 - RNA, 18 nt, Staphylococcus aureus subsp. aureus Mu50
uaaaugcagcuguauaac

SEQ ID NO: 3983702 - RNA, 14 nt, Staphylococcus aureus subsp. aureus Mu50
uaaaugcuauauuu

SEQ ID NO: 3983703 - RNA, 20 nt, Staphylococcus aureus subsp. aureus Mu50
uaaaugcuggguaauaaauu

SEQ ID NO: 3983704 - RNA, 21 nt, Staphylococcus aureus subsp. aureus Mu50
uaaaugcuucugguucuucaa

SEQ ID NO: 3983705 - RNA, 21 nt, Staphylococcus aureus subsp. aureus Mu50
uaaaugguuuucuuuuucuau

SEQ ID NO: 3983706 - RNA, 13 nt, Staphylococcus aureus subsp. aureus Mu50
uaaauguaacgag

SEQ ID NO: 3983707 - RNA, 12 nt, Staphylococcus aureus subsp. aureus Mu50
uaaauguaucac

SEQ ID NO: 3983708 - RNA, 19 nt, Staphylococcus aureus subsp. aureus Mu50
uaaaugucacugcaaacac

SEQ ID NO: 3983709 - RNA, 16 nt, Staphylococcus aureus subsp. aureus Mu50
uaaaugucuuucaaau

SEQ ID NO: 3983710 - RNA, 20 nt, Staphylococcus aureus subsp. aureus Mu50
uaaaugucuuucaaauacac

SEQ ID NO: 3983711 - RNA, 21 nt, Staphylococcus aureus subsp. aureus Mu50
uaaaugucuuucaaauacaca

SEQ ID NO: 3983712 - RNA, 17 nt, Staphylococcus aureus subsp. aureus Mu50
uaaaugugcaauuagaa

SEQ ID NO: 3983713 - RNA, 15 nt, Staphylococcus aureus subsp. aureus Mu50
uaaauguuaaagauu

SEQ ID NO: 3983714 - RNA, 17 nt, Staphylococcus aureus subsp. aureus Mu50
uaaauguuaaauucuaa

SEQ ID NO: 3983715 - RNA, 18 nt, Staphylococcus aureus subsp. aureus Mu50
uaaauguuaaauucuaaa

SEQ ID NO: 3983716 - RNA, 19 nt, Staphylococcus aureus subsp. aureus Mu50
uaaauguuaaauucuaaaa

SEQ ID NO: 3983717 - RNA, 17 nt, Staphylococcus aureus subsp. aureus Mu50
uaaauguuauuaaccau

SEQ ID NO: 3983718 - RNA, 16 nt, Staphylococcus aureus subsp. aureus Mu50
uaaauguuauugcuua

SEQ ID NO: 3983719 - RNA, 15 nt, Staphylococcus aureus subsp. aureus Mu50
uaaauguucuggaau

SEQ ID NO: 3983720 - RNA, 22 nt, Staphylococcus aureus subsp. aureus Mu50
uaaauguugacucguuauucaa

SEQ ID NO: 3983721 - RNA, 17 nt, Staphylococcus aureus subsp. aureus Mu50
uaacaccaauugaauau

SEQ ID NO: 3983722 - RNA, 14 nt, Staphylococcus aureus subsp. aureus Mu50
uaacaccuacugau

SEQ ID NO: 3983723 - RNA, 15 nt, Staphylococcus aureus subsp. aureus Mu50
uaacaccuacugauu

SEQ ID NO: 3983724 - RNA, 20 nt, Staphylococcus aureus subsp. aureus Mu50
uaacacugccggcgcacuua

SEQ ID NO: 3983725 - RNA, 23 nt, Staphylococcus aureus subsp. aureus Mu50
uaacagcugcagucgcaauggca

SEQ ID NO: 3983726 - RNA, 19 nt, Staphylococcus aureus subsp. aureus Mu50
uaacagcuuaauuuuauua

SEQ ID NO: 3983727 - RNA, 20 nt, Staphylococcus aureus subsp. aureus Mu50
uaacagcuuaauuuuauuau

SEQ ID NO: 3983728 - RNA, 21 nt, Staphylococcus aureus subsp. aureus Mu50
uaacaggugcuuacuuuuaaa

SEQ ID NO: 3983729 - RNA, 20 nt, Staphylococcus aureus subsp. aureus Mu50
uaacaguuguaaucauuggu

SEQ ID NO: 3983730 - RNA, 23 nt, Staphylococcus aureus subsp. aureus Mu50
uaacauaaaaaggucuauguaca

SEQ ID NO: 3983731 - RNA, 15 nt, Staphylococcus aureus subsp. aureus Mu50
uaacauaaaaaugcu

SEQ ID NO: 3983732 - RNA, 17 nt, Staphylococcus aureus subsp. aureus Mu50
uaacauaaaaaugcuca

SEQ ID NO: 3983733 - RNA, 13 nt, Staphylococcus aureus subsp. aureus Mu50
uaacauaaaauga

SEQ ID NO: 3983734 - RNA, 15 nt, Staphylococcus aureus subsp. aureus Mu50
uaacauaaaaugagu

SEQ ID NO: 3983735 - RNA, 13 nt, Staphylococcus aureus subsp. aureus Mu50
uaacauaaacaau

SEQ ID NO: 3983736 - RNA, 14 nt, Staphylococcus aureus subsp. aureus Mu50
uaacauaccuaaua

SEQ ID NO: 3983737 - RNA, 16 nt, Staphylococcus aureus subsp. aureus Mu50
uaacauacuauaaaaa

SEQ ID NO: 3983738 - RNA, 20 nt, Staphylococcus aureus subsp. aureus Mu50
uaacauacuauaaaaauuua

SEQ ID NO: 3983739 - RNA, 21 nt, Staphylococcus aureus subsp. aureus Mu50
uaacauacuauaaaaauuuau

SEQ ID NO: 3983740 - RNA, 17 nt, Staphylococcus aureus subsp. aureus Mu50
uaacaucaauuacucuu

SEQ ID NO: 3983741 - RNA, 21 nt, Staphylococcus aureus subsp. aureus Mu50
uaacauccccaaaaauagauu

SEQ ID NO: 3983742 - RNA, 19 nt, Staphylococcus aureus subsp. aureus Mu50
uaacauccugcuuauuaau

SEQ ID NO: 3983743 - RNA, 20 nt, Staphylococcus aureus subsp. aureus Mu50
uaacauccugcuuauuaauu

SEQ ID NO: 3983744 - RNA, 14 nt, Staphylococcus aureus subsp. aureus Mu50
uaacaucuaaauuu

SEQ ID NO: 3983745 - RNA, 19 nt, Staphylococcus aureus subsp. aureus Mu50
uaacaugugcaaguauaau

SEQ ID NO: 3983746 - RNA, 21 nt, Staphylococcus aureus subsp. aureus Mu50
uaacaugugcaaguauaaucc

SEQ ID NO: 3983747 - RNA, 16 nt, Staphylococcus aureus subsp. aureus Mu50
uaacauguuauugcuu

SEQ ID NO: 3983748 - RNA, 10 nt, Staphylococcus aureus subsp. aureus Mu50
uaacauguuu

SEQ ID NO: 3983749 - RNA, 23 nt, Staphylococcus aureus subsp. aureus Mu50
uaacauguuuguggcaccucuuu

SEQ ID NO: 3983750 - RNA, 14 nt, Staphylococcus aureus subsp. aureus Mu50
uaacauuaaaauga

SEQ ID NO: 3983751 - RNA, 13 nt, Staphylococcus aureus subsp. aureus Mu50
uaacauuauuaaa

SEQ ID NO: 3983752 - RNA, 18 nt, Staphylococcus aureus subsp. aureus Mu50
uaacauucuucaaaaaau

SEQ ID NO: 3983753 - RNA, 21 nt, Staphylococcus aureus subsp. aureus Mu50
uaacauucuucaaaaaauaau

SEQ ID NO: 3983754 - RNA, 20 nt, Staphylococcus aureus subsp. aureus Mu50
uaacauugaacgauaacaau

SEQ ID NO: 3983755 - RNA, 13 nt, Staphylococcus aureus subsp. aureus Mu50
uaacauuuaaaaa

SEQ ID NO: 3983756 - RNA, 14 nt, Staphylococcus aureus subsp. aureus Mu50
uaacauuuaaaaaa

SEQ ID NO: 3983757 - RNA, 15 nt, Staphylococcus aureus subsp. aureus Mu50
uaacauuuaaaaaau

SEQ ID NO: 3983758 - RNA, 17 nt, Staphylococcus aureus subsp. aureus Mu50
uaacauuuaaaaaaugc

SEQ ID NO: 3983759 - RNA, 22 nt, Staphylococcus aureus subsp. aureus Mu50
uaacauuucugaugcuagcuuu

SEQ ID NO: 3983760 - RNA, 13 nt, Staphylococcus aureus subsp. aureus Mu50
uaacauuugucau

SEQ ID NO: 3983761 - RNA, 14 nt, Staphylococcus aureus subsp. aureus Mu50
uaacauuugucaua

SEQ ID NO: 3983762 - RNA, 20 nt, Staphylococcus aureus subsp. aureus Mu50
uaacauuuguccgauuuauu

SEQ ID NO: 3983763 - RNA, 12 nt, Staphylococcus aureus subsp. aureus Mu50
uaacauuuugaa

SEQ ID NO: 3983764 - RNA, 22 nt, Staphylococcus aureus subsp. aureus Mu50
uaaccaccaucccauuaaacca

SEQ ID NO: 3983765 - RNA, 18 nt, Staphylococcus aureus subsp. aureus Mu50
uaaccacuccuuaaacaa

SEQ ID NO: 3983766 - RNA, 19 nt, Staphylococcus aureus subsp. aureus Mu50
uaaccaguauaauuuucug

SEQ ID NO: 3983767 - RNA, 18 nt, Staphylococcus aureus subsp. aureus Mu50
uaaccauaguaauaaaau

SEQ ID NO: 3983768 - RNA, 14 nt, Staphylococcus aureus subsp. aureus Mu50
uaaccauguauauc

SEQ ID NO: 3983769 - RNA, 21 nt, Staphylococcus aureus subsp. aureus Mu50
uaaccauuaugauuaauccua

SEQ ID NO: 3983770 - RNA, 15 nt, Staphylococcus aureus subsp. aureus Mu50
uaaccauuuaaaaau

SEQ ID NO: 3983771 - RNA, 23 nt, Staphylococcus aureus subsp. aureus Mu50
uaaccauuucaucauaauugaug

SEQ ID NO: 3983772 - RNA, 18 nt, Staphylococcus aureus subsp. aureus Mu50
uaacccaacgaugaaacu

SEQ ID NO: 3983773 - RNA, 13 nt, Staphylococcus aureus subsp. aureus Mu50
uaacccacauuaa

SEQ ID NO: 3983774 - RNA, 15 nt, Staphylococcus aureus subsp. aureus Mu50
uaacccacauuaaau

SEQ ID NO: 3983775 - RNA, 18 nt, Staphylococcus aureus subsp. aureus Mu50
uaacccauggauucugau

SEQ ID NO: 3983776 - RNA, 18 nt, Staphylococcus aureus subsp. aureus Mu50
uaacccuaaaaugaauag

SEQ ID NO: 3983777 - RNA, 21 nt, Staphylococcus aureus subsp. aureus Mu50
uaacccuaaagcuaaugcaag

SEQ ID NO: 3983778 - RNA, 14 nt, Staphylococcus aureus subsp. aureus Mu50
uaaccgaaauauug

SEQ ID NO: 3983779 - RNA, 14 nt, Staphylococcus aureus subsp. aureus Mu50
uaaccgaugugauu

SEQ ID NO: 3983780 - RNA, 14 nt, Staphylococcus aureus subsp. aureus Mu50
uaaccuacuuugau

SEQ ID NO: 3983781 - RNA, 16 nt, Staphylococcus aureus subsp. aureus Mu50
uaaccuauuaaaucug

SEQ ID NO: 3983782 - RNA, 14 nt, Staphylococcus aureus subsp. aureus Mu50
uaaccuauuucauu

SEQ ID NO: 3983783 - RNA, 17 nt, Staphylococcus aureus subsp. aureus Mu50
uaaccuucgagugcuuu

SEQ ID NO: 3983784 - RNA, 15 nt, Staphylococcus aureus subsp. aureus Mu50
uaaccuuguucuuua

SEQ ID NO: 3983785 - RNA, 15 nt, Staphylococcus aureus subsp. aureus Mu50
uaaccuuuaaaacau

SEQ ID NO: 3983786 - RNA, 16 nt, Staphylococcus aureus subsp. aureus Mu50
uaaccuuuaaaacauc

SEQ ID NO: 3983787 - RNA, 17 nt, Staphylococcus aureus subsp. aureus Mu50
uaaccuuuaaaacauca

SEQ ID NO: 3983788 - RNA, 16 nt, Staphylococcus aureus subsp. aureus Mu50
uaaccuuuaaaacguu

SEQ ID NO: 3983789 - RNA, 18 nt, Staphylococcus aureus subsp. aureus Mu50
uaacgaguccauuuucuu

SEQ ID NO: 3983790 - RNA, 22 nt, Staphylococcus aureus subsp. aureus Mu50
uaacgagugaaaauaagauuau

SEQ ID NO: 3983791 - RNA, 20 nt, Staphylococcus aureus subsp. aureus Mu50
uaacgagugcuuucaccuuu

SEQ ID NO: 3983792 - RNA, 22 nt, Staphylococcus aureus subsp. aureus Mu50
uaacgauaagcacgauaaaaau

SEQ ID NO: 3983793 - RNA, 14 nt, Staphylococcus aureus subsp. aureus Mu50
uaacgauagacauu

SEQ ID NO: 3983794 - RNA, 20 nt, Staphylococcus aureus subsp. aureus Mu50
uaacgaugguugcuucacug

SEQ ID NO: 3983795 - RNA, 21 nt, Staphylococcus aureus subsp. aureus Mu50
uaacgcucaugaguuucucau

SEQ ID NO: 3983796 - RNA, 20 nt, Staphylococcus aureus subsp. aureus Mu50
uaacguacauuuaugauugu

SEQ ID NO: 3983797 - RNA, 20 nt, Staphylococcus aureus subsp. aureus Mu50
uaacgucaacagcauaaaua

SEQ ID NO: 3983798 - RNA, 21 nt, Staphylococcus aureus subsp. aureus Mu50
uaacguguuugcucaaaaaug

SEQ ID NO: 3983799 - RNA, 15 nt, Staphylococcus aureus subsp. aureus Mu50
uaacguuaauauaau

SEQ ID NO: 3983800 - RNA, 14 nt, Staphylococcus aureus subsp. aureus Mu50
uaacguuauucauu

SEQ ID NO: 3983801 - RNA, 16 nt, Staphylococcus aureus subsp. aureus Mu50
uaacguugcagagaau

SEQ ID NO: 3983802 - RNA, 20 nt, Staphylococcus aureus subsp. aureus Mu50
uaacguugcagagaauauag

SEQ ID NO: 3983803 - RNA, 15 nt, Staphylococcus aureus subsp. aureus Mu50
uaacguuucuuugua

SEQ ID NO: 3983804 - RNA, 21 nt, Staphylococcus aureus subsp. aureus Mu50
uaacguuucuuuguauaccua

SEQ ID NO: 3983805 - RNA, 14 nt, Staphylococcus aureus subsp. aureus Mu50
uaacuaaaaugucu

SEQ ID NO: 3983806 - RNA, 21 nt, Staphylococcus aureus subsp. aureus Mu50
uaacuaaaaugucuuugaaaa

SEQ ID NO: 3983807 - RNA, 17 nt, Staphylococcus aureus subsp. aureus Mu50
uaacuaaaccauugaau

SEQ ID NO: 3983808 - RNA, 19 nt, Staphylococcus aureus subsp. aureus Mu50
uaacuacacuuaauauauu

SEQ ID NO: 3983809 - RNA, 18 nt, Staphylococcus aureus subsp. aureus Mu50
uaagaugacugaaccaau

SEQ ID NO: 3983810 - RNA, 19 nt, Staphylococcus aureus subsp. aureus Mu50
uaagaugacugaaccaauc

SEQ ID NO: 3983811 - RNA, 21 nt, Staphylococcus aureus subsp. aureus Mu50
uaagauguauaugaauuuuau

SEQ ID NO: 3983812 - RNA, 12 nt, Staphylococcus aureus subsp. aureus Mu50
uaagauuauuuu

SEQ ID NO: 3983813 - RNA, 15 nt, Staphylococcus aureus subsp. aureus Mu50
uaagauuuaaacauc

SEQ ID NO: 3983814 - RNA, 19 nt, Staphylococcus aureus subsp. aureus Mu50
uaagauuuugaauuuuaua

SEQ ID NO: 3983815 - RNA, 22 nt, Staphylococcus aureus subsp. aureus Mu50
uaagauuuuuuauguuuaauuu

SEQ ID NO: 3983816 - RNA, 12 nt, Staphylococcus aureus subsp. aureus Mu50
uaagcaaaaauu

SEQ ID NO: 3983817 - RNA, 14 nt, Staphylococcus aureus subsp. aureus Mu50
uaagcaaucauaau

SEQ ID NO: 3983818 - RNA, 15 nt, Staphylococcus aureus subsp. aureus Mu50
uaagcaauguaacuu

SEQ ID NO: 3983819 - RNA, 12 nt, Staphylococcus aureus subsp. aureus Mu50
uaagcaauuucu

SEQ ID NO: 3983820 - RNA, 16 nt, Staphylococcus aureus subsp. aureus Mu50
uaagcacgauaaaaau

SEQ ID NO: 3983821 - RNA, 17 nt, Staphylococcus aureus subsp. aureus Mu50
uaagcaguaagaugacu

SEQ ID NO: 3983822 - RNA, 22 nt, Staphylococcus aureus subsp. aureus Mu50
uaagcaguaagaugacuacaac

SEQ ID NO: 3983823 - RNA, 15 nt, Staphylococcus aureus subsp. aureus Mu50
uaagcaguuaauaag

SEQ ID NO: 3983824 - RNA, 19 nt, Staphylococcus aureus subsp. aureus Mu50
uaagcaguuaauaagaaac

SEQ ID NO: 3983825 - RNA, 15 nt, Staphylococcus aureus subsp. aureus Mu50
uaagcauaauucaac

SEQ ID NO: 3983826 - RNA, 22 nt, Staphylococcus aureus subsp. aureus Mu50
uaagcaucacauauguccauaa

SEQ ID NO: 3983827 - RNA, 15 nt, Staphylococcus aureus subsp. aureus Mu50
uaagcaucguaaaaa

SEQ ID NO: 3983828 - RNA, 17 nt, Staphylococcus aureus subsp. aureus Mu50
uaagcauuaauguucaa

SEQ ID NO: 3983829 - RNA, 20 nt, Staphylococcus aureus subsp. aureus Mu50
uaagcauuaauguucaauuu

SEQ ID NO: 3983830 - RNA, 23 nt, Staphylococcus aureus subsp. aureus Mu50
uaagcauuaauguucaauuuaua

SEQ ID NO: 3983831 - RNA, 17 nt, Staphylococcus aureus subsp. aureus Mu50
uaagcauucaguuaaug

SEQ ID NO: 3983832 - RNA, 18 nt, Staphylococcus aureus subsp. aureus Mu50
uaagccuuuucaaacaua

SEQ ID NO: 3983833 - RNA, 23 nt, Staphylococcus aureus subsp. aureus Mu50
uaagcgcaauggccauuugauuu

SEQ ID NO: 3983834 - RNA, 15 nt, Staphylococcus aureus subsp. aureus Mu50
uaagcgcaauuaaaa

SEQ ID NO: 3983835 - RNA, 23 nt, Staphylococcus aureus subsp. aureus Mu50
uaagcuaguguuuuuauuuuuau

SEQ ID NO: 3983836 - RNA, 16 nt, Staphylococcus aureus subsp. aureus Mu50
uaagcuauacucauuu

SEQ ID NO: 3983837 - RNA, 15 nt, Staphylococcus aureus subsp. aureus Mu50
uaagcucaugaauca

SEQ ID NO: 3983838 - RNA, 17 nt, Staphylococcus aureus subsp. aureus Mu50
uaagcucauuucaauau

SEQ ID NO: 3983839 - RNA, 23 nt, Staphylococcus aureus subsp. aureus Mu50
uaagcucauuucaauauuaaaau

SEQ ID NO: 3983840 - RNA, 23 nt, Staphylococcus aureus subsp. aureus Mu50
uaagcucguuaauuuuauuuuag

SEQ ID NO: 3983841 - RNA, 14 nt, Staphylococcus aureus subsp. aureus Mu50
uaagcugaaaauca

SEQ ID NO: 3983842 - RNA, 21 nt, Staphylococcus aureus subsp. aureus Mu50
uaagcugaaaaucaucauuau

SEQ ID NO: 3983843 - RNA, 21 nt, Staphylococcus aureus subsp. aureus Mu50
uaagcugcucgauauaugucu

SEQ ID NO: 3983844 - RNA, 19 nt, Staphylococcus aureus subsp. aureus Mu50
uaagcuuacgacauacuug

SEQ ID NO: 3983845 - RNA, 13 nt, Staphylococcus aureus subsp. aureus Mu50
uaagcuuaucaac

SEQ ID NO: 3983846 - RNA, 19 nt, Staphylococcus aureus subsp. aureus Mu50
uaagcuucuguguuggggc

SEQ ID NO: 3983847 - RNA, 17 nt, Staphylococcus aureus subsp. aureus Mu50
uaagcuuucauuaauuu

SEQ ID NO: 3983848 - RNA, 14 nt, Staphylococcus aureus subsp. aureus Mu50
uaaggaaccugucu

SEQ ID NO: 3983849 - RNA, 23 nt, Staphylococcus aureus subsp. aureus Mu50
uaagguaagaccccgaaaagagg

SEQ ID NO: 3983850 - RNA, 14 nt, Staphylococcus aureus subsp. aureus Mu50
uaagguauuucauu

SEQ ID NO: 3983851 - RNA, 23 nt, Staphylococcus aureus subsp. aureus Mu50
uaagguauuucauugauaagucu

SEQ ID NO: 3983852 - RNA, 15 nt, Staphylococcus aureus subsp. aureus Mu50
uaagguuugaacucu

SEQ ID NO: 3983853 - RNA, 13 nt, Staphylococcus aureus subsp. aureus Mu50
uaaguaaaacugc

SEQ ID NO: 3983854 - RNA, 15 nt, Staphylococcus aureus subsp. aureus Mu50
uaaguaaauaauagu

SEQ ID NO: 3983855 - RNA, 22 nt, Staphylococcus aureus subsp. aureus Mu50
uaaguaaccaagucuaacaguu

SEQ ID NO: 3983856 - RNA, 19 nt, Staphylococcus aureus subsp. aureus Mu50
uaaguaauagcaaccauau

SEQ ID NO: 3983857 - RNA, 19 nt, Staphylococcus aureus subsp. aureus Mu50
uaaguaaucauaauaaucg

SEQ ID NO: 3983858 - RNA, 12 nt, Staphylococcus aureus subsp. aureus Mu50
uaaguaauucau

SEQ ID NO: 3983859 - RNA, 18 nt, Staphylococcus aureus subsp. aureus Mu50
uaaguaauucauuugcuu

SEQ ID NO: 3983860 - RNA, 15 nt, Staphylococcus aureus subsp. aureus Mu50
uaaguacaaauaaua

SEQ ID NO: 3983861 - RNA, 18 nt, Staphylococcus aureus subsp. aureus Mu50
uaaguacagcauauaaug

SEQ ID NO: 3983862 - RNA, 14 nt, Staphylococcus aureus subsp. aureus Mu50
uaaguagaugauua

SEQ ID NO: 3983863 - RNA, 17 nt, Staphylococcus aureus subsp. aureus Mu50
uaaguagcucaaaacaa

SEQ ID NO: 3983864 - RNA, 15 nt, Staphylococcus aureus subsp. aureus Mu50
uaaguaguuguuaua

SEQ ID NO: 3983865 - RNA, 20 nt, Staphylococcus aureus subsp. aureus Mu50
uaaguaguuguuauauucua

SEQ ID NO: 3983866 - RNA, 21 nt, Staphylococcus aureus subsp. aureus Mu50
uaaguaguuguuauauucuag

SEQ ID NO: 3983867 - RNA, 20 nt, Staphylococcus aureus subsp. aureus Mu50
uaaguauaauuaaacuaaua

SEQ ID NO: 3983868 - RNA, 17 nt, Staphylococcus aureus subsp. aureus Mu50
uaaguauauaauugauu

SEQ ID NO: 3983869 - RNA, 12 nt, Staphylococcus aureus subsp. aureus Mu50
uaaguauucaua

SEQ ID NO: 3983870 - RNA, 21 nt, Staphylococcus aureus subsp. aureus Mu50
uaaguauuuaaauaacaagua

SEQ ID NO: 3983871 - RNA, 19 nt, Staphylococcus aureus subsp. aureus Mu50
uaagucuaauguuggaaaa

SEQ ID NO: 3983872 - RNA, 18 nt, Staphylococcus aureus subsp. aureus Mu50
uaagucuagcauuagaau

SEQ ID NO: 3983873 - RNA, 22 nt, Staphylococcus aureus subsp. aureus Mu50
uaagucugaugucgaaaauagc

SEQ ID NO: 3983874 - RNA, 19 nt, Staphylococcus aureus subsp. aureus Mu50
uaagucuuaacaaauuaaa

SEQ ID NO: 3983875 - RNA, 17 nt, Staphylococcus aureus subsp. aureus Mu50
uaagucuuuuaaaugau

SEQ ID NO: 3983876 - RNA, 15 nt, Staphylococcus aureus subsp. aureus Mu50
uaagugacacaccac

SEQ ID NO: 3983877 - RNA, 16 nt, Staphylococcus aureus subsp. aureus Mu50
uaagugacacaccacc

SEQ ID NO: 3983878 - RNA, 17 nt, Staphylococcus aureus subsp. aureus Mu50
uaagugacacaccacca

SEQ ID NO: 3983879 - RNA, 13 nt, Staphylococcus aureus subsp. aureus Mu50
uaagugauaaaua

SEQ ID NO: 3983880 - RNA, 23 nt, Staphylococcus aureus subsp. aureus Mu50
uaagugaugaccaauauucugga

SEQ ID NO: 3983881 - RNA, 23 nt, Staphylococcus aureus subsp. aureus Mu50
uaagugauuucuucauuaucaau

SEQ ID NO: 3983882 - RNA, 22 nt, Staphylococcus aureus subsp. aureus Mu50
uaagugguuaucacgugcuucg

SEQ ID NO: 3983883 - RNA, 23 nt, Staphylococcus aureus subsp. aureus Mu50
uaagugguugaacgguuguauuu

SEQ ID NO: 3983884 - RNA, 24 nt, Staphylococcus aureus subsp. aureus Mu50
uaaguguuuuauagauucauguaa

SEQ ID NO: 3983885 - RNA, 22 nt, Staphylococcus aureus subsp. aureus Mu50
uaaguuaaaaauguaaauaaaa

SEQ ID NO: 3983886 - RNA, 18 nt, Staphylococcus aureus subsp. aureus Mu50
uaaguuaaaaccuuuuca

SEQ ID NO: 3983887 - RNA, 22 nt, Staphylococcus aureus subsp. aureus Mu50
uaaguuaaaaccuuuucaaauu

SEQ ID NO: 3983888 - RNA, 23 nt, Staphylococcus aureus subsp. aureus Mu50
uaaguuaaaaccuuuucaaauua

SEQ ID NO: 3983889 - RNA, 13 nt, Staphylococcus aureus subsp. aureus Mu50
uaaguuaaaauaa

SEQ ID NO: 3983890 - RNA, 22 nt, Staphylococcus aureus subsp. aureus Mu50
uaaguuaauuuuaugucccaau

SEQ ID NO: 3983891 - RNA, 14 nt, Staphylococcus aureus subsp. aureus Mu50
uaaguuaugacuaa

SEQ ID NO: 3983892 - RNA, 21 nt, Staphylococcus aureus subsp. aureus Mu50
uaaguuaugacuaacgaaaaa

SEQ ID NO: 3983893 - RNA, 16 nt, Staphylococcus aureus subsp. aureus Mu50
uaaguugaauauaaaa

SEQ ID NO: 3983894 - RNA, 15 nt, Staphylococcus aureus subsp. aureus Mu50
uaaguugauuucuac

SEQ ID NO: 3983895 - RNA, 18 nt, Staphylococcus aureus subsp. aureus Mu50
uaaguuuauaaucaguuu

SEQ ID NO: 3983896 - RNA, 22 nt, Staphylococcus aureus subsp. aureus Mu50
uaauacuuuuugaguauccaau

SEQ ID NO: 3983897 - RNA, 15 nt, Staphylococcus aureus subsp. aureus Mu50
uaauagaaauaauca

SEQ ID NO: 3983898 - RNA, 24 nt, Staphylococcus aureus subsp. aureus Mu50
uaauagagacauuuuaucugaaaa

SEQ ID NO: 3983899 - RNA, 22 nt, Staphylococcus aureus subsp. aureus Mu50
uaauagcaaaauuauguaaaaa

SEQ ID NO: 3983900 - RNA, 18 nt, Staphylococcus aureus subsp. aureus Mu50
uaauagcaaccauauuuu

SEQ ID NO: 3983901 - RNA, 21 nt, Staphylococcus aureus subsp. aureus Mu50
uaauaggauaugcuaaacacu

SEQ ID NO: 3983902 - RNA, 18 nt, Staphylococcus aureus subsp. aureus Mu50
uaauaggauuauuaucaa

SEQ ID NO: 3983903 - RNA, 16 nt, Staphylococcus aureus subsp. aureus Mu50
uaauaggcuauguaaa

SEQ ID NO: 3983904 - RNA, 20 nt, Staphylococcus aureus subsp. aureus Mu50
uaauaggcuauguaaaucgu

SEQ ID NO: 3983905 - RNA, 16 nt, Staphylococcus aureus subsp. aureus Mu50
uaauaguaaugaugug

SEQ ID NO: 3983906 - RNA, 17 nt, Staphylococcus aureus subsp. aureus Mu50
uaauaguguuauauugu

SEQ ID NO: 3983907 - RNA, 14 nt, Staphylococcus aureus subsp. aureus Mu50
uaauaguuaacgau

SEQ ID NO: 3983908 - RNA, 15 nt, Staphylococcus aureus subsp. aureus Mu50
uaauauaaaaacaaa

SEQ ID NO: 3983909 - RNA, 16 nt, Staphylococcus aureus subsp. aureus Mu50
uaauauaaaauaaagu

SEQ ID NO: 3983910 - RNA, 13 nt, Staphylococcus aureus subsp. aureus Mu50
uaauauaaauaaa

SEQ ID NO: 3983911 - RNA, 16 nt, Staphylococcus aureus subsp. aureus Mu50
uaauauaaauuuugaa

SEQ ID NO: 3983912 - RNA, 22 nt, Staphylococcus aureus subsp. aureus Mu50
uaauauaacgacacuuuuuagu

SEQ ID NO: 3983913 - RNA, 18 nt, Staphylococcus aureus subsp. aureus Mu50
uaauauaacuucuauuaa

SEQ ID NO: 3983914 - RNA, 15 nt, Staphylococcus aureus subsp. aureus Mu50
uaauauaaguauaau

SEQ ID NO: 3983915 - RNA, 12 nt, Staphylococcus aureus subsp. aureus Mu50
uaauauaauacc

SEQ ID NO: 3983916 - RNA, 13 nt, Staphylococcus aureus subsp. aureus Mu50
uaauauaauuaaa

SEQ ID NO: 3983917 - RNA, 14 nt, Staphylococcus aureus subsp. aureus Mu50
uaauauaauuauua

SEQ ID NO: 3983918 - RNA, 17 nt, Staphylococcus aureus subsp. aureus Mu50
uaauauauccugccaau

SEQ ID NO: 3983919 - RNA, 21 nt, Staphylococcus aureus subsp. aureus Mu50
uaauauauccugccaauauau

SEQ ID NO: 3983920 - RNA, 16 nt, Staphylococcus aureus subsp. aureus Mu50
uaauaucaauuuuuac

SEQ ID NO: 3983921 - RNA, 18 nt, Staphylococcus aureus subsp. aureus Mu50
uaauaucacgaucuuuaa

SEQ ID NO: 3983922 - RNA, 22 nt, Staphylococcus aureus subsp. aureus Mu50
uaauaucaugcacaauauucgu

SEQ ID NO: 3983923 - RNA, 19 nt, Staphylococcus aureus subsp. aureus Mu50
uaauaucuuacuacuuaau

SEQ ID NO: 3983924 - RNA, 22 nt, Staphylococcus aureus subsp. aureus Mu50
uaauaucuuacuacuuaauuaa

SEQ ID NO: 3983925 - RNA, 23 nt, Staphylococcus aureus subsp. aureus Mu50
uaauaucuuacuacuuaauuaau

SEQ ID NO: 3983926 - RNA, 14 nt, Staphylococcus aureus subsp. aureus Mu50
uaauaucuucuuua

SEQ ID NO: 3983927 - RNA, 21 nt, Staphylococcus aureus subsp. aureus Mu50
uaauaucuucuuuauuuacac

SEQ ID NO: 3983928 - RNA, 13 nt, Staphylococcus aureus subsp. aureus Mu50
uaauaucuuuugc

SEQ ID NO: 3983929 - RNA, 17 nt, Staphylococcus aureus subsp. aureus Mu50
uaauaugaaggcuuuuu

SEQ ID NO: 3983930 - RNA, 18 nt, Staphylococcus aureus subsp. aureus Mu50
uaauauguugcuuaucaa

SEQ ID NO: 3983931 - RNA, 21 nt, Staphylococcus aureus subsp. aureus Mu50
uaauauuaaauugcguacuug

SEQ ID NO: 3983932 - RNA, 18 nt, Staphylococcus aureus subsp. aureus Mu50
uaauauuagauaucuuaa

SEQ ID NO: 3983933 - RNA, 12 nt, Staphylococcus aureus subsp. aureus Mu50
uaauauuauaaa

SEQ ID NO: 3983934 - RNA, 15 nt, Staphylococcus aureus subsp. aureus Mu50
uaauauuauaaccac

SEQ ID NO: 3983935 - RNA, 17 nt, Staphylococcus aureus subsp. aureus Mu50
uaauauuauaaccacca

SEQ ID NO: 3983936 - RNA, 22 nt, Staphylococcus aureus subsp. aureus Mu50
uaauauuauaaccaccaguaua

SEQ ID NO: 3983937 - RNA, 12 nt, Staphylococcus aureus subsp. aureus Mu50
uaauauuauaag

SEQ ID NO: 3983938 - RNA, 17 nt, Staphylococcus aureus subsp. aureus Mu50
uaauauuauucuuuaua

SEQ ID NO: 3983939 - RNA, 21 nt, Staphylococcus aureus subsp. aureus Mu50
uaauauucuuucguuuucauc

SEQ ID NO: 3983940 - RNA, 23 nt, Staphylococcus aureus subsp. aureus Mu50
uaauauucuuucguuuucaucaa

SEQ ID NO: 3983941 - RNA, 17 nt, Staphylococcus aureus subsp. aureus Mu50
uaauauugaaaugagcu

SEQ ID NO: 3983942 - RNA, 17 nt, Staphylococcus aureus subsp. aureus Mu50
uaauauuggacuuugcu

SEQ ID NO: 3983943 - RNA, 12 nt, Staphylococcus aureus subsp. aureus Mu50
uaauauuguuaa

SEQ ID NO: 3983944 - RNA, 14 nt, Staphylococcus aureus subsp. aureus Mu50
uaauauuuaaccac

SEQ ID NO: 3983945 - RNA, 17 nt, Staphylococcus aureus subsp. aureus Mu50
uaauauuuagauacuga

SEQ ID NO: 3983946 - RNA, 17 nt, Staphylococcus aureus subsp. aureus Mu50
uaauauuucuuaccauu

SEQ ID NO: 3983947 - RNA, 18 nt, Staphylococcus aureus subsp. aureus Mu50
uaauauuucuuaccauuu

SEQ ID NO: 3983948 - RNA, 14 nt, Staphylococcus aureus subsp. aureus Mu50
uaauauuucuuaga

SEQ ID NO: 3983949 - RNA, 18 nt, Staphylococcus aureus subsp. aureus Mu50
uaauauuugauaacaaaa

SEQ ID NO: 3983950 - RNA, 12 nt, Staphylococcus aureus subsp. aureus Mu50
uaauauuuuaaa

SEQ ID NO: 3983951 - RNA, 15 nt, Staphylococcus aureus subsp. aureus Mu50
uaauauuuuaaacgu

SEQ ID NO: 3983952 - RNA, 12 nt, Staphylococcus aureus subsp. aureus Mu50
uaauauuuuggc

SEQ ID NO: 3983953 - RNA, 23 nt, Staphylococcus aureus subsp. aureus Mu50
uaaucaaaaaagacucauacaca

SEQ ID NO: 3983954 - RNA, 13 nt, Staphylococcus aureus subsp. aureus Mu50
uaaucaaaauuau

SEQ ID NO: 3983955 - RNA, 17 nt, Staphylococcus aureus subsp. aureus Mu50
uaaucaaaauuaugacu

SEQ ID NO: 3983956 - RNA, 17 nt, Staphylococcus aureus subsp. aureus Mu50
uaaucaaaccaccaaaa

SEQ ID NO: 3983957 - RNA, 16 nt, Staphylococcus aureus subsp. aureus Mu50
uaaucaaagaaaaagu

SEQ ID NO: 3983958 - RNA, 15 nt, Staphylococcus aureus subsp. aureus Mu50
uaaucaaauuaguca

SEQ ID NO: 3983959 - RNA, 22 nt, Staphylococcus aureus subsp. aureus Mu50
uaaucaacgauaacgauauugu

SEQ ID NO: 3983960 - RNA, 17 nt, Staphylococcus aureus subsp. aureus Mu50
uaaucaagaauauaagu

SEQ ID NO: 3983961 - RNA, 22 nt, Staphylococcus aureus subsp. aureus Mu50
uaaucaagaauauaagugauuu

SEQ ID NO: 3983962 - RNA, 18 nt, Staphylococcus aureus subsp. aureus Mu50
uaaucaagcaaugcaugc

SEQ ID NO: 3983963 - RNA, 14 nt, Staphylococcus aureus subsp. aureus Mu50
uaaucacauuaauu

SEQ ID NO: 3983964 - RNA, 15 nt, Staphylococcus aureus subsp. aureus Mu50
uaaucagaaaagcag

SEQ ID NO: 3983965 - RNA, 21 nt, Staphylococcus aureus subsp. aureus Mu50
uaaucagcuauaaaaguacuu

SEQ ID NO: 3983966 - RNA, 17 nt, Staphylococcus aureus subsp. aureus Mu50
uaaucagugaaauauca

SEQ ID NO: 3983967 - RNA, 12 nt, Staphylococcus aureus subsp. aureus Mu50
uaaucauaaaaa

SEQ ID NO: 3983968 - RNA, 14 nt, Staphylococcus aureus subsp. aureus Mu50
uaaucauaaugaau

SEQ ID NO: 3983969 - RNA, 15 nt, Staphylococcus aureus subsp. aureus Mu50
uaaucauaaugaaua

SEQ ID NO: 3983970 - RNA, 17 nt, Staphylococcus aureus subsp. aureus Mu50
uaaucauaaugaauaau

SEQ ID NO: 3983971 - RNA, 15 nt, Staphylococcus aureus subsp. aureus Mu50
uaaucauagcauuaa

SEQ ID NO: 3983972 - RNA, 19 nt, Staphylococcus aureus subsp. aureus Mu50
uaaucaugaaguugguuua

SEQ ID NO: 3983973 - RNA, 16 nt, Staphylococcus aureus subsp. aureus Mu50
uaaucauguaaugcuu

SEQ ID NO: 3983974 - RNA, 14 nt, Staphylococcus aureus subsp. aureus Mu50
uaaucauuguguau

SEQ ID NO: 3983975 - RNA, 18 nt, Staphylococcus aureus subsp. aureus Mu50
uaaucauuguguauuguu

SEQ ID NO: 3983976 - RNA, 21 nt, Staphylococcus aureus subsp. aureus Mu50
uaaucauuguguauuguuuua

SEQ ID NO: 3983977 - RNA, 19 nt, Staphylococcus aureus subsp. aureus Mu50
uaauccaguaaucaaagau

SEQ ID NO: 3983978 - RNA, 20 nt, Staphylococcus aureus subsp. aureus Mu50
uaauccauacguaucaaaau

SEQ ID NO: 3983979 - RNA, 12 nt, Staphylococcus aureus subsp. aureus Mu50
uaauccauucuu

SEQ ID NO: 3983980 - RNA, 13 nt, Staphylococcus aureus subsp. aureus Mu50
uaaucccauuuua

SEQ ID NO: 3983981 - RNA, 17 nt, Staphylococcus aureus subsp. aureus Mu50
uaaucccauuuuaaagu

SEQ ID NO: 3983982 - RNA, 16 nt, Staphylococcus aureus subsp. aureus Mu50
uaauccccgaagcaca

SEQ ID NO: 3983983 - RNA, 21 nt, Staphylococcus aureus subsp. aureus Mu50
uaauccccgaagcacagaaaa

SEQ ID NO: 3983984 - RNA, 17 nt, Staphylococcus aureus subsp. aureus Mu50
uaaugugcgucacucac

SEQ ID NO: 3983985 - RNA, 20 nt, Staphylococcus aureus subsp. aureus Mu50
uaaugugcgucacucacuuc

SEQ ID NO: 3983986 - RNA, 17 nt, Staphylococcus aureus subsp. aureus Mu50
uaauguguuaauacuuc

SEQ ID NO: 3983987 - RNA, 14 nt, Staphylococcus aureus subsp. aureus Mu50
uaauguuaaaauaa

SEQ ID NO: 3983988 - RNA, 22 nt, Staphylococcus aureus subsp. aureus Mu50
uaauguuaaaauaacugcuaau

SEQ ID NO: 3983989 - RNA, 13 nt, Staphylococcus aureus subsp. aureus Mu50
uaauguuaaacac

SEQ ID NO: 3983990 - RNA, 21 nt, Staphylococcus aureus subsp. aureus Mu50
uaauguucaaaaaaugaauau

SEQ ID NO: 3983991 - RNA, 19 nt, Staphylococcus aureus subsp. aureus Mu50
uaauguuccccugaaaaga

SEQ ID NO: 3983992 - RNA, 18 nt, Staphylococcus aureus subsp. aureus Mu50
uaauguuggcaaacuauu

SEQ ID NO: 3983993 - RNA, 13 nt, Staphylococcus aureus subsp. aureus Mu50
uaauguuuccauu

SEQ ID NO: 3983994 - RNA, 23 nt, Staphylococcus aureus subsp. aureus Mu50
uaauguuuccugauauuucaacu

SEQ ID NO: 3983995 - RNA, 15 nt, Staphylococcus aureus subsp. aureus Mu50
uaauguuugcuuuuu

SEQ ID NO: 3983996 - RNA, 19 nt, Staphylococcus aureus subsp. aureus Mu50
uaauguuuuagugacaaac

SEQ ID NO: 3983997 - RNA, 19 nt, Staphylococcus aureus subsp. aureus Mu50
uaauuaaaaaaagauuagu

SEQ ID NO: 3983998 - RNA, 17 nt, Staphylococcus aureus subsp. aureus Mu50
uaauuaaaaaauuccua

SEQ ID NO: 3983999 - RNA, 23 nt, Staphylococcus aureus subsp. aureus Mu50
uaauuaaaagugcaaguccaaau

SEQ ID NO: 3984000 - RNA, 12 nt, Staphylococcus aureus subsp. aureus Mu50
uaauuaaaauaa

SEQ ID NO: 3984001 - RNA, 13 nt, Staphylococcus aureus subsp. aureus Mu50
uaauuaaaauaca

SEQ ID NO: 3984002 - RNA, 20 nt, Staphylococcus aureus subsp. aureus Mu50
uaauuaaaauacaaauuaca

SEQ ID NO: 3984003 - RNA, 12 nt, Staphylococcus aureus subsp. aureus Mu50
uaauuaacacau

SEQ ID NO: 3984004 - RNA, 15 nt, Staphylococcus aureus subsp. aureus Mu50
uaauuaauaagcauu

SEQ ID NO: 3984005 - RNA, 14 nt, Staphylococcus aureus subsp. aureus Mu50
uaauuaauacauca

SEQ ID NO: 3984006 - RNA, 21 nt, Staphylococcus aureus subsp. aureus Mu50
uaauuaauacaucaauaucuu

SEQ ID NO: 3984007 - RNA, 22 nt, Staphylococcus aureus subsp. aureus Mu50
uaauuaauguucaaaaaaugaa

SEQ ID NO: 3984008 - RNA, 16 nt, Staphylococcus aureus subsp. aureus Mu50
uaauuaauguuucuuc

SEQ ID NO: 3984009 - RNA, 15 nt, Staphylococcus aureus subsp. aureus Mu50
uaauuaauuaaaauu

SEQ ID NO: 3984010 - RNA, 23 nt, Staphylococcus aureus subsp. aureus Mu50
uaauuaauuacuuucauuguaaa

SEQ ID NO: 3984011 - RNA, 19 nt, Staphylococcus aureus subsp. aureus Mu50
uaauuacgucauaaaauac

SEQ ID NO: 3984012 - RNA, 22 nt, Staphylococcus aureus subsp. aureus Mu50
uaauuacuuucauuguaaauuu

SEQ ID NO: 3984013 - RNA, 18 nt, Staphylococcus aureus subsp. aureus Mu50
uaauuagauuuaaaaugu

SEQ ID NO: 3984014 - RNA, 16 nt, Staphylococcus aureus subsp. aureus Mu50
uaauuaggauuaacau

SEQ ID NO: 3984015 - RNA, 17 nt, Staphylococcus aureus subsp. aureus Mu50
uaauuaggauuuccgga

SEQ ID NO: 3984016 - RNA, 21 nt, Staphylococcus aureus subsp. aureus Mu50
uaauuagguauaguguuugac

SEQ ID NO: 3984017 - RNA, 22 nt, Staphylococcus aureus subsp. aureus Mu50
uaauuagugcaaguaauuuaau

SEQ ID NO: 3984018 - RNA, 16 nt, Staphylococcus aureus subsp. aureus Mu50
uaauuaguguuucaug

SEQ ID NO: 3984019 - RNA, 12 nt, Staphylococcus aureus subsp. aureus Mu50
uaauuauauuaa

SEQ ID NO: 3984020 - RNA, 14 nt, Staphylococcus aureus subsp. aureus Mu50
uaauuauauuaaug

SEQ ID NO: 3984021 - RNA, 14 nt, Staphylococcus aureus subsp. aureus Mu50
uaauuaucauauaa

SEQ ID NO: 3984022 - RNA, 21 nt, Staphylococcus aureus subsp. aureus Mu50
uaauuaucauaugugauuuaa

SEQ ID NO: 3984023 - RNA, 11 nt, Staphylococcus aureus subsp. aureus Mu50
uaauuaucauu

SEQ ID NO: 3984024 - RNA, 12 nt, Staphylococcus aureus subsp. aureus Mu50
uaauuaucauua

SEQ ID NO: 3984025 - RNA, 16 nt, Staphylococcus aureus subsp. aureus Mu50
uaauuaucuucaucau

SEQ ID NO: 3984026 - RNA, 17 nt, Staphylococcus aureus subsp. aureus Mu50
uaauuaugguaauuagu

SEQ ID NO: 3984027 - RNA, 19 nt, Staphylococcus aureus subsp. aureus Mu50
uaauuauuaggggagauua

SEQ ID NO: 3984028 - RNA, 13 nt, Staphylococcus aureus subsp. aureus Mu50
uaauuauuauaau

SEQ ID NO: 3984029 - RNA, 14 nt, Staphylococcus aureus subsp. aureus Mu50
uaauuauuauauaa

SEQ ID NO: 3984030 - RNA, 16 nt, Staphylococcus aureus subsp. aureus Mu50
uaauuauugagaauau

SEQ ID NO: 3984031 - RNA, 20 nt, Staphylococcus aureus subsp. aureus Mu50
uaauuauugagaauauuuau

SEQ ID NO: 3984032 - RNA, 13 nt, Staphylococcus aureus subsp. aureus Mu50
uaauuauuucucu

SEQ ID NO: 3984033 - RNA, 14 nt, Staphylococcus aureus subsp. aureus Mu50
uaauuauuucucuu

SEQ ID NO: 3984034 - RNA, 20 nt, Staphylococcus aureus subsp. aureus Mu50
uaauuauuuuaaaaaaugau

SEQ ID NO: 3984035 - RNA, 20 nt, Staphylococcus aureus subsp. aureus Mu50
uaauuauuuucucgauacaa

SEQ ID NO: 3984036 - RNA, 21 nt, Staphylococcus aureus subsp. aureus Mu50
uaauuauuuuucucaacaguu

SEQ ID NO: 3984037 - RNA, 22 nt, Staphylococcus aureus subsp. aureus Mu50
uaauucaacuuaaauggaugau

SEQ ID NO: 3984038 - RNA, 21 nt, Staphylococcus aureus subsp. aureus Mu50
uaauucaaugauuuuuaaaaa

SEQ ID NO: 3984039 - RNA, 15 nt, Staphylococcus aureus subsp. aureus Mu50
uaauucagaugaaua

SEQ ID NO: 3984040 - RNA, 17 nt, Staphylococcus aureus subsp. aureus Mu50
uaauucaggaaaugcau

SEQ ID NO: 3984041 - RNA, 15 nt, Staphylococcus aureus subsp. aureus Mu50
uaauucauauauacu

SEQ ID NO: 3984042 - RNA, 13 nt, Staphylococcus aureus subsp. aureus Mu50
uaauucauauuca

SEQ ID NO: 3984043 - RNA, 23 nt, Staphylococcus aureus subsp. aureus Mu50
uaauucaucuugcgccuuguuca

SEQ ID NO: 3984044 - RNA, 18 nt, Staphylococcus aureus subsp. aureus Mu50
uaauucauuuauuuucuu

SEQ ID NO: 3984045 - RNA, 19 nt, Staphylococcus aureus subsp. aureus Mu50
uaauucccuaggaaauaaa

SEQ ID NO: 3984046 - RNA, 15 nt, Staphylococcus aureus subsp. aureus Mu50
uaauucccuguuaug

SEQ ID NO: 3984047 - RNA, 21 nt, Staphylococcus aureus subsp. aureus Mu50
uaauuccugauacaaugauua

SEQ ID NO: 3984048 - RNA, 13 nt, Staphylococcus aureus subsp. aureus Mu50
uaauuccuggugc

SEQ ID NO: 3984049 - RNA, 22 nt, Staphylococcus aureus subsp. aureus Mu50
uaauuccuucuauagcaccauu

SEQ ID NO: 3984050 - RNA, 14 nt, Staphylococcus aureus subsp. aureus Mu50
uaauucgccaucuu

SEQ ID NO: 3984051 - RNA, 19 nt, Staphylococcus aureus subsp. aureus Mu50
uaauucguaauuuaugauu

SEQ ID NO: 3984052 - RNA, 18 nt, Staphylococcus aureus subsp. aureus Mu50
uaauucguugauuuagca

SEQ ID NO: 3984053 - RNA, 20 nt, Staphylococcus aureus subsp. aureus Mu50
uaauucguuuuacuacuguc

SEQ ID NO: 3984054 - RNA, 20 nt, Staphylococcus aureus subsp. aureus Mu50
uaauucguuuugcuaaccau

SEQ ID NO: 3984055 - RNA, 23 nt, Staphylococcus aureus subsp. aureus Mu50
uaauucguuuugcuaaccaucau

SEQ ID NO: 3984056 - RNA, 13 nt, Staphylococcus aureus subsp. aureus Mu50
uaauucuaagucu

SEQ ID NO: 3984057 - RNA, 21 nt, Staphylococcus aureus subsp. aureus Mu50
uaauucuaagucucuugucau

SEQ ID NO: 3984058 - RNA, 22 nt, Staphylococcus aureus subsp. aureus Mu50
uaauucuagagauaacuagaau

SEQ ID NO: 3984059 - RNA, 17 nt, Staphylococcus aureus subsp. aureus Mu50
uaauucuauuuuugauu

SEQ ID NO: 3984060 - RNA, 20 nt, Staphylococcus aureus subsp. aureus Mu50
uaauucuauuuuugauuuaa

SEQ ID NO: 3984061 - RNA, 14 nt, Staphylococcus aureus subsp. aureus Mu50
uaauucugaaauca

SEQ ID NO: 3984062 - RNA, 22 nt, Staphylococcus aureus subsp. aureus Mu50
uaauucugaaaucaguuuuuga

SEQ ID NO: 3984063 - RNA, 16 nt, Staphylococcus aureus subsp. aureus Mu50
uaauucugguuuaaug

SEQ ID NO: 3984064 - RNA, 17 nt, Staphylococcus aureus subsp. aureus Mu50
uaauucuucaucaauaa

SEQ ID NO: 3984065 - RNA, 19 nt, Staphylococcus aureus subsp. aureus Mu50
uaauucuucaucuucuuca

SEQ ID NO: 3984066 - RNA, 14 nt, Staphylococcus aureus subsp. aureus Mu50
uaauugaaaugaua

SEQ ID NO: 3984067 - RNA, 22 nt, Staphylococcus aureus subsp. aureus Mu50
uaauugaauugauuauaaugau

SEQ ID NO: 3984068 - RNA, 20 nt, Staphylococcus aureus subsp. aureus Mu50
uaauugauauggaucauaau

SEQ ID NO: 3984069 - RNA, 14 nt, Staphylococcus aureus subsp. aureus Mu50
uaauugaucagcau

SEQ ID NO: 3984070 - RNA, 22 nt, Staphylococcus aureus subsp. aureus Mu50
uaauugaugaugaugugcuuua

SEQ ID NO: 3984071 - RNA, 18 nt, Staphylococcus aureus subsp. aureus Mu50
uacaaauguauaaauaau

SEQ ID NO: 3984072 - RNA, 12 nt, Staphylococcus aureus subsp. aureus Mu50
uacaaauugauu

SEQ ID NO: 3984073 - RNA, 13 nt, Staphylococcus aureus subsp. aureus Mu50
uacaaauugauuu

SEQ ID NO: 3984074 - RNA, 18 nt, Staphylococcus aureus subsp. aureus Mu50
uacaaauuuuuuuuauua

SEQ ID NO: 3984075 - RNA, 15 nt, Staphylococcus aureus subsp. aureus Mu50
uacaacaccaauuga

SEQ ID NO: 3984076 - RNA, 15 nt, Staphylococcus aureus subsp. aureus Mu50
uacaacaguugcacc

SEQ ID NO: 3984077 - RNA, 14 nt, Staphylococcus aureus subsp. aureus Mu50
uacaacauacaugc

SEQ ID NO: 3984078 - RNA, 17 nt, Staphylococcus aureus subsp. aureus Mu50
uacaacauagaauaacg

SEQ ID NO: 3984079 - RNA, 14 nt, Staphylococcus aureus subsp. aureus Mu50
uacaacauguguau

SEQ ID NO: 3984080 - RNA, 23 nt, Staphylococcus aureus subsp. aureus Mu50
uacaacgacacgaacaacauuag

SEQ ID NO: 3984081 - RNA, 14 nt, Staphylococcus aureus subsp. aureus Mu50
uacaacuaaauaug

SEQ ID NO: 3984082 - RNA, 19 nt, Staphylococcus aureus subsp. aureus Mu50
uacaacucguuuuuccaug

SEQ ID NO: 3984083 - RNA, 20 nt, Staphylococcus aureus subsp. aureus Mu50
uacaacucguuuuuccaugu

SEQ ID NO: 3984084 - RNA, 12 nt, Staphylococcus aureus subsp. aureus Mu50
uacaacuucauu

SEQ ID NO: 3984085 - RNA, 16 nt, Staphylococcus aureus subsp. aureus Mu50
uacaagucauuaucca

SEQ ID NO: 3984086 - RNA, 14 nt, Staphylococcus aureus subsp. aureus Mu50
uacaagucuuauuu

SEQ ID NO: 3984087 - RNA, 20 nt, Staphylococcus aureus subsp. aureus Mu50
uacaagucuuuacucuacac

SEQ ID NO: 3984088 - RNA, 19 nt, Staphylococcus aureus subsp. aureus Mu50
uacaaguggauauuguguc

SEQ ID NO: 3984089 - RNA, 21 nt, Staphylococcus aureus subsp. aureus Mu50
uacaaguugaucaaaaauguu

SEQ ID NO: 3984090 - RNA, 18 nt, Staphylococcus aureus subsp. aureus Mu50
uacaaguuuauaaucuuu

SEQ ID NO: 3984091 - RNA, 19 nt, Staphylococcus aureus subsp. aureus Mu50
uacaaguuuauaaucuuuu

SEQ ID NO: 3984092 - RNA, 19 nt, Staphylococcus aureus subsp. aureus Mu50
uacaauaagcgcaauuaaa

SEQ ID NO: 3984093 - RNA, 20 nt, Staphylococcus aureus subsp. aureus Mu50
uacaauaagcgcaauuaaaa

SEQ ID NO: 3984094 - RNA, 14 nt, Staphylococcus aureus subsp. aureus Mu50
uacaauaaugugca

SEQ ID NO: 3984095 - RNA, 22 nt, Staphylococcus aureus subsp. aureus Mu50
uacaauaaugugcaaguugggg

SEQ ID NO: 3984096 - RNA, 13 nt, Staphylococcus aureus subsp. aureus Mu50
uacaauaguacua

SEQ ID NO: 3984097 - RNA, 13 nt, Staphylococcus aureus subsp. aureus Mu50
uacaauauaauuu

SEQ ID NO: 3984098 - RNA, 14 nt, Staphylococcus aureus subsp. aureus Mu50
uacaauaugauuaa

SEQ ID NO: 3984099 - RNA, 16 nt, Staphylococcus aureus subsp. aureus Mu50
uacaauaugauuaaua

SEQ ID NO: 3984100 - RNA, 17 nt, Staphylococcus aureus subsp. aureus Mu50
uacaauauucaauaauu

SEQ ID NO: 3984101 - RNA, 20 nt, Staphylococcus aureus subsp. aureus Mu50
uacaauauucaauaauucau

SEQ ID NO: 3984102 - RNA, 14 nt, Staphylococcus aureus subsp. aureus Mu50
uacaaugaaaaaac

SEQ ID NO: 3984103 - RNA, 22 nt, Staphylococcus aureus subsp. aureus Mu50
uacaaugaauuguuaguuuucu

SEQ ID NO: 3984104 - RNA, 17 nt, Staphylococcus aureus subsp. aureus Mu50
uacaaugcgguauugca

SEQ ID NO: 3984105 - RNA, 13 nt, Staphylococcus aureus subsp. aureus Mu50
uacaauuaauuac

SEQ ID NO: 3984106 - RNA, 17 nt, Staphylococcus aureus subsp. aureus Mu50
uacaauuauaaaugauu

SEQ ID NO: 3984107 - RNA, 16 nt, Staphylococcus aureus subsp. aureus Mu50
uacaauuauauguagg

SEQ ID NO: 3984108 - RNA, 15 nt, Staphylococcus aureus subsp. aureus Mu50
uacaauuuccuaccc

SEQ ID NO: 3984109 - RNA, 14 nt, Staphylococcus aureus subsp. aureus Mu50
uacaauuuuuaaaa

SEQ ID NO: 3984110 - RNA, 15 nt, Staphylococcus aureus subsp. aureus Mu50
uacaauuuuuaaaaa

SEQ ID NO: 3984111 - RNA, 16 nt, Staphylococcus aureus subsp. aureus Mu50
uacaauuuuuaaaaac

SEQ ID NO: 3984112 - RNA, 15 nt, Staphylococcus aureus subsp. aureus Mu50
uacacaaauuaaaac

SEQ ID NO: 3984113 - RNA, 21 nt, Staphylococcus aureus subsp. aureus Mu50
uacacaaugcccuuaaagcac

SEQ ID NO: 3984114 - RNA, 16 nt, Staphylococcus aureus subsp. aureus Mu50
uacaccauaaauguaa

SEQ ID NO: 3984115 - RNA, 15 nt, Staphylococcus aureus subsp. aureus Mu50
uacaccuacaaauau

SEQ ID NO: 3984116 - RNA, 17 nt, Staphylococcus aureus subsp. aureus Mu50
uacaccuacaaauauuu

SEQ ID NO: 3984117 - RNA, 14 nt, Staphylococcus aureus subsp. aureus Mu50
uacaccuauaccuc

SEQ ID NO: 3984118 - RNA, 17 nt, Staphylococcus aureus subsp. aureus Mu50
uacacgacgcuaaacaa

SEQ ID NO: 3984119 - RNA, 19 nt, Staphylococcus aureus subsp. aureus Mu50
uacacgacgcuaaacaaag

SEQ ID NO: 3984120 - RNA, 20 nt, Staphylococcus aureus subsp. aureus Mu50
uacacgaguauuaucacaua

SEQ ID NO: 3984121 - RNA, 19 nt, Staphylococcus aureus subsp. aureus Mu50
uacacgcauuacuuuagaa

SEQ ID NO: 3984122 - RNA, 19 nt, Staphylococcus aureus subsp. aureus Mu50
uacacguuucguugcugau

SEQ ID NO: 3984123 - RNA, 14 nt, Staphylococcus aureus subsp. aureus Mu50
uacacuagucuuuu

SEQ ID NO: 3984124 - RNA, 14 nt, Staphylococcus aureus subsp. aureus Mu50
uacacuaucauuau

SEQ ID NO: 3984125 - RNA, 24 nt, Staphylococcus aureus subsp. aureus Mu50
uacacuaucauuaucaaauaaccu

SEQ ID NO: 3984126 - RNA, 14 nt, Staphylococcus aureus subsp. aureus Mu50
uacacuaucguuuu

SEQ ID NO: 3984127 - RNA, 17 nt, Staphylococcus aureus subsp. aureus Mu50
uacacuaucguuuuuau

SEQ ID NO: 3984128 - RNA, 15 nt, Staphylococcus aureus subsp. aureus Mu50
uacacugcacaucau

SEQ ID NO: 3984129 - RNA, 17 nt, Staphylococcus aureus subsp. aureus Mu50
uacacuguuuuauaaau

SEQ ID NO: 3984130 - RNA, 12 nt, Staphylococcus aureus subsp. aureus Mu50
uacacuuaauau

SEQ ID NO: 3984131 - RNA, 16 nt, Staphylococcus aureus subsp. aureus Mu50
uacacuuacaaauauu

SEQ ID NO: 3984132 - RNA, 13 nt, Staphylococcus aureus subsp. aureus Mu50
uacacuugauuau

SEQ ID NO: 3984133 - RNA, 16 nt, Staphylococcus aureus subsp. aureus Mu50
uacacuugauuaucau

SEQ ID NO: 3984134 - RNA, 16 nt, Staphylococcus aureus subsp. aureus Mu50
uacacuuuugauuguu

SEQ ID NO: 3984135 - RNA, 23 nt, Staphylococcus aureus subsp. aureus Mu50
uacacuuuugauuguuuaaacau

SEQ ID NO: 3984136 - RNA, 19 nt, Staphylococcus aureus subsp. aureus Mu50
uacagaaccaacaauaaau

SEQ ID NO: 3984137 - RNA, 21 nt, Staphylococcus aureus subsp. aureus Mu50
uacagaauggauaccuaaagc

SEQ ID NO: 3984138 - RNA, 21 nt, Staphylococcus aureus subsp. aureus Mu50
uacagagaaucaauuauugaa

SEQ ID NO: 3984139 - RNA, 17 nt, Staphylococcus aureus subsp. aureus Mu50
uacagauaagaauauuu

SEQ ID NO: 3984140 - RNA, 13 nt, Staphylococcus aureus subsp. aureus Mu50
uacagauaauuau

SEQ ID NO: 3984141 - RNA, 15 nt, Staphylococcus aureus subsp. aureus Mu50
uacagauaauuauuu

SEQ ID NO: 3984142 - RNA, 18 nt, Staphylococcus aureus subsp. aureus Mu50
uacagaucucaauccaau

SEQ ID NO: 3984143 - RNA, 21 nt, Staphylococcus aureus subsp. aureus Mu50
uacagaugaugcuucgcauca

SEQ ID NO: 3984144 - RNA, 17 nt, Staphylococcus aureus subsp. aureus Mu50
uacagauuuuaaaaauu

SEQ ID NO: 3984145 - RNA, 22 nt, Staphylococcus aureus subsp. aureus Mu50
uacagauuuuaaaaauucauaa

SEQ ID NO: 3984146 - RNA, 15 nt, Staphylococcus aureus subsp. aureus Mu50
uacagcacugaaauc

SEQ ID NO: 3984147 - RNA, 13 nt, Staphylococcus aureus subsp. aureus Mu50
uacagcauauaau

SEQ ID NO: 3984148 - RNA, 16 nt, Staphylococcus aureus subsp. aureus Mu50
uacagccauugacaca

SEQ ID NO: 3984149 - RNA, 22 nt, Staphylococcus aureus subsp. aureus Mu50
uacagcguauuuuaaugauuuu

SEQ ID NO: 3984150 - RNA, 18 nt, Staphylococcus aureus subsp. aureus Mu50
uacagcuagcaagaauag

SEQ ID NO: 3984151 - RNA, 22 nt, Staphylococcus aureus subsp. aureus Mu50
uacaggagcgagccauuauuau

SEQ ID NO: 3984152 - RNA, 15 nt, Staphylococcus aureus subsp. aureus Mu50
uacaggcaaugcaag

SEQ ID NO: 3984153 - RNA, 14 nt, Staphylococcus aureus subsp. aureus Mu50
uacagguaaugcaa

SEQ ID NO: 3984154 - RNA, 15 nt, Staphylococcus aureus subsp. aureus Mu50
uacagguaaugcaag

SEQ ID NO: 3984155 - RNA, 14 nt, Staphylococcus aureus subsp. aureus Mu50
uacagguugaauaa

SEQ ID NO: 3984156 - RNA, 15 nt, Staphylococcus aureus subsp. aureus Mu50
uacagguuuaauaaa

SEQ ID NO: 3984157 - RNA, 18 nt, Staphylococcus aureus subsp. aureus Mu50
uacagguuuuaaaauuaa

SEQ ID NO: 3984158 - RNA, 15 nt, Staphylococcus aureus subsp. aureus Mu50
uacaguaaauugauu

SEQ ID NO: 3984159 - RNA, 12 nt, Staphylococcus aureus subsp. aureus Mu50
uaccaccccaac

SEQ ID NO: 3984160 - RNA, 14 nt, Staphylococcus aureus subsp. aureus Mu50
uaccaccccaacuu

SEQ ID NO: 3984161 - RNA, 20 nt, Staphylococcus aureus subsp. aureus Mu50
uaccacgaacaagucuugca

SEQ ID NO: 3984162 - RNA, 16 nt, Staphylococcus aureus subsp. aureus Mu50
uaccacuugaauacuu

SEQ ID NO: 3984163 - RNA, 12 nt, Staphylococcus aureus subsp. aureus Mu50
uaccagcaugaa

SEQ ID NO: 3984164 - RNA, 19 nt, Staphylococcus aureus subsp. aureus Mu50
uaccaguaacaauaacacc

SEQ ID NO: 3984165 - RNA, 17 nt, Staphylococcus aureus subsp. aureus Mu50
uaccauaauuaaauaac

SEQ ID NO: 3984166 - RNA, 14 nt, Staphylococcus aureus subsp. aureus Mu50
uaccauauaauucu

SEQ ID NO: 3984167 - RNA, 15 nt, Staphylococcus aureus subsp. aureus Mu50
uaccauauaauucuu

SEQ ID NO: 3984168 - RNA, 22 nt, Staphylococcus aureus subsp. aureus Mu50
uaccaucuucgacuacaaguuu

SEQ ID NO: 3984169 - RNA, 15 nt, Staphylococcus aureus subsp. aureus Mu50
uaccaucuuuaauac

SEQ ID NO: 3984170 - RNA, 19 nt, Staphylococcus aureus subsp. aureus Mu50
uaccaugaugagauaaaau

SEQ ID NO: 3984171 - RNA, 22 nt, Staphylococcus aureus subsp. aureus Mu50
uaccaugaugagauaaaaucau

SEQ ID NO: 3984172 - RNA, 17 nt, Staphylococcus aureus subsp. aureus Mu50
uaccauguuuuuuaagu

SEQ ID NO: 3984173 - RNA, 16 nt, Staphylococcus aureus subsp. aureus Mu50
uaccauugugaauaau

SEQ ID NO: 3984174 - RNA, 18 nt, Staphylococcus aureus subsp. aureus Mu50
uaccauugugaauaauuu

SEQ ID NO: 3984175 - RNA, 19 nt, Staphylococcus aureus subsp. aureus Mu50
uaccauugugaauaauuuc

SEQ ID NO: 3984176 - RNA, 23 nt, Staphylococcus aureus subsp. aureus Mu50
uaccauugugaugauaauuaaug

SEQ ID NO: 3984177 - RNA, 23 nt, Staphylococcus aureus subsp. aureus Mu50
uaccauuucaaccuuuuaauagu

SEQ ID NO: 3984178 - RNA, 19 nt, Staphylococcus aureus subsp. aureus Mu50
uacccaaaaaauuguauaa

SEQ ID NO: 3984179 - RNA, 20 nt, Staphylococcus aureus subsp. aureus Mu50
uacccacaucuuuuuaaaag

SEQ ID NO: 3984180 - RNA, 14 nt, Staphylococcus aureus subsp. aureus Mu50
uacccaccacauuu

SEQ ID NO: 3984181 - RNA, 16 nt, Staphylococcus aureus subsp. aureus Mu50
uacccauaauuuaaau

SEQ ID NO: 3984182 - RNA, 22 nt, Staphylococcus aureus subsp. aureus Mu50
uaccccaagaugguauugcuuu

SEQ ID NO: 3984183 - RNA, 17 nt, Staphylococcus aureus subsp. aureus Mu50
uaccccaaguccaauuc

SEQ ID NO: 3984184 - RNA, 20 nt, Staphylococcus aureus subsp. aureus Mu50
uacccucuuuaguuaauucu

SEQ ID NO: 3984185 - RNA, 22 nt, Staphylococcus aureus subsp. aureus Mu50
uacccuugcaaauauaucaucu

SEQ ID NO: 3984186 - RNA, 20 nt, Staphylococcus aureus subsp. aureus Mu50
uaccgacaccuauacauaac

SEQ ID NO: 3984187 - RNA, 21 nt, Staphylococcus aureus subsp. aureus Mu50
uaccgauuguuaauuuaaagu

SEQ ID NO: 3984188 - RNA, 21 nt, Staphylococcus aureus subsp. aureus Mu50
uaccgcuaaaauucuuucagc

SEQ ID NO: 3984189 - RNA, 22 nt, Staphylococcus aureus subsp. aureus Mu50
uaccgguuuuucguauaauuuu

SEQ ID NO: 3984190 - RNA, 19 nt, Staphylococcus aureus subsp. aureus Mu50
uaccguauuuuaauauuga

SEQ ID NO: 3984191 - RNA, 18 nt, Staphylococcus aureus subsp. aureus Mu50
uaccgucuucucuaucag

SEQ ID NO: 3984192 - RNA, 16 nt, Staphylococcus aureus subsp. aureus Mu50
uaccuaaaauagaaaa

SEQ ID NO: 3984193 - RNA, 18 nt, Staphylococcus aureus subsp. aureus Mu50
uaccuaaagcuaauacac

SEQ ID NO: 3984194 - RNA, 19 nt, Staphylococcus aureus subsp. aureus Mu50
uaccuaaagcuaauacacc

SEQ ID NO: 3984195 - RNA, 17 nt, Staphylococcus aureus subsp. aureus Mu50
uaccuaaccauaacaau

SEQ ID NO: 3984196 - RNA, 19 nt, Staphylococcus aureus subsp. aureus Mu50
uaccuaagcugauuaaaau

SEQ ID NO: 3984197 - RNA, 15 nt, Staphylococcus aureus subsp. aureus Mu50
uaccuaauaggauca

SEQ ID NO: 3984198 - RNA, 14 nt, Staphylococcus aureus subsp. aureus Mu50
uaccuacaaauaug

SEQ ID NO: 3984199 - RNA, 15 nt, Staphylococcus aureus subsp. aureus Mu50
uaccuacagaaugga

SEQ ID NO: 3984200 - RNA, 14 nt, Staphylococcus aureus subsp. aureus Mu50
uaccuauaaacaua

SEQ ID NO: 3984201 - RNA, 16 nt, Staphylococcus aureus subsp. aureus Mu50
uaccuauuaauaucau

SEQ ID NO: 3984202 - RNA, 17 nt, Staphylococcus aureus subsp. aureus Mu50
uaccucgaaauuacugu

SEQ ID NO: 3984203 - RNA, 16 nt, Staphylococcus aureus subsp. aureus Mu50
uaccucuacauuauau

SEQ ID NO: 3984204 - RNA, 13 nt, Staphylococcus aureus subsp. aureus Mu50
uaccucuugauaa

SEQ ID NO: 3984205 - RNA, 16 nt, Staphylococcus aureus subsp. aureus Mu50
uaccucuugauaaaau

SEQ ID NO: 3984206 - RNA, 20 nt, Staphylococcus aureus subsp. aureus Mu50
uaccuggguuaccaaguaau

SEQ ID NO: 3984207 - RNA, 15 nt, Staphylococcus aureus subsp. aureus Mu50
uaccuuccauuucga

SEQ ID NO: 3984208 - RNA, 22 nt, Staphylococcus aureus subsp. aureus Mu50
uaccuucuucuacccauaauuu

SEQ ID NO: 3984209 - RNA, 15 nt, Staphylococcus aureus subsp. aureus Mu50
uaccuuuacuuucau

SEQ ID NO: 3984210 - RNA, 18 nt, Staphylococcus aureus subsp. aureus Mu50
uaccuuucaaauauaucu

SEQ ID NO: 3984211 - RNA, 19 nt, Staphylococcus aureus subsp. aureus Mu50
uaccuuucaaauauaucua

SEQ ID NO: 3984212 - RNA, 12 nt, Staphylococcus aureus subsp. aureus Mu50
uaccuuuccauu

SEQ ID NO: 3984213 - RNA, 16 nt, Staphylococcus aureus subsp. aureus Mu50
uaccuuugucuuuuuu

SEQ ID NO: 3984214 - RNA, 20 nt, Staphylococcus aureus subsp. aureus Mu50
uaccuuuuucuaaaccaaca

SEQ ID NO: 3984215 - RNA, 14 nt, Staphylococcus aureus subsp. aureus Mu50
uaccuuuuucuacc

SEQ ID NO: 3984216 - RNA, 22 nt, Staphylococcus aureus subsp. aureus Mu50
uacgaaaucaaaaauaauuaug

SEQ ID NO: 3984217 - RNA, 18 nt, Staphylococcus aureus subsp. aureus Mu50
uacgaacaacuaacacgu

SEQ ID NO: 3984218 - RNA, 19 nt, Staphylococcus aureus subsp. aureus Mu50
uacgaacaucuaauacauu

SEQ ID NO: 3984219 - RNA, 23 nt, Staphylococcus aureus subsp. aureus Mu50
uacgaaguuuaaaugugcaauua

SEQ ID NO: 3984220 - RNA, 18 nt, Staphylococcus aureus subsp. aureus Mu50
uacgacgucgcaacagga

SEQ ID NO: 3984221 - RNA, 20 nt, Staphylococcus aureus subsp. aureus Mu50
uacgauaacuacacuuaaua

SEQ ID NO: 3984222 - RNA, 14 nt, Staphylococcus aureus subsp. aureus Mu50
uacgauacaucauu

SEQ ID NO: 3984223 - RNA, 16 nt, Staphylococcus aureus subsp. aureus Mu50
uacgauauagugcuug

SEQ ID NO: 3984224 - RNA, 13 nt, Staphylococcus aureus subsp. aureus Mu50
uacgaucauaaau

SEQ ID NO: 3984225 - RNA, 17 nt, Staphylococcus aureus subsp. aureus Mu50
uacgauuauuuggauaa

SEQ ID NO: 3984226 - RNA, 12 nt, Staphylococcus aureus subsp. aureus Mu50
uacgauuuucaa

SEQ ID NO: 3984227 - RNA, 21 nt, Staphylococcus aureus subsp. aureus Mu50
uacgcauuuuaaauaaaaugc

SEQ ID NO: 3984228 - RNA, 15 nt, Staphylococcus aureus subsp. aureus Mu50
uacgcccaucaucac

SEQ ID NO: 3984229 - RNA, 14 nt, Staphylococcus aureus subsp. aureus Mu50
uacgccuaaauauu

SEQ ID NO: 3984230 - RNA, 19 nt, Staphylococcus aureus subsp. aureus Mu50
uacgcgauugacguggucu

SEQ ID NO: 3984231 - RNA, 21 nt, Staphylococcus aureus subsp. aureus Mu50
uacgcuaaacaaugaugggaa

SEQ ID NO: 3984232 - RNA, 15 nt, Staphylococcus aureus subsp. aureus Mu50
uacgcucauaugucu

SEQ ID NO: 3984233 - RNA, 15 nt, Staphylococcus aureus subsp. aureus Mu50
uacgcuuuuuaaaaa

SEQ ID NO: 3984234 - RNA, 16 nt, Staphylococcus aureus subsp. aureus Mu50
uacgguagucucccau

SEQ ID NO: 3984235 - RNA, 15 nt, Staphylococcus aureus subsp. aureus Mu50
uacgguuauggugug

SEQ ID NO: 3984236 - RNA, 15 nt, Staphylococcus aureus subsp. aureus Mu50
uacguaucaagaaaa

SEQ ID NO: 3984237 - RNA, 21 nt, Staphylococcus aureus subsp. aureus Mu50
uacguaucaagaaaaaguuuu

SEQ ID NO: 3984238 - RNA, 22 nt, Staphylococcus aureus subsp. aureus Mu50
uacguccaaaaugaacaauacc

SEQ ID NO: 3984239 - RNA, 16 nt, Staphylococcus aureus subsp. aureus Mu50
uacguguguuuucuuu

SEQ ID NO: 3984240 - RNA, 23 nt, Staphylococcus aureus subsp. aureus Mu50
uacguuacuaaacuuuucuucaa

SEQ ID NO: 3984241 - RNA, 16 nt, Staphylococcus aureus subsp. aureus Mu50
uacguuauuucaauaa

SEQ ID NO: 3984242 - RNA, 18 nt, Staphylococcus aureus subsp. aureus Mu50
uacguuauuucaauaaua

SEQ ID NO: 3984243 - RNA, 14 nt, Staphylococcus aureus subsp. aureus Mu50
uacguuuaauaaug

SEQ ID NO: 3984244 - RNA, 17 nt, Staphylococcus aureus subsp. aureus Mu50
uacguuuaauaaugguu

SEQ ID NO: 3984245 - RNA, 14 nt, Staphylococcus aureus subsp. aureus Mu50
uacguuuuaaauaa

SEQ ID NO: 3984246 - RNA, 14 nt, Staphylococcus aureus subsp. aureus Mu50
uacuucauaaguca

SEQ ID NO: 3984247 - RNA, 16 nt, Staphylococcus aureus subsp. aureus Mu50
uacuuccaauacuguu

SEQ ID NO: 3984248 - RNA, 14 nt, Staphylococcus aureus subsp. aureus Mu50
uacuuccauugcuu

SEQ ID NO: 3984249 - RNA, 19 nt, Staphylococcus aureus subsp. aureus Mu50
uacuucuaauuugcaaaau

SEQ ID NO: 3984250 - RNA, 20 nt, Staphylococcus aureus subsp. aureus Mu50
uacuucuauuuuauaauaaa

SEQ ID NO: 3984251 - RNA, 12 nt, Staphylococcus aureus subsp. aureus Mu50
uacuucuucuuc

SEQ ID NO: 3984252 - RNA, 20 nt, Staphylococcus aureus subsp. aureus Mu50
uacuugauuagauuugugug

SEQ ID NO: 3984253 - RNA, 17 nt, Staphylococcus aureus subsp. aureus Mu50
uacuugccuucaaauuc

SEQ ID NO: 3984254 - RNA, 21 nt, Staphylococcus aureus subsp. aureus Mu50
uacuugcuuuuucaaauaaua

SEQ ID NO: 3984255 - RNA, 17 nt, Staphylococcus aureus subsp. aureus Mu50
uacuuguaauuaauaca

SEQ ID NO: 3984256 - RNA, 18 nt, Staphylococcus aureus subsp. aureus Mu50
uacuuguaauuaauacau

SEQ ID NO: 3984257 - RNA, 19 nt, Staphylococcus aureus subsp. aureus Mu50
uacuuguaauuaauacauc

SEQ ID NO: 3984258 - RNA, 16 nt, Staphylococcus aureus subsp. aureus Mu50
uacuugucguauucuu

SEQ ID NO: 3984259 - RNA, 20 nt, Staphylococcus aureus subsp. aureus Mu50
uacuuuaaaauuguauagaa

SEQ ID NO: 3984260 - RNA, 19 nt, Staphylococcus aureus subsp. aureus Mu50
uacuuuaacaguuguaauc

SEQ ID NO: 3984261 - RNA, 17 nt, Staphylococcus aureus subsp. aureus Mu50
uacuuuaauuuagugaa

SEQ ID NO: 3984262 - RNA, 23 nt, Staphylococcus aureus subsp. aureus Mu50
uacuuuagaaagugauucccaaa

SEQ ID NO: 3984263 - RNA, 19 nt, Staphylococcus aureus subsp. aureus Mu50
uacuuuauuugauaauauu

SEQ ID NO: 3984264 - RNA, 19 nt, Staphylococcus aureus subsp. aureus Mu50
uacuuucaaauaaugugaa

SEQ ID NO: 3984265 - RNA, 16 nt, Staphylococcus aureus subsp. aureus Mu50
uacuuucaccauuuac

SEQ ID NO: 3984266 - RNA, 17 nt, Staphylococcus aureus subsp. aureus Mu50
uacuuucacuuuuuaua

SEQ ID NO: 3984267 - RNA, 18 nt, Staphylococcus aureus subsp. aureus Mu50
uacuuucacuuuuuauau

SEQ ID NO: 3984268 - RNA, 18 nt, Staphylococcus aureus subsp. aureus Mu50
uacuuucgaguaauacuu

SEQ ID NO: 3984269 - RNA, 15 nt, Staphylococcus aureus subsp. aureus Mu50
uacuuucuaagauac

SEQ ID NO: 3984270 - RNA, 22 nt, Staphylococcus aureus subsp. aureus Mu50
uacuuuggaaauuuauuauaaa

SEQ ID NO: 3984271 - RNA, 15 nt, Staphylococcus aureus subsp. aureus Mu50
uacuuuggacuuuaa

SEQ ID NO: 3984272 - RNA, 18 nt, Staphylococcus aureus subsp. aureus Mu50
uacuuuggacuuuaaagu

SEQ ID NO: 3984273 - RNA, 19 nt, Staphylococcus aureus subsp. aureus Mu50
uacuuuggacuuuaaaguu

SEQ ID NO: 3984274 - RNA, 18 nt, Staphylococcus aureus subsp. aureus Mu50
uacuuuguucugcuuuuu

SEQ ID NO: 3984275 - RNA, 16 nt, Staphylococcus aureus subsp. aureus Mu50
uacuuuuauaaucuuu

SEQ ID NO: 3984276 - RNA, 19 nt, Staphylococcus aureus subsp. aureus Mu50
uacuuuucucgauuaauuu

SEQ ID NO: 3984277 - RNA, 18 nt, Staphylococcus aureus subsp. aureus Mu50
uacuuuucugucuguaaa

SEQ ID NO: 3984278 - RNA, 14 nt, Staphylococcus aureus subsp. aureus Mu50
uacuuuuucagaau

SEQ ID NO: 3984279 - RNA, 17 nt, Staphylococcus aureus subsp. aureus Mu50
uacuuuuuugagcauuu

SEQ ID NO: 3984280 - RNA, 14 nt, Staphylococcus aureus subsp. aureus Mu50
uagaaaaaguauua

SEQ ID NO: 3984281 - RNA, 19 nt, Staphylococcus aureus subsp. aureus Mu50
uagaaaaauuucaaaaaua

SEQ ID NO: 3984282 - RNA, 14 nt, Staphylococcus aureus subsp. aureus Mu50
uagaaaacaucuua

SEQ ID NO: 3984283 - RNA, 11 nt, Staphylococcus aureus subsp. aureus Mu50
uagaaaacuag

SEQ ID NO: 3984284 - RNA, 18 nt, Staphylococcus aureus subsp. aureus Mu50
uagaaaaggcucauuugu

SEQ ID NO: 3984285 - RNA, 19 nt, Staphylococcus aureus subsp. aureus Mu50
uagaaaagggacagaaaag

SEQ ID NO: 3984286 - RNA, 21 nt, Staphylococcus aureus subsp. aureus Mu50
uagaaaauaugacgaucuuca

SEQ ID NO: 3984287 - RNA, 18 nt, Staphylococcus aureus subsp. aureus Mu50
uagaaaaugaguacaaca

SEQ ID NO: 3984288 - RNA, 13 nt, Staphylococcus aureus subsp. aureus Mu50
uagaaacacuuuu

SEQ ID NO: 3984289 - RNA, 15 nt, Staphylococcus aureus subsp. aureus Mu50
uagaaacacuuuuag

SEQ ID NO: 3984290 - RNA, 22 nt, Staphylococcus aureus subsp. aureus Mu50
uagaaacuuccaacauauaaaa

SEQ ID NO: 3984291 - RNA, 15 nt, Staphylococcus aureus subsp. aureus Mu50
uagaaagaaauuguu

SEQ ID NO: 3984292 - RNA, 16 nt, Staphylococcus aureus subsp. aureus Mu50
uagaaagcgcauuugu

SEQ ID NO: 3984293 - RNA, 15 nt, Staphylococcus aureus subsp. aureus Mu50
uagaaaguugugguc

SEQ ID NO: 3984294 - RNA, 13 nt, Staphylococcus aureus subsp. aureus Mu50
uagaaauagauuu

SEQ ID NO: 3984295 - RNA, 16 nt, Staphylococcus aureus subsp. aureus Mu50
uagaacaagaauuaug

SEQ ID NO: 3984296 - RNA, 18 nt, Staphylococcus aureus subsp. aureus Mu50
uagaacuaagaugugcau

SEQ ID NO: 3984297 - RNA, 21 nt, Staphylococcus aureus subsp. aureus Mu50
uagaagaugauuauucucuuu

SEQ ID NO: 3984298 - RNA, 15 nt, Staphylococcus aureus subsp. aureus Mu50
uagaaguuuuuugau

SEQ ID NO: 3984299 - RNA, 18 nt, Staphylococcus aureus subsp. aureus Mu50
uagaauacuaaaaguguu

SEQ ID NO: 3984300 - RNA, 17 nt, Staphylococcus aureus subsp. aureus Mu50
uagaauaguuaccaaaa

SEQ ID NO: 3984301 - RNA, 19 nt, Staphylococcus aureus subsp. aureus Mu50
uagaauaguuaccaaaauu

SEQ ID NO: 3984302 - RNA, 20 nt, Staphylococcus aureus subsp. aureus Mu50
uagaauauauguauaacauu

SEQ ID NO: 3984303 - RNA, 20 nt, Staphylococcus aureus subsp. aureus Mu50
uagaaucaaccguuuuauug

SEQ ID NO: 3984304 - RNA, 19 nt, Staphylococcus aureus subsp. aureus Mu50
uagaaucuacgauuuucaa

SEQ ID NO: 3984305 - RNA, 15 nt, Staphylococcus aureus subsp. aureus Mu50
uagaaugaauaauuc

SEQ ID NO: 3984306 - RNA, 23 nt, Staphylococcus aureus subsp. aureus Mu50
uagaaugaugaguauacuuacug

SEQ ID NO: 3984307 - RNA, 13 nt, Staphylococcus aureus subsp. aureus Mu50
uagaauucauuaa

SEQ ID NO: 3984308 - RNA, 16 nt, Staphylococcus aureus subsp. aureus Mu50
uagaauucuaaaagaa

SEQ ID NO: 3984309 - RNA, 17 nt, Staphylococcus aureus subsp. aureus Mu50
uagaauucuaaaagaau

SEQ ID NO: 3984310 - RNA, 18 nt, Staphylococcus aureus subsp. aureus Mu50
uagaauucuaaaagaauu

SEQ ID NO: 3984311 - RNA, 19 nt, Staphylococcus aureus subsp. aureus Mu50
uagaauucuaaaagaauua

SEQ ID NO: 3984312 - RNA, 16 nt, Staphylococcus aureus subsp. aureus Mu50
uagaauuucuuuucga

SEQ ID NO: 3984313 - RNA, 21 nt, Staphylococcus aureus subsp. aureus Mu50
uagacaauauuuuuacauauu

SEQ ID NO: 3984314 - RNA, 18 nt, Staphylococcus aureus subsp. aureus Mu50
uagacaguaguuaauuga

SEQ ID NO: 3984315 - RNA, 14 nt, Staphylococcus aureus subsp. aureus Mu50
uagacauaaaaaaa

SEQ ID NO: 3984316 - RNA, 14 nt, Staphylococcus aureus subsp. aureus Mu50
uagacauuaaaaaa

SEQ ID NO: 3984317 - RNA, 19 nt, Staphylococcus aureus subsp. aureus Mu50
uagacauugaauaaaugaa

SEQ ID NO: 3984318 - RNA, 18 nt, Staphylococcus aureus subsp. aureus Mu50
uagacauuguaaaaugcu

SEQ ID NO: 3984319 - RNA, 20 nt, Staphylococcus aureus subsp. aureus Mu50
uagacguaaguguaaaugaa

SEQ ID NO: 3984320 - RNA, 22 nt, Staphylococcus aureus subsp. aureus Mu50
uagacugccaauaaaaugcaau

SEQ ID NO: 3984321 - RNA, 20 nt, Staphylococcus aureus subsp. aureus Mu50
uagacuuauuugaaugcaaa

SEQ ID NO: 3984322 - RNA, 13 nt, Staphylococcus aureus subsp. aureus Mu50
uagagaacagcag

SEQ ID NO: 3984323 - RNA, 21 nt, Staphylococcus aureus subsp. aureus Mu50
uagagaagggaguaccaagaa

SEQ ID NO: 3984324 - RNA, 16 nt, Staphylococcus aureus subsp. aureus Mu50
uagagacuuauuuuau

SEQ ID NO: 3984325 - RNA, 18 nt, Staphylococcus aureus subsp. aureus Mu50
uagagauuguaagaauua

SEQ ID NO: 3984326 - RNA, 14 nt, Staphylococcus aureus subsp. aureus Mu50
uagagguaaaucua

SEQ ID NO: 3984327 - RNA, 23 nt, Staphylococcus aureus subsp. aureus Mu50
uagauaaaauaauuguucuucag

SEQ ID NO: 3984328 - RNA, 16 nt, Staphylococcus aureus subsp. aureus Mu50
uagauaaauuaauaug

SEQ ID NO: 3984329 - RNA, 23 nt, Staphylococcus aureus subsp. aureus Mu50
uagauaaucucauucuuuaauau

SEQ ID NO: 3984330 - RNA, 22 nt, Staphylococcus aureus subsp. aureus Mu50
uagauacucacugcacuuauga

SEQ ID NO: 3984331 - RNA, 17 nt, Staphylococcus aureus subsp. aureus Mu50
uagauagaaauugugcu

SEQ ID NO: 3984332 - RNA, 19 nt, Staphylococcus aureus subsp. aureus Mu50
uagauagaaauugugcuuu

SEQ ID NO: 3984333 - RNA, 15 nt, Staphylococcus aureus subsp. aureus Mu50
uagcgucaaguuuuc

SEQ ID NO: 3984334 - RNA, 16 nt, Staphylococcus aureus subsp. aureus Mu50
uagcgugauuuuucau

SEQ ID NO: 3984335 - RNA, 22 nt, Staphylococcus aureus subsp. aureus Mu50
uagcguucaauagcauaugaua

SEQ ID NO: 3984336 - RNA, 21 nt, Staphylococcus aureus subsp. aureus Mu50
uagcuaaagcuugcuguucaa

SEQ ID NO: 3984337 - RNA, 17 nt, Staphylococcus aureus subsp. aureus Mu50
uagcuaagauacuuuua

SEQ ID NO: 3984338 - RNA, 12 nt, Staphylococcus aureus subsp. aureus Mu50
uagcuaaugcaa

SEQ ID NO: 3984339 - RNA, 18 nt, Staphylococcus aureus subsp. aureus Mu50
uagcuaaugcauuauuau

SEQ ID NO: 3984340 - RNA, 22 nt, Staphylococcus aureus subsp. aureus Mu50
uagcuaaugcauuauuauaaua

SEQ ID NO: 3984341 - RNA, 17 nt, Staphylococcus aureus subsp. aureus Mu50
uagcuacaauuaaagug

SEQ ID NO: 3984342 - RNA, 21 nt, Staphylococcus aureus subsp. aureus Mu50
uagcuacaauuaaagugaaua

SEQ ID NO: 3984343 - RNA, 15 nt, Staphylococcus aureus subsp. aureus Mu50
uagcuauuaaaauag

SEQ ID NO: 3984344 - RNA, 17 nt, Staphylococcus aureus subsp. aureus Mu50
uagcucaaaacaauuua

SEQ ID NO: 3984345 - RNA, 20 nt, Staphylococcus aureus subsp. aureus Mu50
uagcucaaaacaauuuaaaa

SEQ ID NO: 3984346 - RNA, 16 nt, Staphylococcus aureus subsp. aureus Mu50
uagcucaauugaaucu

SEQ ID NO: 3984347 - RNA, 14 nt, Staphylococcus aureus subsp. aureus Mu50
uagcucuucuuuuu

SEQ ID NO: 3984348 - RNA, 21 nt, Staphylococcus aureus subsp. aureus Mu50
uagcugcaaucguugaaaaau

SEQ ID NO: 3984349 - RNA, 16 nt, Staphylococcus aureus subsp. aureus Mu50
uagcuguuugauauug

SEQ ID NO: 3984350 - RNA, 22 nt, Staphylococcus aureus subsp. aureus Mu50
uagcuuaauaauuaauaagcau

SEQ ID NO: 3984351 - RNA, 21 nt, Staphylococcus aureus subsp. aureus Mu50
uagcuuagucaauguauauuu

SEQ ID NO: 3984352 - RNA, 18 nt, Staphylococcus aureus subsp. aureus Mu50
uagcuucgucacguaaaa

SEQ ID NO: 3984353 - RNA, 19 nt, Staphylococcus aureus subsp. aureus Mu50
uagcuucuuaaaucaacau

SEQ ID NO: 3984354 - RNA, 21 nt, Staphylococcus aureus subsp. aureus Mu50
uagcuucuuaaaucaacauca

SEQ ID NO: 3984355 - RNA, 18 nt, Staphylococcus aureus subsp. aureus Mu50
uagcuugaauaauauauu

SEQ ID NO: 3984356 - RNA, 16 nt, Staphylococcus aureus subsp. aureus Mu50
uagcuuucguuucuuu

SEQ ID NO: 3984357 - RNA, 15 nt, Staphylococcus aureus subsp. aureus Mu50
uagcuuuuaugucua

SEQ ID NO: 3984358 - RNA, 23 nt, Staphylococcus aureus subsp. aureus Mu50
uaggaauuguuaauuucaacauu

SEQ ID NO: 3984359 - RNA, 12 nt, Staphylococcus aureus subsp. aureus Mu50
uaggacauauaa

SEQ ID NO: 3984360 - RNA, 13 nt, Staphylococcus aureus subsp. aureus Mu50
uaggacauauaaa

SEQ ID NO: 3984361 - RNA, 16 nt, Staphylococcus aureus subsp. aureus Mu50
uaggaccuacaauuuu

SEQ ID NO: 3984362 - RNA, 16 nt, Staphylococcus aureus subsp. aureus Mu50
uaggaccucuuauuua

SEQ ID NO: 3984363 - RNA, 20 nt, Staphylococcus aureus subsp. aureus Mu50
uaggagagauguauaaaacu

SEQ ID NO: 3984364 - RNA, 22 nt, Staphylococcus aureus subsp. aureus Mu50
uaggagagcuagaaauccucuu

SEQ ID NO: 3984365 - RNA, 19 nt, Staphylococcus aureus subsp. aureus Mu50
uaggauauuuuuuaauaau

SEQ ID NO: 3984366 - RNA, 16 nt, Staphylococcus aureus subsp. aureus Mu50
uaggaucuuuuccauu

SEQ ID NO: 3984367 - RNA, 16 nt, Staphylococcus aureus subsp. aureus Mu50
uaggauguucaucaac

SEQ ID NO: 3984368 - RNA, 17 nt, Staphylococcus aureus subsp. aureus Mu50
uaggauguucaucaaca

SEQ ID NO: 3984369 - RNA, 12 nt, Staphylococcus aureus subsp. aureus Mu50
uaggauuuacac

SEQ ID NO: 3984370 - RNA, 18 nt, Staphylococcus aureus subsp. aureus Mu50
uaggauuuccggaacaau

SEQ ID NO: 3984371 - RNA, 17 nt, Staphylococcus aureus subsp. aureus Mu50
uaggauuugcaccuaua

SEQ ID NO: 3984372 - RNA, 18 nt, Staphylococcus aureus subsp. aureus Mu50
uaggauuugcaccuauac

SEQ ID NO: 3984373 - RNA, 15 nt, Staphylococcus aureus subsp. aureus Mu50
uaggcaggaaugaua

SEQ ID NO: 3984374 - RNA, 17 nt, Staphylococcus aureus subsp. aureus Mu50
uaggcaggaaugauaua

SEQ ID NO: 3984375 - RNA, 20 nt, Staphylococcus aureus subsp. aureus Mu50
uaggcgccauaaucauuagu

SEQ ID NO: 3984376 - RNA, 21 nt, Staphylococcus aureus subsp. aureus Mu50
uaggcucuuaauguacuuuuc

SEQ ID NO: 3984377 - RNA, 17 nt, Staphylococcus aureus subsp. aureus Mu50
uaggggcuuuuaugcau

SEQ ID NO: 3984378 - RNA, 19 nt, Staphylococcus aureus subsp. aureus Mu50
uaggggcuuuuaugcaugc

SEQ ID NO: 3984379 - RNA, 17 nt, Staphylococcus aureus subsp. aureus Mu50
uaggguauugaaauaau

SEQ ID NO: 3984380 - RNA, 16 nt, Staphylococcus aureus subsp. aureus Mu50
uagguacaacuaaaua

SEQ ID NO: 3984381 - RNA, 15 nt, Staphylococcus aureus subsp. aureus Mu50
uagguauaaucauuu

SEQ ID NO: 3984382 - RNA, 19 nt, Staphylococcus aureus subsp. aureus Mu50
uagguauaguguuugacaa

SEQ ID NO: 3984383 - RNA, 12 nt, Staphylococcus aureus subsp. aureus Mu50
uagguuagaauu

SEQ ID NO: 3984384 - RNA, 16 nt, Staphylococcus aureus subsp. aureus Mu50
uagguuuaauuuuaaa

SEQ ID NO: 3984385 - RNA, 17 nt, Staphylococcus aureus subsp. aureus Mu50
uagguuuaauuuuaaau

SEQ ID NO: 3984386 - RNA, 23 nt, Staphylococcus aureus subsp. aureus Mu50
uaguaaaauaaauacaauagaaa

SEQ ID NO: 3984387 - RNA, 20 nt, Staphylococcus aureus subsp. aureus Mu50
uaguaaagugaaauaaagcg

SEQ ID NO: 3984388 - RNA, 14 nt, Staphylococcus aureus subsp. aureus Mu50
uaguaaauauaguu

SEQ ID NO: 3984389 - RNA, 19 nt, Staphylococcus aureus subsp. aureus Mu50
uaguaaauauaguuaaagu

SEQ ID NO: 3984390 - RNA, 19 nt, Staphylococcus aureus subsp. aureus Mu50
uaguaauaacaucuaaauu

SEQ ID NO: 3984391 - RNA, 18 nt, Staphylococcus aureus subsp. aureus Mu50
uaguaauagcuauauuuu

SEQ ID NO: 3984392 - RNA, 14 nt, Staphylococcus aureus subsp. aureus Mu50
uaguaaugauguga

SEQ ID NO: 3984393 - RNA, 22 nt, Staphylococcus aureus subsp. aureus Mu50
uaguaaugaugugaauuggauu

SEQ ID NO: 3984394 - RNA, 19 nt, Staphylococcus aureus subsp. aureus Mu50
uaguacaccucuaaguuca

SEQ ID NO: 3984395 - RNA, 14 nt, Staphylococcus aureus subsp. aureus Mu50
uaguacacguguau

SEQ ID NO: 3984396 - RNA, 16 nt, Staphylococcus aureus subsp. aureus Mu50
uaguacagucaucuug

SEQ ID NO: 3984397 - RNA, 15 nt, Staphylococcus aureus subsp. aureus Mu50
uaguacauuuauuuu

SEQ ID NO: 3984398 - RNA, 19 nt, Staphylococcus aureus subsp. aureus Mu50
uaguaccaagcuucauuag

SEQ ID NO: 3984399 - RNA, 20 nt, Staphylococcus aureus subsp. aureus Mu50
uaguacggcugcuuuaacug

SEQ ID NO: 3984400 - RNA, 22 nt, Staphylococcus aureus subsp. aureus Mu50
uaguacggcugcuuuaacugua

SEQ ID NO: 3984401 - RNA, 23 nt, Staphylococcus aureus subsp. aureus Mu50
uaguacuaaaccgauuaauauaa

SEQ ID NO: 3984402 - RNA, 15 nt, Staphylococcus aureus subsp. aureus Mu50
uaguacuugaaacau

SEQ ID NO: 3984403 - RNA, 22 nt, Staphylococcus aureus subsp. aureus Mu50
uaguacuuugauaucuacagag

SEQ ID NO: 3984404 - RNA, 22 nt, Staphylococcus aureus subsp. aureus Mu50
uaguagacgguaucaucugcau

SEQ ID NO: 3984405 - RNA, 15 nt, Staphylococcus aureus subsp. aureus Mu50
uaguagcuugaauag

SEQ ID NO: 3984406 - RNA, 16 nt, Staphylococcus aureus subsp. aureus Mu50
uaguaguacacgaauu

SEQ ID NO: 3984407 - RNA, 19 nt, Staphylococcus aureus subsp. aureus Mu50
uaguaguuuauaucaaaaa

SEQ ID NO: 3984408 - RNA, 15 nt, Staphylococcus aureus subsp. aureus Mu50
uaguauaaauaucau

SEQ ID NO: 3984409 - RNA, 20 nt, Staphylococcus aureus subsp. aureus Mu50
uaguauaaauaucauaaaug

SEQ ID NO: 3984410 - RNA, 13 nt, Staphylococcus aureus subsp. aureus Mu50
uaguauauucaac

SEQ ID NO: 3984411 - RNA, 14 nt, Staphylococcus aureus subsp. aureus Mu50
uaguauggaauaaa

SEQ ID NO: 3984412 - RNA, 15 nt, Staphylococcus aureus subsp. aureus Mu50
uaguauuauagccua

SEQ ID NO: 3984413 - RNA, 18 nt, Staphylococcus aureus subsp. aureus Mu50
uaguauucaaaaaauauu

SEQ ID NO: 3984414 - RNA, 18 nt, Staphylococcus aureus subsp. aureus Mu50
uaguauugguaccuuucc

SEQ ID NO: 3984415 - RNA, 17 nt, Staphylococcus aureus subsp. aureus Mu50
uagucaauuaaugauaa

SEQ ID NO: 3984416 - RNA, 18 nt, Staphylococcus aureus subsp. aureus Mu50
uagucaggggccccaaca

SEQ ID NO: 3984417 - RNA, 14 nt, Staphylococcus aureus subsp. aureus Mu50
uagucauaauuuaa

SEQ ID NO: 3984418 - RNA, 16 nt, Staphylococcus aureus subsp. aureus Mu50
uagucauaauuuaaaa

SEQ ID NO: 3984419 - RNA, 17 nt, Staphylococcus aureus subsp. aureus Mu50
uagucauaauuuaaaag

SEQ ID NO: 3984420 - RNA, 13 nt, Staphylococcus aureus subsp. aureus Mu50
uauaaacauuuau

SEQ ID NO: 3984421 - RNA, 17 nt, Staphylococcus aureus subsp. aureus Mu50
uauaaacgucacuuuau

SEQ ID NO: 3984422 - RNA, 21 nt, Staphylococcus aureus subsp. aureus Mu50
uauaaacgucacuuuauuaaa

SEQ ID NO: 3984423 - RNA, 22 nt, Staphylococcus aureus subsp. aureus Mu50
uauaaacgucacuuuauuaaau

SEQ ID NO: 3984424 - RNA, 20 nt, Staphylococcus aureus subsp. aureus Mu50
uauaaacguccaaacacaaa

SEQ ID NO: 3984425 - RNA, 14 nt, Staphylococcus aureus subsp. aureus Mu50
uauaaagaaauaau

SEQ ID NO: 3984426 - RNA, 20 nt, Staphylococcus aureus subsp. aureus Mu50
uauaaagaaugauuuauaaa

SEQ ID NO: 3984427 - RNA, 23 nt, Staphylococcus aureus subsp. aureus Mu50
uauaaagaaugauuuauaaaaaa

SEQ ID NO: 3984428 - RNA, 18 nt, Staphylococcus aureus subsp. aureus Mu50
uauaaagacgauuuauua

SEQ ID NO: 3984429 - RNA, 18 nt, Staphylococcus aureus subsp. aureus Mu50
uauaaaggaauagcuaca

SEQ ID NO: 3984430 - RNA, 20 nt, Staphylococcus aureus subsp. aureus Mu50
uauaaaguugacaauacaaa

SEQ ID NO: 3984431 - RNA, 18 nt, Staphylococcus aureus subsp. aureus Mu50
uauaaauaaaaauacaua

SEQ ID NO: 3984432 - RNA, 20 nt, Staphylococcus aureus subsp. aureus Mu50
uauaaauaaaaauacauaau

SEQ ID NO: 3984433 - RNA, 20 nt, Staphylococcus aureus subsp. aureus Mu50
uauaaauaaccgcacuuucu

SEQ ID NO: 3984434 - RNA, 14 nt, Staphylococcus aureus subsp. aureus Mu50
uauaaauaauaaau

SEQ ID NO: 3984435 - RNA, 21 nt, Staphylococcus aureus subsp. aureus Mu50
uauaaauaauaaaugcuauau

SEQ ID NO: 3984436 - RNA, 15 nt, Staphylococcus aureus subsp. aureus Mu50
uauaaauaugguuuc

SEQ ID NO: 3984437 - RNA, 21 nt, Staphylococcus aureus subsp. aureus Mu50
uauaaauaugguuucuuauua

SEQ ID NO: 3984438 - RNA, 22 nt, Staphylococcus aureus subsp. aureus Mu50
uauaaaucauucuuuauagaaa

SEQ ID NO: 3984439 - RNA, 21 nt, Staphylococcus aureus subsp. aureus Mu50
uauaaaugaaucgcuuugauu

SEQ ID NO: 3984440 - RNA, 15 nt, Staphylococcus aureus subsp. aureus Mu50
uauaaaugucauagu

SEQ ID NO: 3984441 - RNA, 16 nt, Staphylococcus aureus subsp. aureus Mu50
uauaaauguuauugcu

SEQ ID NO: 3984442 - RNA, 19 nt, Staphylococcus aureus subsp. aureus Mu50
uauaaauguuuauaucuuu

SEQ ID NO: 3984443 - RNA, 16 nt, Staphylococcus aureus subsp. aureus Mu50
uauaaauuauauuuau

SEQ ID NO: 3984444 - RNA, 15 nt, Staphylococcus aureus subsp. aureus Mu50
uauaaauuaucagaa

SEQ ID NO: 3984445 - RNA, 16 nt, Staphylococcus aureus subsp. aureus Mu50
uauaaauuucuucaua

SEQ ID NO: 3984446 - RNA, 19 nt, Staphylococcus aureus subsp. aureus Mu50
uauaaauuuguaccaaaua

SEQ ID NO: 3984447 - RNA, 20 nt, Staphylococcus aureus subsp. aureus Mu50
uauaaauuuguaccaaauaa

SEQ ID NO: 3984448 - RNA, 20 nt, Staphylococcus aureus subsp. aureus Mu50
uauaacaaaaauugcuauau

SEQ ID NO: 3984449 - RNA, 20 nt, Staphylococcus aureus subsp. aureus Mu50
uauaacaacuacuuaaauua

SEQ ID NO: 3984450 - RNA, 20 nt, Staphylococcus aureus subsp. aureus Mu50
uauaacacuucguauugaau

SEQ ID NO: 3984451 - RNA, 12 nt, Staphylococcus aureus subsp. aureus Mu50
uauaacauuaaa

SEQ ID NO: 3984452 - RNA, 14 nt, Staphylococcus aureus subsp. aureus Mu50
uauaacauuaaaau

SEQ ID NO: 3984453 - RNA, 17 nt, Staphylococcus aureus subsp. aureus Mu50
uauaacauuaaaaugau

SEQ ID NO: 3984454 - RNA, 21 nt, Staphylococcus aureus subsp. aureus Mu50
uauaacauucuucaaaaaaua

SEQ ID NO: 3984455 - RNA, 23 nt, Staphylococcus aureus subsp. aureus Mu50
uauaacauucuucaaaaaauaau

SEQ ID NO: 3984456 - RNA, 20 nt, Staphylococcus aureus subsp. aureus Mu50
uauaaccauguauaucuaau

SEQ ID NO: 3984457 - RNA, 21 nt, Staphylococcus aureus subsp. aureus Mu50
uauaacccuaauguguggauu

SEQ ID NO: 3984458 - RNA, 19 nt, Staphylococcus aureus subsp. aureus Mu50
uauaacccucguaggcaua

SEQ ID NO: 3984459 - RNA, 17 nt, Staphylococcus aureus subsp. aureus Mu50
uauaaccgcuacaauua

SEQ ID NO: 3984460 - RNA, 17 nt, Staphylococcus aureus subsp. aureus Mu50
uauaaccuauuaaaucu

SEQ ID NO: 3984461 - RNA, 16 nt, Staphylococcus aureus subsp. aureus Mu50
uauaaccuauuucauu

SEQ ID NO: 3984462 - RNA, 17 nt, Staphylococcus aureus subsp. aureus Mu50
uauaaccuuguucuuua

SEQ ID NO: 3984463 - RNA, 24 nt, Staphylococcus aureus subsp. aureus Mu50
uauaaccuuguucuuuacuccaaa

SEQ ID NO: 3984464 - RNA, 13 nt, Staphylococcus aureus subsp. aureus Mu50
uauaacugcaugu

SEQ ID NO: 3984465 - RNA, 20 nt, Staphylococcus aureus subsp. aureus Mu50
uauaacugcauguacaucuu

SEQ ID NO: 3984466 - RNA, 15 nt, Staphylococcus aureus subsp. aureus Mu50
uauaacuuuaaaaau

SEQ ID NO: 3984467 - RNA, 18 nt, Staphylococcus aureus subsp. aureus Mu50
uauaacuuuaaaaauuaa

SEQ ID NO: 3984468 - RNA, 20 nt, Staphylococcus aureus subsp. aureus Mu50
uauaagaaucagcuaaauau

SEQ ID NO: 3984469 - RNA, 23 nt, Staphylococcus aureus subsp. aureus Mu50
uauaagaaucagcuaaauauuuu

SEQ ID NO: 3984470 - RNA, 22 nt, Staphylococcus aureus subsp. aureus Mu50
uauaagaauuguugaucaugag

SEQ ID NO: 3984471 - RNA, 16 nt, Staphylococcus aureus subsp. aureus Mu50
uauaagauucauauuu

SEQ ID NO: 3984472 - RNA, 15 nt, Staphylococcus aureus subsp. aureus Mu50
uauaagccuuuucaa

SEQ ID NO: 3984473 - RNA, 18 nt, Staphylococcus aureus subsp. aureus Mu50
uauaagccuuuucaaaca

SEQ ID NO: 3984474 - RNA, 20 nt, Staphylococcus aureus subsp. aureus Mu50
uauaagccuuuucaaacaua

SEQ ID NO: 3984475 - RNA, 17 nt, Staphylococcus aureus subsp. aureus Mu50
uauaagcuuguaauccu

SEQ ID NO: 3984476 - RNA, 20 nt, Staphylococcus aureus subsp. aureus Mu50
uauaagggguauauuaaaaa

SEQ ID NO: 3984477 - RNA, 19 nt, Staphylococcus aureus subsp. aureus Mu50
uauaaguaaucauaauaau

SEQ ID NO: 3984478 - RNA, 14 nt, Staphylococcus aureus subsp. aureus Mu50
uauaaguacaaaua

SEQ ID NO: 3984479 - RNA, 18 nt, Staphylococcus aureus subsp. aureus Mu50
uauaaguagcucaaaaca

SEQ ID NO: 3984480 - RNA, 14 nt, Staphylococcus aureus subsp. aureus Mu50
uauaaguauaauga

SEQ ID NO: 3984481 - RNA, 18 nt, Staphylococcus aureus subsp. aureus Mu50
uauaaguauauaauugau

SEQ ID NO: 3984482 - RNA, 13 nt, Staphylococcus aureus subsp. aureus Mu50
uauaaguuaaaaa

SEQ ID NO: 3984483 - RNA, 14 nt, Staphylococcus aureus subsp. aureus Mu50
uauaaguuaaaaau

SEQ ID NO: 3984484 - RNA, 15 nt, Staphylococcus aureus subsp. aureus Mu50
uauaaguuaaaaaug

SEQ ID NO: 3984485 - RNA, 18 nt, Staphylococcus aureus subsp. aureus Mu50
uauaaguuaaaaauguaa

SEQ ID NO: 3984486 - RNA, 19 nt, Staphylococcus aureus subsp. aureus Mu50
uauaaguuugguucaguag

SEQ ID NO: 3984487 - RNA, 23 nt, Staphylococcus aureus subsp. aureus Mu50
uauaauacuguauuuuaacguca

SEQ ID NO: 3984488 - RNA, 13 nt, Staphylococcus aureus subsp. aureus Mu50
uauaauagaaaua

SEQ ID NO: 3984489 - RNA, 14 nt, Staphylococcus aureus subsp. aureus Mu50
uauaauauacacaa

SEQ ID NO: 3984490 - RNA, 15 nt, Staphylococcus aureus subsp. aureus Mu50
uauaauauacacaaa

SEQ ID NO: 3984491 - RNA, 23 nt, Staphylococcus aureus subsp. aureus Mu50
uauaauccagcgacauguccugu

SEQ ID NO: 3984492 - RNA, 16 nt, Staphylococcus aureus subsp. aureus Mu50
uauaaucuauaaaugg

SEQ ID NO: 3984493 - RNA, 14 nt, Staphylococcus aureus subsp. aureus Mu50
uauaaugauguauu

SEQ ID NO: 3984494 - RNA, 16 nt, Staphylococcus aureus subsp. aureus Mu50
uauaaugauguauuuu

SEQ ID NO: 3984495 - RNA, 21 nt, Staphylococcus aureus subsp. aureus Mu50
uauaaugauugucuuauaaga

SEQ ID NO: 3984496 - RNA, 18 nt, Staphylococcus aureus subsp. aureus Mu50
uauaaugccaaauauagu

SEQ ID NO: 3984497 - RNA, 21 nt, Staphylococcus aureus subsp. aureus Mu50
uauaauggacgguauuuucaa

SEQ ID NO: 3984498 - RNA, 16 nt, Staphylococcus aureus subsp. aureus Mu50
uauaaugguugaauaa

SEQ ID NO: 3984499 - RNA, 14 nt, Staphylococcus aureus subsp. aureus Mu50
uauaauguauaaaa

SEQ ID NO: 3984500 - RNA, 15 nt, Staphylococcus aureus subsp. aureus Mu50
uauaauuaaacauuu

SEQ ID NO: 3984501 - RNA, 21 nt, Staphylococcus aureus subsp. aureus Mu50
uauaauuaaacauuuagauuu

SEQ ID NO: 3984502 - RNA, 12 nt, Staphylococcus aureus subsp. aureus Mu50
uauaauuaaacu

SEQ ID NO: 3984503 - RNA, 14 nt, Staphylococcus aureus subsp. aureus Mu50
uauaauuaaacuaa

SEQ ID NO: 3984504 - RNA, 13 nt, Staphylococcus aureus subsp. aureus Mu50
uauaauuauuaaa

SEQ ID NO: 3984505 - RNA, 14 nt, Staphylococcus aureus subsp. aureus Mu50
uauaauuauuaaac

SEQ ID NO: 3984506 - RNA, 18 nt, Staphylococcus aureus subsp. aureus Mu50
uauaauuccugauacaau

SEQ ID NO: 3984507 - RNA, 14 nt, Staphylococcus aureus subsp. aureus Mu50
uauauaauuuaaag

SEQ ID NO: 3984508 - RNA, 16 nt, Staphylococcus aureus subsp. aureus Mu50
uauauaauuuaaagaa

SEQ ID NO: 3984509 - RNA, 16 nt, Staphylococcus aureus subsp. aureus Mu50
uauauaauuuauaaaa

SEQ ID NO: 3984510 - RNA, 23 nt, Staphylococcus aureus subsp. aureus Mu50
uauauacgauugaguugaaaaua

SEQ ID NO: 3984511 - RNA, 21 nt, Staphylococcus aureus subsp. aureus Mu50
uauauacguugauuaacacau

SEQ ID NO: 3984512 - RNA, 21 nt, Staphylococcus aureus subsp. aureus Mu50
uauauagcgcgcuuauugaaa

SEQ ID NO: 3984513 - RNA, 18 nt, Staphylococcus aureus subsp. aureus Mu50
uauauaguaaaauaaaua

SEQ ID NO: 3984514 - RNA, 19 nt, Staphylococcus aureus subsp. aureus Mu50
uauauagucuaugaauaau

SEQ ID NO: 3984515 - RNA, 20 nt, Staphylococcus aureus subsp. aureus Mu50
uauauauaaagaaauaauuu

SEQ ID NO: 3984516 - RNA, 13 nt, Staphylococcus aureus subsp. aureus Mu50
uauauauauauua

SEQ ID NO: 3984517 - RNA, 14 nt, Staphylococcus aureus subsp. aureus Mu50
uauauauauuaaag

SEQ ID NO: 3984518 - RNA, 17 nt, Staphylococcus aureus subsp. aureus Mu50
uauauaucacaacacau

SEQ ID NO: 3984519 - RNA, 18 nt, Staphylococcus aureus subsp. aureus Mu50
uauauauccuguuucaua

SEQ ID NO: 3984520 - RNA, 15 nt, Staphylococcus aureus subsp. aureus Mu50
uauauauucaauaau

SEQ ID NO: 3984521 - RNA, 16 nt, Staphylococcus aureus subsp. aureus Mu50
uauauauucaauaauu

SEQ ID NO: 3984522 - RNA, 21 nt, Staphylococcus aureus subsp. aureus Mu50
uauauauuccacgcucacauu

SEQ ID NO: 3984523 - RNA, 20 nt, Staphylococcus aureus subsp. aureus Mu50
uauauauucguuacaaauga

SEQ ID NO: 3984524 - RNA, 14 nt, Staphylococcus aureus subsp. aureus Mu50
uauauauuuugcaa

SEQ ID NO: 3984525 - RNA, 19 nt, Staphylococcus aureus subsp. aureus Mu50
uauaucaaauacauuucaa

SEQ ID NO: 3984526 - RNA, 15 nt, Staphylococcus aureus subsp. aureus Mu50
uauaucaacguuaau

SEQ ID NO: 3984527 - RNA, 20 nt, Staphylococcus aureus subsp. aureus Mu50
uauaucaacguuaauauaac

SEQ ID NO: 3984528 - RNA, 20 nt, Staphylococcus aureus subsp. aureus Mu50
uauaucacaacacauaaauu

SEQ ID NO: 3984529 - RNA, 23 nt, Staphylococcus aureus subsp. aureus Mu50
uauaucacaacacauaaauuaag

SEQ ID NO: 3984530 - RNA, 15 nt, Staphylococcus aureus subsp. aureus Mu50
uauaucagcuuguuu

SEQ ID NO: 3984531 - RNA, 15 nt, Staphylococcus aureus subsp. aureus Mu50
uauaucaucucuaug

SEQ ID NO: 3984532 - RNA, 16 nt, Staphylococcus aureus subsp. aureus Mu50
uauauccaguaaaguu

SEQ ID NO: 3984533 - RNA, 14 nt, Staphylococcus aureus subsp. aureus Mu50
uauauccauucaau

SEQ ID NO: 3984534 - RNA, 16 nt, Staphylococcus aureus subsp. aureus Mu50
uauauccgcaucuuuu

SEQ ID NO: 3984535 - RNA, 17 nt, Staphylococcus aureus subsp. aureus Mu50
uauaucgacaccauuua

SEQ ID NO: 3984536 - RNA, 24 nt, Staphylococcus aureus subsp. aureus Mu50
uauaucuaauucguaauuuaugau

SEQ ID NO: 3984537 - RNA, 21 nt, Staphylococcus aureus subsp. aureus Mu50
uauaucuauuuaucauacuuc

SEQ ID NO: 3984538 - RNA, 12 nt, Staphylococcus aureus subsp. aureus Mu50
uauaucuucauu

SEQ ID NO: 3984539 - RNA, 14 nt, Staphylococcus aureus subsp. aureus Mu50
uauaugaaaagaga

SEQ ID NO: 3984540 - RNA, 17 nt, Staphylococcus aureus subsp. aureus Mu50
uauaugauguucaauau

SEQ ID NO: 3984541 - RNA, 19 nt, Staphylococcus aureus subsp. aureus Mu50
uauauggcaucaucaccau

SEQ ID NO: 3984542 - RNA, 13 nt, Staphylococcus aureus subsp. aureus Mu50
uauauguaacaua

SEQ ID NO: 3984543 - RNA, 20 nt, Staphylococcus aureus subsp. aureus Mu50
uauauguaacauaaagcugu

SEQ ID NO: 3984544 - RNA, 16 nt, Staphylococcus aureus subsp. aureus Mu50
uauauguaaucagagu

SEQ ID NO: 3984545 - RNA, 23 nt, Staphylococcus aureus subsp. aureus Mu50
uauauguaggggagucuuauuuu

SEQ ID NO: 3984546 - RNA, 19 nt, Staphylococcus aureus subsp. aureus Mu50
uauauuaaaaauuucaaua

SEQ ID NO: 3984547 - RNA, 20 nt, Staphylococcus aureus subsp. aureus Mu50
uauauuaaaaauuucaauaa

SEQ ID NO: 3984548 - RNA, 23 nt, Staphylococcus aureus subsp. aureus Mu50
uauauuaaaaauuucaauaaugu

SEQ ID NO: 3984549 - RNA, 15 nt, Staphylococcus aureus subsp. aureus Mu50
uauauuaaaguaaaa

SEQ ID NO: 3984550 - RNA, 13 nt, Staphylococcus aureus subsp. aureus Mu50
uauauuaaauacu

SEQ ID NO: 3984551 - RNA, 17 nt, Staphylococcus aureus subsp. aureus Mu50
uauauuaaauacuauau

SEQ ID NO: 3984552 - RNA, 16 nt, Staphylococcus aureus subsp. aureus Mu50
uauauuaacaacuuua

SEQ ID NO: 3984553 - RNA, 17 nt, Staphylococcus aureus subsp. aureus Mu50
uauauuaaggucauuuu

SEQ ID NO: 3984554 - RNA, 21 nt, Staphylococcus aureus subsp. aureus Mu50
uauauuaaggucauuuuuaau

SEQ ID NO: 3984555 - RNA, 17 nt, Staphylococcus aureus subsp. aureus Mu50
uauauuaaucguuaaug

SEQ ID NO: 3984556 - RNA, 11 nt, Staphylococcus aureus subsp. aureus Mu50
uauauuaaugu

SEQ ID NO: 3984557 - RNA, 18 nt, Staphylococcus aureus subsp. aureus Mu50
uauauuacaucuauauuu

SEQ ID NO: 3984558 - RNA, 22 nt, Staphylococcus aureus subsp. aureus Mu50
uauauuacaucuauauuuguuu

SEQ ID NO: 3984559 - RNA, 22 nt, Staphylococcus aureus subsp. aureus Mu50
uauauuacuaaccuauuaaaaa

SEQ ID NO: 3984560 - RNA, 14 nt, Staphylococcus aureus subsp. aureus Mu50
uauauuaguauaau

SEQ ID NO: 3984561 - RNA, 17 nt, Staphylococcus aureus subsp. aureus Mu50
uauauuagugauauuuu

SEQ ID NO: 3984562 - RNA, 16 nt, Staphylococcus aureus subsp. aureus Mu50
uauauucaacuuauua

SEQ ID NO: 3984563 - RNA, 16 nt, Staphylococcus aureus subsp. aureus Mu50
uauauucaucucuuau

SEQ ID NO: 3984564 - RNA, 17 nt, Staphylococcus aureus subsp. aureus Mu50
uauauucguuacaaaug

SEQ ID NO: 3984565 - RNA, 16 nt, Staphylococcus aureus subsp. aureus Mu50
uauauugauagcaccg

SEQ ID NO: 3984566 - RNA, 23 nt, Staphylococcus aureus subsp. aureus Mu50
uauauugcacauaaaaaauguga

SEQ ID NO: 3984567 - RNA, 21 nt, Staphylococcus aureus subsp. aureus Mu50
uauauuguauuuuauuuauuu

SEQ ID NO: 3984568 - RNA, 22 nt, Staphylococcus aureus subsp. aureus Mu50
uauauuguauuuuauuuauuuu

SEQ ID NO: 3984569 - RNA, 12 nt, Staphylococcus aureus subsp. aureus Mu50
uauauuuaaacu

SEQ ID NO: 3984570 - RNA, 17 nt, Staphylococcus aureus subsp. aureus Mu50
uauauuuaaacucucua

SEQ ID NO: 3984571 - RNA, 15 nt, Staphylococcus aureus subsp. aureus Mu50
uauauuuaaaugucu

SEQ ID NO: 3984572 - RNA, 14 nt, Staphylococcus aureus subsp. aureus Mu50
uauauuuaaauugg

SEQ ID NO: 3984573 - RNA, 16 nt, Staphylococcus aureus subsp. aureus Mu50
uauauuuauuuuugau

SEQ ID NO: 3984574 - RNA, 20 nt, Staphylococcus aureus subsp. aureus Mu50
uauauuucgguauuuuaaau

SEQ ID NO: 3984575 - RNA, 16 nt, Staphylococcus aureus subsp. aureus Mu50
uauauuuuaguucaca

SEQ ID NO: 3984576 - RNA, 13 nt, Staphylococcus aureus subsp. aureus Mu50
uauauuuuauuag

SEQ ID NO: 3984577 - RNA, 15 nt, Staphylococcus aureus subsp. aureus Mu50
uauauuuuuaucauc

SEQ ID NO: 3984578 - RNA, 17 nt, Staphylococcus aureus subsp. aureus Mu50
uauauuuuuaucaucuu

SEQ ID NO: 3984579 - RNA, 16 nt, Staphylococcus aureus subsp. aureus Mu50
uauauuuuuguauuua

SEQ ID NO: 3984580 - RNA, 21 nt, Staphylococcus aureus subsp. aureus Mu50
uaucaaaaccgcuauaaaauu

SEQ ID NO: 3984581 - RNA, 15 nt, Staphylococcus aureus subsp. aureus Mu50
uaucaaaauauaaaa

SEQ ID NO: 3984582 - RNA, 16 nt, Staphylococcus aureus subsp. aureus Mu50
uaucaaaauauaaaau

SEQ ID NO: 3984583 - RNA, 21 nt, Staphylococcus aureus subsp. aureus Mu50
uaucaaacuuggcaaugaaau

SEQ ID NO: 3984584 - RNA, 23 nt, Staphylococcus aureus subsp. aureus Mu50
uaucaaagaaauguaugauauaa

SEQ ID NO: 3984585 - RNA, 14 nt, Staphylococcus aureus subsp. aureus Mu50
uaucaaauaaugaa

SEQ ID NO: 3984586 - RNA, 18 nt, Staphylococcus aureus subsp. aureus Mu50
uaucaaauuaccauucau

SEQ ID NO: 3984587 - RNA, 12 nt, Staphylococcus aureus subsp. aureus Mu50
uaucaaauucau

SEQ ID NO: 3984588 - RNA, 12 nt, Staphylococcus aureus subsp. aureus Mu50
uaucaacaaauu

SEQ ID NO: 3984589 - RNA, 17 nt, Staphylococcus aureus subsp. aureus Mu50
uaucaacagcuucaaaa

SEQ ID NO: 3984590 - RNA, 18 nt, Staphylococcus aureus subsp. aureus Mu50
uaucaacauaaaauuuaa

SEQ ID NO: 3984591 - RNA, 15 nt, Staphylococcus aureus subsp. aureus Mu50
uaucaacauauuuau

SEQ ID NO: 3984592 - RNA, 13 nt, Staphylococcus aureus subsp. aureus Mu50
uaucaacauuaau

SEQ ID NO: 3984593 - RNA, 22 nt, Staphylococcus aureus subsp. aureus Mu50
uaucaacgauugaauuguagau

SEQ ID NO: 3984594 - RNA, 22 nt, Staphylococcus aureus subsp. aureus Mu50
uaucaacgauuuugucuuuuau

SEQ ID NO: 3984595 - RNA, 12 nt, Staphylococcus aureus subsp. aureus Mu50
uaugcauuauag

SEQ ID NO: 3984596 - RNA, 18 nt, Staphylococcus aureus subsp. aureus Mu50
uaugccaaauaacguuaa

SEQ ID NO: 3984597 - RNA, 18 nt, Staphylococcus aureus subsp. aureus Mu50
uaugccgccuaauaauaa

SEQ ID NO: 3984598 - RNA, 21 nt, Staphylococcus aureus subsp. aureus Mu50
uaugccgccuaauaauaaaau

SEQ ID NO: 3984599 - RNA, 22 nt, Staphylococcus aureus subsp. aureus Mu50
uaugcguagcaacauuauuuuu

SEQ ID NO: 3984600 - RNA, 15 nt, Staphylococcus aureus subsp. aureus Mu50
uaugcuguuggcaaa

SEQ ID NO: 3984601 - RNA, 21 nt, Staphylococcus aureus subsp. aureus Mu50
uaugcuguuggcaaaacaaua

SEQ ID NO: 3984602 - RNA, 22 nt, Staphylococcus aureus subsp. aureus Mu50
uaugcuguuggcaaaacaauau

SEQ ID NO: 3984603 - RNA, 22 nt, Staphylococcus aureus subsp. aureus Mu50
uaugcuuguugugaauaaaauu

SEQ ID NO: 3984604 - RNA, 17 nt, Staphylococcus aureus subsp. aureus Mu50
uaugcuuuaaaucgaua

SEQ ID NO: 3984605 - RNA, 22 nt, Staphylococcus aureus subsp. aureus Mu50
uaugcuuuacuugcuuuuucaa

SEQ ID NO: 3984606 - RNA, 22 nt, Staphylococcus aureus subsp. aureus Mu50
uaugcuuuuuuuacaauaugau

SEQ ID NO: 3984607 - RNA, 15 nt, Staphylococcus aureus subsp. aureus Mu50
uauggaaaauguuau

SEQ ID NO: 3984608 - RNA, 19 nt, Staphylococcus aureus subsp. aureus Mu50
uauggaauuucauauaaug

SEQ ID NO: 3984609 - RNA, 13 nt, Staphylococcus aureus subsp. aureus Mu50
uauggagcggaag

SEQ ID NO: 3984610 - RNA, 16 nt, Staphylococcus aureus subsp. aureus Mu50
uauggauaaaauuuaa

SEQ ID NO: 3984611 - RNA, 18 nt, Staphylococcus aureus subsp. aureus Mu50
uauggaucauaaucauaa

SEQ ID NO: 3984612 - RNA, 13 nt, Staphylococcus aureus subsp. aureus Mu50
uauggauuucuua

SEQ ID NO: 3984613 - RNA, 17 nt, Staphylococcus aureus subsp. aureus Mu50
uauggcacaaaugaaug

SEQ ID NO: 3984614 - RNA, 22 nt, Staphylococcus aureus subsp. aureus Mu50
uauggcgaaauguuuuggaaaa

SEQ ID NO: 3984615 - RNA, 14 nt, Staphylococcus aureus subsp. aureus Mu50
uaugguauuuauag

SEQ ID NO: 3984616 - RNA, 19 nt, Staphylococcus aureus subsp. aureus Mu50
uauggucuggaauaaaucg

SEQ ID NO: 3984617 - RNA, 13 nt, Staphylococcus aureus subsp. aureus Mu50
uaugguuagagaa

SEQ ID NO: 3984618 - RNA, 15 nt, Staphylococcus aureus subsp. aureus Mu50
uaugguuagagaaaa

SEQ ID NO: 3984619 - RNA, 22 nt, Staphylococcus aureus subsp. aureus Mu50
uaugguuguuuuccaauaauaa

SEQ ID NO: 3984620 - RNA, 17 nt, Staphylococcus aureus subsp. aureus Mu50
uaugguuucuuauuaaa

SEQ ID NO: 3984621 - RNA, 12 nt, Staphylococcus aureus subsp. aureus Mu50
uauguaaaaaau

SEQ ID NO: 3984622 - RNA, 16 nt, Staphylococcus aureus subsp. aureus Mu50
uauguaaauucaaaau

SEQ ID NO: 3984623 - RNA, 14 nt, Staphylococcus aureus subsp. aureus Mu50
uauguaaucagagu

SEQ ID NO: 3984624 - RNA, 20 nt, Staphylococcus aureus subsp. aureus Mu50
uaugucaaauugaacuuaua

SEQ ID NO: 3984625 - RNA, 20 nt, Staphylococcus aureus subsp. aureus Mu50
uaugucuagacuuauuugaa

SEQ ID NO: 3984626 - RNA, 21 nt, Staphylococcus aureus subsp. aureus Mu50
uaugucuagacuuauuugaau

SEQ ID NO: 3984627 - RNA, 22 nt, Staphylococcus aureus subsp. aureus Mu50
uaugucuagacuuauuugaaug

SEQ ID NO: 3984628 - RNA, 16 nt, Staphylococcus aureus subsp. aureus Mu50
uaugucucucuuucuu

SEQ ID NO: 3984629 - RNA, 21 nt, Staphylococcus aureus subsp. aureus Mu50
uaugucucucuuucuuauuca

SEQ ID NO: 3984630 - RNA, 20 nt, Staphylococcus aureus subsp. aureus Mu50
uaugucuuaacaacaugauu

SEQ ID NO: 3984631 - RNA, 14 nt, Staphylococcus aureus subsp. aureus Mu50
uaugugacauacca

SEQ ID NO: 3984632 - RNA, 15 nt, Staphylococcus aureus subsp. aureus Mu50
uaugugcuaaucuau

SEQ ID NO: 3984633 - RNA, 22 nt, Staphylococcus aureus subsp. aureus Mu50
uaugugcuaaucuauuuagcuu

SEQ ID NO: 3984634 - RNA, 12 nt, Staphylococcus aureus subsp. aureus Mu50
uauguguauaug

SEQ ID NO: 3984635 - RNA, 20 nt, Staphylococcus aureus subsp. aureus Mu50
uauguguugugauauauagu

SEQ ID NO: 3984636 - RNA, 23 nt, Staphylococcus aureus subsp. aureus Mu50
uauguguuguguaucaguuauuu

SEQ ID NO: 3984637 - RNA, 15 nt, Staphylococcus aureus subsp. aureus Mu50
uauguguuucuagcu

SEQ ID NO: 3984638 - RNA, 21 nt, Staphylococcus aureus subsp. aureus Mu50
uauguuacuuauauauucaau

SEQ ID NO: 3984639 - RNA, 15 nt, Staphylococcus aureus subsp. aureus Mu50
uauguuauaaauucu

SEQ ID NO: 3984640 - RNA, 15 nt, Staphylococcus aureus subsp. aureus Mu50
uauguuauauuaaac

SEQ ID NO: 3984641 - RNA, 16 nt, Staphylococcus aureus subsp. aureus Mu50
uauguuauguaaauaa

SEQ ID NO: 3984642 - RNA, 17 nt, Staphylococcus aureus subsp. aureus Mu50
uauguucagaaauuuaa

SEQ ID NO: 3984643 - RNA, 18 nt, Staphylococcus aureus subsp. aureus Mu50
uauguucgauuauucuua

SEQ ID NO: 3984644 - RNA, 21 nt, Staphylococcus aureus subsp. aureus Mu50
uauguugaaagugacacugua

SEQ ID NO: 3984645 - RNA, 15 nt, Staphylococcus aureus subsp. aureus Mu50
uauguuguuauauaa

SEQ ID NO: 3984646 - RNA, 16 nt, Staphylococcus aureus subsp. aureus Mu50
uauguuguuauauaaa

SEQ ID NO: 3984647 - RNA, 13 nt, Staphylococcus aureus subsp. aureus Mu50
uauguuguuucua

SEQ ID NO: 3984648 - RNA, 16 nt, Staphylococcus aureus subsp. aureus Mu50
uauguuguuucuaaug

SEQ ID NO: 3984649 - RNA, 16 nt, Staphylococcus aureus subsp. aureus Mu50
uauguuuaaacauuuu

SEQ ID NO: 3984650 - RNA, 18 nt, Staphylococcus aureus subsp. aureus Mu50
uauguuuaucuacugaug

SEQ ID NO: 3984651 - RNA, 18 nt, Staphylococcus aureus subsp. aureus Mu50
uauguuugauuuuauuca

SEQ ID NO: 3984652 - RNA, 13 nt, Staphylococcus aureus subsp. aureus Mu50
uauguuuguuaug

SEQ ID NO: 3984653 - RNA, 13 nt, Staphylococcus aureus subsp. aureus Mu50
uauguuuuaucaa

SEQ ID NO: 3984654 - RNA, 16 nt, Staphylococcus aureus subsp. aureus Mu50
uauguuuuaugauuuu

SEQ ID NO: 3984655 - RNA, 22 nt, Staphylococcus aureus subsp. aureus Mu50
uauguuuuaugauuuucuuuaa

SEQ ID NO: 3984656 - RNA, 14 nt, Staphylococcus aureus subsp. aureus Mu50
uauguuuuugggua

SEQ ID NO: 3984657 - RNA, 17 nt, Staphylococcus aureus subsp. aureus Mu50
uauuaaaaaaaaccacg

SEQ ID NO: 3984658 - RNA, 22 nt, Staphylococcus aureus subsp. aureus Mu50
uauuaaaaaagaacauaaaaaa

SEQ ID NO: 3984659 - RNA, 21 nt, Staphylococcus aureus subsp. aureus Mu50
uauuaaaauacgguacagaua

SEQ ID NO: 3984660 - RNA, 22 nt, Staphylococcus aureus subsp. aureus Mu50
uauuaaacacgcgguaaaacga

SEQ ID NO: 3984661 - RNA, 22 nt, Staphylococcus aureus subsp. aureus Mu50
uauuaaacauuuuugaauuuaa

SEQ ID NO: 3984662 - RNA, 12 nt, Staphylococcus aureus subsp. aureus Mu50
uauuaaaggaaa

SEQ ID NO: 3984663 - RNA, 17 nt, Staphylococcus aureus subsp. aureus Mu50
uauuaaaggaaaucaau

SEQ ID NO: 3984664 - RNA, 13 nt, Staphylococcus aureus subsp. aureus Mu50
uauuaaauuaugg

SEQ ID NO: 3984665 - RNA, 16 nt, Staphylococcus aureus subsp. aureus Mu50
uauuaaauuugaaagu

SEQ ID NO: 3984666 - RNA, 20 nt, Staphylococcus aureus subsp. aureus Mu50
uauuaaauuuuguauaaccu

SEQ ID NO: 3984667 - RNA, 15 nt, Staphylococcus aureus subsp. aureus Mu50
uauuaacugaccuaa

SEQ ID NO: 3984668 - RNA, 18 nt, Staphylococcus aureus subsp. aureus Mu50
uauuaacuuuuccuuguu

SEQ ID NO: 3984669 - RNA, 22 nt, Staphylococcus aureus subsp. aureus Mu50
uauuaagcuauacucauuuucu

SEQ ID NO: 3984670 - RNA, 21 nt, Staphylococcus aureus subsp. aureus Mu50
uauuaaggcaaagcuucauuu

SEQ ID NO: 3984671 - RNA, 17 nt, Staphylococcus aureus subsp. aureus Mu50
uauuaagucuagcauua

SEQ ID NO: 3984672 - RNA, 17 nt, Staphylococcus aureus subsp. aureus Mu50
uauuaaugauugacgau

SEQ ID NO: 3984673 - RNA, 18 nt, Staphylococcus aureus subsp. aureus Mu50
uauuaauguuugaugauu

SEQ ID NO: 3984674 - RNA, 16 nt, Staphylococcus aureus subsp. aureus Mu50
uauuaauuaaaaaauu

SEQ ID NO: 3984675 - RNA, 23 nt, Staphylococcus aureus subsp. aureus Mu50
uauuaauugaauugauuauaaug

SEQ ID NO: 3984676 - RNA, 16 nt, Staphylococcus aureus subsp. aureus Mu50
uauuaauuucauugua

SEQ ID NO: 3984677 - RNA, 17 nt, Staphylococcus aureus subsp. aureus Mu50
uauuaauuugauaaaug

SEQ ID NO: 3984678 - RNA, 18 nt, Staphylococcus aureus subsp. aureus Mu50
uauuacacuaaaaccuau

SEQ ID NO: 3984679 - RNA, 13 nt, Staphylococcus aureus subsp. aureus Mu50
uauuacauaauuu

SEQ ID NO: 3984680 - RNA, 16 nt, Staphylococcus aureus subsp. aureus Mu50
uauuacaucuauauuu

SEQ ID NO: 3984681 - RNA, 17 nt, Staphylococcus aureus subsp. aureus Mu50
uauuacuaaccuauuaa

SEQ ID NO: 3984682 - RNA, 14 nt, Staphylococcus aureus subsp. aureus Mu50
uauucuuaauuuaa

SEQ ID NO: 3984683 - RNA, 15 nt, Staphylococcus aureus subsp. aureus Mu50
uauucuuaucauuca

SEQ ID NO: 3984684 - RNA, 13 nt, Staphylococcus aureus subsp. aureus Mu50
uauucuucauuua

SEQ ID NO: 3984685 - RNA, 19 nt, Staphylococcus aureus subsp. aureus Mu50
uauucuucauuuauaacau

SEQ ID NO: 3984686 - RNA, 21 nt, Staphylococcus aureus subsp. aureus Mu50
uauucuucuaauucugaaauc

SEQ ID NO: 3984687 - RNA, 12 nt, Staphylococcus aureus subsp. aureus Mu50
uauucuuuaaua

SEQ ID NO: 3984688 - RNA, 15 nt, Staphylococcus aureus subsp. aureus Mu50
uauucuuuaauauag

SEQ ID NO: 3984689 - RNA, 14 nt, Staphylococcus aureus subsp. aureus Mu50
uauucuuuauauuu

SEQ ID NO: 3984690 - RNA, 20 nt, Staphylococcus aureus subsp. aureus Mu50
uauucuuucguuuucaucaa

SEQ ID NO: 3984691 - RNA, 14 nt, Staphylococcus aureus subsp. aureus Mu50
uauucuuuuaauag

SEQ ID NO: 3984692 - RNA, 18 nt, Staphylococcus aureus subsp. aureus Mu50
uauucuuuuaauagaucu

SEQ ID NO: 3984693 - RNA, 12 nt, Staphylococcus aureus subsp. aureus Mu50
uauugaaacuaa

SEQ ID NO: 3984694 - RNA, 19 nt, Staphylococcus aureus subsp. aureus Mu50
uauugaaaguguaugcaug

SEQ ID NO: 3984695 - RNA, 23 nt, Staphylococcus aureus subsp. aureus Mu50
uauugaaauaauauaaaaacaaa

SEQ ID NO: 3984696 - RNA, 18 nt, Staphylococcus aureus subsp. aureus Mu50
uauugaaaucgauacuaa

SEQ ID NO: 3984697 - RNA, 21 nt, Staphylococcus aureus subsp. aureus Mu50
uauugaacaauuuuugggaag

SEQ ID NO: 3984698 - RNA, 15 nt, Staphylococcus aureus subsp. aureus Mu50
uauugaaugaauuca

SEQ ID NO: 3984699 - RNA, 19 nt, Staphylococcus aureus subsp. aureus Mu50
uauugaaugaauucauuau

SEQ ID NO: 3984700 - RNA, 22 nt, Staphylococcus aureus subsp. aureus Mu50
uauugaauggaguauaucagcu

SEQ ID NO: 3984701 - RNA, 23 nt, Staphylococcus aureus subsp. aureus Mu50
uauugaauggaguauaucagcuu

SEQ ID NO: 3984702 - RNA, 14 nt, Staphylococcus aureus subsp. aureus Mu50
uauugaauugaaaa

SEQ ID NO: 3984703 - RNA, 21 nt, Staphylococcus aureus subsp. aureus Mu50
uauugaauuugaauaaguggu

SEQ ID NO: 3984704 - RNA, 17 nt, Staphylococcus aureus subsp. aureus Mu50
uauugagauagaaauua

SEQ ID NO: 3984705 - RNA, 13 nt, Staphylococcus aureus subsp. aureus Mu50
uauugauauucua

SEQ ID NO: 3984706 - RNA, 23 nt, Staphylococcus aureus subsp. aureus Mu50
uauugauauucuaaaaaauuaaa

SEQ ID NO: 3984707 - RNA, 16 nt, Staphylococcus aureus subsp. aureus Mu50
uauugaugaauaaaua

SEQ ID NO: 3984708 - RNA, 21 nt, Staphylococcus aureus subsp. aureus Mu50
uauugaugaauaaauagauaa

SEQ ID NO: 3984709 - RNA, 21 nt, Staphylococcus aureus subsp. aureus Mu50
uauugauuguaccaguaacaa

SEQ ID NO: 3984710 - RNA, 23 nt, Staphylococcus aureus subsp. aureus Mu50
uauugauuugauucauuacaugu

SEQ ID NO: 3984711 - RNA, 14 nt, Staphylococcus aureus subsp. aureus Mu50
uauugcaaaaauaa

SEQ ID NO: 3984712 - RNA, 15 nt, Staphylococcus aureus subsp. aureus Mu50
uauugcaauaaaauu

SEQ ID NO: 3984713 - RNA, 17 nt, Staphylococcus aureus subsp. aureus Mu50
uauugccaaauuucucu

SEQ ID NO: 3984714 - RNA, 21 nt, Staphylococcus aureus subsp. aureus Mu50
uauugccgguuaaauuauuua

SEQ ID NO: 3984715 - RNA, 23 nt, Staphylococcus aureus subsp. aureus Mu50
uauugccgguuaaauuauuuaau

SEQ ID NO: 3984716 - RNA, 20 nt, Staphylococcus aureus subsp. aureus Mu50
uauugccuaaccuguuugag

SEQ ID NO: 3984717 - RNA, 22 nt, Staphylococcus aureus subsp. aureus Mu50
uauuggguggucguaauuuggu

SEQ ID NO: 3984718 - RNA, 20 nt, Staphylococcus aureus subsp. aureus Mu50
uauugguaaauuuaucauuu

SEQ ID NO: 3984719 - RNA, 16 nt, Staphylococcus aureus subsp. aureus Mu50
uauuggucauuacuaa

SEQ ID NO: 3984720 - RNA, 18 nt, Staphylococcus aureus subsp. aureus Mu50
uauuggucauuacuaaaa

SEQ ID NO: 3984721 - RNA, 17 nt, Staphylococcus aureus subsp. aureus Mu50
uauugguugaaauuaau

SEQ ID NO: 3984722 - RNA, 17 nt, Staphylococcus aureus subsp. aureus Mu50
uauuguaagcugacuuu

SEQ ID NO: 3984723 - RNA, 14 nt, Staphylococcus aureus subsp. aureus Mu50
uauuguauuuuaau

SEQ ID NO: 3984724 - RNA, 13 nt, Staphylococcus aureus subsp. aureus Mu50
uauugucaucaug

SEQ ID NO: 3984725 - RNA, 15 nt, Staphylococcus aureus subsp. aureus Mu50
uauugucaucauguu

SEQ ID NO: 3984726 - RNA, 16 nt, Staphylococcus aureus subsp. aureus Mu50
uauugugccgcuucua

SEQ ID NO: 3984727 - RNA, 23 nt, Staphylococcus aureus subsp. aureus Mu50
uauuguuaaacuagaaaacauaa

SEQ ID NO: 3984728 - RNA, 14 nt, Staphylococcus aureus subsp. aureus Mu50
uauuguuugaaaau

SEQ ID NO: 3984729 - RNA, 19 nt, Staphylococcus aureus subsp. aureus Mu50
uauuguuuguuuuuauagu

SEQ ID NO: 3984730 - RNA, 20 nt, Staphylococcus aureus subsp. aureus Mu50
uauuguuuguuuuuauaguu

SEQ ID NO: 3984731 - RNA, 15 nt, Staphylococcus aureus subsp. aureus Mu50
uauuguuuucaucau

SEQ ID NO: 3984732 - RNA, 19 nt, Staphylococcus aureus subsp. aureus Mu50
uauuguuuucaucaugcau

SEQ ID NO: 3984733 - RNA, 14 nt, Staphylococcus aureus subsp. aureus Mu50
uauuguuuuuaaaa

SEQ ID NO: 3984734 - RNA, 18 nt, Staphylococcus aureus subsp. aureus Mu50
uauuuaaaacuuguaaau

SEQ ID NO: 3984735 - RNA, 19 nt, Staphylococcus aureus subsp. aureus Mu50
uauuuaaaauauuauuuuu

SEQ ID NO: 3984736 - RNA, 23 nt, Staphylococcus aureus subsp. aureus Mu50
uauuuaaaauauuauuuuuaagu

SEQ ID NO: 3984737 - RNA, 16 nt, Staphylococcus aureus subsp. aureus Mu50
uauuuaaacuaguaau

SEQ ID NO: 3984738 - RNA, 21 nt, Staphylococcus aureus subsp. aureus Mu50
uauuuaaacuaguaauagaau

SEQ ID NO: 3984739 - RNA, 19 nt, Staphylococcus aureus subsp. aureus Mu50
uauuuaaacucucuaaaaa

SEQ ID NO: 3984740 - RNA, 19 nt, Staphylococcus aureus subsp. aureus Mu50
uauuuaaaggguguuuaga

SEQ ID NO: 3984741 - RNA, 17 nt, Staphylococcus aureus subsp. aureus Mu50
uauuuaacaucaauuac

SEQ ID NO: 3984742 - RNA, 12 nt, Staphylococcus aureus subsp. aureus Mu50
uauuuaauaaug

SEQ ID NO: 3984743 - RNA, 22 nt, Staphylococcus aureus subsp. aureus Mu50
uauuuaauacauuuuuauacaa

SEQ ID NO: 3984744 - RNA, 18 nt, Staphylococcus aureus subsp. aureus Mu50
uauuuaaucuuaauauug

SEQ ID NO: 3984745 - RNA, 21 nt, Staphylococcus aureus subsp. aureus Mu50
uauuuaaucuuaauauugauu

SEQ ID NO: 3984746 - RNA, 13 nt, Staphylococcus aureus subsp. aureus Mu50
uauuuaauuauuu

SEQ ID NO: 3984747 - RNA, 19 nt, Staphylococcus aureus subsp. aureus Mu50
uauuuaauuuugauauuuu

SEQ ID NO: 3984748 - RNA, 14 nt, Staphylococcus aureus subsp. aureus Mu50
uauuuaauuuuucu

SEQ ID NO: 3984749 - RNA, 22 nt, Staphylococcus aureus subsp. aureus Mu50
uauuuacaauguuaucuugcuu

SEQ ID NO: 3984750 - RNA, 21 nt, Staphylococcus aureus subsp. aureus Mu50
uauuuacacacaugauaauuu

SEQ ID NO: 3984751 - RNA, 19 nt, Staphylococcus aureus subsp. aureus Mu50
uauuuacacagaaugauau

SEQ ID NO: 3984752 - RNA, 22 nt, Staphylococcus aureus subsp. aureus Mu50
uauuuacauugccacuuuugug

SEQ ID NO: 3984753 - RNA, 15 nt, Staphylococcus aureus subsp. aureus Mu50
uauuuacuaagucgu

SEQ ID NO: 3984754 - RNA, 22 nt, Staphylococcus aureus subsp. aureus Mu50
uauuuagaaacuuccaacauau

SEQ ID NO: 3984755 - RNA, 14 nt, Staphylococcus aureus subsp. aureus Mu50
uauuuagaauaaac

SEQ ID NO: 3984756 - RNA, 16 nt, Staphylococcus aureus subsp. aureus Mu50
uauuuagaauauuaac

SEQ ID NO: 3984757 - RNA, 19 nt, Staphylococcus aureus subsp. aureus Mu50
uauuuagaauucuaaaaga

SEQ ID NO: 3984758 - RNA, 23 nt, Staphylococcus aureus subsp. aureus Mu50
uauuuagauacugaauuuuaacu

SEQ ID NO: 3984759 - RNA, 17 nt, Staphylococcus aureus subsp. aureus Mu50
uauuuagauucuuuucu

SEQ ID NO: 3984760 - RNA, 15 nt, Staphylococcus aureus subsp. aureus Mu50
uauuuagauugguca

SEQ ID NO: 3984761 - RNA, 16 nt, Staphylococcus aureus subsp. aureus Mu50
uauuuagauuuauaac

SEQ ID NO: 3984762 - RNA, 21 nt, Staphylococcus aureus subsp. aureus Mu50
uauuuagcuugcuuacaauaa

SEQ ID NO: 3984763 - RNA, 22 nt, Staphylococcus aureus subsp. aureus Mu50
uauuuaggacgugccuuaacuu

SEQ ID NO: 3984764 - RNA, 17 nt, Staphylococcus aureus subsp. aureus Mu50
uauuuaggaguauccug

SEQ ID NO: 3984765 - RNA, 18 nt, Staphylococcus aureus subsp. aureus Mu50
uauuuauaaaauaaaaug

SEQ ID NO: 3984766 - RNA, 15 nt, Staphylococcus aureus subsp. aureus Mu50
uauuuauaaacaaua

SEQ ID NO: 3984767 - RNA, 16 nt, Staphylococcus aureus subsp. aureus Mu50
uauuuauacuaaauug

SEQ ID NO: 3984768 - RNA, 18 nt, Staphylococcus aureus subsp. aureus Mu50
uauuuauacuaaauugag

SEQ ID NO: 3984769 - RNA, 20 nt, Staphylococcus aureus subsp. aureus Mu50
uauuuuuaggugcuuuaaug

SEQ ID NO: 3984770 - RNA, 16 nt, Staphylococcus aureus subsp. aureus Mu50
uauuuuuaugauucua

SEQ ID NO: 3984771 - RNA, 12 nt, Staphylococcus aureus subsp. aureus Mu50
uauuuuucauca

SEQ ID NO: 3984772 - RNA, 12 nt, Staphylococcus aureus subsp. aureus Mu50
uauuuuucuuaa

SEQ ID NO: 3984773 - RNA, 17 nt, Staphylococcus aureus subsp. aureus Mu50
uauuuuucuucaguuaa

SEQ ID NO: 3984774 - RNA, 23 nt, Staphylococcus aureus subsp. aureus Mu50
uauuuuugauagugguagccaau

SEQ ID NO: 3984775 - RNA, 17 nt, Staphylococcus aureus subsp. aureus Mu50
uauuuuugauuuaauaa

SEQ ID NO: 3984776 - RNA, 22 nt, Staphylococcus aureus subsp. aureus Mu50
uauuuuuguauuuauguuuucu

SEQ ID NO: 3984777 - RNA, 15 nt, Staphylococcus aureus subsp. aureus Mu50
uauuuuuuaauaauc

SEQ ID NO: 3984778 - RNA, 16 nt, Staphylococcus aureus subsp. aureus Mu50
uauuuuuuaucauuuu

SEQ ID NO: 3984779 - RNA, 19 nt, Staphylococcus aureus subsp. aureus Mu50
uauuuuuugagcacuuaau

SEQ ID NO: 3984780 - RNA, 21 nt, Staphylococcus aureus subsp. aureus Mu50
uauuuuuugagcacuuaauaa

SEQ ID NO: 3984781 - RNA, 14 nt, Staphylococcus aureus subsp. aureus Mu50
uauuuuuuuacuuu

SEQ ID NO: 3984782 - RNA, 13 nt, Staphylococcus aureus subsp. aureus Mu50
uauuuuuuuaugc

SEQ ID NO: 3984783 - RNA, 12 nt, Staphylococcus aureus subsp. aureus Mu50
uauuuuuuucuu

SEQ ID NO: 3984784 - RNA, 13 nt, Staphylococcus aureus subsp. aureus Mu50
ucaaaaaauaaua

SEQ ID NO: 3984785 - RNA, 17 nt, Staphylococcus aureus subsp. aureus Mu50
ucaaaaaauauuuacau

SEQ ID NO: 3984786 - RNA, 14 nt, Staphylococcus aureus subsp. aureus Mu50
ucaaaaaauuaauc

SEQ ID NO: 3984787 - RNA, 14 nt, Staphylococcus aureus subsp. aureus Mu50
ucaaaaagacagca

SEQ ID NO: 3984788 - RNA, 23 nt, Staphylococcus aureus subsp. aureus Mu50
ucaaaaauagcguaauuauuaua

SEQ ID NO: 3984789 - RNA, 12 nt, Staphylococcus aureus subsp. aureus Mu50
ucaaaaaucaua

SEQ ID NO: 3984790 - RNA, 21 nt, Staphylococcus aureus subsp. aureus Mu50
ucaaaacaauuuaaaaagcag

SEQ ID NO: 3984791 - RNA, 14 nt, Staphylococcus aureus subsp. aureus Mu50
ucaaaagaaauugu

SEQ ID NO: 3984792 - RNA, 17 nt, Staphylococcus aureus subsp. aureus Mu50
ucaaaagcguucaauuu

SEQ ID NO: 3984793 - RNA, 13 nt, Staphylococcus aureus subsp. aureus Mu50
ucaaaauaguaaa

SEQ ID NO: 3984794 - RNA, 13 nt, Staphylococcus aureus subsp. aureus Mu50
ucaaaauauaaaa

SEQ ID NO: 3984795 - RNA, 13 nt, Staphylococcus aureus subsp. aureus Mu50
ucaaaauguuuaa

SEQ ID NO: 3984796 - RNA, 18 nt, Staphylococcus aureus subsp. aureus Mu50
ucaaaauguuuaacaaua

SEQ ID NO: 3984797 - RNA, 13 nt, Staphylococcus aureus subsp. aureus Mu50
ucaaaauucaaua

SEQ ID NO: 3984798 - RNA, 18 nt, Staphylococcus aureus subsp. aureus Mu50
ucaaaauucaauauuaau

SEQ ID NO: 3984799 - RNA, 22 nt, Staphylococcus aureus subsp. aureus Mu50
ucaaaauucaauauuaaucaua

SEQ ID NO: 3984800 - RNA, 18 nt, Staphylococcus aureus subsp. aureus Mu50
ucaaaauuguggcuacua

SEQ ID NO: 3984801 - RNA, 18 nt, Staphylococcus aureus subsp. aureus Mu50
ucaaaauuucgauuuuca

SEQ ID NO: 3984802 - RNA, 21 nt, Staphylococcus aureus subsp. aureus Mu50
ucaaaauuucgauuuucacca

SEQ ID NO: 3984803 - RNA, 11 nt, Staphylococcus aureus subsp. aureus Mu50
ucaaacaacau

SEQ ID NO: 3984804 - RNA, 22 nt, Staphylococcus aureus subsp. aureus Mu50
ucaaacaagauucauacacugc

SEQ ID NO: 3984805 - RNA, 13 nt, Staphylococcus aureus subsp. aureus Mu50
ucaaacaauaaag

SEQ ID NO: 3984806 - RNA, 14 nt, Staphylococcus aureus subsp. aureus Mu50
ucaaacagacuuaa

SEQ ID NO: 3984807 - RNA, 19 nt, Staphylococcus aureus subsp. aureus Mu50
ucaaacaguccuuauuaua

SEQ ID NO: 3984808 - RNA, 14 nt, Staphylococcus aureus subsp. aureus Mu50
ucaaacauauucau

SEQ ID NO: 3984809 - RNA, 13 nt, Staphylococcus aureus subsp. aureus Mu50
ucaaacugauuuc

SEQ ID NO: 3984810 - RNA, 15 nt, Staphylococcus aureus subsp. aureus Mu50
ucaaacuuaaaacua

SEQ ID NO: 3984811 - RNA, 21 nt, Staphylococcus aureus subsp. aureus Mu50
ucaaacuuaaaacuauaaccu

SEQ ID NO: 3984812 - RNA, 14 nt, Staphylococcus aureus subsp. aureus Mu50
ucaaacuuaucgcc

SEQ ID NO: 3984813 - RNA, 12 nt, Staphylococcus aureus subsp. aureus Mu50
ucaaagaaaaag

SEQ ID NO: 3984814 - RNA, 17 nt, Staphylococcus aureus subsp. aureus Mu50
ucaaagaggcuuuaaaa

SEQ ID NO: 3984815 - RNA, 18 nt, Staphylococcus aureus subsp. aureus Mu50
ucaaagcgauaaaguaug

SEQ ID NO: 3984816 - RNA, 21 nt, Staphylococcus aureus subsp. aureus Mu50
ucaaagcgauaaaguaugagu

SEQ ID NO: 3984817 - RNA, 22 nt, Staphylococcus aureus subsp. aureus Mu50
ucaaagguuuacuauuaaagga

SEQ ID NO: 3984818 - RNA, 12 nt, Staphylococcus aureus subsp. aureus Mu50
ucaaaguagaca

SEQ ID NO: 3984819 - RNA, 14 nt, Staphylococcus aureus subsp. aureus Mu50
ucaaaguagacauu

SEQ ID NO: 3984820 - RNA, 19 nt, Staphylococcus aureus subsp. aureus Mu50
ucaaaguagacauugaaua

SEQ ID NO: 3984821 - RNA, 22 nt, Staphylococcus aureus subsp. aureus Mu50
ucaaaguagacauugaauaaau

SEQ ID NO: 3984822 - RNA, 23 nt, Staphylococcus aureus subsp. aureus Mu50
ucaaaguagauauugaauggagu

SEQ ID NO: 3984823 - RNA, 13 nt, Staphylococcus aureus subsp. aureus Mu50
ucaaaguuuaauu

SEQ ID NO: 3984824 - RNA, 21 nt, Staphylococcus aureus subsp. aureus Mu50
ucaaaguuuucaggaauuguu

SEQ ID NO: 3984825 - RNA, 14 nt, Staphylococcus aureus subsp. aureus Mu50
ucaaaguuuucauu

SEQ ID NO: 3984826 - RNA, 19 nt, Staphylococcus aureus subsp. aureus Mu50
ucaaaguuuucauuuaaca

SEQ ID NO: 3984827 - RNA, 21 nt, Staphylococcus aureus subsp. aureus Mu50
ucaaaguuuucauuuuuucaa

SEQ ID NO: 3984828 - RNA, 15 nt, Staphylococcus aureus subsp. aureus Mu50
ucaaauaaacacauc

SEQ ID NO: 3984829 - RNA, 18 nt, Staphylococcus aureus subsp. aureus Mu50
ucaaauaaaucaaacuuu

SEQ ID NO: 3984830 - RNA, 21 nt, Staphylococcus aureus subsp. aureus Mu50
ucaaauaaaucaaacuuuuca

SEQ ID NO: 3984831 - RNA, 21 nt, Staphylococcus aureus subsp. aureus Mu50
ucaaauaaaugacauuuaaua

SEQ ID NO: 3984832 - RNA, 17 nt, Staphylococcus aureus subsp. aureus Mu50
ucaaauaaccuauuaau

SEQ ID NO: 3984833 - RNA, 14 nt, Staphylococcus aureus subsp. aureus Mu50
ucaaauaauauaaa

SEQ ID NO: 3984834 - RNA, 14 nt, Staphylococcus aureus subsp. aureus Mu50
ucaaauaaugaaua

SEQ ID NO: 3984835 - RNA, 13 nt, Staphylococcus aureus subsp. aureus Mu50
ucaaauaauguga

SEQ ID NO: 3984836 - RNA, 21 nt, Staphylococcus aureus subsp. aureus Mu50
ucaaauaaugugaaaaaucuu

SEQ ID NO: 3984837 - RNA, 22 nt, Staphylococcus aureus subsp. aureus Mu50
ucaaauaaugugaaaaaucuuc

SEQ ID NO: 3984838 - RNA, 15 nt, Staphylococcus aureus subsp. aureus Mu50
ucaaauacauuucaa

SEQ ID NO: 3984839 - RNA, 17 nt, Staphylococcus aureus subsp. aureus Mu50
ucaaauacauuucaaaa

SEQ ID NO: 3984840 - RNA, 22 nt, Staphylococcus aureus subsp. aureus Mu50
ucaaauagacaccaaaaaacag

SEQ ID NO: 3984841 - RNA, 17 nt, Staphylococcus aureus subsp. aureus Mu50
ucaaauaggcauaauga

SEQ ID NO: 3984842 - RNA, 15 nt, Staphylococcus aureus subsp. aureus Mu50
ucaaauauaaauaaa

SEQ ID NO: 3984843 - RNA, 24 nt, Staphylococcus aureus subsp. aureus Mu50
ucaaauauaucaacguuaauauaa

SEQ ID NO: 3984844 - RNA, 13 nt, Staphylococcus aureus subsp. aureus Mu50
ucaaauauaucua

SEQ ID NO: 3984845 - RNA, 17 nt, Staphylococcus aureus subsp. aureus Mu50
ucaaaucauaaguuaaa

SEQ ID NO: 3984846 - RNA, 16 nt, Staphylococcus aureus subsp. aureus Mu50
ucaaauccaaaaucuu

SEQ ID NO: 3984847 - RNA, 20 nt, Staphylococcus aureus subsp. aureus Mu50
ucaaaugacauuuuaaaucu

SEQ ID NO: 3984848 - RNA, 22 nt, Staphylococcus aureus subsp. aureus Mu50
ucaaaugacauuuuaaaucuaa

SEQ ID NO: 3984849 - RNA, 20 nt, Staphylococcus aureus subsp. aureus Mu50
ucaaaugcucccuucaaagu

SEQ ID NO: 3984850 - RNA, 21 nt, Staphylococcus aureus subsp. aureus Mu50
ucaaaugcuuaauaaaaucaa

SEQ ID NO: 3984851 - RNA, 17 nt, Staphylococcus aureus subsp. aureus Mu50
ucaaauguaacauuaaa

SEQ ID NO: 3984852 - RNA, 22 nt, Staphylococcus aureus subsp. aureus Mu50
ucaaauguugaauguggaacau

SEQ ID NO: 3984853 - RNA, 16 nt, Staphylococcus aureus subsp. aureus Mu50
ucaaauuagucaucca

SEQ ID NO: 3984854 - RNA, 19 nt, Staphylococcus aureus subsp. aureus Mu50
ucaaauucucaauuaauuu

SEQ ID NO: 3984855 - RNA, 19 nt, Staphylococcus aureus subsp. aureus Mu50
ucaaauuggacuuaugggu

SEQ ID NO: 3984856 - RNA, 14 nt, Staphylococcus aureus subsp. aureus Mu50
ucaaauugguuuuc

SEQ ID NO: 3984857 - RNA, 14 nt, Staphylococcus aureus subsp. aureus Mu50
ucaauaguuucaau

SEQ ID NO: 3984858 - RNA, 19 nt, Staphylococcus aureus subsp. aureus Mu50
ucaauaguuucaaugccuu

SEQ ID NO: 3984859 - RNA, 14 nt, Staphylococcus aureus subsp. aureus Mu50
ucaauauaaaaagu

SEQ ID NO: 3984860 - RNA, 21 nt, Staphylococcus aureus subsp. aureus Mu50
ucaauaucuguagcgauaccu

SEQ ID NO: 3984861 - RNA, 23 nt, Staphylococcus aureus subsp. aureus Mu50
ucaauaucuguagcgauaccuuu

SEQ ID NO: 3984862 - RNA, 20 nt, Staphylococcus aureus subsp. aureus Mu50
ucaauaucuucuaauuccau

SEQ ID NO: 3984863 - RNA, 18 nt, Staphylococcus aureus subsp. aureus Mu50
ucaauaucuucuucuaac

SEQ ID NO: 3984864 - RNA, 24 nt, Staphylococcus aureus subsp. aureus Mu50
ucaauaucuucuucuaaccacuuc

SEQ ID NO: 3984865 - RNA, 13 nt, Staphylococcus aureus subsp. aureus Mu50
ucaauauuaaaau

SEQ ID NO: 3984866 - RNA, 19 nt, Staphylococcus aureus subsp. aureus Mu50
ucaauauucuuaucauuca

SEQ ID NO: 3984867 - RNA, 13 nt, Staphylococcus aureus subsp. aureus Mu50
ucaauauuuaaau

SEQ ID NO: 3984868 - RNA, 16 nt, Staphylococcus aureus subsp. aureus Mu50
ucaauauuuaaauuuu

SEQ ID NO: 3984869 - RNA, 23 nt, Staphylococcus aureus subsp. aureus Mu50
ucaauauuugaacgagcaccuuu

SEQ ID NO: 3984870 - RNA, 13 nt, Staphylococcus aureus subsp. aureus Mu50
ucaauauuuucau

SEQ ID NO: 3984871 - RNA, 15 nt, Staphylococcus aureus subsp. aureus Mu50
ucaauauuuucaugu

SEQ ID NO: 3984872 - RNA, 17 nt, Staphylococcus aureus subsp. aureus Mu50
ucaaucacuauauuuca

SEQ ID NO: 3984873 - RNA, 15 nt, Staphylococcus aureus subsp. aureus Mu50
ucaaucacuccucua

SEQ ID NO: 3984874 - RNA, 23 nt, Staphylococcus aureus subsp. aureus Mu50
ucaauccaagcaaucuuaguaca

SEQ ID NO: 3984875 - RNA, 22 nt, Staphylococcus aureus subsp. aureus Mu50
ucaauccaauuaaauauuuaac

SEQ ID NO: 3984876 - RNA, 22 nt, Staphylococcus aureus subsp. aureus Mu50
ucaauccaucaauaccauaauu

SEQ ID NO: 3984877 - RNA, 18 nt, Staphylococcus aureus subsp. aureus Mu50
ucaaucccuuuuagcaua

SEQ ID NO: 3984878 - RNA, 15 nt, Staphylococcus aureus subsp. aureus Mu50
ucaauccuaaauuau

SEQ ID NO: 3984879 - RNA, 16 nt, Staphylococcus aureus subsp. aureus Mu50
ucaauccuaaauuaua

SEQ ID NO: 3984880 - RNA, 15 nt, Staphylococcus aureus subsp. aureus Mu50
ucaaucgcauuuugu

SEQ ID NO: 3984881 - RNA, 14 nt, Staphylococcus aureus subsp. aureus Mu50
ucaaugaauuuacu

SEQ ID NO: 3984882 - RNA, 12 nt, Staphylococcus aureus subsp. aureus Mu50
ucaaugacuaag

SEQ ID NO: 3984883 - RNA, 18 nt, Staphylococcus aureus subsp. aureus Mu50
ucaaugacugagaaaaau

SEQ ID NO: 3984884 - RNA, 19 nt, Staphylococcus aureus subsp. aureus Mu50
ucaaugacugagaaaaaua

SEQ ID NO: 3984885 - RNA, 22 nt, Staphylococcus aureus subsp. aureus Mu50
ucaaugacugagaaaaauauuu

SEQ ID NO: 3984886 - RNA, 23 nt, Staphylococcus aureus subsp. aureus Mu50
ucaaugacugagaaaaauauuuc

SEQ ID NO: 3984887 - RNA, 19 nt, Staphylococcus aureus subsp. aureus Mu50
ucaaugauuuuauaauauu

SEQ ID NO: 3984888 - RNA, 12 nt, Staphylococcus aureus subsp. aureus Mu50
ucaaugauuuuu

SEQ ID NO: 3984889 - RNA, 16 nt, Staphylococcus aureus subsp. aureus Mu50
ucaaugauuuuuaaaa

SEQ ID NO: 3984890 - RNA, 19 nt, Staphylococcus aureus subsp. aureus Mu50
ucaaugcauuuaauuuaau

SEQ ID NO: 3984891 - RNA, 16 nt, Staphylococcus aureus subsp. aureus Mu50
ucaauguaagcaacau

SEQ ID NO: 3984892 - RNA, 22 nt, Staphylococcus aureus subsp. aureus Mu50
ucaauguaauuuucacuuucaa

SEQ ID NO: 3984893 - RNA, 16 nt, Staphylococcus aureus subsp. aureus Mu50
ucaauguuuaauuuuc

SEQ ID NO: 3984894 - RNA, 19 nt, Staphylococcus aureus subsp. aureus Mu50
ucaauuaaacuuaagaaua

SEQ ID NO: 3984895 - RNA, 20 nt, Staphylococcus aureus subsp. aureus Mu50
ucaauuaaucggaucauuau

SEQ ID NO: 3984896 - RNA, 24 nt, Staphylococcus aureus subsp. aureus Mu50
ucaauuaaucggaucauuauuuag

SEQ ID NO: 3984897 - RNA, 20 nt, Staphylococcus aureus subsp. aureus Mu50
ucaauuaauuuaaaugcuua

SEQ ID NO: 3984898 - RNA, 14 nt, Staphylococcus aureus subsp. aureus Mu50
ucaauuaauuuagu

SEQ ID NO: 3984899 - RNA, 23 nt, Staphylococcus aureus subsp. aureus Mu50
ucaauuaauuuagucauuacaaa

SEQ ID NO: 3984900 - RNA, 19 nt, Staphylococcus aureus subsp. aureus Mu50
ucaauuauugaaaacaaaa

SEQ ID NO: 3984901 - RNA, 15 nt, Staphylococcus aureus subsp. aureus Mu50
ucaauuauuucaucg

SEQ ID NO: 3984902 - RNA, 21 nt, Staphylococcus aureus subsp. aureus Mu50
ucaauucacgagcugcuucaa

SEQ ID NO: 3984903 - RNA, 17 nt, Staphylococcus aureus subsp. aureus Mu50
ucaauugacauuaauga

SEQ ID NO: 3984904 - RNA, 15 nt, Staphylococcus aureus subsp. aureus Mu50
ucaauuguaaaucuu

SEQ ID NO: 3984905 - RNA, 15 nt, Staphylococcus aureus subsp. aureus Mu50
ucaauugugcuuggu

SEQ ID NO: 3984906 - RNA, 23 nt, Staphylococcus aureus subsp. aureus Mu50
ucaauuguugcaaaauacgauuu

SEQ ID NO: 3984907 - RNA, 12 nt, Staphylococcus aureus subsp. aureus Mu50
ucaauuuaaaua

SEQ ID NO: 3984908 - RNA, 14 nt, Staphylococcus aureus subsp. aureus Mu50
ucaauuuaaauaag

SEQ ID NO: 3984909 - RNA, 19 nt, Staphylococcus aureus subsp. aureus Mu50
ucaauuuaguauaaauaaa

SEQ ID NO: 3984910 - RNA, 22 nt, Staphylococcus aureus subsp. aureus Mu50
ucaauuuaguauaaauaaaaau

SEQ ID NO: 3984911 - RNA, 23 nt, Staphylococcus aureus subsp. aureus Mu50
ucaauuuaguccuucuuuacuaa

SEQ ID NO: 3984912 - RNA, 22 nt, Staphylococcus aureus subsp. aureus Mu50
ucaauuucaccuuguaaauuga

SEQ ID NO: 3984913 - RNA, 16 nt, Staphylococcus aureus subsp. aureus Mu50
ucaauuucauuugaaa

SEQ ID NO: 3984914 - RNA, 14 nt, Staphylococcus aureus subsp. aureus Mu50
ucaauuucuauuuc

SEQ ID NO: 3984915 - RNA, 18 nt, Staphylococcus aureus subsp. aureus Mu50
ucaauuuggaaauaucuu

SEQ ID NO: 3984916 - RNA, 19 nt, Staphylococcus aureus subsp. aureus Mu50
ucaauuuggaaauaucuua

SEQ ID NO: 3984917 - RNA, 19 nt, Staphylococcus aureus subsp. aureus Mu50
ucaauuuuaccauguuuua

SEQ ID NO: 3984918 - RNA, 16 nt, Staphylococcus aureus subsp. aureus Mu50
ucaauuuuuacuaaau

SEQ ID NO: 3984919 - RNA, 20 nt, Staphylococcus aureus subsp. aureus Mu50
ucaauuuuuucaugauuuac

SEQ ID NO: 3984920 - RNA, 21 nt, Staphylococcus aureus subsp. aureus Mu50
ucaauuuuuucaugauuuacu

SEQ ID NO: 3984921 - RNA, 22 nt, Staphylococcus aureus subsp. aureus Mu50
ucacaaaauuaggcauucaucu

SEQ ID NO: 3984922 - RNA, 13 nt, Staphylococcus aureus subsp. aureus Mu50
ucacaaauuugaa

SEQ ID NO: 3984923 - RNA, 15 nt, Staphylococcus aureus subsp. aureus Mu50
ucacaacacauaaau

SEQ ID NO: 3984924 - RNA, 16 nt, Staphylococcus aureus subsp. aureus Mu50
ucacaacugcauauaa

SEQ ID NO: 3984925 - RNA, 20 nt, Staphylococcus aureus subsp. aureus Mu50
ucacaacugcauauaaaguc

SEQ ID NO: 3984926 - RNA, 20 nt, Staphylococcus aureus subsp. aureus Mu50
ucacaaguuuacagguugaa

SEQ ID NO: 3984927 - RNA, 21 nt, Staphylococcus aureus subsp. aureus Mu50
ucacaauacgaaaucaaaaau

SEQ ID NO: 3984928 - RNA, 14 nt, Staphylococcus aureus subsp. aureus Mu50
ucacaauauaacau

SEQ ID NO: 3984929 - RNA, 19 nt, Staphylococcus aureus subsp. aureus Mu50
ucacaauauaacaucaaau

SEQ ID NO: 3984930 - RNA, 16 nt, Staphylococcus aureus subsp. aureus Mu50
ucacaaucauagauau

SEQ ID NO: 3984931 - RNA, 17 nt, Staphylococcus aureus subsp. aureus Mu50
ucacaaucuguucauaa

SEQ ID NO: 3984932 - RNA, 21 nt, Staphylococcus aureus subsp. aureus Mu50
ucacaaugaccauugucaugc

SEQ ID NO: 3984933 - RNA, 15 nt, Staphylococcus aureus subsp. aureus Mu50
ucacagcaauaauaa

SEQ ID NO: 3984934 - RNA, 22 nt, Staphylococcus aureus subsp. aureus Mu50
ucacagcacagcgauuaaauga

SEQ ID NO: 3984935 - RNA, 13 nt, Staphylococcus aureus subsp. aureus Mu50
ucacauacauuuu

SEQ ID NO: 3984936 - RNA, 16 nt, Staphylococcus aureus subsp. aureus Mu50
ucacauacauuuugaa

SEQ ID NO: 3984937 - RNA, 15 nt, Staphylococcus aureus subsp. aureus Mu50
ucacauagaguaauu

SEQ ID NO: 3984938 - RNA, 13 nt, Staphylococcus aureus subsp. aureus Mu50
ucacauauaaaua

SEQ ID NO: 3984939 - RNA, 14 nt, Staphylococcus aureus subsp. aureus Mu50
ucacauauaaauau

SEQ ID NO: 3984940 - RNA, 18 nt, Staphylococcus aureus subsp. aureus Mu50
ucacaucuuuagcuaugu

SEQ ID NO: 3984941 - RNA, 23 nt, Staphylococcus aureus subsp. aureus Mu50
ucacaucuuuagcuauguaaaau

SEQ ID NO: 3984942 - RNA, 22 nt, Staphylococcus aureus subsp. aureus Mu50
ucacaugaauuuuaauauauuu

SEQ ID NO: 3984943 - RNA, 23 nt, Staphylococcus aureus subsp. aureus Mu50
ucacaugaggaucaacugaaauu

SEQ ID NO: 3984944 - RNA, 21 nt, Staphylococcus aureus subsp. aureus Mu50
ucagaugauuuaauucugguu

SEQ ID NO: 3984945 - RNA, 20 nt, Staphylococcus aureus subsp. aureus Mu50
ucagcaccgacaauuauaau

SEQ ID NO: 3984946 - RNA, 20 nt, Staphylococcus aureus subsp. aureus Mu50
ucagcauugggacauaaaau

SEQ ID NO: 3984947 - RNA, 23 nt, Staphylococcus aureus subsp. aureus Mu50
ucagcauugggacauaaaauuaa

SEQ ID NO: 3984948 - RNA, 14 nt, Staphylococcus aureus subsp. aureus Mu50
ucagccacugucau

SEQ ID NO: 3984949 - RNA, 24 nt, Staphylococcus aureus subsp. aureus Mu50
ucagcgauaggcgcgaaaugaccu

SEQ ID NO: 3984950 - RNA, 15 nt, Staphylococcus aureus subsp. aureus Mu50
ucagcgucauauguu

SEQ ID NO: 3984951 - RNA, 10 nt, Staphylococcus aureus subsp. aureus Mu50
ucagcuuguu

SEQ ID NO: 3984952 - RNA, 15 nt, Staphylococcus aureus subsp. aureus Mu50
ucagcuuuaauaaua

SEQ ID NO: 3984953 - RNA, 18 nt, Staphylococcus aureus subsp. aureus Mu50
ucagcuuuggcgacauaa

SEQ ID NO: 3984954 - RNA, 22 nt, Staphylococcus aureus subsp. aureus Mu50
ucagcuuuggcgacauaaauac

SEQ ID NO: 3984955 - RNA, 16 nt, Staphylococcus aureus subsp. aureus Mu50
ucagcuuuuucauuca

SEQ ID NO: 3984956 - RNA, 14 nt, Staphylococcus aureus subsp. aureus Mu50
ucaggaauagaugu

SEQ ID NO: 3984957 - RNA, 22 nt, Staphylococcus aureus subsp. aureus Mu50
ucaggaccaaauagagaaauac

SEQ ID NO: 3984958 - RNA, 22 nt, Staphylococcus aureus subsp. aureus Mu50
ucaggaucacguuuuucuuuaa

SEQ ID NO: 3984959 - RNA, 18 nt, Staphylococcus aureus subsp. aureus Mu50
ucaggcuuaauuaauaaa

SEQ ID NO: 3984960 - RNA, 21 nt, Staphylococcus aureus subsp. aureus Mu50
ucaggggccccaacacagaga

SEQ ID NO: 3984961 - RNA, 18 nt, Staphylococcus aureus subsp. aureus Mu50
ucaguaaaaauacauuuu

SEQ ID NO: 3984962 - RNA, 13 nt, Staphylococcus aureus subsp. aureus Mu50
ucaguaauaauac

SEQ ID NO: 3984963 - RNA, 16 nt, Staphylococcus aureus subsp. aureus Mu50
ucaguaaucuuguuuu

SEQ ID NO: 3984964 - RNA, 20 nt, Staphylococcus aureus subsp. aureus Mu50
ucaguaauuucuccaaguac

SEQ ID NO: 3984965 - RNA, 15 nt, Staphylococcus aureus subsp. aureus Mu50
ucaguaccauguuuu

SEQ ID NO: 3984966 - RNA, 17 nt, Staphylococcus aureus subsp. aureus Mu50
ucaguacgaacaacuaa

SEQ ID NO: 3984967 - RNA, 21 nt, Staphylococcus aureus subsp. aureus Mu50
ucaguacgguuauuuaauaau

SEQ ID NO: 3984968 - RNA, 23 nt, Staphylococcus aureus subsp. aureus Mu50
ucaguacgguuauuuaauaaugc

SEQ ID NO: 3984969 - RNA, 13 nt, Staphylococcus aureus subsp. aureus Mu50
ucaguaucauguu

SEQ ID NO: 3984970 - RNA, 18 nt, Staphylococcus aureus subsp. aureus Mu50
ucaguaucuaaauauuaa

SEQ ID NO: 3984971 - RNA, 23 nt, Staphylococcus aureus subsp. aureus Mu50
ucaguaucuaaauauuaaauuau

SEQ ID NO: 3984972 - RNA, 16 nt, Staphylococcus aureus subsp. aureus Mu50
ucagucaguaaaaaua

SEQ ID NO: 3984973 - RNA, 15 nt, Staphylococcus aureus subsp. aureus Mu50
ucagucauucacaua

SEQ ID NO: 3984974 - RNA, 21 nt, Staphylococcus aureus subsp. aureus Mu50
ucagucucuaaaacuuuuuca

SEQ ID NO: 3984975 - RNA, 13 nt, Staphylococcus aureus subsp. aureus Mu50
ucagugcauuuuu

SEQ ID NO: 3984976 - RNA, 23 nt, Staphylococcus aureus subsp. aureus Mu50
ucagugcauuuuuuauuuuacuu

SEQ ID NO: 3984977 - RNA, 14 nt, Staphylococcus aureus subsp. aureus Mu50
ucaguuaaaucuuu

SEQ ID NO: 3984978 - RNA, 16 nt, Staphylococcus aureus subsp. aureus Mu50
ucaguuaaaucuuuaa

SEQ ID NO: 3984979 - RNA, 13 nt, Staphylococcus aureus subsp. aureus Mu50
ucaguuaauaauu

SEQ ID NO: 3984980 - RNA, 17 nt, Staphylococcus aureus subsp. aureus Mu50
ucaguuagaagaugauu

SEQ ID NO: 3984981 - RNA, 22 nt, Staphylococcus aureus subsp. aureus Mu50
ucaguugagucaauuucuuuaa

SEQ ID NO: 3984982 - RNA, 16 nt, Staphylococcus aureus subsp. aureus Mu50
ucaguuuuuaaaucaa

SEQ ID NO: 3984983 - RNA, 13 nt, Staphylococcus aureus subsp. aureus Mu50
ucauaaaauacca

SEQ ID NO: 3984984 - RNA, 13 nt, Staphylococcus aureus subsp. aureus Mu50
ucauaaaauuuaa

SEQ ID NO: 3984985 - RNA, 18 nt, Staphylococcus aureus subsp. aureus Mu50
ucauaaaauuuaaaacaa

SEQ ID NO: 3984986 - RNA, 16 nt, Staphylococcus aureus subsp. aureus Mu50
ucauaaauauaaaaua

SEQ ID NO: 3984987 - RNA, 19 nt, Staphylococcus aureus subsp. aureus Mu50
ucauaaccgcuucuuuuaa

SEQ ID NO: 3984988 - RNA, 15 nt, Staphylococcus aureus subsp. aureus Mu50
ucauaaguuaaaguu

SEQ ID NO: 3984989 - RNA, 15 nt, Staphylococcus aureus subsp. aureus Mu50
ucauaauaauucagu

SEQ ID NO: 3984990 - RNA, 15 nt, Staphylococcus aureus subsp. aureus Mu50
ucauaauauugauga

SEQ ID NO: 3984991 - RNA, 16 nt, Staphylococcus aureus subsp. aureus Mu50
ucauaaugaacgauau

SEQ ID NO: 3984992 - RNA, 18 nt, Staphylococcus aureus subsp. aureus Mu50
ucauaaugaauaauuaaa

SEQ ID NO: 3984993 - RNA, 21 nt, Staphylococcus aureus subsp. aureus Mu50
ucauaaugaauaauuaaaaaa

SEQ ID NO: 3984994 - RNA, 17 nt, Staphylococcus aureus subsp. aureus Mu50
ucauaaugaucaaguag

SEQ ID NO: 3984995 - RNA, 21 nt, Staphylococcus aureus subsp. aureus Mu50
ucauaauguaagcgaauacaa

SEQ ID NO: 3984996 - RNA, 20 nt, Staphylococcus aureus subsp. aureus Mu50
ucauaauuaacacauucaaa

SEQ ID NO: 3984997 - RNA, 11 nt, Staphylococcus aureus subsp. aureus Mu50
ucauaauuaau

SEQ ID NO: 3984998 - RNA, 14 nt, Staphylococcus aureus subsp. aureus Mu50
ucauaauuaauaac

SEQ ID NO: 3984999 - RNA, 15 nt, Staphylococcus aureus subsp. aureus Mu50
ucauaauuuaaaaga

SEQ ID NO: 3985000 - RNA, 15 nt, Staphylococcus aureus subsp. aureus Mu50
ucauaauuuuguuuu

SEQ ID NO: 3985001 - RNA, 18 nt, Staphylococcus aureus subsp. aureus Mu50
ucauacacugcacaucau

SEQ ID NO: 3985002 - RNA, 19 nt, Staphylococcus aureus subsp. aureus Mu50
ucauaccaaaaacauuaac

SEQ ID NO: 3985003 - RNA, 18 nt, Staphylococcus aureus subsp. aureus Mu50
ucauaccaaauaaauaag

SEQ ID NO: 3985004 - RNA, 18 nt, Staphylococcus aureus subsp. aureus Mu50
ucauacgagaaauuagaa

SEQ ID NO: 3985005 - RNA, 22 nt, Staphylococcus aureus subsp. aureus Mu50
ucauacgcaaugauuauaaaua

SEQ ID NO: 3985006 - RNA, 16 nt, Staphylococcus aureus subsp. aureus Mu50
ucauacuauaagcaau

SEQ ID NO: 3985007 - RNA, 21 nt, Staphylococcus aureus subsp. aureus Mu50
ucauacuauaagcaauuucua

SEQ ID NO: 3985008 - RNA, 20 nt, Staphylococcus aureus subsp. aureus Mu50
ucauacuaucuacaauaacc

SEQ ID NO: 3985009 - RNA, 17 nt, Staphylococcus aureus subsp. aureus Mu50
ucauagaacaaaaugua

SEQ ID NO: 3985010 - RNA, 23 nt, Staphylococcus aureus subsp. aureus Mu50
ucauagacuacgcgauugacgug

SEQ ID NO: 3985011 - RNA, 20 nt, Staphylococcus aureus subsp. aureus Mu50
ucauagaugacgaucuauaa

SEQ ID NO: 3985012 - RNA, 16 nt, Staphylococcus aureus subsp. aureus Mu50
ucauaguauacauaau

SEQ ID NO: 3985013 - RNA, 14 nt, Staphylococcus aureus subsp. aureus Mu50
ucauaguuauuaaa

SEQ ID NO: 3985014 - RNA, 16 nt, Staphylococcus aureus subsp. aureus Mu50
ucauaguucaaauuga

SEQ ID NO: 3985015 - RNA, 20 nt, Staphylococcus aureus subsp. aureus Mu50
ucauaguucaaauugaacuu

SEQ ID NO: 3985016 - RNA, 21 nt, Staphylococcus aureus subsp. aureus Mu50
ucauauaaagucguaucauau

SEQ ID NO: 3985017 - RNA, 13 nt, Staphylococcus aureus subsp. aureus Mu50
ucauauaaauagc

SEQ ID NO: 3985018 - RNA, 20 nt, Staphylococcus aureus subsp. aureus Mu50
ucauauaaaucaaauauacu

SEQ ID NO: 3985019 - RNA, 22 nt, Staphylococcus aureus subsp. aureus Mu50
ucauauaaaucaaauauacuuu

SEQ ID NO: 3985020 - RNA, 14 nt, Staphylococcus aureus subsp. aureus Mu50
ucauauaaugaaug

SEQ ID NO: 3985021 - RNA, 19 nt, Staphylococcus aureus subsp. aureus Mu50
ucauauaaugguugaauaa

SEQ ID NO: 3985022 - RNA, 15 nt, Staphylococcus aureus subsp. aureus Mu50
ucauauaugauaaau

SEQ ID NO: 3985023 - RNA, 17 nt, Staphylococcus aureus subsp. aureus Mu50
ucauauaugauaaauau

SEQ ID NO: 3985024 - RNA, 17 nt, Staphylococcus aureus subsp. aureus Mu50
ucauauaugucucucuu

SEQ ID NO: 3985025 - RNA, 17 nt, Staphylococcus aureus subsp. aureus Mu50
ucauauauuuuguuaau

SEQ ID NO: 3985026 - RNA, 16 nt, Staphylococcus aureus subsp. aureus Mu50
ucauaucauaccaaaa

SEQ ID NO: 3985027 - RNA, 16 nt, Staphylococcus aureus subsp. aureus Mu50
ucauauccuucauuag

SEQ ID NO: 3985028 - RNA, 19 nt, Staphylococcus aureus subsp. aureus Mu50
ucauauccuucauuaguga

SEQ ID NO: 3985029 - RNA, 23 nt, Staphylococcus aureus subsp. aureus Mu50
ucauauccuucauuagugacaag

SEQ ID NO: 3985030 - RNA, 15 nt, Staphylococcus aureus subsp. aureus Mu50
ucauaucgauuaaua

SEQ ID NO: 3985031 - RNA, 17 nt, Staphylococcus aureus subsp. aureus Mu50
ucauaucgauuaauagu

SEQ ID NO: 3985032 - RNA, 11 nt, Staphylococcus aureus subsp. aureus Mu50
ucauaucuuua

SEQ ID NO: 3985033 - RNA, 17 nt, Staphylococcus aureus subsp. aureus Mu50
ucauaucuuuauuugau

SEQ ID NO: 3985034 - RNA, 15 nt, Staphylococcus aureus subsp. aureus Mu50
ucauauggaauacua

SEQ ID NO: 3985035 - RNA, 16 nt, Staphylococcus aureus subsp. aureus Mu50
ucauauggugaacugu

SEQ ID NO: 3985036 - RNA, 14 nt, Staphylococcus aureus subsp. aureus Mu50
ucauauucaaaaua

SEQ ID NO: 3985037 - RNA, 13 nt, Staphylococcus aureus subsp. aureus Mu50
ucauauucacauc

SEQ ID NO: 3985038 - RNA, 16 nt, Staphylococcus aureus subsp. aureus Mu50
ucauauucacaucuuu

SEQ ID NO: 3985039 - RNA, 18 nt, Staphylococcus aureus subsp. aureus Mu50
ucauauuuagguaauaca

SEQ ID NO: 3985040 - RNA, 21 nt, Staphylococcus aureus subsp. aureus Mu50
ucauauuuauauuuacacaga

SEQ ID NO: 3985041 - RNA, 22 nt, Staphylococcus aureus subsp. aureus Mu50
ucauauuuaucgcgauuauuac

SEQ ID NO: 3985042 - RNA, 17 nt, Staphylococcus aureus subsp. aureus Mu50
ucauauuugaauacuuu

SEQ ID NO: 3985043 - RNA, 14 nt, Staphylococcus aureus subsp. aureus Mu50
ucaucaaacaacau

SEQ ID NO: 3985044 - RNA, 18 nt, Staphylococcus aureus subsp. aureus Mu50
ucaucaaacaacaucacu

SEQ ID NO: 3985045 - RNA, 23 nt, Staphylococcus aureus subsp. aureus Mu50
ucaucaacacacacaguuuauaa

SEQ ID NO: 3985046 - RNA, 22 nt, Staphylococcus aureus subsp. aureus Mu50
ucaucaauaaauauugauucua

SEQ ID NO: 3985047 - RNA, 20 nt, Staphylococcus aureus subsp. aureus Mu50
ucaucaccauacuaaaacau

SEQ ID NO: 3985048 - RNA, 18 nt, Staphylococcus aureus subsp. aureus Mu50
ucaucacgugauaaugac

SEQ ID NO: 3985049 - RNA, 19 nt, Staphylococcus aureus subsp. aureus Mu50
ucaucacgugauaaugacu

SEQ ID NO: 3985050 - RNA, 16 nt, Staphylococcus aureus subsp. aureus Mu50
ucaucaugacuauuuc

SEQ ID NO: 3985051 - RNA, 20 nt, Staphylococcus aureus subsp. aureus Mu50
ucaucaugacuauuuuccau

SEQ ID NO: 3985052 - RNA, 22 nt, Staphylococcus aureus subsp. aureus Mu50
ucaucaugcauaaucaucauug

SEQ ID NO: 3985053 - RNA, 17 nt, Staphylococcus aureus subsp. aureus Mu50
ucaucaugugcuuuguu

SEQ ID NO: 3985054 - RNA, 13 nt, Staphylococcus aureus subsp. aureus Mu50
ucaucauguuuau

SEQ ID NO: 3985055 - RNA, 15 nt, Staphylococcus aureus subsp. aureus Mu50
ucaucauuaaaucug

SEQ ID NO: 3985056 - RNA, 13 nt, Staphylococcus aureus subsp. aureus Mu50
ucaucauuacgaa

SEQ ID NO: 3985057 - RNA, 17 nt, Staphylococcus aureus subsp. aureus Mu50
ucaucauuaguuuuuaa

SEQ ID NO: 3985058 - RNA, 19 nt, Staphylococcus aureus subsp. aureus Mu50
ucaucauuguaaaacaaau

SEQ ID NO: 3985059 - RNA, 16 nt, Staphylococcus aureus subsp. aureus Mu50
ucaucauuuaaauauu

SEQ ID NO: 3985060 - RNA, 13 nt, Staphylococcus aureus subsp. aureus Mu50
ucaucauuuucaa

SEQ ID NO: 3985061 - RNA, 22 nt, Staphylococcus aureus subsp. aureus Mu50
ucaucgaacaugaaugauauug

SEQ ID NO: 3985062 - RNA, 16 nt, Staphylococcus aureus subsp. aureus Mu50
ucaucgaguuuguuuc

SEQ ID NO: 3985063 - RNA, 17 nt, Staphylococcus aureus subsp. aureus Mu50
ucaucgucucacuuaau

SEQ ID NO: 3985064 - RNA, 14 nt, Staphylococcus aureus subsp. aureus Mu50
ucaucuaaaaugag

SEQ ID NO: 3985065 - RNA, 21 nt, Staphylococcus aureus subsp. aureus Mu50
ucaucuacuauuuaaucuuaa

SEQ ID NO: 3985066 - RNA, 19 nt, Staphylococcus aureus subsp. aureus Mu50
ucaucuauauuuaauuuug

SEQ ID NO: 3985067 - RNA, 23 nt, Staphylococcus aureus subsp. aureus Mu50
ucaucuauuauuauguuauaaau

SEQ ID NO: 3985068 - RNA, 18 nt, Staphylococcus aureus subsp. aureus Mu50
ucaucuauucaacugauu

SEQ ID NO: 3985069 - RNA, 22 nt, Staphylococcus aureus subsp. aureus Mu50
ucaucuauuuuuaacuaauaga

SEQ ID NO: 3985070 - RNA, 16 nt, Staphylococcus aureus subsp. aureus Mu50
ucaucugcuuguaaua

SEQ ID NO: 3985071 - RNA, 15 nt, Staphylococcus aureus subsp. aureus Mu50
ucaucugguauuuua

SEQ ID NO: 3985072 - RNA, 16 nt, Staphylococcus aureus subsp. aureus Mu50
ucaucuguaucaauca

SEQ ID NO: 3985073 - RNA, 20 nt, Staphylococcus aureus subsp. aureus Mu50
ucaucuuagacgcuguuuua

SEQ ID NO: 3985074 - RNA, 20 nt, Staphylococcus aureus subsp. aureus Mu50
ucaucuuaugacugcuuuuu

SEQ ID NO: 3985075 - RNA, 13 nt, Staphylococcus aureus subsp. aureus Mu50
ucaucuucuaaau

SEQ ID NO: 3985076 - RNA, 17 nt, Staphylococcus aureus subsp. aureus Mu50
ucaucuucuaaaucaau

SEQ ID NO: 3985077 - RNA, 19 nt, Staphylococcus aureus subsp. aureus Mu50
ucaucuucugaauuuaaua

SEQ ID NO: 3985078 - RNA, 14 nt, Staphylococcus aureus subsp. aureus Mu50
ucaucuugagauuu

SEQ ID NO: 3985079 - RNA, 17 nt, Staphylococcus aureus subsp. aureus Mu50
ucaucuugagauuuuca

SEQ ID NO: 3985080 - RNA, 18 nt, Staphylococcus aureus subsp. aureus Mu50
ucaucuugagauuuucaa

SEQ ID NO: 3985081 - RNA, 22 nt, Staphylococcus aureus subsp. aureus Mu50
ucaucuugcaaguauuuucuua

SEQ ID NO: 3985082 - RNA, 23 nt, Staphylococcus aureus subsp. aureus Mu50
ucaucuugcgccuuguucaauuc

SEQ ID NO: 3985083 - RNA, 13 nt, Staphylococcus aureus subsp. aureus Mu50
ucaucuuuaugca

SEQ ID NO: 3985084 - RNA, 17 nt, Staphylococcus aureus subsp. aureus Mu50
ucaucuuucaaaugcuu

SEQ ID NO: 3985085 - RNA, 22 nt, Staphylococcus aureus subsp. aureus Mu50
ucaucuuucacaauuguauaau

SEQ ID NO: 3985086 - RNA, 15 nt, Staphylococcus aureus subsp. aureus Mu50
ucaucuuuugucuua

SEQ ID NO: 3985087 - RNA, 18 nt, Staphylococcus aureus subsp. aureus Mu50
ucaugaaaauaagcauca

SEQ ID NO: 3985088 - RNA, 16 nt, Staphylococcus aureus subsp. aureus Mu50
ucaugaauaaauacaa

SEQ ID NO: 3985089 - RNA, 20 nt, Staphylococcus aureus subsp. aureus Mu50
ucaugaauaaauacaauguu

SEQ ID NO: 3985090 - RNA, 20 nt, Staphylococcus aureus subsp. aureus Mu50
ucaugacauaaaacuuacau

SEQ ID NO: 3985091 - RNA, 12 nt, Staphylococcus aureus subsp. aureus Mu50
ucaugagcacaa

SEQ ID NO: 3985092 - RNA, 15 nt, Staphylococcus aureus subsp. aureus Mu50
ucaugauuaauuaaa

SEQ ID NO: 3985093 - RNA, 13 nt, Staphylococcus aureus subsp. aureus Mu50
ucaugcaaaauaa

SEQ ID NO: 3985094 - RNA, 16 nt, Staphylococcus aureus subsp. aureus Mu50
ucaugcauaaucauca

SEQ ID NO: 3985095 - RNA, 19 nt, Staphylococcus aureus subsp. aureus Mu50
ucaugcauaaucaucauug

SEQ ID NO: 3985096 - RNA, 13 nt, Staphylococcus aureus subsp. aureus Mu50
ucaugccuucauu

SEQ ID NO: 3985097 - RNA, 15 nt, Staphylococcus aureus subsp. aureus Mu50
ucaugcuauuuaaau

SEQ ID NO: 3985098 - RNA, 17 nt, Staphylococcus aureus subsp. aureus Mu50
ucauggggcuuaugcau

SEQ ID NO: 3985099 - RNA, 20 nt, Staphylococcus aureus subsp. aureus Mu50
ucauguaaugcuuaaaaaca

SEQ ID NO: 3985100 - RNA, 22 nt, Staphylococcus aureus subsp. aureus Mu50
ucauguauauggcaucaucacc

SEQ ID NO: 3985101 - RNA, 18 nt, Staphylococcus aureus subsp. aureus Mu50
ucaugucuagauuuuaaa

SEQ ID NO: 3985102 - RNA, 22 nt, Staphylococcus aureus subsp. aureus Mu50
ucaugugcaagcuuuuuaggaa

SEQ ID NO: 3985103 - RNA, 12 nt, Staphylococcus aureus subsp. aureus Mu50
ucaugugcuuug

SEQ ID NO: 3985104 - RNA, 16 nt, Staphylococcus aureus subsp. aureus Mu50
ucaugugucauaaucc

SEQ ID NO: 3985105 - RNA, 17 nt, Staphylococcus aureus subsp. aureus Mu50
ucaugugucauaaucca

SEQ ID NO: 3985106 - RNA, 17 nt, Staphylococcus aureus subsp. aureus Mu50
ucauguucuaaugauau

SEQ ID NO: 3985107 - RNA, 19 nt, Staphylococcus aureus subsp. aureus Mu50
ucauguucuaaugauauuu

SEQ ID NO: 3985108 - RNA, 18 nt, Staphylococcus aureus subsp. aureus Mu50
ucauguucuuauaaaaaa

SEQ ID NO: 3985109 - RNA, 12 nt, Staphylococcus aureus subsp. aureus Mu50
ucauguuugauu

SEQ ID NO: 3985110 - RNA, 15 nt, Staphylococcus aureus subsp. aureus Mu50
ucauuaauaaauuga

SEQ ID NO: 3985111 - RNA, 21 nt, Staphylococcus aureus subsp. aureus Mu50
ucauuaauaaauugacucaaa

SEQ ID NO: 3985112 - RNA, 19 nt, Staphylococcus aureus subsp. aureus Mu50
ucauuaauaggauuauuau

SEQ ID NO: 3985113 - RNA, 15 nt, Staphylococcus aureus subsp. aureus Mu50
ucauuaauuuuucaa

SEQ ID NO: 3985114 - RNA, 16 nt, Staphylococcus aureus subsp. aureus Mu50
ucauuacaaagucugu

SEQ ID NO: 3985115 - RNA, 22 nt, Staphylococcus aureus subsp. aureus Mu50
ucauuacaaagucugucugaau

SEQ ID NO: 3985116 - RNA, 15 nt, Staphylococcus aureus subsp. aureus Mu50
ucauuacagauaauu

SEQ ID NO: 3985117 - RNA, 14 nt, Staphylococcus aureus subsp. aureus Mu50
ucauuacauuuuau

SEQ ID NO: 3985118 - RNA, 18 nt, Staphylococcus aureus subsp. aureus Mu50
ucauuagauaaaauaauu

SEQ ID NO: 3985119 - RNA, 20 nt, Staphylococcus aureus subsp. aureus Mu50
uccaagaaucucuaucauau

SEQ ID NO: 3985120 - RNA, 19 nt, Staphylococcus aureus subsp. aureus Mu50
uccaagagaauuaauaauu

SEQ ID NO: 3985121 - RNA, 19 nt, Staphylococcus aureus subsp. aureus Mu50
uccaagauuaugacaacau

SEQ ID NO: 3985122 - RNA, 22 nt, Staphylococcus aureus subsp. aureus Mu50
uccaagcgcuucaggcauaacu

SEQ ID NO: 3985123 - RNA, 19 nt, Staphylococcus aureus subsp. aureus Mu50
uccaaggauguuauaaaau

SEQ ID NO: 3985124 - RNA, 22 nt, Staphylococcus aureus subsp. aureus Mu50
uccaaggauguuauaaaaugaa

SEQ ID NO: 3985125 - RNA, 19 nt, Staphylococcus aureus subsp. aureus Mu50
uccaaguacacgaauacca

SEQ ID NO: 3985126 - RNA, 15 nt, Staphylococcus aureus subsp. aureus Mu50
uccaagugacaacau

SEQ ID NO: 3985127 - RNA, 19 nt, Staphylococcus aureus subsp. aureus Mu50
uccaagugacaacauuauu

SEQ ID NO: 3985128 - RNA, 20 nt, Staphylococcus aureus subsp. aureus Mu50
uccaauaaauuguggagauc

SEQ ID NO: 3985129 - RNA, 16 nt, Staphylococcus aureus subsp. aureus Mu50
uccaaucaacuucaua

SEQ ID NO: 3985130 - RNA, 22 nt, Staphylococcus aureus subsp. aureus Mu50
uccaaucaacuucauauaaugc

SEQ ID NO: 3985131 - RNA, 15 nt, Staphylococcus aureus subsp. aureus Mu50
uccaaucuauuaaug

SEQ ID NO: 3985132 - RNA, 17 nt, Staphylococcus aureus subsp. aureus Mu50
uccaaucuuuuuaauug

SEQ ID NO: 3985133 - RNA, 17 nt, Staphylococcus aureus subsp. aureus Mu50
uccaaugcaauugguag

SEQ ID NO: 3985134 - RNA, 15 nt, Staphylococcus aureus subsp. aureus Mu50
uccaauuaaauauuu

SEQ ID NO: 3985135 - RNA, 15 nt, Staphylococcus aureus subsp. aureus Mu50
uccaauuaccaauga

SEQ ID NO: 3985136 - RNA, 18 nt, Staphylococcus aureus subsp. aureus Mu50
uccaauuaccaaugaaua

SEQ ID NO: 3985137 - RNA, 15 nt, Staphylococcus aureus subsp. aureus Mu50
uccaauuauguuuau

SEQ ID NO: 3985138 - RNA, 16 nt, Staphylococcus aureus subsp. aureus Mu50
uccaauuauguuuauc

SEQ ID NO: 3985139 - RNA, 12 nt, Staphylococcus aureus subsp. aureus Mu50
uccaauuccaau

SEQ ID NO: 3985140 - RNA, 12 nt, Staphylococcus aureus subsp. aureus Mu50
uccaauuuaaaa

SEQ ID NO: 3985141 - RNA, 15 nt, Staphylococcus aureus subsp. aureus Mu50
uccaauuuaaaauga

SEQ ID NO: 3985142 - RNA, 12 nt, Staphylococcus aureus subsp. aureus Mu50
uccaauuucaag

SEQ ID NO: 3985143 - RNA, 13 nt, Staphylococcus aureus subsp. aureus Mu50
uccacagaauuag

SEQ ID NO: 3985144 - RNA, 22 nt, Staphylococcus aureus subsp. aureus Mu50
uccaccugauaacgagcuaaua

SEQ ID NO: 3985145 - RNA, 13 nt, Staphylococcus aureus subsp. aureus Mu50
uccacgcucacau

SEQ ID NO: 3985146 - RNA, 15 nt, Staphylococcus aureus subsp. aureus Mu50
uccacgcucacauua

SEQ ID NO: 3985147 - RNA, 15 nt, Staphylococcus aureus subsp. aureus Mu50
uccacuucaucuaaa

SEQ ID NO: 3985148 - RNA, 13 nt, Staphylococcus aureus subsp. aureus Mu50
uccacuuuauaau

SEQ ID NO: 3985149 - RNA, 17 nt, Staphylococcus aureus subsp. aureus Mu50
uccagaguuaaagucau

SEQ ID NO: 3985150 - RNA, 17 nt, Staphylococcus aureus subsp. aureus Mu50
uccagcagucauuugau

SEQ ID NO: 3985151 - RNA, 23 nt, Staphylococcus aureus subsp. aureus Mu50
uccaguggaaaugauaauuuaau

SEQ ID NO: 3985152 - RNA, 19 nt, Staphylococcus aureus subsp. aureus Mu50
uccaguuuauaacugggau

SEQ ID NO: 3985153 - RNA, 14 nt, Staphylococcus aureus subsp. aureus Mu50
uccaguuuucaauu

SEQ ID NO: 3985154 - RNA, 16 nt, Staphylococcus aureus subsp. aureus Mu50
uccauaaauaaaaugc

SEQ ID NO: 3985155 - RNA, 11 nt, Staphylococcus aureus subsp. aureus Mu50
uccauaaauau

SEQ ID NO: 3985156 - RNA, 13 nt, Staphylococcus aureus subsp. aureus Mu50
uccauaaauauua

SEQ ID NO: 3985157 - RNA, 17 nt, Staphylococcus aureus subsp. aureus Mu50
uccauaaauauuaaauu

SEQ ID NO: 3985158 - RNA, 18 nt, Staphylococcus aureus subsp. aureus Mu50
uccauaacuguaguuucu

SEQ ID NO: 3985159 - RNA, 18 nt, Staphylococcus aureus subsp. aureus Mu50
uccauaagucacauuuau

SEQ ID NO: 3985160 - RNA, 17 nt, Staphylococcus aureus subsp. aureus Mu50
uccauaaucuuuauuaa

SEQ ID NO: 3985161 - RNA, 18 nt, Staphylococcus aureus subsp. aureus Mu50
uccauaaucuuuauuaau

SEQ ID NO: 3985162 - RNA, 21 nt, Staphylococcus aureus subsp. aureus Mu50
uccauaaucuuuauuaauaaa

SEQ ID NO: 3985163 - RNA, 22 nt, Staphylococcus aureus subsp. aureus Mu50
uccauacaaaucguaaacauaa

SEQ ID NO: 3985164 - RNA, 21 nt, Staphylococcus aureus subsp. aureus Mu50
uccauacguuccuaaagucgu

SEQ ID NO: 3985165 - RNA, 21 nt, Staphylococcus aureus subsp. aureus Mu50
uccauacuucuauuuuauaau

SEQ ID NO: 3985166 - RNA, 15 nt, Staphylococcus aureus subsp. aureus Mu50
uccauaggauucuua

SEQ ID NO: 3985167 - RNA, 18 nt, Staphylococcus aureus subsp. aureus Mu50
uccauaguggaauacuug

SEQ ID NO: 3985168 - RNA, 17 nt, Staphylococcus aureus subsp. aureus Mu50
uccauauaaccuauuuc

SEQ ID NO: 3985169 - RNA, 19 nt, Staphylococcus aureus subsp. aureus Mu50
uccaucgucaucacuuuuu

SEQ ID NO: 3985170 - RNA, 21 nt, Staphylococcus aureus subsp. aureus Mu50
uccaugaguuuacuaaacuuu

SEQ ID NO: 3985171 - RNA, 13 nt, Staphylococcus aureus subsp. aureus Mu50
uccauguauuuuu

SEQ ID NO: 3985172 - RNA, 14 nt, Staphylococcus aureus subsp. aureus Mu50
uccauuaaguuauc

SEQ ID NO: 3985173 - RNA, 22 nt, Staphylococcus aureus subsp. aureus Mu50
uccauuagaacuaagaugugca

SEQ ID NO: 3985174 - RNA, 13 nt, Staphylococcus aureus subsp. aureus Mu50
uccauuauauagu

SEQ ID NO: 3985175 - RNA, 20 nt, Staphylococcus aureus subsp. aureus Mu50
uccauucaaaguauauacua

SEQ ID NO: 3985176 - RNA, 17 nt, Staphylococcus aureus subsp. aureus Mu50
uccauucaauguuuaau

SEQ ID NO: 3985177 - RNA, 22 nt, Staphylococcus aureus subsp. aureus Mu50
uccauucaauguuuaauuuucu

SEQ ID NO: 3985178 - RNA, 17 nt, Staphylococcus aureus subsp. aureus Mu50
uccauucguauaagaau

SEQ ID NO: 3985179 - RNA, 15 nt, Staphylococcus aureus subsp. aureus Mu50
uccauuuaucaacaa

SEQ ID NO: 3985180 - RNA, 19 nt, Staphylococcus aureus subsp. aureus Mu50
uccauuuucuuuuuuuaug

SEQ ID NO: 3985181 - RNA, 21 nt, Staphylococcus aureus subsp. aureus Mu50
ucccaaagcgaauuaucuuua

SEQ ID NO: 3985182 - RNA, 14 nt, Staphylococcus aureus subsp. aureus Mu50
ucccaacuuaauaa

SEQ ID NO: 3985183 - RNA, 21 nt, Staphylococcus aureus subsp. aureus Mu50
ucccaaugcugaauaaauaac

SEQ ID NO: 3985184 - RNA, 15 nt, Staphylococcus aureus subsp. aureus Mu50
ucccacgugccucau

SEQ ID NO: 3985185 - RNA, 19 nt, Staphylococcus aureus subsp. aureus Mu50
ucccacgugccucauccuu

SEQ ID NO: 3985186 - RNA, 21 nt, Staphylococcus aureus subsp. aureus Mu50
ucccacucccuaauaacugag

SEQ ID NO: 3985187 - RNA, 21 nt, Staphylococcus aureus subsp. aureus Mu50
ucccagauucauaucuuucaa

SEQ ID NO: 3985188 - RNA, 23 nt, Staphylococcus aureus subsp. aureus Mu50
ucccagauucauaucuuucaauu

SEQ ID NO: 3985189 - RNA, 19 nt, Staphylococcus aureus subsp. aureus Mu50
ucccauaaaagacagaaau

SEQ ID NO: 3985190 - RNA, 17 nt, Staphylococcus aureus subsp. aureus Mu50
ucccauaacaaaaacau

SEQ ID NO: 3985191 - RNA, 17 nt, Staphylococcus aureus subsp. aureus Mu50
ucccauuggcauuuacg

SEQ ID NO: 3985192 - RNA, 14 nt, Staphylococcus aureus subsp. aureus Mu50
ucccauuuuuaaaa

SEQ ID NO: 3985193 - RNA, 19 nt, Staphylococcus aureus subsp. aureus Mu50
uccccauuaauuaacaaag

SEQ ID NO: 3985194 - RNA, 16 nt, Staphylococcus aureus subsp. aureus Mu50
uccccauuuauguguu

SEQ ID NO: 3985195 - RNA, 21 nt, Staphylococcus aureus subsp. aureus Mu50
ucccgaaaguuagacuaaaaa

SEQ ID NO: 3985196 - RNA, 22 nt, Staphylococcus aureus subsp. aureus Mu50
ucccgaaaguuagacuaaaaaa

SEQ ID NO: 3985197 - RNA, 18 nt, Staphylococcus aureus subsp. aureus Mu50
ucccgcauuauuauuaaa

SEQ ID NO: 3985198 - RNA, 12 nt, Staphylococcus aureus subsp. aureus Mu50
ucccuaugaaau

SEQ ID NO: 3985199 - RNA, 21 nt, Staphylococcus aureus subsp. aureus Mu50
ucccucuaucaaauuaccauu

SEQ ID NO: 3985200 - RNA, 23 nt, Staphylococcus aureus subsp. aureus Mu50
ucccucuaucaaauuaccauuca

SEQ ID NO: 3985201 - RNA, 17 nt, Staphylococcus aureus subsp. aureus Mu50
ucccuggaaaaugauuc

SEQ ID NO: 3985202 - RNA, 20 nt, Staphylococcus aureus subsp. aureus Mu50
ucccuuaaauacaauuucuu

SEQ ID NO: 3985203 - RNA, 21 nt, Staphylococcus aureus subsp. aureus Mu50
ucccuuaaauacaauuucuuc

SEQ ID NO: 3985204 - RNA, 22 nt, Staphylococcus aureus subsp. aureus Mu50
ucccuuaaaucaaguauaucuu

SEQ ID NO: 3985205 - RNA, 11 nt, Staphylococcus aureus subsp. aureus Mu50
ucccuuaauaa

SEQ ID NO: 3985206 - RNA, 16 nt, Staphylococcus aureus subsp. aureus Mu50
ucgaacuaucaauaua

SEQ ID NO: 3985207 - RNA, 14 nt, Staphylococcus aureus subsp. aureus Mu50
ucgaacuuuuguuc

SEQ ID NO: 3985208 - RNA, 16 nt, Staphylococcus aureus subsp. aureus Mu50
ucgaacuuuuguucua

SEQ ID NO: 3985209 - RNA, 22 nt, Staphylococcus aureus subsp. aureus Mu50
ucgaacuuuuguucuaaguguu

SEQ ID NO: 3985210 - RNA, 17 nt, Staphylococcus aureus subsp. aureus Mu50
ucgaauaacuguuuauc

SEQ ID NO: 3985211 - RNA, 20 nt, Staphylococcus aureus subsp. aureus Mu50
ucgaauaacuguuuaucaug

SEQ ID NO: 3985212 - RNA, 22 nt, Staphylococcus aureus subsp. aureus Mu50
ucgaauguauugcuauaagaac

SEQ ID NO: 3985213 - RNA, 14 nt, Staphylococcus aureus subsp. aureus Mu50
ucgaauguuucuuc

SEQ ID NO: 3985214 - RNA, 23 nt, Staphylococcus aureus subsp. aureus Mu50
ucgaauguuucuucguuagugau

SEQ ID NO: 3985215 - RNA, 15 nt, Staphylococcus aureus subsp. aureus Mu50
ucgacaauugcgacc

SEQ ID NO: 3985216 - RNA, 13 nt, Staphylococcus aureus subsp. aureus Mu50
ucgacaucuagau

SEQ ID NO: 3985217 - RNA, 19 nt, Staphylococcus aureus subsp. aureus Mu50
ucgacaucuagaugaaauu

SEQ ID NO: 3985218 - RNA, 20 nt, Staphylococcus aureus subsp. aureus Mu50
ucgacaucuagaugaaauug

SEQ ID NO: 3985219 - RNA, 20 nt, Staphylococcus aureus subsp. aureus Mu50
ucgacuaauuuuucuuucag

SEQ ID NO: 3985220 - RNA, 22 nt, Staphylococcus aureus subsp. aureus Mu50
ucgacuaauuuuucuuucaggc

SEQ ID NO: 3985221 - RNA, 14 nt, Staphylococcus aureus subsp. aureus Mu50
ucgacucaaacaau

SEQ ID NO: 3985222 - RNA, 20 nt, Staphylococcus aureus subsp. aureus Mu50
ucgagcuaggguuaaaauua

SEQ ID NO: 3985223 - RNA, 14 nt, Staphylococcus aureus subsp. aureus Mu50
ucgaguaauacuuu

SEQ ID NO: 3985224 - RNA, 17 nt, Staphylococcus aureus subsp. aureus Mu50
ucgaguagcccuauuuu

SEQ ID NO: 3985225 - RNA, 14 nt, Staphylococcus aureus subsp. aureus Mu50
ucgaguuuguuucu

SEQ ID NO: 3985226 - RNA, 23 nt, Staphylococcus aureus subsp. aureus Mu50
ucgaguuuguuucuaaauucuuu

SEQ ID NO: 3985227 - RNA, 13 nt, Staphylococcus aureus subsp. aureus Mu50
ucgauaaguuuuu

SEQ ID NO: 3985228 - RNA, 23 nt, Staphylococcus aureus subsp. aureus Mu50
ucgauaaguuuuugaauaucuaa

SEQ ID NO: 3985229 - RNA, 14 nt, Staphylococcus aureus subsp. aureus Mu50
ucgauaauauaacu

SEQ ID NO: 3985230 - RNA, 17 nt, Staphylococcus aureus subsp. aureus Mu50
ucgauaccuaaaauacc

SEQ ID NO: 3985231 - RNA, 21 nt, Staphylococcus aureus subsp. aureus Mu50
ucgauacuaaacgauaaauua

SEQ ID NO: 3985232 - RNA, 19 nt, Staphylococcus aureus subsp. aureus Mu50
ucgauaguucuauauaauu

SEQ ID NO: 3985233 - RNA, 13 nt, Staphylococcus aureus subsp. aureus Mu50
ucgauauuucuag

SEQ ID NO: 3985234 - RNA, 15 nt, Staphylococcus aureus subsp. aureus Mu50
ucgauauuuguuucg

SEQ ID NO: 3985235 - RNA, 15 nt, Staphylococcus aureus subsp. aureus Mu50
ucgaucuaaauauau

SEQ ID NO: 3985236 - RNA, 16 nt, Staphylococcus aureus subsp. aureus Mu50
ucgaugacuuugucuu

SEQ ID NO: 3985237 - RNA, 17 nt, Staphylococcus aureus subsp. aureus Mu50
ucgaugacuuugucuuu

SEQ ID NO: 3985238 - RNA, 15 nt, Staphylococcus aureus subsp. aureus Mu50
ucgaugacuuuuuaa

SEQ ID NO: 3985239 - RNA, 16 nt, Staphylococcus aureus subsp. aureus Mu50
ucgaugacuuuuuaau

SEQ ID NO: 3985240 - RNA, 22 nt, Staphylococcus aureus subsp. aureus Mu50
ucgaugcuaaaaauauugaaua

SEQ ID NO: 3985241 - RNA, 22 nt, Staphylococcus aureus subsp. aureus Mu50
ucgauggcuugguuauuuucaa

SEQ ID NO: 3985242 - RNA, 15 nt, Staphylococcus aureus subsp. aureus Mu50
ucgauuaauuuaauu

SEQ ID NO: 3985243 - RNA, 15 nt, Staphylococcus aureus subsp. aureus Mu50
ucgauuaauuuucuu

SEQ ID NO: 3985244 - RNA, 19 nt, Staphylococcus aureus subsp. aureus Mu50
ucgauuauucuuaauuuaa

SEQ ID NO: 3985245 - RNA, 20 nt, Staphylococcus aureus subsp. aureus Mu50
ucgauuauuuagauaaaaau

SEQ ID NO: 3985246 - RNA, 18 nt, Staphylococcus aureus subsp. aureus Mu50
ucgauucauaaaauuuaa

SEQ ID NO: 3985247 - RNA, 15 nt, Staphylococcus aureus subsp. aureus Mu50
ucgauucgauuauuu

SEQ ID NO: 3985248 - RNA, 16 nt, Staphylococcus aureus subsp. aureus Mu50
ucgauugcguuuucua

SEQ ID NO: 3985249 - RNA, 16 nt, Staphylococcus aureus subsp. aureus Mu50
ucgauugguaaaucua

SEQ ID NO: 3985250 - RNA, 14 nt, Staphylococcus aureus subsp. aureus Mu50
ucgauuuaacauaa

SEQ ID NO: 3985251 - RNA, 15 nt, Staphylococcus aureus subsp. aureus Mu50
ucgauuuaucauuau

SEQ ID NO: 3985252 - RNA, 13 nt, Staphylococcus aureus subsp. aureus Mu50
ucgauuuuuuaau

SEQ ID NO: 3985253 - RNA, 18 nt, Staphylococcus aureus subsp. aureus Mu50
ucgcaaauacauaaucau

SEQ ID NO: 3985254 - RNA, 23 nt, Staphylococcus aureus subsp. aureus Mu50
ucgcaccgucaaacuuaaaacua

SEQ ID NO: 3985255 - RNA, 15 nt, Staphylococcus aureus subsp. aureus Mu50
ucgcagcuucuuuaa

SEQ ID NO: 3985256 - RNA, 14 nt, Staphylococcus aureus subsp. aureus Mu50
ucgcauauuuugau

SEQ ID NO: 3985257 - RNA, 21 nt, Staphylococcus aureus subsp. aureus Mu50
ucgcaucguucccugcagcaa

SEQ ID NO: 3985258 - RNA, 22 nt, Staphylococcus aureus subsp. aureus Mu50
ucgcaucuguuaacugaauuuc

SEQ ID NO: 3985259 - RNA, 14 nt, Staphylococcus aureus subsp. aureus Mu50
ucgcccuugccugu

SEQ ID NO: 3985260 - RNA, 21 nt, Staphylococcus aureus subsp. aureus Mu50
ucgcccuuuagccaaugcuuc

SEQ ID NO: 3985261 - RNA, 14 nt, Staphylococcus aureus subsp. aureus Mu50
ucgccuacuauaaa

SEQ ID NO: 3985262 - RNA, 17 nt, Staphylococcus aureus subsp. aureus Mu50
ucgccuacuauaaauac

SEQ ID NO: 3985263 - RNA, 19 nt, Staphylococcus aureus subsp. aureus Mu50
ucgcgaacguuauuuucaa

SEQ ID NO: 3985264 - RNA, 19 nt, Staphylococcus aureus subsp. aureus Mu50
ucgcgaccguguuguugaa

SEQ ID NO: 3985265 - RNA, 17 nt, Staphylococcus aureus subsp. aureus Mu50
ucgcgcaucaaaaauga

SEQ ID NO: 3985266 - RNA, 21 nt, Staphylococcus aureus subsp. aureus Mu50
ucgcuaaauuuauauagucua

SEQ ID NO: 3985267 - RNA, 14 nt, Staphylococcus aureus subsp. aureus Mu50
ucgcucuagacauu

SEQ ID NO: 3985268 - RNA, 15 nt, Staphylococcus aureus subsp. aureus Mu50
ucgcugcuacaccac

SEQ ID NO: 3985269 - RNA, 17 nt, Staphylococcus aureus subsp. aureus Mu50
ucgcugcuacaccaccu

SEQ ID NO: 3985270 - RNA, 16 nt, Staphylococcus aureus subsp. aureus Mu50
ucgcuuccaaugaauc

SEQ ID NO: 3985271 - RNA, 15 nt, Staphylococcus aureus subsp. aureus Mu50
ucgcuugauuaauuu

SEQ ID NO: 3985272 - RNA, 21 nt, Staphylococcus aureus subsp. aureus Mu50
ucgcuugcaaagacucaauuu

SEQ ID NO: 3985273 - RNA, 17 nt, Staphylococcus aureus subsp. aureus Mu50
ucgcuuguaacaagcuu

SEQ ID NO: 3985274 - RNA, 19 nt, Staphylococcus aureus subsp. aureus Mu50
ucgcuuucauaccuugauu

SEQ ID NO: 3985275 - RNA, 23 nt, Staphylococcus aureus subsp. aureus Mu50
ucgcuuuuuuuauuuuucuuuuu

SEQ ID NO: 3985276 - RNA, 18 nt, Staphylococcus aureus subsp. aureus Mu50
ucggaaaaagaugaaaaa

SEQ ID NO: 3985277 - RNA, 19 nt, Staphylococcus aureus subsp. aureus Mu50
ucggaaaaagaugaaaaag

SEQ ID NO: 3985278 - RNA, 22 nt, Staphylococcus aureus subsp. aureus Mu50
ucggaagcauauuucuaaauua

SEQ ID NO: 3985279 - RNA, 14 nt, Staphylococcus aureus subsp. aureus Mu50
ucggaauaaaauaa

SEQ ID NO: 3985280 - RNA, 22 nt, Staphylococcus aureus subsp. aureus Mu50
ucggacagaugaguauacugaa

SEQ ID NO: 3985281 - RNA, 16 nt, Staphylococcus aureus subsp. aureus Mu50
ucggauuaaaaguauc

SEQ ID NO: 3985282 - RNA, 17 nt, Staphylococcus aureus subsp. aureus Mu50
ucggauuauauuuagau

SEQ ID NO: 3985283 - RNA, 22 nt, Staphylococcus aureus subsp. aureus Mu50
ucggauugaaccggaaauuaaa

SEQ ID NO: 3985284 - RNA, 21 nt, Staphylococcus aureus subsp. aureus Mu50
ucggauugagggauuuuuaua

SEQ ID NO: 3985285 - RNA, 18 nt, Staphylococcus aureus subsp. aureus Mu50
ucggcaccauaucaaguu

SEQ ID NO: 3985286 - RNA, 21 nt, Staphylococcus aureus subsp. aureus Mu50
ucggcaugaugcgcuucuaac

SEQ ID NO: 3985287 - RNA, 19 nt, Staphylococcus aureus subsp. aureus Mu50
ucggcuaaaguuauaaauu

SEQ ID NO: 3985288 - RNA, 13 nt, Staphylococcus aureus subsp. aureus Mu50
ucggcucucgcuu

SEQ ID NO: 3985289 - RNA, 13 nt, Staphylococcus aureus subsp. aureus Mu50
ucggcuuucuaag

SEQ ID NO: 3985290 - RNA, 16 nt, Staphylococcus aureus subsp. aureus Mu50
ucggcuuuguaaaauu

SEQ ID NO: 3985291 - RNA, 22 nt, Staphylococcus aureus subsp. aureus Mu50
ucgguacauuuaauggucuaau

SEQ ID NO: 3985292 - RNA, 19 nt, Staphylococcus aureus subsp. aureus Mu50
ucgguauucaauucuguga

SEQ ID NO: 3985293 - RNA, 16 nt, Staphylococcus aureus subsp. aureus Mu50
ucuaacuuaccaugau

SEQ ID NO: 3985294 - RNA, 21 nt, Staphylococcus aureus subsp. aureus Mu50
ucuaacuuuaccaauaucaug

SEQ ID NO: 3985295 - RNA, 13 nt, Staphylococcus aureus subsp. aureus Mu50
ucuaagaguugaa

SEQ ID NO: 3985296 - RNA, 14 nt, Staphylococcus aureus subsp. aureus Mu50
ucuaagauacguug

SEQ ID NO: 3985297 - RNA, 15 nt, Staphylococcus aureus subsp. aureus Mu50
ucuaagauguguuga

SEQ ID NO: 3985298 - RNA, 14 nt, Staphylococcus aureus subsp. aureus Mu50
ucuaaguaauauaa

SEQ ID NO: 3985299 - RNA, 23 nt, Staphylococcus aureus subsp. aureus Mu50
ucuaagucucuugucauuucaau

SEQ ID NO: 3985300 - RNA, 16 nt, Staphylococcus aureus subsp. aureus Mu50
ucuaauacaaaccuau

SEQ ID NO: 3985301 - RNA, 16 nt, Staphylococcus aureus subsp. aureus Mu50
ucuaauacauacugau

SEQ ID NO: 3985302 - RNA, 21 nt, Staphylococcus aureus subsp. aureus Mu50
ucuaauacauacugauuaaac

SEQ ID NO: 3985303 - RNA, 20 nt, Staphylococcus aureus subsp. aureus Mu50
ucuaauacuuucaaacaaau

SEQ ID NO: 3985304 - RNA, 15 nt, Staphylococcus aureus subsp. aureus Mu50
ucuaauacuuucacu

SEQ ID NO: 3985305 - RNA, 14 nt, Staphylococcus aureus subsp. aureus Mu50
ucuaauccaaaaua

SEQ ID NO: 3985306 - RNA, 16 nt, Staphylococcus aureus subsp. aureus Mu50
ucuaauccaaaauaau

SEQ ID NO: 3985307 - RNA, 18 nt, Staphylococcus aureus subsp. aureus Mu50
ucuaauccaaaauaaucg

SEQ ID NO: 3985308 - RNA, 19 nt, Staphylococcus aureus subsp. aureus Mu50
ucuaaugaucaucuauauu

SEQ ID NO: 3985309 - RNA, 22 nt, Staphylococcus aureus subsp. aureus Mu50
ucuaaugauuaaaaaucaaaga

SEQ ID NO: 3985310 - RNA, 22 nt, Staphylococcus aureus subsp. aureus Mu50
ucuaaugcaacuugaucauuau

SEQ ID NO: 3985311 - RNA, 23 nt, Staphylococcus aureus subsp. aureus Mu50
ucuaaugcaacuugaucauuaua

SEQ ID NO: 3985312 - RNA, 20 nt, Staphylococcus aureus subsp. aureus Mu50
ucuaaugggucaaugacuga

SEQ ID NO: 3985313 - RNA, 23 nt, Staphylococcus aureus subsp. aureus Mu50
ucuaauuaaacgcucaacuauau

SEQ ID NO: 3985314 - RNA, 17 nt, Staphylococcus aureus subsp. aureus Mu50
ucuaauuauucaugaau

SEQ ID NO: 3985315 - RNA, 18 nt, Staphylococcus aureus subsp. aureus Mu50
ucuaauuauucaugaauc

SEQ ID NO: 3985316 - RNA, 14 nt, Staphylococcus aureus subsp. aureus Mu50
ucuaauucaaugau

SEQ ID NO: 3985317 - RNA, 21 nt, Staphylococcus aureus subsp. aureus Mu50
ucuaauucaaugauuuuuaaa

SEQ ID NO: 3985318 - RNA, 22 nt, Staphylococcus aureus subsp. aureus Mu50
ucuaauucguuuugcuaaccau

SEQ ID NO: 3985319 - RNA, 14 nt, Staphylococcus aureus subsp. aureus Mu50
ucuaauucugaaau

SEQ ID NO: 3985320 - RNA, 15 nt, Staphylococcus aureus subsp. aureus Mu50
ucuaauuguuguaau

SEQ ID NO: 3985321 - RNA, 13 nt, Staphylococcus aureus subsp. aureus Mu50
ucuaauuucacaa

SEQ ID NO: 3985322 - RNA, 21 nt, Staphylococcus aureus subsp. aureus Mu50
ucuaauuucuuagauuuuaua

SEQ ID NO: 3985323 - RNA, 22 nt, Staphylococcus aureus subsp. aureus Mu50
ucuaauuucuuagauuuuauau

SEQ ID NO: 3985324 - RNA, 20 nt, Staphylococcus aureus subsp. aureus Mu50
ucuaauuugcaaaaucaacc

SEQ ID NO: 3985325 - RNA, 14 nt, Staphylococcus aureus subsp. aureus Mu50
ucuacaacuucauu

SEQ ID NO: 3985326 - RNA, 20 nt, Staphylococcus aureus subsp. aureus Mu50
ucuacaacuucauuaguugc

SEQ ID NO: 3985327 - RNA, 18 nt, Staphylococcus aureus subsp. aureus Mu50
ucuacaauaaccauuuca

SEQ ID NO: 3985328 - RNA, 16 nt, Staphylococcus aureus subsp. aureus Mu50
ucuacaauauuaaaau

SEQ ID NO: 3985329 - RNA, 18 nt, Staphylococcus aureus subsp. aureus Mu50
ucuacaauauuaaaauua

SEQ ID NO: 3985330 - RNA, 19 nt, Staphylococcus aureus subsp. aureus Mu50
ucuacaauauuaaaauuaa

SEQ ID NO: 3985331 - RNA, 22 nt, Staphylococcus aureus subsp. aureus Mu50
ucuacaauauuaaaauuaaaac

SEQ ID NO: 3985332 - RNA, 23 nt, Staphylococcus aureus subsp. aureus Mu50
ucuacacccauuugucuuaauuu

SEQ ID NO: 3985333 - RNA, 12 nt, Staphylococcus aureus subsp. aureus Mu50
ucuacagcacug

SEQ ID NO: 3985334 - RNA, 21 nt, Staphylococcus aureus subsp. aureus Mu50
ucuacagcaucaccuaaagcu

SEQ ID NO: 3985335 - RNA, 11 nt, Staphylococcus aureus subsp. aureus Mu50
ucuacagguaa

SEQ ID NO: 3985336 - RNA, 16 nt, Staphylococcus aureus subsp. aureus Mu50
ucuacagguaaugcaa

SEQ ID NO: 3985337 - RNA, 18 nt, Staphylococcus aureus subsp. aureus Mu50
ucuacagguaaugcaagu

SEQ ID NO: 3985338 - RNA, 22 nt, Staphylococcus aureus subsp. aureus Mu50
ucuacagguaaugcaaguuggg

SEQ ID NO: 3985339 - RNA, 21 nt, Staphylococcus aureus subsp. aureus Mu50
ucuacauauuggcuugcuuca

SEQ ID NO: 3985340 - RNA, 13 nt, Staphylococcus aureus subsp. aureus Mu50
ucuacauuaaaga

SEQ ID NO: 3985341 - RNA, 24 nt, Staphylococcus aureus subsp. aureus Mu50
ucuacauuaaagaaaauaucugaa

SEQ ID NO: 3985342 - RNA, 17 nt, Staphylococcus aureus subsp. aureus Mu50
ucuaccaauaauucccu

SEQ ID NO: 3985343 - RNA, 16 nt, Staphylococcus aureus subsp. aureus Mu50
ucuaccaauacguuuc

SEQ ID NO: 3985344 - RNA, 22 nt, Staphylococcus aureus subsp. aureus Mu50
ucuacccauaauuuaaaugaua

SEQ ID NO: 3985345 - RNA, 19 nt, Staphylococcus aureus subsp. aureus Mu50
ucuacuaaagagaaucgaa

SEQ ID NO: 3985346 - RNA, 21 nt, Staphylococcus aureus subsp. aureus Mu50
ucuacuaagugccauugaaaa

SEQ ID NO: 3985347 - RNA, 18 nt, Staphylococcus aureus subsp. aureus Mu50
ucuacuauuuaaucuuaa

SEQ ID NO: 3985348 - RNA, 13 nt, Staphylococcus aureus subsp. aureus Mu50
ucuacuucguuua

SEQ ID NO: 3985349 - RNA, 12 nt, Staphylococcus aureus subsp. aureus Mu50
ucuagaauauaa

SEQ ID NO: 3985350 - RNA, 15 nt, Staphylococcus aureus subsp. aureus Mu50
ucuagagauaacuag

SEQ ID NO: 3985351 - RNA, 15 nt, Staphylococcus aureus subsp. aureus Mu50
ucuagauuauuuaaa

SEQ ID NO: 3985352 - RNA, 21 nt, Staphylococcus aureus subsp. aureus Mu50
ucuagauucauauuuauauuu

SEQ ID NO: 3985353 - RNA, 18 nt, Staphylococcus aureus subsp. aureus Mu50
ucuagguuagaauuauuu

SEQ ID NO: 3985354 - RNA, 22 nt, Staphylococcus aureus subsp. aureus Mu50
ucuaguguucucauuauaauga

SEQ ID NO: 3985355 - RNA, 13 nt, Staphylococcus aureus subsp. aureus Mu50
ucuauaaaaagaa

SEQ ID NO: 3985356 - RNA, 14 nt, Staphylococcus aureus subsp. aureus Mu50
ucuauaaagaauga

SEQ ID NO: 3985357 - RNA, 18 nt, Staphylococcus aureus subsp. aureus Mu50
ucuauaaauaucaauaau

SEQ ID NO: 3985358 - RNA, 20 nt, Staphylococcus aureus subsp. aureus Mu50
ucuauaaauaucaauaauuc

SEQ ID NO: 3985359 - RNA, 15 nt, Staphylococcus aureus subsp. aureus Mu50
ucuauaauuugugug

SEQ ID NO: 3985360 - RNA, 14 nt, Staphylococcus aureus subsp. aureus Mu50
ucuauaauuuuaau

SEQ ID NO: 3985361 - RNA, 15 nt, Staphylococcus aureus subsp. aureus Mu50
ucuauaauuuuaauu

SEQ ID NO: 3985362 - RNA, 14 nt, Staphylococcus aureus subsp. aureus Mu50
ucuauacaacagua

SEQ ID NO: 3985363 - RNA, 23 nt, Staphylococcus aureus subsp. aureus Mu50
ucuauaccauuccaaaaauugua

SEQ ID NO: 3985364 - RNA, 17 nt, Staphylococcus aureus subsp. aureus Mu50
ucuauagaauuuuucau

SEQ ID NO: 3985365 - RNA, 18 nt, Staphylococcus aureus subsp. aureus Mu50
ucuauagcaccauuauua

SEQ ID NO: 3985366 - RNA, 17 nt, Staphylococcus aureus subsp. aureus Mu50
ucuauagguuuauaaaa

SEQ ID NO: 3985367 - RNA, 18 nt, Staphylococcus aureus subsp. aureus Mu50
ucuauagguuuauaaaaa

SEQ ID NO: 3985368 - RNA, 16 nt, Staphylococcus aureus subsp. aureus Mu50
ucuauauaaaaacugu

SEQ ID NO: 3985369 - RNA, 21 nt, Staphylococcus aureus subsp. aureus Mu50
ucuauauaaaguugacaauac

SEQ ID NO: 3985370 - RNA, 19 nt, Staphylococcus aureus subsp. aureus Mu50
ucuauauaaauguuuauau

SEQ ID NO: 3985371 - RNA, 12 nt, Staphylococcus aureus subsp. aureus Mu50
ucuauauaagaa

SEQ ID NO: 3985372 - RNA, 15 nt, Staphylococcus aureus subsp. aureus Mu50
ucuauaucuauuuau

SEQ ID NO: 3985373 - RNA, 13 nt, Staphylococcus aureus subsp. aureus Mu50
ucuauauuaauag

SEQ ID NO: 3985374 - RNA, 13 nt, Staphylococcus aureus subsp. aureus Mu50
ucuaucaaauaau

SEQ ID NO: 3985375 - RNA, 17 nt, Staphylococcus aureus subsp. aureus Mu50
ucuaucgccuaaaaaua

SEQ ID NO: 3985376 - RNA, 17 nt, Staphylococcus aureus subsp. aureus Mu50
ucuaucgguaauuuuug

SEQ ID NO: 3985377 - RNA, 21 nt, Staphylococcus aureus subsp. aureus Mu50
ucuaucguuguguauuguuug

SEQ ID NO: 3985378 - RNA, 14 nt, Staphylococcus aureus subsp. aureus Mu50
ucuaugaaauuuuu

SEQ ID NO: 3985379 - RNA, 16 nt, Staphylococcus aureus subsp. aureus Mu50
ucuaugaaauuuuuua

SEQ ID NO: 3985380 - RNA, 13 nt, Staphylococcus aureus subsp. aureus Mu50
ucuguaauuaauc

SEQ ID NO: 3985381 - RNA, 15 nt, Staphylococcus aureus subsp. aureus Mu50
ucuguaccguauuuu

SEQ ID NO: 3985382 - RNA, 18 nt, Staphylococcus aureus subsp. aureus Mu50
ucuguaccguauuuuaau

SEQ ID NO: 3985383 - RNA, 16 nt, Staphylococcus aureus subsp. aureus Mu50
ucuguacguuuuaaau

SEQ ID NO: 3985384 - RNA, 12 nt, Staphylococcus aureus subsp. aureus Mu50
ucuguacuucua

SEQ ID NO: 3985385 - RNA, 15 nt, Staphylococcus aureus subsp. aureus Mu50
ucuguaucaaaaucg

SEQ ID NO: 3985386 - RNA, 21 nt, Staphylococcus aureus subsp. aureus Mu50
ucuguauccucgguauuuaau

SEQ ID NO: 3985387 - RNA, 23 nt, Staphylococcus aureus subsp. aureus Mu50
ucuguaucgauucgauuauuuag

SEQ ID NO: 3985388 - RNA, 13 nt, Staphylococcus aureus subsp. aureus Mu50
ucuguauuauuau

SEQ ID NO: 3985389 - RNA, 14 nt, Staphylococcus aureus subsp. aureus Mu50
ucugucaaauugga

SEQ ID NO: 3985390 - RNA, 18 nt, Staphylococcus aureus subsp. aureus Mu50
ucuguccgauuuuuaaug

SEQ ID NO: 3985391 - RNA, 21 nt, Staphylococcus aureus subsp. aureus Mu50
ucugucggacuccuuuuacuu

SEQ ID NO: 3985392 - RNA, 17 nt, Staphylococcus aureus subsp. aureus Mu50
ucugucuaaaaacauaa

SEQ ID NO: 3985393 - RNA, 21 nt, Staphylococcus aureus subsp. aureus Mu50
ucugucuaaaaacauaaaaau

SEQ ID NO: 3985394 - RNA, 22 nt, Staphylococcus aureus subsp. aureus Mu50
ucugugaauaugcuuuuaauag

SEQ ID NO: 3985395 - RNA, 23 nt, Staphylococcus aureus subsp. aureus Mu50
ucugugaauaugcuuuuaauagu

SEQ ID NO: 3985396 - RNA, 11 nt, Staphylococcus aureus subsp. aureus Mu50
ucuguguuggg

SEQ ID NO: 3985397 - RNA, 22 nt, Staphylococcus aureus subsp. aureus Mu50
ucuguguuggggcccacacccc

SEQ ID NO: 3985398 - RNA, 16 nt, Staphylococcus aureus subsp. aureus Mu50
ucuguucauaauguaa

SEQ ID NO: 3985399 - RNA, 19 nt, Staphylococcus aureus subsp. aureus Mu50
ucuguuccucaauaggaau

SEQ ID NO: 3985400 - RNA, 20 nt, Staphylococcus aureus subsp. aureus Mu50
ucuguugaagucaauaauuu

SEQ ID NO: 3985401 - RNA, 14 nt, Staphylococcus aureus subsp. aureus Mu50
ucuguuuaaauuua

SEQ ID NO: 3985402 - RNA, 20 nt, Staphylococcus aureus subsp. aureus Mu50
ucuguuuaugagcuuaauaa

SEQ ID NO: 3985403 - RNA, 15 nt, Staphylococcus aureus subsp. aureus Mu50
ucuguuucaaagcug

SEQ ID NO: 3985404 - RNA, 16 nt, Staphylococcus aureus subsp. aureus Mu50
ucuguuugucacuuaa

SEQ ID NO: 3985405 - RNA, 16 nt, Staphylococcus aureus subsp. aureus Mu50
ucuuaaagaauuaagu

SEQ ID NO: 3985406 - RNA, 19 nt, Staphylococcus aureus subsp. aureus Mu50
ucuuaaagauuuuucagcu

SEQ ID NO: 3985407 - RNA, 17 nt, Staphylococcus aureus subsp. aureus Mu50
ucuuaaaucaacaucau

SEQ ID NO: 3985408 - RNA, 22 nt, Staphylococcus aureus subsp. aureus Mu50
ucuuaaaucacuagcuaaugca

SEQ ID NO: 3985409 - RNA, 13 nt, Staphylococcus aureus subsp. aureus Mu50
ucuuaaguacaua

SEQ ID NO: 3985410 - RNA, 19 nt, Staphylococcus aureus subsp. aureus Mu50
ucuuaaucagcuauaaaag

SEQ ID NO: 3985411 - RNA, 21 nt, Staphylococcus aureus subsp. aureus Mu50
ucuuaaucgagugauucagga

SEQ ID NO: 3985412 - RNA, 14 nt, Staphylococcus aureus subsp. aureus Mu50
ucuuaauguacuuu

SEQ ID NO: 3985413 - RNA, 13 nt, Staphylococcus aureus subsp. aureus Mu50
ucuuaauucuucu

SEQ ID NO: 3985414 - RNA, 17 nt, Staphylococcus aureus subsp. aureus Mu50
ucuuacauugauaaaau

SEQ ID NO: 3985415 - RNA, 20 nt, Staphylococcus aureus subsp. aureus Mu50
ucuuacauugauaaaauaau

SEQ ID NO: 3985416 - RNA, 17 nt, Staphylococcus aureus subsp. aureus Mu50
ucuuaccauuuauccuu

SEQ ID NO: 3985417 - RNA, 18 nt, Staphylococcus aureus subsp. aureus Mu50
ucuuacugcaauuauuuu

SEQ ID NO: 3985418 - RNA, 19 nt, Staphylococcus aureus subsp. aureus Mu50
ucuuacugcugcuuuuaau

SEQ ID NO: 3985419 - RNA, 19 nt, Staphylococcus aureus subsp. aureus Mu50
ucuuacugcuguucucuau

SEQ ID NO: 3985420 - RNA, 20 nt, Staphylococcus aureus subsp. aureus Mu50
ucuuacugcuguucucuauu

SEQ ID NO: 3985421 - RNA, 21 nt, Staphylococcus aureus subsp. aureus Mu50
ucuuagacauuguaaaaugcu

SEQ ID NO: 3985422 - RNA, 23 nt, Staphylococcus aureus subsp. aureus Mu50
ucuuagacgcuguuuuaaauuga

SEQ ID NO: 3985423 - RNA, 22 nt, Staphylococcus aureus subsp. aureus Mu50
ucuuagauuuucacuaauauuu

SEQ ID NO: 3985424 - RNA, 20 nt, Staphylococcus aureus subsp. aureus Mu50
ucuuagcacuuggauuuuaa

SEQ ID NO: 3985425 - RNA, 23 nt, Staphylococcus aureus subsp. aureus Mu50
ucuuagucaaucaaguuaaucag

SEQ ID NO: 3985426 - RNA, 18 nt, Staphylococcus aureus subsp. aureus Mu50
ucuuagugaaucuucuaa

SEQ ID NO: 3985427 - RNA, 17 nt, Staphylococcus aureus subsp. aureus Mu50
ucuuaguuaaaauucag

SEQ ID NO: 3985428 - RNA, 18 nt, Staphylococcus aureus subsp. aureus Mu50
ucuuaguuaaaauucagu

SEQ ID NO: 3985429 - RNA, 19 nt, Staphylococcus aureus subsp. aureus Mu50
ucuuaguuuagguugauuu

SEQ ID NO: 3985430 - RNA, 13 nt, Staphylococcus aureus subsp. aureus Mu50
ucuuauaaaaauc

SEQ ID NO: 3985431 - RNA, 14 nt, Staphylococcus aureus subsp. aureus Mu50
ucuuauaaguucaa

SEQ ID NO: 3985432 - RNA, 18 nt, Staphylococcus aureus subsp. aureus Mu50
ucuuauauucuuaaaaga

SEQ ID NO: 3985433 - RNA, 15 nt, Staphylococcus aureus subsp. aureus Mu50
ucuuaucauaaucuu

SEQ ID NO: 3985434 - RNA, 18 nt, Staphylococcus aureus subsp. aureus Mu50
ucuuaucauuucaaauaa

SEQ ID NO: 3985435 - RNA, 22 nt, Staphylococcus aureus subsp. aureus Mu50
ucuuaucgaaagaugauauauu

SEQ ID NO: 3985436 - RNA, 23 nt, Staphylococcus aureus subsp. aureus Mu50
ucuuaucgaaagaugauauauuc

SEQ ID NO: 3985437 - RNA, 16 nt, Staphylococcus aureus subsp. aureus Mu50
ucuuaucuuuaugaua

SEQ ID NO: 3985438 - RNA, 22 nt, Staphylococcus aureus subsp. aureus Mu50
ucuuaucuuuaugauaauuaau

SEQ ID NO: 3985439 - RNA, 19 nt, Staphylococcus aureus subsp. aureus Mu50
ucuuauguauaucuuuauu

SEQ ID NO: 3985440 - RNA, 11 nt, Staphylococcus aureus subsp. aureus Mu50
ucuuauuaaaa

SEQ ID NO: 3985441 - RNA, 14 nt, Staphylococcus aureus subsp. aureus Mu50
ucuuauuaaaaaag

SEQ ID NO: 3985442 - RNA, 22 nt, Staphylococcus aureus subsp. aureus Mu50
ucuuauuaaaaaagaacauaaa

SEQ ID NO: 3985443 - RNA, 12 nt, Staphylococcus aureus subsp. aureus Mu50
ucuuauuauuaa

SEQ ID NO: 3985444 - RNA, 18 nt, Staphylococcus aureus subsp. aureus Mu50
ucuuauuuguaauuucag

SEQ ID NO: 3985445 - RNA, 19 nt, Staphylococcus aureus subsp. aureus Mu50
ucuuauuuguaauuucagc

SEQ ID NO: 3985446 - RNA, 16 nt, Staphylococcus aureus subsp. aureus Mu50
ucuuauuuguuuaauu

SEQ ID NO: 3985447 - RNA, 20 nt, Staphylococcus aureus subsp. aureus Mu50
ucuuauuuuguuuuaaaaaa

SEQ ID NO: 3985448 - RNA, 14 nt, Staphylococcus aureus subsp. aureus Mu50
ucuuauuuuuaugc

SEQ ID NO: 3985449 - RNA, 23 nt, Staphylococcus aureus subsp. aureus Mu50
ucuucaaaaaauaauagcaaaau

SEQ ID NO: 3985450 - RNA, 17 nt, Staphylococcus aureus subsp. aureus Mu50
ucuucaaacagacuuaa

SEQ ID NO: 3985451 - RNA, 18 nt, Staphylococcus aureus subsp. aureus Mu50
ucuucaacuucgauauga

SEQ ID NO: 3985452 - RNA, 22 nt, Staphylococcus aureus subsp. aureus Mu50
ucuucaacuucgauaugauuaa

SEQ ID NO: 3985453 - RNA, 22 nt, Staphylococcus aureus subsp. aureus Mu50
ucuucaacuuuaucuaaaggua

SEQ ID NO: 3985454 - RNA, 21 nt, Staphylococcus aureus subsp. aureus Mu50
ucuucaauauuuaaauuuuaa

SEQ ID NO: 3985455 - RNA, 17 nt, Staphylococcus aureus subsp. aureus Mu50
ucuucaauucuuacacc

SEQ ID NO: 3985456 - RNA, 15 nt, Staphylococcus aureus subsp. aureus Mu50
ucuucaauuuauuuu

SEQ ID NO: 3985457 - RNA, 9 nt, Staphylococcus aureus subsp. aureus Mu50
ucuucacca

SEQ ID NO: 3985458 - RNA, 19 nt, Staphylococcus aureus subsp. aureus Mu50
ucuucacuaaaaauauauu

SEQ ID NO: 3985459 - RNA, 17 nt, Staphylococcus aureus subsp. aureus Mu50
ucuucagaaccuugaau

SEQ ID NO: 3985460 - RNA, 17 nt, Staphylococcus aureus subsp. aureus Mu50
ucuucaggugauucauu

SEQ ID NO: 3985461 - RNA, 17 nt, Staphylococcus aureus subsp. aureus Mu50
ucuucagguguuuuacc

SEQ ID NO: 3985462 - RNA, 19 nt, Staphylococcus aureus subsp. aureus Mu50
ucuucaguuaaaucuuuaa

SEQ ID NO: 3985463 - RNA, 13 nt, Staphylococcus aureus subsp. aureus Mu50
ucuucauaaucgu

SEQ ID NO: 3985464 - RNA, 23 nt, Staphylococcus aureus subsp. aureus Mu50
ucuucaucaauaacuauaaucau

SEQ ID NO: 3985465 - RNA, 13 nt, Staphylococcus aureus subsp. aureus Mu50
ucuucaucauauu

SEQ ID NO: 3985466 - RNA, 13 nt, Staphylococcus aureus subsp. aureus Mu50
ucuucaucaugac

SEQ ID NO: 3985467 - RNA, 21 nt, Staphylococcus aureus subsp. aureus Mu50
ucuuucucggcgauaaaaugu

SEQ ID NO: 3985468 - RNA, 16 nt, Staphylococcus aureus subsp. aureus Mu50
ucuuucucuauuaauu

SEQ ID NO: 3985469 - RNA, 20 nt, Staphylococcus aureus subsp. aureus Mu50
ucuuucuuagugaaucuucu

SEQ ID NO: 3985470 - RNA, 14 nt, Staphylococcus aureus subsp. aureus Mu50
ucuuucuuguucua

SEQ ID NO: 3985471 - RNA, 22 nt, Staphylococcus aureus subsp. aureus Mu50
ucuuucuuuguguuugcuuuuu

SEQ ID NO: 3985472 - RNA, 20 nt, Staphylococcus aureus subsp. aureus Mu50
ucuuucuuuucugaauguau

SEQ ID NO: 3985473 - RNA, 14 nt, Staphylococcus aureus subsp. aureus Mu50
ucuuugaacauauu

SEQ ID NO: 3985474 - RNA, 20 nt, Staphylococcus aureus subsp. aureus Mu50
ucuuugaacauauuauaaaa

SEQ ID NO: 3985475 - RNA, 13 nt, Staphylococcus aureus subsp. aureus Mu50
ucuuugacaugug

SEQ ID NO: 3985476 - RNA, 17 nt, Staphylococcus aureus subsp. aureus Mu50
ucuuuggucuaaagcuu

SEQ ID NO: 3985477 - RNA, 18 nt, Staphylococcus aureus subsp. aureus Mu50
ucuuuggucuaaagcuua

SEQ ID NO: 3985478 - RNA, 22 nt, Staphylococcus aureus subsp. aureus Mu50
ucuuuggucuaaagcuuauuaa

SEQ ID NO: 3985479 - RNA, 15 nt, Staphylococcus aureus subsp. aureus Mu50
ucuuuggugaaagua

SEQ ID NO: 3985480 - RNA, 17 nt, Staphylococcus aureus subsp. aureus Mu50
ucuuuguauaccuauuc

SEQ ID NO: 3985481 - RNA, 13 nt, Staphylococcus aureus subsp. aureus Mu50
ucuuuguauuuau

SEQ ID NO: 3985482 - RNA, 19 nt, Staphylococcus aureus subsp. aureus Mu50
ucuuugucaucuuuugucu

SEQ ID NO: 3985483 - RNA, 18 nt, Staphylococcus aureus subsp. aureus Mu50
ucuuuguugcaaugcaua

SEQ ID NO: 3985484 - RNA, 22 nt, Staphylococcus aureus subsp. aureus Mu50
ucuuuguuggggcccacacccc

SEQ ID NO: 3985485 - RNA, 20 nt, Staphylococcus aureus subsp. aureus Mu50
ucuuuguuucgcaaguaguc

SEQ ID NO: 3985486 - RNA, 18 nt, Staphylococcus aureus subsp. aureus Mu50
ucuuuguuuuuaauuuuu

SEQ ID NO: 3985487 - RNA, 19 nt, Staphylococcus aureus subsp. aureus Mu50
ucuuuguuuuuaauuuuua

SEQ ID NO: 3985488 - RNA, 16 nt, Staphylococcus aureus subsp. aureus Mu50
ucuuuuaaauucuuau

SEQ ID NO: 3985489 - RNA, 24 nt, Staphylococcus aureus subsp. aureus Mu50
ucuuuuaacccacauuaaauauua

SEQ ID NO: 3985490 - RNA, 18 nt, Staphylococcus aureus subsp. aureus Mu50
ucuuuuaauagaucuuug

SEQ ID NO: 3985491 - RNA, 22 nt, Staphylococcus aureus subsp. aureus Mu50
ucuuuuaauauuugauaacaaa

SEQ ID NO: 3985492 - RNA, 12 nt, Staphylococcus aureus subsp. aureus Mu50
ucuuuuaauucu

SEQ ID NO: 3985493 - RNA, 17 nt, Staphylococcus aureus subsp. aureus Mu50
ucuuuuacuaaaugaau

SEQ ID NO: 3985494 - RNA, 16 nt, Staphylococcus aureus subsp. aureus Mu50
ucuuuuagcuuuugua

SEQ ID NO: 3985495 - RNA, 16 nt, Staphylococcus aureus subsp. aureus Mu50
ucuuuuagguaauaau

SEQ ID NO: 3985496 - RNA, 21 nt, Staphylococcus aureus subsp. aureus Mu50
ucuuuuauacauguacauuau

SEQ ID NO: 3985497 - RNA, 17 nt, Staphylococcus aureus subsp. aureus Mu50
ucuuuuauauuuuuauc

SEQ ID NO: 3985498 - RNA, 22 nt, Staphylococcus aureus subsp. aureus Mu50
ucuuuuauauuuuuaucaucuu

SEQ ID NO: 3985499 - RNA, 22 nt, Staphylococcus aureus subsp. aureus Mu50
ucuuuuauggugggaagguaaa

SEQ ID NO: 3985500 - RNA, 14 nt, Staphylococcus aureus subsp. aureus Mu50
ucuuuuauuuucau

SEQ ID NO: 3985501 - RNA, 15 nt, Staphylococcus aureus subsp. aureus Mu50
ucuuuuauuuucaua

SEQ ID NO: 3985502 - RNA, 18 nt, Staphylococcus aureus subsp. aureus Mu50
ucuuuucacgaauaucuu

SEQ ID NO: 3985503 - RNA, 20 nt, Staphylococcus aureus subsp. aureus Mu50
ucuuuuccaaaacaaaaaua

SEQ ID NO: 3985504 - RNA, 22 nt, Staphylococcus aureus subsp. aureus Mu50
ucuuuucgaaauucucuuuguu

SEQ ID NO: 3985505 - RNA, 12 nt, Staphylococcus aureus subsp. aureus Mu50
ucuuuucuuuga

SEQ ID NO: 3985506 - RNA, 21 nt, Staphylococcus aureus subsp. aureus Mu50
ucuuuugagacguuuuccaug

SEQ ID NO: 3985507 - RNA, 19 nt, Staphylococcus aureus subsp. aureus Mu50
ucuuuugauagcuaaugca

SEQ ID NO: 3985508 - RNA, 14 nt, Staphylococcus aureus subsp. aureus Mu50
ucuuuugauuuuuu

SEQ ID NO: 3985509 - RNA, 21 nt, Staphylococcus aureus subsp. aureus Mu50
ucuuuugcaaaacgcauuuca

SEQ ID NO: 3985510 - RNA, 16 nt, Staphylococcus aureus subsp. aureus Mu50
ucuuuugcaagguuuu

SEQ ID NO: 3985511 - RNA, 21 nt, Staphylococcus aureus subsp. aureus Mu50
ucuuuuguaagacuucccaau

SEQ ID NO: 3985512 - RNA, 23 nt, Staphylococcus aureus subsp. aureus Mu50
ucuuuuguuuaguauggaauaaa

SEQ ID NO: 3985513 - RNA, 13 nt, Staphylococcus aureus subsp. aureus Mu50
ucuuuuguuuuca

SEQ ID NO: 3985514 - RNA, 15 nt, Staphylococcus aureus subsp. aureus Mu50
ucuuuuuaucaugau

SEQ ID NO: 3985515 - RNA, 19 nt, Staphylococcus aureus subsp. aureus Mu50
ucuuuuucagcuaauuguc

SEQ ID NO: 3985516 - RNA, 20 nt, Staphylococcus aureus subsp. aureus Mu50
ucuuuuucaugcuauuuaaa

SEQ ID NO: 3985517 - RNA, 16 nt, Staphylococcus aureus subsp. aureus Mu50
ucuuuuucuaaauaaa

SEQ ID NO: 3985518 - RNA, 17 nt, Staphylococcus aureus subsp. aureus Mu50
ucuuuuucuuucauaau

SEQ ID NO: 3985519 - RNA, 19 nt, Staphylococcus aureus subsp. aureus Mu50
ucuuuuugaucaacuauau

SEQ ID NO: 3985520 - RNA, 18 nt, Staphylococcus aureus subsp. aureus Mu50
ucuuuuugcguuuuuaaa

SEQ ID NO: 3985521 - RNA, 21 nt, Staphylococcus aureus subsp. aureus Mu50
ucuuuuugcguuuuuaaauaa

SEQ ID NO: 3985522 - RNA, 22 nt, Staphylococcus aureus subsp. aureus Mu50
ucuuuuugcguuuuuaaauaau

SEQ ID NO: 3985523 - RNA, 15 nt, Staphylococcus aureus subsp. aureus Mu50
ucuuuuuguccccag

SEQ ID NO: 3985524 - RNA, 16 nt, Staphylococcus aureus subsp. aureus Mu50
ucuuuuuguuguuuua

SEQ ID NO: 3985525 - RNA, 19 nt, Staphylococcus aureus subsp. aureus Mu50
ucuuuuuguuguuuuaauu

SEQ ID NO: 3985526 - RNA, 20 nt, Staphylococcus aureus subsp. aureus Mu50
ucuuuuuguuguuuuaauuu

SEQ ID NO: 3985527 - RNA, 11 nt, Staphylococcus aureus subsp. aureus Mu50
ucuuuuuguuu

SEQ ID NO: 3985528 - RNA, 14 nt, Staphylococcus aureus subsp. aureus Mu50
ucuuuuuguuuauc

SEQ ID NO: 3985529 - RNA, 12 nt, Staphylococcus aureus subsp. aureus Mu50
ucuuuuuuaauu

SEQ ID NO: 3985530 - RNA, 17 nt, Staphylococcus aureus subsp. aureus Mu50
ucuuuuuuaauucuauu

SEQ ID NO: 3985531 - RNA, 16 nt, Staphylococcus aureus subsp. aureus Mu50
ucuuuuuuacuaaaau

SEQ ID NO: 3985532 - RNA, 19 nt, Staphylococcus aureus subsp. aureus Mu50
ucuuuuuuauuaaguauau

SEQ ID NO: 3985533 - RNA, 15 nt, Staphylococcus aureus subsp. aureus Mu50
ucuuuuuuauuuaau

SEQ ID NO: 3985534 - RNA, 12 nt, Staphylococcus aureus subsp. aureus Mu50
ucuuuuuuuaau

SEQ ID NO: 3985535 - RNA, 17 nt, Staphylococcus aureus subsp. aureus Mu50
ucuuuuuuuaccuaauu

SEQ ID NO: 3985536 - RNA, 18 nt, Staphylococcus aureus subsp. aureus Mu50
ugaaaaaacgagcuggug

SEQ ID NO: 3985537 - RNA, 22 nt, Staphylococcus aureus subsp. aureus Mu50
ugaaaaaauaacuguaaaacau

SEQ ID NO: 3985538 - RNA, 23 nt, Staphylococcus aureus subsp. aureus Mu50
ugaaaaaauaacuguaaaacauu

SEQ ID NO: 3985539 - RNA, 15 nt, Staphylococcus aureus subsp. aureus Mu50
ugaaaaacuucuuaa

SEQ ID NO: 3985540 - RNA, 20 nt, Staphylococcus aureus subsp. aureus Mu50
ugaaaaacuucuuaacuuga

SEQ ID NO: 3985541 - RNA, 17 nt, Staphylococcus aureus subsp. aureus Mu50
ugaaaaaguuucggaaa

SEQ ID NO: 3985542 - RNA, 15 nt, Staphylococcus aureus subsp. aureus Mu50
ugaaaaaucuucucc

SEQ ID NO: 3985543 - RNA, 12 nt, Staphylococcus aureus subsp. aureus Mu50
ugaaaacuucuc

SEQ ID NO: 3985544 - RNA, 15 nt, Staphylococcus aureus subsp. aureus Mu50
ugaaaagaauaaguu

SEQ ID NO: 3985545 - RNA, 15 nt, Staphylococcus aureus subsp. aureus Mu50
ugaaaagauaaacaa

SEQ ID NO: 3985546 - RNA, 16 nt, Staphylococcus aureus subsp. aureus Mu50
ugaaaaggaaaaacuu

SEQ ID NO: 3985547 - RNA, 16 nt, Staphylococcus aureus subsp. aureus Mu50
ugaaaaguaaauugag

SEQ ID NO: 3985548 - RNA, 12 nt, Staphylococcus aureus subsp. aureus Mu50
ugaaaaguaauu

SEQ ID NO: 3985549 - RNA, 17 nt, Staphylococcus aureus subsp. aureus Mu50
ugaaaaguaauuaaaua

SEQ ID NO: 3985550 - RNA, 15 nt, Staphylococcus aureus subsp. aureus Mu50
ugaaaaguugauugc

SEQ ID NO: 3985551 - RNA, 17 nt, Staphylococcus aureus subsp. aureus Mu50
ugaaaaguuuggcuuuu

SEQ ID NO: 3985552 - RNA, 21 nt, Staphylococcus aureus subsp. aureus Mu50
ugaaaauaagcuuguaacaag

SEQ ID NO: 3985553 - RNA, 12 nt, Staphylococcus aureus subsp. aureus Mu50
ugaaaauaauac

SEQ ID NO: 3985554 - RNA, 23 nt, Staphylococcus aureus subsp. aureus Mu50
ugaaggcuuugaagggagcauuu

SEQ ID NO: 3985555 - RNA, 14 nt, Staphylococcus aureus subsp. aureus Mu50
ugaagggagcauuu

SEQ ID NO: 3985556 - RNA, 16 nt, Staphylococcus aureus subsp. aureus Mu50
ugaagggagcauuuca

SEQ ID NO: 3985557 - RNA, 14 nt, Staphylococcus aureus subsp. aureus Mu50
ugaagguaauuuaa

SEQ ID NO: 3985558 - RNA, 17 nt, Staphylococcus aureus subsp. aureus Mu50
ugaaguaauauauaaaa

SEQ ID NO: 3985559 - RNA, 17 nt, Staphylococcus aureus subsp. aureus Mu50
ugaaguacauuaaaaca

SEQ ID NO: 3985560 - RNA, 15 nt, Staphylococcus aureus subsp. aureus Mu50
ugaaguaguuucauu

SEQ ID NO: 3985561 - RNA, 15 nt, Staphylococcus aureus subsp. aureus Mu50
ugaaguauggaaguu

SEQ ID NO: 3985562 - RNA, 18 nt, Staphylococcus aureus subsp. aureus Mu50
ugaagucaauaauuuuau

SEQ ID NO: 3985563 - RNA, 23 nt, Staphylococcus aureus subsp. aureus Mu50
ugaagucuguuuagaagaaacuu

SEQ ID NO: 3985564 - RNA, 22 nt, Staphylococcus aureus subsp. aureus Mu50
ugaaguuaacuauaacaauagu

SEQ ID NO: 3985565 - RNA, 14 nt, Staphylococcus aureus subsp. aureus Mu50
ugaaguuacuauau

SEQ ID NO: 3985566 - RNA, 16 nt, Staphylococcus aureus subsp. aureus Mu50
ugaaguuacuauauuu

SEQ ID NO: 3985567 - RNA, 13 nt, Staphylococcus aureus subsp. aureus Mu50
ugaaguuguuucu

SEQ ID NO: 3985568 - RNA, 16 nt, Staphylococcus aureus subsp. aureus Mu50
ugaaguuuaaucguau

SEQ ID NO: 3985569 - RNA, 22 nt, Staphylococcus aureus subsp. aureus Mu50
ugaaguuuaaucguauuagcca

SEQ ID NO: 3985570 - RNA, 14 nt, Staphylococcus aureus subsp. aureus Mu50
ugaauaaaauauau

SEQ ID NO: 3985571 - RNA, 17 nt, Staphylococcus aureus subsp. aureus Mu50
ugaauaaaauauaucuu

SEQ ID NO: 3985572 - RNA, 14 nt, Staphylococcus aureus subsp. aureus Mu50
ugaauaaaauugug

SEQ ID NO: 3985573 - RNA, 20 nt, Staphylococcus aureus subsp. aureus Mu50
ugaauaaagcuaacauaccu

SEQ ID NO: 3985574 - RNA, 12 nt, Staphylococcus aureus subsp. aureus Mu50
ugaauaaauaac

SEQ ID NO: 3985575 - RNA, 13 nt, Staphylococcus aureus subsp. aureus Mu50
ugaauaaauaacu

SEQ ID NO: 3985576 - RNA, 14 nt, Staphylococcus aureus subsp. aureus Mu50
ugaauaaauaacuu

SEQ ID NO: 3985577 - RNA, 15 nt, Staphylococcus aureus subsp. aureus Mu50
ugaauaaauaacuuc

SEQ ID NO: 3985578 - RNA, 13 nt, Staphylococcus aureus subsp. aureus Mu50
ugaauaaauacaa

SEQ ID NO: 3985579 - RNA, 21 nt, Staphylococcus aureus subsp. aureus Mu50
ugaauaaauacaauguuauua

SEQ ID NO: 3985580 - RNA, 21 nt, Staphylococcus aureus subsp. aureus Mu50
ugaauaaauagauaauauaua

SEQ ID NO: 3985581 - RNA, 21 nt, Staphylococcus aureus subsp. aureus Mu50
ugaauaaauuuuauucuucag

SEQ ID NO: 3985582 - RNA, 18 nt, Staphylococcus aureus subsp. aureus Mu50
ugaauaauguuuucauug

SEQ ID NO: 3985583 - RNA, 13 nt, Staphylococcus aureus subsp. aureus Mu50
ugaauaauuaaaa

SEQ ID NO: 3985584 - RNA, 15 nt, Staphylococcus aureus subsp. aureus Mu50
ugaauaauuccagua

SEQ ID NO: 3985585 - RNA, 17 nt, Staphylococcus aureus subsp. aureus Mu50
ugaauaauugcuaaaau

SEQ ID NO: 3985586 - RNA, 19 nt, Staphylococcus aureus subsp. aureus Mu50
ugaauaauuucaguucuua

SEQ ID NO: 3985587 - RNA, 21 nt, Staphylococcus aureus subsp. aureus Mu50
ugaauaauuucaguucuuaga

SEQ ID NO: 3985588 - RNA, 21 nt, Staphylococcus aureus subsp. aureus Mu50
ugaauaguaaucagcuuuuuc

SEQ ID NO: 3985589 - RNA, 14 nt, Staphylococcus aureus subsp. aureus Mu50
ugaauauaaguaau

SEQ ID NO: 3985590 - RNA, 13 nt, Staphylococcus aureus subsp. aureus Mu50
ugaauauagcugu

SEQ ID NO: 3985591 - RNA, 20 nt, Staphylococcus aureus subsp. aureus Mu50
ugaauauagcugugauuuga

SEQ ID NO: 3985592 - RNA, 14 nt, Staphylococcus aureus subsp. aureus Mu50
ugaauaucuaaugc

SEQ ID NO: 3985593 - RNA, 14 nt, Staphylococcus aureus subsp. aureus Mu50
ugaauaugauauua

SEQ ID NO: 3985594 - RNA, 17 nt, Staphylococcus aureus subsp. aureus Mu50
ugaauaugauauuaagu

SEQ ID NO: 3985595 - RNA, 15 nt, Staphylococcus aureus subsp. aureus Mu50
ugaauaugcuuuuaa

SEQ ID NO: 3985596 - RNA, 20 nt, Staphylococcus aureus subsp. aureus Mu50
ugaauauggaaaauguauua

SEQ ID NO: 3985597 - RNA, 21 nt, Staphylococcus aureus subsp. aureus Mu50
ugaauauggaaaauguauuau

SEQ ID NO: 3985598 - RNA, 13 nt, Staphylococcus aureus subsp. aureus Mu50
ugaauauuauuca

SEQ ID NO: 3985599 - RNA, 15 nt, Staphylococcus aureus subsp. aureus Mu50
ugaauauuuuucaau

SEQ ID NO: 3985600 - RNA, 23 nt, Staphylococcus aureus subsp. aureus Mu50
ugaauauuuuucaauuaaauguu

SEQ ID NO: 3985601 - RNA, 15 nt, Staphylococcus aureus subsp. aureus Mu50
ugaaucaacaauuua

SEQ ID NO: 3985602 - RNA, 14 nt, Staphylococcus aureus subsp. aureus Mu50
ugaaucaacaguuu

SEQ ID NO: 3985603 - RNA, 23 nt, Staphylococcus aureus subsp. aureus Mu50
ugaaucaacaguuuuauuaucuu

SEQ ID NO: 3985604 - RNA, 16 nt, Staphylococcus aureus subsp. aureus Mu50
ugaaucagaugauuua

SEQ ID NO: 3985605 - RNA, 18 nt, Staphylococcus aureus subsp. aureus Mu50
ugaaucauuuuagcaccg

SEQ ID NO: 3985606 - RNA, 18 nt, Staphylococcus aureus subsp. aureus Mu50
ugaaucccauaacaauca

SEQ ID NO: 3985607 - RNA, 24 nt, Staphylococcus aureus subsp. aureus Mu50
ugaaucccauaacaaucauuucug

SEQ ID NO: 3985608 - RNA, 16 nt, Staphylococcus aureus subsp. aureus Mu50
ugaaucccauaaugac

SEQ ID NO: 3985609 - RNA, 20 nt, Staphylococcus aureus subsp. aureus Mu50
ugaaucgaguuugaaauaau

SEQ ID NO: 3985610 - RNA, 14 nt, Staphylococcus aureus subsp. aureus Mu50
ugaaucgcauuuaa

SEQ ID NO: 3985611 - RNA, 18 nt, Staphylococcus aureus subsp. aureus Mu50
ugaaucgcauuuaaauau

SEQ ID NO: 3985612 - RNA, 24 nt, Staphylococcus aureus subsp. aureus Mu50
ugaaucggugucuuuauguuugau

SEQ ID NO: 3985613 - RNA, 20 nt, Staphylococcus aureus subsp. aureus Mu50
ugaaucuaaacuauaauaau

SEQ ID NO: 3985614 - RNA, 20 nt, Staphylococcus aureus subsp. aureus Mu50
ugaaucuuauuuuguuuuaa

SEQ ID NO: 3985615 - RNA, 13 nt, Staphylococcus aureus subsp. aureus Mu50
ugaaugaaaauaa

SEQ ID NO: 3985616 - RNA, 14 nt, Staphylococcus aureus subsp. aureus Mu50
ugaaugaaaauaag

SEQ ID NO: 3985617 - RNA, 22 nt, Staphylococcus aureus subsp. aureus Mu50
ugaaugaaaggcgucuuaaauu

SEQ ID NO: 3985618 - RNA, 16 nt, Staphylococcus aureus subsp. aureus Mu50
ugaaugauugcauuga

SEQ ID NO: 3985619 - RNA, 17 nt, Staphylococcus aureus subsp. aureus Mu50
ugaauggagcaugauua

SEQ ID NO: 3985620 - RNA, 23 nt, Staphylococcus aureus subsp. aureus Mu50
ugaauggcaaucuauauaaaugu

SEQ ID NO: 3985621 - RNA, 12 nt, Staphylococcus aureus subsp. aureus Mu50
ugaauggcucgu

SEQ ID NO: 3985622 - RNA, 19 nt, Staphylococcus aureus subsp. aureus Mu50
ugaaugggucauuaaauga

SEQ ID NO: 3985623 - RNA, 15 nt, Staphylococcus aureus subsp. aureus Mu50
ugaaugguugauuau

SEQ ID NO: 3985624 - RNA, 19 nt, Staphylococcus aureus subsp. aureus Mu50
ugaaugguugauuauauuu

SEQ ID NO: 3985625 - RNA, 23 nt, Staphylococcus aureus subsp. aureus Mu50
ugaaugguugauuauauuucuca

SEQ ID NO: 3985626 - RNA, 12 nt, Staphylococcus aureus subsp. aureus Mu50
ugaauuaaaaaa

SEQ ID NO: 3985627 - RNA, 17 nt, Staphylococcus aureus subsp. aureus Mu50
ugaauuaaagcaucgaa

SEQ ID NO: 3985628 - RNA, 22 nt, Staphylococcus aureus subsp. aureus Mu50
ugaauuaacaauauuaaauuuc

SEQ ID NO: 3985629 - RNA, 13 nt, Staphylococcus aureus subsp. aureus Mu50
ugaauuaauagcu

SEQ ID NO: 3985630 - RNA, 15 nt, Staphylococcus aureus subsp. aureus Mu50
ugaauuauuuaaaau

SEQ ID NO: 3985631 - RNA, 18 nt, Staphylococcus aureus subsp. aureus Mu50
ugaauuauuuaaaaugcu

SEQ ID NO: 3985632 - RNA, 19 nt, Staphylococcus aureus subsp. aureus Mu50
ugaauuauuuaaaaugcuu

SEQ ID NO: 3985633 - RNA, 13 nt, Staphylococcus aureus subsp. aureus Mu50
ugaauugacuuac

SEQ ID NO: 3985634 - RNA, 16 nt, Staphylococcus aureus subsp. aureus Mu50
ugaauugaguauuaaa

SEQ ID NO: 3985635 - RNA, 21 nt, Staphylococcus aureus subsp. aureus Mu50
ugaauugaguauuaaauuuga

SEQ ID NO: 3985636 - RNA, 14 nt, Staphylococcus aureus subsp. aureus Mu50
ugaauugauuauaa

SEQ ID NO: 3985637 - RNA, 15 nt, Staphylococcus aureus subsp. aureus Mu50
ugaauugauuauaau

SEQ ID NO: 3985638 - RNA, 18 nt, Staphylococcus aureus subsp. aureus Mu50
ugaauugguugaucaauu

SEQ ID NO: 3985639 - RNA, 17 nt, Staphylococcus aureus subsp. aureus Mu50
ugaauuguuaguuuucu

SEQ ID NO: 3985640 - RNA, 14 nt, Staphylococcus aureus subsp. aureus Mu50
ugaauuuagaugca

SEQ ID NO: 3985641 - RNA, 21 nt, Staphylococcus aureus subsp. aureus Mu50
ugaauuuagaugcauaaaaaa

SEQ ID NO: 3985642 - RNA, 19 nt, Staphylococcus aureus subsp. aureus Mu50
ugagauauauuaauguuug

SEQ ID NO: 3985643 - RNA, 13 nt, Staphylococcus aureus subsp. aureus Mu50
ugagauuaucuuu

SEQ ID NO: 3985644 - RNA, 19 nt, Staphylococcus aureus subsp. aureus Mu50
ugagauuaucuuuagacau

SEQ ID NO: 3985645 - RNA, 16 nt, Staphylococcus aureus subsp. aureus Mu50
ugagauuauuuuuuua

SEQ ID NO: 3985646 - RNA, 23 nt, Staphylococcus aureus subsp. aureus Mu50
ugagauuauuuuuuuaaaucuau

SEQ ID NO: 3985647 - RNA, 21 nt, Staphylococcus aureus subsp. aureus Mu50
ugagcaaagcaaauuaguaug

SEQ ID NO: 3985648 - RNA, 16 nt, Staphylococcus aureus subsp. aureus Mu50
ugagcaaagcuuuuuu

SEQ ID NO: 3985649 - RNA, 22 nt, Staphylococcus aureus subsp. aureus Mu50
ugagcaacaaaagauguugcuc

SEQ ID NO: 3985650 - RNA, 14 nt, Staphylococcus aureus subsp. aureus Mu50
ugagcaagucuucu

SEQ ID NO: 3985651 - RNA, 15 nt, Staphylococcus aureus subsp. aureus Mu50
ugagcacaaacuaaa

SEQ ID NO: 3985652 - RNA, 15 nt, Staphylococcus aureus subsp. aureus Mu50
ugagcacuuaauaag

SEQ ID NO: 3985653 - RNA, 19 nt, Staphylococcus aureus subsp. aureus Mu50
ugagcaucacucaacauau

SEQ ID NO: 3985654 - RNA, 21 nt, Staphylococcus aureus subsp. aureus Mu50
ugagcaucuugucuaguucga

SEQ ID NO: 3985655 - RNA, 23 nt, Staphylococcus aureus subsp. aureus Mu50
ugagcuguuacacuuuucuuauc

SEQ ID NO: 3985656 - RNA, 16 nt, Staphylococcus aureus subsp. aureus Mu50
ugagcuuaauaaauug

SEQ ID NO: 3985657 - RNA, 17 nt, Staphylococcus aureus subsp. aureus Mu50
ugagcuucuuuaaauac

SEQ ID NO: 3985658 - RNA, 17 nt, Staphylococcus aureus subsp. aureus Mu50
ugaggaauaugaauugc

SEQ ID NO: 3985659 - RNA, 19 nt, Staphylococcus aureus subsp. aureus Mu50
ugaggaauaugaauugcuu

SEQ ID NO: 3985660 - RNA, 18 nt, Staphylococcus aureus subsp. aureus Mu50
ugaggauacauaaaucua

SEQ ID NO: 3985661 - RNA, 20 nt, Staphylococcus aureus subsp. aureus Mu50
ugaggcccauaaauuacuug

SEQ ID NO: 3985662 - RNA, 15 nt, Staphylococcus aureus subsp. aureus Mu50
ugagggauuuuuaua

SEQ ID NO: 3985663 - RNA, 13 nt, Staphylococcus aureus subsp. aureus Mu50
ugagggccccaac

SEQ ID NO: 3985664 - RNA, 19 nt, Staphylococcus aureus subsp. aureus Mu50
ugagggccccaacacagaa

SEQ ID NO: 3985665 - RNA, 11 nt, Staphylococcus aureus subsp. aureus Mu50
ugaguacaaca

SEQ ID NO: 3985666 - RNA, 17 nt, Staphylococcus aureus subsp. aureus Mu50
ugaguaggcucuuaaug

SEQ ID NO: 3985667 - RNA, 20 nt, Staphylococcus aureus subsp. aureus Mu50
ugaguauacuuacugaaacu

SEQ ID NO: 3985668 - RNA, 14 nt, Staphylococcus aureus subsp. aureus Mu50
ugaguaucaugcuu

SEQ ID NO: 3985669 - RNA, 15 nt, Staphylococcus aureus subsp. aureus Mu50
ugaguaugacgaaau

SEQ ID NO: 3985670 - RNA, 23 nt, Staphylococcus aureus subsp. aureus Mu50
ugaguauuaaauuugaaaguaaa

SEQ ID NO: 3985671 - RNA, 17 nt, Staphylococcus aureus subsp. aureus Mu50
ugaguauuacuugaaaa

SEQ ID NO: 3985672 - RNA, 22 nt, Staphylococcus aureus subsp. aureus Mu50
ugaguauuugccuuuuuuauuu

SEQ ID NO: 3985673 - RNA, 16 nt, Staphylococcus aureus subsp. aureus Mu50
ugagucaauuucuuua

SEQ ID NO: 3985674 - RNA, 23 nt, Staphylococcus aureus subsp. aureus Mu50
ugagucaauuucuuuaaagucuu

SEQ ID NO: 3985675 - RNA, 21 nt, Staphylococcus aureus subsp. aureus Mu50
ugagucuuagacauuguaaaa

SEQ ID NO: 3985676 - RNA, 22 nt, Staphylococcus aureus subsp. aureus Mu50
ugagucuuagacauuguaaaau

SEQ ID NO: 3985677 - RNA, 21 nt, Staphylococcus aureus subsp. aureus Mu50
ugagugcuuauuuguuuauua

SEQ ID NO: 3985678 - RNA, 22 nt, Staphylococcus aureus subsp. aureus Mu50
ugaguguguccaucauuugugu

SEQ ID NO: 3985679 - RNA, 18 nt, Staphylococcus aureus subsp. aureus Mu50
ugaguguuucauaaucuc

SEQ ID NO: 3985680 - RNA, 14 nt, Staphylococcus aureus subsp. aureus Mu50
ugaguuggcaucag

SEQ ID NO: 3985681 - RNA, 13 nt, Staphylococcus aureus subsp. aureus Mu50
ugaguuuaaaaau

SEQ ID NO: 3985682 - RNA, 14 nt, Staphylococcus aureus subsp. aureus Mu50
ugaguuuaaaaaua

SEQ ID NO: 3985683 - RNA, 21 nt, Staphylococcus aureus subsp. aureus Mu50
ugauaaaaaauaaagucauau

SEQ ID NO: 3985684 - RNA, 15 nt, Staphylococcus aureus subsp. aureus Mu50
ugauaaaaaucuuau

SEQ ID NO: 3985685 - RNA, 13 nt, Staphylococcus aureus subsp. aureus Mu50
ugauaaaauaaau

SEQ ID NO: 3985686 - RNA, 16 nt, Staphylococcus aureus subsp. aureus Mu50
ugauaaaauaaauaag

SEQ ID NO: 3985687 - RNA, 12 nt, Staphylococcus aureus subsp. aureus Mu50
ugauaaauaaaa

SEQ ID NO: 3985688 - RNA, 11 nt, Staphylococcus aureus subsp. aureus Mu50
ugauaaauaau

SEQ ID NO: 3985689 - RNA, 15 nt, Staphylococcus aureus subsp. aureus Mu50
ugauaaauaaugcau

SEQ ID NO: 3985690 - RNA, 19 nt, Staphylococcus aureus subsp. aureus Mu50
ugauaacaauuuuaaaucu

SEQ ID NO: 3985691 - RNA, 20 nt, Staphylococcus aureus subsp. aureus Mu50
ugauaacaauuuuaaaucuu

SEQ ID NO: 3985692 - RNA, 22 nt, Staphylococcus aureus subsp. aureus Mu50
ugauaaccauuaugauuaaucc

SEQ ID NO: 3985693 - RNA, 19 nt, Staphylococcus aureus subsp. aureus Mu50
ugauaacucguaaucauag

SEQ ID NO: 3985694 - RNA, 15 nt, Staphylococcus aureus subsp. aureus Mu50
ugauaacuuguaaua

SEQ ID NO: 3985695 - RNA, 18 nt, Staphylococcus aureus subsp. aureus Mu50
ugauaagucuugauggug

SEQ ID NO: 3985696 - RNA, 22 nt, Staphylococcus aureus subsp. aureus Mu50
ugauaauacuguuuaaauaaaa

SEQ ID NO: 3985697 - RNA, 21 nt, Staphylococcus aureus subsp. aureus Mu50
ugauaauccaccaaauacagu

SEQ ID NO: 3985698 - RNA, 19 nt, Staphylococcus aureus subsp. aureus Mu50
ugauaaugucuuacuuguc

SEQ ID NO: 3985699 - RNA, 13 nt, Staphylococcus aureus subsp. aureus Mu50
ugauaauuuaaua

SEQ ID NO: 3985700 - RNA, 14 nt, Staphylococcus aureus subsp. aureus Mu50
ugauaauuuuucuu

SEQ ID NO: 3985701 - RNA, 21 nt, Staphylococcus aureus subsp. aureus Mu50
ugauaauuuuucuucuuuuuu

SEQ ID NO: 3985702 - RNA, 22 nt, Staphylococcus aureus subsp. aureus Mu50
ugauaauuuuucuucuuuuuua

SEQ ID NO: 3985703 - RNA, 14 nt, Staphylococcus aureus subsp. aureus Mu50
ugauacaaugauua

SEQ ID NO: 3985704 - RNA, 20 nt, Staphylococcus aureus subsp. aureus Mu50
ugauacagaaccaacaauaa

SEQ ID NO: 3985705 - RNA, 14 nt, Staphylococcus aureus subsp. aureus Mu50
ugauacauuauuaa

SEQ ID NO: 3985706 - RNA, 18 nt, Staphylococcus aureus subsp. aureus Mu50
ugauacauuauuaaauag

SEQ ID NO: 3985707 - RNA, 17 nt, Staphylococcus aureus subsp. aureus Mu50
ugauacgcacguauaua

SEQ ID NO: 3985708 - RNA, 16 nt, Staphylococcus aureus subsp. aureus Mu50
ugauacgccuaaauau

SEQ ID NO: 3985709 - RNA, 19 nt, Staphylococcus aureus subsp. aureus Mu50
ugauacgccuaaauauuua

SEQ ID NO: 3985710 - RNA, 15 nt, Staphylococcus aureus subsp. aureus Mu50
ugauacgcuuuuuaa

SEQ ID NO: 3985711 - RNA, 20 nt, Staphylococcus aureus subsp. aureus Mu50
ugauacgcuuuuuaaaaaau

SEQ ID NO: 3985712 - RNA, 14 nt, Staphylococcus aureus subsp. aureus Mu50
ugauacucaauaaa

SEQ ID NO: 3985713 - RNA, 14 nt, Staphylococcus aureus subsp. aureus Mu50
ugauacugauauuu

SEQ ID NO: 3985714 - RNA, 17 nt, Staphylococcus aureus subsp. aureus Mu50
ugauacuucaccaucuu

SEQ ID NO: 3985715 - RNA, 17 nt, Staphylococcus aureus subsp. aureus Mu50
ugauagacuaauuaucu

SEQ ID NO: 3985716 - RNA, 15 nt, Staphylococcus aureus subsp. aureus Mu50
ugauagaugauacau

SEQ ID NO: 3985717 - RNA, 20 nt, Staphylococcus aureus subsp. aureus Mu50
ugauagcaaugaauuaauag

SEQ ID NO: 3985718 - RNA, 21 nt, Staphylococcus aureus subsp. aureus Mu50
ugauagccgcuucauugauga

SEQ ID NO: 3985719 - RNA, 21 nt, Staphylococcus aureus subsp. aureus Mu50
ugauagcgugauuuuucauau

SEQ ID NO: 3985720 - RNA, 22 nt, Staphylococcus aureus subsp. aureus Mu50
ugauagcuaaacauuuuauacu

SEQ ID NO: 3985721 - RNA, 15 nt, Staphylococcus aureus subsp. aureus Mu50
ugauaguacauuuau

SEQ ID NO: 3985722 - RNA, 14 nt, Staphylococcus aureus subsp. aureus Mu50
ugauagugaauaau

SEQ ID NO: 3985723 - RNA, 22 nt, Staphylococcus aureus subsp. aureus Mu50
ugauagugguagccaauaucau

SEQ ID NO: 3985724 - RNA, 17 nt, Staphylococcus aureus subsp. aureus Mu50
ugauaguuucuaaucuu

SEQ ID NO: 3985725 - RNA, 17 nt, Staphylococcus aureus subsp. aureus Mu50
ugauauaaaaagugaaa

SEQ ID NO: 3985726 - RNA, 23 nt, Staphylococcus aureus subsp. aureus Mu50
ugauauaaaaagugaaaguauua

SEQ ID NO: 3985727 - RNA, 16 nt, Staphylococcus aureus subsp. aureus Mu50
ugauauaaaccaugau

SEQ ID NO: 3985728 - RNA, 22 nt, Staphylococcus aureus subsp. aureus Mu50
ugauauaaauuaucagaaucaa

SEQ ID NO: 3985729 - RNA, 17 nt, Staphylococcus aureus subsp. aureus Mu50
ugauuaccuucucuuca

SEQ ID NO: 3985730 - RNA, 21 nt, Staphylococcus aureus subsp. aureus Mu50
ugauuacguugguuuaaaaau

SEQ ID NO: 3985731 - RNA, 23 nt, Staphylococcus aureus subsp. aureus Mu50
ugauuaguuucugacuuuuaaaa

SEQ ID NO: 3985732 - RNA, 15 nt, Staphylococcus aureus subsp. aureus Mu50
ugauuauaaauacau

SEQ ID NO: 3985733 - RNA, 14 nt, Staphylococcus aureus subsp. aureus Mu50
ugauuauauuucuc

SEQ ID NO: 3985734 - RNA, 15 nt, Staphylococcus aureus subsp. aureus Mu50
ugauuauauuucuca

SEQ ID NO: 3985735 - RNA, 16 nt, Staphylococcus aureus subsp. aureus Mu50
ugauuauauuucucau

SEQ ID NO: 3985736 - RNA, 17 nt, Staphylococcus aureus subsp. aureus Mu50
ugauuauauuuuucuuc

SEQ ID NO: 3985737 - RNA, 19 nt, Staphylococcus aureus subsp. aureus Mu50
ugauuauauuuuucuucag

SEQ ID NO: 3985738 - RNA, 15 nt, Staphylococcus aureus subsp. aureus Mu50
ugauuauucuucauu

SEQ ID NO: 3985739 - RNA, 22 nt, Staphylococcus aureus subsp. aureus Mu50
ugauucaaauaaaucaaacuuu

SEQ ID NO: 3985740 - RNA, 20 nt, Staphylococcus aureus subsp. aureus Mu50
ugauuccacuacaaucauac

SEQ ID NO: 3985741 - RNA, 14 nt, Staphylococcus aureus subsp. aureus Mu50
ugauucguauucaa

SEQ ID NO: 3985742 - RNA, 23 nt, Staphylococcus aureus subsp. aureus Mu50
ugauucguuaucuaagauuaaug

SEQ ID NO: 3985743 - RNA, 18 nt, Staphylococcus aureus subsp. aureus Mu50
ugauucuaaauaaucgaa

SEQ ID NO: 3985744 - RNA, 14 nt, Staphylococcus aureus subsp. aureus Mu50
ugauucuacagcau

SEQ ID NO: 3985745 - RNA, 14 nt, Staphylococcus aureus subsp. aureus Mu50
ugauucuagugaaa

SEQ ID NO: 3985746 - RNA, 21 nt, Staphylococcus aureus subsp. aureus Mu50
ugauucucuguagauaucaaa

SEQ ID NO: 3985747 - RNA, 22 nt, Staphylococcus aureus subsp. aureus Mu50
ugauucuucacuaaaaauauau

SEQ ID NO: 3985748 - RNA, 21 nt, Staphylococcus aureus subsp. aureus Mu50
ugauugaaauccuuaacuuua

SEQ ID NO: 3985749 - RNA, 12 nt, Staphylococcus aureus subsp. aureus Mu50
ugauugaacaau

SEQ ID NO: 3985750 - RNA, 17 nt, Staphylococcus aureus subsp. aureus Mu50
ugauugaacaauaauau

SEQ ID NO: 3985751 - RNA, 13 nt, Staphylococcus aureus subsp. aureus Mu50
ugauugaauguuu

SEQ ID NO: 3985752 - RNA, 16 nt, Staphylococcus aureus subsp. aureus Mu50
ugauugaauguuuggu

SEQ ID NO: 3985753 - RNA, 14 nt, Staphylococcus aureus subsp. aureus Mu50
ugauugauaugguu

SEQ ID NO: 3985754 - RNA, 20 nt, Staphylococcus aureus subsp. aureus Mu50
ugauugauaugguuagagaa

SEQ ID NO: 3985755 - RNA, 17 nt, Staphylococcus aureus subsp. aureus Mu50
ugauugcaaauuaucau

SEQ ID NO: 3985756 - RNA, 18 nt, Staphylococcus aureus subsp. aureus Mu50
ugauugcaaauuaucauu

SEQ ID NO: 3985757 - RNA, 19 nt, Staphylococcus aureus subsp. aureus Mu50
ugauugcaaauuaucauua

SEQ ID NO: 3985758 - RNA, 21 nt, Staphylococcus aureus subsp. aureus Mu50
ugauugcauugauuucagcac

SEQ ID NO: 3985759 - RNA, 22 nt, Staphylococcus aureus subsp. aureus Mu50
ugauugcugcuguacaauuucg

SEQ ID NO: 3985760 - RNA, 20 nt, Staphylococcus aureus subsp. aureus Mu50
ugauuggcagugaucuuuuu

SEQ ID NO: 3985761 - RNA, 22 nt, Staphylococcus aureus subsp. aureus Mu50
ugauuggcuugaaguuguuucu

SEQ ID NO: 3985762 - RNA, 16 nt, Staphylococcus aureus subsp. aureus Mu50
ugauuguaauaucuaa

SEQ ID NO: 3985763 - RNA, 14 nt, Staphylococcus aureus subsp. aureus Mu50
ugauugucauauaa

SEQ ID NO: 3985764 - RNA, 17 nt, Staphylococcus aureus subsp. aureus Mu50
ugauuguuaacgaauaa

SEQ ID NO: 3985765 - RNA, 13 nt, Staphylococcus aureus subsp. aureus Mu50
ugauuuaaaaaau

SEQ ID NO: 3985766 - RNA, 22 nt, Staphylococcus aureus subsp. aureus Mu50
ugauuuaagauuuaauaaagug

SEQ ID NO: 3985767 - RNA, 21 nt, Staphylococcus aureus subsp. aureus Mu50
ugauuuaauaaugcuauauuu

SEQ ID NO: 3985768 - RNA, 15 nt, Staphylococcus aureus subsp. aureus Mu50
ugauuuaauugaaau

SEQ ID NO: 3985769 - RNA, 15 nt, Staphylococcus aureus subsp. aureus Mu50
ugauuuaauuuuuaa

SEQ ID NO: 3985770 - RNA, 19 nt, Staphylococcus aureus subsp. aureus Mu50
ugauuuaccuuugucuuuu

SEQ ID NO: 3985771 - RNA, 22 nt, Staphylococcus aureus subsp. aureus Mu50
ugauuuaccuuugucuuuuuua

SEQ ID NO: 3985772 - RNA, 14 nt, Staphylococcus aureus subsp. aureus Mu50
ugauuuacgugcau

SEQ ID NO: 3985773 - RNA, 21 nt, Staphylococcus aureus subsp. aureus Mu50
ugauuuacgugcauuguaaua

SEQ ID NO: 3985774 - RNA, 19 nt, Staphylococcus aureus subsp. aureus Mu50
ugauuuagcagcgauacgu

SEQ ID NO: 3985775 - RNA, 17 nt, Staphylococcus aureus subsp. aureus Mu50
ugauuuagcauacauua

SEQ ID NO: 3985776 - RNA, 13 nt, Staphylococcus aureus subsp. aureus Mu50
ugauuuauaaaaa

SEQ ID NO: 3985777 - RNA, 22 nt, Staphylococcus aureus subsp. aureus Mu50
ugauuuauaaaaacuuauuugc

SEQ ID NO: 3985778 - RNA, 17 nt, Staphylococcus aureus subsp. aureus Mu50
ugauuuauucuaaauau

SEQ ID NO: 3985779 - RNA, 21 nt, Staphylococcus aureus subsp. aureus Mu50
ugauuuauucuaaauauauuu

SEQ ID NO: 3985780 - RNA, 12 nt, Staphylococcus aureus subsp. aureus Mu50
ugauuucacuac

SEQ ID NO: 3985781 - RNA, 14 nt, Staphylococcus aureus subsp. aureus Mu50
ugauuucacuacca

SEQ ID NO: 3985782 - RNA, 19 nt, Staphylococcus aureus subsp. aureus Mu50
ugauuuggguaauguuuuu

SEQ ID NO: 3985783 - RNA, 21 nt, Staphylococcus aureus subsp. aureus Mu50
ugauuugugguaaucauguaa

SEQ ID NO: 3985784 - RNA, 15 nt, Staphylococcus aureus subsp. aureus Mu50
ugauuuguuacuucu

SEQ ID NO: 3985785 - RNA, 16 nt, Staphylococcus aureus subsp. aureus Mu50
ugauuuguuacuucua

SEQ ID NO: 3985786 - RNA, 14 nt, Staphylococcus aureus subsp. aureus Mu50
ugauuuuacuugaa

SEQ ID NO: 3985787 - RNA, 18 nt, Staphylococcus aureus subsp. aureus Mu50
ugauuuuacuugaauaua

SEQ ID NO: 3985788 - RNA, 21 nt, Staphylococcus aureus subsp. aureus Mu50
ugauuuuaucaaauucaucag

SEQ ID NO: 3985789 - RNA, 17 nt, Staphylococcus aureus subsp. aureus Mu50
ugauuuugaauaaaaaa

SEQ ID NO: 3985790 - RNA, 14 nt, Staphylococcus aureus subsp. aureus Mu50
ugauuuugaaucac

SEQ ID NO: 3985791 - RNA, 19 nt, Staphylococcus aureus subsp. aureus Mu50
ugauuuugcuuuauuuucu

SEQ ID NO: 3985792 - RNA, 12 nt, Staphylococcus aureus subsp. aureus Mu50
ugauuuuuaaaa

SEQ ID NO: 3985793 - RNA, 22 nt, Staphylococcus aureus subsp. aureus Mu50
ugauuuuuauuauugucaucau

SEQ ID NO: 3985794 - RNA, 24 nt, Staphylococcus aureus subsp. aureus Mu50
ugauuuuucaucaauaucaaauuu

SEQ ID NO: 3985795 - RNA, 18 nt, Staphylococcus aureus subsp. aureus Mu50
ugauuuuuguaauugaug

SEQ ID NO: 3985796 - RNA, 12 nt, Staphylococcus aureus subsp. aureus Mu50
ugcaaaaauaau

SEQ ID NO: 3985797 - RNA, 18 nt, Staphylococcus aureus subsp. aureus Mu50
ugcaaaacgcauuucaug

SEQ ID NO: 3985798 - RNA, 15 nt, Staphylococcus aureus subsp. aureus Mu50
ugcaaaauguuacac

SEQ ID NO: 3985799 - RNA, 15 nt, Staphylococcus aureus subsp. aureus Mu50
ugcaaaauuaaugaa

SEQ ID NO: 3985800 - RNA, 15 nt, Staphylococcus aureus subsp. aureus Mu50
ugcaaacacaguaca

SEQ ID NO: 3985801 - RNA, 20 nt, Staphylococcus aureus subsp. aureus Mu50
ugcaaacacaguacaaauaa

SEQ ID NO: 3985802 - RNA, 15 nt, Staphylococcus aureus subsp. aureus Mu50
ugcaaacgauauguu

SEQ ID NO: 3985803 - RNA, 20 nt, Staphylococcus aureus subsp. aureus Mu50
ugcaaagggcgaaauggauu

SEQ ID NO: 3985804 - RNA, 13 nt, Staphylococcus aureus subsp. aureus Mu50
ugcaaauaaaaaa

SEQ ID NO: 3985805 - RNA, 14 nt, Staphylococcus aureus subsp. aureus Mu50
ugcaaauaaaaaag

SEQ ID NO: 3985806 - RNA, 20 nt, Staphylococcus aureus subsp. aureus Mu50
ugcaaauacgaguguuuuaa

SEQ ID NO: 3985807 - RNA, 19 nt, Staphylococcus aureus subsp. aureus Mu50
ugcaaauauaucaucucua

SEQ ID NO: 3985808 - RNA, 16 nt, Staphylococcus aureus subsp. aureus Mu50
ugcaaaucaaauacau

SEQ ID NO: 3985809 - RNA, 16 nt, Staphylococcus aureus subsp. aureus Mu50
ugcaaaugaaauucuu

SEQ ID NO: 3985810 - RNA, 14 nt, Staphylococcus aureus subsp. aureus Mu50
ugcaaaugccucuu

SEQ ID NO: 3985811 - RNA, 16 nt, Staphylococcus aureus subsp. aureus Mu50
ugcaaaugccucuuuc

SEQ ID NO: 3985812 - RNA, 20 nt, Staphylococcus aureus subsp. aureus Mu50
ugcaaauuaucauuaaauug

SEQ ID NO: 3985813 - RNA, 21 nt, Staphylococcus aureus subsp. aureus Mu50
ugcaaauuggauaauuucuuc

SEQ ID NO: 3985814 - RNA, 17 nt, Staphylococcus aureus subsp. aureus Mu50
ugcaacaauauaauaua

SEQ ID NO: 3985815 - RNA, 19 nt, Staphylococcus aureus subsp. aureus Mu50
ugcaacaccacacagcauu

SEQ ID NO: 3985816 - RNA, 15 nt, Staphylococcus aureus subsp. aureus Mu50
ugcauuuaauuuaau

SEQ ID NO: 3985817 - RNA, 20 nt, Staphylococcus aureus subsp. aureus Mu50
ugcauuuaauuuaauuuuag

SEQ ID NO: 3985818 - RNA, 21 nt, Staphylococcus aureus subsp. aureus Mu50
ugcauuuagaugauucuuauc

SEQ ID NO: 3985819 - RNA, 22 nt, Staphylococcus aureus subsp. aureus Mu50
ugcauuuagaugauucuuauca

SEQ ID NO: 3985820 - RNA, 21 nt, Staphylococcus aureus subsp. aureus Mu50
ugcauuuugcccaugucauga

SEQ ID NO: 3985821 - RNA, 18 nt, Staphylococcus aureus subsp. aureus Mu50
ugccaaaaugguuaaaau

SEQ ID NO: 3985822 - RNA, 15 nt, Staphylococcus aureus subsp. aureus Mu50
ugccaaauuucucuu

SEQ ID NO: 3985823 - RNA, 17 nt, Staphylococcus aureus subsp. aureus Mu50
ugccaauaaaaugcaau

SEQ ID NO: 3985824 - RNA, 17 nt, Staphylococcus aureus subsp. aureus Mu50
ugccaauggaaguuuuu

SEQ ID NO: 3985825 - RNA, 18 nt, Staphylococcus aureus subsp. aureus Mu50
ugccauacccauauuaaa

SEQ ID NO: 3985826 - RNA, 14 nt, Staphylococcus aureus subsp. aureus Mu50
ugccaucaauuucu

SEQ ID NO: 3985827 - RNA, 18 nt, Staphylococcus aureus subsp. aureus Mu50
ugccauucauuaagcuuu

SEQ ID NO: 3985828 - RNA, 19 nt, Staphylococcus aureus subsp. aureus Mu50
ugccauuguuauccaaaac

SEQ ID NO: 3985829 - RNA, 21 nt, Staphylococcus aureus subsp. aureus Mu50
ugcccaucucgugaaaauaau

SEQ ID NO: 3985830 - RNA, 12 nt, Staphylococcus aureus subsp. aureus Mu50
ugcccuuaaagc

SEQ ID NO: 3985831 - RNA, 20 nt, Staphylococcus aureus subsp. aureus Mu50
ugccgccuaauaauaaaaua

SEQ ID NO: 3985832 - RNA, 14 nt, Staphylococcus aureus subsp. aureus Mu50
ugccgcuucuacaa

SEQ ID NO: 3985833 - RNA, 14 nt, Staphylococcus aureus subsp. aureus Mu50
ugccggucauaaca

SEQ ID NO: 3985834 - RNA, 17 nt, Staphylococcus aureus subsp. aureus Mu50
ugccguaucuauaaaaa

SEQ ID NO: 3985835 - RNA, 17 nt, Staphylococcus aureus subsp. aureus Mu50
ugccguuauuuucaaua

SEQ ID NO: 3985836 - RNA, 23 nt, Staphylococcus aureus subsp. aureus Mu50
ugccguuugaagucuguuuagaa

SEQ ID NO: 3985837 - RNA, 14 nt, Staphylococcus aureus subsp. aureus Mu50
ugccuaaccuguuu

SEQ ID NO: 3985838 - RNA, 13 nt, Staphylococcus aureus subsp. aureus Mu50
ugccuaauuuugu

SEQ ID NO: 3985839 - RNA, 21 nt, Staphylococcus aureus subsp. aureus Mu50
ugccuauuugacacauuauug

SEQ ID NO: 3985840 - RNA, 20 nt, Staphylococcus aureus subsp. aureus Mu50
ugccugcccuuuagucaugu

SEQ ID NO: 3985841 - RNA, 18 nt, Staphylococcus aureus subsp. aureus Mu50
ugccuuaacuucauaaua

SEQ ID NO: 3985842 - RNA, 15 nt, Staphylococcus aureus subsp. aureus Mu50
ugccuuaucagcauu

SEQ ID NO: 3985843 - RNA, 16 nt, Staphylococcus aureus subsp. aureus Mu50
ugccuugucuauugua

SEQ ID NO: 3985844 - RNA, 17 nt, Staphylococcus aureus subsp. aureus Mu50
ugccuugucuauuguaa

SEQ ID NO: 3985845 - RNA, 15 nt, Staphylococcus aureus subsp. aureus Mu50
ugccuuugauuuuac

SEQ ID NO: 3985846 - RNA, 17 nt, Staphylococcus aureus subsp. aureus Mu50
ugccuuuuacauuugua

SEQ ID NO: 3985847 - RNA, 23 nt, Staphylococcus aureus subsp. aureus Mu50
ugcgaagaaaccuuuuuucucuu

SEQ ID NO: 3985848 - RNA, 16 nt, Staphylococcus aureus subsp. aureus Mu50
ugcgaagauuuuuaac

SEQ ID NO: 3985849 - RNA, 19 nt, Staphylococcus aureus subsp. aureus Mu50
ugcgaagauuuuuaacauu

SEQ ID NO: 3985850 - RNA, 15 nt, Staphylococcus aureus subsp. aureus Mu50
ugcgaagucacuugu

SEQ ID NO: 3985851 - RNA, 22 nt, Staphylococcus aureus subsp. aureus Mu50
ugcgacaucgccaauuugauua

SEQ ID NO: 3985852 - RNA, 13 nt, Staphylococcus aureus subsp. aureus Mu50
ugcgaguuggggu

SEQ ID NO: 3985853 - RNA, 18 nt, Staphylococcus aureus subsp. aureus Mu50
ugcgauaagcaaaaauuc

SEQ ID NO: 3985854 - RNA, 12 nt, Staphylococcus aureus subsp. aureus Mu50
ugcgcuuccaau

SEQ ID NO: 3985855 - RNA, 19 nt, Staphylococcus aureus subsp. aureus Mu50
ugcguaagguauuucauug

SEQ ID NO: 3985856 - RNA, 14 nt, Staphylococcus aureus subsp. aureus Mu50
ugcgucguuuauua

SEQ ID NO: 3985857 - RNA, 20 nt, Staphylococcus aureus subsp. aureus Mu50
ugcgugcgaagucacuuguc

SEQ ID NO: 3985858 - RNA, 19 nt, Staphylococcus aureus subsp. aureus Mu50
ugcgugcuuaauuacaaua

SEQ ID NO: 3985859 - RNA, 19 nt, Staphylococcus aureus subsp. aureus Mu50
ugcguugguauucaucuuc

SEQ ID NO: 3985860 - RNA, 23 nt, Staphylococcus aureus subsp. aureus Mu50
ugcuaaaaaaauuaaaauguuaa

SEQ ID NO: 3985861 - RNA, 16 nt, Staphylococcus aureus subsp. aureus Mu50
ugcuaaaaaguuagca

SEQ ID NO: 3985862 - RNA, 20 nt, Staphylococcus aureus subsp. aureus Mu50
ugcuaaaaaguuagcaaacg

SEQ ID NO: 3985863 - RNA, 13 nt, Staphylococcus aureus subsp. aureus Mu50
ugcuaaaaauauu

SEQ ID NO: 3985864 - RNA, 20 nt, Staphylococcus aureus subsp. aureus Mu50
ugcuaaaaauauugaauaau

SEQ ID NO: 3985865 - RNA, 17 nt, Staphylococcus aureus subsp. aureus Mu50
ugcuaaaaguauaaacc

SEQ ID NO: 3985866 - RNA, 20 nt, Staphylococcus aureus subsp. aureus Mu50
ugcuaauacuaaucaaagaa

SEQ ID NO: 3985867 - RNA, 17 nt, Staphylococcus aureus subsp. aureus Mu50
ugcuaauucaagaacag

SEQ ID NO: 3985868 - RNA, 18 nt, Staphylococcus aureus subsp. aureus Mu50
ugcuaauuuuuucaucau

SEQ ID NO: 3985869 - RNA, 13 nt, Staphylococcus aureus subsp. aureus Mu50
ugcuacaauuucc

SEQ ID NO: 3985870 - RNA, 17 nt, Staphylococcus aureus subsp. aureus Mu50
ugcuacaauuuccuacc

SEQ ID NO: 3985871 - RNA, 20 nt, Staphylococcus aureus subsp. aureus Mu50
ugcuagcuuucuuuuucauc

SEQ ID NO: 3985872 - RNA, 16 nt, Staphylococcus aureus subsp. aureus Mu50
ugcuagucauaauuua

SEQ ID NO: 3985873 - RNA, 12 nt, Staphylococcus aureus subsp. aureus Mu50
ugcuagugcuuc

SEQ ID NO: 3985874 - RNA, 22 nt, Staphylococcus aureus subsp. aureus Mu50
ugcuauauuucgguauuuuaaa

SEQ ID NO: 3985875 - RNA, 18 nt, Staphylococcus aureus subsp. aureus Mu50
ugcuauccuugcuaucaa

SEQ ID NO: 3985876 - RNA, 20 nt, Staphylococcus aureus subsp. aureus Mu50
ugcuaucucuaccauuucaa

SEQ ID NO: 3985877 - RNA, 21 nt, Staphylococcus aureus subsp. aureus Mu50
ugcuaucucuaccauuucaac

SEQ ID NO: 3985878 - RNA, 14 nt, Staphylococcus aureus subsp. aureus Mu50
ugcuauguauuuuu

SEQ ID NO: 3985879 - RNA, 19 nt, Staphylococcus aureus subsp. aureus Mu50
ugcuauuucaacaaacaua

SEQ ID NO: 3985880 - RNA, 14 nt, Staphylococcus aureus subsp. aureus Mu50
ugcuauuuuggaua

SEQ ID NO: 3985881 - RNA, 17 nt, Staphylococcus aureus subsp. aureus Mu50
ugcuauuuuggauaaua

SEQ ID NO: 3985882 - RNA, 19 nt, Staphylococcus aureus subsp. aureus Mu50
ugcucaaaaaugcuuauau

SEQ ID NO: 3985883 - RNA, 17 nt, Staphylococcus aureus subsp. aureus Mu50
ugcucaugagcacaaac

SEQ ID NO: 3985884 - RNA, 18 nt, Staphylococcus aureus subsp. aureus Mu50
ugcucgauauaugucuca

SEQ ID NO: 3985885 - RNA, 23 nt, Staphylococcus aureus subsp. aureus Mu50
ugcucuaaacuucuauuaauaau

SEQ ID NO: 3985886 - RNA, 18 nt, Staphylococcus aureus subsp. aureus Mu50
ugcucuaauccaaaauaa

SEQ ID NO: 3985887 - RNA, 17 nt, Staphylococcus aureus subsp. aureus Mu50
ugcucuaauucaaugau

SEQ ID NO: 3985888 - RNA, 17 nt, Staphylococcus aureus subsp. aureus Mu50
ugcucuuuauauauaaa

SEQ ID NO: 3985889 - RNA, 15 nt, Staphylococcus aureus subsp. aureus Mu50
ugcugaauaaauaac

SEQ ID NO: 3985890 - RNA, 20 nt, Staphylococcus aureus subsp. aureus Mu50
ugcugaaucgaguuugaaau

SEQ ID NO: 3985891 - RNA, 23 nt, Staphylococcus aureus subsp. aureus Mu50
ugcugauaauuuuucuucuuuuu

SEQ ID NO: 3985892 - RNA, 23 nt, Staphylococcus aureus subsp. aureus Mu50
ugcugccggugcagauaauugaa

SEQ ID NO: 3985893 - RNA, 14 nt, Staphylococcus aureus subsp. aureus Mu50
ugcugcuaauugau

SEQ ID NO: 3985894 - RNA, 17 nt, Staphylococcus aureus subsp. aureus Mu50
ugcuggguaauaaauug

SEQ ID NO: 3985895 - RNA, 13 nt, Staphylococcus aureus subsp. aureus Mu50
ugcugguugcuuc

SEQ ID NO: 3985896 - RNA, 22 nt, Staphylococcus aureus subsp. aureus Mu50
ugcugucaaacaacaaucaaau

SEQ ID NO: 3985897 - RNA, 14 nt, Staphylococcus aureus subsp. aureus Mu50
ugcuguuacuucuc

SEQ ID NO: 3985898 - RNA, 19 nt, Staphylococcus aureus subsp. aureus Mu50
ugcuguucucuauuuauaa

SEQ ID NO: 3985899 - RNA, 13 nt, Staphylococcus aureus subsp. aureus Mu50
ugcuguucuuuuu

SEQ ID NO: 3985900 - RNA, 22 nt, Staphylococcus aureus subsp. aureus Mu50
ugcuguugaagaagguaauaaa

SEQ ID NO: 3985901 - RNA, 15 nt, Staphylococcus aureus subsp. aureus Mu50
ugcuguuuuauucaa

SEQ ID NO: 3985902 - RNA, 16 nt, Staphylococcus aureus subsp. aureus Mu50
ugcuguuuuauucaau

SEQ ID NO: 3985903 - RNA, 18 nt, Staphylococcus aureus subsp. aureus Mu50
uggaugucaugucuagau

SEQ ID NO: 3985904 - RNA, 14 nt, Staphylococcus aureus subsp. aureus Mu50
uggauguguuuuaa

SEQ ID NO: 3985905 - RNA, 14 nt, Staphylococcus aureus subsp. aureus Mu50
uggauuacagauga

SEQ ID NO: 3985906 - RNA, 17 nt, Staphylococcus aureus subsp. aureus Mu50
uggauuaccguuaaaaa

SEQ ID NO: 3985907 - RNA, 21 nt, Staphylococcus aureus subsp. aureus Mu50
uggauuaucgaauuagauuua

SEQ ID NO: 3985908 - RNA, 23 nt, Staphylococcus aureus subsp. aureus Mu50
uggauucaaaugacauuuuaaau

SEQ ID NO: 3985909 - RNA, 13 nt, Staphylococcus aureus subsp. aureus Mu50
uggauuucuuauu

SEQ ID NO: 3985910 - RNA, 14 nt, Staphylococcus aureus subsp. aureus Mu50
uggauuucuuuuua

SEQ ID NO: 3985911 - RNA, 21 nt, Staphylococcus aureus subsp. aureus Mu50
uggauuuuaacaagauaacua

SEQ ID NO: 3985912 - RNA, 20 nt, Staphylococcus aureus subsp. aureus Mu50
uggauuuuucuuauaaaaau

SEQ ID NO: 3985913 - RNA, 13 nt, Staphylococcus aureus subsp. aureus Mu50
uggauuuuuuggu

SEQ ID NO: 3985914 - RNA, 16 nt, Staphylococcus aureus subsp. aureus Mu50
uggauuuuuuuguacu

SEQ ID NO: 3985915 - RNA, 14 nt, Staphylococcus aureus subsp. aureus Mu50
uggcaaagaauccu

SEQ ID NO: 3985916 - RNA, 14 nt, Staphylococcus aureus subsp. aureus Mu50
uggcaaaucaaaca

SEQ ID NO: 3985917 - RNA, 20 nt, Staphylococcus aureus subsp. aureus Mu50
uggcaaccuuuugauguuua

SEQ ID NO: 3985918 - RNA, 18 nt, Staphylococcus aureus subsp. aureus Mu50
uggcaacggcacauucau

SEQ ID NO: 3985919 - RNA, 15 nt, Staphylococcus aureus subsp. aureus Mu50
uggcaacguucuacu

SEQ ID NO: 3985920 - RNA, 20 nt, Staphylococcus aureus subsp. aureus Mu50
uggcaauauacuuuuuaaau

SEQ ID NO: 3985921 - RNA, 16 nt, Staphylococcus aureus subsp. aureus Mu50
uggcacauaaaucaau

SEQ ID NO: 3985922 - RNA, 15 nt, Staphylococcus aureus subsp. aureus Mu50
uggcacugcaaucag

SEQ ID NO: 3985923 - RNA, 19 nt, Staphylococcus aureus subsp. aureus Mu50
uggcauaucgauaaaugua

SEQ ID NO: 3985924 - RNA, 23 nt, Staphylococcus aureus subsp. aureus Mu50
uggcauaucgauaaauguauuaa

SEQ ID NO: 3985925 - RNA, 19 nt, Staphylococcus aureus subsp. aureus Mu50
uggcauuuacgaaguuuaa

SEQ ID NO: 3985926 - RNA, 21 nt, Staphylococcus aureus subsp. aureus Mu50
uggccuuuaaugauucuacag

SEQ ID NO: 3985927 - RNA, 21 nt, Staphylococcus aureus subsp. aureus Mu50
uggcgaauagcgauuuuaaag

SEQ ID NO: 3985928 - RNA, 22 nt, Staphylococcus aureus subsp. aureus Mu50
uggcgcaaugauaucuuuucca

SEQ ID NO: 3985929 - RNA, 16 nt, Staphylococcus aureus subsp. aureus Mu50
uggcgggcccccaaca

SEQ ID NO: 3985930 - RNA, 14 nt, Staphylococcus aureus subsp. aureus Mu50
uggcggggccccaa

SEQ ID NO: 3985931 - RNA, 19 nt, Staphylococcus aureus subsp. aureus Mu50
uggcggggccccaacacag

SEQ ID NO: 3985932 - RNA, 16 nt, Staphylococcus aureus subsp. aureus Mu50
uggcguaaugauauua

SEQ ID NO: 3985933 - RNA, 15 nt, Staphylococcus aureus subsp. aureus Mu50
uggcguugcaccaag

SEQ ID NO: 3985934 - RNA, 18 nt, Staphylococcus aureus subsp. aureus Mu50
uggcuacuugaauaccuu

SEQ ID NO: 3985935 - RNA, 19 nt, Staphylococcus aureus subsp. aureus Mu50
uggcuagucuuuaacuuua

SEQ ID NO: 3985936 - RNA, 22 nt, Staphylococcus aureus subsp. aureus Mu50
uggcuagucuuuaacuuuaauu

SEQ ID NO: 3985937 - RNA, 17 nt, Staphylococcus aureus subsp. aureus Mu50
uggcucaaaacuuuuac

SEQ ID NO: 3985938 - RNA, 14 nt, Staphylococcus aureus subsp. aureus Mu50
uggcucuucuuauc

SEQ ID NO: 3985939 - RNA, 19 nt, Staphylococcus aureus subsp. aureus Mu50
uggcucuuuuuauuuauaa

SEQ ID NO: 3985940 - RNA, 21 nt, Staphylococcus aureus subsp. aureus Mu50
uggcuuagguuuaauuuuaaa

SEQ ID NO: 3985941 - RNA, 14 nt, Staphylococcus aureus subsp. aureus Mu50
uggcuucucuuagu

SEQ ID NO: 3985942 - RNA, 21 nt, Staphylococcus aureus subsp. aureus Mu50
uggcuuuuuaauuguuuaaua

SEQ ID NO: 3985943 - RNA, 21 nt, Staphylococcus aureus subsp. aureus Mu50
uggcuuuuuauaccaauaauu

SEQ ID NO: 3985944 - RNA, 13 nt, Staphylococcus aureus subsp. aureus Mu50
uggcuuuuuuaau

SEQ ID NO: 3985945 - RNA, 14 nt, Staphylococcus aureus subsp. aureus Mu50
uggcuuuuuuaauu

SEQ ID NO: 3985946 - RNA, 18 nt, Staphylococcus aureus subsp. aureus Mu50
uggcuuuuuuauuuuaua

SEQ ID NO: 3985947 - RNA, 19 nt, Staphylococcus aureus subsp. aureus Mu50
uggcuuuuuuuauggugug

SEQ ID NO: 3985948 - RNA, 17 nt, Staphylococcus aureus subsp. aureus Mu50
ugggaauuguauuagca

SEQ ID NO: 3985949 - RNA, 18 nt, Staphylococcus aureus subsp. aureus Mu50
ugggacagaaaacaaagc

SEQ ID NO: 3985950 - RNA, 12 nt, Staphylococcus aureus subsp. aureus Mu50
ugggacauuaau

SEQ ID NO: 3985951 - RNA, 14 nt, Staphylococcus aureus subsp. aureus Mu50
ugggacgacgaaau

SEQ ID NO: 3985952 - RNA, 14 nt, Staphylococcus aureus subsp. aureus Mu50
ugggacuuuuuaua

SEQ ID NO: 3985953 - RNA, 21 nt, Staphylococcus aureus subsp. aureus Mu50
ugggccccaacacagagaauu

SEQ ID NO: 3985954 - RNA, 18 nt, Staphylococcus aureus subsp. aureus Mu50
uggggaugggccccaaca

SEQ ID NO: 3985955 - RNA, 22 nt, Staphylococcus aureus subsp. aureus Mu50
uggggaugggccccaacaaaga

SEQ ID NO: 3985956 - RNA, 17 nt, Staphylococcus aureus subsp. aureus Mu50
uggggcccacaccccaa

SEQ ID NO: 3985957 - RNA, 18 nt, Staphylococcus aureus subsp. aureus Mu50
uggggcccacaccccaac

SEQ ID NO: 3985958 - RNA, 16 nt, Staphylococcus aureus subsp. aureus Mu50
uggguaauaaauugua

SEQ ID NO: 3985959 - RNA, 14 nt, Staphylococcus aureus subsp. aureus Mu50
uggguaauguuuuu

SEQ ID NO: 3985960 - RNA, 15 nt, Staphylococcus aureus subsp. aureus Mu50
uggguauauaauuua

SEQ ID NO: 3985961 - RNA, 19 nt, Staphylococcus aureus subsp. aureus Mu50
uggguuuuaccauaaauug

SEQ ID NO: 3985962 - RNA, 18 nt, Staphylococcus aureus subsp. aureus Mu50
ugguaaaaaaauaacguu

SEQ ID NO: 3985963 - RNA, 15 nt, Staphylococcus aureus subsp. aureus Mu50
ugguaaaaaguuuaa

SEQ ID NO: 3985964 - RNA, 23 nt, Staphylococcus aureus subsp. aureus Mu50
ugguaaauuuaucauuuuaagua

SEQ ID NO: 3985965 - RNA, 15 nt, Staphylococcus aureus subsp. aureus Mu50
ugguaacguuaauag

SEQ ID NO: 3985966 - RNA, 19 nt, Staphylococcus aureus subsp. aureus Mu50
ugguaaguauaauuaaacu

SEQ ID NO: 3985967 - RNA, 17 nt, Staphylococcus aureus subsp. aureus Mu50
ugguacaccuacaaaua

SEQ ID NO: 3985968 - RNA, 15 nt, Staphylococcus aureus subsp. aureus Mu50
ugguaccuuuccaau

SEQ ID NO: 3985969 - RNA, 19 nt, Staphylococcus aureus subsp. aureus Mu50
ugguacuacuauccagucc

SEQ ID NO: 3985970 - RNA, 18 nt, Staphylococcus aureus subsp. aureus Mu50
ugguagccaauaucauau

SEQ ID NO: 3985971 - RNA, 17 nt, Staphylococcus aureus subsp. aureus Mu50
ugguauaucgaaaggua

SEQ ID NO: 3985972 - RNA, 18 nt, Staphylococcus aureus subsp. aureus Mu50
ugguaugacugcaaauac

SEQ ID NO: 3985973 - RNA, 20 nt, Staphylococcus aureus subsp. aureus Mu50
ugguaugacugcaaauacga

SEQ ID NO: 3985974 - RNA, 23 nt, Staphylococcus aureus subsp. aureus Mu50
ugguauuuuaugacguaauuaau

SEQ ID NO: 3985975 - RNA, 14 nt, Staphylococcus aureus subsp. aureus Mu50
ugguauuuuuuaaa

SEQ ID NO: 3985976 - RNA, 15 nt, Staphylococcus aureus subsp. aureus Mu50
ugguauuuuuuaaau

SEQ ID NO: 3985977 - RNA, 21 nt, Staphylococcus aureus subsp. aureus Mu50
uggucauuacuaaaacaaauu

SEQ ID NO: 3985978 - RNA, 18 nt, Staphylococcus aureus subsp. aureus Mu50
uggucuaaagcuuauuaa

SEQ ID NO: 3985979 - RNA, 19 nt, Staphylococcus aureus subsp. aureus Mu50
uggucuaucgccuaaaaau

SEQ ID NO: 3985980 - RNA, 15 nt, Staphylococcus aureus subsp. aureus Mu50
uggucugugauauuc

SEQ ID NO: 3985981 - RNA, 13 nt, Staphylococcus aureus subsp. aureus Mu50
uggugcaauaaua

SEQ ID NO: 3985982 - RNA, 20 nt, Staphylococcus aureus subsp. aureus Mu50
ugguggagaaccuuuaaaag

SEQ ID NO: 3985983 - RNA, 20 nt, Staphylococcus aureus subsp. aureus Mu50
uggugugccggcuuuuucuu

SEQ ID NO: 3985984 - RNA, 16 nt, Staphylococcus aureus subsp. aureus Mu50
ugguuaaaguuaaugc

SEQ ID NO: 3985985 - RNA, 15 nt, Staphylococcus aureus subsp. aureus Mu50
ugguuaacauccugc

SEQ ID NO: 3985986 - RNA, 19 nt, Staphylococcus aureus subsp. aureus Mu50
ugguuagagaaaaaucugu

SEQ ID NO: 3985987 - RNA, 15 nt, Staphylococcus aureus subsp. aureus Mu50
ugguuauuaaaauua

SEQ ID NO: 3985988 - RNA, 17 nt, Staphylococcus aureus subsp. aureus Mu50
ugguuauuaaaauuaaa

SEQ ID NO: 3985989 - RNA, 15 nt, Staphylococcus aureus subsp. aureus Mu50
ugguucaaaaaucau

SEQ ID NO: 3985990 - RNA, 16 nt, Staphylococcus aureus subsp. aureus Mu50
ugguucaaaaaucaua

SEQ ID NO: 3985991 - RNA, 19 nt, Staphylococcus aureus subsp. aureus Mu50
uguaccaauugauuuugcu

SEQ ID NO: 3985992 - RNA, 19 nt, Staphylococcus aureus subsp. aureus Mu50
uguaccaucacuaaaguaa

SEQ ID NO: 3985993 - RNA, 20 nt, Staphylococcus aureus subsp. aureus Mu50
uguaccaucacuaaaguaaa

SEQ ID NO: 3985994 - RNA, 16 nt, Staphylococcus aureus subsp. aureus Mu50
uguaccgaauccuuca

SEQ ID NO: 3985995 - RNA, 16 nt, Staphylococcus aureus subsp. aureus Mu50
uguaccguauuuuaau

SEQ ID NO: 3985996 - RNA, 19 nt, Staphylococcus aureus subsp. aureus Mu50
uguacgcuucaauuauuuc

SEQ ID NO: 3985997 - RNA, 15 nt, Staphylococcus aureus subsp. aureus Mu50
uguacguuuuuuuaa

SEQ ID NO: 3985998 - RNA, 16 nt, Staphylococcus aureus subsp. aureus Mu50
uguacguuuuuuuaaa

SEQ ID NO: 3985999 - RNA, 20 nt, Staphylococcus aureus subsp. aureus Mu50
uguacucuucguuuuaauaa

SEQ ID NO: 3986000 - RNA, 14 nt, Staphylococcus aureus subsp. aureus Mu50
uguacuuaaaaaua

SEQ ID NO: 3986001 - RNA, 13 nt, Staphylococcus aureus subsp. aureus Mu50
uguacuucaauuu

SEQ ID NO: 3986002 - RNA, 22 nt, Staphylococcus aureus subsp. aureus Mu50
uguacuuccuuccauucggaua

SEQ ID NO: 3986003 - RNA, 13 nt, Staphylococcus aureus subsp. aureus Mu50
uguagaaaacaug

SEQ ID NO: 3986004 - RNA, 22 nt, Staphylococcus aureus subsp. aureus Mu50
uguagacaauuguaguaaugaa

SEQ ID NO: 3986005 - RNA, 12 nt, Staphylococcus aureus subsp. aureus Mu50
uguagagaugug

SEQ ID NO: 3986006 - RNA, 19 nt, Staphylococcus aureus subsp. aureus Mu50
uguagauuacuuugcuaaa

SEQ ID NO: 3986007 - RNA, 18 nt, Staphylococcus aureus subsp. aureus Mu50
uguagccaaauaaauuuu

SEQ ID NO: 3986008 - RNA, 16 nt, Staphylococcus aureus subsp. aureus Mu50
uguaguacuauaguca

SEQ ID NO: 3986009 - RNA, 12 nt, Staphylococcus aureus subsp. aureus Mu50
uguauaaauaac

SEQ ID NO: 3986010 - RNA, 21 nt, Staphylococcus aureus subsp. aureus Mu50
uguauaaauaauaaaugcuau

SEQ ID NO: 3986011 - RNA, 13 nt, Staphylococcus aureus subsp. aureus Mu50
uguauaaauguca

SEQ ID NO: 3986012 - RNA, 13 nt, Staphylococcus aureus subsp. aureus Mu50
uguauaacauuau

SEQ ID NO: 3986013 - RNA, 14 nt, Staphylococcus aureus subsp. aureus Mu50
uguauaacauuauu

SEQ ID NO: 3986014 - RNA, 16 nt, Staphylococcus aureus subsp. aureus Mu50
uguauaacauuauuaa

SEQ ID NO: 3986015 - RNA, 22 nt, Staphylococcus aureus subsp. aureus Mu50
uguauaagcugaaaaucaucau

SEQ ID NO: 3986016 - RNA, 19 nt, Staphylococcus aureus subsp. aureus Mu50
uguauaaggauguacuaua

SEQ ID NO: 3986017 - RNA, 17 nt, Staphylococcus aureus subsp. aureus Mu50
uguauaccuauuccuau

SEQ ID NO: 3986018 - RNA, 17 nt, Staphylococcus aureus subsp. aureus Mu50
uguauagauuguauuua

SEQ ID NO: 3986019 - RNA, 15 nt, Staphylococcus aureus subsp. aureus Mu50
uguauauauauguaa

SEQ ID NO: 3986020 - RNA, 22 nt, Staphylococcus aureus subsp. aureus Mu50
uguauauauauguaaaugaaau

SEQ ID NO: 3986021 - RNA, 15 nt, Staphylococcus aureus subsp. aureus Mu50
uguauauggcauuaa

SEQ ID NO: 3986022 - RNA, 15 nt, Staphylococcus aureus subsp. aureus Mu50
uguauauucuuuuua

SEQ ID NO: 3986023 - RNA, 24 nt, Staphylococcus aureus subsp. aureus Mu50
uguauauuuaacaucaauuacucu

SEQ ID NO: 3986024 - RNA, 19 nt, Staphylococcus aureus subsp. aureus Mu50
uguaucacauucaauauuu

SEQ ID NO: 3986025 - RNA, 17 nt, Staphylococcus aureus subsp. aureus Mu50
uguaucaucauaaucaa

SEQ ID NO: 3986026 - RNA, 20 nt, Staphylococcus aureus subsp. aureus Mu50
uguaucucugaaaaacuucu

SEQ ID NO: 3986027 - RNA, 16 nt, Staphylococcus aureus subsp. aureus Mu50
uguaucugauguugau

SEQ ID NO: 3986028 - RNA, 21 nt, Staphylococcus aureus subsp. aureus Mu50
uguaucuguaacauaaacaau

SEQ ID NO: 3986029 - RNA, 14 nt, Staphylococcus aureus subsp. aureus Mu50
uguaucuucaccau

SEQ ID NO: 3986030 - RNA, 19 nt, Staphylococcus aureus subsp. aureus Mu50
uguaugaaaggaguauuuu

SEQ ID NO: 3986031 - RNA, 20 nt, Staphylococcus aureus subsp. aureus Mu50
uguaugauaaccauuaugau

SEQ ID NO: 3986032 - RNA, 21 nt, Staphylococcus aureus subsp. aureus Mu50
uguaugaucaagcugagcuuu

SEQ ID NO: 3986033 - RNA, 16 nt, Staphylococcus aureus subsp. aureus Mu50
uguaugaugaacuuaa

SEQ ID NO: 3986034 - RNA, 18 nt, Staphylococcus aureus subsp. aureus Mu50
uguaugccgccuaauaau

SEQ ID NO: 3986035 - RNA, 14 nt, Staphylococcus aureus subsp. aureus Mu50
uguauggcauaacc

SEQ ID NO: 3986036 - RNA, 12 nt, Staphylococcus aureus subsp. aureus Mu50
uguauuaaacau

SEQ ID NO: 3986037 - RNA, 19 nt, Staphylococcus aureus subsp. aureus Mu50
uguauuagcaauuugguca

SEQ ID NO: 3986038 - RNA, 20 nt, Staphylococcus aureus subsp. aureus Mu50
uguauuauccucaaauauau

SEQ ID NO: 3986039 - RNA, 21 nt, Staphylococcus aureus subsp. aureus Mu50
uguauuauugaaacuaauaau

SEQ ID NO: 3986040 - RNA, 20 nt, Staphylococcus aureus subsp. aureus Mu50
uguauucagucaguaaaaau

SEQ ID NO: 3986041 - RNA, 18 nt, Staphylococcus aureus subsp. aureus Mu50
uguauucauuuuaaauuc

SEQ ID NO: 3986042 - RNA, 19 nt, Staphylococcus aureus subsp. aureus Mu50
uguauucugaaacuuuaau

SEQ ID NO: 3986043 - RNA, 18 nt, Staphylococcus aureus subsp. aureus Mu50
uguauucuucuaauucug

SEQ ID NO: 3986044 - RNA, 19 nt, Staphylococcus aureus subsp. aureus Mu50
uguauucuucuaauucuga

SEQ ID NO: 3986045 - RNA, 16 nt, Staphylococcus aureus subsp. aureus Mu50
uguauugcuauaagaa

SEQ ID NO: 3986046 - RNA, 16 nt, Staphylococcus aureus subsp. aureus Mu50
uguauuguauuuuaau

SEQ ID NO: 3986047 - RNA, 17 nt, Staphylococcus aureus subsp. aureus Mu50
uguauuguauuuuaaug

SEQ ID NO: 3986048 - RNA, 19 nt, Staphylococcus aureus subsp. aureus Mu50
uguauuguuuguuuuuaua

SEQ ID NO: 3986049 - RNA, 12 nt, Staphylococcus aureus subsp. aureus Mu50
uguauuuauuac

SEQ ID NO: 3986050 - RNA, 18 nt, Staphylococcus aureus subsp. aureus Mu50
uguauuuauuuuuuuaaa

SEQ ID NO: 3986051 - RNA, 13 nt, Staphylococcus aureus subsp. aureus Mu50
uguauuucaucau

SEQ ID NO: 3986052 - RNA, 21 nt, Staphylococcus aureus subsp. aureus Mu50
uguauuuuucuuaauuaucau

SEQ ID NO: 3986053 - RNA, 19 nt, Staphylococcus aureus subsp. aureus Mu50
ugucaaaucggcuauacau

SEQ ID NO: 3986054 - RNA, 24 nt, Staphylococcus aureus subsp. aureus Mu50
ugucaaaucggcuauacauugaua

SEQ ID NO: 3986055 - RNA, 18 nt, Staphylococcus aureus subsp. aureus Mu50
ugucaauagcgguuuaaa

SEQ ID NO: 3986056 - RNA, 17 nt, Staphylococcus aureus subsp. aureus Mu50
ugucaauuuuuucauga

SEQ ID NO: 3986057 - RNA, 16 nt, Staphylococcus aureus subsp. aureus Mu50
ugucacaaucuguuca

SEQ ID NO: 3986058 - RNA, 23 nt, Staphylococcus aureus subsp. aureus Mu50
ugucacauguaccacauuuuccu

SEQ ID NO: 3986059 - RNA, 21 nt, Staphylococcus aureus subsp. aureus Mu50
ugucacugcaaacacaguaca

SEQ ID NO: 3986060 - RNA, 22 nt, Staphylococcus aureus subsp. aureus Mu50
ugucacuuggauucaaaugaca

SEQ ID NO: 3986061 - RNA, 15 nt, Staphylococcus aureus subsp. aureus Mu50
ugucaguuuuuuuau

SEQ ID NO: 3986062 - RNA, 20 nt, Staphylococcus aureus subsp. aureus Mu50
ugucauaauagauaaugcac

SEQ ID NO: 3986063 - RNA, 19 nt, Staphylococcus aureus subsp. aureus Mu50
ugucauaauccauucuucu

SEQ ID NO: 3986064 - RNA, 11 nt, Staphylococcus aureus subsp. aureus Mu50
ugucauaccuu

SEQ ID NO: 3986065 - RNA, 17 nt, Staphylococcus aureus subsp. aureus Mu50
ugucauaccuuuuaauu

SEQ ID NO: 3986066 - RNA, 21 nt, Staphylococcus aureus subsp. aureus Mu50
ugucauagccuauuuaaaaga

SEQ ID NO: 3986067 - RNA, 19 nt, Staphylococcus aureus subsp. aureus Mu50
ugucauaguauacauaauu

SEQ ID NO: 3986068 - RNA, 20 nt, Staphylococcus aureus subsp. aureus Mu50
ugucauaguauacauaauuc

SEQ ID NO: 3986069 - RNA, 22 nt, Staphylococcus aureus subsp. aureus Mu50
ugucaucaccuuguuaaaauaa

SEQ ID NO: 3986070 - RNA, 15 nt, Staphylococcus aureus subsp. aureus Mu50
ugucaucauguucua

SEQ ID NO: 3986071 - RNA, 12 nt, Staphylococcus aureus subsp. aureus Mu50
ugucaucgcuuu

SEQ ID NO: 3986072 - RNA, 16 nt, Staphylococcus aureus subsp. aureus Mu50
ugucaucgcuuuaauu

SEQ ID NO: 3986073 - RNA, 14 nt, Staphylococcus aureus subsp. aureus Mu50
ugucaucuaauuac

SEQ ID NO: 3986074 - RNA, 20 nt, Staphylococcus aureus subsp. aureus Mu50
ugucaugaauuuucaucauu

SEQ ID NO: 3986075 - RNA, 20 nt, Staphylococcus aureus subsp. aureus Mu50
ugucauguguucaaauaacg

SEQ ID NO: 3986076 - RNA, 12 nt, Staphylococcus aureus subsp. aureus Mu50
ugucauucuagu

SEQ ID NO: 3986077 - RNA, 13 nt, Staphylococcus aureus subsp. aureus Mu50
ugucauuucuucu

SEQ ID NO: 3986078 - RNA, 11 nt, Staphylococcus aureus subsp. aureus Mu50
uguguuuucaa

SEQ ID NO: 3986079 - RNA, 18 nt, Staphylococcus aureus subsp. aureus Mu50
uguguuuucaacaguuuu

SEQ ID NO: 3986080 - RNA, 14 nt, Staphylococcus aureus subsp. aureus Mu50
uguguuuucuuuuc

SEQ ID NO: 3986081 - RNA, 18 nt, Staphylococcus aureus subsp. aureus Mu50
uguuaaaauuugaauuga

SEQ ID NO: 3986082 - RNA, 18 nt, Staphylococcus aureus subsp. aureus Mu50
uguuaaagauuauuauua

SEQ ID NO: 3986083 - RNA, 14 nt, Staphylococcus aureus subsp. aureus Mu50
uguuaaaugacgcu

SEQ ID NO: 3986084 - RNA, 19 nt, Staphylococcus aureus subsp. aureus Mu50
uguuaaauuaaaucgauau

SEQ ID NO: 3986085 - RNA, 15 nt, Staphylococcus aureus subsp. aureus Mu50
uguuaaauucuaaaa

SEQ ID NO: 3986086 - RNA, 14 nt, Staphylococcus aureus subsp. aureus Mu50
uguuaacugaauuu

SEQ ID NO: 3986087 - RNA, 17 nt, Staphylococcus aureus subsp. aureus Mu50
uguuaacugaauuucgu

SEQ ID NO: 3986088 - RNA, 16 nt, Staphylococcus aureus subsp. aureus Mu50
uguuaacugauaaaag

SEQ ID NO: 3986089 - RNA, 16 nt, Staphylococcus aureus subsp. aureus Mu50
uguuaaguagaugauu

SEQ ID NO: 3986090 - RNA, 16 nt, Staphylococcus aureus subsp. aureus Mu50
uguuaauaaccgaaau

SEQ ID NO: 3986091 - RNA, 14 nt, Staphylococcus aureus subsp. aureus Mu50
uguuaaucaaaauu

SEQ ID NO: 3986092 - RNA, 18 nt, Staphylococcus aureus subsp. aureus Mu50
uguuaauuucaacauuac

SEQ ID NO: 3986093 - RNA, 15 nt, Staphylococcus aureus subsp. aureus Mu50
uguuacacaaauuaa

SEQ ID NO: 3986094 - RNA, 17 nt, Staphylococcus aureus subsp. aureus Mu50
uguuacacaaauuaaaa

SEQ ID NO: 3986095 - RNA, 21 nt, Staphylococcus aureus subsp. aureus Mu50
uguuacacaucgaucuaaaua

SEQ ID NO: 3986096 - RNA, 23 nt, Staphylococcus aureus subsp. aureus Mu50
uguuacacaucgaucuaaauaua

SEQ ID NO: 3986097 - RNA, 21 nt, Staphylococcus aureus subsp. aureus Mu50
uguuacacaugaguuaaacga

SEQ ID NO: 3986098 - RNA, 22 nt, Staphylococcus aureus subsp. aureus Mu50
uguuacauauugcauuuagacu

SEQ ID NO: 3986099 - RNA, 22 nt, Staphylococcus aureus subsp. aureus Mu50
uguuacugcacggauaccuacu

SEQ ID NO: 3986100 - RNA, 13 nt, Staphylococcus aureus subsp. aureus Mu50
uguuacuuauaua

SEQ ID NO: 3986101 - RNA, 16 nt, Staphylococcus aureus subsp. aureus Mu50
uguuacuuauauauuc

SEQ ID NO: 3986102 - RNA, 20 nt, Staphylococcus aureus subsp. aureus Mu50
uguuacuuauauauucaaua

SEQ ID NO: 3986103 - RNA, 15 nt, Staphylococcus aureus subsp. aureus Mu50
uguuacuugagaacc

SEQ ID NO: 3986104 - RNA, 17 nt, Staphylococcus aureus subsp. aureus Mu50
uguuagauaaucucauu

SEQ ID NO: 3986105 - RNA, 19 nt, Staphylococcus aureus subsp. aureus Mu50
uguuaggagagauguauaa

SEQ ID NO: 3986106 - RNA, 13 nt, Staphylococcus aureus subsp. aureus Mu50
uguuaggauaaag

SEQ ID NO: 3986107 - RNA, 16 nt, Staphylococcus aureus subsp. aureus Mu50
uguuaggggcuuuuau

SEQ ID NO: 3986108 - RNA, 18 nt, Staphylococcus aureus subsp. aureus Mu50
uguuagucuuuuuaagua

SEQ ID NO: 3986109 - RNA, 20 nt, Staphylococcus aureus subsp. aureus Mu50
uguuaguuuucuuaaaagag

SEQ ID NO: 3986110 - RNA, 23 nt, Staphylococcus aureus subsp. aureus Mu50
uguuaguuuucuuaaaagagcaa

SEQ ID NO: 3986111 - RNA, 22 nt, Staphylococcus aureus subsp. aureus Mu50
uguuauaaaggaagacauacuc

SEQ ID NO: 3986112 - RNA, 17 nt, Staphylococcus aureus subsp. aureus Mu50
uguuauaaguaaauaau

SEQ ID NO: 3986113 - RNA, 14 nt, Staphylococcus aureus subsp. aureus Mu50
uguuauauaaauau

SEQ ID NO: 3986114 - RNA, 15 nt, Staphylococcus aureus subsp. aureus Mu50
uguuauaucuaauuc

SEQ ID NO: 3986115 - RNA, 21 nt, Staphylococcus aureus subsp. aureus Mu50
uguuauauucuagauucauau

SEQ ID NO: 3986116 - RNA, 17 nt, Staphylococcus aureus subsp. aureus Mu50
uguuauccaaaacauuu

SEQ ID NO: 3986117 - RNA, 15 nt, Staphylococcus aureus subsp. aureus Mu50
uguuauguaaauaac

SEQ ID NO: 3986118 - RNA, 18 nt, Staphylococcus aureus subsp. aureus Mu50
uguuaugugauuaauuuc

SEQ ID NO: 3986119 - RNA, 15 nt, Staphylococcus aureus subsp. aureus Mu50
uguuauuaaccauca

SEQ ID NO: 3986120 - RNA, 16 nt, Staphylococcus aureus subsp. aureus Mu50
uguuauuaaccaucau

SEQ ID NO: 3986121 - RNA, 16 nt, Staphylococcus aureus subsp. aureus Mu50
uguucaaaaaaugaau

SEQ ID NO: 3986122 - RNA, 15 nt, Staphylococcus aureus subsp. aureus Mu50
uguucaaagacacgg

SEQ ID NO: 3986123 - RNA, 13 nt, Staphylococcus aureus subsp. aureus Mu50
uguucaaauguag

SEQ ID NO: 3986124 - RNA, 17 nt, Staphylococcus aureus subsp. aureus Mu50
uguucaacuaaauuuuc

SEQ ID NO: 3986125 - RNA, 20 nt, Staphylococcus aureus subsp. aureus Mu50
uguucaacuaaauuuucuaa

SEQ ID NO: 3986126 - RNA, 13 nt, Staphylococcus aureus subsp. aureus Mu50
uguucaauauuua

SEQ ID NO: 3986127 - RNA, 17 nt, Staphylococcus aureus subsp. aureus Mu50
uguucaaucacuauauu

SEQ ID NO: 3986128 - RNA, 16 nt, Staphylococcus aureus subsp. aureus Mu50
uguucaaugauuuuau

SEQ ID NO: 3986129 - RNA, 17 nt, Staphylococcus aureus subsp. aureus Mu50
uguucaaugauuuuaua

SEQ ID NO: 3986130 - RNA, 18 nt, Staphylococcus aureus subsp. aureus Mu50
uguucaaugauuuuauaa

SEQ ID NO: 3986131 - RNA, 19 nt, Staphylococcus aureus subsp. aureus Mu50
uguucaaugauuuuauaau

SEQ ID NO: 3986132 - RNA, 23 nt, Staphylococcus aureus subsp. aureus Mu50
uguucaaugauuuuauaauauua

SEQ ID NO: 3986133 - RNA, 17 nt, Staphylococcus aureus subsp. aureus Mu50
uguucaauuguuacuuu

SEQ ID NO: 3986134 - RNA, 16 nt, Staphylococcus aureus subsp. aureus Mu50
uguucacauucuugaa

SEQ ID NO: 3986135 - RNA, 16 nt, Staphylococcus aureus subsp. aureus Mu50
uguucaguuaaaucug

SEQ ID NO: 3986136 - RNA, 16 nt, Staphylococcus aureus subsp. aureus Mu50
uguucaguuguuuuuu

SEQ ID NO: 3986137 - RNA, 19 nt, Staphylococcus aureus subsp. aureus Mu50
uguucaguuguuuuuuugu

SEQ ID NO: 3986138 - RNA, 13 nt, Staphylococcus aureus subsp. aureus Mu50
uguucauaauaua

SEQ ID NO: 3986139 - RNA, 21 nt, Staphylococcus aureus subsp. aureus Mu50
uguucauacgcucaaucgcau

SEQ ID NO: 3986140 - RNA, 13 nt, Staphylococcus aureus subsp. aureus Mu50
uguucaugguuua

SEQ ID NO: 3986141 - RNA, 15 nt, Staphylococcus aureus subsp. aureus Mu50
uguucccauuuuuaa

SEQ ID NO: 3986142 - RNA, 17 nt, Staphylococcus aureus subsp. aureus Mu50
uguucccauuuuuaaaa

SEQ ID NO: 3986143 - RNA, 18 nt, Staphylococcus aureus subsp. aureus Mu50
uguuccgcuacaaaacau

SEQ ID NO: 3986144 - RNA, 21 nt, Staphylococcus aureus subsp. aureus Mu50
uguuccgcuacaaaacauauu

SEQ ID NO: 3986145 - RNA, 20 nt, Staphylococcus aureus subsp. aureus Mu50
uguuccuccaccaccugcaa

SEQ ID NO: 3986146 - RNA, 17 nt, Staphylococcus aureus subsp. aureus Mu50
uguucgggaauuuuuua

SEQ ID NO: 3986147 - RNA, 18 nt, Staphylococcus aureus subsp. aureus Mu50
uguucuaaccauucguaa

SEQ ID NO: 3986148 - RNA, 22 nt, Staphylococcus aureus subsp. aureus Mu50
uguucuaaccauucguaauaaa

SEQ ID NO: 3986149 - RNA, 17 nt, Staphylococcus aureus subsp. aureus Mu50
uguucuaaguguuuuau

SEQ ID NO: 3986150 - RNA, 14 nt, Staphylococcus aureus subsp. aureus Mu50
uguucuaaugcugc

SEQ ID NO: 3986151 - RNA, 16 nt, Staphylococcus aureus subsp. aureus Mu50
uguucuaauuguugua

SEQ ID NO: 3986152 - RNA, 18 nt, Staphylococcus aureus subsp. aureus Mu50
uguucucgucuuucgucc

SEQ ID NO: 3986153 - RNA, 15 nt, Staphylococcus aureus subsp. aureus Mu50
uguucucuauuuaua

SEQ ID NO: 3986154 - RNA, 16 nt, Staphylococcus aureus subsp. aureus Mu50
uguucugcuuuuucuu

SEQ ID NO: 3986155 - RNA, 21 nt, Staphylococcus aureus subsp. aureus Mu50
uguucuggaauugggaaauau

SEQ ID NO: 3986156 - RNA, 15 nt, Staphylococcus aureus subsp. aureus Mu50
uguucuuauaaaaaa

SEQ ID NO: 3986157 - RNA, 22 nt, Staphylococcus aureus subsp. aureus Mu50
uguucuucagaaacuuuugaaa

SEQ ID NO: 3986158 - RNA, 21 nt, Staphylococcus aureus subsp. aureus Mu50
uguucuucugcauagcgcucu

SEQ ID NO: 3986159 - RNA, 18 nt, Staphylococcus aureus subsp. aureus Mu50
uguucuuucuuucuuuuc

SEQ ID NO: 3986160 - RNA, 15 nt, Staphylococcus aureus subsp. aureus Mu50
uguugaaaaugacua

SEQ ID NO: 3986161 - RNA, 16 nt, Staphylococcus aureus subsp. aureus Mu50
uguugaaaaugacuac

SEQ ID NO: 3986162 - RNA, 19 nt, Staphylococcus aureus subsp. aureus Mu50
uguugaaauuaaauucaaa

SEQ ID NO: 3986163 - RNA, 18 nt, Staphylococcus aureus subsp. aureus Mu50
uguugaacgguagauuua

SEQ ID NO: 3986164 - RNA, 19 nt, Staphylococcus aureus subsp. aureus Mu50
uguugaacuuuaguauauu

SEQ ID NO: 3986165 - RNA, 16 nt, Staphylococcus aureus subsp. aureus Mu50
uguugaagucaauaau

SEQ ID NO: 3986166 - RNA, 21 nt, Staphylococcus aureus subsp. aureus Mu50
uguuuucagccacugucaugu

SEQ ID NO: 3986167 - RNA, 16 nt, Staphylococcus aureus subsp. aureus Mu50
uguuuucuauaauauu

SEQ ID NO: 3986168 - RNA, 17 nt, Staphylococcus aureus subsp. aureus Mu50
uguuuucuuuucaaaau

SEQ ID NO: 3986169 - RNA, 16 nt, Staphylococcus aureus subsp. aureus Mu50
uguuuugaauguuucu

SEQ ID NO: 3986170 - RNA, 21 nt, Staphylococcus aureus subsp. aureus Mu50
uguuuugagagauuauuuaaa

SEQ ID NO: 3986171 - RNA, 20 nt, Staphylococcus aureus subsp. aureus Mu50
uguuuuggaaaaauuguggc

SEQ ID NO: 3986172 - RNA, 19 nt, Staphylococcus aureus subsp. aureus Mu50
uguuuuuaacagcuuuuuc

SEQ ID NO: 3986173 - RNA, 15 nt, Staphylococcus aureus subsp. aureus Mu50
uguuuuuacaaaugu

SEQ ID NO: 3986174 - RNA, 18 nt, Staphylococcus aureus subsp. aureus Mu50
uguuuuucaucauuaaaa

SEQ ID NO: 3986175 - RNA, 19 nt, Staphylococcus aureus subsp. aureus Mu50
uguuuuucaucauuaaaau

SEQ ID NO: 3986176 - RNA, 20 nt, Staphylococcus aureus subsp. aureus Mu50
uguuuuugauaguaauaguu

SEQ ID NO: 3986177 - RNA, 13 nt, Staphylococcus aureus subsp. aureus Mu50
uguuuuuuaagua

SEQ ID NO: 3986178 - RNA, 18 nt, Staphylococcus aureus subsp. aureus Mu50
uguuuuuuuguuuggugu

SEQ ID NO: 3986179 - RNA, 10 nt, Staphylococcus aureus subsp. aureus Mu50
uuaaaaaaau

SEQ ID NO: 3986180 - RNA, 14 nt, Staphylococcus aureus subsp. aureus Mu50
uuaaaaaacaaaac

SEQ ID NO: 3986181 - RNA, 19 nt, Staphylococcus aureus subsp. aureus Mu50
uuaaaaaacauaccugcau

SEQ ID NO: 3986182 - RNA, 11 nt, Staphylococcus aureus subsp. aureus Mu50
uuaaaaaaccu

SEQ ID NO: 3986183 - RNA, 15 nt, Staphylococcus aureus subsp. aureus Mu50
uuaaaaaaccugaaa

SEQ ID NO: 3986184 - RNA, 18 nt, Staphylococcus aureus subsp. aureus Mu50
uuaaaaaaccugaaacaa

SEQ ID NO: 3986185 - RNA, 16 nt, Staphylococcus aureus subsp. aureus Mu50
uuaaaaaauuuaaaua

SEQ ID NO: 3986186 - RNA, 19 nt, Staphylococcus aureus subsp. aureus Mu50
uuaaaaacaauauugacuu

SEQ ID NO: 3986187 - RNA, 15 nt, Staphylococcus aureus subsp. aureus Mu50
uuaaaaacagcagua

SEQ ID NO: 3986188 - RNA, 22 nt, Staphylococcus aureus subsp. aureus Mu50
uuaaaaagcaguaaguugauuu

SEQ ID NO: 3986189 - RNA, 22 nt, Staphylococcus aureus subsp. aureus Mu50
uuaaaaagguacuaauguuaau

SEQ ID NO: 3986190 - RNA, 23 nt, Staphylococcus aureus subsp. aureus Mu50
uuaaaaagguacuaauguuaauc

SEQ ID NO: 3986191 - RNA, 16 nt, Staphylococcus aureus subsp. aureus Mu50
uuaaaaaguaauuaau

SEQ ID NO: 3986192 - RNA, 22 nt, Staphylococcus aureus subsp. aureus Mu50
uuaaaaauauguguuaacugau

SEQ ID NO: 3986193 - RNA, 13 nt, Staphylococcus aureus subsp. aureus Mu50
uuaaaaaucaaag

SEQ ID NO: 3986194 - RNA, 15 nt, Staphylococcus aureus subsp. aureus Mu50
uuaaaaaucaaagag

SEQ ID NO: 3986195 - RNA, 17 nt, Staphylococcus aureus subsp. aureus Mu50
uuaaaaaucaaagaggc

SEQ ID NO: 3986196 - RNA, 15 nt, Staphylococcus aureus subsp. aureus Mu50
uuaaaaaugaaauga

SEQ ID NO: 3986197 - RNA, 16 nt, Staphylococcus aureus subsp. aureus Mu50
uuaaaaauuucaauaa

SEQ ID NO: 3986198 - RNA, 17 nt, Staphylococcus aureus subsp. aureus Mu50
uuaaaaauuucaauaau

SEQ ID NO: 3986199 - RNA, 20 nt, Staphylococcus aureus subsp. aureus Mu50
uuaaaacaauaauuuaauau

SEQ ID NO: 3986200 - RNA, 12 nt, Staphylococcus aureus subsp. aureus Mu50
uuaaaacaucau

SEQ ID NO: 3986201 - RNA, 15 nt, Staphylococcus aureus subsp. aureus Mu50
uuaaaaccuuuucaa

SEQ ID NO: 3986202 - RNA, 13 nt, Staphylococcus aureus subsp. aureus Mu50
uuaaaacuauaau

SEQ ID NO: 3986203 - RNA, 14 nt, Staphylococcus aureus subsp. aureus Mu50
uuaaaacuauaaua

SEQ ID NO: 3986204 - RNA, 14 nt, Staphylococcus aureus subsp. aureus Mu50
uuaaaacuuguaaa

SEQ ID NO: 3986205 - RNA, 17 nt, Staphylococcus aureus subsp. aureus Mu50
uuaaaaguaacauacua

SEQ ID NO: 3986206 - RNA, 13 nt, Staphylococcus aureus subsp. aureus Mu50
uuaaaagugcaag

SEQ ID NO: 3986207 - RNA, 20 nt, Staphylococcus aureus subsp. aureus Mu50
uuaaaagugguuuuacugcu

SEQ ID NO: 3986208 - RNA, 21 nt, Staphylococcus aureus subsp. aureus Mu50
uuaaaagugucugguucuuua

SEQ ID NO: 3986209 - RNA, 12 nt, Staphylococcus aureus subsp. aureus Mu50
uuaaaauacaaa

SEQ ID NO: 3986210 - RNA, 22 nt, Staphylococcus aureus subsp. aureus Mu50
uuaaaauauaaauuucuucaua

SEQ ID NO: 3986211 - RNA, 21 nt, Staphylococcus aureus subsp. aureus Mu50
uuaaaauaugauuuaaaauau

SEQ ID NO: 3986212 - RNA, 18 nt, Staphylococcus aureus subsp. aureus Mu50
uuaaaauauuauuuuuaa

SEQ ID NO: 3986213 - RNA, 16 nt, Staphylococcus aureus subsp. aureus Mu50
uuaaaauauuuaacuu

SEQ ID NO: 3986214 - RNA, 18 nt, Staphylococcus aureus subsp. aureus Mu50
uuaaaaucucauaauaau

SEQ ID NO: 3986215 - RNA, 20 nt, Staphylococcus aureus subsp. aureus Mu50
uuaaaaugauaucugacauu

SEQ ID NO: 3986216 - RNA, 13 nt, Staphylococcus aureus subsp. aureus Mu50
uuaaaaugauugu

SEQ ID NO: 3986217 - RNA, 11 nt, Staphylococcus aureus subsp. aureus Mu50
uuaaaaugcuu

SEQ ID NO: 3986218 - RNA, 18 nt, Staphylococcus aureus subsp. aureus Mu50
uuaaaauuaaaccuacaa

SEQ ID NO: 3986219 - RNA, 11 nt, Staphylococcus aureus subsp. aureus Mu50
uuaaaauuauu

SEQ ID NO: 3986220 - RNA, 14 nt, Staphylococcus aureus subsp. aureus Mu50
uuaaaauuuaaaua

SEQ ID NO: 3986221 - RNA, 17 nt, Staphylococcus aureus subsp. aureus Mu50
uuaaaauuuuaauuaau

SEQ ID NO: 3986222 - RNA, 12 nt, Staphylococcus aureus subsp. aureus Mu50
uuaaacaaauaa

SEQ ID NO: 3986223 - RNA, 14 nt, Staphylococcus aureus subsp. aureus Mu50
uuaaacaagcauca

SEQ ID NO: 3986224 - RNA, 15 nt, Staphylococcus aureus subsp. aureus Mu50
uuaaacaagcaucau

SEQ ID NO: 3986225 - RNA, 16 nt, Staphylococcus aureus subsp. aureus Mu50
uuaaacaagcaucaug

SEQ ID NO: 3986226 - RNA, 19 nt, Staphylococcus aureus subsp. aureus Mu50
uuaaacaagccuuaaaaua

SEQ ID NO: 3986227 - RNA, 21 nt, Staphylococcus aureus subsp. aureus Mu50
uuaaacacgcgguaaaacgaa

SEQ ID NO: 3986228 - RNA, 16 nt, Staphylococcus aureus subsp. aureus Mu50
uuaaacaguuuaauuc

SEQ ID NO: 3986229 - RNA, 22 nt, Staphylococcus aureus subsp. aureus Mu50
uuaaacauaacaugaccuaaua

SEQ ID NO: 3986230 - RNA, 16 nt, Staphylococcus aureus subsp. aureus Mu50
uuaaacauuuagauuu

SEQ ID NO: 3986231 - RNA, 15 nt, Staphylococcus aureus subsp. aureus Mu50
uuaaacauuuuugaa

SEQ ID NO: 3986232 - RNA, 18 nt, Staphylococcus aureus subsp. aureus Mu50
uuaaaccguauagucauu

SEQ ID NO: 3986233 - RNA, 17 nt, Staphylococcus aureus subsp. aureus Mu50
uuaaaccguuauauauu

SEQ ID NO: 3986234 - RNA, 14 nt, Staphylococcus aureus subsp. aureus Mu50
uuaaaccuuaauaa

SEQ ID NO: 3986235 - RNA, 15 nt, Staphylococcus aureus subsp. aureus Mu50
uuaaaccuuaauaau

SEQ ID NO: 3986236 - RNA, 17 nt, Staphylococcus aureus subsp. aureus Mu50
uuaaacgcugauuuuau

SEQ ID NO: 3986237 - RNA, 20 nt, Staphylococcus aureus subsp. aureus Mu50
uuaaacgcugauuuuauaaa

SEQ ID NO: 3986238 - RNA, 15 nt, Staphylococcus aureus subsp. aureus Mu50
uuaaacgguucauuu

SEQ ID NO: 3986239 - RNA, 14 nt, Staphylococcus aureus subsp. aureus Mu50
uuaaacguaucauu

SEQ ID NO: 3986240 - RNA, 22 nt, Staphylococcus aureus subsp. aureus Mu50
uuaaacgugaauucgaugacuu

SEQ ID NO: 3986241 - RNA, 17 nt, Staphylococcus aureus subsp. aureus Mu50
uuaaacuacgaauucuc

SEQ ID NO: 3986242 - RNA, 18 nt, Staphylococcus aureus subsp. aureus Mu50
uuaaacucucuaaaaagc

SEQ ID NO: 3986243 - RNA, 12 nt, Staphylococcus aureus subsp. aureus Mu50
uuaaacuuauua

SEQ ID NO: 3986244 - RNA, 20 nt, Staphylococcus aureus subsp. aureus Mu50
uuaaacuuauuaauuaauag

SEQ ID NO: 3986245 - RNA, 19 nt, Staphylococcus aureus subsp. aureus Mu50
uuaaacuuccuuuuuuuaa

SEQ ID NO: 3986246 - RNA, 19 nt, Staphylococcus aureus subsp. aureus Mu50
uuaaagaaaaguuuaaguc

SEQ ID NO: 3986247 - RNA, 18 nt, Staphylococcus aureus subsp. aureus Mu50
uuaaagaaaauuucagua

SEQ ID NO: 3986248 - RNA, 20 nt, Staphylococcus aureus subsp. aureus Mu50
uuaaagaacuauuuuaaauu

SEQ ID NO: 3986249 - RNA, 21 nt, Staphylococcus aureus subsp. aureus Mu50
uuaaagagcaauuaaagucaa

SEQ ID NO: 3986250 - RNA, 18 nt, Staphylococcus aureus subsp. aureus Mu50
uuaaagauggcugcauca

SEQ ID NO: 3986251 - RNA, 19 nt, Staphylococcus aureus subsp. aureus Mu50
uuaaagauggcugcaucaa

SEQ ID NO: 3986252 - RNA, 20 nt, Staphylococcus aureus subsp. aureus Mu50
uuaaagauggcugcaucaau

SEQ ID NO: 3986253 - RNA, 19 nt, Staphylococcus aureus subsp. aureus Mu50
uuaaagaugucgaaaagua

SEQ ID NO: 3986254 - RNA, 13 nt, Staphylococcus aureus subsp. aureus Mu50
uuaacaucugaau

SEQ ID NO: 3986255 - RNA, 15 nt, Staphylococcus aureus subsp. aureus Mu50
uuaacaucugaaucu

SEQ ID NO: 3986256 - RNA, 14 nt, Staphylococcus aureus subsp. aureus Mu50
uuaacauuucugau

SEQ ID NO: 3986257 - RNA, 13 nt, Staphylococcus aureus subsp. aureus Mu50
uuaacauuuugaa

SEQ ID NO: 3986258 - RNA, 19 nt, Staphylococcus aureus subsp. aureus Mu50
uuaaccacuccuuaaacaa

SEQ ID NO: 3986259 - RNA, 15 nt, Staphylococcus aureus subsp. aureus Mu50
uuaaccauuuaaaaa

SEQ ID NO: 3986260 - RNA, 17 nt, Staphylococcus aureus subsp. aureus Mu50
uuaaccauuuaaaaauu

SEQ ID NO: 3986261 - RNA, 14 nt, Staphylococcus aureus subsp. aureus Mu50
uuaacgcaaaaaua

SEQ ID NO: 3986262 - RNA, 17 nt, Staphylococcus aureus subsp. aureus Mu50
uuaacgcaaaaauacuc

SEQ ID NO: 3986263 - RNA, 18 nt, Staphylococcus aureus subsp. aureus Mu50
uuaacggaaauacaauga

SEQ ID NO: 3986264 - RNA, 18 nt, Staphylococcus aureus subsp. aureus Mu50
uuaacggcguauucaauu

SEQ ID NO: 3986265 - RNA, 17 nt, Staphylococcus aureus subsp. aureus Mu50
uuaacgucaacagcaua

SEQ ID NO: 3986266 - RNA, 16 nt, Staphylococcus aureus subsp. aureus Mu50
uuaacguuuugauguu

SEQ ID NO: 3986267 - RNA, 12 nt, Staphylococcus aureus subsp. aureus Mu50
uuaacuaaacca

SEQ ID NO: 3986268 - RNA, 15 nt, Staphylococcus aureus subsp. aureus Mu50
uuaacuaauagacug

SEQ ID NO: 3986269 - RNA, 22 nt, Staphylococcus aureus subsp. aureus Mu50
uuaacuaguguaaugucucuuu

SEQ ID NO: 3986270 - RNA, 18 nt, Staphylococcus aureus subsp. aureus Mu50
uuaacuauaaauagaaga

SEQ ID NO: 3986271 - RNA, 17 nt, Staphylococcus aureus subsp. aureus Mu50
uuaacuauguuacuuau

SEQ ID NO: 3986272 - RNA, 18 nt, Staphylococcus aureus subsp. aureus Mu50
uuaacucaacuuaaauau

SEQ ID NO: 3986273 - RNA, 14 nt, Staphylococcus aureus subsp. aureus Mu50
uuaacugccauaua

SEQ ID NO: 3986274 - RNA, 20 nt, Staphylococcus aureus subsp. aureus Mu50
uuaacugguugauaaauaaa

SEQ ID NO: 3986275 - RNA, 20 nt, Staphylococcus aureus subsp. aureus Mu50
uuaacuguacgauucaauuu

SEQ ID NO: 3986276 - RNA, 21 nt, Staphylococcus aureus subsp. aureus Mu50
uuaacuguaugccgccuaaua

SEQ ID NO: 3986277 - RNA, 15 nt, Staphylococcus aureus subsp. aureus Mu50
uuaacuuaaaauuua

SEQ ID NO: 3986278 - RNA, 19 nt, Staphylococcus aureus subsp. aureus Mu50
uuaacuuaaaauuuaaaua

SEQ ID NO: 3986279 - RNA, 12 nt, Staphylococcus aureus subsp. aureus Mu50
uuaacuuaauua

SEQ ID NO: 3986280 - RNA, 14 nt, Staphylococcus aureus subsp. aureus Mu50
uuaacuucauaaua

SEQ ID NO: 3986281 - RNA, 17 nt, Staphylococcus aureus subsp. aureus Mu50
uuaacuucauaauauau

SEQ ID NO: 3986282 - RNA, 16 nt, Staphylococcus aureus subsp. aureus Mu50
uuaacuuccuaaaauu

SEQ ID NO: 3986283 - RNA, 14 nt, Staphylococcus aureus subsp. aureus Mu50
uuaacuuuaacauc

SEQ ID NO: 3986284 - RNA, 20 nt, Staphylococcus aureus subsp. aureus Mu50
uuaacuuucuuuuguuuuua

SEQ ID NO: 3986285 - RNA, 17 nt, Staphylococcus aureus subsp. aureus Mu50
uuaagaaacgucuuaau

SEQ ID NO: 3986286 - RNA, 23 nt, Staphylococcus aureus subsp. aureus Mu50
uuaagaauaaucgaacauaaaua

SEQ ID NO: 3986287 - RNA, 15 nt, Staphylococcus aureus subsp. aureus Mu50
uuaagaauacaugac

SEQ ID NO: 3986288 - RNA, 13 nt, Staphylococcus aureus subsp. aureus Mu50
uuaagaauguaca

SEQ ID NO: 3986289 - RNA, 15 nt, Staphylococcus aureus subsp. aureus Mu50
uuaagauuuuaacuu

SEQ ID NO: 3986290 - RNA, 13 nt, Staphylococcus aureus subsp. aureus Mu50
uuaagcccuuccc

SEQ ID NO: 3986291 - RNA, 19 nt, Staphylococcus aureus subsp. aureus Mu50
uuaagccugauguaccacu

SEQ ID NO: 3986292 - RNA, 15 nt, Staphylococcus aureus subsp. aureus Mu50
uuaagcuaucuaaac

SEQ ID NO: 3986293 - RNA, 22 nt, Staphylococcus aureus subsp. aureus Mu50
uuaagcucauuucaauauuaaa

SEQ ID NO: 3986294 - RNA, 13 nt, Staphylococcus aureus subsp. aureus Mu50
uuaagcuuuaauc

SEQ ID NO: 3986295 - RNA, 15 nt, Staphylococcus aureus subsp. aureus Mu50
uuaaguacaacaguu

SEQ ID NO: 3986296 - RNA, 13 nt, Staphylococcus aureus subsp. aureus Mu50
uuaaguacuuuua

SEQ ID NO: 3986297 - RNA, 19 nt, Staphylococcus aureus subsp. aureus Mu50
uuaaguagaugauuagugu

SEQ ID NO: 3986298 - RNA, 19 nt, Staphylococcus aureus subsp. aureus Mu50
uuaaguaguuguuauauuc

SEQ ID NO: 3986299 - RNA, 14 nt, Staphylococcus aureus subsp. aureus Mu50
uuaaguauaucuuu

SEQ ID NO: 3986300 - RNA, 17 nt, Staphylococcus aureus subsp. aureus Mu50
uuaaguauuuaaauaac

SEQ ID NO: 3986301 - RNA, 22 nt, Staphylococcus aureus subsp. aureus Mu50
uuaagucgccuaacuuuuauua

SEQ ID NO: 3986302 - RNA, 12 nt, Staphylococcus aureus subsp. aureus Mu50
uuaagugaguuu

SEQ ID NO: 3986303 - RNA, 17 nt, Staphylococcus aureus subsp. aureus Mu50
uuaagugaguuuuauuu

SEQ ID NO: 3986304 - RNA, 18 nt, Staphylococcus aureus subsp. aureus Mu50
uuaagugaguuuuauuua

SEQ ID NO: 3986305 - RNA, 20 nt, Staphylococcus aureus subsp. aureus Mu50
uuaagugcaauaacaccaau

SEQ ID NO: 3986306 - RNA, 17 nt, Staphylococcus aureus subsp. aureus Mu50
uuaagugggacuuuuua

SEQ ID NO: 3986307 - RNA, 13 nt, Staphylococcus aureus subsp. aureus Mu50
uuaaguuaauuuu

SEQ ID NO: 3986308 - RNA, 22 nt, Staphylococcus aureus subsp. aureus Mu50
uuaaguucaucuggugcaauau

SEQ ID NO: 3986309 - RNA, 14 nt, Staphylococcus aureus subsp. aureus Mu50
uuaaguuuucaauu

SEQ ID NO: 3986310 - RNA, 12 nt, Staphylococcus aureus subsp. aureus Mu50
uuaauaaaccua

SEQ ID NO: 3986311 - RNA, 19 nt, Staphylococcus aureus subsp. aureus Mu50
uuaauaaacgcuucauagu

SEQ ID NO: 3986312 - RNA, 13 nt, Staphylococcus aureus subsp. aureus Mu50
uuaauaaaguaau

SEQ ID NO: 3986313 - RNA, 12 nt, Staphylococcus aureus subsp. aureus Mu50
uuaauaaauaau

SEQ ID NO: 3986314 - RNA, 22 nt, Staphylococcus aureus subsp. aureus Mu50
uuaauaaauugacucaaagaua

SEQ ID NO: 3986315 - RNA, 22 nt, Staphylococcus aureus subsp. aureus Mu50
uuaauaaauuguuaucguucaa

SEQ ID NO: 3986316 - RNA, 19 nt, Staphylococcus aureus subsp. aureus Mu50
uuaauaaccauguaaaauu

SEQ ID NO: 3986317 - RNA, 20 nt, Staphylococcus aureus subsp. aureus Mu50
uuaauaacccauuuucaaaa

SEQ ID NO: 3986318 - RNA, 17 nt, Staphylococcus aureus subsp. aureus Mu50
uuaauaaccgaaauauu

SEQ ID NO: 3986319 - RNA, 21 nt, Staphylococcus aureus subsp. aureus Mu50
uuaauaaccuuuaaaacauca

SEQ ID NO: 3986320 - RNA, 23 nt, Staphylococcus aureus subsp. aureus Mu50
uuaauaaccuuuaaaacaucauu

SEQ ID NO: 3986321 - RNA, 13 nt, Staphylococcus aureus subsp. aureus Mu50
uuaauaacgauaa

SEQ ID NO: 3986322 - RNA, 20 nt, Staphylococcus aureus subsp. aureus Mu50
uuaauaauaucuuuugcguc

SEQ ID NO: 3986323 - RNA, 19 nt, Staphylococcus aureus subsp. aureus Mu50
uuaauaauuuuuuuccuuu

SEQ ID NO: 3986324 - RNA, 15 nt, Staphylococcus aureus subsp. aureus Mu50
uuaauacaucaauau

SEQ ID NO: 3986325 - RNA, 17 nt, Staphylococcus aureus subsp. aureus Mu50
uuaauacguuuaauaau

SEQ ID NO: 3986326 - RNA, 18 nt, Staphylococcus aureus subsp. aureus Mu50
uuaauacuaccguuuuua

SEQ ID NO: 3986327 - RNA, 20 nt, Staphylococcus aureus subsp. aureus Mu50
uuaauacuaccguuuuuaua

SEQ ID NO: 3986328 - RNA, 22 nt, Staphylococcus aureus subsp. aureus Mu50
uuaauacuaccguuuuuauaua

SEQ ID NO: 3986329 - RNA, 19 nt, Staphylococcus aureus subsp. aureus Mu50
uuaauacuauaguaagaaa

SEQ ID NO: 3986330 - RNA, 20 nt, Staphylococcus aureus subsp. aureus Mu50
uuaauacuauaguaagaaaa

SEQ ID NO: 3986331 - RNA, 23 nt, Staphylococcus aureus subsp. aureus Mu50
uuaauacuuuucucgauuaauuu

SEQ ID NO: 3986332 - RNA, 17 nt, Staphylococcus aureus subsp. aureus Mu50
uuaauagaaagagguuu

SEQ ID NO: 3986333 - RNA, 16 nt, Staphylococcus aureus subsp. aureus Mu50
uuaauagaaagugcgg

SEQ ID NO: 3986334 - RNA, 15 nt, Staphylococcus aureus subsp. aureus Mu50
uuaauagagaaagaa

SEQ ID NO: 3986335 - RNA, 18 nt, Staphylococcus aureus subsp. aureus Mu50
uuaauagagaaagaauaa

SEQ ID NO: 3986336 - RNA, 13 nt, Staphylococcus aureus subsp. aureus Mu50
uuaauagaucuuu

SEQ ID NO: 3986337 - RNA, 17 nt, Staphylococcus aureus subsp. aureus Mu50
uuaauagcuuggauugu

SEQ ID NO: 3986338 - RNA, 17 nt, Staphylococcus aureus subsp. aureus Mu50
uuaauaguacuuaauuu

SEQ ID NO: 3986339 - RNA, 21 nt, Staphylococcus aureus subsp. aureus Mu50
uuaauagugucaucaccuugu

SEQ ID NO: 3986340 - RNA, 14 nt, Staphylococcus aureus subsp. aureus Mu50
uuaauauaaaauaa

SEQ ID NO: 3986341 - RNA, 17 nt, Staphylococcus aureus subsp. aureus Mu50
uuaauauaaauaucaau

SEQ ID NO: 3986342 - RNA, 19 nt, Staphylococcus aureus subsp. aureus Mu50
uuaauuuugauauuuuuca

SEQ ID NO: 3986343 - RNA, 19 nt, Staphylococcus aureus subsp. aureus Mu50
uuaauuuugcaacauuaaa

SEQ ID NO: 3986344 - RNA, 12 nt, Staphylococcus aureus subsp. aureus Mu50
uuaauuuuucaa

SEQ ID NO: 3986345 - RNA, 13 nt, Staphylococcus aureus subsp. aureus Mu50
uuaauuuuucauu

SEQ ID NO: 3986346 - RNA, 16 nt, Staphylococcus aureus subsp. aureus Mu50
uuacaaacuucacauc

SEQ ID NO: 3986347 - RNA, 21 nt, Staphylococcus aureus subsp. aureus Mu50
uuacaaaguuaaccauacaua

SEQ ID NO: 3986348 - RNA, 13 nt, Staphylococcus aureus subsp. aureus Mu50
uuacaaauauacu

SEQ ID NO: 3986349 - RNA, 17 nt, Staphylococcus aureus subsp. aureus Mu50
uuacaaaucaugacaua

SEQ ID NO: 3986350 - RNA, 17 nt, Staphylococcus aureus subsp. aureus Mu50
uuacaaaugaagguguu

SEQ ID NO: 3986351 - RNA, 20 nt, Staphylococcus aureus subsp. aureus Mu50
uuacaaauguauaaauaaua

SEQ ID NO: 3986352 - RNA, 13 nt, Staphylococcus aureus subsp. aureus Mu50
uuacaauaaucac

SEQ ID NO: 3986353 - RNA, 17 nt, Staphylococcus aureus subsp. aureus Mu50
uuacaauauaauuuccu

SEQ ID NO: 3986354 - RNA, 22 nt, Staphylococcus aureus subsp. aureus Mu50
uuacacccuuuaaauuuaacuc

SEQ ID NO: 3986355 - RNA, 15 nt, Staphylococcus aureus subsp. aureus Mu50
uuacaccuuuggcac

SEQ ID NO: 3986356 - RNA, 23 nt, Staphylococcus aureus subsp. aureus Mu50
uuacacuaaaaccuauuccuaau

SEQ ID NO: 3986357 - RNA, 19 nt, Staphylococcus aureus subsp. aureus Mu50
uuacacuuuucuuaucagu

SEQ ID NO: 3986358 - RNA, 20 nt, Staphylococcus aureus subsp. aureus Mu50
uuacacuuuucuuaucaguu

SEQ ID NO: 3986359 - RNA, 22 nt, Staphylococcus aureus subsp. aureus Mu50
uuacaggagcgagccauuauua

SEQ ID NO: 3986360 - RNA, 16 nt, Staphylococcus aureus subsp. aureus Mu50
uuacagguugaauaaa

SEQ ID NO: 3986361 - RNA, 19 nt, Staphylococcus aureus subsp. aureus Mu50
uuacagguuuuaaaauuaa

SEQ ID NO: 3986362 - RNA, 20 nt, Staphylococcus aureus subsp. aureus Mu50
uuacagguuuuaaaauuaaa

SEQ ID NO: 3986363 - RNA, 17 nt, Staphylococcus aureus subsp. aureus Mu50
uuacagucaacugcugc

SEQ ID NO: 3986364 - RNA, 20 nt, Staphylococcus aureus subsp. aureus Mu50
uuacauaauuuaucugcaaa

SEQ ID NO: 3986365 - RNA, 15 nt, Staphylococcus aureus subsp. aureus Mu50
uuacauauugcauuu

SEQ ID NO: 3986366 - RNA, 15 nt, Staphylococcus aureus subsp. aureus Mu50
uuacaugcaccuuua

SEQ ID NO: 3986367 - RNA, 21 nt, Staphylococcus aureus subsp. aureus Mu50
uuacaugcaccuuuacaacau

SEQ ID NO: 3986368 - RNA, 12 nt, Staphylococcus aureus subsp. aureus Mu50
uuacauuacaua

SEQ ID NO: 3986369 - RNA, 14 nt, Staphylococcus aureus subsp. aureus Mu50
uuacauuacauaua

SEQ ID NO: 3986370 - RNA, 21 nt, Staphylococcus aureus subsp. aureus Mu50
uuacauuacgcucaucaccuu

SEQ ID NO: 3986371 - RNA, 18 nt, Staphylococcus aureus subsp. aureus Mu50
uuacauuuuaauaaaauc

SEQ ID NO: 3986372 - RNA, 19 nt, Staphylococcus aureus subsp. aureus Mu50
uuacauuuuaauaaaauca

SEQ ID NO: 3986373 - RNA, 14 nt, Staphylococcus aureus subsp. aureus Mu50
uuacauuuucaaaa

SEQ ID NO: 3986374 - RNA, 16 nt, Staphylococcus aureus subsp. aureus Mu50
uuaccaauaucaugca

SEQ ID NO: 3986375 - RNA, 23 nt, Staphylococcus aureus subsp. aureus Mu50
uuaccaauaucaugcaaaauaau

SEQ ID NO: 3986376 - RNA, 14 nt, Staphylococcus aureus subsp. aureus Mu50
uuaccaaugaauaa

SEQ ID NO: 3986377 - RNA, 15 nt, Staphylococcus aureus subsp. aureus Mu50
uuaccaaugaauaaa

SEQ ID NO: 3986378 - RNA, 15 nt, Staphylococcus aureus subsp. aureus Mu50
uuaccaccauuuuua

SEQ ID NO: 3986379 - RNA, 14 nt, Staphylococcus aureus subsp. aureus Mu50
uuaccaguaucauu

SEQ ID NO: 3986380 - RNA, 14 nt, Staphylococcus aureus subsp. aureus Mu50
uuaccaucuuuaau

SEQ ID NO: 3986381 - RNA, 22 nt, Staphylococcus aureus subsp. aureus Mu50
uuaccaugaugagauaaaauca

SEQ ID NO: 3986382 - RNA, 12 nt, Staphylococcus aureus subsp. aureus Mu50
uuacccaaaaaa

SEQ ID NO: 3986383 - RNA, 19 nt, Staphylococcus aureus subsp. aureus Mu50
uuacccacuuauaaacaaa

SEQ ID NO: 3986384 - RNA, 14 nt, Staphylococcus aureus subsp. aureus Mu50
uuacccuuuaaacu

SEQ ID NO: 3986385 - RNA, 14 nt, Staphylococcus aureus subsp. aureus Mu50
uuaccguuuauuuc

SEQ ID NO: 3986386 - RNA, 13 nt, Staphylococcus aureus subsp. aureus Mu50
uuaccuuuaauua

SEQ ID NO: 3986387 - RNA, 15 nt, Staphylococcus aureus subsp. aureus Mu50
uuaccuuuaauuaca

SEQ ID NO: 3986388 - RNA, 20 nt, Staphylococcus aureus subsp. aureus Mu50
uuaccuuuaccaguaucauu

SEQ ID NO: 3986389 - RNA, 15 nt, Staphylococcus aureus subsp. aureus Mu50
uuaccuuuauguuca

SEQ ID NO: 3986390 - RNA, 13 nt, Staphylococcus aureus subsp. aureus Mu50
uuaccuuucaaau

SEQ ID NO: 3986391 - RNA, 15 nt, Staphylococcus aureus subsp. aureus Mu50
uuaccuuuuaaaccu

SEQ ID NO: 3986392 - RNA, 15 nt, Staphylococcus aureus subsp. aureus Mu50
uuacgaaaguagaau

SEQ ID NO: 3986393 - RNA, 15 nt, Staphylococcus aureus subsp. aureus Mu50
uuacgaaguuuaaau

SEQ ID NO: 3986394 - RNA, 23 nt, Staphylococcus aureus subsp. aureus Mu50
uuacgacauacuugucguauucu

SEQ ID NO: 3986395 - RNA, 21 nt, Staphylococcus aureus subsp. aureus Mu50
uuacgagugcacuuguaauau

SEQ ID NO: 3986396 - RNA, 23 nt, Staphylococcus aureus subsp. aureus Mu50
uuacgagugcacuuguaauauua

SEQ ID NO: 3986397 - RNA, 14 nt, Staphylococcus aureus subsp. aureus Mu50
uuacgauaaacuaa

SEQ ID NO: 3986398 - RNA, 18 nt, Staphylococcus aureus subsp. aureus Mu50
uuacgaucauaaauauuu

SEQ ID NO: 3986399 - RNA, 12 nt, Staphylococcus aureus subsp. aureus Mu50
uuacuaaaacaa

SEQ ID NO: 3986400 - RNA, 12 nt, Staphylococcus aureus subsp. aureus Mu50
uuacuaaaauca

SEQ ID NO: 3986401 - RNA, 14 nt, Staphylococcus aureus subsp. aureus Mu50
uuacuaaaugaauu

SEQ ID NO: 3986402 - RNA, 20 nt, Staphylococcus aureus subsp. aureus Mu50
uuacuaaaugaauugcuugu

SEQ ID NO: 3986403 - RNA, 22 nt, Staphylococcus aureus subsp. aureus Mu50
uuacuacaaacuugauuaugua

SEQ ID NO: 3986404 - RNA, 16 nt, Staphylococcus aureus subsp. aureus Mu50
uuacuacgcauuauua

SEQ ID NO: 3986405 - RNA, 15 nt, Staphylococcus aureus subsp. aureus Mu50
uuacuacuuaauuaa

SEQ ID NO: 3986406 - RNA, 16 nt, Staphylococcus aureus subsp. aureus Mu50
uuacuacuuaauuaau

SEQ ID NO: 3986407 - RNA, 15 nt, Staphylococcus aureus subsp. aureus Mu50
uuacuauuaaaggaa

SEQ ID NO: 3986408 - RNA, 21 nt, Staphylococcus aureus subsp. aureus Mu50
uuacucaaaccaucuuaucuu

SEQ ID NO: 3986409 - RNA, 13 nt, Staphylococcus aureus subsp. aureus Mu50
uuacuccuuacaa

SEQ ID NO: 3986410 - RNA, 16 nt, Staphylococcus aureus subsp. aureus Mu50
uuacuccuuacaauaa

SEQ ID NO: 3986411 - RNA, 16 nt, Staphylococcus aureus subsp. aureus Mu50
uuacugaaacuaaauu

SEQ ID NO: 3986412 - RNA, 22 nt, Staphylococcus aureus subsp. aureus Mu50
uuacugaaacuaaauuaaaagu

SEQ ID NO: 3986413 - RNA, 16 nt, Staphylococcus aureus subsp. aureus Mu50
uuacugaugaacauac

SEQ ID NO: 3986414 - RNA, 19 nt, Staphylococcus aureus subsp. aureus Mu50
uuacugcaauuauuuuuca

SEQ ID NO: 3986415 - RNA, 21 nt, Staphylococcus aureus subsp. aureus Mu50
uuacugcacggauaccuacug

SEQ ID NO: 3986416 - RNA, 21 nt, Staphylococcus aureus subsp. aureus Mu50
uuacugcuguuuuuuauagua

SEQ ID NO: 3986417 - RNA, 15 nt, Staphylococcus aureus subsp. aureus Mu50
uuacuguaaauauga

SEQ ID NO: 3986418 - RNA, 14 nt, Staphylococcus aureus subsp. aureus Mu50
uuacuguaguacua

SEQ ID NO: 3986419 - RNA, 22 nt, Staphylococcus aureus subsp. aureus Mu50
uuacuguuaggauaaagauguc

SEQ ID NO: 3986420 - RNA, 12 nt, Staphylococcus aureus subsp. aureus Mu50
uuacuuaaucug

SEQ ID NO: 3986421 - RNA, 23 nt, Staphylococcus aureus subsp. aureus Mu50
uuacuuaaucuggguuguaaucu

SEQ ID NO: 3986422 - RNA, 16 nt, Staphylococcus aureus subsp. aureus Mu50
uuacuuauauauucaa

SEQ ID NO: 3986423 - RNA, 17 nt, Staphylococcus aureus subsp. aureus Mu50
uuacuuauauauucaau

SEQ ID NO: 3986424 - RNA, 11 nt, Staphylococcus aureus subsp. aureus Mu50
uuacuucaguu

SEQ ID NO: 3986425 - RNA, 17 nt, Staphylococcus aureus subsp. aureus Mu50
uuacuuccauugcuucu

SEQ ID NO: 3986426 - RNA, 18 nt, Staphylococcus aureus subsp. aureus Mu50
uuacuucuaauaguaaug

SEQ ID NO: 3986427 - RNA, 22 nt, Staphylococcus aureus subsp. aureus Mu50
uuacuugcuuuuucaaauaaua

SEQ ID NO: 3986428 - RNA, 12 nt, Staphylococcus aureus subsp. aureus Mu50
uuacuuuaacuu

SEQ ID NO: 3986429 - RNA, 16 nt, Staphylococcus aureus subsp. aureus Mu50
uuacuuucgcuugcaa

SEQ ID NO: 3986430 - RNA, 22 nt, Staphylococcus aureus subsp. aureus Mu50
uuauaaagacaccuucaauauc

SEQ ID NO: 3986431 - RNA, 14 nt, Staphylococcus aureus subsp. aureus Mu50
uuauaaauaucuuu

SEQ ID NO: 3986432 - RNA, 15 nt, Staphylococcus aureus subsp. aureus Mu50
uuauaaaucaaagag

SEQ ID NO: 3986433 - RNA, 17 nt, Staphylococcus aureus subsp. aureus Mu50
uuauaaaucaaagagga

SEQ ID NO: 3986434 - RNA, 18 nt, Staphylococcus aureus subsp. aureus Mu50
uuauaaaucauucuuuau

SEQ ID NO: 3986435 - RNA, 17 nt, Staphylococcus aureus subsp. aureus Mu50
uuauaaaugaaucgcuu

SEQ ID NO: 3986436 - RNA, 21 nt, Staphylococcus aureus subsp. aureus Mu50
uuauaaaugaauuauuuaaaa

SEQ ID NO: 3986437 - RNA, 14 nt, Staphylococcus aureus subsp. aureus Mu50
uuauaaaugauuaa

SEQ ID NO: 3986438 - RNA, 19 nt, Staphylococcus aureus subsp. aureus Mu50
uuauaaauucuaucuauaa

SEQ ID NO: 3986439 - RNA, 23 nt, Staphylococcus aureus subsp. aureus Mu50
uuauaaauuucgauuaauugaau

SEQ ID NO: 3986440 - RNA, 15 nt, Staphylococcus aureus subsp. aureus Mu50
uuauaaauuuuggac

SEQ ID NO: 3986441 - RNA, 16 nt, Staphylococcus aureus subsp. aureus Mu50
uuauaacaaaaauugc

SEQ ID NO: 3986442 - RNA, 19 nt, Staphylococcus aureus subsp. aureus Mu50
uuauaacauuuaagaaacg

SEQ ID NO: 3986443 - RNA, 16 nt, Staphylococcus aureus subsp. aureus Mu50
uuauaacuuuaaaaau

SEQ ID NO: 3986444 - RNA, 19 nt, Staphylococcus aureus subsp. aureus Mu50
uuauaagaauuuaaaagag

SEQ ID NO: 3986445 - RNA, 13 nt, Staphylococcus aureus subsp. aureus Mu50
uuauaagccuuuu

SEQ ID NO: 3986446 - RNA, 14 nt, Staphylococcus aureus subsp. aureus Mu50
uuauaaguaaauaa

SEQ ID NO: 3986447 - RNA, 16 nt, Staphylococcus aureus subsp. aureus Mu50
uuauaaguaaauaaua

SEQ ID NO: 3986448 - RNA, 15 nt, Staphylococcus aureus subsp. aureus Mu50
uuauaaguauauaau

SEQ ID NO: 3986449 - RNA, 21 nt, Staphylococcus aureus subsp. aureus Mu50
uuauaaguaucgccaucauuc

SEQ ID NO: 3986450 - RNA, 14 nt, Staphylococcus aureus subsp. aureus Mu50
uuauaaguugcaua

SEQ ID NO: 3986451 - RNA, 21 nt, Staphylococcus aureus subsp. aureus Mu50
uuauaauacguguguuuucuu

SEQ ID NO: 3986452 - RNA, 17 nt, Staphylococcus aureus subsp. aureus Mu50
uuauaauggcaguaguu

SEQ ID NO: 3986453 - RNA, 15 nt, Staphylococcus aureus subsp. aureus Mu50
uuauacagugaaucu

SEQ ID NO: 3986454 - RNA, 14 nt, Staphylococcus aureus subsp. aureus Mu50
uuauacauaaauau

SEQ ID NO: 3986455 - RNA, 14 nt, Staphylococcus aureus subsp. aureus Mu50
uuauacgaaucaca

SEQ ID NO: 3986456 - RNA, 23 nt, Staphylococcus aureus subsp. aureus Mu50
uuauacuauaaauacaaauauau

SEQ ID NO: 3986457 - RNA, 16 nt, Staphylococcus aureus subsp. aureus Mu50
uuauacucugaaaagc

SEQ ID NO: 3986458 - RNA, 19 nt, Staphylococcus aureus subsp. aureus Mu50
uuauacuuuuggucuguug

SEQ ID NO: 3986459 - RNA, 16 nt, Staphylococcus aureus subsp. aureus Mu50
uuauagauuuaaagaa

SEQ ID NO: 3986460 - RNA, 22 nt, Staphylococcus aureus subsp. aureus Mu50
uuauagcaaauugauuaaauaa

SEQ ID NO: 3986461 - RNA, 23 nt, Staphylococcus aureus subsp. aureus Mu50
uuauagcaaauugauuaaauaaa

SEQ ID NO: 3986462 - RNA, 22 nt, Staphylococcus aureus subsp. aureus Mu50
uuauagcagguggcauccauau

SEQ ID NO: 3986463 - RNA, 15 nt, Staphylococcus aureus subsp. aureus Mu50
uuauagugguaaaaa

SEQ ID NO: 3986464 - RNA, 14 nt, Staphylococcus aureus subsp. aureus Mu50
uuauauaaaaagaa

SEQ ID NO: 3986465 - RNA, 17 nt, Staphylococcus aureus subsp. aureus Mu50
uuauauaaacaaaaauc

SEQ ID NO: 3986466 - RNA, 17 nt, Staphylococcus aureus subsp. aureus Mu50
uuauauaauucuucaaa

SEQ ID NO: 3986467 - RNA, 23 nt, Staphylococcus aureus subsp. aureus Mu50
uuauauauaaaaucauuaauaau

SEQ ID NO: 3986468 - RNA, 14 nt, Staphylococcus aureus subsp. aureus Mu50
uuauauauauuaaa

SEQ ID NO: 3986469 - RNA, 18 nt, Staphylococcus aureus subsp. aureus Mu50
uuauauauauuaaaguaa

SEQ ID NO: 3986470 - RNA, 15 nt, Staphylococcus aureus subsp. aureus Mu50
uuauauauucaauaa

SEQ ID NO: 3986471 - RNA, 14 nt, Staphylococcus aureus subsp. aureus Mu50
uuauaucaaaaaau

SEQ ID NO: 3986472 - RNA, 21 nt, Staphylococcus aureus subsp. aureus Mu50
uuauaucauucuguguaaaua

SEQ ID NO: 3986473 - RNA, 23 nt, Staphylococcus aureus subsp. aureus Mu50
uuauauccaucuccaccauuaau

SEQ ID NO: 3986474 - RNA, 22 nt, Staphylococcus aureus subsp. aureus Mu50
uuauaucuuuuauacauguaca

SEQ ID NO: 3986475 - RNA, 20 nt, Staphylococcus aureus subsp. aureus Mu50
uuauaugaagcguuuuuauu

SEQ ID NO: 3986476 - RNA, 17 nt, Staphylococcus aureus subsp. aureus Mu50
uuauaugaugaauuguu

SEQ ID NO: 3986477 - RNA, 14 nt, Staphylococcus aureus subsp. aureus Mu50
uuauaugcaacuua

SEQ ID NO: 3986478 - RNA, 16 nt, Staphylococcus aureus subsp. aureus Mu50
uuauaugcaacuuaua

SEQ ID NO: 3986479 - RNA, 17 nt, Staphylococcus aureus subsp. aureus Mu50
uuauauggguguuggaa

SEQ ID NO: 3986480 - RNA, 12 nt, Staphylococcus aureus subsp. aureus Mu50
uuauauguuaua

SEQ ID NO: 3986481 - RNA, 15 nt, Staphylococcus aureus subsp. aureus Mu50
uuauauguuauauua

SEQ ID NO: 3986482 - RNA, 20 nt, Staphylococcus aureus subsp. aureus Mu50
uuauauuaaucguuaaugua

SEQ ID NO: 3986483 - RNA, 14 nt, Staphylococcus aureus subsp. aureus Mu50
uuauauucaacuua

SEQ ID NO: 3986484 - RNA, 19 nt, Staphylococcus aureus subsp. aureus Mu50
uuauauugagacaacauug

SEQ ID NO: 3986485 - RNA, 15 nt, Staphylococcus aureus subsp. aureus Mu50
uuauauugcaaaaau

SEQ ID NO: 3986486 - RNA, 16 nt, Staphylococcus aureus subsp. aureus Mu50
uuauauugcaaaaaua

SEQ ID NO: 3986487 - RNA, 17 nt, Staphylococcus aureus subsp. aureus Mu50
uuauauugcaaaaauaa

SEQ ID NO: 3986488 - RNA, 18 nt, Staphylococcus aureus subsp. aureus Mu50
uuauauugcaaaaauaau

SEQ ID NO: 3986489 - RNA, 19 nt, Staphylococcus aureus subsp. aureus Mu50
uuauauugcgaaaaauaau

SEQ ID NO: 3986490 - RNA, 14 nt, Staphylococcus aureus subsp. aureus Mu50
uuauauuguauuuu

SEQ ID NO: 3986491 - RNA, 18 nt, Staphylococcus aureus subsp. aureus Mu50
uuauauuguauuuuauuu

SEQ ID NO: 3986492 - RNA, 16 nt, Staphylococcus aureus subsp. aureus Mu50
uuauauuguuaaaauu

SEQ ID NO: 3986493 - RNA, 17 nt, Staphylococcus aureus subsp. aureus Mu50
uuauauuuaaaugucuu

SEQ ID NO: 3986494 - RNA, 15 nt, Staphylococcus aureus subsp. aureus Mu50
uuauauuuucucaua

SEQ ID NO: 3986495 - RNA, 20 nt, Staphylococcus aureus subsp. aureus Mu50
uuaucaaauaaccuauuaau

SEQ ID NO: 3986496 - RNA, 14 nt, Staphylococcus aureus subsp. aureus Mu50
uuaucaaauugacc

SEQ ID NO: 3986497 - RNA, 15 nt, Staphylococcus aureus subsp. aureus Mu50
uuaucaacaaauuua

SEQ ID NO: 3986498 - RNA, 20 nt, Staphylococcus aureus subsp. aureus Mu50
uuaucaacgauuuugucuuu

SEQ ID NO: 3986499 - RNA, 19 nt, Staphylococcus aureus subsp. aureus Mu50
uuaucaagagguaaaucug

SEQ ID NO: 3986500 - RNA, 22 nt, Staphylococcus aureus subsp. aureus Mu50
uuaucaauaaaucaguaguuuu

SEQ ID NO: 3986501 - RNA, 20 nt, Staphylococcus aureus subsp. aureus Mu50
uuaucaauuucuauuucacu

SEQ ID NO: 3986502 - RNA, 18 nt, Staphylococcus aureus subsp. aureus Mu50
uuaucagcgaaauuugua

SEQ ID NO: 3986503 - RNA, 16 nt, Staphylococcus aureus subsp. aureus Mu50
uuaucagcuuuaauaa

SEQ ID NO: 3986504 - RNA, 20 nt, Staphylococcus aureus subsp. aureus Mu50
uuaucauauaugugagcaaa

SEQ ID NO: 3986505 - RNA, 15 nt, Staphylococcus aureus subsp. aureus Mu50
uuaucauaugaacaa

SEQ ID NO: 3986506 - RNA, 18 nt, Staphylococcus aureus subsp. aureus Mu50
uuaucaucacacucuccc

SEQ ID NO: 3986507 - RNA, 16 nt, Staphylococcus aureus subsp. aureus Mu50
uuaucaucuucuggau

SEQ ID NO: 3986508 - RNA, 16 nt, Staphylococcus aureus subsp. aureus Mu50
uuaucauuacagauaa

SEQ ID NO: 3986509 - RNA, 13 nt, Staphylococcus aureus subsp. aureus Mu50
uuaucauuauucg

SEQ ID NO: 3986510 - RNA, 16 nt, Staphylococcus aureus subsp. aureus Mu50
uuaucauuauucgcau

SEQ ID NO: 3986511 - RNA, 20 nt, Staphylococcus aureus subsp. aureus Mu50
uuaucauuuuuaauuuugac

SEQ ID NO: 3986512 - RNA, 15 nt, Staphylococcus aureus subsp. aureus Mu50
uuauccaaaacauuu

SEQ ID NO: 3986513 - RNA, 18 nt, Staphylococcus aureus subsp. aureus Mu50
uuauccaaaacauuuugu

SEQ ID NO: 3986514 - RNA, 14 nt, Staphylococcus aureus subsp. aureus Mu50
uuauccaaaccaau

SEQ ID NO: 3986515 - RNA, 21 nt, Staphylococcus aureus subsp. aureus Mu50
uuauccaaggauguuauaaaa

SEQ ID NO: 3986516 - RNA, 15 nt, Staphylococcus aureus subsp. aureus Mu50
uuaucgaagaaacau

SEQ ID NO: 3986517 - RNA, 17 nt, Staphylococcus aureus subsp. aureus Mu50
uuaucgaagaaacauua

SEQ ID NO: 3986518 - RNA, 22 nt, Staphylococcus aureus subsp. aureus Mu50
uuauucacuuuuuuuaauuuga

SEQ ID NO: 3986519 - RNA, 15 nt, Staphylococcus aureus subsp. aureus Mu50
uuauucguuaacaau

SEQ ID NO: 3986520 - RNA, 17 nt, Staphylococcus aureus subsp. aureus Mu50
uuauucuaaguuaaaac

SEQ ID NO: 3986521 - RNA, 14 nt, Staphylococcus aureus subsp. aureus Mu50
uuauucuaauacaa

SEQ ID NO: 3986522 - RNA, 15 nt, Staphylococcus aureus subsp. aureus Mu50
uuauucuaauacaaa

SEQ ID NO: 3986523 - RNA, 18 nt, Staphylococcus aureus subsp. aureus Mu50
uuauucuuaauuuaagua

SEQ ID NO: 3986524 - RNA, 13 nt, Staphylococcus aureus subsp. aureus Mu50
uuauucuucccaa

SEQ ID NO: 3986525 - RNA, 16 nt, Staphylococcus aureus subsp. aureus Mu50
uuauucuucccaaaaa

SEQ ID NO: 3986526 - RNA, 22 nt, Staphylococcus aureus subsp. aureus Mu50
uuauucuuuauauuugugaaug

SEQ ID NO: 3986527 - RNA, 20 nt, Staphylococcus aureus subsp. aureus Mu50
uuauugaaaagauaaacaag

SEQ ID NO: 3986528 - RNA, 13 nt, Staphylococcus aureus subsp. aureus Mu50
uuauugaaacuaa

SEQ ID NO: 3986529 - RNA, 23 nt, Staphylococcus aureus subsp. aureus Mu50
uuauugaauuugaauaagugguu

SEQ ID NO: 3986530 - RNA, 15 nt, Staphylococcus aureus subsp. aureus Mu50
uuauugagaauauuu

SEQ ID NO: 3986531 - RNA, 22 nt, Staphylococcus aureus subsp. aureus Mu50
uuauugagaauauuuauuguuu

SEQ ID NO: 3986532 - RNA, 18 nt, Staphylococcus aureus subsp. aureus Mu50
uuauugaguaucaugcuu

SEQ ID NO: 3986533 - RNA, 19 nt, Staphylococcus aureus subsp. aureus Mu50
uuauugaguaucaugcuuu

SEQ ID NO: 3986534 - RNA, 20 nt, Staphylococcus aureus subsp. aureus Mu50
uuauugaguaucaugcuuuu

SEQ ID NO: 3986535 - RNA, 23 nt, Staphylococcus aureus subsp. aureus Mu50
uuauugggagcaaucaauacaau

SEQ ID NO: 3986536 - RNA, 20 nt, Staphylococcus aureus subsp. aureus Mu50
uuauugguuacuguaguacu

SEQ ID NO: 3986537 - RNA, 17 nt, Staphylococcus aureus subsp. aureus Mu50
uuauugguugaaauuaa

SEQ ID NO: 3986538 - RNA, 22 nt, Staphylococcus aureus subsp. aureus Mu50
uuauugucaucauguucuaaug

SEQ ID NO: 3986539 - RNA, 16 nt, Staphylococcus aureus subsp. aureus Mu50
uuauuguuuuaaugua

SEQ ID NO: 3986540 - RNA, 16 nt, Staphylococcus aureus subsp. aureus Mu50
uuauuguuuuuaaaau

SEQ ID NO: 3986541 - RNA, 13 nt, Staphylococcus aureus subsp. aureus Mu50
uuauuuaaaaugc

SEQ ID NO: 3986542 - RNA, 14 nt, Staphylococcus aureus subsp. aureus Mu50
uuauuuaaaaugcu

SEQ ID NO: 3986543 - RNA, 12 nt, Staphylococcus aureus subsp. aureus Mu50
uuauuuaaauuu

SEQ ID NO: 3986544 - RNA, 20 nt, Staphylococcus aureus subsp. aureus Mu50
uuauuuaaucguaacauauc

SEQ ID NO: 3986545 - RNA, 22 nt, Staphylococcus aureus subsp. aureus Mu50
uuauuuacaccugcuaguucag

SEQ ID NO: 3986546 - RNA, 14 nt, Staphylococcus aureus subsp. aureus Mu50
uuauuuagaauucu

SEQ ID NO: 3986547 - RNA, 20 nt, Staphylococcus aureus subsp. aureus Mu50
uuauuuagaauucuaaaaga

SEQ ID NO: 3986548 - RNA, 12 nt, Staphylococcus aureus subsp. aureus Mu50
uuauuuaguaca

SEQ ID NO: 3986549 - RNA, 15 nt, Staphylococcus aureus subsp. aureus Mu50
uuauuuauaaacaau

SEQ ID NO: 3986550 - RNA, 20 nt, Staphylococcus aureus subsp. aureus Mu50
uuauuuauaacuuuaaaaau

SEQ ID NO: 3986551 - RNA, 12 nt, Staphylococcus aureus subsp. aureus Mu50
uuauuuauauuu

SEQ ID NO: 3986552 - RNA, 14 nt, Staphylococcus aureus subsp. aureus Mu50
uuauuuaugaguuu

SEQ ID NO: 3986553 - RNA, 16 nt, Staphylococcus aureus subsp. aureus Mu50
uuauuucaauaauaau

SEQ ID NO: 3986554 - RNA, 15 nt, Staphylococcus aureus subsp. aureus Mu50
uuauuucaauuauca

SEQ ID NO: 3986555 - RNA, 21 nt, Staphylococcus aureus subsp. aureus Mu50
uuauuucuauaucuauuuauc

SEQ ID NO: 3986556 - RNA, 12 nt, Staphylococcus aureus subsp. aureus Mu50
uuauuucuuuuc

SEQ ID NO: 3986557 - RNA, 22 nt, Staphylococcus aureus subsp. aureus Mu50
uuauuugaaaugauaagaauca

SEQ ID NO: 3986558 - RNA, 16 nt, Staphylococcus aureus subsp. aureus Mu50
uuauuugauaaauaaa

SEQ ID NO: 3986559 - RNA, 21 nt, Staphylococcus aureus subsp. aureus Mu50
uuauuuggaugguaaguauaa

SEQ ID NO: 3986560 - RNA, 20 nt, Staphylococcus aureus subsp. aureus Mu50
uuauuuggguaacauuagca

SEQ ID NO: 3986561 - RNA, 18 nt, Staphylococcus aureus subsp. aureus Mu50
uuauuuguuuaauuaucu

SEQ ID NO: 3986562 - RNA, 16 nt, Staphylococcus aureus subsp. aureus Mu50
uuauuuuaacuuaauu

SEQ ID NO: 3986563 - RNA, 13 nt, Staphylococcus aureus subsp. aureus Mu50
uuauuuuaucauc

SEQ ID NO: 3986564 - RNA, 15 nt, Staphylococcus aureus subsp. aureus Mu50
uuauuuuaucaucua

SEQ ID NO: 3986565 - RNA, 12 nt, Staphylococcus aureus subsp. aureus Mu50
uuauuuuauguu

SEQ ID NO: 3986566 - RNA, 12 nt, Staphylococcus aureus subsp. aureus Mu50
uuauuuucaaua

SEQ ID NO: 3986567 - RNA, 23 nt, Staphylococcus aureus subsp. aureus Mu50
uuauuuucaauaaauuuuauaua

SEQ ID NO: 3986568 - RNA, 21 nt, Staphylococcus aureus subsp. aureus Mu50
uuauuuucuuuggugaaagua

SEQ ID NO: 3986569 - RNA, 16 nt, Staphylococcus aureus subsp. aureus Mu50
uuauuuuuauucaguu

SEQ ID NO: 3986570 - RNA, 23 nt, Staphylococcus aureus subsp. aureus Mu50
uucaaaaaauaauagcaaaauua

SEQ ID NO: 3986571 - RNA, 18 nt, Staphylococcus aureus subsp. aureus Mu50
uucaaaaaaugaauauaa

SEQ ID NO: 3986572 - RNA, 22 nt, Staphylococcus aureus subsp. aureus Mu50
uucaaaaagguauucaaauaaa

SEQ ID NO: 3986573 - RNA, 11 nt, Staphylococcus aureus subsp. aureus Mu50
uucaaaaauag

SEQ ID NO: 3986574 - RNA, 19 nt, Staphylococcus aureus subsp. aureus Mu50
uucaaaaaucauaccacgg

SEQ ID NO: 3986575 - RNA, 19 nt, Staphylococcus aureus subsp. aureus Mu50
uucaaaacguuuaauugca

SEQ ID NO: 3986576 - RNA, 20 nt, Staphylococcus aureus subsp. aureus Mu50
uucaaaacguuuaauugcag

SEQ ID NO: 3986577 - RNA, 20 nt, Staphylococcus aureus subsp. aureus Mu50
uucaaaacuagcaguaauau

SEQ ID NO: 3986578 - RNA, 14 nt, Staphylococcus aureus subsp. aureus Mu50
uucaaaacugccaa

SEQ ID NO: 3986579 - RNA, 23 nt, Staphylococcus aureus subsp. aureus Mu50
uucaaaagaaauuguguuucuuu

SEQ ID NO: 3986580 - RNA, 22 nt, Staphylococcus aureus subsp. aureus Mu50
uucaaaauaguaaagugaaaua

SEQ ID NO: 3986581 - RNA, 14 nt, Staphylococcus aureus subsp. aureus Mu50
uucaaaaucaaauu

SEQ ID NO: 3986582 - RNA, 14 nt, Staphylococcus aureus subsp. aureus Mu50
uucaaaaucuuuau

SEQ ID NO: 3986583 - RNA, 17 nt, Staphylococcus aureus subsp. aureus Mu50
uucaaaaucuuuaucag

SEQ ID NO: 3986584 - RNA, 17 nt, Staphylococcus aureus subsp. aureus Mu50
uucaaaauucaauauua

SEQ ID NO: 3986585 - RNA, 13 nt, Staphylococcus aureus subsp. aureus Mu50
uucaaacaauaca

SEQ ID NO: 3986586 - RNA, 17 nt, Staphylococcus aureus subsp. aureus Mu50
uucaaacgugauuuuau

SEQ ID NO: 3986587 - RNA, 23 nt, Staphylococcus aureus subsp. aureus Mu50
uucaaagacacggccugcaaguc

SEQ ID NO: 3986588 - RNA, 15 nt, Staphylococcus aureus subsp. aureus Mu50
uucaaagacguacau

SEQ ID NO: 3986589 - RNA, 18 nt, Staphylococcus aureus subsp. aureus Mu50
uucaaagcgauaaaguau

SEQ ID NO: 3986590 - RNA, 16 nt, Staphylococcus aureus subsp. aureus Mu50
uucaaagcgaucauua

SEQ ID NO: 3986591 - RNA, 19 nt, Staphylococcus aureus subsp. aureus Mu50
uucaaagcugucaacuugu

SEQ ID NO: 3986592 - RNA, 15 nt, Staphylococcus aureus subsp. aureus Mu50
uucaaaguagacauu

SEQ ID NO: 3986593 - RNA, 21 nt, Staphylococcus aureus subsp. aureus Mu50
uucaaaguagacauugaauaa

SEQ ID NO: 3986594 - RNA, 17 nt, Staphylococcus aureus subsp. aureus Mu50
uucaaaguagauauuga

SEQ ID NO: 3986595 - RNA, 13 nt, Staphylococcus aureus subsp. aureus Mu50
uucaaauaaagau

SEQ ID NO: 3986596 - RNA, 21 nt, Staphylococcus aureus subsp. aureus Mu50
uucaaauaaaucaaacuuuuc

SEQ ID NO: 3986597 - RNA, 21 nt, Staphylococcus aureus subsp. aureus Mu50
uucaaauaaaugacauuuaau

SEQ ID NO: 3986598 - RNA, 15 nt, Staphylococcus aureus subsp. aureus Mu50
uucaaauaauauaaa

SEQ ID NO: 3986599 - RNA, 16 nt, Staphylococcus aureus subsp. aureus Mu50
uucaaauaauauaaaa

SEQ ID NO: 3986600 - RNA, 15 nt, Staphylococcus aureus subsp. aureus Mu50
uucaaauguaacauu

SEQ ID NO: 3986601 - RNA, 19 nt, Staphylococcus aureus subsp. aureus Mu50
uucaaauguaacauuaaaa

SEQ ID NO: 3986602 - RNA, 14 nt, Staphylococcus aureus subsp. aureus Mu50
uucaaauuaauuaa

SEQ ID NO: 3986603 - RNA, 15 nt, Staphylococcus aureus subsp. aureus Mu50
uucaaauugguuuuc

SEQ ID NO: 3986604 - RNA, 14 nt, Staphylococcus aureus subsp. aureus Mu50
uucaacauauuaua

SEQ ID NO: 3986605 - RNA, 21 nt, Staphylococcus aureus subsp. aureus Mu50
uucaaccauaugacuuuuuau

SEQ ID NO: 3986606 - RNA, 19 nt, Staphylococcus aureus subsp. aureus Mu50
uuccauaaauaaaaugcua

SEQ ID NO: 3986607 - RNA, 14 nt, Staphylococcus aureus subsp. aureus Mu50
uuccauaaauauuu

SEQ ID NO: 3986608 - RNA, 18 nt, Staphylococcus aureus subsp. aureus Mu50
uuccauauuuuuuaguaa

SEQ ID NO: 3986609 - RNA, 13 nt, Staphylococcus aureus subsp. aureus Mu50
uuccaugaauaag

SEQ ID NO: 3986610 - RNA, 13 nt, Staphylococcus aureus subsp. aureus Mu50
uuccaugaguuua

SEQ ID NO: 3986611 - RNA, 18 nt, Staphylococcus aureus subsp. aureus Mu50
uuccaugaguuuacuaaa

SEQ ID NO: 3986612 - RNA, 15 nt, Staphylococcus aureus subsp. aureus Mu50
uuccauucauaaaag

SEQ ID NO: 3986613 - RNA, 17 nt, Staphylococcus aureus subsp. aureus Mu50
uuccauugauguaugug

SEQ ID NO: 3986614 - RNA, 20 nt, Staphylococcus aureus subsp. aureus Mu50
uuccauuggaaguucuuuug

SEQ ID NO: 3986615 - RNA, 22 nt, Staphylococcus aureus subsp. aureus Mu50
uuccauuucgauaccuaaaaua

SEQ ID NO: 3986616 - RNA, 12 nt, Staphylococcus aureus subsp. aureus Mu50
uucccacuuauc

SEQ ID NO: 3986617 - RNA, 22 nt, Staphylococcus aureus subsp. aureus Mu50
uucccagucaugucccauaaca

SEQ ID NO: 3986618 - RNA, 19 nt, Staphylococcus aureus subsp. aureus Mu50
uucccauuuuuaaaauuau

SEQ ID NO: 3986619 - RNA, 15 nt, Staphylococcus aureus subsp. aureus Mu50
uucccuaugaaauaa

SEQ ID NO: 3986620 - RNA, 17 nt, Staphylococcus aureus subsp. aureus Mu50
uucccuguuaugaagua

SEQ ID NO: 3986621 - RNA, 16 nt, Staphylococcus aureus subsp. aureus Mu50
uuccgaacauguuucu

SEQ ID NO: 3986622 - RNA, 18 nt, Staphylococcus aureus subsp. aureus Mu50
uuccguugaauuaacaau

SEQ ID NO: 3986623 - RNA, 18 nt, Staphylococcus aureus subsp. aureus Mu50
uuccuaccccgugaaucu

SEQ ID NO: 3986624 - RNA, 22 nt, Staphylococcus aureus subsp. aureus Mu50
uuccuagcuuuuaugucuaguu

SEQ ID NO: 3986625 - RNA, 20 nt, Staphylococcus aureus subsp. aureus Mu50
uuccuccuaccgcuaaaauu

SEQ ID NO: 3986626 - RNA, 22 nt, Staphylococcus aureus subsp. aureus Mu50
uuccucuccuucggcucucgcu

SEQ ID NO: 3986627 - RNA, 22 nt, Staphylococcus aureus subsp. aureus Mu50
uuccucuggaacuuuaauacca

SEQ ID NO: 3986628 - RNA, 15 nt, Staphylococcus aureus subsp. aureus Mu50
uuccugauacaauga

SEQ ID NO: 3986629 - RNA, 17 nt, Staphylococcus aureus subsp. aureus Mu50
uuccugauacaaugauu

SEQ ID NO: 3986630 - RNA, 21 nt, Staphylococcus aureus subsp. aureus Mu50
uuccugauauuucaacuuuuu

SEQ ID NO: 3986631 - RNA, 15 nt, Staphylococcus aureus subsp. aureus Mu50
uuccugcuacaacuu

SEQ ID NO: 3986632 - RNA, 23 nt, Staphylococcus aureus subsp. aureus Mu50
uuccuuuagcaaaaauauuuaaa

SEQ ID NO: 3986633 - RNA, 19 nt, Staphylococcus aureus subsp. aureus Mu50
uucgaaaagaaauucuaca

SEQ ID NO: 3986634 - RNA, 22 nt, Staphylococcus aureus subsp. aureus Mu50
uucgaaaagaaauucuacaaac

SEQ ID NO: 3986635 - RNA, 14 nt, Staphylococcus aureus subsp. aureus Mu50
uucgaaauagguau

SEQ ID NO: 3986636 - RNA, 20 nt, Staphylococcus aureus subsp. aureus Mu50
uucgaacgauauuuuaaaaa

SEQ ID NO: 3986637 - RNA, 23 nt, Staphylococcus aureus subsp. aureus Mu50
uucgaacgauauuuuaaaaagua

SEQ ID NO: 3986638 - RNA, 17 nt, Staphylococcus aureus subsp. aureus Mu50
uucgaacgcuugaaaaa

SEQ ID NO: 3986639 - RNA, 12 nt, Staphylococcus aureus subsp. aureus Mu50
uucgaacuuuug

SEQ ID NO: 3986640 - RNA, 17 nt, Staphylococcus aureus subsp. aureus Mu50
uucgaacuuuuguucua

SEQ ID NO: 3986641 - RNA, 19 nt, Staphylococcus aureus subsp. aureus Mu50
uucgaauuuaacaucuuug

SEQ ID NO: 3986642 - RNA, 20 nt, Staphylococcus aureus subsp. aureus Mu50
uucgacuacaaguuuauaau

SEQ ID NO: 3986643 - RNA, 19 nt, Staphylococcus aureus subsp. aureus Mu50
uucgaguaugguugauuac

SEQ ID NO: 3986644 - RNA, 21 nt, Staphylococcus aureus subsp. aureus Mu50
uucgaguaugguugauuacaa

SEQ ID NO: 3986645 - RNA, 21 nt, Staphylococcus aureus subsp. aureus Mu50
uucgagugcuuuuaaucaaau

SEQ ID NO: 3986646 - RNA, 19 nt, Staphylococcus aureus subsp. aureus Mu50
uucgauaauauaacugcau

SEQ ID NO: 3986647 - RNA, 19 nt, Staphylococcus aureus subsp. aureus Mu50
uucgauaccuaaaauaccc

SEQ ID NO: 3986648 - RNA, 15 nt, Staphylococcus aureus subsp. aureus Mu50
uucgauaguuuauua

SEQ ID NO: 3986649 - RNA, 14 nt, Staphylococcus aureus subsp. aureus Mu50
uucgauaugauuaa

SEQ ID NO: 3986650 - RNA, 15 nt, Staphylococcus aureus subsp. aureus Mu50
uucgauuauucuuaa

SEQ ID NO: 3986651 - RNA, 13 nt, Staphylococcus aureus subsp. aureus Mu50
uucgauucauaaa

SEQ ID NO: 3986652 - RNA, 15 nt, Staphylococcus aureus subsp. aureus Mu50
uucgauuguaauaac

SEQ ID NO: 3986653 - RNA, 16 nt, Staphylococcus aureus subsp. aureus Mu50
uucgauuuagaagaac

SEQ ID NO: 3986654 - RNA, 14 nt, Staphylococcus aureus subsp. aureus Mu50
uucgcaaguagucu

SEQ ID NO: 3986655 - RNA, 16 nt, Staphylococcus aureus subsp. aureus Mu50
uucgcagcuuuauaau

SEQ ID NO: 3986656 - RNA, 14 nt, Staphylococcus aureus subsp. aureus Mu50
uucgcauacuuuuu

SEQ ID NO: 3986657 - RNA, 17 nt, Staphylococcus aureus subsp. aureus Mu50
uucgcaucguucccugc

SEQ ID NO: 3986658 - RNA, 21 nt, Staphylococcus aureus subsp. aureus Mu50
uucgccucaucuaauuuauga

SEQ ID NO: 3986659 - RNA, 23 nt, Staphylococcus aureus subsp. aureus Mu50
uucgcuaauaauacgucguaaug

SEQ ID NO: 3986660 - RNA, 19 nt, Staphylococcus aureus subsp. aureus Mu50
uucgcugcuacaccaccug

SEQ ID NO: 3986661 - RNA, 20 nt, Staphylococcus aureus subsp. aureus Mu50
uucgcuuaaaaacgcuuuua

SEQ ID NO: 3986662 - RNA, 18 nt, Staphylococcus aureus subsp. aureus Mu50
uucgcuucaucaguugug

SEQ ID NO: 3986663 - RNA, 13 nt, Staphylococcus aureus subsp. aureus Mu50
uucgcuugauuaa

SEQ ID NO: 3986664 - RNA, 19 nt, Staphylococcus aureus subsp. aureus Mu50
uucggaauuugcacaaaga

SEQ ID NO: 3986665 - RNA, 12 nt, Staphylococcus aureus subsp. aureus Mu50
uucggauaaaua

SEQ ID NO: 3986666 - RNA, 16 nt, Staphylococcus aureus subsp. aureus Mu50
uucggaugagaaaugu

SEQ ID NO: 3986667 - RNA, 21 nt, Staphylococcus aureus subsp. aureus Mu50
uucggauugagggauuuuuau

SEQ ID NO: 3986668 - RNA, 22 nt, Staphylococcus aureus subsp. aureus Mu50
uucguaaaucgugucaaaugcc

SEQ ID NO: 3986669 - RNA, 19 nt, Staphylococcus aureus subsp. aureus Mu50
uucguaacauuuaaaaaau

SEQ ID NO: 3986670 - RNA, 20 nt, Staphylococcus aureus subsp. aureus Mu50
uucguaauaaacauguguau

SEQ ID NO: 3986671 - RNA, 23 nt, Staphylococcus aureus subsp. aureus Mu50
uucguacuaguucgauucaugaa

SEQ ID NO: 3986672 - RNA, 16 nt, Staphylococcus aureus subsp. aureus Mu50
uucgucaaauucaacg

SEQ ID NO: 3986673 - RNA, 23 nt, Staphylococcus aureus subsp. aureus Mu50
uucguccaacauguaacaaaaua

SEQ ID NO: 3986674 - RNA, 15 nt, Staphylococcus aureus subsp. aureus Mu50
uucguucuaaaagga

SEQ ID NO: 3986675 - RNA, 15 nt, Staphylococcus aureus subsp. aureus Mu50
uucguuuucaucaac

SEQ ID NO: 3986676 - RNA, 17 nt, Staphylococcus aureus subsp. aureus Mu50
uucuaaaagaauuauuc

SEQ ID NO: 3986677 - RNA, 12 nt, Staphylococcus aureus subsp. aureus Mu50
uucuaaaaguug

SEQ ID NO: 3986678 - RNA, 13 nt, Staphylococcus aureus subsp. aureus Mu50
uucuaaaaguuga

SEQ ID NO: 3986679 - RNA, 16 nt, Staphylococcus aureus subsp. aureus Mu50
uucuaaaucaauauaa

SEQ ID NO: 3986680 - RNA, 13 nt, Staphylococcus aureus subsp. aureus Mu50
uucuaaaucuugu

SEQ ID NO: 3986681 - RNA, 22 nt, Staphylococcus aureus subsp. aureus Mu50
uucuaacggcguuuguuucuua

SEQ ID NO: 3986682 - RNA, 17 nt, Staphylococcus aureus subsp. aureus Mu50
uucuaacgguaaauaac

SEQ ID NO: 3986683 - RNA, 19 nt, Staphylococcus aureus subsp. aureus Mu50
uucuaacugcaaagccaug

SEQ ID NO: 3986684 - RNA, 13 nt, Staphylococcus aureus subsp. aureus Mu50
uucuaagucucuu

SEQ ID NO: 3986685 - RNA, 16 nt, Staphylococcus aureus subsp. aureus Mu50
uucuaaguguuuuaua

SEQ ID NO: 3986686 - RNA, 20 nt, Staphylococcus aureus subsp. aureus Mu50
uucuaaucguuaauaaaccu

SEQ ID NO: 3986687 - RNA, 20 nt, Staphylococcus aureus subsp. aureus Mu50
uucuaaugcuaauuuaacug

SEQ ID NO: 3986688 - RNA, 15 nt, Staphylococcus aureus subsp. aureus Mu50
uucuaauuaagaaug

SEQ ID NO: 3986689 - RNA, 19 nt, Staphylococcus aureus subsp. aureus Mu50
uucuaauuguuguaauucu

SEQ ID NO: 3986690 - RNA, 13 nt, Staphylococcus aureus subsp. aureus Mu50
uucuaauuguuuu

SEQ ID NO: 3986691 - RNA, 13 nt, Staphylococcus aureus subsp. aureus Mu50
uucuaauuugcaa

SEQ ID NO: 3986692 - RNA, 13 nt, Staphylococcus aureus subsp. aureus Mu50
uucuaauuuuuca

SEQ ID NO: 3986693 - RNA, 15 nt, Staphylococcus aureus subsp. aureus Mu50
uucuucaucuuuuau

SEQ ID NO: 3986694 - RNA, 23 nt, Staphylococcus aureus subsp. aureus Mu50
uucuucuuguuuagggaauccca

SEQ ID NO: 3986695 - RNA, 17 nt, Staphylococcus aureus subsp. aureus Mu50
uucuucuuuuuuaucua

SEQ ID NO: 3986696 - RNA, 14 nt, Staphylococcus aureus subsp. aureus Mu50
uucuugaaaaguuu

SEQ ID NO: 3986697 - RNA, 17 nt, Staphylococcus aureus subsp. aureus Mu50
uucuugccaucaauuuc

SEQ ID NO: 3986698 - RNA, 14 nt, Staphylococcus aureus subsp. aureus Mu50
uucuuguucuaaaa

SEQ ID NO: 3986699 - RNA, 16 nt, Staphylococcus aureus subsp. aureus Mu50
uucuuguucuaaaaua

SEQ ID NO: 3986700 - RNA, 21 nt, Staphylococcus aureus subsp. aureus Mu50
uucuuuaacaauugauugcuc

SEQ ID NO: 3986701 - RNA, 22 nt, Staphylococcus aureus subsp. aureus Mu50
uucuuuaacaauugauugcucu

SEQ ID NO: 3986702 - RNA, 15 nt, Staphylococcus aureus subsp. aureus Mu50
uucuuuacuaaagau

SEQ ID NO: 3986703 - RNA, 21 nt, Staphylococcus aureus subsp. aureus Mu50
uucuuuacuucuuucaaaaac

SEQ ID NO: 3986704 - RNA, 20 nt, Staphylococcus aureus subsp. aureus Mu50
uucuuuauagaaaccaaaaa

SEQ ID NO: 3986705 - RNA, 23 nt, Staphylococcus aureus subsp. aureus Mu50
uucuuuaugauaauaagaauauu

SEQ ID NO: 3986706 - RNA, 16 nt, Staphylococcus aureus subsp. aureus Mu50
uucuuuauuagaauga

SEQ ID NO: 3986707 - RNA, 12 nt, Staphylococcus aureus subsp. aureus Mu50
uucuuucauaau

SEQ ID NO: 3986708 - RNA, 12 nt, Staphylococcus aureus subsp. aureus Mu50
uucuuucuuuuu

SEQ ID NO: 3986709 - RNA, 23 nt, Staphylococcus aureus subsp. aureus Mu50
uucuuugucuguaaagcuaucca

SEQ ID NO: 3986710 - RNA, 17 nt, Staphylococcus aureus subsp. aureus Mu50
uucuuuguguuugcuuu

SEQ ID NO: 3986711 - RNA, 16 nt, Staphylococcus aureus subsp. aureus Mu50
uucuuuucaaaauaau

SEQ ID NO: 3986712 - RNA, 17 nt, Staphylococcus aureus subsp. aureus Mu50
uucuuuucaaaauaaua

SEQ ID NO: 3986713 - RNA, 16 nt, Staphylococcus aureus subsp. aureus Mu50
uucuuuuguaaauggu

SEQ ID NO: 3986714 - RNA, 13 nt, Staphylococcus aureus subsp. aureus Mu50
uucuuuuguaauu

SEQ ID NO: 3986715 - RNA, 14 nt, Staphylococcus aureus subsp. aureus Mu50
uucuuuuguuuuac

SEQ ID NO: 3986716 - RNA, 15 nt, Staphylococcus aureus subsp. aureus Mu50
uucuuuuguuuuuau

SEQ ID NO: 3986717 - RNA, 11 nt, Staphylococcus aureus subsp. aureus Mu50
uucuuuuuaaa

SEQ ID NO: 3986718 - RNA, 11 nt, Staphylococcus aureus subsp. aureus Mu50
uucuuuuuaac

SEQ ID NO: 3986719 - RNA, 16 nt, Staphylococcus aureus subsp. aureus Mu50
uucuuuuuauuuacuc

SEQ ID NO: 3986720 - RNA, 15 nt, Staphylococcus aureus subsp. aureus Mu50
uucuuuuucaucuuu

SEQ ID NO: 3986721 - RNA, 21 nt, Staphylococcus aureus subsp. aureus Mu50
uucuuuuucgaggucaucaaa

SEQ ID NO: 3986722 - RNA, 15 nt, Staphylococcus aureus subsp. aureus Mu50
uucuuuuucuauaca

SEQ ID NO: 3986723 - RNA, 22 nt, Staphylococcus aureus subsp. aureus Mu50
uucuuuuugcguuuuuaaauaa

SEQ ID NO: 3986724 - RNA, 13 nt, Staphylococcus aureus subsp. aureus Mu50
uucuuuuugcuuu

SEQ ID NO: 3986725 - RNA, 18 nt, Staphylococcus aureus subsp. aureus Mu50
uucuuuuuguucggcuuu

SEQ ID NO: 3986726 - RNA, 23 nt, Staphylococcus aureus subsp. aureus Mu50
uucuuuuuuaauucuauuuuuga

SEQ ID NO: 3986727 - RNA, 17 nt, Staphylococcus aureus subsp. aureus Mu50
uucuuuuuuuguuacca

SEQ ID NO: 3986728 - RNA, 13 nt, Staphylococcus aureus subsp. aureus Mu50
uugaaaaagacua

SEQ ID NO: 3986729 - RNA, 19 nt, Staphylococcus aureus subsp. aureus Mu50
uugaaaaauuaaaaaacaa

SEQ ID NO: 3986730 - RNA, 16 nt, Staphylococcus aureus subsp. aureus Mu50
uugaaaagauaaacaa

SEQ ID NO: 3986731 - RNA, 19 nt, Staphylococcus aureus subsp. aureus Mu50
uugaaaaguaauuaaauac

SEQ ID NO: 3986732 - RNA, 23 nt, Staphylococcus aureus subsp. aureus Mu50
uugaaaauaaucgaacagaaaau

SEQ ID NO: 3986733 - RNA, 13 nt, Staphylococcus aureus subsp. aureus Mu50
uugaaaaugacgu

SEQ ID NO: 3986734 - RNA, 18 nt, Staphylococcus aureus subsp. aureus Mu50
uugaaacgguaucaacau

SEQ ID NO: 3986735 - RNA, 17 nt, Staphylococcus aureus subsp. aureus Mu50
uugaaauaaucuaguau

SEQ ID NO: 3986736 - RNA, 13 nt, Staphylococcus aureus subsp. aureus Mu50
uugaaauguuuaa

SEQ ID NO: 3986737 - RNA, 13 nt, Staphylococcus aureus subsp. aureus Mu50
uugaaauguuuau

SEQ ID NO: 3986738 - RNA, 19 nt, Staphylococcus aureus subsp. aureus Mu50
uugaaauuauuauuuaaau

SEQ ID NO: 3986739 - RNA, 17 nt, Staphylococcus aureus subsp. aureus Mu50
uugaaauuuauuauaau

SEQ ID NO: 3986740 - RNA, 15 nt, Staphylococcus aureus subsp. aureus Mu50
uugaacaauaauaug

SEQ ID NO: 3986741 - RNA, 15 nt, Staphylococcus aureus subsp. aureus Mu50
uugaacaauucuuca

SEQ ID NO: 3986742 - RNA, 20 nt, Staphylococcus aureus subsp. aureus Mu50
uugaacgauaacaauuuauu

SEQ ID NO: 3986743 - RNA, 19 nt, Staphylococcus aureus subsp. aureus Mu50
uugaacgguuguauuucau

SEQ ID NO: 3986744 - RNA, 22 nt, Staphylococcus aureus subsp. aureus Mu50
uugaacuaaaacgauaauaaua

SEQ ID NO: 3986745 - RNA, 13 nt, Staphylococcus aureus subsp. aureus Mu50
uugaacuucuuuu

SEQ ID NO: 3986746 - RNA, 19 nt, Staphylococcus aureus subsp. aureus Mu50
uugaacuuuaguauauuca

SEQ ID NO: 3986747 - RNA, 11 nt, Staphylococcus aureus subsp. aureus Mu50
uugaacuuuua

SEQ ID NO: 3986748 - RNA, 23 nt, Staphylococcus aureus subsp. aureus Mu50
uugaagaaggaugaguuuaaaaa

SEQ ID NO: 3986749 - RNA, 15 nt, Staphylococcus aureus subsp. aureus Mu50
uugaagaauaaaaaa

SEQ ID NO: 3986750 - RNA, 21 nt, Staphylococcus aureus subsp. aureus Mu50
uugaagaaucaggaccaaaua

SEQ ID NO: 3986751 - RNA, 18 nt, Staphylococcus aureus subsp. aureus Mu50
uugaagaugcuuuaauua

SEQ ID NO: 3986752 - RNA, 20 nt, Staphylococcus aureus subsp. aureus Mu50
uugaagaugcuuuaauuaaa

SEQ ID NO: 3986753 - RNA, 17 nt, Staphylococcus aureus subsp. aureus Mu50
uugaagcuaauucauau

SEQ ID NO: 3986754 - RNA, 21 nt, Staphylococcus aureus subsp. aureus Mu50
uugaagcuaauucauauucaa

SEQ ID NO: 3986755 - RNA, 15 nt, Staphylococcus aureus subsp. aureus Mu50
uugaagggagcauuu

SEQ ID NO: 3986756 - RNA, 20 nt, Staphylococcus aureus subsp. aureus Mu50
uugaagggagcauuucauua

SEQ ID NO: 3986757 - RNA, 15 nt, Staphylococcus aureus subsp. aureus Mu50
uugaaggugauaaug

SEQ ID NO: 3986758 - RNA, 19 nt, Staphylococcus aureus subsp. aureus Mu50
uugaagucaauaauuuuau

SEQ ID NO: 3986759 - RNA, 22 nt, Staphylococcus aureus subsp. aureus Mu50
uugaagugaguuuaucuacauu

SEQ ID NO: 3986760 - RNA, 19 nt, Staphylococcus aureus subsp. aureus Mu50
uugaaguuacuauauuuau

SEQ ID NO: 3986761 - RNA, 12 nt, Staphylococcus aureus subsp. aureus Mu50
uugaaguuguuu

SEQ ID NO: 3986762 - RNA, 11 nt, Staphylococcus aureus subsp. aureus Mu50
uugaauaauca

SEQ ID NO: 3986763 - RNA, 17 nt, Staphylococcus aureus subsp. aureus Mu50
uugaauaccuuuuauua

SEQ ID NO: 3986764 - RNA, 15 nt, Staphylococcus aureus subsp. aureus Mu50
uugaauacuuuauuu

SEQ ID NO: 3986765 - RNA, 19 nt, Staphylococcus aureus subsp. aureus Mu50
uugaauacuuuauuugaua

SEQ ID NO: 3986766 - RNA, 21 nt, Staphylococcus aureus subsp. aureus Mu50
uugaauagugagcguauuauu

SEQ ID NO: 3986767 - RNA, 12 nt, Staphylococcus aureus subsp. aureus Mu50
uugaauauaaaa

SEQ ID NO: 3986768 - RNA, 13 nt, Staphylococcus aureus subsp. aureus Mu50
uugaauauaaaaa

SEQ ID NO: 3986769 - RNA, 15 nt, Staphylococcus aureus subsp. aureus Mu50
uugaauauaaaaaag

SEQ ID NO: 3986770 - RNA, 15 nt, Staphylococcus aureus subsp. aureus Mu50
uugaauauaguccuu

SEQ ID NO: 3986771 - RNA, 18 nt, Staphylococcus aureus subsp. aureus Mu50
uugaauauaguccuuccc

SEQ ID NO: 3986772 - RNA, 22 nt, Staphylococcus aureus subsp. aureus Mu50
uugaauauggaaaauguauuau

SEQ ID NO: 3986773 - RNA, 16 nt, Staphylococcus aureus subsp. aureus Mu50
uugaaucaacaguuuu

SEQ ID NO: 3986774 - RNA, 20 nt, Staphylococcus aureus subsp. aureus Mu50
uugaaucaacaguuuuauua

SEQ ID NO: 3986775 - RNA, 17 nt, Staphylococcus aureus subsp. aureus Mu50
uugaaucaguauaauca

SEQ ID NO: 3986776 - RNA, 20 nt, Staphylococcus aureus subsp. aureus Mu50
uugaaucauacgaauuugug

SEQ ID NO: 3986777 - RNA, 22 nt, Staphylococcus aureus subsp. aureus Mu50
uugaauccaagugacaacauua

SEQ ID NO: 3986778 - RNA, 17 nt, Staphylococcus aureus subsp. aureus Mu50
uugaaucggugucuuua

SEQ ID NO: 3986779 - RNA, 17 nt, Staphylococcus aureus subsp. aureus Mu50
uugaaucuuguugaacu

SEQ ID NO: 3986780 - RNA, 23 nt, Staphylococcus aureus subsp. aureus Mu50
uugaaugaaguaauauauaaaag

SEQ ID NO: 3986781 - RNA, 15 nt, Staphylococcus aureus subsp. aureus Mu50
uugauuuauuauuuc

SEQ ID NO: 3986782 - RNA, 19 nt, Staphylococcus aureus subsp. aureus Mu50
uugauuuggguaauguuuu

SEQ ID NO: 3986783 - RNA, 14 nt, Staphylococcus aureus subsp. aureus Mu50
uugauuuuauucac

SEQ ID NO: 3986784 - RNA, 18 nt, Staphylococcus aureus subsp. aureus Mu50
uugauuuugaauaaaaaa

SEQ ID NO: 3986785 - RNA, 21 nt, Staphylococcus aureus subsp. aureus Mu50
uugauuuugaauaaaaaaagc

SEQ ID NO: 3986786 - RNA, 20 nt, Staphylococcus aureus subsp. aureus Mu50
uugauuuugaaucacauuaa

SEQ ID NO: 3986787 - RNA, 18 nt, Staphylococcus aureus subsp. aureus Mu50
uugauuuuuugaaauguu

SEQ ID NO: 3986788 - RNA, 17 nt, Staphylococcus aureus subsp. aureus Mu50
uugauuuuuuuguucuu

SEQ ID NO: 3986789 - RNA, 16 nt, Staphylococcus aureus subsp. aureus Mu50
uugcaaaaauaauaug

SEQ ID NO: 3986790 - RNA, 22 nt, Staphylococcus aureus subsp. aureus Mu50
uugcaaaacgcauuucaugugu

SEQ ID NO: 3986791 - RNA, 15 nt, Staphylococcus aureus subsp. aureus Mu50
uugcaaauuaucauu

SEQ ID NO: 3986792 - RNA, 19 nt, Staphylococcus aureus subsp. aureus Mu50
uugcaaauuaucauuaaau

SEQ ID NO: 3986793 - RNA, 15 nt, Staphylococcus aureus subsp. aureus Mu50
uugcaacauuaaauu

SEQ ID NO: 3986794 - RNA, 17 nt, Staphylococcus aureus subsp. aureus Mu50
uugcaagccaucaauau

SEQ ID NO: 3986795 - RNA, 13 nt, Staphylococcus aureus subsp. aureus Mu50
uugcaauaaaauu

SEQ ID NO: 3986796 - RNA, 22 nt, Staphylococcus aureus subsp. aureus Mu50
uugcaauaaaauuagccuaauu

SEQ ID NO: 3986797 - RNA, 13 nt, Staphylococcus aureus subsp. aureus Mu50
uugcaaucaucug

SEQ ID NO: 3986798 - RNA, 21 nt, Staphylococcus aureus subsp. aureus Mu50
uugcacgucuuguaucaacau

SEQ ID NO: 3986799 - RNA, 22 nt, Staphylococcus aureus subsp. aureus Mu50
uugcacgucuuguaucaacauu

SEQ ID NO: 3986800 - RNA, 17 nt, Staphylococcus aureus subsp. aureus Mu50
uugcacuaugcauaaua

SEQ ID NO: 3986801 - RNA, 13 nt, Staphylococcus aureus subsp. aureus Mu50
uugcacuuuuuuc

SEQ ID NO: 3986802 - RNA, 20 nt, Staphylococcus aureus subsp. aureus Mu50
uugcacuuuuuucauuucuu

SEQ ID NO: 3986803 - RNA, 18 nt, Staphylococcus aureus subsp. aureus Mu50
uugcagauuuugcaaucu

SEQ ID NO: 3986804 - RNA, 22 nt, Staphylococcus aureus subsp. aureus Mu50
uugcauaccuauaaacauaucu

SEQ ID NO: 3986805 - RNA, 19 nt, Staphylococcus aureus subsp. aureus Mu50
uugcauacgaauuaaaaua

SEQ ID NO: 3986806 - RNA, 19 nt, Staphylococcus aureus subsp. aureus Mu50
uugcauacguaaaugguaa

SEQ ID NO: 3986807 - RNA, 13 nt, Staphylococcus aureus subsp. aureus Mu50
uugcauauaaaaa

SEQ ID NO: 3986808 - RNA, 14 nt, Staphylococcus aureus subsp. aureus Mu50
uugcauugauuuca

SEQ ID NO: 3986809 - RNA, 21 nt, Staphylococcus aureus subsp. aureus Mu50
uugccaaaaguuauauaaauu

SEQ ID NO: 3986810 - RNA, 22 nt, Staphylococcus aureus subsp. aureus Mu50
uugccggggugggacgacgaaa

SEQ ID NO: 3986811 - RNA, 21 nt, Staphylococcus aureus subsp. aureus Mu50
uugccuggcaacguucuacuc

SEQ ID NO: 3986812 - RNA, 14 nt, Staphylococcus aureus subsp. aureus Mu50
uugccuuucauuuu

SEQ ID NO: 3986813 - RNA, 13 nt, Staphylococcus aureus subsp. aureus Mu50
uugcgaaaauauc

SEQ ID NO: 3986814 - RNA, 21 nt, Staphylococcus aureus subsp. aureus Mu50
uugcgauauacgaauccucau

SEQ ID NO: 3986815 - RNA, 16 nt, Staphylococcus aureus subsp. aureus Mu50
uugcgguuggcucuuu

SEQ ID NO: 3986816 - RNA, 19 nt, Staphylococcus aureus subsp. aureus Mu50
uugcgguuuuuuugauuga

SEQ ID NO: 3986817 - RNA, 23 nt, Staphylococcus aureus subsp. aureus Mu50
uugcguuuguguguuuuaaaauu

SEQ ID NO: 3986818 - RNA, 17 nt, Staphylococcus aureus subsp. aureus Mu50
uugcguuuuuaaauaau

SEQ ID NO: 3986819 - RNA, 18 nt, Staphylococcus aureus subsp. aureus Mu50
uugcuaaaauaucaaaau

SEQ ID NO: 3986820 - RNA, 21 nt, Staphylococcus aureus subsp. aureus Mu50
uugcuaaaauaucaaaauaua

SEQ ID NO: 3986821 - RNA, 21 nt, Staphylococcus aureus subsp. aureus Mu50
uugcuaaccaucauaaauguu

SEQ ID NO: 3986822 - RNA, 20 nt, Staphylococcus aureus subsp. aureus Mu50
uugcuagucauaauuuaaaa

SEQ ID NO: 3986823 - RNA, 18 nt, Staphylococcus aureus subsp. aureus Mu50
uugcuauauuaguauaau

SEQ ID NO: 3986824 - RNA, 19 nt, Staphylococcus aureus subsp. aureus Mu50
uugcuaucaaacuuggcaa

SEQ ID NO: 3986825 - RNA, 19 nt, Staphylococcus aureus subsp. aureus Mu50
uugcucgcgcucuucuuca

SEQ ID NO: 3986826 - RNA, 14 nt, Staphylococcus aureus subsp. aureus Mu50
uugcucuaauccaa

SEQ ID NO: 3986827 - RNA, 15 nt, Staphylococcus aureus subsp. aureus Mu50
uugcucuuuaacaau

SEQ ID NO: 3986828 - RNA, 14 nt, Staphylococcus aureus subsp. aureus Mu50
uugcugaauaaaau

SEQ ID NO: 3986829 - RNA, 18 nt, Staphylococcus aureus subsp. aureus Mu50
uugcugccaaaaaguauu

SEQ ID NO: 3986830 - RNA, 21 nt, Staphylococcus aureus subsp. aureus Mu50
uugcugcuguacaauuucgcu

SEQ ID NO: 3986831 - RNA, 23 nt, Staphylococcus aureus subsp. aureus Mu50
uugcuguucaacaucuuuaugug

SEQ ID NO: 3986832 - RNA, 22 nt, Staphylococcus aureus subsp. aureus Mu50
uugcuuaaaccuuaauaaugaa

SEQ ID NO: 3986833 - RNA, 23 nt, Staphylococcus aureus subsp. aureus Mu50
uugcuuaacuuccuuuuuauuuu

SEQ ID NO: 3986834 - RNA, 14 nt, Staphylococcus aureus subsp. aureus Mu50
uugcuuauguuuuu

SEQ ID NO: 3986835 - RNA, 13 nt, Staphylococcus aureus subsp. aureus Mu50
uugcuucuguauc

SEQ ID NO: 3986836 - RNA, 17 nt, Staphylococcus aureus subsp. aureus Mu50
uugcuucuuaucaacaa

SEQ ID NO: 3986837 - RNA, 17 nt, Staphylococcus aureus subsp. aureus Mu50
uugcuuggauaauugca

SEQ ID NO: 3986838 - RNA, 14 nt, Staphylococcus aureus subsp. aureus Mu50
uugcuuuaauuuga

SEQ ID NO: 3986839 - RNA, 21 nt, Staphylococcus aureus subsp. aureus Mu50
uugcuuuaauuugauuaaauu

SEQ ID NO: 3986840 - RNA, 16 nt, Staphylococcus aureus subsp. aureus Mu50
uugcuuuuauaauaau

SEQ ID NO: 3986841 - RNA, 13 nt, Staphylococcus aureus subsp. aureus Mu50
uugcuuuuuacua

SEQ ID NO: 3986842 - RNA, 14 nt, Staphylococcus aureus subsp. aureus Mu50
uugcuuuuuacuau

SEQ ID NO: 3986843 - RNA, 14 nt, Staphylococcus aureus subsp. aureus Mu50
uuggaaagauggga

SEQ ID NO: 3986844 - RNA, 21 nt, Staphylococcus aureus subsp. aureus Mu50
uuggaaagaugggauuucacu

SEQ ID NO: 3986845 - RNA, 19 nt, Staphylococcus aureus subsp. aureus Mu50
uuggaaauaucuuacugcu

SEQ ID NO: 3986846 - RNA, 22 nt, Staphylococcus aureus subsp. aureus Mu50
uuggaagaaugccuuuuauuua

SEQ ID NO: 3986847 - RNA, 16 nt, Staphylococcus aureus subsp. aureus Mu50
uuggaagcaauuaugg

SEQ ID NO: 3986848 - RNA, 16 nt, Staphylococcus aureus subsp. aureus Mu50
uuggaaucccaaugcu

SEQ ID NO: 3986849 - RNA, 17 nt, Staphylococcus aureus subsp. aureus Mu50
uuggagcguaaaguuuu

SEQ ID NO: 3986850 - RNA, 15 nt, Staphylococcus aureus subsp. aureus Mu50
uuggaggugaugaga

SEQ ID NO: 3986851 - RNA, 14 nt, Staphylococcus aureus subsp. aureus Mu50
uuggauaaaaugau

SEQ ID NO: 3986852 - RNA, 17 nt, Staphylococcus aureus subsp. aureus Mu50
uuggauagguaacuaaa

SEQ ID NO: 3986853 - RNA, 21 nt, Staphylococcus aureus subsp. aureus Mu50
uuggauagguaacuaaaaugu

SEQ ID NO: 3986854 - RNA, 19 nt, Staphylococcus aureus subsp. aureus Mu50
uuggauguaauagagaagg

SEQ ID NO: 3986855 - RNA, 17 nt, Staphylococcus aureus subsp. aureus Mu50
uuggauucaaaugacau

SEQ ID NO: 3986856 - RNA, 14 nt, Staphylococcus aureus subsp. aureus Mu50
uuggauuucuuuuu

SEQ ID NO: 3986857 - RNA, 15 nt, Staphylococcus aureus subsp. aureus Mu50
uuggauuuuaacaag

SEQ ID NO: 3986858 - RNA, 15 nt, Staphylococcus aureus subsp. aureus Mu50
uuggcacauaaauca

SEQ ID NO: 3986859 - RNA, 18 nt, Staphylococcus aureus subsp. aureus Mu50
uuggcagugaucuuuuuu

SEQ ID NO: 3986860 - RNA, 17 nt, Staphylococcus aureus subsp. aureus Mu50
uuggcggggccccaaca

SEQ ID NO: 3986861 - RNA, 18 nt, Staphylococcus aureus subsp. aureus Mu50
uuggcucuauaucaaauu

SEQ ID NO: 3986862 - RNA, 21 nt, Staphylococcus aureus subsp. aureus Mu50
uuggcuggcccccaacacuga

SEQ ID NO: 3986863 - RNA, 18 nt, Staphylococcus aureus subsp. aureus Mu50
uuggcuucgucaucaaca

SEQ ID NO: 3986864 - RNA, 13 nt, Staphylococcus aureus subsp. aureus Mu50
uuggcuugcuuca

SEQ ID NO: 3986865 - RNA, 16 nt, Staphylococcus aureus subsp. aureus Mu50
uuggcuuuuauuuaua

SEQ ID NO: 3986866 - RNA, 20 nt, Staphylococcus aureus subsp. aureus Mu50
uugggcugauaauaaaaguu

SEQ ID NO: 3986867 - RNA, 19 nt, Staphylococcus aureus subsp. aureus Mu50
uuggggaugggccccaaca

SEQ ID NO: 3986868 - RNA, 22 nt, Staphylococcus aureus subsp. aureus Mu50
uuguuaaaaaauggauuugguc

SEQ ID NO: 3986869 - RNA, 14 nt, Staphylococcus aureus subsp. aureus Mu50
uuguuaaaauaaug

SEQ ID NO: 3986870 - RNA, 23 nt, Staphylococcus aureus subsp. aureus Mu50
uuguuaauucaacggaacuacua

SEQ ID NO: 3986871 - RNA, 18 nt, Staphylococcus aureus subsp. aureus Mu50
uuguuaauuuaaagucuu

SEQ ID NO: 3986872 - RNA, 16 nt, Staphylococcus aureus subsp. aureus Mu50
uuguuaauuuaauaau

SEQ ID NO: 3986873 - RNA, 13 nt, Staphylococcus aureus subsp. aureus Mu50
uuguuaauuucaa

SEQ ID NO: 3986874 - RNA, 17 nt, Staphylococcus aureus subsp. aureus Mu50
uuguuaccaaacaauac

SEQ ID NO: 3986875 - RNA, 22 nt, Staphylococcus aureus subsp. aureus Mu50
uuguuacuaguuuguaauaauu

SEQ ID NO: 3986876 - RNA, 13 nt, Staphylococcus aureus subsp. aureus Mu50
uuguuagcaucug

SEQ ID NO: 3986877 - RNA, 18 nt, Staphylococcus aureus subsp. aureus Mu50
uuguuauaaguaaauaau

SEQ ID NO: 3986878 - RNA, 14 nt, Staphylococcus aureus subsp. aureus Mu50
uuguuauccaaaac

SEQ ID NO: 3986879 - RNA, 16 nt, Staphylococcus aureus subsp. aureus Mu50
uuguucaacuaaauuu

SEQ ID NO: 3986880 - RNA, 17 nt, Staphylococcus aureus subsp. aureus Mu50
uuguucaacuaaauuuu

SEQ ID NO: 3986881 - RNA, 22 nt, Staphylococcus aureus subsp. aureus Mu50
uuguucuccgaucaugccuuca

SEQ ID NO: 3986882 - RNA, 14 nt, Staphylococcus aureus subsp. aureus Mu50
uuguugaaauuucu

SEQ ID NO: 3986883 - RNA, 19 nt, Staphylococcus aureus subsp. aureus Mu50
uuguugaauaauuaauguu

SEQ ID NO: 3986884 - RNA, 22 nt, Staphylococcus aureus subsp. aureus Mu50
uuguugaauaauuaauguuucu

SEQ ID NO: 3986885 - RNA, 14 nt, Staphylococcus aureus subsp. aureus Mu50
uuguugcaaugauu

SEQ ID NO: 3986886 - RNA, 18 nt, Staphylococcus aureus subsp. aureus Mu50
uuguuggaucuuucaaag

SEQ ID NO: 3986887 - RNA, 15 nt, Staphylococcus aureus subsp. aureus Mu50
uuguuuaagaaugua

SEQ ID NO: 3986888 - RNA, 18 nt, Staphylococcus aureus subsp. aureus Mu50
uuguuuaucuguaucaaa

SEQ ID NO: 3986889 - RNA, 16 nt, Staphylococcus aureus subsp. aureus Mu50
uuguuuauuacauaau

SEQ ID NO: 3986890 - RNA, 14 nt, Staphylococcus aureus subsp. aureus Mu50
uuguuucuaaugcu

SEQ ID NO: 3986891 - RNA, 14 nt, Staphylococcus aureus subsp. aureus Mu50
uuguuuuaaauacu

SEQ ID NO: 3986892 - RNA, 20 nt, Staphylococcus aureus subsp. aureus Mu50
uuguuuucaaaugaaaauac

SEQ ID NO: 3986893 - RNA, 22 nt, Staphylococcus aureus subsp. aureus Mu50
uuguuuucaucaugcauaauca

SEQ ID NO: 3986894 - RNA, 20 nt, Staphylococcus aureus subsp. aureus Mu50
uuguuuugaauguuucuccu

SEQ ID NO: 3986895 - RNA, 16 nt, Staphylococcus aureus subsp. aureus Mu50
uuguuuugcuucuuua

SEQ ID NO: 3986896 - RNA, 12 nt, Staphylococcus aureus subsp. aureus Mu50
uuguuuuuauau

SEQ ID NO: 3986897 - RNA, 21 nt, Staphylococcus aureus subsp. aureus Mu50
uuguuuuucacuguuaaaguc

SEQ ID NO: 3986898 - RNA, 23 nt, Staphylococcus aureus subsp. aureus Mu50
uuguuuuuuauaagaacaugaua

SEQ ID NO: 3986899 - RNA, 12 nt, Staphylococcus aureus subsp. aureus Mu50
uuuaaaaaacag

SEQ ID NO: 3986900 - RNA, 18 nt, Staphylococcus aureus subsp. aureus Mu50
uuuaaaaaauuuaaauaa

SEQ ID NO: 3986901 - RNA, 17 nt, Staphylococcus aureus subsp. aureus Mu50
uuuaaaaaauuuaaugu

SEQ ID NO: 3986902 - RNA, 13 nt, Staphylococcus aureus subsp. aureus Mu50
uuuaaaaaguaau

SEQ ID NO: 3986903 - RNA, 21 nt, Staphylococcus aureus subsp. aureus Mu50
uuuaaaaaguaauuaauuccu

SEQ ID NO: 3986904 - RNA, 13 nt, Staphylococcus aureus subsp. aureus Mu50
uuuaaaaaguuaa

SEQ ID NO: 3986905 - RNA, 12 nt, Staphylococcus aureus subsp. aureus Mu50
uuuaaaaauaca

SEQ ID NO: 3986906 - RNA, 13 nt, Staphylococcus aureus subsp. aureus Mu50
uuuaaaaaucaaa

SEQ ID NO: 3986907 - RNA, 12 nt, Staphylococcus aureus subsp. aureus Mu50
uuuaaaaaugcu

SEQ ID NO: 3986908 - RNA, 22 nt, Staphylococcus aureus subsp. aureus Mu50
uuuaaaaaugcugguaaauguu

SEQ ID NO: 3986909 - RNA, 16 nt, Staphylococcus aureus subsp. aureus Mu50
uuuaaaaauugauauu

SEQ ID NO: 3986910 - RNA, 15 nt, Staphylococcus aureus subsp. aureus Mu50
uuuaaaacaaugauu

SEQ ID NO: 3986911 - RNA, 22 nt, Staphylococcus aureus subsp. aureus Mu50
uuuaaaacaucauucacaaguu

SEQ ID NO: 3986912 - RNA, 22 nt, Staphylococcus aureus subsp. aureus Mu50
uuuaaaaggcgaaacauuaaaa

SEQ ID NO: 3986913 - RNA, 12 nt, Staphylococcus aureus subsp. aureus Mu50
uuuaaaaguaac

SEQ ID NO: 3986914 - RNA, 18 nt, Staphylococcus aureus subsp. aureus Mu50
uuuaaaaguaagcaccug

SEQ ID NO: 3986915 - RNA, 14 nt, Staphylococcus aureus subsp. aureus Mu50
uuuaaaauaauaga

SEQ ID NO: 3986916 - RNA, 21 nt, Staphylococcus aureus subsp. aureus Mu50
uuuaaaauaguucuuuaaauu

SEQ ID NO: 3986917 - RNA, 13 nt, Staphylococcus aureus subsp. aureus Mu50
uuuaaaauauuau

SEQ ID NO: 3986918 - RNA, 17 nt, Staphylococcus aureus subsp. aureus Mu50
uuuaaaaucucauaaua

SEQ ID NO: 3986919 - RNA, 13 nt, Staphylococcus aureus subsp. aureus Mu50
uuuaaaauuauca

SEQ ID NO: 3986920 - RNA, 17 nt, Staphylococcus aureus subsp. aureus Mu50
uuuaaaauuaucaauug

SEQ ID NO: 3986921 - RNA, 15 nt, Staphylococcus aureus subsp. aureus Mu50
uuuaaaauuaugauu

SEQ ID NO: 3986922 - RNA, 23 nt, Staphylococcus aureus subsp. aureus Mu50
uuuaaacaagcaucaugaaauua

SEQ ID NO: 3986923 - RNA, 23 nt, Staphylococcus aureus subsp. aureus Mu50
uuuaaaccguguucuuuaaugua

SEQ ID NO: 3986924 - RNA, 17 nt, Staphylococcus aureus subsp. aureus Mu50
uuuaaaccuguuaaugu

SEQ ID NO: 3986925 - RNA, 13 nt, Staphylococcus aureus subsp. aureus Mu50
uuuaaacgcucau

SEQ ID NO: 3986926 - RNA, 16 nt, Staphylococcus aureus subsp. aureus Mu50
uuuaaacucguaaauu

SEQ ID NO: 3986927 - RNA, 18 nt, Staphylococcus aureus subsp. aureus Mu50
uuuaaagaaaauuucagu

SEQ ID NO: 3986928 - RNA, 19 nt, Staphylococcus aureus subsp. aureus Mu50
uuuaaagacugaaccguau

SEQ ID NO: 3986929 - RNA, 18 nt, Staphylococcus aureus subsp. aureus Mu50
uuuaaagcaucauauaca

SEQ ID NO: 3986930 - RNA, 22 nt, Staphylococcus aureus subsp. aureus Mu50
uuuaaagcuaaauguuaaugcu

SEQ ID NO: 3986931 - RNA, 21 nt, Staphylococcus aureus subsp. aureus Mu50
uuuaaagguauugugauuuca

SEQ ID NO: 3986932 - RNA, 22 nt, Staphylococcus aureus subsp. aureus Mu50
uuuaaagguuaaauauuuaauu

SEQ ID NO: 3986933 - RNA, 13 nt, Staphylococcus aureus subsp. aureus Mu50
uuuaaauaaaaug

SEQ ID NO: 3986934 - RNA, 18 nt, Staphylococcus aureus subsp. aureus Mu50
uuuaaauaaaauuguuga

SEQ ID NO: 3986935 - RNA, 15 nt, Staphylococcus aureus subsp. aureus Mu50
uuuaaauaaaugacu

SEQ ID NO: 3986936 - RNA, 18 nt, Staphylococcus aureus subsp. aureus Mu50
uuuaaauaaaugacuuca

SEQ ID NO: 3986937 - RNA, 23 nt, Staphylococcus aureus subsp. aureus Mu50
uuuaaauaauaauucauaaaugc

SEQ ID NO: 3986938 - RNA, 22 nt, Staphylococcus aureus subsp. aureus Mu50
uuuaaauaaucgaaaauuucag

SEQ ID NO: 3986939 - RNA, 16 nt, Staphylococcus aureus subsp. aureus Mu50
uuuaaaucuauauaaa

SEQ ID NO: 3986940 - RNA, 20 nt, Staphylococcus aureus subsp. aureus Mu50
uuuaaaucuguacuucuaau

SEQ ID NO: 3986941 - RNA, 18 nt, Staphylococcus aureus subsp. aureus Mu50
uuuaaaucuuguucuaau

SEQ ID NO: 3986942 - RNA, 18 nt, Staphylococcus aureus subsp. aureus Mu50
uuuaaaucuuuuagcuuu

SEQ ID NO: 3986943 - RNA, 12 nt, Staphylococcus aureus subsp. aureus Mu50
uuuaaaugauau

SEQ ID NO: 3986944 - RNA, 23 nt, Staphylococcus aureus subsp. aureus Mu50
uuuaaaugauuucacuucauaaa

SEQ ID NO: 3986945 - RNA, 20 nt, Staphylococcus aureus subsp. aureus Mu50
uuuaaauguauuuuuacuuu

SEQ ID NO: 3986946 - RNA, 13 nt, Staphylococcus aureus subsp. aureus Mu50
uuuaaauuuaaga

SEQ ID NO: 3986947 - RNA, 14 nt, Staphylococcus aureus subsp. aureus Mu50
uuuaaauuuauaau

SEQ ID NO: 3986948 - RNA, 17 nt, Staphylococcus aureus subsp. aureus Mu50
uuuaaauuuucaucaua

SEQ ID NO: 3986949 - RNA, 18 nt, Staphylococcus aureus subsp. aureus Mu50
uuuaacaaaauuaagaag

SEQ ID NO: 3986950 - RNA, 10 nt, Staphylococcus aureus subsp. aureus Mu50
uuuaacauag

SEQ ID NO: 3986951 - RNA, 20 nt, Staphylococcus aureus subsp. aureus Mu50
uuuaacauagcuuaauaauu

SEQ ID NO: 3986952 - RNA, 24 nt, Staphylococcus aureus subsp. aureus Mu50
uuuaacauuuauucuuucucuauu

SEQ ID NO: 3986953 - RNA, 14 nt, Staphylococcus aureus subsp. aureus Mu50
uuuaacauuucuga

SEQ ID NO: 3986954 - RNA, 15 nt, Staphylococcus aureus subsp. aureus Mu50
uuuaacgucauuuuu

SEQ ID NO: 3986955 - RNA, 22 nt, Staphylococcus aureus subsp. aureus Mu50
uuuaacgucauuuuuaauaaug

SEQ ID NO: 3986956 - RNA, 14 nt, Staphylococcus aureus subsp. aureus Mu50
uuuacauucguuua

SEQ ID NO: 3986957 - RNA, 17 nt, Staphylococcus aureus subsp. aureus Mu50
uuuaccaauaucaugca

SEQ ID NO: 3986958 - RNA, 17 nt, Staphylococcus aureus subsp. aureus Mu50
uuuaccacuuauaacau

SEQ ID NO: 3986959 - RNA, 20 nt, Staphylococcus aureus subsp. aureus Mu50
uuuaccucuugauaaaauaa

SEQ ID NO: 3986960 - RNA, 22 nt, Staphylococcus aureus subsp. aureus Mu50
uuuacgaaaguagaauuauuua

SEQ ID NO: 3986961 - RNA, 13 nt, Staphylococcus aureus subsp. aureus Mu50
uuuacgauaaaua

SEQ ID NO: 3986962 - RNA, 15 nt, Staphylococcus aureus subsp. aureus Mu50
uuuacuaaacuuuug

SEQ ID NO: 3986963 - RNA, 15 nt, Staphylococcus aureus subsp. aureus Mu50
uuuacuaaaugaauu

SEQ ID NO: 3986964 - RNA, 22 nt, Staphylococcus aureus subsp. aureus Mu50
uuuacuaggaauauaaaacugu

SEQ ID NO: 3986965 - RNA, 15 nt, Staphylococcus aureus subsp. aureus Mu50
uuuacuauuaaagga

SEQ ID NO: 3986966 - RNA, 17 nt, Staphylococcus aureus subsp. aureus Mu50
uuuacucaaaccaucuu

SEQ ID NO: 3986967 - RNA, 18 nt, Staphylococcus aureus subsp. aureus Mu50
uuuacucaaaccaucuua

SEQ ID NO: 3986968 - RNA, 16 nt, Staphylococcus aureus subsp. aureus Mu50
uuuacucuacacucaa

SEQ ID NO: 3986969 - RNA, 15 nt, Staphylococcus aureus subsp. aureus Mu50
uuuacugcuucaauc

SEQ ID NO: 3986970 - RNA, 11 nt, Staphylococcus aureus subsp. aureus Mu50
uuuacuuaauc

SEQ ID NO: 3986971 - RNA, 19 nt, Staphylococcus aureus subsp. aureus Mu50
uuuacuuucucaucuauuu

SEQ ID NO: 3986972 - RNA, 18 nt, Staphylococcus aureus subsp. aureus Mu50
uuuagaaaaggauuauag

SEQ ID NO: 3986973 - RNA, 18 nt, Staphylococcus aureus subsp. aureus Mu50
uuuagaaagaauacaguu

SEQ ID NO: 3986974 - RNA, 14 nt, Staphylococcus aureus subsp. aureus Mu50
uuuagaaauagauu

SEQ ID NO: 3986975 - RNA, 21 nt, Staphylococcus aureus subsp. aureus Mu50
uuuagaagaaacuuaaucaag

SEQ ID NO: 3986976 - RNA, 17 nt, Staphylococcus aureus subsp. aureus Mu50
uuuagaauaagaaauaa

SEQ ID NO: 3986977 - RNA, 18 nt, Staphylococcus aureus subsp. aureus Mu50
uuuagaauaagaaauaaa

SEQ ID NO: 3986978 - RNA, 22 nt, Staphylococcus aureus subsp. aureus Mu50
uuuagaaucaaccguuuuauug

SEQ ID NO: 3986979 - RNA, 14 nt, Staphylococcus aureus subsp. aureus Mu50
uuuagacauaaaaa

SEQ ID NO: 3986980 - RNA, 17 nt, Staphylococcus aureus subsp. aureus Mu50
uuuagacaucauuguuu

SEQ ID NO: 3986981 - RNA, 17 nt, Staphylococcus aureus subsp. aureus Mu50
uuuagacauuaaaaaau

SEQ ID NO: 3986982 - RNA, 18 nt, Staphylococcus aureus subsp. aureus Mu50
uuuagaguuuuuauuauu

SEQ ID NO: 3986983 - RNA, 20 nt, Staphylococcus aureus subsp. aureus Mu50
uuuagauagcucuauggcuu

SEQ ID NO: 3986984 - RNA, 17 nt, Staphylococcus aureus subsp. aureus Mu50
uuuagauucuuuucuga

SEQ ID NO: 3986985 - RNA, 13 nt, Staphylococcus aureus subsp. aureus Mu50
uuuagauuuaguu

SEQ ID NO: 3986986 - RNA, 14 nt, Staphylococcus aureus subsp. aureus Mu50
uuuagauuuaguuu

SEQ ID NO: 3986987 - RNA, 13 nt, Staphylococcus aureus subsp. aureus Mu50
uuuagauuuauaa

SEQ ID NO: 3986988 - RNA, 19 nt, Staphylococcus aureus subsp. aureus Mu50
uuuagauuucaugauguua

SEQ ID NO: 3986989 - RNA, 18 nt, Staphylococcus aureus subsp. aureus Mu50
uuuagcaauugaaucaaa

SEQ ID NO: 3986990 - RNA, 19 nt, Staphylococcus aureus subsp. aureus Mu50
uuuagcaauugaaucaaau

SEQ ID NO: 3986991 - RNA, 22 nt, Staphylococcus aureus subsp. aureus Mu50
uuuagcauacauuaagcuaugc

SEQ ID NO: 3986992 - RNA, 19 nt, Staphylococcus aureus subsp. aureus Mu50
uuuagcuauguaaaauuau

SEQ ID NO: 3986993 - RNA, 14 nt, Staphylococcus aureus subsp. aureus Mu50
uuuaggcaaauaac

SEQ ID NO: 3986994 - RNA, 18 nt, Staphylococcus aureus subsp. aureus Mu50
uuuaggugcuuuaaugcc

SEQ ID NO: 3986995 - RNA, 23 nt, Staphylococcus aureus subsp. aureus Mu50
uuuaguacauagaccuuuauuuu

SEQ ID NO: 3986996 - RNA, 14 nt, Staphylococcus aureus subsp. aureus Mu50
uuuaguauaaauaa

SEQ ID NO: 3986997 - RNA, 21 nt, Staphylococcus aureus subsp. aureus Mu50
uuuaguaucuauacaauuaug

SEQ ID NO: 3986998 - RNA, 21 nt, Staphylococcus aureus subsp. aureus Mu50
uuuaguauguuuuauuuucuu

SEQ ID NO: 3986999 - RNA, 22 nt, Staphylococcus aureus subsp. aureus Mu50
uuuaguauugguaccuuuccaa

SEQ ID NO: 3987000 - RNA, 21 nt, Staphylococcus aureus subsp. aureus Mu50
uuuaguauuucaucauuaguu

SEQ ID NO: 3987001 - RNA, 20 nt, Staphylococcus aureus subsp. aureus Mu50
uuuaguccuucuuuacuaaa

SEQ ID NO: 3987002 - RNA, 18 nt, Staphylococcus aureus subsp. aureus Mu50
uuuagucgguguuuucuu

SEQ ID NO: 3987003 - RNA, 15 nt, Staphylococcus aureus subsp. aureus Mu50
uuuagugaaaaaguu

SEQ ID NO: 3987004 - RNA, 13 nt, Staphylococcus aureus subsp. aureus Mu50
uuuaguuaaauag

SEQ ID NO: 3987005 - RNA, 15 nt, Staphylococcus aureus subsp. aureus Mu50
uuuaguuaaauagua

SEQ ID NO: 3987006 - RNA, 22 nt, Staphylococcus aureus subsp. aureus Mu50
uuuaguuagcccuauucaacua

SEQ ID NO: 3987007 - RNA, 18 nt, Staphylococcus aureus subsp. aureus Mu50
uuuaguucacaugaauuu

SEQ ID NO: 3987008 - RNA, 17 nt, Staphylococcus aureus subsp. aureus Mu50
uuuauaaaaaaaucccu

SEQ ID NO: 3987009 - RNA, 13 nt, Staphylococcus aureus subsp. aureus Mu50
uuuauaaaaagag

SEQ ID NO: 3987010 - RNA, 19 nt, Staphylococcus aureus subsp. aureus Mu50
uuuauaaacaauuacaaaa

SEQ ID NO: 3987011 - RNA, 13 nt, Staphylococcus aureus subsp. aureus Mu50
uuuauaaaucaaa

SEQ ID NO: 3987012 - RNA, 23 nt, Staphylococcus aureus subsp. aureus Mu50
uuuauaaaugaauuauuuaaaau

SEQ ID NO: 3987013 - RNA, 15 nt, Staphylococcus aureus subsp. aureus Mu50
uuuauaaauuaaaug

SEQ ID NO: 3987014 - RNA, 14 nt, Staphylococcus aureus subsp. aureus Mu50
uuuauaaauuauag

SEQ ID NO: 3987015 - RNA, 12 nt, Staphylococcus aureus subsp. aureus Mu50
uuuauaaauuuc

SEQ ID NO: 3987016 - RNA, 22 nt, Staphylococcus aureus subsp. aureus Mu50
uuuauaacauacguuauuuuuu

SEQ ID NO: 3987017 - RNA, 22 nt, Staphylococcus aureus subsp. aureus Mu50
uuuauaagaacaugauacugaa

SEQ ID NO: 3987018 - RNA, 22 nt, Staphylococcus aureus subsp. aureus Mu50
uuuauaagccuuuucaaacaua

SEQ ID NO: 3987019 - RNA, 23 nt, Staphylococcus aureus subsp. aureus Mu50
uuuauaagccuuuucaaacauau

SEQ ID NO: 3987020 - RNA, 13 nt, Staphylococcus aureus subsp. aureus Mu50
uuuauaauaaucg

SEQ ID NO: 3987021 - RNA, 14 nt, Staphylococcus aureus subsp. aureus Mu50
uuuauaaucaguuu

SEQ ID NO: 3987022 - RNA, 16 nt, Staphylococcus aureus subsp. aureus Mu50
uuuauaauucuaaguc

SEQ ID NO: 3987023 - RNA, 13 nt, Staphylococcus aureus subsp. aureus Mu50
uuuauacauaaau

SEQ ID NO: 3987024 - RNA, 14 nt, Staphylococcus aureus subsp. aureus Mu50
uuuauacauaaaua

SEQ ID NO: 3987025 - RNA, 18 nt, Staphylococcus aureus subsp. aureus Mu50
uuuauacauguacauuau

SEQ ID NO: 3987026 - RNA, 17 nt, Staphylococcus aureus subsp. aureus Mu50
uuuauacuauaaauaca

SEQ ID NO: 3987027 - RNA, 18 nt, Staphylococcus aureus subsp. aureus Mu50
uuuauagaaaccaaaaaa

SEQ ID NO: 3987028 - RNA, 13 nt, Staphylococcus aureus subsp. aureus Mu50
uuuauauccaucu

SEQ ID NO: 3987029 - RNA, 23 nt, Staphylococcus aureus subsp. aureus Mu50
uuuauaucuuaaguacauaaaug

SEQ ID NO: 3987030 - RNA, 17 nt, Staphylococcus aureus subsp. aureus Mu50
uuuauaucuuucugaag

SEQ ID NO: 3987031 - RNA, 16 nt, Staphylococcus aureus subsp. aureus Mu50
uuuauauuaaauacua

SEQ ID NO: 3987032 - RNA, 13 nt, Staphylococcus aureus subsp. aureus Mu50
uuuauauucuaau

SEQ ID NO: 3987033 - RNA, 17 nt, Staphylococcus aureus subsp. aureus Mu50
uuuauauuuuuaucauc

SEQ ID NO: 3987034 - RNA, 16 nt, Staphylococcus aureus subsp. aureus Mu50
uuuaucaacaaauuua

SEQ ID NO: 3987035 - RNA, 17 nt, Staphylococcus aureus subsp. aureus Mu50
uuuaucaacaaauuuaa

SEQ ID NO: 3987036 - RNA, 16 nt, Staphylococcus aureus subsp. aureus Mu50
uuuaucaacaaauuuu

SEQ ID NO: 3987037 - RNA, 15 nt, Staphylococcus aureus subsp. aureus Mu50
uuuaucaacauaaaa

SEQ ID NO: 3987038 - RNA, 12 nt, Staphylococcus aureus subsp. aureus Mu50
uuuaucaauaaa

SEQ ID NO: 3987039 - RNA, 12 nt, Staphylococcus aureus subsp. aureus Mu50
uuuaucaauauu

SEQ ID NO: 3987040 - RNA, 14 nt, Staphylococcus aureus subsp. aureus Mu50
uuuaucaauuucua

SEQ ID NO: 3987041 - RNA, 15 nt, Staphylococcus aureus subsp. aureus Mu50
uuuaucaauuucuau

SEQ ID NO: 3987042 - RNA, 16 nt, Staphylococcus aureus subsp. aureus Mu50
uuuaucaauuucuauu

SEQ ID NO: 3987043 - RNA, 15 nt, Staphylococcus aureus subsp. aureus Mu50
uuuaucaauuucucu

SEQ ID NO: 3987044 - RNA, 17 nt, Staphylococcus aureus subsp. aureus Mu50
uuuaucaauuucucuuu

SEQ ID NO: 3987045 - RNA, 13 nt, Staphylococcus aureus subsp. aureus Mu50
uuuaucacuguau

SEQ ID NO: 3987046 - RNA, 22 nt, Staphylococcus aureus subsp. aureus Mu50
uuuaucaucaugacuauuucgc

SEQ ID NO: 3987047 - RNA, 19 nt, Staphylococcus aureus subsp. aureus Mu50
uuuaucaugaugauaaauu

SEQ ID NO: 3987048 - RNA, 12 nt, Staphylococcus aureus subsp. aureus Mu50
uuuaucauuauu

SEQ ID NO: 3987049 - RNA, 13 nt, Staphylococcus aureus subsp. aureus Mu50
uuuaucauuauuc

SEQ ID NO: 3987050 - RNA, 12 nt, Staphylococcus aureus subsp. aureus Mu50
uuuauccaaacc

SEQ ID NO: 3987051 - RNA, 15 nt, Staphylococcus aureus subsp. aureus Mu50
uuuauccaaaccaau

SEQ ID NO: 3987052 - RNA, 19 nt, Staphylococcus aureus subsp. aureus Mu50
uuuauccaaaccaauuuua

SEQ ID NO: 3987053 - RNA, 20 nt, Staphylococcus aureus subsp. aureus Mu50
uuuauccaaaccaauuuuaa

SEQ ID NO: 3987054 - RNA, 20 nt, Staphylococcus aureus subsp. aureus Mu50
uuuauccgucgaauauaauu

SEQ ID NO: 3987055 - RNA, 15 nt, Staphylococcus aureus subsp. aureus Mu50
uuuaucgccaauuaa

SEQ ID NO: 3987056 - RNA, 22 nt, Staphylococcus aureus subsp. aureus Mu50
uuuaucuaaagguaccacugua

SEQ ID NO: 3987057 - RNA, 15 nt, Staphylococcus aureus subsp. aureus Mu50
uuuaucuaguuguuu

SEQ ID NO: 3987058 - RNA, 17 nt, Staphylococcus aureus subsp. aureus Mu50
uuuaucugaaaauauca

SEQ ID NO: 3987059 - RNA, 19 nt, Staphylococcus aureus subsp. aureus Mu50
uuuaucugaauuuuacuga

SEQ ID NO: 3987060 - RNA, 15 nt, Staphylococcus aureus subsp. aureus Mu50
uuuaucugcaaaaug

SEQ ID NO: 3987061 - RNA, 19 nt, Staphylococcus aureus subsp. aureus Mu50
uuuaucuguaacaaagucu

SEQ ID NO: 3987062 - RNA, 22 nt, Staphylococcus aureus subsp. aureus Mu50
uuuaucuguagaaacacuuuua

SEQ ID NO: 3987063 - RNA, 21 nt, Staphylococcus aureus subsp. aureus Mu50
uuuaucuuauuauuaauuccu

SEQ ID NO: 3987064 - RNA, 23 nt, Staphylococcus aureus subsp. aureus Mu50
uuuaucuucaguaauuucuccaa

SEQ ID NO: 3987065 - RNA, 17 nt, Staphylococcus aureus subsp. aureus Mu50
uuuaugaagugaaauca

SEQ ID NO: 3987066 - RNA, 16 nt, Staphylococcus aureus subsp. aureus Mu50
uuuaugacaaaguucu

SEQ ID NO: 3987067 - RNA, 20 nt, Staphylococcus aureus subsp. aureus Mu50
uuuaugacaaaguucugcaa

SEQ ID NO: 3987068 - RNA, 20 nt, Staphylococcus aureus subsp. aureus Mu50
uuuaugauaauaagaauauu

SEQ ID NO: 3987069 - RNA, 12 nt, Staphylococcus aureus subsp. aureus Mu50
uuuaugauuguu

SEQ ID NO: 3987070 - RNA, 14 nt, Staphylococcus aureus subsp. aureus Mu50
uuuaugauuugauu

SEQ ID NO: 3987071 - RNA, 19 nt, Staphylococcus aureus subsp. aureus Mu50
uuuaugcaugcgcaaaagc

SEQ ID NO: 3987072 - RNA, 17 nt, Staphylococcus aureus subsp. aureus Mu50
uuuaugcgauucucauu

SEQ ID NO: 3987073 - RNA, 13 nt, Staphylococcus aureus subsp. aureus Mu50
uuuaugcuuuaaa

SEQ ID NO: 3987074 - RNA, 17 nt, Staphylococcus aureus subsp. aureus Mu50
uuuauggauuucuuauu

SEQ ID NO: 3987075 - RNA, 13 nt, Staphylococcus aureus subsp. aureus Mu50
uuuaugguguggu

SEQ ID NO: 3987076 - RNA, 21 nt, Staphylococcus aureus subsp. aureus Mu50
uuuaugguguggugugaugua

SEQ ID NO: 3987077 - RNA, 18 nt, Staphylococcus aureus subsp. aureus Mu50
uuuauguuugauuuuauu

SEQ ID NO: 3987078 - RNA, 18 nt, Staphylococcus aureus subsp. aureus Mu50
uuuauguuuuaauuucuu

SEQ ID NO: 3987079 - RNA, 20 nt, Staphylococcus aureus subsp. aureus Mu50
uuuauuaaagaaacaugauu

SEQ ID NO: 3987080 - RNA, 12 nt, Staphylococcus aureus subsp. aureus Mu50
uuuauuaaauaa

SEQ ID NO: 3987081 - RNA, 13 nt, Staphylococcus aureus subsp. aureus Mu50
uuuauuaaauaac

SEQ ID NO: 3987082 - RNA, 13 nt, Staphylococcus aureus subsp. aureus Mu50
uuuauuaaauaua

SEQ ID NO: 3987083 - RNA, 18 nt, Staphylococcus aureus subsp. aureus Mu50
uuuauuaauaaauucucu

SEQ ID NO: 3987084 - RNA, 17 nt, Staphylococcus aureus subsp. aureus Mu50
uuuauuaauauuaguga

SEQ ID NO: 3987085 - RNA, 12 nt, Staphylococcus aureus subsp. aureus Mu50
uuuauuacuuau

SEQ ID NO: 3987086 - RNA, 21 nt, Staphylococcus aureus subsp. aureus Mu50
uuuauuacuuuaauuuaguga

SEQ ID NO: 3987087 - RNA, 14 nt, Staphylococcus aureus subsp. aureus Mu50
uuuauuagaaugaa

SEQ ID NO: 3987088 - RNA, 21 nt, Staphylococcus aureus subsp. aureus Mu50
uuuauuauacauaggcgcugu

SEQ ID NO: 3987089 - RNA, 11 nt, Staphylococcus aureus subsp. aureus Mu50
uuuauuauuag

SEQ ID NO: 3987090 - RNA, 15 nt, Staphylococcus aureus subsp. aureus Mu50
uuuauucuaaauaua

SEQ ID NO: 3987091 - RNA, 16 nt, Staphylococcus aureus subsp. aureus Mu50
uuuauucuaaguuaaa

SEQ ID NO: 3987092 - RNA, 18 nt, Staphylococcus aureus subsp. aureus Mu50
uuuauucuaauacaaacc

SEQ ID NO: 3987093 - RNA, 12 nt, Staphylococcus aureus subsp. aureus Mu50
uuuauucuuccc

SEQ ID NO: 3987094 - RNA, 21 nt, Staphylococcus aureus subsp. aureus Mu50
uuuauugagcuuuguuugaaa

SEQ ID NO: 3987095 - RNA, 19 nt, Staphylococcus aureus subsp. aureus Mu50
uuuauuuagaauaaacuuu

SEQ ID NO: 3987096 - RNA, 22 nt, Staphylococcus aureus subsp. aureus Mu50
uuuauuuauaaaauaaaaugca

SEQ ID NO: 3987097 - RNA, 14 nt, Staphylococcus aureus subsp. aureus Mu50
uuuauuuauucuaa

SEQ ID NO: 3987098 - RNA, 19 nt, Staphylococcus aureus subsp. aureus Mu50
uuuauuugagaaccacuau

SEQ ID NO: 3987099 - RNA, 20 nt, Staphylococcus aureus subsp. aureus Mu50
uuuauuuguacaugaacaaa

SEQ ID NO: 3987100 - RNA, 17 nt, Staphylococcus aureus subsp. aureus Mu50
uuuauuuuagcagcagu

SEQ ID NO: 3987101 - RNA, 19 nt, Staphylococcus aureus subsp. aureus Mu50
uuuauuuucaauaaauaaa

SEQ ID NO: 3987102 - RNA, 18 nt, Staphylococcus aureus subsp. aureus Mu50
uuuauuuucauauaaaua

SEQ ID NO: 3987103 - RNA, 13 nt, Staphylococcus aureus subsp. aureus Mu50
uuuauuuugauua

SEQ ID NO: 3987104 - RNA, 11 nt, Staphylococcus aureus subsp. aureus Mu50
uuucaaaaaua

SEQ ID NO: 3987105 - RNA, 15 nt, Staphylococcus aureus subsp. aureus Mu50
uuucaaaaccaauua

SEQ ID NO: 3987106 - RNA, 14 nt, Staphylococcus aureus subsp. aureus Mu50
uuucaaaacuagca

SEQ ID NO: 3987107 - RNA, 24 nt, Staphylococcus aureus subsp. aureus Mu50
uuucaaaacuagcaguaauauguu

SEQ ID NO: 3987108 - RNA, 14 nt, Staphylococcus aureus subsp. aureus Mu50
uuucaaaacugcca

SEQ ID NO: 3987109 - RNA, 12 nt, Staphylococcus aureus subsp. aureus Mu50
uuucaaacaaag

SEQ ID NO: 3987110 - RNA, 18 nt, Staphylococcus aureus subsp. aureus Mu50
uuucaaauaauauaaaac

SEQ ID NO: 3987111 - RNA, 22 nt, Staphylococcus aureus subsp. aureus Mu50
uuucaaauaauauaaaacgaua

SEQ ID NO: 3987112 - RNA, 23 nt, Staphylococcus aureus subsp. aureus Mu50
uuucaaauuaauuaaaccaauac

SEQ ID NO: 3987113 - RNA, 17 nt, Staphylococcus aureus subsp. aureus Mu50
uuucaacacacuauuau

SEQ ID NO: 3987114 - RNA, 16 nt, Staphylococcus aureus subsp. aureus Mu50
uuucaacauaauauuu

SEQ ID NO: 3987115 - RNA, 13 nt, Staphylococcus aureus subsp. aureus Mu50
uuucaacauuacu

SEQ ID NO: 3987116 - RNA, 18 nt, Staphylococcus aureus subsp. aureus Mu50
uuucaacgcauauucuau

SEQ ID NO: 3987117 - RNA, 19 nt, Staphylococcus aureus subsp. aureus Mu50
uuucaacgcauauucuauu

SEQ ID NO: 3987118 - RNA, 23 nt, Staphylococcus aureus subsp. aureus Mu50
uuucaacuuuugaggagauagua

SEQ ID NO: 3987119 - RNA, 20 nt, Staphylococcus aureus subsp. aureus Mu50
uuucaacuuuuuaauaauac

SEQ ID NO: 3987120 - RNA, 17 nt, Staphylococcus aureus subsp. aureus Mu50
uuucaagaccaaauauu

SEQ ID NO: 3987121 - RNA, 18 nt, Staphylococcus aureus subsp. aureus Mu50
uuucaaguaaugauauua

SEQ ID NO: 3987122 - RNA, 13 nt, Staphylococcus aureus subsp. aureus Mu50
uuucaauaaauaa

SEQ ID NO: 3987123 - RNA, 13 nt, Staphylococcus aureus subsp. aureus Mu50
uuucaauaaauuu

SEQ ID NO: 3987124 - RNA, 20 nt, Staphylococcus aureus subsp. aureus Mu50
uuucaauuaauuuaaaugcu

SEQ ID NO: 3987125 - RNA, 14 nt, Staphylococcus aureus subsp. aureus Mu50
uuucaauuagaaaa

SEQ ID NO: 3987126 - RNA, 12 nt, Staphylococcus aureus subsp. aureus Mu50
uuucaauuugga

SEQ ID NO: 3987127 - RNA, 14 nt, Staphylococcus aureus subsp. aureus Mu50
uuucaauuuggaaa

SEQ ID NO: 3987128 - RNA, 16 nt, Staphylococcus aureus subsp. aureus Mu50
uuucacgauuucuuua

SEQ ID NO: 3987129 - RNA, 20 nt, Staphylococcus aureus subsp. aureus Mu50
uuucacgcugaaauuuuuua

SEQ ID NO: 3987130 - RNA, 18 nt, Staphylococcus aureus subsp. aureus Mu50
uuucacuuuaacuucuuu

SEQ ID NO: 3987131 - RNA, 13 nt, Staphylococcus aureus subsp. aureus Mu50
uuucagaaugaac

SEQ ID NO: 3987132 - RNA, 15 nt, Staphylococcus aureus subsp. aureus Mu50
uuucuggcucuucuu

SEQ ID NO: 3987133 - RNA, 18 nt, Staphylococcus aureus subsp. aureus Mu50
uuucugggcuuucuuuuu

SEQ ID NO: 3987134 - RNA, 14 nt, Staphylococcus aureus subsp. aureus Mu50
uuucugugaccaau

SEQ ID NO: 3987135 - RNA, 15 nt, Staphylococcus aureus subsp. aureus Mu50
uuucuuaacauaaaa

SEQ ID NO: 3987136 - RNA, 10 nt, Staphylococcus aureus subsp. aureus Mu50
uuucuuaauu

SEQ ID NO: 3987137 - RNA, 12 nt, Staphylococcus aureus subsp. aureus Mu50
uuucuuaauuac

SEQ ID NO: 3987138 - RNA, 18 nt, Staphylococcus aureus subsp. aureus Mu50
uuucuuaguuugacaucu

SEQ ID NO: 3987139 - RNA, 13 nt, Staphylococcus aureus subsp. aureus Mu50
uuucuuauaaaaa

SEQ ID NO: 3987140 - RNA, 13 nt, Staphylococcus aureus subsp. aureus Mu50
uuucuuauguaua

SEQ ID NO: 3987141 - RNA, 13 nt, Staphylococcus aureus subsp. aureus Mu50
uuucuuauuaaau

SEQ ID NO: 3987142 - RNA, 14 nt, Staphylococcus aureus subsp. aureus Mu50
uuucuuauuaaaua

SEQ ID NO: 3987143 - RNA, 16 nt, Staphylococcus aureus subsp. aureus Mu50
uuucuuauuuguaauu

SEQ ID NO: 3987144 - RNA, 19 nt, Staphylococcus aureus subsp. aureus Mu50
uuucuucauaguucaaauu

SEQ ID NO: 3987145 - RNA, 12 nt, Staphylococcus aureus subsp. aureus Mu50
uuucuucauuuu

SEQ ID NO: 3987146 - RNA, 21 nt, Staphylococcus aureus subsp. aureus Mu50
uuucuucauuuucauuguaug

SEQ ID NO: 3987147 - RNA, 11 nt, Staphylococcus aureus subsp. aureus Mu50
uuucuucuucu

SEQ ID NO: 3987148 - RNA, 16 nt, Staphylococcus aureus subsp. aureus Mu50
uuucuucuuuuuccca

SEQ ID NO: 3987149 - RNA, 18 nt, Staphylococcus aureus subsp. aureus Mu50
uuucuugaaguacuuuac

SEQ ID NO: 3987150 - RNA, 23 nt, Staphylococcus aureus subsp. aureus Mu50
uuucuugccaucaauuucuguaa

SEQ ID NO: 3987151 - RNA, 14 nt, Staphylococcus aureus subsp. aureus Mu50
uuucuuguucuaaa

SEQ ID NO: 3987152 - RNA, 14 nt, Staphylococcus aureus subsp. aureus Mu50
uuucuuucuuuucu

SEQ ID NO: 3987153 - RNA, 18 nt, Staphylococcus aureus subsp. aureus Mu50
uuucuuugauaacaauuu

SEQ ID NO: 3987154 - RNA, 22 nt, Staphylococcus aureus subsp. aureus Mu50
uuucuuugauaacaauuuuaaa

SEQ ID NO: 3987155 - RNA, 13 nt, Staphylococcus aureus subsp. aureus Mu50
uuucuuuuauuuu

SEQ ID NO: 3987156 - RNA, 16 nt, Staphylococcus aureus subsp. aureus Mu50
uuucuuuucaaaauaa

SEQ ID NO: 3987157 - RNA, 14 nt, Staphylococcus aureus subsp. aureus Mu50
uuucuuuuuuaauu

SEQ ID NO: 3987158 - RNA, 12 nt, Staphylococcus aureus subsp. aureus Mu50
uuucuuuuuuau

SEQ ID NO: 3987159 - RNA, 20 nt, Staphylococcus aureus subsp. aureus Mu50
uuucuuuuuugcuguauaua

SEQ ID NO: 3987160 - RNA, 14 nt, Staphylococcus aureus subsp. aureus Mu50
uuugaaaauuucac

SEQ ID NO: 3987161 - RNA, 18 nt, Staphylococcus aureus subsp. aureus Mu50
uuugaaaauuucaccgcu

SEQ ID NO: 3987162 - RNA, 16 nt, Staphylococcus aureus subsp. aureus Mu50
uuugaaacaucuaaau

SEQ ID NO: 3987163 - RNA, 19 nt, Staphylococcus aureus subsp. aureus Mu50
uuugaaagaaggaauaauu

SEQ ID NO: 3987164 - RNA, 12 nt, Staphylococcus aureus subsp. aureus Mu50
uuugaaaucaau

SEQ ID NO: 3987165 - RNA, 13 nt, Staphylococcus aureus subsp. aureus Mu50
uuugaaauuuauu

SEQ ID NO: 3987166 - RNA, 19 nt, Staphylococcus aureus subsp. aureus Mu50
uuugaaauuucgacaucua

SEQ ID NO: 3987167 - RNA, 23 nt, Staphylococcus aureus subsp. aureus Mu50
uuugaacaacaucuuuuguuguu

SEQ ID NO: 3987168 - RNA, 15 nt, Staphylococcus aureus subsp. aureus Mu50
uuugaacauauuaua

SEQ ID NO: 3987169 - RNA, 17 nt, Staphylococcus aureus subsp. aureus Mu50
uuugaagaauguuucau

SEQ ID NO: 3987170 - RNA, 20 nt, Staphylococcus aureus subsp. aureus Mu50
uuugaaggagauauuuucuu

SEQ ID NO: 3987171 - RNA, 19 nt, Staphylococcus aureus subsp. aureus Mu50
uuugaagggagcauuucau

SEQ ID NO: 3987172 - RNA, 21 nt, Staphylococcus aureus subsp. aureus Mu50
uuugaaguuacuauauuuauu

SEQ ID NO: 3987173 - RNA, 17 nt, Staphylococcus aureus subsp. aureus Mu50
uuugaauacuuuauuug

SEQ ID NO: 3987174 - RNA, 12 nt, Staphylococcus aureus subsp. aureus Mu50
uuugaauauacu

SEQ ID NO: 3987175 - RNA, 16 nt, Staphylococcus aureus subsp. aureus Mu50
uuugaauauuugcuuu

SEQ ID NO: 3987176 - RNA, 23 nt, Staphylococcus aureus subsp. aureus Mu50
uuugaaucaguauaaucagcaau

SEQ ID NO: 3987177 - RNA, 16 nt, Staphylococcus aureus subsp. aureus Mu50
uuugaaucuuguugaa

SEQ ID NO: 3987178 - RNA, 21 nt, Staphylococcus aureus subsp. aureus Mu50
uuugaaugcaaaucaaauaca

SEQ ID NO: 3987179 - RNA, 15 nt, Staphylococcus aureus subsp. aureus Mu50
uuugaauugacuuac

SEQ ID NO: 3987180 - RNA, 17 nt, Staphylococcus aureus subsp. aureus Mu50
uuugaauugacuuacau

SEQ ID NO: 3987181 - RNA, 12 nt, Staphylococcus aureus subsp. aureus Mu50
uuugaauuuuau

SEQ ID NO: 3987182 - RNA, 18 nt, Staphylococcus aureus subsp. aureus Mu50
uuugacauaaaaaauaac

SEQ ID NO: 3987183 - RNA, 19 nt, Staphylococcus aureus subsp. aureus Mu50
uuugacauaucgauauucu

SEQ ID NO: 3987184 - RNA, 19 nt, Staphylococcus aureus subsp. aureus Mu50
uuugacauauuuuuuaaau

SEQ ID NO: 3987185 - RNA, 16 nt, Staphylococcus aureus subsp. aureus Mu50
uuugacuauucucagu

SEQ ID NO: 3987186 - RNA, 17 nt, Staphylococcus aureus subsp. aureus Mu50
uuugacucuuuucugca

SEQ ID NO: 3987187 - RNA, 14 nt, Staphylococcus aureus subsp. aureus Mu50
uuugagaaaugaaa

SEQ ID NO: 3987188 - RNA, 18 nt, Staphylococcus aureus subsp. aureus Mu50
uuugagauauauuaaugu

SEQ ID NO: 3987189 - RNA, 21 nt, Staphylococcus aureus subsp. aureus Mu50
uuugaggauacauaaaucuaa

SEQ ID NO: 3987190 - RNA, 21 nt, Staphylococcus aureus subsp. aureus Mu50
uuugagguguggaguaaagau

SEQ ID NO: 3987191 - RNA, 14 nt, Staphylococcus aureus subsp. aureus Mu50
uuugaguaaauuaa

SEQ ID NO: 3987192 - RNA, 15 nt, Staphylococcus aureus subsp. aureus Mu50
uuugaguaaauuaau

SEQ ID NO: 3987193 - RNA, 14 nt, Staphylococcus aureus subsp. aureus Mu50
uuugaguauccaau

SEQ ID NO: 3987194 - RNA, 20 nt, Staphylococcus aureus subsp. aureus Mu50
uuugaguguguccaucauuu

SEQ ID NO: 3987195 - RNA, 23 nt, Staphylococcus aureus subsp. aureus Mu50
uuugauaaaugcgguugaugguu

SEQ ID NO: 3987196 - RNA, 19 nt, Staphylococcus aureus subsp. aureus Mu50
uuugauaacaauuuuaaau

SEQ ID NO: 3987197 - RNA, 13 nt, Staphylococcus aureus subsp. aureus Mu50
uuugauaagugau

SEQ ID NO: 3987198 - RNA, 19 nt, Staphylococcus aureus subsp. aureus Mu50
uuugauaagugaugugaug

SEQ ID NO: 3987199 - RNA, 14 nt, Staphylococcus aureus subsp. aureus Mu50
uuugauaaugauag

SEQ ID NO: 3987200 - RNA, 22 nt, Staphylococcus aureus subsp. aureus Mu50
uuugauauaaaaagugaaagua

SEQ ID NO: 3987201 - RNA, 23 nt, Staphylococcus aureus subsp. aureus Mu50
uuugauauaaaaagugaaaguau

SEQ ID NO: 3987202 - RNA, 17 nt, Staphylococcus aureus subsp. aureus Mu50
uuugaucaacuauauau

SEQ ID NO: 3987203 - RNA, 20 nt, Staphylococcus aureus subsp. aureus Mu50
uuugauccaaaguacucaag

SEQ ID NO: 3987204 - RNA, 24 nt, Staphylococcus aureus subsp. aureus Mu50
uuugaugaucauuaguguagaaaa

SEQ ID NO: 3987205 - RNA, 15 nt, Staphylococcus aureus subsp. aureus Mu50
uuugauguuuucuau

SEQ ID NO: 3987206 - RNA, 16 nt, Staphylococcus aureus subsp. aureus Mu50
uuugauguuuucuaua

SEQ ID NO: 3987207 - RNA, 23 nt, Staphylococcus aureus subsp. aureus Mu50
uuugauguuuucuauaauauuua

SEQ ID NO: 3987208 - RNA, 17 nt, Staphylococcus aureus subsp. aureus Mu50
uuugauuaaaaucugcu

SEQ ID NO: 3987209 - RNA, 13 nt, Staphylococcus aureus subsp. aureus Mu50
uuugauuaaauuc

SEQ ID NO: 3987210 - RNA, 17 nt, Staphylococcus aureus subsp. aureus Mu50
uuugauuaguaaauaua

SEQ ID NO: 3987211 - RNA, 12 nt, Staphylococcus aureus subsp. aureus Mu50
uuugauugauau

SEQ ID NO: 3987212 - RNA, 13 nt, Staphylococcus aureus subsp. aureus Mu50
uuugauuguuuaa

SEQ ID NO: 3987213 - RNA, 13 nt, Staphylococcus aureus subsp. aureus Mu50
uuugauuuggaaa

SEQ ID NO: 3987214 - RNA, 17 nt, Staphylococcus aureus subsp. aureus Mu50
uuugauuuuacuugaau

SEQ ID NO: 3987215 - RNA, 17 nt, Staphylococcus aureus subsp. aureus Mu50
uuugauuuuauucacuu

SEQ ID NO: 3987216 - RNA, 14 nt, Staphylococcus aureus subsp. aureus Mu50
uuugcaaaaucaac

SEQ ID NO: 3987217 - RNA, 17 nt, Staphylococcus aureus subsp. aureus Mu50
uuugcacaaagauaugu

SEQ ID NO: 3987218 - RNA, 18 nt, Staphylococcus aureus subsp. aureus Mu50
uuugcaccuauaccucgu

SEQ ID NO: 3987219 - RNA, 23 nt, Staphylococcus aureus subsp. aureus Mu50
uuugcauaccuauaaacauaucu

SEQ ID NO: 3987220 - RNA, 16 nt, Staphylococcus aureus subsp. aureus Mu50
uuuuaaauaaaaugca

SEQ ID NO: 3987221 - RNA, 18 nt, Staphylococcus aureus subsp. aureus Mu50
uuuuaaaucuacaauauu

SEQ ID NO: 3987222 - RNA, 13 nt, Staphylococcus aureus subsp. aureus Mu50
uuuuaaauuuaag

SEQ ID NO: 3987223 - RNA, 21 nt, Staphylococcus aureus subsp. aureus Mu50
uuuuaaauuuaguaucucauu

SEQ ID NO: 3987224 - RNA, 20 nt, Staphylococcus aureus subsp. aureus Mu50
uuuuaacagcgugaauauaa

SEQ ID NO: 3987225 - RNA, 15 nt, Staphylococcus aureus subsp. aureus Mu50
uuuuaacagcugcag

SEQ ID NO: 3987226 - RNA, 21 nt, Staphylococcus aureus subsp. aureus Mu50
uuuuaacauagcuuaauaauu

SEQ ID NO: 3987227 - RNA, 21 nt, Staphylococcus aureus subsp. aureus Mu50
uuuuaacccacauuaaauauu

SEQ ID NO: 3987228 - RNA, 22 nt, Staphylococcus aureus subsp. aureus Mu50
uuuuaacgucauuuuuaauaau

SEQ ID NO: 3987229 - RNA, 21 nt, Staphylococcus aureus subsp. aureus Mu50
uuuuaacuauguuacuuauau

SEQ ID NO: 3987230 - RNA, 12 nt, Staphylococcus aureus subsp. aureus Mu50
uuuuaacuuaau

SEQ ID NO: 3987231 - RNA, 22 nt, Staphylococcus aureus subsp. aureus Mu50
uuuuaauaaugcagauucuuca

SEQ ID NO: 3987232 - RNA, 18 nt, Staphylococcus aureus subsp. aureus Mu50
uuuuaauauauuuauuuu

SEQ ID NO: 3987233 - RNA, 21 nt, Staphylococcus aureus subsp. aureus Mu50
uuuuaauauauuuauuuuuga

SEQ ID NO: 3987234 - RNA, 20 nt, Staphylococcus aureus subsp. aureus Mu50
uuuuaauauugaaaugagcu

SEQ ID NO: 3987235 - RNA, 19 nt, Staphylococcus aureus subsp. aureus Mu50
uuuuaaugggcgauaaaag

SEQ ID NO: 3987236 - RNA, 22 nt, Staphylococcus aureus subsp. aureus Mu50
uuuuaaugggcgauaaaaguug

SEQ ID NO: 3987237 - RNA, 18 nt, Staphylococcus aureus subsp. aureus Mu50
uuuuaauguauucuucua

SEQ ID NO: 3987238 - RNA, 13 nt, Staphylococcus aureus subsp. aureus Mu50
uuuuaauucuauu

SEQ ID NO: 3987239 - RNA, 13 nt, Staphylococcus aureus subsp. aureus Mu50
uuuuaauuguuca

SEQ ID NO: 3987240 - RNA, 19 nt, Staphylococcus aureus subsp. aureus Mu50
uuuuaauuguuuaauaaca

SEQ ID NO: 3987241 - RNA, 16 nt, Staphylococcus aureus subsp. aureus Mu50
uuuuaauuucacuuua

SEQ ID NO: 3987242 - RNA, 23 nt, Staphylococcus aureus subsp. aureus Mu50
uuuuacaaaauauggaauuucau

SEQ ID NO: 3987243 - RNA, 22 nt, Staphylococcus aureus subsp. aureus Mu50
uuuuacaaacuucacaucaugu

SEQ ID NO: 3987244 - RNA, 15 nt, Staphylococcus aureus subsp. aureus Mu50
uuuuacaaagugauu

SEQ ID NO: 3987245 - RNA, 21 nt, Staphylococcus aureus subsp. aureus Mu50
uuuuacaaagugauuuaaaaa

SEQ ID NO: 3987246 - RNA, 16 nt, Staphylococcus aureus subsp. aureus Mu50
uuuuacauuuucaaaa

SEQ ID NO: 3987247 - RNA, 15 nt, Staphylococcus aureus subsp. aureus Mu50
uuuuaccauaaauug

SEQ ID NO: 3987248 - RNA, 19 nt, Staphylococcus aureus subsp. aureus Mu50
uuuuaccauugugaauaau

SEQ ID NO: 3987249 - RNA, 21 nt, Staphylococcus aureus subsp. aureus Mu50
uuuuaccauugugaauaauuu

SEQ ID NO: 3987250 - RNA, 18 nt, Staphylococcus aureus subsp. aureus Mu50
uuuuaccucugauaaaug

SEQ ID NO: 3987251 - RNA, 23 nt, Staphylococcus aureus subsp. aureus Mu50
uuuuaccuucgcauacuuuuuca

SEQ ID NO: 3987252 - RNA, 15 nt, Staphylococcus aureus subsp. aureus Mu50
uuuuaccuuuaauua

SEQ ID NO: 3987253 - RNA, 21 nt, Staphylococcus aureus subsp. aureus Mu50
uuuuacguaaucuaauacaua

SEQ ID NO: 3987254 - RNA, 14 nt, Staphylococcus aureus subsp. aureus Mu50
uuuuacguuuucua

SEQ ID NO: 3987255 - RNA, 15 nt, Staphylococcus aureus subsp. aureus Mu50
uuuuacuaacugaau

SEQ ID NO: 3987256 - RNA, 23 nt, Staphylococcus aureus subsp. aureus Mu50
uuuuacuacugucucaucuucua

SEQ ID NO: 3987257 - RNA, 21 nt, Staphylococcus aureus subsp. aureus Mu50
uuuuacuaggaauauaaaacu

SEQ ID NO: 3987258 - RNA, 19 nt, Staphylococcus aureus subsp. aureus Mu50
uuuuacuauggcauuauug

SEQ ID NO: 3987259 - RNA, 16 nt, Staphylococcus aureus subsp. aureus Mu50
uuuuacugcuucgaca

SEQ ID NO: 3987260 - RNA, 20 nt, Staphylococcus aureus subsp. aureus Mu50
uuuuacuuucaccauuuacu

SEQ ID NO: 3987261 - RNA, 15 nt, Staphylococcus aureus subsp. aureus Mu50
uuuuacuuuuauaau

SEQ ID NO: 3987262 - RNA, 13 nt, Staphylococcus aureus subsp. aureus Mu50
uuuuagaaaagga

SEQ ID NO: 3987263 - RNA, 15 nt, Staphylococcus aureus subsp. aureus Mu50
uuuuagaaucaaaaa

SEQ ID NO: 3987264 - RNA, 20 nt, Staphylococcus aureus subsp. aureus Mu50
uuuuagauuuaguuuuuuua

SEQ ID NO: 3987265 - RNA, 17 nt, Staphylococcus aureus subsp. aureus Mu50
uuuuagcaacaguauuu

SEQ ID NO: 3987266 - RNA, 19 nt, Staphylococcus aureus subsp. aureus Mu50
uuuuagccccagcaaauac

SEQ ID NO: 3987267 - RNA, 22 nt, Staphylococcus aureus subsp. aureus Mu50
uuuuagcuaaacgacauuguuu

SEQ ID NO: 3987268 - RNA, 20 nt, Staphylococcus aureus subsp. aureus Mu50
uuuuaggaugcauauauaua

SEQ ID NO: 3987269 - RNA, 14 nt, Staphylococcus aureus subsp. aureus Mu50
uuuuagguaauaau

SEQ ID NO: 3987270 - RNA, 18 nt, Staphylococcus aureus subsp. aureus Mu50
uuuuagguaauaauucag

SEQ ID NO: 3987271 - RNA, 19 nt, Staphylococcus aureus subsp. aureus Mu50
uuuuagguugaauuucuuu

SEQ ID NO: 3987272 - RNA, 14 nt, Staphylococcus aureus subsp. aureus Mu50
uuuuagugacucag

SEQ ID NO: 3987273 - RNA, 23 nt, Staphylococcus aureus subsp. aureus Mu50
uuuuaguuagaaaguauuuauuu

SEQ ID NO: 3987274 - RNA, 14 nt, Staphylococcus aureus subsp. aureus Mu50
uuuuauaaaucauu

SEQ ID NO: 3987275 - RNA, 12 nt, Staphylococcus aureus subsp. aureus Mu50
uuuuauaaauua

SEQ ID NO: 3987276 - RNA, 13 nt, Staphylococcus aureus subsp. aureus Mu50
uuuuauaaauuuu

SEQ ID NO: 3987277 - RNA, 20 nt, Staphylococcus aureus subsp. aureus Mu50
uuuuauaagaauuuaaaaga

SEQ ID NO: 3987278 - RNA, 15 nt, Staphylococcus aureus subsp. aureus Mu50
uuuuauaauauuauu

SEQ ID NO: 3987279 - RNA, 14 nt, Staphylococcus aureus subsp. aureus Mu50
uuuuauaaucuuuu

SEQ ID NO: 3987280 - RNA, 16 nt, Staphylococcus aureus subsp. aureus Mu50
uuuuauaccaauaauu

SEQ ID NO: 3987281 - RNA, 22 nt, Staphylococcus aureus subsp. aureus Mu50
uuuuauagcaaauugauuaaau

SEQ ID NO: 3987282 - RNA, 13 nt, Staphylococcus aureus subsp. aureus Mu50
uuuuauaguaaua

SEQ ID NO: 3987283 - RNA, 23 nt, Staphylococcus aureus subsp. aureus Mu50
uuuuauaguaauagcuauauuuu

SEQ ID NO: 3987284 - RNA, 19 nt, Staphylococcus aureus subsp. aureus Mu50
uuuuauagugguaaaaagu

SEQ ID NO: 3987285 - RNA, 16 nt, Staphylococcus aureus subsp. aureus Mu50
uuuuauauccaucucc

SEQ ID NO: 3987286 - RNA, 18 nt, Staphylococcus aureus subsp. aureus Mu50
uuuuauaugcaacuuaua

SEQ ID NO: 3987287 - RNA, 21 nt, Staphylococcus aureus subsp. aureus Mu50
uuuuauauucaacuuauuauu

SEQ ID NO: 3987288 - RNA, 21 nt, Staphylococcus aureus subsp. aureus Mu50
uuuuauauuuaaacucucuaa

SEQ ID NO: 3987289 - RNA, 14 nt, Staphylococcus aureus subsp. aureus Mu50
uuuuauauuuauuu

SEQ ID NO: 3987290 - RNA, 13 nt, Staphylococcus aureus subsp. aureus Mu50
uuuuauauuuuua

SEQ ID NO: 3987291 - RNA, 15 nt, Staphylococcus aureus subsp. aureus Mu50
uuuuaucgaaauauu

SEQ ID NO: 3987292 - RNA, 18 nt, Staphylococcus aureus subsp. aureus Mu50
uuuuaucgaaauauuuau

SEQ ID NO: 3987293 - RNA, 16 nt, Staphylococcus aureus subsp. aureus Mu50
uuuuaucuaaacauuu

SEQ ID NO: 3987294 - RNA, 18 nt, Staphylococcus aureus subsp. aureus Mu50
uuuuaucuaaacauuuuu

SEQ ID NO: 3987295 - RNA, 21 nt, Staphylococcus aureus subsp. aureus Mu50
uuuuaucuaucgguaauuuuu

SEQ ID NO: 3987296 - RNA, 17 nt, Staphylococcus aureus subsp. aureus Mu50
uuuuaucugaaaauauc

SEQ ID NO: 3987297 - RNA, 18 nt, Staphylococcus aureus subsp. aureus Mu50
uuuuaucugaaaauauca

SEQ ID NO: 3987298 - RNA, 13 nt, Staphylococcus aureus subsp. aureus Mu50
uuuuaucugaauc

SEQ ID NO: 3987299 - RNA, 14 nt, Staphylococcus aureus subsp. aureus Mu50
uuuuaucugaaucu

SEQ ID NO: 3987300 - RNA, 17 nt, Staphylococcus aureus subsp. aureus Mu50
uuuuaugaauugaguau

SEQ ID NO: 3987301 - RNA, 22 nt, Staphylococcus aureus subsp. aureus Mu50
uuuuaugaauugaguauuaaau

SEQ ID NO: 3987302 - RNA, 20 nt, Staphylococcus aureus subsp. aureus Mu50
uuuuaugagcuucuuuaaau

SEQ ID NO: 3987303 - RNA, 15 nt, Staphylococcus aureus subsp. aureus Mu50
uuuuaugauuuucuu

SEQ ID NO: 3987304 - RNA, 13 nt, Staphylococcus aureus subsp. aureus Mu50
uuuuaugcacaaa

SEQ ID NO: 3987305 - RNA, 23 nt, Staphylococcus aureus subsp. aureus Mu50
uuuuaugcacaaaaaaaucuccu

SEQ ID NO: 3987306 - RNA, 18 nt, Staphylococcus aureus subsp. aureus Mu50
uuuuaugguuuaauuuag

SEQ ID NO: 3987307 - RNA, 15 nt, Staphylococcus aureus subsp. aureus Mu50
uuuugcucuaaacuu

SEQ ID NO: 3987308 - RNA, 16 nt, Staphylococcus aureus subsp. aureus Mu50
uuuuggcgaaccauac

SEQ ID NO: 3987309 - RNA, 17 nt, Staphylococcus aureus subsp. aureus Mu50
uuuuggucaaguaaaug

SEQ ID NO: 3987310 - RNA, 15 nt, Staphylococcus aureus subsp. aureus Mu50
uuuuguaaacauggu

SEQ ID NO: 3987311 - RNA, 18 nt, Staphylococcus aureus subsp. aureus Mu50
uuuuguaagacuucccaa

SEQ ID NO: 3987312 - RNA, 19 nt, Staphylococcus aureus subsp. aureus Mu50
uuuuguaagacuucccaau

SEQ ID NO: 3987313 - RNA, 20 nt, Staphylococcus aureus subsp. aureus Mu50
uuuuguaauuguaaucuauu

SEQ ID NO: 3987314 - RNA, 16 nt, Staphylococcus aureus subsp. aureus Mu50
uuuuguccaauaaauu

SEQ ID NO: 3987315 - RNA, 13 nt, Staphylococcus aureus subsp. aureus Mu50
uuuugucuuuuau

SEQ ID NO: 3987316 - RNA, 15 nt, Staphylococcus aureus subsp. aureus Mu50
uuuugugaauuuauu

SEQ ID NO: 3987317 - RNA, 17 nt, Staphylococcus aureus subsp. aureus Mu50
uuuugugaauuuauuuu

SEQ ID NO: 3987318 - RNA, 13 nt, Staphylococcus aureus subsp. aureus Mu50
uuuuguuaaaaaa

SEQ ID NO: 3987319 - RNA, 15 nt, Staphylococcus aureus subsp. aureus Mu50
uuuuguuaauuuuuu

SEQ ID NO: 3987320 - RNA, 13 nt, Staphylococcus aureus subsp. aureus Mu50
uuuuguucaauca

SEQ ID NO: 3987321 - RNA, 12 nt, Staphylococcus aureus subsp. aureus Mu50
uuuuguugcuca

SEQ ID NO: 3987322 - RNA, 22 nt, Staphylococcus aureus subsp. aureus Mu50
uuuuguugcucagugcauuuuu

SEQ ID NO: 3987323 - RNA, 15 nt, Staphylococcus aureus subsp. aureus Mu50
uuuuguuguacuucc

SEQ ID NO: 3987324 - RNA, 23 nt, Staphylococcus aureus subsp. aureus Mu50
uuuuguuucaaacgugauuuuau

SEQ ID NO: 3987325 - RNA, 16 nt, Staphylococcus aureus subsp. aureus Mu50
uuuuguuuuuauauua

SEQ ID NO: 3987326 - RNA, 17 nt, Staphylococcus aureus subsp. aureus Mu50
uuuuuaaaaaauuuaaa

SEQ ID NO: 3987327 - RNA, 13 nt, Staphylococcus aureus subsp. aureus Mu50
uuuuuaaaauaau

SEQ ID NO: 3987328 - RNA, 14 nt, Staphylococcus aureus subsp. aureus Mu50
uuuuuaaaucuaca

SEQ ID NO: 3987329 - RNA, 17 nt, Staphylococcus aureus subsp. aureus Mu50
uuuuuaaaugauuuaau

SEQ ID NO: 3987330 - RNA, 12 nt, Staphylococcus aureus subsp. aureus Mu50
uuuuuaacaaaa

SEQ ID NO: 3987331 - RNA, 22 nt, Staphylococcus aureus subsp. aureus Mu50
uuuuuaacaaaauauacuaaau

SEQ ID NO: 3987332 - RNA, 18 nt, Staphylococcus aureus subsp. aureus Mu50
uuuuuaacagcuuuuucu

SEQ ID NO: 3987333 - RNA, 19 nt, Staphylococcus aureus subsp. aureus Mu50
uuuuuaacuuuaacaucug

SEQ ID NO: 3987334 - RNA, 23 nt, Staphylococcus aureus subsp. aureus Mu50
uuuuuaacuuuaacaucugaauc

SEQ ID NO: 3987335 - RNA, 14 nt, Staphylococcus aureus subsp. aureus Mu50
uuuuuaauaaugca

SEQ ID NO: 3987336 - RNA, 16 nt, Staphylococcus aureus subsp. aureus Mu50
uuuuuaauauauuuau

SEQ ID NO: 3987337 - RNA, 18 nt, Staphylococcus aureus subsp. aureus Mu50
uuuuuaauguauucuucu

SEQ ID NO: 3987338 - RNA, 13 nt, Staphylococcus aureus subsp. aureus Mu50
uuuuuaaugugua

SEQ ID NO: 3987339 - RNA, 16 nt, Staphylococcus aureus subsp. aureus Mu50
uuuuuaauuauuuccc

SEQ ID NO: 3987340 - RNA, 17 nt, Staphylococcus aureus subsp. aureus Mu50
uuuuuaauuuuaucucc

SEQ ID NO: 3987341 - RNA, 15 nt, Staphylococcus aureus subsp. aureus Mu50
uuuuuaauuuugaca

SEQ ID NO: 3987342 - RNA, 23 nt, Staphylococcus aureus subsp. aureus Mu50
uuuuuaauuuugacauaaaaaau

SEQ ID NO: 3987343 - RNA, 14 nt, Staphylococcus aureus subsp. aureus Mu50
uuuuuacguuuucu

SEQ ID NO: 3987344 - RNA, 15 nt, Staphylococcus aureus subsp. aureus Mu50
uuuuuacuaaaucau

SEQ ID NO: 3987345 - RNA, 23 nt, Staphylococcus aureus subsp. aureus Mu50
uuuuuacuaaaucauuuugccuc

SEQ ID NO: 3987346 - RNA, 19 nt, Staphylococcus aureus subsp. aureus Mu50
uuuuuagacauuaaaaaau

SEQ ID NO: 3987347 - RNA, 18 nt, Staphylococcus aureus subsp. aureus Mu50
uuuuuagccccagcaaau

SEQ ID NO: 3987348 - RNA, 13 nt, Staphylococcus aureus subsp. aureus Mu50
uuuuuaguaguuu

SEQ ID NO: 3987349 - RNA, 22 nt, Staphylococcus aureus subsp. aureus Mu50
uuuuuaguuagaaaguauuuau

SEQ ID NO: 3987350 - RNA, 11 nt, Staphylococcus aureus subsp. aureus Mu50
uuuuuauauua

SEQ ID NO: 3987351 - RNA, 20 nt, Staphylococcus aureus subsp. aureus Mu50
uuuuuaucuguagaaacacu

SEQ ID NO: 3987352 - RNA, 20 nt, Staphylococcus aureus subsp. aureus Mu50
uuuuuaugcacaaaaaaauc

SEQ ID NO: 3987353 - RNA, 20 nt, Staphylococcus aureus subsp. aureus Mu50
uuuuuaugcuuuaaaucgau

SEQ ID NO: 3987354 - RNA, 19 nt, Staphylococcus aureus subsp. aureus Mu50
uuuuuauuaauuaaaaaau

SEQ ID NO: 3987355 - RNA, 17 nt, Staphylococcus aureus subsp. aureus Mu50
uuuuuauuaguauucaa

SEQ ID NO: 3987356 - RNA, 13 nt, Staphylococcus aureus subsp. aureus Mu50
uuuuuauuauaau

SEQ ID NO: 3987357 - RNA, 15 nt, Staphylococcus aureus subsp. aureus Mu50
uuuuuauuauacacu

SEQ ID NO: 3987358 - RNA, 14 nt, Staphylococcus aureus subsp. aureus Mu50
uuuuuauuauuaug

SEQ ID NO: 3987359 - RNA, 22 nt, Staphylococcus aureus subsp. aureus Mu50
uuuuuauuccgaacauguuucu

SEQ ID NO: 3987360 - RNA, 13 nt, Staphylococcus aureus subsp. aureus Mu50
uuuuuauuuacuc

SEQ ID NO: 3987361 - RNA, 18 nt, Staphylococcus aureus subsp. aureus Mu50
uuuuuauuuauacuaaau

SEQ ID NO: 3987362 - RNA, 10 nt, Staphylococcus aureus subsp. aureus Mu50
uuuuuauuuu

SEQ ID NO: 3987363 - RNA, 14 nt, Staphylococcus aureus subsp. aureus Mu50
uuuuucaaauaaua

SEQ ID NO: 3987364 - RNA, 16 nt, Staphylococcus aureus subsp. aureus Mu50
uuuuucaaauauauca

SEQ ID NO: 3987365 - RNA, 19 nt, Staphylococcus aureus subsp. aureus Mu50
uuuuucaauuaaauguuua

SEQ ID NO: 3987366 - RNA, 15 nt, Staphylococcus aureus subsp. aureus Mu50
uuuuucauauucaca

SEQ ID NO: 3987367 - RNA, 16 nt, Staphylococcus aureus subsp. aureus Mu50
uuuuucaucauuaaaa

SEQ ID NO: 3987368 - RNA, 15 nt, Staphylococcus aureus subsp. aureus Mu50
uuuuucccaaucgau

SEQ ID NO: 3987369 - RNA, 13 nt, Staphylococcus aureus subsp. aureus Mu50
uuuuucgcauuaa

SEQ ID NO: 3987370 - RNA, 22 nt, Staphylococcus aureus subsp. aureus Mu50
uuuuucguaacauuuaaaaaau

SEQ ID NO: 3987371 - RNA, 17 nt, Staphylococcus aureus subsp. aureus Mu50
uuuuucguuuuaauaau

SEQ ID NO: 3987372 - RNA, 14 nt, Staphylococcus aureus subsp. aureus Mu50
uuuuucuaaauaaa

SEQ ID NO: 3987373 - RNA, 19 nt, Staphylococcus aureus subsp. aureus Mu50
uuuuucuccuuuguauaag

SEQ ID NO: 3987374 - RNA, 14 nt, Staphylococcus aureus subsp. aureus Mu50
uuuuucuuuuguuu

SEQ ID NO: 3987375 - RNA, 20 nt, Staphylococcus aureus subsp. aureus Mu50
uuuuugaaauuucgacaucu

SEQ ID NO: 3987376 - RNA, 16 nt, Staphylococcus aureus subsp. aureus Mu50
uuuuugaauaucuaau

SEQ ID NO: 3987377 - RNA, 17 nt, Staphylococcus aureus subsp. aureus Mu50
uuuuugaauaucuaaug

SEQ ID NO: 3987378 - RNA, 14 nt, Staphylococcus aureus subsp. aureus Mu50
uuuuugaauuuaau

SEQ ID NO: 3987379 - RNA, 17 nt, Staphylococcus aureus subsp. aureus Mu50
uuuuugagcacuuaaua

SEQ ID NO: 3987380 - RNA, 21 nt, Staphylococcus aureus subsp. aureus Mu50
uuuuugauaguaauaguuaac

SEQ ID NO: 3987381 - RNA, 16 nt, Staphylococcus aureus subsp. aureus Mu50
uuuuugcguuaauaau

SEQ ID NO: 3987382 - RNA, 15 nt, Staphylococcus aureus subsp. aureus Mu50
uuuuuggucaccaaa

SEQ ID NO: 3987383 - RNA, 13 nt, Staphylococcus aureus subsp. aureus Mu50
uuuuugucaguaa

SEQ ID NO: 3987384 - RNA, 14 nt, Staphylococcus aureus subsp. aureus Mu50
uuuuuguugcaauu

SEQ ID NO: 3987385 - RNA, 13 nt, Staphylococcus aureus subsp. aureus Mu50
uuuuuguuuucaa

SEQ ID NO: 3987386 - RNA, 13 nt, Staphylococcus aureus subsp. aureus Mu50
uuuuuuaaaauga

SEQ ID NO: 3987387 - RNA, 13 nt, Staphylococcus aureus subsp. aureus Mu50
uuuuuuaaaguuu

SEQ ID NO: 3987388 - RNA, 12 nt, Staphylococcus aureus subsp. aureus Mu50
uuuuuuaaauac

SEQ ID NO: 3987389 - RNA, 21 nt, Staphylococcus aureus subsp. aureus Mu50
uuuuuuaauuaaguuaaaaua

SEQ ID NO: 3987390 - RNA, 16 nt, Staphylococcus aureus subsp. aureus Mu50
uuuuuuacauucguuu

SEQ ID NO: 3987391 - RNA, 11 nt, Staphylococcus aureus subsp. aureus Mu50
uuuuuuauguu

SEQ ID NO: 3987392 - RNA, 12 nt, Staphylococcus aureus subsp. aureus Mu50
uuuuuuauuaau

SEQ ID NO: 3987393 - RNA, 11 nt, Staphylococcus aureus subsp. aureus Mu50
uuuuuuuaaag

SEQ ID NO: 3987394 - RNA, 23 nt, Staphylococcus aureus subsp. aureus Mu50
uuuuuuuauaaguuaaaaaugua

SEQ ID NO: 3987395 - RNA, 14 nt, Staphylococcus aureus subsp. aureus Mu50
aaaaaaagauuagu

SEQ ID NO: 3987396 - RNA, 15 nt, Staphylococcus aureus subsp. aureus Mu50
aaaaaaccaauaauc

SEQ ID NO: 3987397 - RNA, 13 nt, Staphylococcus aureus subsp. aureus Mu50
aaaaaagauuagu

SEQ ID NO: 3987398 - RNA, 22 nt, Staphylococcus aureus subsp. aureus Mu50
aaaaaagauuaguagccacaau

SEQ ID NO: 3987399 - RNA, 22 nt, Staphylococcus aureus subsp. aureus Mu50
aaaaaaggaugaugugaauguu

SEQ ID NO: 3987400 - RNA, 17 nt, Staphylococcus aureus subsp. aureus Mu50
aaaaaaguugauuaaaa

SEQ ID NO: 3987401 - RNA, 12 nt, Staphylococcus aureus subsp. aureus Mu50
aaaaaauaauag

SEQ ID NO: 3987402 - RNA, 23 nt, Staphylococcus aureus subsp. aureus Mu50
aaaaaauacuaagauuagcuaug

SEQ ID NO: 3987403 - RNA, 18 nt, Staphylococcus aureus subsp. aureus Mu50
aaaaaaucaguuuuuaaa

SEQ ID NO: 3987404 - RNA, 13 nt, Staphylococcus aureus subsp. aureus Mu50
aaaaaaucgaauu

SEQ ID NO: 3987405 - RNA, 14 nt, Staphylococcus aureus subsp. aureus Mu50
aaaaaaugaauguu

SEQ ID NO: 3987406 - RNA, 12 nt, Staphylococcus aureus subsp. aureus Mu50
aaaaaaugaugc

SEQ ID NO: 3987407 - RNA, 16 nt, Staphylococcus aureus subsp. aureus Mu50
aaaaaauuaaaaauuu

SEQ ID NO: 3987408 - RNA, 15 nt, Staphylococcus aureus subsp. aureus Mu50
aaaaaauuaauaauu

SEQ ID NO: 3987409 - RNA, 12 nt, Staphylococcus aureus subsp. aureus Mu50
aaaaaauuauua

SEQ ID NO: 3987410 - RNA, 14 nt, Staphylococcus aureus subsp. aureus Mu50
aaaaaauuauuaaa

SEQ ID NO: 3987411 - RNA, 13 nt, Staphylococcus aureus subsp. aureus Mu50
aaaaaauuguaua

SEQ ID NO: 3987412 - RNA, 12 nt, Staphylococcus aureus subsp. aureus Mu50
aaaaaauuuaaa

SEQ ID NO: 3987413 - RNA, 16 nt, Staphylococcus aureus subsp. aureus Mu50
aaaaaauuuaaauaau

SEQ ID NO: 3987414 - RNA, 12 nt, Staphylococcus aureus subsp. aureus Mu50
aaaaacaaaaaa

SEQ ID NO: 3987415 - RNA, 16 nt, Staphylococcus aureus subsp. aureus Mu50
aaaaacagcaguaaga

SEQ ID NO: 3987416 - RNA, 14 nt, Staphylococcus aureus subsp. aureus Mu50
aaaaacaguuacaa

SEQ ID NO: 3987417 - RNA, 13 nt, Staphylococcus aureus subsp. aureus Mu50
aaaaacauaaaaa

SEQ ID NO: 3987418 - RNA, 16 nt, Staphylococcus aureus subsp. aureus Mu50
aaaacauuauuaagug

SEQ ID NO: 3987419 - RNA, 19 nt, Staphylococcus aureus subsp. aureus Mu50
aaaacauucccuuaauaau

SEQ ID NO: 3987420 - RNA, 13 nt, Staphylococcus aureus subsp. aureus Mu50
aaaaccacgcaca

SEQ ID NO: 3987421 - RNA, 15 nt, Staphylococcus aureus subsp. aureus Mu50
aaaacccaguaucga

SEQ ID NO: 3987422 - RNA, 21 nt, Staphylococcus aureus subsp. aureus Mu50
aaaaccccuguugaacuuuag

SEQ ID NO: 3987423 - RNA, 17 nt, Staphylococcus aureus subsp. aureus Mu50
aaaaccgaacaucugaa

SEQ ID NO: 3987424 - RNA, 18 nt, Staphylococcus aureus subsp. aureus Mu50
aaaaccgaacaucugaaa

SEQ ID NO: 3987425 - RNA, 15 nt, Staphylococcus aureus subsp. aureus Mu50
aaaaccgagaaucuc

SEQ ID NO: 3987426 - RNA, 20 nt, Staphylococcus aureus subsp. aureus Mu50
aaaaccgaggaaauccuuaa

SEQ ID NO: 3987427 - RNA, 21 nt, Staphylococcus aureus subsp. aureus Mu50
aaaaccgcuauaaaauuuuga

SEQ ID NO: 3987428 - RNA, 14 nt, Staphylococcus aureus subsp. aureus Mu50
aaaaccugaaacaa

SEQ ID NO: 3987429 - RNA, 19 nt, Staphylococcus aureus subsp. aureus Mu50
aaaaccuuacccaaaaaau

SEQ ID NO: 3987430 - RNA, 18 nt, Staphylococcus aureus subsp. aureus Mu50
aaaacgacucauuauaaa

SEQ ID NO: 3987431 - RNA, 15 nt, Staphylococcus aureus subsp. aureus Mu50
aaaacgauaauaaua

SEQ ID NO: 3987432 - RNA, 15 nt, Staphylococcus aureus subsp. aureus Mu50
aaaacgauucauuau

SEQ ID NO: 3987433 - RNA, 21 nt, Staphylococcus aureus subsp. aureus Mu50
aaaacgauucauuauaugguu

SEQ ID NO: 3987434 - RNA, 18 nt, Staphylococcus aureus subsp. aureus Mu50
aaaacgugacauuuucaa

SEQ ID NO: 3987435 - RNA, 21 nt, Staphylococcus aureus subsp. aureus Mu50
aaaacgugcaaauaaaaaagu

SEQ ID NO: 3987436 - RNA, 14 nt, Staphylococcus aureus subsp. aureus Mu50
aaaacguucaaucg

SEQ ID NO: 3987437 - RNA, 18 nt, Staphylococcus aureus subsp. aureus Mu50
aaaacguugaguauuacu

SEQ ID NO: 3987438 - RNA, 20 nt, Staphylococcus aureus subsp. aureus Mu50
aaaacuaaucaaauuaguca

SEQ ID NO: 3987439 - RNA, 13 nt, Staphylococcus aureus subsp. aureus Mu50
aaaacuaaugaua

SEQ ID NO: 3987440 - RNA, 14 nt, Staphylococcus aureus subsp. aureus Mu50
aaaacuacauuugg

SEQ ID NO: 3987441 - RNA, 16 nt, Staphylococcus aureus subsp. aureus Mu50
aaaacuacauuugguu

SEQ ID NO: 3987442 - RNA, 16 nt, Staphylococcus aureus subsp. aureus Mu50
aaaacuacugauuuau

SEQ ID NO: 3987443 - RNA, 16 nt, Staphylococcus aureus subsp. aureus Mu50
aaaacuagaacuuagu

SEQ ID NO: 3987444 - RNA, 16 nt, Staphylococcus aureus subsp. aureus Mu50
aaaacuauaauaaaga

SEQ ID NO: 3987445 - RNA, 13 nt, Staphylococcus aureus subsp. aureus Mu50
aaaacuauuuuaa

SEQ ID NO: 3987446 - RNA, 14 nt, Staphylococcus aureus subsp. aureus Mu50
aaaacuauuuuaaa

SEQ ID NO: 3987447 - RNA, 17 nt, Staphylococcus aureus subsp. aureus Mu50
aaaacuguaaaucauca

SEQ ID NO: 3987448 - RNA, 19 nt, Staphylococcus aureus subsp. aureus Mu50
aaaacuuauuugccauaua

SEQ ID NO: 3987449 - RNA, 21 nt, Staphylococcus aureus subsp. aureus Mu50
aaaacuucccuuuggaagcaa

SEQ ID NO: 3987450 - RNA, 17 nt, Staphylococcus aureus subsp. aureus Mu50
aaaacuugcgcaugcuu

SEQ ID NO: 3987451 - RNA, 15 nt, Staphylococcus aureus subsp. aureus Mu50
aaaacuuguaaucau

SEQ ID NO: 3987452 - RNA, 22 nt, Staphylococcus aureus subsp. aureus Mu50
aaaacuuguaaucauaccagca

SEQ ID NO: 3987453 - RNA, 14 nt, Staphylococcus aureus subsp. aureus Mu50
aaaagaaaaauuuu

SEQ ID NO: 3987454 - RNA, 12 nt, Staphylococcus aureus subsp. aureus Mu50
aaaagaaauucu

SEQ ID NO: 3987455 - RNA, 17 nt, Staphylococcus aureus subsp. aureus Mu50
aaaagaaauucuacagg

SEQ ID NO: 3987456 - RNA, 18 nt, Staphylococcus aureus subsp. aureus Mu50
aaaagaauuauucaagua

SEQ ID NO: 3987457 - RNA, 22 nt, Staphylococcus aureus subsp. aureus Mu50
aaaagaauuauucaaguaauau

SEQ ID NO: 3987458 - RNA, 22 nt, Staphylococcus aureus subsp. aureus Mu50
aaaagaauuucgaaaagaaauu

SEQ ID NO: 3987459 - RNA, 13 nt, Staphylococcus aureus subsp. aureus Mu50
aaaagacaaucuc

SEQ ID NO: 3987460 - RNA, 12 nt, Staphylococcus aureus subsp. aureus Mu50
aaaagacagaaa

SEQ ID NO: 3987461 - RNA, 20 nt, Staphylococcus aureus subsp. aureus Mu50
aaaagacuuuccaccauaug

SEQ ID NO: 3987462 - RNA, 12 nt, Staphylococcus aureus subsp. aureus Mu50
aaaagagaccuu

SEQ ID NO: 3987463 - RNA, 18 nt, Staphylococcus aureus subsp. aureus Mu50
aaaagaggcgccacaaca

SEQ ID NO: 3987464 - RNA, 16 nt, Staphylococcus aureus subsp. aureus Mu50
aaaagauauaaacauu

SEQ ID NO: 3987465 - RNA, 14 nt, Staphylococcus aureus subsp. aureus Mu50
aaaagaucgauacu

SEQ ID NO: 3987466 - RNA, 17 nt, Staphylococcus aureus subsp. aureus Mu50
aaaagaucgauacuuuu

SEQ ID NO: 3987467 - RNA, 21 nt, Staphylococcus aureus subsp. aureus Mu50
aaaagauuagaugauauuuaa

SEQ ID NO: 3987468 - RNA, 13 nt, Staphylococcus aureus subsp. aureus Mu50
aaaagauuaguag

SEQ ID NO: 3987469 - RNA, 17 nt, Staphylococcus aureus subsp. aureus Mu50
aaaagauucggaaaaua

SEQ ID NO: 3987470 - RNA, 19 nt, Staphylococcus aureus subsp. aureus Mu50
aaaagauucggaaaauaug

SEQ ID NO: 3987471 - RNA, 20 nt, Staphylococcus aureus subsp. aureus Mu50
aaaagcacuagccguuauuu

SEQ ID NO: 3987472 - RNA, 13 nt, Staphylococcus aureus subsp. aureus Mu50
aaaagcaucuuua

SEQ ID NO: 3987473 - RNA, 18 nt, Staphylococcus aureus subsp. aureus Mu50
aaaagcaugauacucaau

SEQ ID NO: 3987474 - RNA, 23 nt, Staphylococcus aureus subsp. aureus Mu50
aaaagcaugauacucaauaaaau

SEQ ID NO: 3987475 - RNA, 15 nt, Staphylococcus aureus subsp. aureus Mu50
aaaagccaacacauu

SEQ ID NO: 3987476 - RNA, 13 nt, Staphylococcus aureus subsp. aureus Mu50
aaaagccaccuau

SEQ ID NO: 3987477 - RNA, 19 nt, Staphylococcus aureus subsp. aureus Mu50
aaaagccaucuuaccuuua

SEQ ID NO: 3987478 - RNA, 21 nt, Staphylococcus aureus subsp. aureus Mu50
aaaagcccaccuaaaaaguac

SEQ ID NO: 3987479 - RNA, 22 nt, Staphylococcus aureus subsp. aureus Mu50
aaaagccuacuuugucugcaau

SEQ ID NO: 3987480 - RNA, 17 nt, Staphylococcus aureus subsp. aureus Mu50
aaaagcggacugaaaga

SEQ ID NO: 3987481 - RNA, 20 nt, Staphylococcus aureus subsp. aureus Mu50
aaaagcguucaauuuuuguu

SEQ ID NO: 3987482 - RNA, 22 nt, Staphylococcus aureus subsp. aureus Mu50
aaaagcucggcacaccauuuua

SEQ ID NO: 3987483 - RNA, 12 nt, Staphylococcus aureus subsp. aureus Mu50
aaaaggaaaaac

SEQ ID NO: 3987484 - RNA, 14 nt, Staphylococcus aureus subsp. aureus Mu50
aaaaggaaaaacuu

SEQ ID NO: 3987485 - RNA, 21 nt, Staphylococcus aureus subsp. aureus Mu50
aaaaggaugaugugaauguuu

SEQ ID NO: 3987486 - RNA, 16 nt, Staphylococcus aureus subsp. aureus Mu50
aaaaggcucauuuguu

SEQ ID NO: 3987487 - RNA, 13 nt, Staphylococcus aureus subsp. aureus Mu50
aaaagggcaaaaa

SEQ ID NO: 3987488 - RNA, 15 nt, Staphylococcus aureus subsp. aureus Mu50
aaaaggucaaaaaau

SEQ ID NO: 3987489 - RNA, 23 nt, Staphylococcus aureus subsp. aureus Mu50
aaaaggugugggcuuuauuauca

SEQ ID NO: 3987490 - RNA, 22 nt, Staphylococcus aureus subsp. aureus Mu50
aaaaguaaaaucuuuaacauuu

SEQ ID NO: 3987491 - RNA, 20 nt, Staphylococcus aureus subsp. aureus Mu50
aaaaguaacauacuauaaaa

SEQ ID NO: 3987492 - RNA, 14 nt, Staphylococcus aureus subsp. aureus Mu50
aaaaguaaguaaaa

SEQ ID NO: 3987493 - RNA, 17 nt, Staphylococcus aureus subsp. aureus Mu50
aaaaguaaguaaaauaa

SEQ ID NO: 3987494 - RNA, 17 nt, Staphylococcus aureus subsp. aureus Mu50
aaaaguaauuaaauacu

SEQ ID NO: 3987495 - RNA, 24 nt, Staphylococcus aureus subsp. aureus Mu50
aaaaguacuaacccaacgaugaaa

SEQ ID NO: 3987496 - RNA, 13 nt, Staphylococcus aureus subsp. aureus Mu50
aaaaguacuuuaa

SEQ ID NO: 3987497 - RNA, 21 nt, Staphylococcus aureus subsp. aureus Mu50
aaaaguauugccguuauuuuc

SEQ ID NO: 3987498 - RNA, 21 nt, Staphylococcus aureus subsp. aureus Mu50
aaaagucagcuuacaauaaug

SEQ ID NO: 3987499 - RNA, 22 nt, Staphylococcus aureus subsp. aureus Mu50
aaaagucccgcuuaaaaugauu

SEQ ID NO: 3987500 - RNA, 23 nt, Staphylococcus aureus subsp. aureus Mu50
aaaagugaaaguauuagauauau

SEQ ID NO: 3987501 - RNA, 23 nt, Staphylococcus aureus subsp. aureus Mu50
aaaagugcaaguccaaauaauau

SEQ ID NO: 3987502 - RNA, 17 nt, Staphylococcus aureus subsp. aureus Mu50
aaaagugcgauuaucag

SEQ ID NO: 3987503 - RNA, 13 nt, Staphylococcus aureus subsp. aureus Mu50
aaaaguguaaugu

SEQ ID NO: 3987504 - RNA, 20 nt, Staphylococcus aureus subsp. aureus Mu50
aaaaguguuaaugucuucau

SEQ ID NO: 3987505 - RNA, 17 nt, Staphylococcus aureus subsp. aureus Mu50
aaaauguuacacaaauu

SEQ ID NO: 3987506 - RNA, 16 nt, Staphylococcus aureus subsp. aureus Mu50
aaaauguuuaacaaua

SEQ ID NO: 3987507 - RNA, 17 nt, Staphylococcus aureus subsp. aureus Mu50
aaaauguuuaacaauaa

SEQ ID NO: 3987508 - RNA, 17 nt, Staphylococcus aureus subsp. aureus Mu50
aaaauuaaaaaacaaaa

SEQ ID NO: 3987509 - RNA, 14 nt, Staphylococcus aureus subsp. aureus Mu50
aaaauuaaaacagc

SEQ ID NO: 3987510 - RNA, 15 nt, Staphylococcus aureus subsp. aureus Mu50
aaaauuaaauaauga

SEQ ID NO: 3987511 - RNA, 19 nt, Staphylococcus aureus subsp. aureus Mu50
aaaauuaauaauuuuccau

SEQ ID NO: 3987512 - RNA, 22 nt, Staphylococcus aureus subsp. aureus Mu50
aaaauuacuaacguaaagguga

SEQ ID NO: 3987513 - RNA, 22 nt, Staphylococcus aureus subsp. aureus Mu50
aaaauuagccuaauugagagaa

SEQ ID NO: 3987514 - RNA, 17 nt, Staphylococcus aureus subsp. aureus Mu50
aaaauuauacaaauuau

SEQ ID NO: 3987515 - RNA, 18 nt, Staphylococcus aureus subsp. aureus Mu50
aaaauuauauaaauuacc

SEQ ID NO: 3987516 - RNA, 11 nt, Staphylococcus aureus subsp. aureus Mu50
aaaauuauaug

SEQ ID NO: 3987517 - RNA, 12 nt, Staphylococcus aureus subsp. aureus Mu50
aaaauuaucaau

SEQ ID NO: 3987518 - RNA, 12 nt, Staphylococcus aureus subsp. aureus Mu50
aaaauuauuaaa

SEQ ID NO: 3987519 - RNA, 14 nt, Staphylococcus aureus subsp. aureus Mu50
aaaauuauuaaaaa

SEQ ID NO: 3987520 - RNA, 15 nt, Staphylococcus aureus subsp. aureus Mu50
aaaauuauuaaaaaa

SEQ ID NO: 3987521 - RNA, 16 nt, Staphylococcus aureus subsp. aureus Mu50
aaaauuauuaaaaaaa

SEQ ID NO: 3987522 - RNA, 18 nt, Staphylococcus aureus subsp. aureus Mu50
aaaauuauugaauuugaa

SEQ ID NO: 3987523 - RNA, 10 nt, Staphylococcus aureus subsp. aureus Mu50
aaaauuauuu

SEQ ID NO: 3987524 - RNA, 14 nt, Staphylococcus aureus subsp. aureus Mu50
aaaauucaccaacu

SEQ ID NO: 3987525 - RNA, 13 nt, Staphylococcus aureus subsp. aureus Mu50
aaaauucucuuuu

SEQ ID NO: 3987526 - RNA, 13 nt, Staphylococcus aureus subsp. aureus Mu50
aaaauugaacuuu

SEQ ID NO: 3987527 - RNA, 23 nt, Staphylococcus aureus subsp. aureus Mu50
aaaauugaaggaaaauaaaaacc

SEQ ID NO: 3987528 - RNA, 21 nt, Staphylococcus aureus subsp. aureus Mu50
aaaauugauauugcaaaacuu

SEQ ID NO: 3987529 - RNA, 16 nt, Staphylococcus aureus subsp. aureus Mu50
aaaauugcuaaaaaaa

SEQ ID NO: 3987530 - RNA, 17 nt, Staphylococcus aureus subsp. aureus Mu50
aaaauugcuauauuagu

SEQ ID NO: 3987531 - RNA, 18 nt, Staphylococcus aureus subsp. aureus Mu50
aaaauugcuauauuagua

SEQ ID NO: 3987532 - RNA, 15 nt, Staphylococcus aureus subsp. aureus Mu50
aaaauugguuuggau

SEQ ID NO: 3987533 - RNA, 20 nt, Staphylococcus aureus subsp. aureus Mu50
aaaauugguuuggauaaaau

SEQ ID NO: 3987534 - RNA, 22 nt, Staphylococcus aureus subsp. aureus Mu50
aaaauugguuuggauaaaauga

SEQ ID NO: 3987535 - RNA, 17 nt, Staphylococcus aureus subsp. aureus Mu50
aaaauuguaagucgaaa

SEQ ID NO: 3987536 - RNA, 23 nt, Staphylococcus aureus subsp. aureus Mu50
aaaauugugccauuugcaacaau

SEQ ID NO: 3987537 - RNA, 22 nt, Staphylococcus aureus subsp. aureus Mu50
aaaauuguggcuacuaaucuuu

SEQ ID NO: 3987538 - RNA, 17 nt, Staphylococcus aureus subsp. aureus Mu50
aaaauuguucaauauuu

SEQ ID NO: 3987539 - RNA, 15 nt, Staphylococcus aureus subsp. aureus Mu50
aaaauuuacaaaugu

SEQ ID NO: 3987540 - RNA, 19 nt, Staphylococcus aureus subsp. aureus Mu50
aaaauuuacaaauguauaa

SEQ ID NO: 3987541 - RNA, 15 nt, Staphylococcus aureus subsp. aureus Mu50
aaaauuuauucaaau

SEQ ID NO: 3987542 - RNA, 19 nt, Staphylococcus aureus subsp. aureus Mu50
aaaauuucaccgcuuucaa

SEQ ID NO: 3987543 - RNA, 20 nt, Staphylococcus aureus subsp. aureus Mu50
aaaauuucaguaccauguuu

SEQ ID NO: 3987544 - RNA, 18 nt, Staphylococcus aureus subsp. aureus Mu50
aaaauuucccuuuauacu

SEQ ID NO: 3987545 - RNA, 12 nt, Staphylococcus aureus subsp. aureus Mu50
aaaauuucugcu

SEQ ID NO: 3987546 - RNA, 22 nt, Staphylococcus aureus subsp. aureus Mu50
aaaauuugaaauauaccaacca

SEQ ID NO: 3987547 - RNA, 23 nt, Staphylococcus aureus subsp. aureus Mu50
aaaauuuucuugguuugagaauc

SEQ ID NO: 3987548 - RNA, 16 nt, Staphylococcus aureus subsp. aureus Mu50
aaaauuuuuaaaaaaa

SEQ ID NO: 3987549 - RNA, 15 nt, Staphylococcus aureus subsp. aureus Mu50
aaacaaaaaucuacu

SEQ ID NO: 3987550 - RNA, 14 nt, Staphylococcus aureus subsp. aureus Mu50
aaacaaaacaaaaa

SEQ ID NO: 3987551 - RNA, 14 nt, Staphylococcus aureus subsp. aureus Mu50
aaacaaaagaaagu

SEQ ID NO: 3987552 - RNA, 22 nt, Staphylococcus aureus subsp. aureus Mu50
aaacaaaagaucgauacuuuuu

SEQ ID NO: 3987553 - RNA, 21 nt, Staphylococcus aureus subsp. aureus Mu50
aaacaaagcucaauaaauuau

SEQ ID NO: 3987554 - RNA, 12 nt, Staphylococcus aureus subsp. aureus Mu50
aaacaaauuaca

SEQ ID NO: 3987555 - RNA, 13 nt, Staphylococcus aureus subsp. aureus Mu50
aaacaaauuacac

SEQ ID NO: 3987556 - RNA, 15 nt, Staphylococcus aureus subsp. aureus Mu50
aaacaacaaucaaau

SEQ ID NO: 3987557 - RNA, 15 nt, Staphylococcus aureus subsp. aureus Mu50
aaacaacaucgauuu

SEQ ID NO: 3987558 - RNA, 20 nt, Staphylococcus aureus subsp. aureus Mu50
aaacaacaucgauuuaucau

SEQ ID NO: 3987559 - RNA, 16 nt, Staphylococcus aureus subsp. aureus Mu50
aaacaacuucugaaac

SEQ ID NO: 3987560 - RNA, 19 nt, Staphylococcus aureus subsp. aureus Mu50
aaacaagccuuaaaauauu

SEQ ID NO: 3987561 - RNA, 20 nt, Staphylococcus aureus subsp. aureus Mu50
aaacaauaaaaaaccaagug

SEQ ID NO: 3987562 - RNA, 16 nt, Staphylococcus aureus subsp. aureus Mu50
aaacaauaaaauuacu

SEQ ID NO: 3987563 - RNA, 19 nt, Staphylococcus aureus subsp. aureus Mu50
aaacaauaugaauuggaug

SEQ ID NO: 3987564 - RNA, 14 nt, Staphylococcus aureus subsp. aureus Mu50
aaacaaugauggga

SEQ ID NO: 3987565 - RNA, 17 nt, Staphylococcus aureus subsp. aureus Mu50
aaacaauuacaaaauca

SEQ ID NO: 3987566 - RNA, 13 nt, Staphylococcus aureus subsp. aureus Mu50
aaacaauuuaaaa

SEQ ID NO: 3987567 - RNA, 17 nt, Staphylococcus aureus subsp. aureus Mu50
aaacaauuuguaacuau

SEQ ID NO: 3987568 - RNA, 23 nt, Staphylococcus aureus subsp. aureus Mu50
aaacacacuaaaagcugauguga

SEQ ID NO: 3987569 - RNA, 20 nt, Staphylococcus aureus subsp. aureus Mu50
aaacacagacguuuuugaau

SEQ ID NO: 3987570 - RNA, 14 nt, Staphylococcus aureus subsp. aureus Mu50
aaacacaguacaaa

SEQ ID NO: 3987571 - RNA, 16 nt, Staphylococcus aureus subsp. aureus Mu50
aaacacaguacaaaua

SEQ ID NO: 3987572 - RNA, 19 nt, Staphylococcus aureus subsp. aureus Mu50
aaacacccugcuuaucauu

SEQ ID NO: 3987573 - RNA, 15 nt, Staphylococcus aureus subsp. aureus Mu50
aaacacucaaaaugu

SEQ ID NO: 3987574 - RNA, 18 nt, Staphylococcus aureus subsp. aureus Mu50
aaacacucaaaauguuua

SEQ ID NO: 3987575 - RNA, 19 nt, Staphylococcus aureus subsp. aureus Mu50
aaacacuuuuaguuguaac

SEQ ID NO: 3987576 - RNA, 14 nt, Staphylococcus aureus subsp. aureus Mu50
aaacauaacaugac

SEQ ID NO: 3987577 - RNA, 22 nt, Staphylococcus aureus subsp. aureus Mu50
aaacauaguuucuucuauuaua

SEQ ID NO: 3987578 - RNA, 13 nt, Staphylococcus aureus subsp. aureus Mu50
aaacauaucuucu

SEQ ID NO: 3987579 - RNA, 15 nt, Staphylococcus aureus subsp. aureus Mu50
aaacauauucauucu

SEQ ID NO: 3987580 - RNA, 19 nt, Staphylococcus aureus subsp. aureus Mu50
aaacaucguaaagaucauu

SEQ ID NO: 3987581 - RNA, 20 nt, Staphylococcus aureus subsp. aureus Mu50
aaacaucuaaauaguuuuuc

SEQ ID NO: 3987582 - RNA, 15 nt, Staphylococcus aureus subsp. aureus Mu50
aaacaugaacaauca

SEQ ID NO: 3987583 - RNA, 16 nt, Staphylococcus aureus subsp. aureus Mu50
aaacaugaacaaucag

SEQ ID NO: 3987584 - RNA, 21 nt, Staphylococcus aureus subsp. aureus Mu50
aaacauguugauaaaaaggau

SEQ ID NO: 3987585 - RNA, 15 nt, Staphylococcus aureus subsp. aureus Mu50
aaacauuaaaauaau

SEQ ID NO: 3987586 - RNA, 16 nt, Staphylococcus aureus subsp. aureus Mu50
aaacauuaaaauaauu

SEQ ID NO: 3987587 - RNA, 18 nt, Staphylococcus aureus subsp. aureus Mu50
aaacauuaaaauaauuaa

SEQ ID NO: 3987588 - RNA, 18 nt, Staphylococcus aureus subsp. aureus Mu50
aaacauuauuaagugagu

SEQ ID NO: 3987589 - RNA, 19 nt, Staphylococcus aureus subsp. aureus Mu50
aaacauucccuuaauaaua

SEQ ID NO: 3987590 - RNA, 20 nt, Staphylococcus aureus subsp. aureus Mu50
aaacauucccuuaauaauaa

SEQ ID NO: 3987591 - RNA, 21 nt, Staphylococcus aureus subsp. aureus Mu50
aaacauucccuuaauaauaag

SEQ ID NO: 3987592 - RNA, 16 nt, Staphylococcus aureus subsp. aureus Mu50
aaacauuuauauagau

SEQ ID NO: 3987593 - RNA, 12 nt, Staphylococcus aureus subsp. aureus Mu50
aaacuucuuuuc

SEQ ID NO: 3987594 - RNA, 17 nt, Staphylococcus aureus subsp. aureus Mu50
aaacuucuuuucuuuga

SEQ ID NO: 3987595 - RNA, 19 nt, Staphylococcus aureus subsp. aureus Mu50
aaacuucuuuucuuugaua

SEQ ID NO: 3987596 - RNA, 21 nt, Staphylococcus aureus subsp. aureus Mu50
aaacuucuuuucuuugauaac

SEQ ID NO: 3987597 - RNA, 12 nt, Staphylococcus aureus subsp. aureus Mu50
aaacuugauuau

SEQ ID NO: 3987598 - RNA, 22 nt, Staphylococcus aureus subsp. aureus Mu50
aaacuugauuauguaauucuag

SEQ ID NO: 3987599 - RNA, 16 nt, Staphylococcus aureus subsp. aureus Mu50
aaacuuggcaaugaaa

SEQ ID NO: 3987600 - RNA, 19 nt, Staphylococcus aureus subsp. aureus Mu50
aaacuuggcaaugaaauua

SEQ ID NO: 3987601 - RNA, 22 nt, Staphylococcus aureus subsp. aureus Mu50
aaacuuguaaauuuauuuuuaa

SEQ ID NO: 3987602 - RNA, 20 nt, Staphylococcus aureus subsp. aureus Mu50
aaacuuguccguuuuauauu

SEQ ID NO: 3987603 - RNA, 20 nt, Staphylococcus aureus subsp. aureus Mu50
aaacuuuauggguauccuuc

SEQ ID NO: 3987604 - RNA, 17 nt, Staphylococcus aureus subsp. aureus Mu50
aaacuuucagagauauu

SEQ ID NO: 3987605 - RNA, 12 nt, Staphylococcus aureus subsp. aureus Mu50
aaagaaaaguuu

SEQ ID NO: 3987606 - RNA, 17 nt, Staphylococcus aureus subsp. aureus Mu50
aaagaaaauaucugaaa

SEQ ID NO: 3987607 - RNA, 14 nt, Staphylococcus aureus subsp. aureus Mu50
aaagaaacaugauu

SEQ ID NO: 3987608 - RNA, 15 nt, Staphylococcus aureus subsp. aureus Mu50
aaagaaagcuaauau

SEQ ID NO: 3987609 - RNA, 18 nt, Staphylococcus aureus subsp. aureus Mu50
aaagaaagcuaauaucaa

SEQ ID NO: 3987610 - RNA, 14 nt, Staphylococcus aureus subsp. aureus Mu50
aaagaaauaauuua

SEQ ID NO: 3987611 - RNA, 16 nt, Staphylococcus aureus subsp. aureus Mu50
aaagaaauaauuuaaa

SEQ ID NO: 3987612 - RNA, 14 nt, Staphylococcus aureus subsp. aureus Mu50
aaagaaaucaccag

SEQ ID NO: 3987613 - RNA, 14 nt, Staphylococcus aureus subsp. aureus Mu50
aaagaacuaacaua

SEQ ID NO: 3987614 - RNA, 16 nt, Staphylococcus aureus subsp. aureus Mu50
aaagaacuauuuuaaa

SEQ ID NO: 3987615 - RNA, 17 nt, Staphylococcus aureus subsp. aureus Mu50
aaagaauaaauguuaaa

SEQ ID NO: 3987616 - RNA, 12 nt, Staphylococcus aureus subsp. aureus Mu50
aaagaauaugau

SEQ ID NO: 3987617 - RNA, 22 nt, Staphylococcus aureus subsp. aureus Mu50
aaagaauccuuaauugcucuuc

SEQ ID NO: 3987618 - RNA, 16 nt, Staphylococcus aureus subsp. aureus Mu50
aaagaaugauuuauaa

SEQ ID NO: 3987619 - RNA, 16 nt, Staphylococcus aureus subsp. aureus Mu50
aaagaauuauucaagu

SEQ ID NO: 3987620 - RNA, 17 nt, Staphylococcus aureus subsp. aureus Mu50
aaagaauuucgaaaaga

SEQ ID NO: 3987621 - RNA, 18 nt, Staphylococcus aureus subsp. aureus Mu50
aaagaauuucgaaaagaa

SEQ ID NO: 3987622 - RNA, 15 nt, Staphylococcus aureus subsp. aureus Mu50
aaagacaccuucaau

SEQ ID NO: 3987623 - RNA, 13 nt, Staphylococcus aureus subsp. aureus Mu50
aaagacagcagua

SEQ ID NO: 3987624 - RNA, 19 nt, Staphylococcus aureus subsp. aureus Mu50
aaagacauccacagaauua

SEQ ID NO: 3987625 - RNA, 16 nt, Staphylococcus aureus subsp. aureus Mu50
aaagacaugagauuau

SEQ ID NO: 3987626 - RNA, 11 nt, Staphylococcus aureus subsp. aureus Mu50
aaagacauuua

SEQ ID NO: 3987627 - RNA, 13 nt, Staphylococcus aureus subsp. aureus Mu50
aaagaccauugua

SEQ ID NO: 3987628 - RNA, 22 nt, Staphylococcus aureus subsp. aureus Mu50
aaagacgauuuauuaguuuuua

SEQ ID NO: 3987629 - RNA, 15 nt, Staphylococcus aureus subsp. aureus Mu50
aaagacuacaaguca

SEQ ID NO: 3987630 - RNA, 22 nt, Staphylococcus aureus subsp. aureus Mu50
aaagacucaauuucauuugaaa

SEQ ID NO: 3987631 - RNA, 16 nt, Staphylococcus aureus subsp. aureus Mu50
aaagacucauacacaa

SEQ ID NO: 3987632 - RNA, 21 nt, Staphylococcus aureus subsp. aureus Mu50
aaagacugaaccguauaaugc

SEQ ID NO: 3987633 - RNA, 22 nt, Staphylococcus aureus subsp. aureus Mu50
aaagagaaacaaaacaaaaaau

SEQ ID NO: 3987634 - RNA, 23 nt, Staphylococcus aureus subsp. aureus Mu50
aaagagaaucgaaccaaauuuua

SEQ ID NO: 3987635 - RNA, 22 nt, Staphylococcus aureus subsp. aureus Mu50
aaagagauacugguuaguaaaa

SEQ ID NO: 3987636 - RNA, 19 nt, Staphylococcus aureus subsp. aureus Mu50
aaagagccagacgccaaga

SEQ ID NO: 3987637 - RNA, 22 nt, Staphylococcus aureus subsp. aureus Mu50
aaagaggcgccacaacauguuu

SEQ ID NO: 3987638 - RNA, 19 nt, Staphylococcus aureus subsp. aureus Mu50
aaagagguacuagaauuaa

SEQ ID NO: 3987639 - RNA, 14 nt, Staphylococcus aureus subsp. aureus Mu50
aaagauaauauuaa

SEQ ID NO: 3987640 - RNA, 12 nt, Staphylococcus aureus subsp. aureus Mu50
aaagauacugcu

SEQ ID NO: 3987641 - RNA, 19 nt, Staphylococcus aureus subsp. aureus Mu50
aaagauagaaugaauaauu

SEQ ID NO: 3987642 - RNA, 14 nt, Staphylococcus aureus subsp. aureus Mu50
aaagauauaaacau

SEQ ID NO: 3987643 - RNA, 16 nt, Staphylococcus aureus subsp. aureus Mu50
aaagauauaaacauuu

SEQ ID NO: 3987644 - RNA, 14 nt, Staphylococcus aureus subsp. aureus Mu50
aaagauauguuuau

SEQ ID NO: 3987645 - RNA, 21 nt, Staphylococcus aureus subsp. aureus Mu50
aaagauauguuuauauugcaa

SEQ ID NO: 3987646 - RNA, 16 nt, Staphylococcus aureus subsp. aureus Mu50
aaagaucgauacuuuu

SEQ ID NO: 3987647 - RNA, 14 nt, Staphylococcus aureus subsp. aureus Mu50
aaagaugaaaaagu

SEQ ID NO: 3987648 - RNA, 17 nt, Staphylococcus aureus subsp. aureus Mu50
aaagaugauauauucau

SEQ ID NO: 3987649 - RNA, 13 nt, Staphylococcus aureus subsp. aureus Mu50
aaagaugucgaaa

SEQ ID NO: 3987650 - RNA, 22 nt, Staphylococcus aureus subsp. aureus Mu50
aaagaugucgaaaaguauauga

SEQ ID NO: 3987651 - RNA, 12 nt, Staphylococcus aureus subsp. aureus Mu50
aaagauuauuau

SEQ ID NO: 3987652 - RNA, 17 nt, Staphylococcus aureus subsp. aureus Mu50
aaagauuauuauuacaa

SEQ ID NO: 3987653 - RNA, 18 nt, Staphylococcus aureus subsp. aureus Mu50
aaagauuauuauuacaau

SEQ ID NO: 3987654 - RNA, 17 nt, Staphylococcus aureus subsp. aureus Mu50
aaagauucggaaaauau

SEQ ID NO: 3987655 - RNA, 11 nt, Staphylococcus aureus subsp. aureus Mu50
aaagauuucag

SEQ ID NO: 3987656 - RNA, 20 nt, Staphylococcus aureus subsp. aureus Mu50
aaagauuuuguugaacguuu

SEQ ID NO: 3987657 - RNA, 16 nt, Staphylococcus aureus subsp. aureus Mu50
aaagcaaauuauauag

SEQ ID NO: 3987658 - RNA, 13 nt, Staphylococcus aureus subsp. aureus Mu50
aaagcacauguau

SEQ ID NO: 3987659 - RNA, 17 nt, Staphylococcus aureus subsp. aureus Mu50
aaagcaggcaagcuauc

SEQ ID NO: 3987660 - RNA, 17 nt, Staphylococcus aureus subsp. aureus Mu50
aaagcagucgaacaaug

SEQ ID NO: 3987661 - RNA, 22 nt, Staphylococcus aureus subsp. aureus Mu50
aaagcaucuucaauauuuaaau

SEQ ID NO: 3987662 - RNA, 23 nt, Staphylococcus aureus subsp. aureus Mu50
aaagcaucuucaauauuuaaauu

SEQ ID NO: 3987663 - RNA, 12 nt, Staphylococcus aureus subsp. aureus Mu50
aaagcaucuuua

SEQ ID NO: 3987664 - RNA, 22 nt, Staphylococcus aureus subsp. aureus Mu50
aaagcaugauacucaauaaaau

SEQ ID NO: 3987665 - RNA, 15 nt, Staphylococcus aureus subsp. aureus Mu50
aaagcccuaagcucg

SEQ ID NO: 3987666 - RNA, 14 nt, Staphylococcus aureus subsp. aureus Mu50
aaagcgccaauaca

SEQ ID NO: 3987667 - RNA, 16 nt, Staphylococcus aureus subsp. aureus Mu50
aaagcggacugaaaga

SEQ ID NO: 3987668 - RNA, 22 nt, Staphylococcus aureus subsp. aureus Mu50
aaagcguccucuugugaaauua

SEQ ID NO: 3987669 - RNA, 16 nt, Staphylococcus aureus subsp. aureus Mu50
aaagcgugguucccaa

SEQ ID NO: 3987670 - RNA, 17 nt, Staphylococcus aureus subsp. aureus Mu50
aaagcguucaauuuuug

SEQ ID NO: 3987671 - RNA, 14 nt, Staphylococcus aureus subsp. aureus Mu50
aaagcuaaugcaag

SEQ ID NO: 3987672 - RNA, 13 nt, Staphylococcus aureus subsp. aureus Mu50
aaagcuauaaaaa

SEQ ID NO: 3987673 - RNA, 15 nt, Staphylococcus aureus subsp. aureus Mu50
aaagcuauaaaaaau

SEQ ID NO: 3987674 - RNA, 20 nt, Staphylococcus aureus subsp. aureus Mu50
aaagcuauaaaaaaucuuuu

SEQ ID NO: 3987675 - RNA, 23 nt, Staphylococcus aureus subsp. aureus Mu50
aaagcuauauaugaauugaguau

SEQ ID NO: 3987676 - RNA, 23 nt, Staphylococcus aureus subsp. aureus Mu50
aaagcuggggaagaccauuuuau

SEQ ID NO: 3987677 - RNA, 20 nt, Staphylococcus aureus subsp. aureus Mu50
aaagcuguaguuucaacuuu

SEQ ID NO: 3987678 - RNA, 14 nt, Staphylococcus aureus subsp. aureus Mu50
aaagcugucaacuu

SEQ ID NO: 3987679 - RNA, 16 nt, Staphylococcus aureus subsp. aureus Mu50
aaagcuuauuaaauca

SEQ ID NO: 3987680 - RNA, 15 nt, Staphylococcus aureus subsp. aureus Mu50
aaagcuucauauuua

SEQ ID NO: 3987681 - RNA, 13 nt, Staphylococcus aureus subsp. aureus Mu50
aaauaaaaauaca

SEQ ID NO: 3987682 - RNA, 13 nt, Staphylococcus aureus subsp. aureus Mu50
aaauaaaaauuau

SEQ ID NO: 3987683 - RNA, 19 nt, Staphylococcus aureus subsp. aureus Mu50
aaauaaaacgcuucauaua

SEQ ID NO: 3987684 - RNA, 15 nt, Staphylococcus aureus subsp. aureus Mu50
aaauaaaaugcauag

SEQ ID NO: 3987685 - RNA, 12 nt, Staphylococcus aureus subsp. aureus Mu50
aaauaaaaugcu

SEQ ID NO: 3987686 - RNA, 12 nt, Staphylococcus aureus subsp. aureus Mu50
aaauaaaauuuu

SEQ ID NO: 3987687 - RNA, 22 nt, Staphylococcus aureus subsp. aureus Mu50
aaauaaaauuuuuuucauaauu

SEQ ID NO: 3987688 - RNA, 19 nt, Staphylococcus aureus subsp. aureus Mu50
aaauaaacacaucuaugug

SEQ ID NO: 3987689 - RNA, 19 nt, Staphylococcus aureus subsp. aureus Mu50
aaauaaacucaccaaguuc

SEQ ID NO: 3987690 - RNA, 18 nt, Staphylococcus aureus subsp. aureus Mu50
aaauaaagucauaugguu

SEQ ID NO: 3987691 - RNA, 11 nt, Staphylococcus aureus subsp. aureus Mu50
aaauaaauaag

SEQ ID NO: 3987692 - RNA, 14 nt, Staphylococcus aureus subsp. aureus Mu50
aaauaaauauaaaa

SEQ ID NO: 3987693 - RNA, 19 nt, Staphylococcus aureus subsp. aureus Mu50
aaauaaaugacauuuaaua

SEQ ID NO: 3987694 - RNA, 22 nt, Staphylococcus aureus subsp. aureus Mu50
aaauaaauguccgacuugauaa

SEQ ID NO: 3987695 - RNA, 19 nt, Staphylococcus aureus subsp. aureus Mu50
aaauaaauuuuacgaaaau

SEQ ID NO: 3987696 - RNA, 16 nt, Staphylococcus aureus subsp. aureus Mu50
aaauaacaaacauuaa

SEQ ID NO: 3987697 - RNA, 23 nt, Staphylococcus aureus subsp. aureus Mu50
aaauaacguuaauauaauuaauu

SEQ ID NO: 3987698 - RNA, 21 nt, Staphylococcus aureus subsp. aureus Mu50
aaauaacuagauguucacauu

SEQ ID NO: 3987699 - RNA, 19 nt, Staphylococcus aureus subsp. aureus Mu50
aaauaacugcuaauuuuuu

SEQ ID NO: 3987700 - RNA, 18 nt, Staphylococcus aureus subsp. aureus Mu50
aaauaacuguaaaacauu

SEQ ID NO: 3987701 - RNA, 20 nt, Staphylococcus aureus subsp. aureus Mu50
aaauaacuucguuuuaauaa

SEQ ID NO: 3987702 - RNA, 21 nt, Staphylococcus aureus subsp. aureus Mu50
aaauaacuucguuuuaauaaa

SEQ ID NO: 3987703 - RNA, 13 nt, Staphylococcus aureus subsp. aureus Mu50
aaauaagaugaaa

SEQ ID NO: 3987704 - RNA, 14 nt, Staphylococcus aureus subsp. aureus Mu50
aaauaagaugaaau

SEQ ID NO: 3987705 - RNA, 20 nt, Staphylococcus aureus subsp. aureus Mu50
aaauaagaugaaauauucuu

SEQ ID NO: 3987706 - RNA, 16 nt, Staphylococcus aureus subsp. aureus Mu50
aaauaaguaguucagc

SEQ ID NO: 3987707 - RNA, 16 nt, Staphylococcus aureus subsp. aureus Mu50
aaauaagugauaaaua

SEQ ID NO: 3987708 - RNA, 20 nt, Staphylococcus aureus subsp. aureus Mu50
aaauaagugauaaauaaugc

SEQ ID NO: 3987709 - RNA, 22 nt, Staphylococcus aureus subsp. aureus Mu50
aaauaauaacccgaacacaaaa

SEQ ID NO: 3987710 - RNA, 23 nt, Staphylococcus aureus subsp. aureus Mu50
aaauaauaaguugaauauaaaaa

SEQ ID NO: 3987711 - RNA, 21 nt, Staphylococcus aureus subsp. aureus Mu50
aaauaauaauucauaaaugcu

SEQ ID NO: 3987712 - RNA, 17 nt, Staphylococcus aureus subsp. aureus Mu50
aaauaauagauaauagu

SEQ ID NO: 3987713 - RNA, 14 nt, Staphylococcus aureus subsp. aureus Mu50
aaauaauagcaaaa

SEQ ID NO: 3987714 - RNA, 14 nt, Staphylococcus aureus subsp. aureus Mu50
aaauaauauaaaac

SEQ ID NO: 3987715 - RNA, 12 nt, Staphylococcus aureus subsp. aureus Mu50
aaauaauaucuc

SEQ ID NO: 3987716 - RNA, 17 nt, Staphylococcus aureus subsp. aureus Mu50
aaauaaucccaaccauu

SEQ ID NO: 3987717 - RNA, 17 nt, Staphylococcus aureus subsp. aureus Mu50
aaauaaucgaacagaaa

SEQ ID NO: 3987718 - RNA, 19 nt, Staphylococcus aureus subsp. aureus Mu50
aaauaaucgaacagaaaau

SEQ ID NO: 3987719 - RNA, 22 nt, Staphylococcus aureus subsp. aureus Mu50
aaauaaucucuucaauuuauuu

SEQ ID NO: 3987720 - RNA, 23 nt, Staphylococcus aureus subsp. aureus Mu50
aaauaaugauauauuacaccauu

SEQ ID NO: 3987721 - RNA, 21 nt, Staphylococcus aureus subsp. aureus Mu50
aaauaaugaugcauaagauuu

SEQ ID NO: 3987722 - RNA, 17 nt, Staphylococcus aureus subsp. aureus Mu50
aaauaaugucuuacuuu

SEQ ID NO: 3987723 - RNA, 13 nt, Staphylococcus aureus subsp. aureus Mu50
aaauaauuaugaa

SEQ ID NO: 3987724 - RNA, 22 nt, Staphylococcus aureus subsp. aureus Mu50
aaauaauuuaaaggcauaauaa

SEQ ID NO: 3987725 - RNA, 13 nt, Staphylococcus aureus subsp. aureus Mu50
aaauaauuuacau

SEQ ID NO: 3987726 - RNA, 17 nt, Staphylococcus aureus subsp. aureus Mu50
aaauacaaauuacaaua

SEQ ID NO: 3987727 - RNA, 21 nt, Staphylococcus aureus subsp. aureus Mu50
aaauacaacucccuuuuauaa

SEQ ID NO: 3987728 - RNA, 18 nt, Staphylococcus aureus subsp. aureus Mu50
aaauacaaugaauuguua

SEQ ID NO: 3987729 - RNA, 17 nt, Staphylococcus aureus subsp. aureus Mu50
aaauacaauuucuucau

SEQ ID NO: 3987730 - RNA, 20 nt, Staphylococcus aureus subsp. aureus Mu50
aaauacaauuucuucauuuu

SEQ ID NO: 3987731 - RNA, 16 nt, Staphylococcus aureus subsp. aureus Mu50
aaauacauaauaaaaa

SEQ ID NO: 3987732 - RNA, 13 nt, Staphylococcus aureus subsp. aureus Mu50
aaauacauaauca

SEQ ID NO: 3987733 - RNA, 14 nt, Staphylococcus aureus subsp. aureus Mu50
aaauacauaauuaa

SEQ ID NO: 3987734 - RNA, 19 nt, Staphylococcus aureus subsp. aureus Mu50
aaauacauccauacuucua

SEQ ID NO: 3987735 - RNA, 15 nt, Staphylococcus aureus subsp. aureus Mu50
aaauacaucggaauu

SEQ ID NO: 3987736 - RNA, 17 nt, Staphylococcus aureus subsp. aureus Mu50
aaauaccacgacucauu

SEQ ID NO: 3987737 - RNA, 23 nt, Staphylococcus aureus subsp. aureus Mu50
aaauaccacgacucauuagauaa

SEQ ID NO: 3987738 - RNA, 23 nt, Staphylococcus aureus subsp. aureus Mu50
aaauaccagaugaaccaaaaaac

SEQ ID NO: 3987739 - RNA, 15 nt, Staphylococcus aureus subsp. aureus Mu50
aaauacgccaaauau

SEQ ID NO: 3987740 - RNA, 20 nt, Staphylococcus aureus subsp. aureus Mu50
aaauacguaucaagaaaaag

SEQ ID NO: 3987741 - RNA, 15 nt, Staphylococcus aureus subsp. aureus Mu50
aaauacuaacaauua

SEQ ID NO: 3987742 - RNA, 15 nt, Staphylococcus aureus subsp. aureus Mu50
aaauacuaagauuag

SEQ ID NO: 3987743 - RNA, 14 nt, Staphylococcus aureus subsp. aureus Mu50
aaauacuauacuga

SEQ ID NO: 3987744 - RNA, 18 nt, Staphylococcus aureus subsp. aureus Mu50
aaauacuauauauaauga

SEQ ID NO: 3987745 - RNA, 19 nt, Staphylococcus aureus subsp. aureus Mu50
aaauacuauauauaaugaa

SEQ ID NO: 3987746 - RNA, 19 nt, Staphylococcus aureus subsp. aureus Mu50
aaauacucccuucaacaua

SEQ ID NO: 3987747 - RNA, 17 nt, Staphylococcus aureus subsp. aureus Mu50
aaauacuccuuucauac

SEQ ID NO: 3987748 - RNA, 18 nt, Staphylococcus aureus subsp. aureus Mu50
aaauacuugaauuuaaua

SEQ ID NO: 3987749 - RNA, 21 nt, Staphylococcus aureus subsp. aureus Mu50
aaauacuugcucuaauucaau

SEQ ID NO: 3987750 - RNA, 21 nt, Staphylococcus aureus subsp. aureus Mu50
aaauacuuuuugaugauuuac

SEQ ID NO: 3987751 - RNA, 19 nt, Staphylococcus aureus subsp. aureus Mu50
aaauagaaaaauuucaaaa

SEQ ID NO: 3987752 - RNA, 12 nt, Staphylococcus aureus subsp. aureus Mu50
aaauagaaacua

SEQ ID NO: 3987753 - RNA, 18 nt, Staphylococcus aureus subsp. aureus Mu50
aaauagacaccaaaaaac

SEQ ID NO: 3987754 - RNA, 15 nt, Staphylococcus aureus subsp. aureus Mu50
aaauagauaauauau

SEQ ID NO: 3987755 - RNA, 16 nt, Staphylococcus aureus subsp. aureus Mu50
aaauagaugagaaagu

SEQ ID NO: 3987756 - RNA, 20 nt, Staphylococcus aureus subsp. aureus Mu50
aaauagaugagaaaguaaaa

SEQ ID NO: 3987757 - RNA, 13 nt, Staphylococcus aureus subsp. aureus Mu50
aaauagauugaaa

SEQ ID NO: 3987758 - RNA, 19 nt, Staphylococcus aureus subsp. aureus Mu50
aaauagauugaaaaaauaa

SEQ ID NO: 3987759 - RNA, 19 nt, Staphylococcus aureus subsp. aureus Mu50
aaauagauuuagaaacaau

SEQ ID NO: 3987760 - RNA, 22 nt, Staphylococcus aureus subsp. aureus Mu50
aaauagccauauucauauuacu

SEQ ID NO: 3987761 - RNA, 17 nt, Staphylococcus aureus subsp. aureus Mu50
aaauagcguaauuauua

SEQ ID NO: 3987762 - RNA, 20 nt, Staphylococcus aureus subsp. aureus Mu50
aaauagcguaauuauuauaa

SEQ ID NO: 3987763 - RNA, 21 nt, Staphylococcus aureus subsp. aureus Mu50
aaauagcguaauuauuauaau

SEQ ID NO: 3987764 - RNA, 14 nt, Staphylococcus aureus subsp. aureus Mu50
aaauagcuauuaaa

SEQ ID NO: 3987765 - RNA, 15 nt, Staphylococcus aureus subsp. aureus Mu50
aaauagcuauuaaaa

SEQ ID NO: 3987766 - RNA, 17 nt, Staphylococcus aureus subsp. aureus Mu50
aaauagcuauuaaaaua

SEQ ID NO: 3987767 - RNA, 18 nt, Staphylococcus aureus subsp. aureus Mu50
aaauagcuauuaaaauag

SEQ ID NO: 3987768 - RNA, 17 nt, Staphylococcus aureus subsp. aureus Mu50
aaaucaccuuuuuuaac

SEQ ID NO: 3987769 - RNA, 23 nt, Staphylococcus aureus subsp. aureus Mu50
aaaucacgauuuucaaguaauga

SEQ ID NO: 3987770 - RNA, 19 nt, Staphylococcus aureus subsp. aureus Mu50
aaaucacugcuuucaagua

SEQ ID NO: 3987771 - RNA, 22 nt, Staphylococcus aureus subsp. aureus Mu50
aaaucacuugguaaaacaucgu

SEQ ID NO: 3987772 - RNA, 13 nt, Staphylococcus aureus subsp. aureus Mu50
aaaucaguaauau

SEQ ID NO: 3987773 - RNA, 16 nt, Staphylococcus aureus subsp. aureus Mu50
aaaucaguaauaucaa

SEQ ID NO: 3987774 - RNA, 18 nt, Staphylococcus aureus subsp. aureus Mu50
aaaucaguuuuuaaauca

SEQ ID NO: 3987775 - RNA, 23 nt, Staphylococcus aureus subsp. aureus Mu50
aaaucaguuuuuaaaucaaagcu

SEQ ID NO: 3987776 - RNA, 13 nt, Staphylococcus aureus subsp. aureus Mu50
aaaucauaacgac

SEQ ID NO: 3987777 - RNA, 21 nt, Staphylococcus aureus subsp. aureus Mu50
aaaucauacgagaaauuagaa

SEQ ID NO: 3987778 - RNA, 13 nt, Staphylococcus aureus subsp. aureus Mu50
aaaucaucauaac

SEQ ID NO: 3987779 - RNA, 16 nt, Staphylococcus aureus subsp. aureus Mu50
aaaucauccauaaaaa

SEQ ID NO: 3987780 - RNA, 20 nt, Staphylococcus aureus subsp. aureus Mu50
aaaucaucguauuucauaua

SEQ ID NO: 3987781 - RNA, 16 nt, Staphylococcus aureus subsp. aureus Mu50
aaaucaugacauaaaa

SEQ ID NO: 3987782 - RNA, 14 nt, Staphylococcus aureus subsp. aureus Mu50
aaaucauuaauaau

SEQ ID NO: 3987783 - RNA, 15 nt, Staphylococcus aureus subsp. aureus Mu50
aaaucauuaauaauu

SEQ ID NO: 3987784 - RNA, 19 nt, Staphylococcus aureus subsp. aureus Mu50
aaaucauuaauaauuaaac

SEQ ID NO: 3987785 - RNA, 18 nt, Staphylococcus aureus subsp. aureus Mu50
aaaucauucauuugcaaa

SEQ ID NO: 3987786 - RNA, 19 nt, Staphylococcus aureus subsp. aureus Mu50
aaaucauucauuugcaaag

SEQ ID NO: 3987787 - RNA, 14 nt, Staphylococcus aureus subsp. aureus Mu50
aaaucauucuuuau

SEQ ID NO: 3987788 - RNA, 16 nt, Staphylococcus aureus subsp. aureus Mu50
aaauccacacauuaag

SEQ ID NO: 3987789 - RNA, 20 nt, Staphylococcus aureus subsp. aureus Mu50
aaauccguuaaaauuuuaau

SEQ ID NO: 3987790 - RNA, 22 nt, Staphylococcus aureus subsp. aureus Mu50
aaauccuaagcaucguaaaaaa

SEQ ID NO: 3987791 - RNA, 15 nt, Staphylococcus aureus subsp. aureus Mu50
aaauccucaguuaua

SEQ ID NO: 3987792 - RNA, 24 nt, Staphylococcus aureus subsp. aureus Mu50
aaauccucaguuauaccauauuua

SEQ ID NO: 3987793 - RNA, 15 nt, Staphylococcus aureus subsp. aureus Mu50
aaauccuuaaaugga

SEQ ID NO: 3987794 - RNA, 12 nt, Staphylococcus aureus subsp. aureus Mu50
aaauccuuuaua

SEQ ID NO: 3987795 - RNA, 14 nt, Staphylococcus aureus subsp. aureus Mu50
aaaucgaacaaaug

SEQ ID NO: 3987796 - RNA, 16 nt, Staphylococcus aureus subsp. aureus Mu50
aaaucgaauugaugga

SEQ ID NO: 3987797 - RNA, 23 nt, Staphylococcus aureus subsp. aureus Mu50
aaaucgaauugguaaaaaucuca

SEQ ID NO: 3987798 - RNA, 11 nt, Staphylococcus aureus subsp. aureus Mu50
aaaucgauaaa

SEQ ID NO: 3987799 - RNA, 15 nt, Staphylococcus aureus subsp. aureus Mu50
aaaucgauaacaguu

SEQ ID NO: 3987800 - RNA, 15 nt, Staphylococcus aureus subsp. aureus Mu50
aaaucgauacuaaua

SEQ ID NO: 3987801 - RNA, 22 nt, Staphylococcus aureus subsp. aureus Mu50
aaaucgauacuggguuuuacca

SEQ ID NO: 3987802 - RNA, 23 nt, Staphylococcus aureus subsp. aureus Mu50
aaaucgauacuggguuuuaccau

SEQ ID NO: 3987803 - RNA, 14 nt, Staphylococcus aureus subsp. aureus Mu50
aaaucgauuaagaa

SEQ ID NO: 3987804 - RNA, 15 nt, Staphylococcus aureus subsp. aureus Mu50
aaaucgauuaauuau

SEQ ID NO: 3987805 - RNA, 19 nt, Staphylococcus aureus subsp. aureus Mu50
aaaucgcagcaaugacacu

SEQ ID NO: 3987806 - RNA, 16 nt, Staphylococcus aureus subsp. aureus Mu50
aaaucggauuaacauu

SEQ ID NO: 3987807 - RNA, 16 nt, Staphylococcus aureus subsp. aureus Mu50
aaaucggcuauacauu

SEQ ID NO: 3987808 - RNA, 14 nt, Staphylococcus aureus subsp. aureus Mu50
aaaucgguuugauu

SEQ ID NO: 3987809 - RNA, 18 nt, Staphylococcus aureus subsp. aureus Mu50
aaaucgugcccauaugau

SEQ ID NO: 3987810 - RNA, 19 nt, Staphylococcus aureus subsp. aureus Mu50
aaaucgugcccauaugauu

SEQ ID NO: 3987811 - RNA, 22 nt, Staphylococcus aureus subsp. aureus Mu50
aaaucgugcccauaugauuaca

SEQ ID NO: 3987812 - RNA, 15 nt, Staphylococcus aureus subsp. aureus Mu50
aaaucguuauaagua

SEQ ID NO: 3987813 - RNA, 19 nt, Staphylococcus aureus subsp. aureus Mu50
aaaucuaacuggaaaugau

SEQ ID NO: 3987814 - RNA, 23 nt, Staphylococcus aureus subsp. aureus Mu50
aaaucuaauccugguauaaugga

SEQ ID NO: 3987815 - RNA, 12 nt, Staphylococcus aureus subsp. aureus Mu50
aaaucuacaaua

SEQ ID NO: 3987816 - RNA, 16 nt, Staphylococcus aureus subsp. aureus Mu50
aaaucuacaauauuaa

SEQ ID NO: 3987817 - RNA, 18 nt, Staphylococcus aureus subsp. aureus Mu50
aaaucuacaauauuaaaa

SEQ ID NO: 3987818 - RNA, 16 nt, Staphylococcus aureus subsp. aureus Mu50
aaaucuacuacuaauc

SEQ ID NO: 3987819 - RNA, 12 nt, Staphylococcus aureus subsp. aureus Mu50
aaaucuauaaau

SEQ ID NO: 3987820 - RNA, 20 nt, Staphylococcus aureus subsp. aureus Mu50
aaaucuauaaauaucaauaa

SEQ ID NO: 3987821 - RNA, 21 nt, Staphylococcus aureus subsp. aureus Mu50
aaaucuauaccauuccaaaaa

SEQ ID NO: 3987822 - RNA, 13 nt, Staphylococcus aureus subsp. aureus Mu50
aaaucuauauaaa

SEQ ID NO: 3987823 - RNA, 15 nt, Staphylococcus aureus subsp. aureus Mu50
aaaucuauauaaagu

SEQ ID NO: 3987824 - RNA, 14 nt, Staphylococcus aureus subsp. aureus Mu50
aaaucuaucuacuc

SEQ ID NO: 3987825 - RNA, 16 nt, Staphylococcus aureus subsp. aureus Mu50
aaaucuaucuacucaa

SEQ ID NO: 3987826 - RNA, 22 nt, Staphylococcus aureus subsp. aureus Mu50
aaaucuaucuacucaaauauaa

SEQ ID NO: 3987827 - RNA, 13 nt, Staphylococcus aureus subsp. aureus Mu50
aaaucucaaaauu

SEQ ID NO: 3987828 - RNA, 16 nt, Staphylococcus aureus subsp. aureus Mu50
aaaucucauaauaauu

SEQ ID NO: 3987829 - RNA, 22 nt, Staphylococcus aureus subsp. aureus Mu50
aaaucucauaauaauucaguaa

SEQ ID NO: 3987830 - RNA, 13 nt, Staphylococcus aureus subsp. aureus Mu50
aaaucuccucaaa

SEQ ID NO: 3987831 - RNA, 22 nt, Staphylococcus aureus subsp. aureus Mu50
aaaucucgucacauauaaauau

SEQ ID NO: 3987832 - RNA, 20 nt, Staphylococcus aureus subsp. aureus Mu50
aaaucugcuugugugucauu

SEQ ID NO: 3987833 - RNA, 21 nt, Staphylococcus aureus subsp. aureus Mu50
aaaucugcuuuauuuuaucau

SEQ ID NO: 3987834 - RNA, 23 nt, Staphylococcus aureus subsp. aureus Mu50
aaaucuggcacuuaagcuuuaau

SEQ ID NO: 3987835 - RNA, 22 nt, Staphylococcus aureus subsp. aureus Mu50
aaaucuguacuucuaauuugca

SEQ ID NO: 3987836 - RNA, 23 nt, Staphylococcus aureus subsp. aureus Mu50
aaaucuguuuaaauuuaaaagaa

SEQ ID NO: 3987837 - RNA, 13 nt, Staphylococcus aureus subsp. aureus Mu50
aaaucuucuauuu

SEQ ID NO: 3987838 - RNA, 16 nt, Staphylococcus aureus subsp. aureus Mu50
aaaucuucuauuuuca

SEQ ID NO: 3987839 - RNA, 21 nt, Staphylococcus aureus subsp. aureus Mu50
aaaucuuguuggauuuuaaca

SEQ ID NO: 3987840 - RNA, 22 nt, Staphylococcus aureus subsp. aureus Mu50
aaaucuuguuggauuuuaacaa

SEQ ID NO: 3987841 - RNA, 13 nt, Staphylococcus aureus subsp. aureus Mu50
aaaucuuuaaaug

SEQ ID NO: 3987842 - RNA, 16 nt, Staphylococcus aureus subsp. aureus Mu50
aaaucuuuaaauguau

SEQ ID NO: 3987843 - RNA, 19 nt, Staphylococcus aureus subsp. aureus Mu50
aaaucuuuaacauuugucc

SEQ ID NO: 3987844 - RNA, 15 nt, Staphylococcus aureus subsp. aureus Mu50
aaaucuuuuacuaaa

SEQ ID NO: 3987845 - RNA, 21 nt, Staphylococcus aureus subsp. aureus Mu50
aaaucuuuuacuaaaugaauu

SEQ ID NO: 3987846 - RNA, 20 nt, Staphylococcus aureus subsp. aureus Mu50
aaaucuuuuagcuuuuguaa

SEQ ID NO: 3987847 - RNA, 23 nt, Staphylococcus aureus subsp. aureus Mu50
aaaucuuuugagacguuuuccau

SEQ ID NO: 3987848 - RNA, 19 nt, Staphylococcus aureus subsp. aureus Mu50
aaaucuuuuguaagacuuc

SEQ ID NO: 3987849 - RNA, 20 nt, Staphylococcus aureus subsp. aureus Mu50
aaaugaaaauaccucuacau

SEQ ID NO: 3987850 - RNA, 18 nt, Staphylococcus aureus subsp. aureus Mu50
aaaugaagaauacaaaua

SEQ ID NO: 3987851 - RNA, 18 nt, Staphylococcus aureus subsp. aureus Mu50
aaaugaagguguugaaaa

SEQ ID NO: 3987852 - RNA, 14 nt, Staphylococcus aureus subsp. aureus Mu50
aaaugaauauaaua

SEQ ID NO: 3987853 - RNA, 22 nt, Staphylococcus aureus subsp. aureus Mu50
aaaugaaucgcuuugauuacca

SEQ ID NO: 3987854 - RNA, 19 nt, Staphylococcus aureus subsp. aureus Mu50
aaaugaaugaagacgaaua

SEQ ID NO: 3987855 - RNA, 12 nt, Staphylococcus aureus subsp. aureus Mu50
aaauuaaugaac

SEQ ID NO: 3987856 - RNA, 13 nt, Staphylococcus aureus subsp. aureus Mu50
aaauuaauugcuu

SEQ ID NO: 3987857 - RNA, 21 nt, Staphylococcus aureus subsp. aureus Mu50
aaauuacaauaagcgcaauua

SEQ ID NO: 3987858 - RNA, 14 nt, Staphylococcus aureus subsp. aureus Mu50
aaauuacacccuuu

SEQ ID NO: 3987859 - RNA, 19 nt, Staphylococcus aureus subsp. aureus Mu50
aaauuacacccuuuaaauu

SEQ ID NO: 3987860 - RNA, 23 nt, Staphylococcus aureus subsp. aureus Mu50
aaauuacacccuuuaaauuuaac

SEQ ID NO: 3987861 - RNA, 12 nt, Staphylococcus aureus subsp. aureus Mu50
aaauuacuaacg

SEQ ID NO: 3987862 - RNA, 19 nt, Staphylococcus aureus subsp. aureus Mu50
aaauuacuguuaggauaaa

SEQ ID NO: 3987863 - RNA, 22 nt, Staphylococcus aureus subsp. aureus Mu50
aaauuacuugaauauuauucau

SEQ ID NO: 3987864 - RNA, 21 nt, Staphylococcus aureus subsp. aureus Mu50
aaauuagaaccaucauucaua

SEQ ID NO: 3987865 - RNA, 14 nt, Staphylococcus aureus subsp. aureus Mu50
aaauuagaugaaau

SEQ ID NO: 3987866 - RNA, 23 nt, Staphylococcus aureus subsp. aureus Mu50
aaauuagcaagugaguaacauuu

SEQ ID NO: 3987867 - RNA, 22 nt, Staphylococcus aureus subsp. aureus Mu50
aaauuagccgaaaaacaucauu

SEQ ID NO: 3987868 - RNA, 23 nt, Staphylococcus aureus subsp. aureus Mu50
aaauuagccuaauugagagaagu

SEQ ID NO: 3987869 - RNA, 18 nt, Staphylococcus aureus subsp. aureus Mu50
aaauuaggcauucaucua

SEQ ID NO: 3987870 - RNA, 17 nt, Staphylococcus aureus subsp. aureus Mu50
aaauuagggugaacagu

SEQ ID NO: 3987871 - RNA, 15 nt, Staphylococcus aureus subsp. aureus Mu50
aaauuagucauccaa

SEQ ID NO: 3987872 - RNA, 14 nt, Staphylococcus aureus subsp. aureus Mu50
aaauuaguuauacu

SEQ ID NO: 3987873 - RNA, 14 nt, Staphylococcus aureus subsp. aureus Mu50
aaauuaguuugaua

SEQ ID NO: 3987874 - RNA, 12 nt, Staphylococcus aureus subsp. aureus Mu50
aaauuauacaaa

SEQ ID NO: 3987875 - RNA, 20 nt, Staphylococcus aureus subsp. aureus Mu50
aaauuauacaaauuauaaau

SEQ ID NO: 3987876 - RNA, 20 nt, Staphylococcus aureus subsp. aureus Mu50
aaauuauaguacguuugcau

SEQ ID NO: 3987877 - RNA, 12 nt, Staphylococcus aureus subsp. aureus Mu50
aaauuauauaaa

SEQ ID NO: 3987878 - RNA, 12 nt, Staphylococcus aureus subsp. aureus Mu50
aaauuauauuua

SEQ ID NO: 3987879 - RNA, 20 nt, Staphylococcus aureus subsp. aureus Mu50
aaauuaucauuaaauugcuu

SEQ ID NO: 3987880 - RNA, 13 nt, Staphylococcus aureus subsp. aureus Mu50
aaauuaugacuaa

SEQ ID NO: 3987881 - RNA, 22 nt, Staphylococcus aureus subsp. aureus Mu50
aaauuaugauuauauuuucuca

SEQ ID NO: 3987882 - RNA, 16 nt, Staphylococcus aureus subsp. aureus Mu50
aaauuauguaaaaaau

SEQ ID NO: 3987883 - RNA, 17 nt, Staphylococcus aureus subsp. aureus Mu50
aaauuauugaauuugaa

SEQ ID NO: 3987884 - RNA, 19 nt, Staphylococcus aureus subsp. aureus Mu50
aaauuauugaauuugaaua

SEQ ID NO: 3987885 - RNA, 22 nt, Staphylococcus aureus subsp. aureus Mu50
aaauuauuguuuuaauguacuu

SEQ ID NO: 3987886 - RNA, 23 nt, Staphylococcus aureus subsp. aureus Mu50
aaauuauuuauucauuauagucu

SEQ ID NO: 3987887 - RNA, 13 nt, Staphylococcus aureus subsp. aureus Mu50
aaauuauuugaua

SEQ ID NO: 3987888 - RNA, 16 nt, Staphylococcus aureus subsp. aureus Mu50
aaauuauuugauauuu

SEQ ID NO: 3987889 - RNA, 16 nt, Staphylococcus aureus subsp. aureus Mu50
aaauucaacgucauca

SEQ ID NO: 3987890 - RNA, 18 nt, Staphylococcus aureus subsp. aureus Mu50
aaauucaacgucaucaaa

SEQ ID NO: 3987891 - RNA, 15 nt, Staphylococcus aureus subsp. aureus Mu50
aaauucaacuaugaa

SEQ ID NO: 3987892 - RNA, 15 nt, Staphylococcus aureus subsp. aureus Mu50
aaauucaacuuuaau

SEQ ID NO: 3987893 - RNA, 21 nt, Staphylococcus aureus subsp. aureus Mu50
aaauucaacuuuaaucaaaaa

SEQ ID NO: 3987894 - RNA, 14 nt, Staphylococcus aureus subsp. aureus Mu50
aaauucaauauuaa

SEQ ID NO: 3987895 - RNA, 13 nt, Staphylococcus aureus subsp. aureus Mu50
aaauucaguaucu

SEQ ID NO: 3987896 - RNA, 24 nt, Staphylococcus aureus subsp. aureus Mu50
aaauucaucuuaucaagaauauaa

SEQ ID NO: 3987897 - RNA, 11 nt, Staphylococcus aureus subsp. aureus Mu50
aaauucauuug

SEQ ID NO: 3987898 - RNA, 17 nt, Staphylococcus aureus subsp. aureus Mu50
aaauucgaaaagaaauu

SEQ ID NO: 3987899 - RNA, 16 nt, Staphylococcus aureus subsp. aureus Mu50
aaauucgcaagccuuc

SEQ ID NO: 3987900 - RNA, 22 nt, Staphylococcus aureus subsp. aureus Mu50
aaauucgcuugauuaauuuuau

SEQ ID NO: 3987901 - RNA, 18 nt, Staphylococcus aureus subsp. aureus Mu50
aaauucgcuuguaacaag

SEQ ID NO: 3987902 - RNA, 14 nt, Staphylococcus aureus subsp. aureus Mu50
aaauucuacaaaca

SEQ ID NO: 3987903 - RNA, 17 nt, Staphylococcus aureus subsp. aureus Mu50
aaauucuacaggcaaug

SEQ ID NO: 3987904 - RNA, 22 nt, Staphylococcus aureus subsp. aureus Mu50
aaauucuacaggcaaugcgagu

SEQ ID NO: 3987905 - RNA, 22 nt, Staphylococcus aureus subsp. aureus Mu50
aaauucuacagguaaugcaagu

SEQ ID NO: 3987906 - RNA, 20 nt, Staphylococcus aureus subsp. aureus Mu50
aaauucuauaauuuuaauua

SEQ ID NO: 3987907 - RNA, 16 nt, Staphylococcus aureus subsp. aureus Mu50
aaauucuaucuauaaa

SEQ ID NO: 3987908 - RNA, 13 nt, Staphylococcus aureus subsp. aureus Mu50
aaauucucaauua

SEQ ID NO: 3987909 - RNA, 17 nt, Staphylococcus aureus subsp. aureus Mu50
aaauucucaguguuggg

SEQ ID NO: 3987910 - RNA, 22 nt, Staphylococcus aureus subsp. aureus Mu50
aaauucucuaauuucucccguu

SEQ ID NO: 3987911 - RNA, 17 nt, Staphylococcus aureus subsp. aureus Mu50
aaauucuuauaaaauaa

SEQ ID NO: 3987912 - RNA, 13 nt, Staphylococcus aureus subsp. aureus Mu50
aaauucuuuugua

SEQ ID NO: 3987913 - RNA, 14 nt, Staphylococcus aureus subsp. aureus Mu50
aaauucuuuuguaa

SEQ ID NO: 3987914 - RNA, 16 nt, Staphylococcus aureus subsp. aureus Mu50
aaauucuuuuguaauu

SEQ ID NO: 3987915 - RNA, 16 nt, Staphylococcus aureus subsp. aureus Mu50
aaauugaaauguuuau

SEQ ID NO: 3987916 - RNA, 13 nt, Staphylococcus aureus subsp. aureus Mu50
aaauugaaauuau

SEQ ID NO: 3987917 - RNA, 17 nt, Staphylococcus aureus subsp. aureus Mu50
aaauugaacuuauaagu

SEQ ID NO: 3987918 - RNA, 13 nt, Staphylococcus aureus subsp. aureus Mu50
aaauugaacuuug

SEQ ID NO: 3987919 - RNA, 18 nt, Staphylococcus aureus subsp. aureus Mu50
aaauugaacuuuguaucu

SEQ ID NO: 3987920 - RNA, 19 nt, Staphylococcus aureus subsp. aureus Mu50
aaauugaccgacaaaacuu

SEQ ID NO: 3987921 - RNA, 15 nt, Staphylococcus aureus subsp. aureus Mu50
aaauugacgcauuaa

SEQ ID NO: 3987922 - RNA, 19 nt, Staphylococcus aureus subsp. aureus Mu50
aaauugaguauauucaaaa

SEQ ID NO: 3987923 - RNA, 21 nt, Staphylococcus aureus subsp. aureus Mu50
aaauugauauugcaaaacuug

SEQ ID NO: 3987924 - RNA, 12 nt, Staphylococcus aureus subsp. aureus Mu50
aaauugauuaaa

SEQ ID NO: 3987925 - RNA, 15 nt, Staphylococcus aureus subsp. aureus Mu50
aaauugauucuuugg

SEQ ID NO: 3987926 - RNA, 15 nt, Staphylococcus aureus subsp. aureus Mu50
aaauugcaaugcuau

SEQ ID NO: 3987927 - RNA, 17 nt, Staphylococcus aureus subsp. aureus Mu50
aaauugccuuucauuuu

SEQ ID NO: 3987928 - RNA, 20 nt, Staphylococcus aureus subsp. aureus Mu50
aaauugccuuucauuuuagc

SEQ ID NO: 3987929 - RNA, 17 nt, Staphylococcus aureus subsp. aureus Mu50
aaauugcgaauuguuag

SEQ ID NO: 3987930 - RNA, 19 nt, Staphylococcus aureus subsp. aureus Mu50
aaauugcuauauuaguaua

SEQ ID NO: 3987931 - RNA, 16 nt, Staphylococcus aureus subsp. aureus Mu50
aaauuggaauagaugu

SEQ ID NO: 3987932 - RNA, 20 nt, Staphylococcus aureus subsp. aureus Mu50
aaauuggacuuauggguuca

SEQ ID NO: 3987933 - RNA, 19 nt, Staphylococcus aureus subsp. aureus Mu50
aaauuggauaauuucuucu

SEQ ID NO: 3987934 - RNA, 12 nt, Staphylococcus aureus subsp. aureus Mu50
aaauuguaaaac

SEQ ID NO: 3987935 - RNA, 21 nt, Staphylococcus aureus subsp. aureus Mu50
aaauuguaugaauaauauggu

SEQ ID NO: 3987936 - RNA, 21 nt, Staphylococcus aureus subsp. aureus Mu50
aaauuguauuucuuaacaucc

SEQ ID NO: 3987937 - RNA, 23 nt, Staphylococcus aureus subsp. aureus Mu50
aaauuguggagaucuaacaauau

SEQ ID NO: 3987938 - RNA, 20 nt, Staphylococcus aureus subsp. aureus Mu50
aaauuguggcguaguuugaa

SEQ ID NO: 3987939 - RNA, 15 nt, Staphylococcus aureus subsp. aureus Mu50
aaauuguguuucuuu

SEQ ID NO: 3987940 - RNA, 22 nt, Staphylococcus aureus subsp. aureus Mu50
aaauuguguuucuuuuauuuuc

SEQ ID NO: 3987941 - RNA, 20 nt, Staphylococcus aureus subsp. aureus Mu50
aaauuguuuacuauacuuug

SEQ ID NO: 3987942 - RNA, 16 nt, Staphylococcus aureus subsp. aureus Mu50
aaauuuaaaacaauga

SEQ ID NO: 3987943 - RNA, 20 nt, Staphylococcus aureus subsp. aureus Mu50
aacaauaccgcgauaaauaa

SEQ ID NO: 3987944 - RNA, 22 nt, Staphylococcus aureus subsp. aureus Mu50
aacaauacguuuucggauugaa

SEQ ID NO: 3987945 - RNA, 22 nt, Staphylococcus aureus subsp. aureus Mu50
aacaauagguacaacuaaauau

SEQ ID NO: 3987946 - RNA, 20 nt, Staphylococcus aureus subsp. aureus Mu50
aacaauauuaaauuucugaa

SEQ ID NO: 3987947 - RNA, 18 nt, Staphylococcus aureus subsp. aureus Mu50
aacaaucaaagagccaga

SEQ ID NO: 3987948 - RNA, 16 nt, Staphylococcus aureus subsp. aureus Mu50
aacaaucaaauuacaa

SEQ ID NO: 3987949 - RNA, 14 nt, Staphylococcus aureus subsp. aureus Mu50
aacaaucacgauua

SEQ ID NO: 3987950 - RNA, 13 nt, Staphylococcus aureus subsp. aureus Mu50
aacaaucagauaa

SEQ ID NO: 3987951 - RNA, 19 nt, Staphylococcus aureus subsp. aureus Mu50
aacaaucagauaaguuacu

SEQ ID NO: 3987952 - RNA, 15 nt, Staphylococcus aureus subsp. aureus Mu50
aacaaucaguaauaa

SEQ ID NO: 3987953 - RNA, 18 nt, Staphylococcus aureus subsp. aureus Mu50
aacaaucggaagcauauu

SEQ ID NO: 3987954 - RNA, 24 nt, Staphylococcus aureus subsp. aureus Mu50
aacaaucggaagcauauuucuaaa

SEQ ID NO: 3987955 - RNA, 13 nt, Staphylococcus aureus subsp. aureus Mu50
aacaaucuuuuuc

SEQ ID NO: 3987956 - RNA, 15 nt, Staphylococcus aureus subsp. aureus Mu50
aacaaucuuuuucau

SEQ ID NO: 3987957 - RNA, 18 nt, Staphylococcus aureus subsp. aureus Mu50
aacaaugaggauugugua

SEQ ID NO: 3987958 - RNA, 17 nt, Staphylococcus aureus subsp. aureus Mu50
aacaaugauuaaaauua

SEQ ID NO: 3987959 - RNA, 19 nt, Staphylococcus aureus subsp. aureus Mu50
aacaaugcagcuguauuua

SEQ ID NO: 3987960 - RNA, 19 nt, Staphylococcus aureus subsp. aureus Mu50
aacaaugcccguguaacac

SEQ ID NO: 3987961 - RNA, 21 nt, Staphylococcus aureus subsp. aureus Mu50
aacaauuacgacaagaauuaa

SEQ ID NO: 3987962 - RNA, 16 nt, Staphylococcus aureus subsp. aureus Mu50
aacaauucuucaucau

SEQ ID NO: 3987963 - RNA, 17 nt, Staphylococcus aureus subsp. aureus Mu50
aacaauucuucaucaug

SEQ ID NO: 3987964 - RNA, 19 nt, Staphylococcus aureus subsp. aureus Mu50
aacaauugcuaauccauac

SEQ ID NO: 3987965 - RNA, 22 nt, Staphylococcus aureus subsp. aureus Mu50
aacaauuuuaaaucuuuuagcu

SEQ ID NO: 3987966 - RNA, 23 nt, Staphylococcus aureus subsp. aureus Mu50
aacaauuuuauauagacaguagu

SEQ ID NO: 3987967 - RNA, 12 nt, Staphylococcus aureus subsp. aureus Mu50
aacacaaagaau

SEQ ID NO: 3987968 - RNA, 17 nt, Staphylococcus aureus subsp. aureus Mu50
aacacaaggaauauaca

SEQ ID NO: 3987969 - RNA, 17 nt, Staphylococcus aureus subsp. aureus Mu50
aacacacacugauguga

SEQ ID NO: 3987970 - RNA, 23 nt, Staphylococcus aureus subsp. aureus Mu50
aacacaguacaaauaacaaacau

SEQ ID NO: 3987971 - RNA, 16 nt, Staphylococcus aureus subsp. aureus Mu50
aacacauaaauuaagc

SEQ ID NO: 3987972 - RNA, 11 nt, Staphylococcus aureus subsp. aureus Mu50
aacacaucuau

SEQ ID NO: 3987973 - RNA, 21 nt, Staphylococcus aureus subsp. aureus Mu50
aacacaucuauguggcuacuu

SEQ ID NO: 3987974 - RNA, 12 nt, Staphylococcus aureus subsp. aureus Mu50
aacacaugcacu

SEQ ID NO: 3987975 - RNA, 14 nt, Staphylococcus aureus subsp. aureus Mu50
aacacauucaaaua

SEQ ID NO: 3987976 - RNA, 18 nt, Staphylococcus aureus subsp. aureus Mu50
aacacauucuuauuugaa

SEQ ID NO: 3987977 - RNA, 12 nt, Staphylococcus aureus subsp. aureus Mu50
aacaccaauuga

SEQ ID NO: 3987978 - RNA, 15 nt, Staphylococcus aureus subsp. aureus Mu50
aacaccaauugaaau

SEQ ID NO: 3987979 - RNA, 21 nt, Staphylococcus aureus subsp. aureus Mu50
aacaccacacagcauuuucaa

SEQ ID NO: 3987980 - RNA, 22 nt, Staphylococcus aureus subsp. aureus Mu50
aacaccagauaucauaauauug

SEQ ID NO: 3987981 - RNA, 14 nt, Staphylococcus aureus subsp. aureus Mu50
aacaccuaauauuu

SEQ ID NO: 3987982 - RNA, 16 nt, Staphylococcus aureus subsp. aureus Mu50
aacaccuaauauuuua

SEQ ID NO: 3987983 - RNA, 20 nt, Staphylococcus aureus subsp. aureus Mu50
aacacgaacugcauagguaa

SEQ ID NO: 3987984 - RNA, 22 nt, Staphylococcus aureus subsp. aureus Mu50
aacacgacaaucgaauguauug

SEQ ID NO: 3987985 - RNA, 17 nt, Staphylococcus aureus subsp. aureus Mu50
aacacgaugagcgcaua

SEQ ID NO: 3987986 - RNA, 15 nt, Staphylococcus aureus subsp. aureus Mu50
aacacgcucuuuuca

SEQ ID NO: 3987987 - RNA, 16 nt, Staphylococcus aureus subsp. aureus Mu50
aacacgcucuuuucaa

SEQ ID NO: 3987988 - RNA, 21 nt, Staphylococcus aureus subsp. aureus Mu50
aacacggucgccaacaguaau

SEQ ID NO: 3987989 - RNA, 21 nt, Staphylococcus aureus subsp. aureus Mu50
aacacguucuugguauuuuuu

SEQ ID NO: 3987990 - RNA, 22 nt, Staphylococcus aureus subsp. aureus Mu50
aacacguucuugguauuuuuua

SEQ ID NO: 3987991 - RNA, 15 nt, Staphylococcus aureus subsp. aureus Mu50
aacacucaaaauguu

SEQ ID NO: 3987992 - RNA, 22 nt, Staphylococcus aureus subsp. aureus Mu50
aacacucaaaauguuuaacaau

SEQ ID NO: 3987993 - RNA, 18 nt, Staphylococcus aureus subsp. aureus Mu50
aacacugagaauuucuaa

SEQ ID NO: 3987994 - RNA, 22 nt, Staphylococcus aureus subsp. aureus Mu50
aacacugugaaguauugccaaa

SEQ ID NO: 3987995 - RNA, 19 nt, Staphylococcus aureus subsp. aureus Mu50
aacagaaccgaaaauaauc

SEQ ID NO: 3987996 - RNA, 18 nt, Staphylococcus aureus subsp. aureus Mu50
aacagcaguaagauauuu

SEQ ID NO: 3987997 - RNA, 18 nt, Staphylococcus aureus subsp. aureus Mu50
aacagcaguaagauuauu

SEQ ID NO: 3987998 - RNA, 21 nt, Staphylococcus aureus subsp. aureus Mu50
aacagcggaauacagaugaug

SEQ ID NO: 3987999 - RNA, 18 nt, Staphylococcus aureus subsp. aureus Mu50
aacagcgugaauauaagu

SEQ ID NO: 3988000 - RNA, 15 nt, Staphylococcus aureus subsp. aureus Mu50
aacagcuucaaaauc

SEQ ID NO: 3988001 - RNA, 15 nt, Staphylococcus aureus subsp. aureus Mu50
aacagcuuuuucuac

SEQ ID NO: 3988002 - RNA, 16 nt, Staphylococcus aureus subsp. aureus Mu50
aacaguaaucaugcau

SEQ ID NO: 3988003 - RNA, 15 nt, Staphylococcus aureus subsp. aureus Mu50
aacaguuaauaugaa

SEQ ID NO: 3988004 - RNA, 13 nt, Staphylococcus aureus subsp. aureus Mu50
aacaguuagugcu

SEQ ID NO: 3988005 - RNA, 19 nt, Staphylococcus aureus subsp. aureus Mu50
aacaguuuuauuaucuuug

SEQ ID NO: 3988006 - RNA, 13 nt, Staphylococcus aureus subsp. aureus Mu50
aacauaaaaugag

SEQ ID NO: 3988007 - RNA, 12 nt, Staphylococcus aureus subsp. aureus Mu50
aacauaaaauuu

SEQ ID NO: 3988008 - RNA, 11 nt, Staphylococcus aureus subsp. aureus Mu50
aacauaaauaa

SEQ ID NO: 3988009 - RNA, 24 nt, Staphylococcus aureus subsp. aureus Mu50
aacauaacaugaccuaauauauua

SEQ ID NO: 3988010 - RNA, 15 nt, Staphylococcus aureus subsp. aureus Mu50
aacauaacucaaaua

SEQ ID NO: 3988011 - RNA, 15 nt, Staphylococcus aureus subsp. aureus Mu50
aacauaauauuuuga

SEQ ID NO: 3988012 - RNA, 13 nt, Staphylococcus aureus subsp. aureus Mu50
aacauaaugacau

SEQ ID NO: 3988013 - RNA, 13 nt, Staphylococcus aureus subsp. aureus Mu50
aacauaauuuuua

SEQ ID NO: 3988014 - RNA, 19 nt, Staphylococcus aureus subsp. aureus Mu50
aacauaauuuuuauuuaca

SEQ ID NO: 3988015 - RNA, 20 nt, Staphylococcus aureus subsp. aureus Mu50
aacauaccuaauaacgcaua

SEQ ID NO: 3988016 - RNA, 18 nt, Staphylococcus aureus subsp. aureus Mu50
aacauacuauaaaaauuu

SEQ ID NO: 3988017 - RNA, 18 nt, Staphylococcus aureus subsp. aureus Mu50
aacauagacacuuaacuu

SEQ ID NO: 3988018 - RNA, 23 nt, Staphylococcus aureus subsp. aureus Mu50
aacauaguuucuucuauuauauu

SEQ ID NO: 3988019 - RNA, 18 nt, Staphylococcus aureus subsp. aureus Mu50
aacauauaaaaaauuauu

SEQ ID NO: 3988020 - RNA, 14 nt, Staphylococcus aureus subsp. aureus Mu50
aacauauaaaucau

SEQ ID NO: 3988021 - RNA, 15 nt, Staphylococcus aureus subsp. aureus Mu50
aacauauaaaucauu

SEQ ID NO: 3988022 - RNA, 16 nt, Staphylococcus aureus subsp. aureus Mu50
aacauauguacuauua

SEQ ID NO: 3988023 - RNA, 14 nt, Staphylococcus aureus subsp. aureus Mu50
aacauauuacccca

SEQ ID NO: 3988024 - RNA, 16 nt, Staphylococcus aureus subsp. aureus Mu50
aacauauuauaaaagu

SEQ ID NO: 3988025 - RNA, 16 nt, Staphylococcus aureus subsp. aureus Mu50
aacauauuauauauau

SEQ ID NO: 3988026 - RNA, 17 nt, Staphylococcus aureus subsp. aureus Mu50
aacauauucauaauauc

SEQ ID NO: 3988027 - RNA, 18 nt, Staphylococcus aureus subsp. aureus Mu50
aacauauucauaauaucg

SEQ ID NO: 3988028 - RNA, 21 nt, Staphylococcus aureus subsp. aureus Mu50
aacauauuuaucucuuucuuc

SEQ ID NO: 3988029 - RNA, 12 nt, Staphylococcus aureus subsp. aureus Mu50
aacauauuuuaa

SEQ ID NO: 3988030 - RNA, 19 nt, Staphylococcus aureus subsp. aureus Mu50
aacaucaauuacucuuuuu

SEQ ID NO: 3988031 - RNA, 17 nt, Staphylococcus aureus subsp. aureus Mu50
aaccaucucaacuaauc

SEQ ID NO: 3988032 - RNA, 17 nt, Staphylococcus aureus subsp. aureus Mu50
aaccaugauuagcgcac

SEQ ID NO: 3988033 - RNA, 24 nt, Staphylococcus aureus subsp. aureus Mu50
aaccauuccaauuucaaguguauu

SEQ ID NO: 3988034 - RNA, 13 nt, Staphylococcus aureus subsp. aureus Mu50
aaccauucguaau

SEQ ID NO: 3988035 - RNA, 18 nt, Staphylococcus aureus subsp. aureus Mu50
aaccauucguaauaaaca

SEQ ID NO: 3988036 - RNA, 12 nt, Staphylococcus aureus subsp. aureus Mu50
aaccauugaaug

SEQ ID NO: 3988037 - RNA, 14 nt, Staphylococcus aureus subsp. aureus Mu50
aaccauuuaaaaau

SEQ ID NO: 3988038 - RNA, 21 nt, Staphylococcus aureus subsp. aureus Mu50
aaccauuucaucauaauugau

SEQ ID NO: 3988039 - RNA, 17 nt, Staphylococcus aureus subsp. aureus Mu50
aaccauuuuauuuuaac

SEQ ID NO: 3988040 - RNA, 18 nt, Staphylococcus aureus subsp. aureus Mu50
aaccauuuuauuuuaacu

SEQ ID NO: 3988041 - RNA, 13 nt, Staphylococcus aureus subsp. aureus Mu50
aacccaauuaacc

SEQ ID NO: 3988042 - RNA, 14 nt, Staphylococcus aureus subsp. aureus Mu50
aacccacauuaaau

SEQ ID NO: 3988043 - RNA, 15 nt, Staphylococcus aureus subsp. aureus Mu50
aacccacauuaaaua

SEQ ID NO: 3988044 - RNA, 20 nt, Staphylococcus aureus subsp. aureus Mu50
aacccaguaucgauuuaaca

SEQ ID NO: 3988045 - RNA, 18 nt, Staphylococcus aureus subsp. aureus Mu50
aacccauuuucaaaacua

SEQ ID NO: 3988046 - RNA, 12 nt, Staphylococcus aureus subsp. aureus Mu50
aacccuuuaaac

SEQ ID NO: 3988047 - RNA, 15 nt, Staphylococcus aureus subsp. aureus Mu50
aaccgaagcgcagug

SEQ ID NO: 3988048 - RNA, 16 nt, Staphylococcus aureus subsp. aureus Mu50
aaccgacuuguugaua

SEQ ID NO: 3988049 - RNA, 14 nt, Staphylococcus aureus subsp. aureus Mu50
aaccgauuaauaua

SEQ ID NO: 3988050 - RNA, 18 nt, Staphylococcus aureus subsp. aureus Mu50
aaccgauuaauauaauac

SEQ ID NO: 3988051 - RNA, 15 nt, Staphylococcus aureus subsp. aureus Mu50
aaccgcuacaauuau

SEQ ID NO: 3988052 - RNA, 22 nt, Staphylococcus aureus subsp. aureus Mu50
aaccgcuacaauuauaaaugau

SEQ ID NO: 3988053 - RNA, 14 nt, Staphylococcus aureus subsp. aureus Mu50
aaccgcuguuuuuc

SEQ ID NO: 3988054 - RNA, 16 nt, Staphylococcus aureus subsp. aureus Mu50
aaccguaauuuuaaug

SEQ ID NO: 3988055 - RNA, 18 nt, Staphylococcus aureus subsp. aureus Mu50
aaccgucacaaaccauuc

SEQ ID NO: 3988056 - RNA, 17 nt, Staphylococcus aureus subsp. aureus Mu50
aaccguguucuuuaaug

SEQ ID NO: 3988057 - RNA, 16 nt, Staphylococcus aureus subsp. aureus Mu50
aaccguuauauauuau

SEQ ID NO: 3988058 - RNA, 14 nt, Staphylococcus aureus subsp. aureus Mu50
aaccuaaaaacaaa

SEQ ID NO: 3988059 - RNA, 17 nt, Staphylococcus aureus subsp. aureus Mu50
aaccuaaagauaauauu

SEQ ID NO: 3988060 - RNA, 20 nt, Staphylococcus aureus subsp. aureus Mu50
aaccuaaagauaauauuaaa

SEQ ID NO: 3988061 - RNA, 13 nt, Staphylococcus aureus subsp. aureus Mu50
aaccuaaauucca

SEQ ID NO: 3988062 - RNA, 23 nt, Staphylococcus aureus subsp. aureus Mu50
aaccuaaucuaccauguuuugua

SEQ ID NO: 3988063 - RNA, 15 nt, Staphylococcus aureus subsp. aureus Mu50
aaccuacaauauaga

SEQ ID NO: 3988064 - RNA, 16 nt, Staphylococcus aureus subsp. aureus Mu50
aaccuacuaauauauu

SEQ ID NO: 3988065 - RNA, 19 nt, Staphylococcus aureus subsp. aureus Mu50
aaccuauuccuaauaaaua

SEQ ID NO: 3988066 - RNA, 22 nt, Staphylococcus aureus subsp. aureus Mu50
aaccuauuuuuuauaugaugaa

SEQ ID NO: 3988067 - RNA, 18 nt, Staphylococcus aureus subsp. aureus Mu50
aaccucuaaauaaaauua

SEQ ID NO: 3988068 - RNA, 23 nt, Staphylococcus aureus subsp. aureus Mu50
aaccucugauguguuauguuaga

SEQ ID NO: 3988069 - RNA, 20 nt, Staphylococcus aureus subsp. aureus Mu50
aaccucuguuuuguuggugu

SEQ ID NO: 3988070 - RNA, 15 nt, Staphylococcus aureus subsp. aureus Mu50
aaccugucuuaauuc

SEQ ID NO: 3988071 - RNA, 20 nt, Staphylococcus aureus subsp. aureus Mu50
aaccuguucuuuauuuaaag

SEQ ID NO: 3988072 - RNA, 22 nt, Staphylococcus aureus subsp. aureus Mu50
aaccuuuaaaacguuaguacuu

SEQ ID NO: 3988073 - RNA, 17 nt, Staphylococcus aureus subsp. aureus Mu50
aaccuuuaaaaguaaca

SEQ ID NO: 3988074 - RNA, 21 nt, Staphylococcus aureus subsp. aureus Mu50
aaccuuugguuguuaggggcu

SEQ ID NO: 3988075 - RNA, 15 nt, Staphylococcus aureus subsp. aureus Mu50
aaccuuuucaaauua

SEQ ID NO: 3988076 - RNA, 20 nt, Staphylococcus aureus subsp. aureus Mu50
aaccuuuuuguuuucaauaa

SEQ ID NO: 3988077 - RNA, 17 nt, Staphylococcus aureus subsp. aureus Mu50
aacgaaauuguuaucua

SEQ ID NO: 3988078 - RNA, 21 nt, Staphylococcus aureus subsp. aureus Mu50
aacgaagucagucaauucaaa

SEQ ID NO: 3988079 - RNA, 21 nt, Staphylococcus aureus subsp. aureus Mu50
aacgaaucgccuacuauaaau

SEQ ID NO: 3988080 - RNA, 17 nt, Staphylococcus aureus subsp. aureus Mu50
aacgaauguuccuuguu

SEQ ID NO: 3988081 - RNA, 14 nt, Staphylococcus aureus subsp. aureus Mu50
aacgacaacuugaa

SEQ ID NO: 3988082 - RNA, 15 nt, Staphylococcus aureus subsp. aureus Mu50
aacgacacuuuuuag

SEQ ID NO: 3988083 - RNA, 22 nt, Staphylococcus aureus subsp. aureus Mu50
aacgagacaucaucuauuuuua

SEQ ID NO: 3988084 - RNA, 13 nt, Staphylococcus aureus subsp. aureus Mu50
aacgagauuacac

SEQ ID NO: 3988085 - RNA, 24 nt, Staphylococcus aureus subsp. aureus Mu50
aacgagcaguauauaucaaauaca

SEQ ID NO: 3988086 - RNA, 17 nt, Staphylococcus aureus subsp. aureus Mu50
aacgagcuggugagaaa

SEQ ID NO: 3988087 - RNA, 22 nt, Staphylococcus aureus subsp. aureus Mu50
aacgagcuggugagaaauugaa

SEQ ID NO: 3988088 - RNA, 16 nt, Staphylococcus aureus subsp. aureus Mu50
aacgagucauaaauau

SEQ ID NO: 3988089 - RNA, 18 nt, Staphylococcus aureus subsp. aureus Mu50
aacgagucauaaauauaa

SEQ ID NO: 3988090 - RNA, 21 nt, Staphylococcus aureus subsp. aureus Mu50
aacgauaacaauuuauuaaaa

SEQ ID NO: 3988091 - RNA, 17 nt, Staphylococcus aureus subsp. aureus Mu50
aacgauaagaauuaaca

SEQ ID NO: 3988092 - RNA, 15 nt, Staphylococcus aureus subsp. aureus Mu50
aacgauaccaaauau

SEQ ID NO: 3988093 - RNA, 19 nt, Staphylococcus aureus subsp. aureus Mu50
aacgauagacauugagaua

SEQ ID NO: 3988094 - RNA, 23 nt, Staphylococcus aureus subsp. aureus Mu50
aacgauagugguacuauuuuuga

SEQ ID NO: 3988095 - RNA, 14 nt, Staphylococcus aureus subsp. aureus Mu50
aacgaugcuacuua

SEQ ID NO: 3988096 - RNA, 18 nt, Staphylococcus aureus subsp. aureus Mu50
aacgauuguugcaaugau

SEQ ID NO: 3988097 - RNA, 18 nt, Staphylococcus aureus subsp. aureus Mu50
aacgcacuaucaaugaca

SEQ ID NO: 3988098 - RNA, 18 nt, Staphylococcus aureus subsp. aureus Mu50
aacgcacuauuuuuauaa

SEQ ID NO: 3988099 - RNA, 20 nt, Staphylococcus aureus subsp. aureus Mu50
aacgcauauucuauuguugu

SEQ ID NO: 3988100 - RNA, 13 nt, Staphylococcus aureus subsp. aureus Mu50
aacgcauuucaug

SEQ ID NO: 3988101 - RNA, 16 nt, Staphylococcus aureus subsp. aureus Mu50
aacgccucaacacuuu

SEQ ID NO: 3988102 - RNA, 17 nt, Staphylococcus aureus subsp. aureus Mu50
aacgcuugaaaaauuuu

SEQ ID NO: 3988103 - RNA, 17 nt, Staphylococcus aureus subsp. aureus Mu50
aacgcuuuauuacuuua

SEQ ID NO: 3988104 - RNA, 22 nt, Staphylococcus aureus subsp. aureus Mu50
aacgcuuugcagauugauauaa

SEQ ID NO: 3988105 - RNA, 16 nt, Staphylococcus aureus subsp. aureus Mu50
aacggcacauucauac

SEQ ID NO: 3988106 - RNA, 18 nt, Staphylococcus aureus subsp. aureus Mu50
aacgguaaauaaccacuu

SEQ ID NO: 3988107 - RNA, 15 nt, Staphylococcus aureus subsp. aureus Mu50
aacgguaauuucuau

SEQ ID NO: 3988108 - RNA, 14 nt, Staphylococcus aureus subsp. aureus Mu50
aacgguagaauaaa

SEQ ID NO: 3988109 - RNA, 16 nt, Staphylococcus aureus subsp. aureus Mu50
aacgguagaauaaaag

SEQ ID NO: 3988110 - RNA, 19 nt, Staphylococcus aureus subsp. aureus Mu50
aacgguaucaacauauuua

SEQ ID NO: 3988111 - RNA, 16 nt, Staphylococcus aureus subsp. aureus Mu50
aacguaaacaugguuc

SEQ ID NO: 3988112 - RNA, 14 nt, Staphylococcus aureus subsp. aureus Mu50
aacguacaauguau

SEQ ID NO: 3988113 - RNA, 15 nt, Staphylococcus aureus subsp. aureus Mu50
aacguacauuuuuau

SEQ ID NO: 3988114 - RNA, 18 nt, Staphylococcus aureus subsp. aureus Mu50
aacguauauaaguuaaaa

SEQ ID NO: 3988115 - RNA, 15 nt, Staphylococcus aureus subsp. aureus Mu50
aacguaucauuuaaa

SEQ ID NO: 3988116 - RNA, 15 nt, Staphylococcus aureus subsp. aureus Mu50
aacgucaacagcaua

SEQ ID NO: 3988117 - RNA, 22 nt, Staphylococcus aureus subsp. aureus Mu50
aacgucacuuuauuaaauaaca

SEQ ID NO: 3988118 - RNA, 18 nt, Staphylococcus aureus subsp. aureus Mu50
aacgucaucaaaacguuu

SEQ ID NO: 3988119 - RNA, 13 nt, Staphylococcus aureus subsp. aureus Mu50
aacuuacauuaca

SEQ ID NO: 3988120 - RNA, 14 nt, Staphylococcus aureus subsp. aureus Mu50
aacuuacauuacau

SEQ ID NO: 3988121 - RNA, 18 nt, Staphylococcus aureus subsp. aureus Mu50
aacuuacauuacauauau

SEQ ID NO: 3988122 - RNA, 15 nt, Staphylococcus aureus subsp. aureus Mu50
aacuuaccaugauga

SEQ ID NO: 3988123 - RNA, 15 nt, Staphylococcus aureus subsp. aureus Mu50
aacuuagaauuuaca

SEQ ID NO: 3988124 - RNA, 21 nt, Staphylococcus aureus subsp. aureus Mu50
aacuuagcuuagucaauguau

SEQ ID NO: 3988125 - RNA, 23 nt, Staphylococcus aureus subsp. aureus Mu50
aacuuagcuuagucaauguauau

SEQ ID NO: 3988126 - RNA, 17 nt, Staphylococcus aureus subsp. aureus Mu50
aacuuagguuauuauaa

SEQ ID NO: 3988127 - RNA, 20 nt, Staphylococcus aureus subsp. aureus Mu50
aacuuagguuauuauaaaau

SEQ ID NO: 3988128 - RNA, 12 nt, Staphylococcus aureus subsp. aureus Mu50
aacuuauaauau

SEQ ID NO: 3988129 - RNA, 20 nt, Staphylococcus aureus subsp. aureus Mu50
aacuuauauacguugauuaa

SEQ ID NO: 3988130 - RNA, 13 nt, Staphylococcus aureus subsp. aureus Mu50
aacuuauuauuua

SEQ ID NO: 3988131 - RNA, 15 nt, Staphylococcus aureus subsp. aureus Mu50
aacuuauuauuuauc

SEQ ID NO: 3988132 - RNA, 18 nt, Staphylococcus aureus subsp. aureus Mu50
aacuuauucaaacagucc

SEQ ID NO: 3988133 - RNA, 15 nt, Staphylococcus aureus subsp. aureus Mu50
aacuuauuugccaua

SEQ ID NO: 3988134 - RNA, 19 nt, Staphylococcus aureus subsp. aureus Mu50
aacuuauuugccauauaca

SEQ ID NO: 3988135 - RNA, 16 nt, Staphylococcus aureus subsp. aureus Mu50
aacuucauaauauauc

SEQ ID NO: 3988136 - RNA, 19 nt, Staphylococcus aureus subsp. aureus Mu50
aacuucauaauauauccug

SEQ ID NO: 3988137 - RNA, 15 nt, Staphylococcus aureus subsp. aureus Mu50
aacuuccaacauaua

SEQ ID NO: 3988138 - RNA, 17 nt, Staphylococcus aureus subsp. aureus Mu50
aacuuccaacauauaaa

SEQ ID NO: 3988139 - RNA, 18 nt, Staphylococcus aureus subsp. aureus Mu50
aacuuccuaaaauuuaca

SEQ ID NO: 3988140 - RNA, 20 nt, Staphylococcus aureus subsp. aureus Mu50
aacuuccuuuuuauuuuuug

SEQ ID NO: 3988141 - RNA, 17 nt, Staphylococcus aureus subsp. aureus Mu50
aacuucgauaugauuaa

SEQ ID NO: 3988142 - RNA, 14 nt, Staphylococcus aureus subsp. aureus Mu50
aacuucuaacaccu

SEQ ID NO: 3988143 - RNA, 12 nt, Staphylococcus aureus subsp. aureus Mu50
aacuucuacagu

SEQ ID NO: 3988144 - RNA, 13 nt, Staphylococcus aureus subsp. aureus Mu50
aacuucucuuagu

SEQ ID NO: 3988145 - RNA, 16 nt, Staphylococcus aureus subsp. aureus Mu50
aacuucugauucuuca

SEQ ID NO: 3988146 - RNA, 16 nt, Staphylococcus aureus subsp. aureus Mu50
aacuucuuuuguuuua

SEQ ID NO: 3988147 - RNA, 11 nt, Staphylococcus aureus subsp. aureus Mu50
aacuucuuuuu

SEQ ID NO: 3988148 - RNA, 15 nt, Staphylococcus aureus subsp. aureus Mu50
aacuucuuuuuugua

SEQ ID NO: 3988149 - RNA, 17 nt, Staphylococcus aureus subsp. aureus Mu50
aacuugaucauuauaaa

SEQ ID NO: 3988150 - RNA, 20 nt, Staphylococcus aureus subsp. aureus Mu50
aacuugaucauuauaaaaug

SEQ ID NO: 3988151 - RNA, 21 nt, Staphylococcus aureus subsp. aureus Mu50
aacuugaucauuauaaaaugg

SEQ ID NO: 3988152 - RNA, 14 nt, Staphylococcus aureus subsp. aureus Mu50
aacuugauuaugua

SEQ ID NO: 3988153 - RNA, 20 nt, Staphylococcus aureus subsp. aureus Mu50
aacuugauuauguaauucua

SEQ ID NO: 3988154 - RNA, 14 nt, Staphylococcus aureus subsp. aureus Mu50
aacuuggcaaugaa

SEQ ID NO: 3988155 - RNA, 16 nt, Staphylococcus aureus subsp. aureus Mu50
aacuuggcaaugaaau

SEQ ID NO: 3988156 - RNA, 18 nt, Staphylococcus aureus subsp. aureus Mu50
aacuuggcaaugaaauua

SEQ ID NO: 3988157 - RNA, 20 nt, Staphylococcus aureus subsp. aureus Mu50
aacuuggcaaugaaauuacc

SEQ ID NO: 3988158 - RNA, 16 nt, Staphylococcus aureus subsp. aureus Mu50
aacuuggcuuaaucuc

SEQ ID NO: 3988159 - RNA, 20 nt, Staphylococcus aureus subsp. aureus Mu50
aacuuguaaauuuauuuuua

SEQ ID NO: 3988160 - RNA, 16 nt, Staphylococcus aureus subsp. aureus Mu50
aacuuguaauauaaca

SEQ ID NO: 3988161 - RNA, 20 nt, Staphylococcus aureus subsp. aureus Mu50
aacuugugauauauaaccau

SEQ ID NO: 3988162 - RNA, 20 nt, Staphylococcus aureus subsp. aureus Mu50
aacuuguguuauguaugaaa

SEQ ID NO: 3988163 - RNA, 15 nt, Staphylococcus aureus subsp. aureus Mu50
aacuuuaauauaagu

SEQ ID NO: 3988164 - RNA, 16 nt, Staphylococcus aureus subsp. aureus Mu50
aacuuuaauauaagua

SEQ ID NO: 3988165 - RNA, 20 nt, Staphylococcus aureus subsp. aureus Mu50
aacuuuaauauaaguauaau

SEQ ID NO: 3988166 - RNA, 20 nt, Staphylococcus aureus subsp. aureus Mu50
aacuuuaauuaaagcaucuu

SEQ ID NO: 3988167 - RNA, 22 nt, Staphylococcus aureus subsp. aureus Mu50
aacuuuaauuaaagcaucuuca

SEQ ID NO: 3988168 - RNA, 22 nt, Staphylococcus aureus subsp. aureus Mu50
aacuuuaauuuuucauuaauac

SEQ ID NO: 3988169 - RNA, 20 nt, Staphylococcus aureus subsp. aureus Mu50
aacuuuaccaauaucaugca

SEQ ID NO: 3988170 - RNA, 19 nt, Staphylococcus aureus subsp. aureus Mu50
aacuuuaccaccauuuuua

SEQ ID NO: 3988171 - RNA, 16 nt, Staphylococcus aureus subsp. aureus Mu50
aacuuuacgauaaaua

SEQ ID NO: 3988172 - RNA, 16 nt, Staphylococcus aureus subsp. aureus Mu50
aacuuuagacauaaaa

SEQ ID NO: 3988173 - RNA, 17 nt, Staphylococcus aureus subsp. aureus Mu50
aacuuuaguauauucaa

SEQ ID NO: 3988174 - RNA, 18 nt, Staphylococcus aureus subsp. aureus Mu50
aacuuuauauaagucaua

SEQ ID NO: 3988175 - RNA, 21 nt, Staphylococcus aureus subsp. aureus Mu50
aacuuuauauauaaagaaaua

SEQ ID NO: 3988176 - RNA, 23 nt, Staphylococcus aureus subsp. aureus Mu50
aacuuucagcaccagaacaauuc

SEQ ID NO: 3988177 - RNA, 19 nt, Staphylococcus aureus subsp. aureus Mu50
aacuuugucuguauuauua

SEQ ID NO: 3988178 - RNA, 23 nt, Staphylococcus aureus subsp. aureus Mu50
aacuuugucuguauuauuauaau

SEQ ID NO: 3988179 - RNA, 13 nt, Staphylococcus aureus subsp. aureus Mu50
aacuuuuacuuuc

SEQ ID NO: 3988180 - RNA, 13 nt, Staphylococcus aureus subsp. aureus Mu50
aacuuuuauuauc

SEQ ID NO: 3988181 - RNA, 16 nt, Staphylococcus aureus subsp. aureus Mu50
aacuuuuauugccaua

SEQ ID NO: 3988182 - RNA, 15 nt, Staphylococcus aureus subsp. aureus Mu50
aacuuuuauuuuuua

SEQ ID NO: 3988183 - RNA, 22 nt, Staphylococcus aureus subsp. aureus Mu50
aacuuuuuaauaauuguaucgu

SEQ ID NO: 3988184 - RNA, 13 nt, Staphylococcus aureus subsp. aureus Mu50
aacuuuuuuaaca

SEQ ID NO: 3988185 - RNA, 21 nt, Staphylococcus aureus subsp. aureus Mu50
aagaaaaaccugggacauuaa

SEQ ID NO: 3988186 - RNA, 20 nt, Staphylococcus aureus subsp. aureus Mu50
aagaaaaagugauaauuaaa

SEQ ID NO: 3988187 - RNA, 13 nt, Staphylococcus aureus subsp. aureus Mu50
aagaaaauacuaa

SEQ ID NO: 3988188 - RNA, 18 nt, Staphylococcus aureus subsp. aureus Mu50
aagaaaauacuaacaauu

SEQ ID NO: 3988189 - RNA, 14 nt, Staphylococcus aureus subsp. aureus Mu50
aagaaaauuucagu

SEQ ID NO: 3988190 - RNA, 14 nt, Staphylococcus aureus subsp. aureus Mu50
aagaaacauuauau

SEQ ID NO: 3988191 - RNA, 21 nt, Staphylococcus aureus subsp. aureus Mu50
aagaaauacuaauuucuauag

SEQ ID NO: 3988192 - RNA, 20 nt, Staphylococcus aureus subsp. aureus Mu50
aagaaauacuugaauuuaau

SEQ ID NO: 3988193 - RNA, 14 nt, Staphylococcus aureus subsp. aureus Mu50
aagaaaucaacaac

SEQ ID NO: 3988194 - RNA, 16 nt, Staphylococcus aureus subsp. aureus Mu50
aagaaaucaacaacuu

SEQ ID NO: 3988195 - RNA, 18 nt, Staphylococcus aureus subsp. aureus Mu50
aagaaaucaccagauuuu

SEQ ID NO: 3988196 - RNA, 18 nt, Staphylococcus aureus subsp. aureus Mu50
aagaaauguuaaauuaaa

SEQ ID NO: 3988197 - RNA, 20 nt, Staphylococcus aureus subsp. aureus Mu50
aagaaauguuaaauuaaauc

SEQ ID NO: 3988198 - RNA, 21 nt, Staphylococcus aureus subsp. aureus Mu50
aagaaauucgcuugauuaauu

SEQ ID NO: 3988199 - RNA, 19 nt, Staphylococcus aureus subsp. aureus Mu50
aagaaauucuacagguaau

SEQ ID NO: 3988200 - RNA, 12 nt, Staphylococcus aureus subsp. aureus Mu50
aagaaauuuuuu

SEQ ID NO: 3988201 - RNA, 22 nt, Staphylococcus aureus subsp. aureus Mu50
aagaacaguauguggauacaaa

SEQ ID NO: 3988202 - RNA, 17 nt, Staphylococcus aureus subsp. aureus Mu50
aagaacaugauacugaa

SEQ ID NO: 3988203 - RNA, 14 nt, Staphylococcus aureus subsp. aureus Mu50
aagaaccgauauuu

SEQ ID NO: 3988204 - RNA, 18 nt, Staphylococcus aureus subsp. aureus Mu50
aagaaccgauauuucuga

SEQ ID NO: 3988205 - RNA, 17 nt, Staphylococcus aureus subsp. aureus Mu50
aagaacguguuugaaug

SEQ ID NO: 3988206 - RNA, 17 nt, Staphylococcus aureus subsp. aureus Mu50
aagaacuaacauaauuu

SEQ ID NO: 3988207 - RNA, 15 nt, Staphylococcus aureus subsp. aureus Mu50
aagcaaugcaugcuu

SEQ ID NO: 3988208 - RNA, 20 nt, Staphylococcus aureus subsp. aureus Mu50
aagcaauuauggagcggaag

SEQ ID NO: 3988209 - RNA, 17 nt, Staphylococcus aureus subsp. aureus Mu50
aagcacagaaaauuaua

SEQ ID NO: 3988210 - RNA, 19 nt, Staphylococcus aureus subsp. aureus Mu50
aagcacagaaaauuauacu

SEQ ID NO: 3988211 - RNA, 23 nt, Staphylococcus aureus subsp. aureus Mu50
aagcacgugguugguuaccaucu

SEQ ID NO: 3988212 - RNA, 16 nt, Staphylococcus aureus subsp. aureus Mu50
aagcaguuguugguuu

SEQ ID NO: 3988213 - RNA, 17 nt, Staphylococcus aureus subsp. aureus Mu50
aagcauaccuacagaau

SEQ ID NO: 3988214 - RNA, 16 nt, Staphylococcus aureus subsp. aureus Mu50
aagcaucaugaaauua

SEQ ID NO: 3988215 - RNA, 16 nt, Staphylococcus aureus subsp. aureus Mu50
aagcaucgaacaaucg

SEQ ID NO: 3988216 - RNA, 15 nt, Staphylococcus aureus subsp. aureus Mu50
aagcaucgauuuauu

SEQ ID NO: 3988217 - RNA, 17 nt, Staphylococcus aureus subsp. aureus Mu50
aagcaucguaaaaaaca

SEQ ID NO: 3988218 - RNA, 18 nt, Staphylococcus aureus subsp. aureus Mu50
aagcaucguaaaaaacaa

SEQ ID NO: 3988219 - RNA, 19 nt, Staphylococcus aureus subsp. aureus Mu50
aagcaucguaaaaaacaaa

SEQ ID NO: 3988220 - RNA, 18 nt, Staphylococcus aureus subsp. aureus Mu50
aagcaucuucaauauuua

SEQ ID NO: 3988221 - RNA, 21 nt, Staphylococcus aureus subsp. aureus Mu50
aagcaucuucaauauuuaaau

SEQ ID NO: 3988222 - RNA, 14 nt, Staphylococcus aureus subsp. aureus Mu50
aagcauuuuucaau

SEQ ID NO: 3988223 - RNA, 16 nt, Staphylococcus aureus subsp. aureus Mu50
aagccaacacauaaau

SEQ ID NO: 3988224 - RNA, 21 nt, Staphylococcus aureus subsp. aureus Mu50
aagccaagauaaaucaucauu

SEQ ID NO: 3988225 - RNA, 13 nt, Staphylococcus aureus subsp. aureus Mu50
aagccaucaauau

SEQ ID NO: 3988226 - RNA, 18 nt, Staphylococcus aureus subsp. aureus Mu50
aagccaucaauauugaua

SEQ ID NO: 3988227 - RNA, 20 nt, Staphylococcus aureus subsp. aureus Mu50
aagccaucaauauugauauc

SEQ ID NO: 3988228 - RNA, 21 nt, Staphylococcus aureus subsp. aureus Mu50
aagccaucccaacuuaauaac

SEQ ID NO: 3988229 - RNA, 20 nt, Staphylococcus aureus subsp. aureus Mu50
aagcccuuccccuacaaagu

SEQ ID NO: 3988230 - RNA, 14 nt, Staphylococcus aureus subsp. aureus Mu50
aagccuacuuuguc

SEQ ID NO: 3988231 - RNA, 17 nt, Staphylococcus aureus subsp. aureus Mu50
aagccugauguaccacu

SEQ ID NO: 3988232 - RNA, 21 nt, Staphylococcus aureus subsp. aureus Mu50
aagccuuaaaauauuuaacuu

SEQ ID NO: 3988233 - RNA, 20 nt, Staphylococcus aureus subsp. aureus Mu50
aagccuuaauaucaugcaca

SEQ ID NO: 3988234 - RNA, 17 nt, Staphylococcus aureus subsp. aureus Mu50
aagccuucaauaguuuc

SEQ ID NO: 3988235 - RNA, 20 nt, Staphylococcus aureus subsp. aureus Mu50
aagccuucaauaguuucaau

SEQ ID NO: 3988236 - RNA, 14 nt, Staphylococcus aureus subsp. aureus Mu50
aagccuucuauaua

SEQ ID NO: 3988237 - RNA, 20 nt, Staphylococcus aureus subsp. aureus Mu50
aagcgacgauuggaaaguuu

SEQ ID NO: 3988238 - RNA, 19 nt, Staphylococcus aureus subsp. aureus Mu50
aagcgauaaaguaugagug

SEQ ID NO: 3988239 - RNA, 22 nt, Staphylococcus aureus subsp. aureus Mu50
aagcgaucauuagcaauuucau

SEQ ID NO: 3988240 - RNA, 13 nt, Staphylococcus aureus subsp. aureus Mu50
aagcgauuuccau

SEQ ID NO: 3988241 - RNA, 18 nt, Staphylococcus aureus subsp. aureus Mu50
aagcgcaggcgaaccgaa

SEQ ID NO: 3988242 - RNA, 23 nt, Staphylococcus aureus subsp. aureus Mu50
aagcgcaugcuugaacuuuuauu

SEQ ID NO: 3988243 - RNA, 19 nt, Staphylococcus aureus subsp. aureus Mu50
aagcgccugucucauuagc

SEQ ID NO: 3988244 - RNA, 16 nt, Staphylococcus aureus subsp. aureus Mu50
aagcguaugauguugu

SEQ ID NO: 3988245 - RNA, 16 nt, Staphylococcus aureus subsp. aureus Mu50
aagcguccucuuguga

SEQ ID NO: 3988246 - RNA, 18 nt, Staphylococcus aureus subsp. aureus Mu50
aagcgucuuuuuuguaug

SEQ ID NO: 3988247 - RNA, 23 nt, Staphylococcus aureus subsp. aureus Mu50
aagcgucuuuuuuguaugaguuc

SEQ ID NO: 3988248 - RNA, 15 nt, Staphylococcus aureus subsp. aureus Mu50
aagcguucaauuuuu

SEQ ID NO: 3988249 - RNA, 21 nt, Staphylococcus aureus subsp. aureus Mu50
aagcguucgugauagaaguuu

SEQ ID NO: 3988250 - RNA, 20 nt, Staphylococcus aureus subsp. aureus Mu50
aagcguucucuaauuucaca

SEQ ID NO: 3988251 - RNA, 15 nt, Staphylococcus aureus subsp. aureus Mu50
aagcuaaagaguuau

SEQ ID NO: 3988252 - RNA, 20 nt, Staphylococcus aureus subsp. aureus Mu50
aagcuaaauguuaaugcuuc

SEQ ID NO: 3988253 - RNA, 16 nt, Staphylococcus aureus subsp. aureus Mu50
aagcuaaguuugaagg

SEQ ID NO: 3988254 - RNA, 18 nt, Staphylococcus aureus subsp. aureus Mu50
aagcuaauaucaauaaug

SEQ ID NO: 3988255 - RNA, 14 nt, Staphylococcus aureus subsp. aureus Mu50
aagcuaauucauau

SEQ ID NO: 3988256 - RNA, 17 nt, Staphylococcus aureus subsp. aureus Mu50
aagcuaauucauauuca

SEQ ID NO: 3988257 - RNA, 14 nt, Staphylococcus aureus subsp. aureus Mu50
aagcuauaaaaaau

SEQ ID NO: 3988258 - RNA, 21 nt, Staphylococcus aureus subsp. aureus Mu50
aagcuauaaaaaaucuuuuga

SEQ ID NO: 3988259 - RNA, 13 nt, Staphylococcus aureus subsp. aureus Mu50
aagcuauacucau

SEQ ID NO: 3988260 - RNA, 16 nt, Staphylococcus aureus subsp. aureus Mu50
aagcuauauaugaauu

SEQ ID NO: 3988261 - RNA, 17 nt, Staphylococcus aureus subsp. aureus Mu50
aagcuaucguaaacaac

SEQ ID NO: 3988262 - RNA, 18 nt, Staphylococcus aureus subsp. aureus Mu50
aagcuaucguaaacaaca

SEQ ID NO: 3988263 - RNA, 19 nt, Staphylococcus aureus subsp. aureus Mu50
aagcuaucguuuauugaua

SEQ ID NO: 3988264 - RNA, 15 nt, Staphylococcus aureus subsp. aureus Mu50
aagcucaugaaucag

SEQ ID NO: 3988265 - RNA, 20 nt, Staphylococcus aureus subsp. aureus Mu50
aagcucaugaaucagaugau

SEQ ID NO: 3988266 - RNA, 22 nt, Staphylococcus aureus subsp. aureus Mu50
aagcucaugaaucagaugauuu

SEQ ID NO: 3988267 - RNA, 19 nt, Staphylococcus aureus subsp. aureus Mu50
aagcugacgaaaagucagc

SEQ ID NO: 3988268 - RNA, 13 nt, Staphylococcus aureus subsp. aureus Mu50
aagcugauuaaaa

SEQ ID NO: 3988269 - RNA, 21 nt, Staphylococcus aureus subsp. aureus Mu50
aagcugauuucuaucaaauaa

SEQ ID NO: 3988270 - RNA, 20 nt, Staphylococcus aureus subsp. aureus Mu50
aagcugcgauauaacuaaaa

SEQ ID NO: 3988271 - RNA, 14 nt, Staphylococcus aureus subsp. aureus Mu50
aagcugucauaccu

SEQ ID NO: 3988272 - RNA, 17 nt, Staphylococcus aureus subsp. aureus Mu50
aagcugucuuacugcug

SEQ ID NO: 3988273 - RNA, 23 nt, Staphylococcus aureus subsp. aureus Mu50
aagcugucuuacugcuguuuuua

SEQ ID NO: 3988274 - RNA, 23 nt, Staphylococcus aureus subsp. aureus Mu50
aagcugugcugucauuuucugcu

SEQ ID NO: 3988275 - RNA, 21 nt, Staphylococcus aureus subsp. aureus Mu50
aagcuucauuucccuuaaauc

SEQ ID NO: 3988276 - RNA, 20 nt, Staphylococcus aureus subsp. aureus Mu50
aagcuucuguguuggggccc

SEQ ID NO: 3988277 - RNA, 15 nt, Staphylococcus aureus subsp. aureus Mu50
aagcuugcuguucaa

SEQ ID NO: 3988278 - RNA, 23 nt, Staphylococcus aureus subsp. aureus Mu50
aagcuuuuacgccuucuuuauaa

SEQ ID NO: 3988279 - RNA, 21 nt, Staphylococcus aureus subsp. aureus Mu50
aagcuuuuuugcuuuuauaau

SEQ ID NO: 3988280 - RNA, 14 nt, Staphylococcus aureus subsp. aureus Mu50
aaggaaauggcucc

SEQ ID NO: 3988281 - RNA, 22 nt, Staphylococcus aureus subsp. aureus Mu50
aaggaaauggcuccauuuaauu

SEQ ID NO: 3988282 - RNA, 22 nt, Staphylococcus aureus subsp. aureus Mu50
aaggaacguguucuaaaaguug

SEQ ID NO: 3988283 - RNA, 11 nt, Staphylococcus aureus subsp. aureus Mu50
aaggaagaaca

SEQ ID NO: 3988284 - RNA, 13 nt, Staphylococcus aureus subsp. aureus Mu50
aaggaagcaugag

SEQ ID NO: 3988285 - RNA, 23 nt, Staphylococcus aureus subsp. aureus Mu50
aaggaauaauuuuaaaaauaaaa

SEQ ID NO: 3988286 - RNA, 22 nt, Staphylococcus aureus subsp. aureus Mu50
aaggaauguauucuaagaguug

SEQ ID NO: 3988287 - RNA, 17 nt, Staphylococcus aureus subsp. aureus Mu50
aaggacaggaauaaauu

SEQ ID NO: 3988288 - RNA, 16 nt, Staphylococcus aureus subsp. aureus Mu50
aaggaugaguuuaaaa

SEQ ID NO: 3988289 - RNA, 19 nt, Staphylococcus aureus subsp. aureus Mu50
aaggauguuauaaaaugaa

SEQ ID NO: 3988290 - RNA, 22 nt, Staphylococcus aureus subsp. aureus Mu50
aaggauuauuaacuuuaauaua

SEQ ID NO: 3988291 - RNA, 14 nt, Staphylococcus aureus subsp. aureus Mu50
aaggccugcaucac

SEQ ID NO: 3988292 - RNA, 16 nt, Staphylococcus aureus subsp. aureus Mu50
aaggcgaaacauuaaa

SEQ ID NO: 3988293 - RNA, 18 nt, Staphylococcus aureus subsp. aureus Mu50
aaggcgcucucuuuuuag

SEQ ID NO: 3988294 - RNA, 17 nt, Staphylococcus aureus subsp. aureus Mu50
aaguauuaugauugcuu

SEQ ID NO: 3988295 - RNA, 19 nt, Staphylococcus aureus subsp. aureus Mu50
aaguauugccaaauuucuc

SEQ ID NO: 3988296 - RNA, 21 nt, Staphylococcus aureus subsp. aureus Mu50
aaguauugccguuauuuucaa

SEQ ID NO: 3988297 - RNA, 15 nt, Staphylococcus aureus subsp. aureus Mu50
aagucaauaauuuua

SEQ ID NO: 3988298 - RNA, 13 nt, Staphylococcus aureus subsp. aureus Mu50
aagucaauuuaaa

SEQ ID NO: 3988299 - RNA, 15 nt, Staphylococcus aureus subsp. aureus Mu50
aagucaauuuaaaua

SEQ ID NO: 3988300 - RNA, 22 nt, Staphylococcus aureus subsp. aureus Mu50
aagucacaguaucuucaguuau

SEQ ID NO: 3988301 - RNA, 15 nt, Staphylococcus aureus subsp. aureus Mu50
aagucacauuuauaa

SEQ ID NO: 3988302 - RNA, 22 nt, Staphylococcus aureus subsp. aureus Mu50
aagucaggaucacguuuuucuu

SEQ ID NO: 3988303 - RNA, 16 nt, Staphylococcus aureus subsp. aureus Mu50
aagucagucaauucaa

SEQ ID NO: 3988304 - RNA, 22 nt, Staphylococcus aureus subsp. aureus Mu50
aagucaguuaacggcguauuca

SEQ ID NO: 3988305 - RNA, 22 nt, Staphylococcus aureus subsp. aureus Mu50
aagucauuaaauguacauugua

SEQ ID NO: 3988306 - RNA, 14 nt, Staphylococcus aureus subsp. aureus Mu50
aaguccaaauaaua

SEQ ID NO: 3988307 - RNA, 17 nt, Staphylococcus aureus subsp. aureus Mu50
aaguccggcugaaggga

SEQ ID NO: 3988308 - RNA, 12 nt, Staphylococcus aureus subsp. aureus Mu50
aagucgaaagua

SEQ ID NO: 3988309 - RNA, 20 nt, Staphylococcus aureus subsp. aureus Mu50
aagucgcucuagacauuaca

SEQ ID NO: 3988310 - RNA, 20 nt, Staphylococcus aureus subsp. aureus Mu50
aagucguucaauuguugauu

SEQ ID NO: 3988311 - RNA, 22 nt, Staphylococcus aureus subsp. aureus Mu50
aagucguucucuuaaauaugaa

SEQ ID NO: 3988312 - RNA, 20 nt, Staphylococcus aureus subsp. aureus Mu50
aagucguuguugaaauuaaa

SEQ ID NO: 3988313 - RNA, 18 nt, Staphylococcus aureus subsp. aureus Mu50
aagucuaauguuggaaaa

SEQ ID NO: 3988314 - RNA, 16 nt, Staphylococcus aureus subsp. aureus Mu50
aagucucuugucauuu

SEQ ID NO: 3988315 - RNA, 18 nt, Staphylococcus aureus subsp. aureus Mu50
aagucucuugucauuuca

SEQ ID NO: 3988316 - RNA, 15 nt, Staphylococcus aureus subsp. aureus Mu50
aagucucuuuccuca

SEQ ID NO: 3988317 - RNA, 22 nt, Staphylococcus aureus subsp. aureus Mu50
aagucucuuuugauaaauuccc

SEQ ID NO: 3988318 - RNA, 17 nt, Staphylococcus aureus subsp. aureus Mu50
aagucugaugucgaaaa

SEQ ID NO: 3988319 - RNA, 16 nt, Staphylococcus aureus subsp. aureus Mu50
aagucuguugguuuau

SEQ ID NO: 3988320 - RNA, 19 nt, Staphylococcus aureus subsp. aureus Mu50
aagucuuaacaaauuaaaa

SEQ ID NO: 3988321 - RNA, 21 nt, Staphylococcus aureus subsp. aureus Mu50
aagucuucaucuuuaaagaaa

SEQ ID NO: 3988322 - RNA, 23 nt, Staphylococcus aureus subsp. aureus Mu50
aagucuuuaauagcgucaaguuu

SEQ ID NO: 3988323 - RNA, 13 nt, Staphylococcus aureus subsp. aureus Mu50
aagucuuuacucu

SEQ ID NO: 3988324 - RNA, 14 nt, Staphylococcus aureus subsp. aureus Mu50
aagucuuuuaaaug

SEQ ID NO: 3988325 - RNA, 20 nt, Staphylococcus aureus subsp. aureus Mu50
aagugaaaguauuagauaua

SEQ ID NO: 3988326 - RNA, 17 nt, Staphylococcus aureus subsp. aureus Mu50
aagugaaaucauuuaaa

SEQ ID NO: 3988327 - RNA, 13 nt, Staphylococcus aureus subsp. aureus Mu50
aagugacacugua

SEQ ID NO: 3988328 - RNA, 18 nt, Staphylococcus aureus subsp. aureus Mu50
aagugaguaacauuugcu

SEQ ID NO: 3988329 - RNA, 14 nt, Staphylococcus aureus subsp. aureus Mu50
aagugauaaauaau

SEQ ID NO: 3988330 - RNA, 14 nt, Staphylococcus aureus subsp. aureus Mu50
aagugauaauuaaa

SEQ ID NO: 3988331 - RNA, 15 nt, Staphylococcus aureus subsp. aureus Mu50
aagugauaauuaaaa

SEQ ID NO: 3988332 - RNA, 18 nt, Staphylococcus aureus subsp. aureus Mu50
aagugauaauuaaaauaa

SEQ ID NO: 3988333 - RNA, 15 nt, Staphylococcus aureus subsp. aureus Mu50
aagugaugaccaaua

SEQ ID NO: 3988334 - RNA, 19 nt, Staphylococcus aureus subsp. aureus Mu50
aagugaugaccaauauucu

SEQ ID NO: 3988335 - RNA, 15 nt, Staphylococcus aureus subsp. aureus Mu50
aagugcaauuauuuc

SEQ ID NO: 3988336 - RNA, 19 nt, Staphylococcus aureus subsp. aureus Mu50
aagugcagauguugguuca

SEQ ID NO: 3988337 - RNA, 22 nt, Staphylococcus aureus subsp. aureus Mu50
aagugcagauguugguucauca

SEQ ID NO: 3988338 - RNA, 18 nt, Staphylococcus aureus subsp. aureus Mu50
aagugcauauuuaauaca

SEQ ID NO: 3988339 - RNA, 19 nt, Staphylococcus aureus subsp. aureus Mu50
aagugccuugccaugauuu

SEQ ID NO: 3988340 - RNA, 21 nt, Staphylococcus aureus subsp. aureus Mu50
aagugccuugccaugauuuaa

SEQ ID NO: 3988341 - RNA, 22 nt, Staphylococcus aureus subsp. aureus Mu50
aagugcgggggauuauuuauau

SEQ ID NO: 3988342 - RNA, 16 nt, Staphylococcus aureus subsp. aureus Mu50
aagugcgguuuaaucu

SEQ ID NO: 3988343 - RNA, 20 nt, Staphylococcus aureus subsp. aureus Mu50
aagugcuguuacuucucccu

SEQ ID NO: 3988344 - RNA, 20 nt, Staphylococcus aureus subsp. aureus Mu50
aagugcuugauuaacauuuu

SEQ ID NO: 3988345 - RNA, 17 nt, Staphylococcus aureus subsp. aureus Mu50
aagugcuugguuaaagu

SEQ ID NO: 3988346 - RNA, 17 nt, Staphylococcus aureus subsp. aureus Mu50
aagugguuguucccauu

SEQ ID NO: 3988347 - RNA, 20 nt, Staphylococcus aureus subsp. aureus Mu50
aagugguuuuacugcuucaa

SEQ ID NO: 3988348 - RNA, 14 nt, Staphylococcus aureus subsp. aureus Mu50
aaguguaaaugaaa

SEQ ID NO: 3988349 - RNA, 18 nt, Staphylococcus aureus subsp. aureus Mu50
aaguguaaaugaaaguac

SEQ ID NO: 3988350 - RNA, 22 nt, Staphylococcus aureus subsp. aureus Mu50
aagugucugguucuuuacuaaa

SEQ ID NO: 3988351 - RNA, 14 nt, Staphylococcus aureus subsp. aureus Mu50
aaguguuauaaaua

SEQ ID NO: 3988352 - RNA, 15 nt, Staphylococcus aureus subsp. aureus Mu50
aaguguuauaaauag

SEQ ID NO: 3988353 - RNA, 20 nt, Staphylococcus aureus subsp. aureus Mu50
aaguguuauaaauagagaac

SEQ ID NO: 3988354 - RNA, 19 nt, Staphylococcus aureus subsp. aureus Mu50
aaguguugaccauuaucaa

SEQ ID NO: 3988355 - RNA, 16 nt, Staphylococcus aureus subsp. aureus Mu50
aaguguuucaacauau

SEQ ID NO: 3988356 - RNA, 18 nt, Staphylococcus aureus subsp. aureus Mu50
aaguguuuuaaguucauc

SEQ ID NO: 3988357 - RNA, 12 nt, Staphylococcus aureus subsp. aureus Mu50
aaguuaaaaccu

SEQ ID NO: 3988358 - RNA, 22 nt, Staphylococcus aureus subsp. aureus Mu50
aaguuaaaaccuuuucaaauua

SEQ ID NO: 3988359 - RNA, 14 nt, Staphylococcus aureus subsp. aureus Mu50
aaguuaaaauaaaa

SEQ ID NO: 3988360 - RNA, 18 nt, Staphylococcus aureus subsp. aureus Mu50
aaguuaacuauaacaaua

SEQ ID NO: 3988361 - RNA, 19 nt, Staphylococcus aureus subsp. aureus Mu50
aaguuaacuauaacaauag

SEQ ID NO: 3988362 - RNA, 18 nt, Staphylococcus aureus subsp. aureus Mu50
aaguuaagucgccuaacu

SEQ ID NO: 3988363 - RNA, 15 nt, Staphylococcus aureus subsp. aureus Mu50
aaguuaaucagaaaa

SEQ ID NO: 3988364 - RNA, 17 nt, Staphylococcus aureus subsp. aureus Mu50
aaguuaaugugcauuua

SEQ ID NO: 3988365 - RNA, 15 nt, Staphylococcus aureus subsp. aureus Mu50
aaguuacaauaucau

SEQ ID NO: 3988366 - RNA, 15 nt, Staphylococcus aureus subsp. aureus Mu50
aaguuacuuacgcca

SEQ ID NO: 3988367 - RNA, 13 nt, Staphylococcus aureus subsp. aureus Mu50
aaguuauaaauua

SEQ ID NO: 3988368 - RNA, 15 nt, Staphylococcus aureus subsp. aureus Mu50
aaguuauaaauuaua

SEQ ID NO: 3988369 - RNA, 15 nt, Staphylococcus aureus subsp. aureus Mu50
aaguuauauaaauuu

SEQ ID NO: 3988370 - RNA, 18 nt, Staphylococcus aureus subsp. aureus Mu50
aaguuauauaaauuugua

SEQ ID NO: 3988371 - RNA, 12 nt, Staphylococcus aureus subsp. aureus Mu50
aaguuauaucau

SEQ ID NO: 3988372 - RNA, 20 nt, Staphylococcus aureus subsp. aureus Mu50
aaguuaugaugggaaaaaau

SEQ ID NO: 3988373 - RNA, 18 nt, Staphylococcus aureus subsp. aureus Mu50
aaguuauuuaguacauag

SEQ ID NO: 3988374 - RNA, 18 nt, Staphylococcus aureus subsp. aureus Mu50
aaguuauuuggauauuua

SEQ ID NO: 3988375 - RNA, 23 nt, Staphylococcus aureus subsp. aureus Mu50
aaguucaucguuaucuuuaagua

SEQ ID NO: 3988376 - RNA, 14 nt, Staphylococcus aureus subsp. aureus Mu50
aaguucauuacaaa

SEQ ID NO: 3988377 - RNA, 14 nt, Staphylococcus aureus subsp. aureus Mu50
aaguugaaaaccuc

SEQ ID NO: 3988378 - RNA, 21 nt, Staphylococcus aureus subsp. aureus Mu50
aaguugacaauacaaaucgau

SEQ ID NO: 3988379 - RNA, 15 nt, Staphylococcus aureus subsp. aureus Mu50
aaguugauaauguaa

SEQ ID NO: 3988380 - RNA, 14 nt, Staphylococcus aureus subsp. aureus Mu50
aaguugauuaaaag

SEQ ID NO: 3988381 - RNA, 12 nt, Staphylococcus aureus subsp. aureus Mu50
aauaaccacuuu

SEQ ID NO: 3988382 - RNA, 20 nt, Staphylococcus aureus subsp. aureus Mu50
aauaaccaugccagcuucua

SEQ ID NO: 3988383 - RNA, 16 nt, Staphylococcus aureus subsp. aureus Mu50
aauaacccauuuucaa

SEQ ID NO: 3988384 - RNA, 18 nt, Staphylococcus aureus subsp. aureus Mu50
aauaaccgcacuuucuau

SEQ ID NO: 3988385 - RNA, 23 nt, Staphylococcus aureus subsp. aureus Mu50
aauaaccgcacuuucuauuaaua

SEQ ID NO: 3988386 - RNA, 17 nt, Staphylococcus aureus subsp. aureus Mu50
aauaaccgcuuaauucu

SEQ ID NO: 3988387 - RNA, 19 nt, Staphylococcus aureus subsp. aureus Mu50
aauaaccuagguuaaagau

SEQ ID NO: 3988388 - RNA, 20 nt, Staphylococcus aureus subsp. aureus Mu50
aauaaccuuuaaaacaucau

SEQ ID NO: 3988389 - RNA, 23 nt, Staphylococcus aureus subsp. aureus Mu50
aauaaccuuuaaaacaucauuca

SEQ ID NO: 3988390 - RNA, 22 nt, Staphylococcus aureus subsp. aureus Mu50
aauaacguacauuuaugauugu

SEQ ID NO: 3988391 - RNA, 20 nt, Staphylococcus aureus subsp. aureus Mu50
aauaacuagaacaagaauua

SEQ ID NO: 3988392 - RNA, 23 nt, Staphylococcus aureus subsp. aureus Mu50
aauaacugaguuuuaaugaacuc

SEQ ID NO: 3988393 - RNA, 20 nt, Staphylococcus aureus subsp. aureus Mu50
aauaacugcuaauuuuuuca

SEQ ID NO: 3988394 - RNA, 17 nt, Staphylococcus aureus subsp. aureus Mu50
aauaacuguagcgaagu

SEQ ID NO: 3988395 - RNA, 15 nt, Staphylococcus aureus subsp. aureus Mu50
aauaacuguucuuuc

SEQ ID NO: 3988396 - RNA, 18 nt, Staphylococcus aureus subsp. aureus Mu50
aauaacuguuuaucauga

SEQ ID NO: 3988397 - RNA, 22 nt, Staphylococcus aureus subsp. aureus Mu50
aauaacuucguuuuaauaaauu

SEQ ID NO: 3988398 - RNA, 21 nt, Staphylococcus aureus subsp. aureus Mu50
aauaacuuuaccaccauuuuu

SEQ ID NO: 3988399 - RNA, 19 nt, Staphylococcus aureus subsp. aureus Mu50
aauaagaauguguuaauca

SEQ ID NO: 3988400 - RNA, 20 nt, Staphylococcus aureus subsp. aureus Mu50
aauaagagaacuuuucaaac

SEQ ID NO: 3988401 - RNA, 15 nt, Staphylococcus aureus subsp. aureus Mu50
aauaagaugaaauau

SEQ ID NO: 3988402 - RNA, 20 nt, Staphylococcus aureus subsp. aureus Mu50
aauaagaugaaauauucuuu

SEQ ID NO: 3988403 - RNA, 11 nt, Staphylococcus aureus subsp. aureus Mu50
aauaagauuau

SEQ ID NO: 3988404 - RNA, 12 nt, Staphylococcus aureus subsp. aureus Mu50
aauaagauuauu

SEQ ID NO: 3988405 - RNA, 14 nt, Staphylococcus aureus subsp. aureus Mu50
aauaagauuuuuua

SEQ ID NO: 3988406 - RNA, 15 nt, Staphylococcus aureus subsp. aureus Mu50
aauaagcgcaauuaa

SEQ ID NO: 3988407 - RNA, 15 nt, Staphylococcus aureus subsp. aureus Mu50
aauaagcuacuaagc

SEQ ID NO: 3988408 - RNA, 17 nt, Staphylococcus aureus subsp. aureus Mu50
aauaaguaauaauuuau

SEQ ID NO: 3988409 - RNA, 11 nt, Staphylococcus aureus subsp. aureus Mu50
aauaaguaugg

SEQ ID NO: 3988410 - RNA, 19 nt, Staphylococcus aureus subsp. aureus Mu50
aauaagugguuguucccau

SEQ ID NO: 3988411 - RNA, 20 nt, Staphylococcus aureus subsp. aureus Mu50
aauaagugguuguucccauu

SEQ ID NO: 3988412 - RNA, 21 nt, Staphylococcus aureus subsp. aureus Mu50
aauaaguuaaugugcauuuau

SEQ ID NO: 3988413 - RNA, 13 nt, Staphylococcus aureus subsp. aureus Mu50
aauaaguuaccuu

SEQ ID NO: 3988414 - RNA, 15 nt, Staphylococcus aureus subsp. aureus Mu50
aauaaguugaauaua

SEQ ID NO: 3988415 - RNA, 22 nt, Staphylococcus aureus subsp. aureus Mu50
aauaaguugaauauaaaaaaga

SEQ ID NO: 3988416 - RNA, 13 nt, Staphylococcus aureus subsp. aureus Mu50
aauaaguugucau

SEQ ID NO: 3988417 - RNA, 14 nt, Staphylococcus aureus subsp. aureus Mu50
aauaaguugucauc

SEQ ID NO: 3988418 - RNA, 11 nt, Staphylococcus aureus subsp. aureus Mu50
aauaauaaaau

SEQ ID NO: 3988419 - RNA, 12 nt, Staphylococcus aureus subsp. aureus Mu50
aauaauaaaaua

SEQ ID NO: 3988420 - RNA, 13 nt, Staphylococcus aureus subsp. aureus Mu50
aauaauaaaauag

SEQ ID NO: 3988421 - RNA, 20 nt, Staphylococcus aureus subsp. aureus Mu50
aauaauaaaccuaaagauau

SEQ ID NO: 3988422 - RNA, 14 nt, Staphylococcus aureus subsp. aureus Mu50
aauaauaaugggaa

SEQ ID NO: 3988423 - RNA, 18 nt, Staphylococcus aureus subsp. aureus Mu50
aauaauacgcuugauaaa

SEQ ID NO: 3988424 - RNA, 19 nt, Staphylococcus aureus subsp. aureus Mu50
aauaauacgcuugauaaaa

SEQ ID NO: 3988425 - RNA, 16 nt, Staphylococcus aureus subsp. aureus Mu50
aauaauacuacauaua

SEQ ID NO: 3988426 - RNA, 14 nt, Staphylococcus aureus subsp. aureus Mu50
aauaauagcaaaau

SEQ ID NO: 3988427 - RNA, 16 nt, Staphylococcus aureus subsp. aureus Mu50
aauaauagcaaaauua

SEQ ID NO: 3988428 - RNA, 13 nt, Staphylococcus aureus subsp. aureus Mu50
aauaauauaaaaa

SEQ ID NO: 3988429 - RNA, 16 nt, Staphylococcus aureus subsp. aureus Mu50
aauaauauaaaacgau

SEQ ID NO: 3988430 - RNA, 20 nt, Staphylococcus aureus subsp. aureus Mu50
aauaauauaaauaaaagcca

SEQ ID NO: 3988431 - RNA, 13 nt, Staphylococcus aureus subsp. aureus Mu50
aauaaucacauua

SEQ ID NO: 3988432 - RNA, 15 nt, Staphylococcus aureus subsp. aureus Mu50
aauaaucacauuaau

SEQ ID NO: 3988433 - RNA, 16 nt, Staphylococcus aureus subsp. aureus Mu50
aauaaucauccauaua

SEQ ID NO: 3988434 - RNA, 23 nt, Staphylococcus aureus subsp. aureus Mu50
aauaaucccaaccauucuaccag

SEQ ID NO: 3988435 - RNA, 18 nt, Staphylococcus aureus subsp. aureus Mu50
aauaaucgaacauaaaua

SEQ ID NO: 3988436 - RNA, 17 nt, Staphylococcus aureus subsp. aureus Mu50
aauaaucgcccaucucu

SEQ ID NO: 3988437 - RNA, 13 nt, Staphylococcus aureus subsp. aureus Mu50
aauaaucuuuaac

SEQ ID NO: 3988438 - RNA, 20 nt, Staphylococcus aureus subsp. aureus Mu50
aauaaugacaaauuaucacu

SEQ ID NO: 3988439 - RNA, 19 nt, Staphylococcus aureus subsp. aureus Mu50
aauaaugacgagaauuaaa

SEQ ID NO: 3988440 - RNA, 20 nt, Staphylococcus aureus subsp. aureus Mu50
aauaaugacgagaauuaaag

SEQ ID NO: 3988441 - RNA, 20 nt, Staphylococcus aureus subsp. aureus Mu50
aauaaugaugcauaagauuu

SEQ ID NO: 3988442 - RNA, 22 nt, Staphylococcus aureus subsp. aureus Mu50
aauaaugccaccguggaauuua

SEQ ID NO: 3988443 - RNA, 14 nt, Staphylococcus aureus subsp. aureus Mu50
aauaauggcaauua

SEQ ID NO: 3988444 - RNA, 23 nt, Staphylococcus aureus subsp. aureus Mu50
aauaaugggaauuguauuagcaa

SEQ ID NO: 3988445 - RNA, 14 nt, Staphylococcus aureus subsp. aureus Mu50
aauaauguaucauu

SEQ ID NO: 3988446 - RNA, 16 nt, Staphylococcus aureus subsp. aureus Mu50
aauaaugucuuacuuu

SEQ ID NO: 3988447 - RNA, 20 nt, Staphylococcus aureus subsp. aureus Mu50
aauaaugucuuacuuuuaaa

SEQ ID NO: 3988448 - RNA, 20 nt, Staphylococcus aureus subsp. aureus Mu50
aauaauguugucacuuggau

SEQ ID NO: 3988449 - RNA, 11 nt, Staphylococcus aureus subsp. aureus Mu50
aauaauguuuc

SEQ ID NO: 3988450 - RNA, 18 nt, Staphylococcus aureus subsp. aureus Mu50
aauaauguuuccauuuau

SEQ ID NO: 3988451 - RNA, 12 nt, Staphylococcus aureus subsp. aureus Mu50
aauaauuaaaaa

SEQ ID NO: 3988452 - RNA, 17 nt, Staphylococcus aureus subsp. aureus Mu50
aauaauuaaauaaaaau

SEQ ID NO: 3988453 - RNA, 17 nt, Staphylococcus aureus subsp. aureus Mu50
aauaauuaauguuucuu

SEQ ID NO: 3988454 - RNA, 15 nt, Staphylococcus aureus subsp. aureus Mu50
aauaauuacuaaccu

SEQ ID NO: 3988455 - RNA, 18 nt, Staphylococcus aureus subsp. aureus Mu50
aauaauuacuaaccuaaa

SEQ ID NO: 3988456 - RNA, 16 nt, Staphylococcus aureus subsp. aureus Mu50
aauaauuagauuuaaa

SEQ ID NO: 3988457 - RNA, 17 nt, Staphylococcus aureus subsp. aureus Mu50
aauaauuagauuuaaaa

SEQ ID NO: 3988458 - RNA, 19 nt, Staphylococcus aureus subsp. aureus Mu50
aauaauucauaaaugcuuc

SEQ ID NO: 3988459 - RNA, 18 nt, Staphylococcus aureus subsp. aureus Mu50
aauaauucccuaggaaau

SEQ ID NO: 3988460 - RNA, 17 nt, Staphylococcus aureus subsp. aureus Mu50
aauaauugcuaaaauau

SEQ ID NO: 3988461 - RNA, 19 nt, Staphylococcus aureus subsp. aureus Mu50
aauaauugcuuuagaaagu

SEQ ID NO: 3988462 - RNA, 16 nt, Staphylococcus aureus subsp. aureus Mu50
aauaauuggaaucauc

SEQ ID NO: 3988463 - RNA, 17 nt, Staphylococcus aureus subsp. aureus Mu50
aauaauuggaaucaucu

SEQ ID NO: 3988464 - RNA, 18 nt, Staphylococcus aureus subsp. aureus Mu50
aauaauuggaaucaucuu

SEQ ID NO: 3988465 - RNA, 19 nt, Staphylococcus aureus subsp. aureus Mu50
aauaauuggaaucaucuuu

SEQ ID NO: 3988466 - RNA, 20 nt, Staphylococcus aureus subsp. aureus Mu50
aauaauuggaaucaucuuuu

SEQ ID NO: 3988467 - RNA, 11 nt, Staphylococcus aureus subsp. aureus Mu50
aauaauugucc

SEQ ID NO: 3988468 - RNA, 15 nt, Staphylococcus aureus subsp. aureus Mu50
aauaauuuaacuaau

SEQ ID NO: 3988469 - RNA, 20 nt, Staphylococcus aureus subsp. aureus Mu50
aauacuaccguuuuuauaua

SEQ ID NO: 3988470 - RNA, 18 nt, Staphylococcus aureus subsp. aureus Mu50
aauacuauacugaugaaa

SEQ ID NO: 3988471 - RNA, 14 nt, Staphylococcus aureus subsp. aureus Mu50
aauacuauaugaaa

SEQ ID NO: 3988472 - RNA, 16 nt, Staphylococcus aureus subsp. aureus Mu50
aauacucccuucaaca

SEQ ID NO: 3988473 - RNA, 17 nt, Staphylococcus aureus subsp. aureus Mu50
aauacucuucaaucuac

SEQ ID NO: 3988474 - RNA, 17 nt, Staphylococcus aureus subsp. aureus Mu50
aauacuguauuuuaacg

SEQ ID NO: 3988475 - RNA, 15 nt, Staphylococcus aureus subsp. aureus Mu50
aauacuguuuaaaua

SEQ ID NO: 3988476 - RNA, 16 nt, Staphylococcus aureus subsp. aureus Mu50
aauacuguuuaaauaa

SEQ ID NO: 3988477 - RNA, 23 nt, Staphylococcus aureus subsp. aureus Mu50
aauacuguuuaaauaaaauuguu

SEQ ID NO: 3988478 - RNA, 16 nt, Staphylococcus aureus subsp. aureus Mu50
aauacuucaccacaua

SEQ ID NO: 3988479 - RNA, 15 nt, Staphylococcus aureus subsp. aureus Mu50
aauacuucguuauau

SEQ ID NO: 3988480 - RNA, 13 nt, Staphylococcus aureus subsp. aureus Mu50
aauacuugaaaga

SEQ ID NO: 3988481 - RNA, 20 nt, Staphylococcus aureus subsp. aureus Mu50
aauacuugaaagauuuguag

SEQ ID NO: 3988482 - RNA, 19 nt, Staphylococcus aureus subsp. aureus Mu50
aauacuugaauuuaauaag

SEQ ID NO: 3988483 - RNA, 17 nt, Staphylococcus aureus subsp. aureus Mu50
aauacuuuauuugauaa

SEQ ID NO: 3988484 - RNA, 22 nt, Staphylococcus aureus subsp. aureus Mu50
aauacuuucaaacaaaucuuuu

SEQ ID NO: 3988485 - RNA, 17 nt, Staphylococcus aureus subsp. aureus Mu50
aauacuuucacuuuuua

SEQ ID NO: 3988486 - RNA, 18 nt, Staphylococcus aureus subsp. aureus Mu50
aauacuuucacuuuuuau

SEQ ID NO: 3988487 - RNA, 21 nt, Staphylococcus aureus subsp. aureus Mu50
aauacuuucacuuuuuauauc

SEQ ID NO: 3988488 - RNA, 14 nt, Staphylococcus aureus subsp. aureus Mu50
aauacuuuuuaacu

SEQ ID NO: 3988489 - RNA, 12 nt, Staphylococcus aureus subsp. aureus Mu50
aauacuuuuuga

SEQ ID NO: 3988490 - RNA, 21 nt, Staphylococcus aureus subsp. aureus Mu50
aauagaaaaauuucaaaaaua

SEQ ID NO: 3988491 - RNA, 22 nt, Staphylococcus aureus subsp. aureus Mu50
aauagaaagcgcauuugucauc

SEQ ID NO: 3988492 - RNA, 14 nt, Staphylococcus aureus subsp. aureus Mu50
aauagaaauaauca

SEQ ID NO: 3988493 - RNA, 15 nt, Staphylococcus aureus subsp. aureus Mu50
aauagaacgaaauag

SEQ ID NO: 3988494 - RNA, 23 nt, Staphylococcus aureus subsp. aureus Mu50
aauagaaucuaaggccauuugua

SEQ ID NO: 3988495 - RNA, 20 nt, Staphylococcus aureus subsp. aureus Mu50
aauagacugccaauaaaaug

SEQ ID NO: 3988496 - RNA, 22 nt, Staphylococcus aureus subsp. aureus Mu50
aauagacugccaauaaaaugca

SEQ ID NO: 3988497 - RNA, 15 nt, Staphylococcus aureus subsp. aureus Mu50
aauagacuuauauua

SEQ ID NO: 3988498 - RNA, 17 nt, Staphylococcus aureus subsp. aureus Mu50
aauagauaaugcaccug

SEQ ID NO: 3988499 - RNA, 13 nt, Staphylococcus aureus subsp. aureus Mu50
aauagaugagaaa

SEQ ID NO: 3988500 - RNA, 19 nt, Staphylococcus aureus subsp. aureus Mu50
aauagaugagaaaguaaaa

SEQ ID NO: 3988501 - RNA, 22 nt, Staphylococcus aureus subsp. aureus Mu50
aauagaugagaaaguaaaaguu

SEQ ID NO: 3988502 - RNA, 13 nt, Staphylococcus aureus subsp. aureus Mu50
aauagauugaaaa

SEQ ID NO: 3988503 - RNA, 18 nt, Staphylococcus aureus subsp. aureus Mu50
aauagauuuagaaacaau

SEQ ID NO: 3988504 - RNA, 20 nt, Staphylococcus aureus subsp. aureus Mu50
aauagauuuagaaacaaucg

SEQ ID NO: 3988505 - RNA, 16 nt, Staphylococcus aureus subsp. aureus Mu50
aauagcaaccauauuu

SEQ ID NO: 3988506 - RNA, 13 nt, Staphylococcus aureus subsp. aureus Mu50
aauagcaauugaa

SEQ ID NO: 3988507 - RNA, 22 nt, Staphylococcus aureus subsp. aureus Mu50
aauagcaguuucugagaagaaa

SEQ ID NO: 3988508 - RNA, 20 nt, Staphylococcus aureus subsp. aureus Mu50
aauagcauuccuaauuauau

SEQ ID NO: 3988509 - RNA, 13 nt, Staphylococcus aureus subsp. aureus Mu50
aauagcauuugua

SEQ ID NO: 3988510 - RNA, 14 nt, Staphylococcus aureus subsp. aureus Mu50
aauagccauauuca

SEQ ID NO: 3988511 - RNA, 15 nt, Staphylococcus aureus subsp. aureus Mu50
aauagcgauuuuaaa

SEQ ID NO: 3988512 - RNA, 20 nt, Staphylococcus aureus subsp. aureus Mu50
aauagcgauuuuaaagaaaa

SEQ ID NO: 3988513 - RNA, 17 nt, Staphylococcus aureus subsp. aureus Mu50
aauagcgguuuaaaaau

SEQ ID NO: 3988514 - RNA, 20 nt, Staphylococcus aureus subsp. aureus Mu50
aauagcgucaucuggaauac

SEQ ID NO: 3988515 - RNA, 21 nt, Staphylococcus aureus subsp. aureus Mu50
aauagcuacaauuaaagugaa

SEQ ID NO: 3988516 - RNA, 18 nt, Staphylococcus aureus subsp. aureus Mu50
aauagcuauaacucuaaa

SEQ ID NO: 3988517 - RNA, 21 nt, Staphylococcus aureus subsp. aureus Mu50
aauagcuauaacucuaaauau

SEQ ID NO: 3988518 - RNA, 14 nt, Staphylococcus aureus subsp. aureus Mu50
aauagcuauauuuu

SEQ ID NO: 3988519 - RNA, 17 nt, Staphylococcus aureus subsp. aureus Mu50
aauagcuauauuuuugu

SEQ ID NO: 3988520 - RNA, 22 nt, Staphylococcus aureus subsp. aureus Mu50
aauagcuauauuuuuguauuua

SEQ ID NO: 3988521 - RNA, 15 nt, Staphylococcus aureus subsp. aureus Mu50
aauagcuauuaaaau

SEQ ID NO: 3988522 - RNA, 17 nt, Staphylococcus aureus subsp. aureus Mu50
aauagcuauuaaaauag

SEQ ID NO: 3988523 - RNA, 22 nt, Staphylococcus aureus subsp. aureus Mu50
aauagcuauuaaaauagaguag

SEQ ID NO: 3988524 - RNA, 19 nt, Staphylococcus aureus subsp. aureus Mu50
aauagcuuucguuucuuuu

SEQ ID NO: 3988525 - RNA, 20 nt, Staphylococcus aureus subsp. aureus Mu50
aauagcuuucguuucuuuua

SEQ ID NO: 3988526 - RNA, 21 nt, Staphylococcus aureus subsp. aureus Mu50
aauagcuuucguuucuuuuau

SEQ ID NO: 3988527 - RNA, 22 nt, Staphylococcus aureus subsp. aureus Mu50
aauagcuuucguuucuuuuaua

SEQ ID NO: 3988528 - RNA, 18 nt, Staphylococcus aureus subsp. aureus Mu50
aauaggauaugcuaaaca

SEQ ID NO: 3988529 - RNA, 20 nt, Staphylococcus aureus subsp. aureus Mu50
aauaggcaggaaugauauac

SEQ ID NO: 3988530 - RNA, 19 nt, Staphylococcus aureus subsp. aureus Mu50
aauagguacaacuaaauau

SEQ ID NO: 3988531 - RNA, 20 nt, Staphylococcus aureus subsp. aureus Mu50
aauagguuauuugauaauga

SEQ ID NO: 3988532 - RNA, 20 nt, Staphylococcus aureus subsp. aureus Mu50
aauagguucauuauuuaaau

SEQ ID NO: 3988533 - RNA, 13 nt, Staphylococcus aureus subsp. aureus Mu50
aauaguaaaguga

SEQ ID NO: 3988534 - RNA, 14 nt, Staphylococcus aureus subsp. aureus Mu50
aauaguaaagugaa

SEQ ID NO: 3988535 - RNA, 18 nt, Staphylococcus aureus subsp. aureus Mu50
aauagucaauuaaugaua

SEQ ID NO: 3988536 - RNA, 20 nt, Staphylococcus aureus subsp. aureus Mu50
aauagugucaucaccuuguu

SEQ ID NO: 3988537 - RNA, 23 nt, Staphylococcus aureus subsp. aureus Mu50
aauaguuaccaaaauuugaaaua

SEQ ID NO: 3988538 - RNA, 14 nt, Staphylococcus aureus subsp. aureus Mu50
aauaguucaaaaua

SEQ ID NO: 3988539 - RNA, 12 nt, Staphylococcus aureus subsp. aureus Mu50
aauaguucaaau

SEQ ID NO: 3988540 - RNA, 14 nt, Staphylococcus aureus subsp. aureus Mu50
aauaguucuuuaaa

SEQ ID NO: 3988541 - RNA, 17 nt, Staphylococcus aureus subsp. aureus Mu50
aauaguucuuuaaauua

SEQ ID NO: 3988542 - RNA, 18 nt, Staphylococcus aureus subsp. aureus Mu50
aauaguucuuuaaauuau

SEQ ID NO: 3988543 - RNA, 21 nt, Staphylococcus aureus subsp. aureus Mu50
aauaguucuuuaaauuauaua

SEQ ID NO: 3988544 - RNA, 15 nt, Staphylococcus aureus subsp. aureus Mu50
aauaguuucaaugcc

SEQ ID NO: 3988545 - RNA, 14 nt, Staphylococcus aureus subsp. aureus Mu50
aauaguuuuucaua

SEQ ID NO: 3988546 - RNA, 20 nt, Staphylococcus aureus subsp. aureus Mu50
aauaguuuuucauauucaca

SEQ ID NO: 3988547 - RNA, 19 nt, Staphylococcus aureus subsp. aureus Mu50
aauauaaaaaagaucacug

SEQ ID NO: 3988548 - RNA, 14 nt, Staphylococcus aureus subsp. aureus Mu50
aauauaaaacgaua

SEQ ID NO: 3988549 - RNA, 12 nt, Staphylococcus aureus subsp. aureus Mu50
aauauaaaauaa

SEQ ID NO: 3988550 - RNA, 15 nt, Staphylococcus aureus subsp. aureus Mu50
aauauaaaauaaagu

SEQ ID NO: 3988551 - RNA, 22 nt, Staphylococcus aureus subsp. aureus Mu50
aauauaaauuucuucauaguuc

SEQ ID NO: 3988552 - RNA, 15 nt, Staphylococcus aureus subsp. aureus Mu50
aauauaaauuuugaa

SEQ ID NO: 3988553 - RNA, 21 nt, Staphylococcus aureus subsp. aureus Mu50
aauauaacaacuacuuaaauu

SEQ ID NO: 3988554 - RNA, 18 nt, Staphylococcus aureus subsp. aureus Mu50
aauauaacaaguauaaau

SEQ ID NO: 3988555 - RNA, 16 nt, Staphylococcus aureus subsp. aureus Mu50
aauauaacaucaaaua

SEQ ID NO: 3988556 - RNA, 20 nt, Staphylococcus aureus subsp. aureus Mu50
aauaugaauugcuuguuuua

SEQ ID NO: 3988557 - RNA, 17 nt, Staphylococcus aureus subsp. aureus Mu50
aauaugaauuuguuuua

SEQ ID NO: 3988558 - RNA, 13 nt, Staphylococcus aureus subsp. aureus Mu50
aauaugacacaua

SEQ ID NO: 3988559 - RNA, 20 nt, Staphylococcus aureus subsp. aureus Mu50
aauaugacgaucuucaugaa

SEQ ID NO: 3988560 - RNA, 18 nt, Staphylococcus aureus subsp. aureus Mu50
aauaugagacaauacgau

SEQ ID NO: 3988561 - RNA, 22 nt, Staphylococcus aureus subsp. aureus Mu50
aauaugagugaaaguuugaagg

SEQ ID NO: 3988562 - RNA, 18 nt, Staphylococcus aureus subsp. aureus Mu50
aauaugauaacucguaau

SEQ ID NO: 3988563 - RNA, 14 nt, Staphylococcus aureus subsp. aureus Mu50
aauaugauauuaag

SEQ ID NO: 3988564 - RNA, 14 nt, Staphylococcus aureus subsp. aureus Mu50
aauaugauauugau

SEQ ID NO: 3988565 - RNA, 21 nt, Staphylococcus aureus subsp. aureus Mu50
aauaugauccuuuaaugcuuu

SEQ ID NO: 3988566 - RNA, 14 nt, Staphylococcus aureus subsp. aureus Mu50
aauaugauguuaaa

SEQ ID NO: 3988567 - RNA, 17 nt, Staphylococcus aureus subsp. aureus Mu50
aauaugauuaauaaagu

SEQ ID NO: 3988568 - RNA, 19 nt, Staphylococcus aureus subsp. aureus Mu50
aauaugauugaaugaagcu

SEQ ID NO: 3988569 - RNA, 18 nt, Staphylococcus aureus subsp. aureus Mu50
aauaugauugcaaauuau

SEQ ID NO: 3988570 - RNA, 15 nt, Staphylococcus aureus subsp. aureus Mu50
aauaugcccccuaau

SEQ ID NO: 3988571 - RNA, 17 nt, Staphylococcus aureus subsp. aureus Mu50
aauaugcuuuuaauagu

SEQ ID NO: 3988572 - RNA, 15 nt, Staphylococcus aureus subsp. aureus Mu50
aauauggaaaaugua

SEQ ID NO: 3988573 - RNA, 18 nt, Staphylococcus aureus subsp. aureus Mu50
aauauggaauuucauaua

SEQ ID NO: 3988574 - RNA, 23 nt, Staphylococcus aureus subsp. aureus Mu50
aauauggaauuucauauaaugaa

SEQ ID NO: 3988575 - RNA, 14 nt, Staphylococcus aureus subsp. aureus Mu50
aauauggauuuuga

SEQ ID NO: 3988576 - RNA, 19 nt, Staphylococcus aureus subsp. aureus Mu50
aauaugguuucuuauuaaa

SEQ ID NO: 3988577 - RNA, 21 nt, Staphylococcus aureus subsp. aureus Mu50
aauaugguuucuuauuaaaua

SEQ ID NO: 3988578 - RNA, 17 nt, Staphylococcus aureus subsp. aureus Mu50
aauauguaaucagguuu

SEQ ID NO: 3988579 - RNA, 17 nt, Staphylococcus aureus subsp. aureus Mu50
aauaugugcaugagacu

SEQ ID NO: 3988580 - RNA, 23 nt, Staphylococcus aureus subsp. aureus Mu50
aauauguggcgcucuuauaaaga

SEQ ID NO: 3988581 - RNA, 15 nt, Staphylococcus aureus subsp. aureus Mu50
aauauguguuaacug

SEQ ID NO: 3988582 - RNA, 12 nt, Staphylococcus aureus subsp. aureus Mu50
aauauuaaaauc

SEQ ID NO: 3988583 - RNA, 18 nt, Staphylococcus aureus subsp. aureus Mu50
aauauuaaaauuaaaacu

SEQ ID NO: 3988584 - RNA, 16 nt, Staphylococcus aureus subsp. aureus Mu50
aauauuaaauucaucu

SEQ ID NO: 3988585 - RNA, 17 nt, Staphylococcus aureus subsp. aureus Mu50
aauauuaaauucaucuu

SEQ ID NO: 3988586 - RNA, 21 nt, Staphylococcus aureus subsp. aureus Mu50
aauauuaaauucaucuugcaa

SEQ ID NO: 3988587 - RNA, 16 nt, Staphylococcus aureus subsp. aureus Mu50
aauauuaaauuucuga

SEQ ID NO: 3988588 - RNA, 21 nt, Staphylococcus aureus subsp. aureus Mu50
aauauuaaauuucugaacaua

SEQ ID NO: 3988589 - RNA, 14 nt, Staphylococcus aureus subsp. aureus Mu50
aauauuaacaccag

SEQ ID NO: 3988590 - RNA, 15 nt, Staphylococcus aureus subsp. aureus Mu50
aauauuaagauguau

SEQ ID NO: 3988591 - RNA, 18 nt, Staphylococcus aureus subsp. aureus Mu50
aauauuaauauaaaauaa

SEQ ID NO: 3988592 - RNA, 12 nt, Staphylococcus aureus subsp. aureus Mu50
aauauuauaagu

SEQ ID NO: 3988593 - RNA, 20 nt, Staphylococcus aureus subsp. aureus Mu50
aauauuauaaguugcauaua

SEQ ID NO: 3988594 - RNA, 18 nt, Staphylococcus aureus subsp. aureus Mu50
aauauuauuaaaucaaag

SEQ ID NO: 3988595 - RNA, 20 nt, Staphylococcus aureus subsp. aureus Mu50
aauauuauucauaauauauu

SEQ ID NO: 3988596 - RNA, 15 nt, Staphylococcus aureus subsp. aureus Mu50
aauauuauucuuuau

SEQ ID NO: 3988597 - RNA, 17 nt, Staphylococcus aureus subsp. aureus Mu50
aauauucacgacuugau

SEQ ID NO: 3988598 - RNA, 17 nt, Staphylococcus aureus subsp. aureus Mu50
aauauucagauuuucga

SEQ ID NO: 3988599 - RNA, 20 nt, Staphylococcus aureus subsp. aureus Mu50
aauauucgauacauaaaaca

SEQ ID NO: 3988600 - RNA, 20 nt, Staphylococcus aureus subsp. aureus Mu50
aauauucguaaauccuuuau

SEQ ID NO: 3988601 - RNA, 21 nt, Staphylococcus aureus subsp. aureus Mu50
aauauucguaaauccuuuaua

SEQ ID NO: 3988602 - RNA, 19 nt, Staphylococcus aureus subsp. aureus Mu50
aauauucuuaucauucauu

SEQ ID NO: 3988603 - RNA, 18 nt, Staphylococcus aureus subsp. aureus Mu50
aauauucuuucguuuuca

SEQ ID NO: 3988604 - RNA, 13 nt, Staphylococcus aureus subsp. aureus Mu50
aauauugaacaau

SEQ ID NO: 3988605 - RNA, 15 nt, Staphylococcus aureus subsp. aureus Mu50
aauauugaacaauuu

SEQ ID NO: 3988606 - RNA, 18 nt, Staphylococcus aureus subsp. aureus Mu50
aauauugaacaauuuuug

SEQ ID NO: 3988607 - RNA, 18 nt, Staphylococcus aureus subsp. aureus Mu50
aauauugaagaugcuuua

SEQ ID NO: 3988608 - RNA, 17 nt, Staphylococcus aureus subsp. aureus Mu50
aauauugaauaaucauc

SEQ ID NO: 3988609 - RNA, 14 nt, Staphylococcus aureus subsp. aureus Mu50
aauauugaugaaua

SEQ ID NO: 3988610 - RNA, 15 nt, Staphylococcus aureus subsp. aureus Mu50
aauauugaugaauaa

SEQ ID NO: 3988611 - RNA, 20 nt, Staphylococcus aureus subsp. aureus Mu50
aauauugauucuagugaaau

SEQ ID NO: 3988612 - RNA, 19 nt, Staphylococcus aureus subsp. aureus Mu50
aauauuggaauacucuuca

SEQ ID NO: 3988613 - RNA, 15 nt, Staphylococcus aureus subsp. aureus Mu50
aauauuguauugauc

SEQ ID NO: 3988614 - RNA, 14 nt, Staphylococcus aureus subsp. aureus Mu50
aauauuuaaacuag

SEQ ID NO: 3988615 - RNA, 17 nt, Staphylococcus aureus subsp. aureus Mu50
aauauuuaaacuaguaa

SEQ ID NO: 3988616 - RNA, 16 nt, Staphylococcus aureus subsp. aureus Mu50
aauauuuaaauuuuaa

SEQ ID NO: 3988617 - RNA, 22 nt, Staphylococcus aureus subsp. aureus Mu50
aauauuuaaccuuuaaaacguu

SEQ ID NO: 3988618 - RNA, 15 nt, Staphylococcus aureus subsp. aureus Mu50
aauauuuaacuuuuu

SEQ ID NO: 3988619 - RNA, 14 nt, Staphylococcus aureus subsp. aureus Mu50
aauauuuaaguuuc

SEQ ID NO: 3988620 - RNA, 15 nt, Staphylococcus aureus subsp. aureus Mu50
aauauuuauauuaaa

SEQ ID NO: 3988621 - RNA, 16 nt, Staphylococcus aureus subsp. aureus Mu50
aauauuuauuguuuuu

SEQ ID NO: 3988622 - RNA, 17 nt, Staphylococcus aureus subsp. aureus Mu50
aauauuuauuguuuuua

SEQ ID NO: 3988623 - RNA, 19 nt, Staphylococcus aureus subsp. aureus Mu50
aauauuuauuguuuuuaaa

SEQ ID NO: 3988624 - RNA, 19 nt, Staphylococcus aureus subsp. aureus Mu50
aauauuucccuaugaaaua

SEQ ID NO: 3988625 - RNA, 15 nt, Staphylococcus aureus subsp. aureus Mu50
aauauuucuuaccau

SEQ ID NO: 3988626 - RNA, 21 nt, Staphylococcus aureus subsp. aureus Mu50
aauauuucuuagauacucacu

SEQ ID NO: 3988627 - RNA, 15 nt, Staphylococcus aureus subsp. aureus Mu50
aauauuugaaaauuu

SEQ ID NO: 3988628 - RNA, 12 nt, Staphylococcus aureus subsp. aureus Mu50
aauauuugauaa

SEQ ID NO: 3988629 - RNA, 13 nt, Staphylococcus aureus subsp. aureus Mu50
aauauuugauaac

SEQ ID NO: 3988630 - RNA, 16 nt, Staphylococcus aureus subsp. aureus Mu50
aauauuugauaaguag

SEQ ID NO: 3988631 - RNA, 22 nt, Staphylococcus aureus subsp. aureus Mu50
aauauuugauaaguagaaaaua

SEQ ID NO: 3988632 - RNA, 22 nt, Staphylococcus aureus subsp. aureus Mu50
aauauuuucuuagaaaaucaag

SEQ ID NO: 3988633 - RNA, 19 nt, Staphylococcus aureus subsp. aureus Mu50
aauauuuuuacauauuuau

SEQ ID NO: 3988634 - RNA, 19 nt, Staphylococcus aureus subsp. aureus Mu50
aauauuuuucaauuaaaug

SEQ ID NO: 3988635 - RNA, 13 nt, Staphylococcus aureus subsp. aureus Mu50
aauauuuuuuaaa

SEQ ID NO: 3988636 - RNA, 18 nt, Staphylococcus aureus subsp. aureus Mu50
aauauuuuuuaaaaugau

SEQ ID NO: 3988637 - RNA, 15 nt, Staphylococcus aureus subsp. aureus Mu50
aaucaaaaaagacau

SEQ ID NO: 3988638 - RNA, 13 nt, Staphylococcus aureus subsp. aureus Mu50
aaucaaaaauaau

SEQ ID NO: 3988639 - RNA, 16 nt, Staphylococcus aureus subsp. aureus Mu50
aaucaaaauuaugacu

SEQ ID NO: 3988640 - RNA, 12 nt, Staphylococcus aureus subsp. aureus Mu50
aaucaaagagga

SEQ ID NO: 3988641 - RNA, 20 nt, Staphylococcus aureus subsp. aureus Mu50
aaucaaagaggcuuuaaaau

SEQ ID NO: 3988642 - RNA, 13 nt, Staphylococcus aureus subsp. aureus Mu50
aaucaaagauuuu

SEQ ID NO: 3988643 - RNA, 17 nt, Staphylococcus aureus subsp. aureus Mu50
aaucaaagcuauauaug

SEQ ID NO: 3988644 - RNA, 20 nt, Staphylococcus aureus subsp. aureus Mu50
aauccuuuauauuuaguuag

SEQ ID NO: 3988645 - RNA, 16 nt, Staphylococcus aureus subsp. aureus Mu50
aaucgaaaauaucaau

SEQ ID NO: 3988646 - RNA, 19 nt, Staphylococcus aureus subsp. aureus Mu50
aaucgaaccaaauuuuaua

SEQ ID NO: 3988647 - RNA, 21 nt, Staphylococcus aureus subsp. aureus Mu50
aaucgaauugauggaaaaguu

SEQ ID NO: 3988648 - RNA, 17 nt, Staphylococcus aureus subsp. aureus Mu50
aaucgagugauucagga

SEQ ID NO: 3988649 - RNA, 15 nt, Staphylococcus aureus subsp. aureus Mu50
aaucgaguuugaaau

SEQ ID NO: 3988650 - RNA, 14 nt, Staphylococcus aureus subsp. aureus Mu50
aaucgauaaaaugu

SEQ ID NO: 3988651 - RNA, 14 nt, Staphylococcus aureus subsp. aureus Mu50
aaucgauaacaguu

SEQ ID NO: 3988652 - RNA, 15 nt, Staphylococcus aureus subsp. aureus Mu50
aaucgauauaaugaa

SEQ ID NO: 3988653 - RNA, 15 nt, Staphylococcus aureus subsp. aureus Mu50
aaucgauauugagaa

SEQ ID NO: 3988654 - RNA, 22 nt, Staphylococcus aureus subsp. aureus Mu50
aaucgauuuuauaucuuucuga

SEQ ID NO: 3988655 - RNA, 14 nt, Staphylococcus aureus subsp. aureus Mu50
aaucgcauuuaaau

SEQ ID NO: 3988656 - RNA, 16 nt, Staphylococcus aureus subsp. aureus Mu50
aaucgcauuuaaauau

SEQ ID NO: 3988657 - RNA, 17 nt, Staphylococcus aureus subsp. aureus Mu50
aaucgcauuuaaauaua

SEQ ID NO: 3988658 - RNA, 14 nt, Staphylococcus aureus subsp. aureus Mu50
aaucgcauuuuguu

SEQ ID NO: 3988659 - RNA, 17 nt, Staphylococcus aureus subsp. aureus Mu50
aaucgcauuuuguuuca

SEQ ID NO: 3988660 - RNA, 14 nt, Staphylococcus aureus subsp. aureus Mu50
aaucgccauugucc

SEQ ID NO: 3988661 - RNA, 18 nt, Staphylococcus aureus subsp. aureus Mu50
aaucggaauaaaauaaau

SEQ ID NO: 3988662 - RNA, 19 nt, Staphylococcus aureus subsp. aureus Mu50
aaucggacagaggagcuca

SEQ ID NO: 3988663 - RNA, 20 nt, Staphylococcus aureus subsp. aureus Mu50
aaucggaucauuauuuagaa

SEQ ID NO: 3988664 - RNA, 18 nt, Staphylococcus aureus subsp. aureus Mu50
aaucggcuauacauugau

SEQ ID NO: 3988665 - RNA, 18 nt, Staphylococcus aureus subsp. aureus Mu50
aaucgggaugauaaccaa

SEQ ID NO: 3988666 - RNA, 18 nt, Staphylococcus aureus subsp. aureus Mu50
aaucguaacuaacauguu

SEQ ID NO: 3988667 - RNA, 15 nt, Staphylococcus aureus subsp. aureus Mu50
aaucguaucuucacu

SEQ ID NO: 3988668 - RNA, 14 nt, Staphylococcus aureus subsp. aureus Mu50
aaucguauucauau

SEQ ID NO: 3988669 - RNA, 16 nt, Staphylococcus aureus subsp. aureus Mu50
aaucgugcuguuauca

SEQ ID NO: 3988670 - RNA, 22 nt, Staphylococcus aureus subsp. aureus Mu50
aaucguuaaaacacccugcuua

SEQ ID NO: 3988671 - RNA, 19 nt, Staphylococcus aureus subsp. aureus Mu50
aaucguuguggcuuuuuau

SEQ ID NO: 3988672 - RNA, 15 nt, Staphylococcus aureus subsp. aureus Mu50
aaucguuucaugcac

SEQ ID NO: 3988673 - RNA, 12 nt, Staphylococcus aureus subsp. aureus Mu50
aaucguuugcca

SEQ ID NO: 3988674 - RNA, 15 nt, Staphylococcus aureus subsp. aureus Mu50
aaucuaacugugcaa

SEQ ID NO: 3988675 - RNA, 18 nt, Staphylococcus aureus subsp. aureus Mu50
aaucuaauccugguauaa

SEQ ID NO: 3988676 - RNA, 22 nt, Staphylococcus aureus subsp. aureus Mu50
aaucuacaauauuaaaauuaaa

SEQ ID NO: 3988677 - RNA, 18 nt, Staphylococcus aureus subsp. aureus Mu50
aaucuacgauuuucaaga

SEQ ID NO: 3988678 - RNA, 18 nt, Staphylococcus aureus subsp. aureus Mu50
aaucuagaauauaacaac

SEQ ID NO: 3988679 - RNA, 19 nt, Staphylococcus aureus subsp. aureus Mu50
aaucuagaccuucaauauc

SEQ ID NO: 3988680 - RNA, 14 nt, Staphylococcus aureus subsp. aureus Mu50
aaucuauaaauauc

SEQ ID NO: 3988681 - RNA, 21 nt, Staphylococcus aureus subsp. aureus Mu50
aaucuauaccauuccaaaaau

SEQ ID NO: 3988682 - RNA, 13 nt, Staphylococcus aureus subsp. aureus Mu50
aaucuauauaaag

SEQ ID NO: 3988683 - RNA, 12 nt, Staphylococcus aureus subsp. aureus Mu50
aaucuauauaua

SEQ ID NO: 3988684 - RNA, 17 nt, Staphylococcus aureus subsp. aureus Mu50
aaucuauggaaaauguu

SEQ ID NO: 3988685 - RNA, 18 nt, Staphylococcus aureus subsp. aureus Mu50
aaucuauggaaaauguua

SEQ ID NO: 3988686 - RNA, 13 nt, Staphylococcus aureus subsp. aureus Mu50
aaucuauuuuaaa

SEQ ID NO: 3988687 - RNA, 16 nt, Staphylococcus aureus subsp. aureus Mu50
aaucuauuuuaaacuc

SEQ ID NO: 3988688 - RNA, 19 nt, Staphylococcus aureus subsp. aureus Mu50
aaucuauuuucugccauaa

SEQ ID NO: 3988689 - RNA, 12 nt, Staphylococcus aureus subsp. aureus Mu50
aaucucaaaauu

SEQ ID NO: 3988690 - RNA, 13 nt, Staphylococcus aureus subsp. aureus Mu50
aaucucaaaauuu

SEQ ID NO: 3988691 - RNA, 16 nt, Staphylococcus aureus subsp. aureus Mu50
aaucucauaauaauuc

SEQ ID NO: 3988692 - RNA, 17 nt, Staphylococcus aureus subsp. aureus Mu50
aaucucauucuuuaaua

SEQ ID NO: 3988693 - RNA, 17 nt, Staphylococcus aureus subsp. aureus Mu50
aaucuccauuagaacua

SEQ ID NO: 3988694 - RNA, 22 nt, Staphylococcus aureus subsp. aureus Mu50
aaucuccauuuaaggauuuccu

SEQ ID NO: 3988695 - RNA, 20 nt, Staphylococcus aureus subsp. aureus Mu50
aaucucggcauuuuuauauu

SEQ ID NO: 3988696 - RNA, 19 nt, Staphylococcus aureus subsp. aureus Mu50
aaucucgguacauuuaaug

SEQ ID NO: 3988697 - RNA, 20 nt, Staphylococcus aureus subsp. aureus Mu50
aaucucgucacauauaaaua

SEQ ID NO: 3988698 - RNA, 21 nt, Staphylococcus aureus subsp. aureus Mu50
aaucucgucacauauaaauau

SEQ ID NO: 3988699 - RNA, 17 nt, Staphylococcus aureus subsp. aureus Mu50
aaucucguuuuuacaug

SEQ ID NO: 3988700 - RNA, 22 nt, Staphylococcus aureus subsp. aureus Mu50
aaucucucgcuaaauuuauaua

SEQ ID NO: 3988701 - RNA, 16 nt, Staphylococcus aureus subsp. aureus Mu50
aaucucuuuacaccau

SEQ ID NO: 3988702 - RNA, 15 nt, Staphylococcus aureus subsp. aureus Mu50
aaucucuuuagauga

SEQ ID NO: 3988703 - RNA, 18 nt, Staphylococcus aureus subsp. aureus Mu50
aaucucuuuuugauuaua

SEQ ID NO: 3988704 - RNA, 15 nt, Staphylococcus aureus subsp. aureus Mu50
aaucugauucauuaa

SEQ ID NO: 3988705 - RNA, 16 nt, Staphylococcus aureus subsp. aureus Mu50
aaucugauucauuaaa

SEQ ID NO: 3988706 - RNA, 15 nt, Staphylococcus aureus subsp. aureus Mu50
aaucugcaaaugccu

SEQ ID NO: 3988707 - RNA, 20 nt, Staphylococcus aureus subsp. aureus Mu50
aaucugcaacgauuuuaaaa

SEQ ID NO: 3988708 - RNA, 14 nt, Staphylococcus aureus subsp. aureus Mu50
aaucugcuuuauuu

SEQ ID NO: 3988709 - RNA, 21 nt, Staphylococcus aureus subsp. aureus Mu50
aaucuggcacuuaagcuuuaa

SEQ ID NO: 3988710 - RNA, 14 nt, Staphylococcus aureus subsp. aureus Mu50
aaucuguuuaaauu

SEQ ID NO: 3988711 - RNA, 17 nt, Staphylococcus aureus subsp. aureus Mu50
aaucuguuuaaauuuaa

SEQ ID NO: 3988712 - RNA, 21 nt, Staphylococcus aureus subsp. aureus Mu50
aaucuguuuaaauuuaaaaga

SEQ ID NO: 3988713 - RNA, 18 nt, Staphylococcus aureus subsp. aureus Mu50
aaucuuaauauugauuaa

SEQ ID NO: 3988714 - RNA, 18 nt, Staphylococcus aureus subsp. aureus Mu50
aaucuuaguacaaaauug

SEQ ID NO: 3988715 - RNA, 13 nt, Staphylococcus aureus subsp. aureus Mu50
aaucuuauuuugu

SEQ ID NO: 3988716 - RNA, 14 nt, Staphylococcus aureus subsp. aureus Mu50
aaucuuauuuuguu

SEQ ID NO: 3988717 - RNA, 17 nt, Staphylococcus aureus subsp. aureus Mu50
aaucuucauuaauuaca

SEQ ID NO: 3988718 - RNA, 18 nt, Staphylococcus aureus subsp. aureus Mu50
aaucuucuaauuaagaau

SEQ ID NO: 3988719 - RNA, 16 nt, Staphylococcus aureus subsp. aureus Mu50
aaucuugauuauauuu

SEQ ID NO: 3988720 - RNA, 19 nt, Staphylococcus aureus subsp. aureus Mu50
aaucuuguugaacucugau

SEQ ID NO: 3988721 - RNA, 22 nt, Staphylococcus aureus subsp. aureus Mu50
aaucuuguuggauuuuaacaag

SEQ ID NO: 3988722 - RNA, 19 nt, Staphylococcus aureus subsp. aureus Mu50
aaucuuguuuucauuuaaa

SEQ ID NO: 3988723 - RNA, 20 nt, Staphylococcus aureus subsp. aureus Mu50
aaucuuguuuucauuuaaaa

SEQ ID NO: 3988724 - RNA, 13 nt, Staphylococcus aureus subsp. aureus Mu50
aaucuuuaaaugu

SEQ ID NO: 3988725 - RNA, 19 nt, Staphylococcus aureus subsp. aureus Mu50
aaucuuuacuuguaauuaa

SEQ ID NO: 3988726 - RNA, 22 nt, Staphylococcus aureus subsp. aureus Mu50
aaucuuuacuuguaauuaauac

SEQ ID NO: 3988727 - RNA, 14 nt, Staphylococcus aureus subsp. aureus Mu50
aaucuuuaucaguu

SEQ ID NO: 3988728 - RNA, 15 nt, Staphylococcus aureus subsp. aureus Mu50
aaucuuuaucaguuu

SEQ ID NO: 3988729 - RNA, 20 nt, Staphylococcus aureus subsp. aureus Mu50
aaucuuuuaaauuuaguauc

SEQ ID NO: 3988730 - RNA, 13 nt, Staphylococcus aureus subsp. aureus Mu50
aaucuuuuaacuu

SEQ ID NO: 3988731 - RNA, 19 nt, Staphylococcus aureus subsp. aureus Mu50
aaucuuuuagcuuuuguaa

SEQ ID NO: 3988732 - RNA, 12 nt, Staphylococcus aureus subsp. aureus Mu50
aaugcuauauuu

SEQ ID NO: 3988733 - RNA, 14 nt, Staphylococcus aureus subsp. aureus Mu50
aaugcuauauuuag

SEQ ID NO: 3988734 - RNA, 20 nt, Staphylococcus aureus subsp. aureus Mu50
aaugcuauauuuagaaugau

SEQ ID NO: 3988735 - RNA, 17 nt, Staphylococcus aureus subsp. aureus Mu50
aaugcucccuucaaagu

SEQ ID NO: 3988736 - RNA, 19 nt, Staphylococcus aureus subsp. aureus Mu50
aaugcucccuucaaaguag

SEQ ID NO: 3988737 - RNA, 15 nt, Staphylococcus aureus subsp. aureus Mu50
aaugcucuauauauc

SEQ ID NO: 3988738 - RNA, 19 nt, Staphylococcus aureus subsp. aureus Mu50
aaugcucuauauauccauu

SEQ ID NO: 3988739 - RNA, 20 nt, Staphylococcus aureus subsp. aureus Mu50
aaugcucuauauauccauuc

SEQ ID NO: 3988740 - RNA, 15 nt, Staphylococcus aureus subsp. aureus Mu50
aaugcuguacuauau

SEQ ID NO: 3988741 - RNA, 18 nt, Staphylococcus aureus subsp. aureus Mu50
aaugcuuauauaaacaaa

SEQ ID NO: 3988742 - RNA, 18 nt, Staphylococcus aureus subsp. aureus Mu50
aaugcuucaaauguaaca

SEQ ID NO: 3988743 - RNA, 18 nt, Staphylococcus aureus subsp. aureus Mu50
aaugcuugaauuuuauua

SEQ ID NO: 3988744 - RNA, 15 nt, Staphylococcus aureus subsp. aureus Mu50
aaugcuuuaauaaau

SEQ ID NO: 3988745 - RNA, 17 nt, Staphylococcus aureus subsp. aureus Mu50
aaugcuuuagcauuauu

SEQ ID NO: 3988746 - RNA, 14 nt, Staphylococcus aureus subsp. aureus Mu50
aauggaaagacguu

SEQ ID NO: 3988747 - RNA, 16 nt, Staphylococcus aureus subsp. aureus Mu50
aauggaugaauauauu

SEQ ID NO: 3988748 - RNA, 16 nt, Staphylococcus aureus subsp. aureus Mu50
aauggcaaucuauaua

SEQ ID NO: 3988749 - RNA, 19 nt, Staphylococcus aureus subsp. aureus Mu50
aauggcaaucuauauaaau

SEQ ID NO: 3988750 - RNA, 21 nt, Staphylococcus aureus subsp. aureus Mu50
aauggcaaucuauauaaaugu

SEQ ID NO: 3988751 - RNA, 20 nt, Staphylococcus aureus subsp. aureus Mu50
aauggcaauuaaaacuauaa

SEQ ID NO: 3988752 - RNA, 19 nt, Staphylococcus aureus subsp. aureus Mu50
aauggcaccauacuucguu

SEQ ID NO: 3988753 - RNA, 16 nt, Staphylococcus aureus subsp. aureus Mu50
aauggcacuuaauaua

SEQ ID NO: 3988754 - RNA, 16 nt, Staphylococcus aureus subsp. aureus Mu50
aauggcuccauuuaau

SEQ ID NO: 3988755 - RNA, 21 nt, Staphylococcus aureus subsp. aureus Mu50
aauggcuccauuuaauuuguu

SEQ ID NO: 3988756 - RNA, 22 nt, Staphylococcus aureus subsp. aureus Mu50
aaugggaauuguauuagcaauu

SEQ ID NO: 3988757 - RNA, 18 nt, Staphylococcus aureus subsp. aureus Mu50
aaugggcgauaaaaguug

SEQ ID NO: 3988758 - RNA, 15 nt, Staphylococcus aureus subsp. aureus Mu50
aaugggcgugccauu

SEQ ID NO: 3988759 - RNA, 14 nt, Staphylococcus aureus subsp. aureus Mu50
aaugguaaguaugg

SEQ ID NO: 3988760 - RNA, 18 nt, Staphylococcus aureus subsp. aureus Mu50
aauggucuaauaucaauu

SEQ ID NO: 3988761 - RNA, 23 nt, Staphylococcus aureus subsp. aureus Mu50
aaugguuaauaacccauuuucaa

SEQ ID NO: 3988762 - RNA, 17 nt, Staphylococcus aureus subsp. aureus Mu50
aaugguucauagugaaa

SEQ ID NO: 3988763 - RNA, 23 nt, Staphylococcus aureus subsp. aureus Mu50
aaugguugauuauauuucucaua

SEQ ID NO: 3988764 - RNA, 14 nt, Staphylococcus aureus subsp. aureus Mu50
aauguaacauuaaa

SEQ ID NO: 3988765 - RNA, 18 nt, Staphylococcus aureus subsp. aureus Mu50
aauguaagcgaauacaau

SEQ ID NO: 3988766 - RNA, 17 nt, Staphylococcus aureus subsp. aureus Mu50
aauguacauguauaaaa

SEQ ID NO: 3988767 - RNA, 18 nt, Staphylococcus aureus subsp. aureus Mu50
aauguacauuguaaauau

SEQ ID NO: 3988768 - RNA, 21 nt, Staphylococcus aureus subsp. aureus Mu50
aauguacauuguaaauauagu

SEQ ID NO: 3988769 - RNA, 15 nt, Staphylococcus aureus subsp. aureus Mu50
aauguacuaggaccu

SEQ ID NO: 3988770 - RNA, 15 nt, Staphylococcus aureus subsp. aureus Mu50
aauguacuuuucugu

SEQ ID NO: 3988771 - RNA, 14 nt, Staphylococcus aureus subsp. aureus Mu50
aauguagauuacuu

SEQ ID NO: 3988772 - RNA, 20 nt, Staphylococcus aureus subsp. aureus Mu50
aauguaggcgccauaaucau

SEQ ID NO: 3988773 - RNA, 21 nt, Staphylococcus aureus subsp. aureus Mu50
aauguaguuaagauaccuuuu

SEQ ID NO: 3988774 - RNA, 14 nt, Staphylococcus aureus subsp. aureus Mu50
aauguauaaaaagu

SEQ ID NO: 3988775 - RNA, 14 nt, Staphylococcus aureus subsp. aureus Mu50
aauguauaucgaca

SEQ ID NO: 3988776 - RNA, 15 nt, Staphylococcus aureus subsp. aureus Mu50
aauguauauuuaaca

SEQ ID NO: 3988777 - RNA, 17 nt, Staphylococcus aureus subsp. aureus Mu50
aauguauauuuaacauc

SEQ ID NO: 3988778 - RNA, 19 nt, Staphylococcus aureus subsp. aureus Mu50
aauguaucaagaucaacaa

SEQ ID NO: 3988779 - RNA, 24 nt, Staphylococcus aureus subsp. aureus Mu50
aauguaucacauucaauauuugaa

SEQ ID NO: 3988780 - RNA, 13 nt, Staphylococcus aureus subsp. aureus Mu50
aauguaucaccua

SEQ ID NO: 3988781 - RNA, 15 nt, Staphylococcus aureus subsp. aureus Mu50
aauguaucacuugga

SEQ ID NO: 3988782 - RNA, 13 nt, Staphylococcus aureus subsp. aureus Mu50
aauguaucauuuc

SEQ ID NO: 3988783 - RNA, 19 nt, Staphylococcus aureus subsp. aureus Mu50
aauguauucagucaguaaa

SEQ ID NO: 3988784 - RNA, 15 nt, Staphylococcus aureus subsp. aureus Mu50
aaugucauagacuac

SEQ ID NO: 3988785 - RNA, 22 nt, Staphylococcus aureus subsp. aureus Mu50
aauguccgacuugauaaaaaau

SEQ ID NO: 3988786 - RNA, 18 nt, Staphylococcus aureus subsp. aureus Mu50
aaugucgauauuucuagu

SEQ ID NO: 3988787 - RNA, 19 nt, Staphylococcus aureus subsp. aureus Mu50
aaugucgauauuucuaguu

SEQ ID NO: 3988788 - RNA, 18 nt, Staphylococcus aureus subsp. aureus Mu50
aaugucgaucuaacaauu

SEQ ID NO: 3988789 - RNA, 22 nt, Staphylococcus aureus subsp. aureus Mu50
aaugucgaucuaacaauugcag

SEQ ID NO: 3988790 - RNA, 15 nt, Staphylococcus aureus subsp. aureus Mu50
aaugucguauaugua

SEQ ID NO: 3988791 - RNA, 16 nt, Staphylococcus aureus subsp. aureus Mu50
aaugucuaaaaauguc

SEQ ID NO: 3988792 - RNA, 19 nt, Staphylococcus aureus subsp. aureus Mu50
aaugucucuuuucacgaau

SEQ ID NO: 3988793 - RNA, 15 nt, Staphylococcus aureus subsp. aureus Mu50
aaugucuuacuuguc

SEQ ID NO: 3988794 - RNA, 14 nt, Staphylococcus aureus subsp. aureus Mu50
aaugucuuacuuuu

SEQ ID NO: 3988795 - RNA, 15 nt, Staphylococcus aureus subsp. aureus Mu50
aaugugagauauaaa

SEQ ID NO: 3988796 - RNA, 19 nt, Staphylococcus aureus subsp. aureus Mu50
aaugugcaauuagaauaua

SEQ ID NO: 3988797 - RNA, 20 nt, Staphylococcus aureus subsp. aureus Mu50
aaugugcaauuagaauauau

SEQ ID NO: 3988798 - RNA, 15 nt, Staphylococcus aureus subsp. aureus Mu50
aaugugcauuuaucu

SEQ ID NO: 3988799 - RNA, 22 nt, Staphylococcus aureus subsp. aureus Mu50
aaugugcugugucuuuugauuu

SEQ ID NO: 3988800 - RNA, 14 nt, Staphylococcus aureus subsp. aureus Mu50
aauguguaugguuu

SEQ ID NO: 3988801 - RNA, 23 nt, Staphylococcus aureus subsp. aureus Mu50
aauguguaugguuuuguacauau

SEQ ID NO: 3988802 - RNA, 14 nt, Staphylococcus aureus subsp. aureus Mu50
aauguguuaauacu

SEQ ID NO: 3988803 - RNA, 18 nt, Staphylococcus aureus subsp. aureus Mu50
aauguguuaauacuucau

SEQ ID NO: 3988804 - RNA, 23 nt, Staphylococcus aureus subsp. aureus Mu50
aauguguuaauacuucauauccu

SEQ ID NO: 3988805 - RNA, 17 nt, Staphylococcus aureus subsp. aureus Mu50
aauguguuuucaacagu

SEQ ID NO: 3988806 - RNA, 15 nt, Staphylococcus aureus subsp. aureus Mu50
aauguuaaaauaacu

SEQ ID NO: 3988807 - RNA, 17 nt, Staphylococcus aureus subsp. aureus Mu50
aauguuaaagauuauua

SEQ ID NO: 3988808 - RNA, 16 nt, Staphylococcus aureus subsp. aureus Mu50
aauguuaaauucuaaa

SEQ ID NO: 3988809 - RNA, 17 nt, Staphylococcus aureus subsp. aureus Mu50
aauguuaaauucuaaaa

SEQ ID NO: 3988810 - RNA, 17 nt, Staphylococcus aureus subsp. aureus Mu50
aauguuaacugcaaacu

SEQ ID NO: 3988811 - RNA, 18 nt, Staphylococcus aureus subsp. aureus Mu50
aauguuacacaaauuaaa

SEQ ID NO: 3988812 - RNA, 14 nt, Staphylococcus aureus subsp. aureus Mu50
aauguuaggugaaa

SEQ ID NO: 3988813 - RNA, 17 nt, Staphylococcus aureus subsp. aureus Mu50
aauguuaucuugcuuau

SEQ ID NO: 3988814 - RNA, 16 nt, Staphylococcus aureus subsp. aureus Mu50
aauguuauuaaccauc

SEQ ID NO: 3988815 - RNA, 14 nt, Staphylococcus aureus subsp. aureus Mu50
aauguucaaaaaau

SEQ ID NO: 3988816 - RNA, 17 nt, Staphylococcus aureus subsp. aureus Mu50
aauguucaaaaaaugaa

SEQ ID NO: 3988817 - RNA, 15 nt, Staphylococcus aureus subsp. aureus Mu50
aauguucaauuuaua

SEQ ID NO: 3988818 - RNA, 17 nt, Staphylococcus aureus subsp. aureus Mu50
aauguucccuucaaagu

SEQ ID NO: 3988819 - RNA, 20 nt, Staphylococcus aureus subsp. aureus Mu50
aauguuccuuguuuuaaacu

SEQ ID NO: 3988820 - RNA, 22 nt, Staphylococcus aureus subsp. aureus Mu50
aauuauaaguagugauuuuuua

SEQ ID NO: 3988821 - RNA, 22 nt, Staphylococcus aureus subsp. aureus Mu50
aauuauaauaaaacuugugaua

SEQ ID NO: 3988822 - RNA, 20 nt, Staphylococcus aureus subsp. aureus Mu50
aauuauacaaauuauaaauu

SEQ ID NO: 3988823 - RNA, 21 nt, Staphylococcus aureus subsp. aureus Mu50
aauuauacguuacuaaacuuu

SEQ ID NO: 3988824 - RNA, 15 nt, Staphylococcus aureus subsp. aureus Mu50
aauuauauguuuuua

SEQ ID NO: 3988825 - RNA, 16 nt, Staphylococcus aureus subsp. aureus Mu50
aauuaucaacauaaua

SEQ ID NO: 3988826 - RNA, 17 nt, Staphylococcus aureus subsp. aureus Mu50
aauuaucagaaucaagu

SEQ ID NO: 3988827 - RNA, 18 nt, Staphylococcus aureus subsp. aureus Mu50
aauuaucagaaucaagua

SEQ ID NO: 3988828 - RNA, 15 nt, Staphylococcus aureus subsp. aureus Mu50
aauuaucauaaagau

SEQ ID NO: 3988829 - RNA, 20 nt, Staphylococcus aureus subsp. aureus Mu50
aauuaucauaugugauuuaa

SEQ ID NO: 3988830 - RNA, 12 nt, Staphylococcus aureus subsp. aureus Mu50
aauuaucauuac

SEQ ID NO: 3988831 - RNA, 15 nt, Staphylococcus aureus subsp. aureus Mu50
aauuaucuuaaguca

SEQ ID NO: 3988832 - RNA, 20 nt, Staphylococcus aureus subsp. aureus Mu50
aauuaucuuaagucaucaau

SEQ ID NO: 3988833 - RNA, 14 nt, Staphylococcus aureus subsp. aureus Mu50
aauuaucuucauca

SEQ ID NO: 3988834 - RNA, 16 nt, Staphylococcus aureus subsp. aureus Mu50
aauuaucuucaucauu

SEQ ID NO: 3988835 - RNA, 14 nt, Staphylococcus aureus subsp. aureus Mu50
aauuaucuuuagua

SEQ ID NO: 3988836 - RNA, 21 nt, Staphylococcus aureus subsp. aureus Mu50
aauuaugacuuauuuuucauc

SEQ ID NO: 3988837 - RNA, 23 nt, Staphylococcus aureus subsp. aureus Mu50
aauuaugauuauauuuucucaua

SEQ ID NO: 3988838 - RNA, 19 nt, Staphylococcus aureus subsp. aureus Mu50
aauuauggagcggaagaua

SEQ ID NO: 3988839 - RNA, 17 nt, Staphylococcus aureus subsp. aureus Mu50
aauuauggauaaaauuu

SEQ ID NO: 3988840 - RNA, 19 nt, Staphylococcus aureus subsp. aureus Mu50
aauuauggcagauccauaa

SEQ ID NO: 3988841 - RNA, 20 nt, Staphylococcus aureus subsp. aureus Mu50
aauuauguaaaaaauaucuu

SEQ ID NO: 3988842 - RNA, 20 nt, Staphylococcus aureus subsp. aureus Mu50
aauuauguauuuuuauuuau

SEQ ID NO: 3988843 - RNA, 13 nt, Staphylococcus aureus subsp. aureus Mu50
aauuauuaauaag

SEQ ID NO: 3988844 - RNA, 15 nt, Staphylococcus aureus subsp. aureus Mu50
aauuauuaauuuaau

SEQ ID NO: 3988845 - RNA, 16 nt, Staphylococcus aureus subsp. aureus Mu50
aauuauuaauuuaauc

SEQ ID NO: 3988846 - RNA, 18 nt, Staphylococcus aureus subsp. aureus Mu50
aauuauuaauuuaaucca

SEQ ID NO: 3988847 - RNA, 23 nt, Staphylococcus aureus subsp. aureus Mu50
aauuauuagaacguaauguuaca

SEQ ID NO: 3988848 - RNA, 18 nt, Staphylococcus aureus subsp. aureus Mu50
aauuauuauaguuuagau

SEQ ID NO: 3988849 - RNA, 19 nt, Staphylococcus aureus subsp. aureus Mu50
aauuauuauaguuuagauu

SEQ ID NO: 3988850 - RNA, 20 nt, Staphylococcus aureus subsp. aureus Mu50
aauuauuauuuaaauuuuca

SEQ ID NO: 3988851 - RNA, 16 nt, Staphylococcus aureus subsp. aureus Mu50
aauuauucaaguaaua

SEQ ID NO: 3988852 - RNA, 20 nt, Staphylococcus aureus subsp. aureus Mu50
aauuauucaaguaauaucuu

SEQ ID NO: 3988853 - RNA, 18 nt, Staphylococcus aureus subsp. aureus Mu50
aauuauugagaauauuua

SEQ ID NO: 3988854 - RNA, 13 nt, Staphylococcus aureus subsp. aureus Mu50
aauuauuguuuua

SEQ ID NO: 3988855 - RNA, 16 nt, Staphylococcus aureus subsp. aureus Mu50
aauuauuuaaaaugcu

SEQ ID NO: 3988856 - RNA, 19 nt, Staphylococcus aureus subsp. aureus Mu50
aauuauuuaauuuuucuaa

SEQ ID NO: 3988857 - RNA, 16 nt, Staphylococcus aureus subsp. aureus Mu50
aauuauuuagaaacuu

SEQ ID NO: 3988858 - RNA, 19 nt, Staphylococcus aureus subsp. aureus Mu50
aauuauuuauucauuauag

SEQ ID NO: 3988859 - RNA, 18 nt, Staphylococcus aureus subsp. aureus Mu50
aauuauuucaauuaucaa

SEQ ID NO: 3988860 - RNA, 11 nt, Staphylococcus aureus subsp. aureus Mu50
aauuauuucau

SEQ ID NO: 3988861 - RNA, 22 nt, Staphylococcus aureus subsp. aureus Mu50
aauuauuucccuggaaaaugau

SEQ ID NO: 3988862 - RNA, 23 nt, Staphylococcus aureus subsp. aureus Mu50
aauuauuucccuggaaaaugauu

SEQ ID NO: 3988863 - RNA, 13 nt, Staphylococcus aureus subsp. aureus Mu50
aauuauuucucuu

SEQ ID NO: 3988864 - RNA, 17 nt, Staphylococcus aureus subsp. aureus Mu50
aauuauuuuaaaaaaug

SEQ ID NO: 3988865 - RNA, 19 nt, Staphylococcus aureus subsp. aureus Mu50
aauuauuuuaaaaaaugau

SEQ ID NO: 3988866 - RNA, 19 nt, Staphylococcus aureus subsp. aureus Mu50
aauuauuuucucgauacaa

SEQ ID NO: 3988867 - RNA, 20 nt, Staphylococcus aureus subsp. aureus Mu50
aauuauuuucucgauacaaa

SEQ ID NO: 3988868 - RNA, 18 nt, Staphylococcus aureus subsp. aureus Mu50
aauuauuuuucaaauaua

SEQ ID NO: 3988869 - RNA, 18 nt, Staphylococcus aureus subsp. aureus Mu50
aauucaaaaugccaagaa

SEQ ID NO: 3988870 - RNA, 19 nt, Staphylococcus aureus subsp. aureus Mu50
aauucaaccaauuauuaaa

SEQ ID NO: 3988871 - RNA, 18 nt, Staphylococcus aureus subsp. aureus Mu50
aauucaacuaugaaauug

SEQ ID NO: 3988872 - RNA, 22 nt, Staphylococcus aureus subsp. aureus Mu50
aauucaacuuaaauggaugaua

SEQ ID NO: 3988873 - RNA, 12 nt, Staphylococcus aureus subsp. aureus Mu50
aauucaacuuua

SEQ ID NO: 3988874 - RNA, 23 nt, Staphylococcus aureus subsp. aureus Mu50
aauucaacuuuaaucaaaaaaga

SEQ ID NO: 3988875 - RNA, 14 nt, Staphylococcus aureus subsp. aureus Mu50
aauucaauaccuaa

SEQ ID NO: 3988876 - RNA, 23 nt, Staphylococcus aureus subsp. aureus Mu50
aauucaauauuaaucauaaugaa

SEQ ID NO: 3988877 - RNA, 15 nt, Staphylococcus aureus subsp. aureus Mu50
aauucaaugauuuuu

SEQ ID NO: 3988878 - RNA, 17 nt, Staphylococcus aureus subsp. aureus Mu50
aauucaaugauuuuuaa

SEQ ID NO: 3988879 - RNA, 15 nt, Staphylococcus aureus subsp. aureus Mu50
aauucacgagcugcu

SEQ ID NO: 3988880 - RNA, 17 nt, Staphylococcus aureus subsp. aureus Mu50
aauucacgcaauaucau

SEQ ID NO: 3988881 - RNA, 11 nt, Staphylococcus aureus subsp. aureus Mu50
aauucacuuua

SEQ ID NO: 3988882 - RNA, 22 nt, Staphylococcus aureus subsp. aureus Mu50
aauucagcugaugcuucgaauu

SEQ ID NO: 3988883 - RNA, 23 nt, Staphylococcus aureus subsp. aureus Mu50
aauucaguaaucuuguuuucauu

SEQ ID NO: 3988884 - RNA, 15 nt, Staphylococcus aureus subsp. aureus Mu50
aauucaguaucuaaa

SEQ ID NO: 3988885 - RNA, 21 nt, Staphylococcus aureus subsp. aureus Mu50
aauucaguaucuaaauauuaa

SEQ ID NO: 3988886 - RNA, 21 nt, Staphylococcus aureus subsp. aureus Mu50
aauucaguucaaacagaaauu

SEQ ID NO: 3988887 - RNA, 16 nt, Staphylococcus aureus subsp. aureus Mu50
aauucauuuuauaaau

SEQ ID NO: 3988888 - RNA, 20 nt, Staphylococcus aureus subsp. aureus Mu50
aauucauuuuauaaaucaaa

SEQ ID NO: 3988889 - RNA, 21 nt, Staphylococcus aureus subsp. aureus Mu50
aauucauuuuauaaaucaaag

SEQ ID NO: 3988890 - RNA, 17 nt, Staphylococcus aureus subsp. aureus Mu50
aauuccaaagaaagcua

SEQ ID NO: 3988891 - RNA, 15 nt, Staphylococcus aureus subsp. aureus Mu50
aauuccauuaaguua

SEQ ID NO: 3988892 - RNA, 14 nt, Staphylococcus aureus subsp. aureus Mu50
aauucccaaccuuc

SEQ ID NO: 3988893 - RNA, 13 nt, Staphylococcus aureus subsp. aureus Mu50
aauucccauguau

SEQ ID NO: 3988894 - RNA, 21 nt, Staphylococcus aureus subsp. aureus Mu50
aauuccccaaagccuucuauc

SEQ ID NO: 3988895 - RNA, 21 nt, Staphylococcus aureus subsp. aureus Mu50
aauuccucuggaacuuuaaua

SEQ ID NO: 3988896 - RNA, 19 nt, Staphylococcus aureus subsp. aureus Mu50
aauuccuggugcaauaaua

SEQ ID NO: 3988897 - RNA, 20 nt, Staphylococcus aureus subsp. aureus Mu50
aauuccuggugcaauaauaa

SEQ ID NO: 3988898 - RNA, 21 nt, Staphylococcus aureus subsp. aureus Mu50
aauuccuggugcaauaauaaa

SEQ ID NO: 3988899 - RNA, 13 nt, Staphylococcus aureus subsp. aureus Mu50
aauuccuucuaua

SEQ ID NO: 3988900 - RNA, 18 nt, Staphylococcus aureus subsp. aureus Mu50
aauuccuucuauagcacc

SEQ ID NO: 3988901 - RNA, 13 nt, Staphylococcus aureus subsp. aureus Mu50
aauucgaaaagaa

SEQ ID NO: 3988902 - RNA, 18 nt, Staphylococcus aureus subsp. aureus Mu50
aauucgaacuaucaauau

SEQ ID NO: 3988903 - RNA, 17 nt, Staphylococcus aureus subsp. aureus Mu50
aauucgacucaaacaau

SEQ ID NO: 3988904 - RNA, 18 nt, Staphylococcus aureus subsp. aureus Mu50
aauucgacucaaacaaua

SEQ ID NO: 3988905 - RNA, 19 nt, Staphylococcus aureus subsp. aureus Mu50
aauucgacucaaacaauaa

SEQ ID NO: 3988906 - RNA, 15 nt, Staphylococcus aureus subsp. aureus Mu50
aauucgccaucuuuu

SEQ ID NO: 3988907 - RNA, 18 nt, Staphylococcus aureus subsp. aureus Mu50
aauugcuuguuuuaaaug

SEQ ID NO: 3988908 - RNA, 17 nt, Staphylococcus aureus subsp. aureus Mu50
aauugcuuuagaaaguc

SEQ ID NO: 3988909 - RNA, 20 nt, Staphylococcus aureus subsp. aureus Mu50
aauuggaaucaucuuuuuga

SEQ ID NO: 3988910 - RNA, 18 nt, Staphylococcus aureus subsp. aureus Mu50
aauuggauaauuucuucu

SEQ ID NO: 3988911 - RNA, 16 nt, Staphylococcus aureus subsp. aureus Mu50
aauuggauuaaauacg

SEQ ID NO: 3988912 - RNA, 22 nt, Staphylococcus aureus subsp. aureus Mu50
aauuggauuaucgaauuagauu

SEQ ID NO: 3988913 - RNA, 14 nt, Staphylococcus aureus subsp. aureus Mu50
aauuggauugagau

SEQ ID NO: 3988914 - RNA, 14 nt, Staphylococcus aureus subsp. aureus Mu50
aauugggaaauauu

SEQ ID NO: 3988915 - RNA, 16 nt, Staphylococcus aureus subsp. aureus Mu50
aauugggaaauauuug

SEQ ID NO: 3988916 - RNA, 17 nt, Staphylococcus aureus subsp. aureus Mu50
aauugggaaauauuuga

SEQ ID NO: 3988917 - RNA, 20 nt, Staphylococcus aureus subsp. aureus Mu50
aauugggaaauauuugaaaa

SEQ ID NO: 3988918 - RNA, 23 nt, Staphylococcus aureus subsp. aureus Mu50
aauugguaaaaaucucaaaauuu

SEQ ID NO: 3988919 - RNA, 18 nt, Staphylococcus aureus subsp. aureus Mu50
aauugguuuuuagugaaa

SEQ ID NO: 3988920 - RNA, 15 nt, Staphylococcus aureus subsp. aureus Mu50
aauuguaaagcauga

SEQ ID NO: 3988921 - RNA, 17 nt, Staphylococcus aureus subsp. aureus Mu50
aauuguaaagcaugaau

SEQ ID NO: 3988922 - RNA, 16 nt, Staphylococcus aureus subsp. aureus Mu50
aauuguaaucuauuuu

SEQ ID NO: 3988923 - RNA, 16 nt, Staphylococcus aureus subsp. aureus Mu50
aauuguagauccaauu

SEQ ID NO: 3988924 - RNA, 18 nt, Staphylococcus aureus subsp. aureus Mu50
aauuguagauccaauucc

SEQ ID NO: 3988925 - RNA, 11 nt, Staphylococcus aureus subsp. aureus Mu50
aauuguauaaa

SEQ ID NO: 3988926 - RNA, 13 nt, Staphylococcus aureus subsp. aureus Mu50
aauuguauagaau

SEQ ID NO: 3988927 - RNA, 21 nt, Staphylococcus aureus subsp. aureus Mu50
aauugucacaaucuguucaua

SEQ ID NO: 3988928 - RNA, 20 nt, Staphylococcus aureus subsp. aureus Mu50
aauugucuagguuagaauua

SEQ ID NO: 3988929 - RNA, 22 nt, Staphylococcus aureus subsp. aureus Mu50
aauugugccauuugcaacaaua

SEQ ID NO: 3988930 - RNA, 15 nt, Staphylococcus aureus subsp. aureus Mu50
aauuguggcuacuaa

SEQ ID NO: 3988931 - RNA, 13 nt, Staphylococcus aureus subsp. aureus Mu50
aauuguuaaaccc

SEQ ID NO: 3988932 - RNA, 22 nt, Staphylococcus aureus subsp. aureus Mu50
aauuguuaaacccucauuuuua

SEQ ID NO: 3988933 - RNA, 16 nt, Staphylococcus aureus subsp. aureus Mu50
aauuguuacuaguucu

SEQ ID NO: 3988934 - RNA, 20 nt, Staphylococcus aureus subsp. aureus Mu50
aauuguuauaaguaaauaau

SEQ ID NO: 3988935 - RNA, 11 nt, Staphylococcus aureus subsp. aureus Mu50
aauuguuaucg

SEQ ID NO: 3988936 - RNA, 14 nt, Staphylococcus aureus subsp. aureus Mu50
aauuguuaucguuc

SEQ ID NO: 3988937 - RNA, 19 nt, Staphylococcus aureus subsp. aureus Mu50
aauuguucuaauacaccaa

SEQ ID NO: 3988938 - RNA, 23 nt, Staphylococcus aureus subsp. aureus Mu50
aauuguucuaauacaccaaaucc

SEQ ID NO: 3988939 - RNA, 17 nt, Staphylococcus aureus subsp. aureus Mu50
aauuguucuucagaaac

SEQ ID NO: 3988940 - RNA, 23 nt, Staphylococcus aureus subsp. aureus Mu50
aauuguucuucagaaacuuuuga

SEQ ID NO: 3988941 - RNA, 17 nt, Staphylococcus aureus subsp. aureus Mu50
aauuguuguacauguau

SEQ ID NO: 3988942 - RNA, 18 nt, Staphylococcus aureus subsp. aureus Mu50
aauuguuguacauguauu

SEQ ID NO: 3988943 - RNA, 19 nt, Staphylococcus aureus subsp. aureus Mu50
aauuguuuaauaacaaaau

SEQ ID NO: 3988944 - RNA, 21 nt, Staphylococcus aureus subsp. aureus Mu50
aauuguuuaauaacaaaauua

SEQ ID NO: 3988945 - RNA, 14 nt, Staphylococcus aureus subsp. aureus Mu50
aauuguuuacuaua

SEQ ID NO: 3988946 - RNA, 15 nt, Staphylococcus aureus subsp. aureus Mu50
aauuguuuugagaua

SEQ ID NO: 3988947 - RNA, 17 nt, Staphylococcus aureus subsp. aureus Mu50
aauuguuuuuucuuauu

SEQ ID NO: 3988948 - RNA, 16 nt, Staphylococcus aureus subsp. aureus Mu50
aauuuaaaaagcagua

SEQ ID NO: 3988949 - RNA, 12 nt, Staphylococcus aureus subsp. aureus Mu50
aauuuaaaacaa

SEQ ID NO: 3988950 - RNA, 16 nt, Staphylococcus aureus subsp. aureus Mu50
aauuuaaaacaaugau

SEQ ID NO: 3988951 - RNA, 22 nt, Staphylococcus aureus subsp. aureus Mu50
aauuuaaaacaaugauuaaaau

SEQ ID NO: 3988952 - RNA, 14 nt, Staphylococcus aureus subsp. aureus Mu50
aauuuaaaagaaaa

SEQ ID NO: 3988953 - RNA, 15 nt, Staphylococcus aureus subsp. aureus Mu50
aauuuaaaagagaau

SEQ ID NO: 3988954 - RNA, 12 nt, Staphylococcus aureus subsp. aureus Mu50
aauuuaaaauaa

SEQ ID NO: 3988955 - RNA, 13 nt, Staphylococcus aureus subsp. aureus Mu50
aauuuaaaauaau

SEQ ID NO: 3988956 - RNA, 15 nt, Staphylococcus aureus subsp. aureus Mu50
aauuuaaacgcacua

SEQ ID NO: 3988957 - RNA, 13 nt, Staphylococcus aureus subsp. aureus Mu50
aauuuaaagcauc

SEQ ID NO: 3988958 - RNA, 15 nt, Staphylococcus aureus subsp. aureus Mu50
aauuuaaagcaucau

SEQ ID NO: 3988959 - RNA, 18 nt, Staphylococcus aureus subsp. aureus Mu50
aauuuaaagcaucauaua

SEQ ID NO: 3988960 - RNA, 22 nt, Staphylococcus aureus subsp. aureus Mu50
aauuuaaagcaucauauacaua

SEQ ID NO: 3988961 - RNA, 17 nt, Staphylococcus aureus subsp. aureus Mu50
aauuuaaaucuguacuu

SEQ ID NO: 3988962 - RNA, 19 nt, Staphylococcus aureus subsp. aureus Mu50
aauuuaaaugauauugaaa

SEQ ID NO: 3988963 - RNA, 12 nt, Staphylococcus aureus subsp. aureus Mu50
aauuuaaaugcu

SEQ ID NO: 3988964 - RNA, 19 nt, Staphylococcus aureus subsp. aureus Mu50
aauuuaaauugucacaauc

SEQ ID NO: 3988965 - RNA, 14 nt, Staphylococcus aureus subsp. aureus Mu50
aauuuaacaucuuu

SEQ ID NO: 3988966 - RNA, 17 nt, Staphylococcus aureus subsp. aureus Mu50
aauuuaacggaaauaca

SEQ ID NO: 3988967 - RNA, 19 nt, Staphylococcus aureus subsp. aureus Mu50
aauuuaacggaaauacaau

SEQ ID NO: 3988968 - RNA, 16 nt, Staphylococcus aureus subsp. aureus Mu50
aauuuaacguguaaug

SEQ ID NO: 3988969 - RNA, 17 nt, Staphylococcus aureus subsp. aureus Mu50
aauuuaacguguaauga

SEQ ID NO: 3988970 - RNA, 20 nt, Staphylococcus aureus subsp. aureus Mu50
aauuuaacguuauucauuug

SEQ ID NO: 3988971 - RNA, 16 nt, Staphylococcus aureus subsp. aureus Mu50
aauuuaauaauuaaau

SEQ ID NO: 3988972 - RNA, 20 nt, Staphylococcus aureus subsp. aureus Mu50
aauuuaauaggcuauguaaa

SEQ ID NO: 3988973 - RNA, 15 nt, Staphylococcus aureus subsp. aureus Mu50
aauuuaauauuauaa

SEQ ID NO: 3988974 - RNA, 16 nt, Staphylococcus aureus subsp. aureus Mu50
aauuuaauauuauaag

SEQ ID NO: 3988975 - RNA, 16 nt, Staphylococcus aureus subsp. aureus Mu50
aauuuaauauuguuaa

SEQ ID NO: 3988976 - RNA, 15 nt, Staphylococcus aureus subsp. aureus Mu50
aauuuaauguuuuca

SEQ ID NO: 3988977 - RNA, 21 nt, Staphylococcus aureus subsp. aureus Mu50
aauuuaauguuuucagccacu

SEQ ID NO: 3988978 - RNA, 16 nt, Staphylococcus aureus subsp. aureus Mu50
aauuuaauuaagaaaa

SEQ ID NO: 3988979 - RNA, 15 nt, Staphylococcus aureus subsp. aureus Mu50
aauuuaauugguucu

SEQ ID NO: 3988980 - RNA, 15 nt, Staphylococcus aureus subsp. aureus Mu50
aauuuacgaaaguag

SEQ ID NO: 3988981 - RNA, 17 nt, Staphylococcus aureus subsp. aureus Mu50
aauuuacucaaaccauc

SEQ ID NO: 3988982 - RNA, 21 nt, Staphylococcus aureus subsp. aureus Mu50
aauuuacucaaaccaucuuau

SEQ ID NO: 3988983 - RNA, 19 nt, Staphylococcus aureus subsp. aureus Mu50
aauuuacuccuuacaauaa

SEQ ID NO: 3988984 - RNA, 20 nt, Staphylococcus aureus subsp. aureus Mu50
aauuuacuccuuacaauaaa

SEQ ID NO: 3988985 - RNA, 17 nt, Staphylococcus aureus subsp. aureus Mu50
aauuuagauauuauaaa

SEQ ID NO: 3988986 - RNA, 12 nt, Staphylococcus aureus subsp. aureus Mu50
aauuuagaugca

SEQ ID NO: 3988987 - RNA, 18 nt, Staphylococcus aureus subsp. aureus Mu50
aauuuagcaucaaaaaua

SEQ ID NO: 3988988 - RNA, 17 nt, Staphylococcus aureus subsp. aureus Mu50
aauuuaggcaugucaaa

SEQ ID NO: 3988989 - RNA, 18 nt, Staphylococcus aureus subsp. aureus Mu50
aauuuaguacucaauguu

SEQ ID NO: 3988990 - RNA, 21 nt, Staphylococcus aureus subsp. aureus Mu50
aauuuaguauaaauaaaaaua

SEQ ID NO: 3988991 - RNA, 21 nt, Staphylococcus aureus subsp. aureus Mu50
aauuuaguaucuauacaauua

SEQ ID NO: 3988992 - RNA, 15 nt, Staphylococcus aureus subsp. aureus Mu50
aauuuagucauuaca

SEQ ID NO: 3988993 - RNA, 17 nt, Staphylococcus aureus subsp. aureus Mu50
aauuuagucauuacaaa

SEQ ID NO: 3988994 - RNA, 18 nt, Staphylococcus aureus subsp. aureus Mu50
aauuuagucauuacaaau

SEQ ID NO: 3988995 - RNA, 20 nt, Staphylococcus aureus subsp. aureus Mu50
aauuuugacgcucagguaua

SEQ ID NO: 3988996 - RNA, 13 nt, Staphylococcus aureus subsp. aureus Mu50
aauuuugauauag

SEQ ID NO: 3988997 - RNA, 15 nt, Staphylococcus aureus subsp. aureus Mu50
aauuuugcaacauua

SEQ ID NO: 3988998 - RNA, 20 nt, Staphylococcus aureus subsp. aureus Mu50
aauuuuggaccucuugaaaa

SEQ ID NO: 3988999 - RNA, 22 nt, Staphylococcus aureus subsp. aureus Mu50
aauuuuguuuugcuucuuuaaa

SEQ ID NO: 3989000 - RNA, 19 nt, Staphylococcus aureus subsp. aureus Mu50
aauuuuuaaaucuacaaua

SEQ ID NO: 3989001 - RNA, 13 nt, Staphylococcus aureus subsp. aureus Mu50
aauuuuuaacaaa

SEQ ID NO: 3989002 - RNA, 14 nt, Staphylococcus aureus subsp. aureus Mu50
aauuuuuaacaaaa

SEQ ID NO: 3989003 - RNA, 21 nt, Staphylococcus aureus subsp. aureus Mu50
aauuuuuaacaaaauauacua

SEQ ID NO: 3989004 - RNA, 13 nt, Staphylococcus aureus subsp. aureus Mu50
aauuuuuaauaua

SEQ ID NO: 3989005 - RNA, 18 nt, Staphylococcus aureus subsp. aureus Mu50
aauuuuuaugcauuauag

SEQ ID NO: 3989006 - RNA, 15 nt, Staphylococcus aureus subsp. aureus Mu50
aauuuuuauuuacac

SEQ ID NO: 3989007 - RNA, 23 nt, Staphylococcus aureus subsp. aureus Mu50
aauuuuuauuuacacacaugaua

SEQ ID NO: 3989008 - RNA, 12 nt, Staphylococcus aureus subsp. aureus Mu50
aauuuuucaaaa

SEQ ID NO: 3989009 - RNA, 14 nt, Staphylococcus aureus subsp. aureus Mu50
aauuuuucaaaagc

SEQ ID NO: 3989010 - RNA, 13 nt, Staphylococcus aureus subsp. aureus Mu50
aauuuuucaaagc

SEQ ID NO: 3989011 - RNA, 17 nt, Staphylococcus aureus subsp. aureus Mu50
aauuuuucuaaaugauu

SEQ ID NO: 3989012 - RNA, 19 nt, Staphylococcus aureus subsp. aureus Mu50
aauuuuuguaauacaucua

SEQ ID NO: 3989013 - RNA, 15 nt, Staphylococcus aureus subsp. aureus Mu50
aauuuuuuagugaaa

SEQ ID NO: 3989014 - RNA, 15 nt, Staphylococcus aureus subsp. aureus Mu50
aauuuuuuauuaaga

SEQ ID NO: 3989015 - RNA, 15 nt, Staphylococcus aureus subsp. aureus Mu50
aauuuuuuucauaau

SEQ ID NO: 3989016 - RNA, 17 nt, Staphylococcus aureus subsp. aureus Mu50
aauuuuuuucauaauua

SEQ ID NO: 3989017 - RNA, 13 nt, Staphylococcus aureus subsp. aureus Mu50
acaaaaaaaccga

SEQ ID NO: 3989018 - RNA, 19 nt, Staphylococcus aureus subsp. aureus Mu50
acaaaaagaauuucgaaaa

SEQ ID NO: 3989019 - RNA, 16 nt, Staphylococcus aureus subsp. aureus Mu50
acaaaaauaaaccaug

SEQ ID NO: 3989020 - RNA, 16 nt, Staphylococcus aureus subsp. aureus Mu50
acaaaaauauagcuau

SEQ ID NO: 3989021 - RNA, 12 nt, Staphylococcus aureus subsp. aureus Mu50
acaaaacauauu

SEQ ID NO: 3989022 - RNA, 12 nt, Staphylococcus aureus subsp. aureus Mu50
acaaaacgauug

SEQ ID NO: 3989023 - RNA, 15 nt, Staphylococcus aureus subsp. aureus Mu50
acaaaaguaugauuu

SEQ ID NO: 3989024 - RNA, 19 nt, Staphylococcus aureus subsp. aureus Mu50
acaaaaguaugauuuguuu

SEQ ID NO: 3989025 - RNA, 21 nt, Staphylococcus aureus subsp. aureus Mu50
acaaaaguaugauuuguuuga

SEQ ID NO: 3989026 - RNA, 14 nt, Staphylococcus aureus subsp. aureus Mu50
acaaaauaacaugu

SEQ ID NO: 3989027 - RNA, 16 nt, Staphylococcus aureus subsp. aureus Mu50
acaaaauaacauguuu

SEQ ID NO: 3989028 - RNA, 18 nt, Staphylococcus aureus subsp. aureus Mu50
acaaaauacccugcuuua

SEQ ID NO: 3989029 - RNA, 15 nt, Staphylococcus aureus subsp. aureus Mu50
acaaaaucaccuuuu

SEQ ID NO: 3989030 - RNA, 18 nt, Staphylococcus aureus subsp. aureus Mu50
acaaaauuaagaagaaau

SEQ ID NO: 3989031 - RNA, 18 nt, Staphylococcus aureus subsp. aureus Mu50
acaaaauugucucacuug

SEQ ID NO: 3989032 - RNA, 19 nt, Staphylococcus aureus subsp. aureus Mu50
acaaacgacuaaccacauu

SEQ ID NO: 3989033 - RNA, 17 nt, Staphylococcus aureus subsp. aureus Mu50
acaaacgcacugcugca

SEQ ID NO: 3989034 - RNA, 17 nt, Staphylococcus aureus subsp. aureus Mu50
acaaacgcugauuuaau

SEQ ID NO: 3989035 - RNA, 13 nt, Staphylococcus aureus subsp. aureus Mu50
acaaagaaauuaa

SEQ ID NO: 3989036 - RNA, 21 nt, Staphylococcus aureus subsp. aureus Mu50
acaaagaaccacgcaucaugu

SEQ ID NO: 3989037 - RNA, 22 nt, Staphylococcus aureus subsp. aureus Mu50
acaaagaaccacgcaucaugua

SEQ ID NO: 3989038 - RNA, 20 nt, Staphylococcus aureus subsp. aureus Mu50
acaaagaauuucgaaaagaa

SEQ ID NO: 3989039 - RNA, 22 nt, Staphylococcus aureus subsp. aureus Mu50
acaaagaauuucgaaaagaaau

SEQ ID NO: 3989040 - RNA, 23 nt, Staphylococcus aureus subsp. aureus Mu50
acaaagaauuucgaaaagaaauu

SEQ ID NO: 3989041 - RNA, 13 nt, Staphylococcus aureus subsp. aureus Mu50
acaaagauauguu

SEQ ID NO: 3989042 - RNA, 14 nt, Staphylococcus aureus subsp. aureus Mu50
acaaagcuauguau

SEQ ID NO: 3989043 - RNA, 19 nt, Staphylococcus aureus subsp. aureus Mu50
acaaagcucaauaaauuau

SEQ ID NO: 3989044 - RNA, 21 nt, Staphylococcus aureus subsp. aureus Mu50
acaaagggguauguuuguuau

SEQ ID NO: 3989045 - RNA, 14 nt, Staphylococcus aureus subsp. aureus Mu50
acaaaguacaguua

SEQ ID NO: 3989046 - RNA, 18 nt, Staphylococcus aureus subsp. aureus Mu50
acaaagucugucugaauu

SEQ ID NO: 3989047 - RNA, 20 nt, Staphylococcus aureus subsp. aureus Mu50
acaaagucugucugaauuag

SEQ ID NO: 3989048 - RNA, 19 nt, Staphylococcus aureus subsp. aureus Mu50
acaaagugcaauuauuuca

SEQ ID NO: 3989049 - RNA, 21 nt, Staphylococcus aureus subsp. aureus Mu50
acaaauaaaggcaacaaauau

SEQ ID NO: 3989050 - RNA, 15 nt, Staphylococcus aureus subsp. aureus Mu50
acaaauaacaaacau

SEQ ID NO: 3989051 - RNA, 16 nt, Staphylococcus aureus subsp. aureus Mu50
acaaauaacaaacauu

SEQ ID NO: 3989052 - RNA, 15 nt, Staphylococcus aureus subsp. aureus Mu50
acaaauaauuuacau

SEQ ID NO: 3989053 - RNA, 14 nt, Staphylococcus aureus subsp. aureus Mu50
acaaauaguucaaa

SEQ ID NO: 3989054 - RNA, 14 nt, Staphylococcus aureus subsp. aureus Mu50
acaaauauuucuaa

SEQ ID NO: 3989055 - RNA, 19 nt, Staphylococcus aureus subsp. aureus Mu50
acaaaucgauuaauuauaa

SEQ ID NO: 3989056 - RNA, 16 nt, Staphylococcus aureus subsp. aureus Mu50
acaaaucuauaaauau

SEQ ID NO: 3989057 - RNA, 19 nt, Staphylococcus aureus subsp. aureus Mu50
acaaaucuuuuaaauuuag

SEQ ID NO: 3989058 - RNA, 21 nt, Staphylococcus aureus subsp. aureus Mu50
acaaaugaagguguugaaaag

SEQ ID NO: 3989059 - RNA, 22 nt, Staphylococcus aureus subsp. aureus Mu50
acaaaugaagguguugaaaagu

SEQ ID NO: 3989060 - RNA, 18 nt, Staphylococcus aureus subsp. aureus Mu50
acaaauguauaaauaaua

SEQ ID NO: 3989061 - RNA, 19 nt, Staphylococcus aureus subsp. aureus Mu50
acaaauguauaaauaauaa

SEQ ID NO: 3989062 - RNA, 17 nt, Staphylococcus aureus subsp. aureus Mu50
acaaauguucuauagaa

SEQ ID NO: 3989063 - RNA, 22 nt, Staphylococcus aureus subsp. aureus Mu50
acaaauuaaaaaacaauaaaau

SEQ ID NO: 3989064 - RNA, 14 nt, Staphylococcus aureus subsp. aureus Mu50
acaaauuauaaauu

SEQ ID NO: 3989065 - RNA, 11 nt, Staphylococcus aureus subsp. aureus Mu50
acaaauuauua

SEQ ID NO: 3989066 - RNA, 19 nt, Staphylococcus aureus subsp. aureus Mu50
acaaauuugaauauacuua

SEQ ID NO: 3989067 - RNA, 23 nt, Staphylococcus aureus subsp. aureus Mu50
acaaauuugaauauacuuaauuu

SEQ ID NO: 3989068 - RNA, 15 nt, Staphylococcus aureus subsp. aureus Mu50
acaacaaauugugau

SEQ ID NO: 3989069 - RNA, 15 nt, Staphylococcus aureus subsp. aureus Mu50
acaacaaucaaauua

SEQ ID NO: 3989070 - RNA, 18 nt, Staphylococcus aureus subsp. aureus Mu50
acaacaugauuucuucuc

SEQ ID NO: 3989071 - RNA, 21 nt, Staphylococcus aureus subsp. aureus Mu50
acaacaugauuucuucuccuu

SEQ ID NO: 3989072 - RNA, 11 nt, Staphylococcus aureus subsp. aureus Mu50
acaacauguuu

SEQ ID NO: 3989073 - RNA, 21 nt, Staphylococcus aureus subsp. aureus Mu50
acaacauuauuuauauuuaga

SEQ ID NO: 3989074 - RNA, 17 nt, Staphylococcus aureus subsp. aureus Mu50
acaaccgucccauaaaa

SEQ ID NO: 3989075 - RNA, 14 nt, Staphylococcus aureus subsp. aureus Mu50
acaacuauucccac

SEQ ID NO: 3989076 - RNA, 16 nt, Staphylococcus aureus subsp. aureus Mu50
acaacuauucccacuc

SEQ ID NO: 3989077 - RNA, 17 nt, Staphylococcus aureus subsp. aureus Mu50
acaacuauucccacuca

SEQ ID NO: 3989078 - RNA, 22 nt, Staphylococcus aureus subsp. aureus Mu50
acaacuauucccacucaauugu

SEQ ID NO: 3989079 - RNA, 20 nt, Staphylococcus aureus subsp. aureus Mu50
acaacucccuuuuauaagcu

SEQ ID NO: 3989080 - RNA, 16 nt, Staphylococcus aureus subsp. aureus Mu50
acaacugauuuaauau

SEQ ID NO: 3989081 - RNA, 17 nt, Staphylococcus aureus subsp. aureus Mu50
acaacugauuuaauauc

SEQ ID NO: 3989082 - RNA, 13 nt, Staphylococcus aureus subsp. aureus Mu50
acaacuucacuuc

SEQ ID NO: 3989083 - RNA, 21 nt, Staphylococcus aureus subsp. aureus Mu50
acacacaugauaauuuuuagu

SEQ ID NO: 3989084 - RNA, 12 nt, Staphylococcus aureus subsp. aureus Mu50
acacaccaccac

SEQ ID NO: 3989085 - RNA, 14 nt, Staphylococcus aureus subsp. aureus Mu50
acacacuaaaagcu

SEQ ID NO: 3989086 - RNA, 18 nt, Staphylococcus aureus subsp. aureus Mu50
acacacuaaggaaaauua

SEQ ID NO: 3989087 - RNA, 20 nt, Staphylococcus aureus subsp. aureus Mu50
acacacuguugaaaaugacu

SEQ ID NO: 3989088 - RNA, 21 nt, Staphylococcus aureus subsp. aureus Mu50
acacacuguugaaaaugacua

SEQ ID NO: 3989089 - RNA, 23 nt, Staphylococcus aureus subsp. aureus Mu50
acacagaagcugacgaaaaguca

SEQ ID NO: 3989090 - RNA, 20 nt, Staphylococcus aureus subsp. aureus Mu50
acacagguaaauuuaaaaua

SEQ ID NO: 3989091 - RNA, 21 nt, Staphylococcus aureus subsp. aureus Mu50
acacagguaaauuuaaaauaa

SEQ ID NO: 3989092 - RNA, 22 nt, Staphylococcus aureus subsp. aureus Mu50
acacaguaauucuuaaaaagca

SEQ ID NO: 3989093 - RNA, 13 nt, Staphylococcus aureus subsp. aureus Mu50
acacaucacuaua

SEQ ID NO: 3989094 - RNA, 22 nt, Staphylococcus aureus subsp. aureus Mu50
acacaucuauguggcuacuuga

SEQ ID NO: 3989095 - RNA, 21 nt, Staphylococcus aureus subsp. aureus Mu50
acacauguacguuuuuuuaaa

SEQ ID NO: 3989096 - RNA, 16 nt, Staphylococcus aureus subsp. aureus Mu50
acacauuauugaaauu

SEQ ID NO: 3989097 - RNA, 17 nt, Staphylococcus aureus subsp. aureus Mu50
acacauucuuauuugaa

SEQ ID NO: 3989098 - RNA, 22 nt, Staphylococcus aureus subsp. aureus Mu50
acacauucuuauuugaaaugau

SEQ ID NO: 3989099 - RNA, 12 nt, Staphylococcus aureus subsp. aureus Mu50
acacauuuacuu

SEQ ID NO: 3989100 - RNA, 22 nt, Staphylococcus aureus subsp. aureus Mu50
acaccaauugaauauuuuucaa

SEQ ID NO: 3989101 - RNA, 13 nt, Staphylococcus aureus subsp. aureus Mu50
acaccagauauca

SEQ ID NO: 3989102 - RNA, 19 nt, Staphylococcus aureus subsp. aureus Mu50
acaccagauaucauaauau

SEQ ID NO: 3989103 - RNA, 22 nt, Staphylococcus aureus subsp. aureus Mu50
acaccaucaacgccauauuuau

SEQ ID NO: 3989104 - RNA, 12 nt, Staphylococcus aureus subsp. aureus Mu50
acacccaaauuu

SEQ ID NO: 3989105 - RNA, 18 nt, Staphylococcus aureus subsp. aureus Mu50
acacccauuugucuuaau

SEQ ID NO: 3989106 - RNA, 12 nt, Staphylococcus aureus subsp. aureus Mu50
acaccccaacuc

SEQ ID NO: 3989107 - RNA, 12 nt, Staphylococcus aureus subsp. aureus Mu50
acaccccaacuu

SEQ ID NO: 3989108 - RNA, 14 nt, Staphylococcus aureus subsp. aureus Mu50
acaccccaacuugc

SEQ ID NO: 3989109 - RNA, 14 nt, Staphylococcus aureus subsp. aureus Mu50
acacccuuuaaauu

SEQ ID NO: 3989110 - RNA, 15 nt, Staphylococcus aureus subsp. aureus Mu50
acaccuaauauuuua

SEQ ID NO: 3989111 - RNA, 18 nt, Staphylococcus aureus subsp. aureus Mu50
acaccuaauucauauaua

SEQ ID NO: 3989112 - RNA, 13 nt, Staphylococcus aureus subsp. aureus Mu50
acaccuacaaaua

SEQ ID NO: 3989113 - RNA, 15 nt, Staphylococcus aureus subsp. aureus Mu50
acaccuauaccucgu

SEQ ID NO: 3989114 - RNA, 22 nt, Staphylococcus aureus subsp. aureus Mu50
acaccugguacauaaauaccug

SEQ ID NO: 3989115 - RNA, 20 nt, Staphylococcus aureus subsp. aureus Mu50
acaccuuaucacuuggaaua

SEQ ID NO: 3989116 - RNA, 15 nt, Staphylococcus aureus subsp. aureus Mu50
acaccuucaauaucu

SEQ ID NO: 3989117 - RNA, 19 nt, Staphylococcus aureus subsp. aureus Mu50
acaccuuuacucacagacu

SEQ ID NO: 3989118 - RNA, 20 nt, Staphylococcus aureus subsp. aureus Mu50
acacgaauaccaagaccagg

SEQ ID NO: 3989119 - RNA, 21 nt, Staphylococcus aureus subsp. aureus Mu50
acacgaguauuaucacauaga

SEQ ID NO: 3989120 - RNA, 14 nt, Staphylococcus aureus subsp. aureus Mu50
acacgauaauuaua

SEQ ID NO: 3989121 - RNA, 17 nt, Staphylococcus aureus subsp. aureus Mu50
acacgcauuacuuuaga

SEQ ID NO: 3989122 - RNA, 21 nt, Staphylococcus aureus subsp. aureus Mu50
acacguguauuguauuuuaau

SEQ ID NO: 3989123 - RNA, 22 nt, Staphylococcus aureus subsp. aureus Mu50
acacguguauuguauuuuaaug

SEQ ID NO: 3989124 - RNA, 20 nt, Staphylococcus aureus subsp. aureus Mu50
acacguucuugguauuuuuu

SEQ ID NO: 3989125 - RNA, 23 nt, Staphylococcus aureus subsp. aureus Mu50
acacguucuugguauuuuuuaaa

SEQ ID NO: 3989126 - RNA, 16 nt, Staphylococcus aureus subsp. aureus Mu50
acacuacgcugaugaa

SEQ ID NO: 3989127 - RNA, 21 nt, Staphylococcus aureus subsp. aureus Mu50
acacuacgcugaugaaugauu

SEQ ID NO: 3989128 - RNA, 22 nt, Staphylococcus aureus subsp. aureus Mu50
acacuaucauuaucaaauaacc

SEQ ID NO: 3989129 - RNA, 12 nt, Staphylococcus aureus subsp. aureus Mu50
acacuauuauag

SEQ ID NO: 3989130 - RNA, 12 nt, Staphylococcus aureus subsp. aureus Mu50
acacucaaacaa

SEQ ID NO: 3989131 - RNA, 17 nt, Staphylococcus aureus subsp. aureus Mu50
acacugcacaucauaau

SEQ ID NO: 3989132 - RNA, 22 nt, Staphylococcus aureus subsp. aureus Mu50
acacugcacaucauaauaaauc

SEQ ID NO: 3989133 - RNA, 15 nt, Staphylococcus aureus subsp. aureus Mu50
acacuuaauauauuc

SEQ ID NO: 3989134 - RNA, 22 nt, Staphylococcus aureus subsp. aureus Mu50
acacuucaacauauaaaucauu

SEQ ID NO: 3989135 - RNA, 16 nt, Staphylococcus aureus subsp. aureus Mu50
acacuugauaaaacua

SEQ ID NO: 3989136 - RNA, 17 nt, Staphylococcus aureus subsp. aureus Mu50
acacuugauaaaacuaa

SEQ ID NO: 3989137 - RNA, 22 nt, Staphylococcus aureus subsp. aureus Mu50
acacuuggcuuaggaugaaaau

SEQ ID NO: 3989138 - RNA, 17 nt, Staphylococcus aureus subsp. aureus Mu50
acacuuuaaacaagcau

SEQ ID NO: 3989139 - RNA, 22 nt, Staphylococcus aureus subsp. aureus Mu50
acagaaaaucguuauaaguaca

SEQ ID NO: 3989140 - RNA, 13 nt, Staphylococcus aureus subsp. aureus Mu50
acagacaaacauu

SEQ ID NO: 3989141 - RNA, 23 nt, Staphylococcus aureus subsp. aureus Mu50
acagagaaauucgaaaagaaauu

SEQ ID NO: 3989142 - RNA, 22 nt, Staphylococcus aureus subsp. aureus Mu50
acagagaaucaauuauugaaaa

SEQ ID NO: 3989143 - RNA, 22 nt, Staphylococcus aureus subsp. aureus Mu50
acagagaauuucgaaaagaaau

SEQ ID NO: 3989144 - RNA, 23 nt, Staphylococcus aureus subsp. aureus Mu50
acagagaauuucgaaaagaaauu

SEQ ID NO: 3989145 - RNA, 15 nt, Staphylococcus aureus subsp. aureus Mu50
acagauaaagcuucg

SEQ ID NO: 3989146 - RNA, 21 nt, Staphylococcus aureus subsp. aureus Mu50
acagauaagaauauuuaaguu

SEQ ID NO: 3989147 - RNA, 22 nt, Staphylococcus aureus subsp. aureus Mu50
acagauaagaauauuuaaguuu

SEQ ID NO: 3989148 - RNA, 13 nt, Staphylococcus aureus subsp. aureus Mu50
acagauaauuauu

SEQ ID NO: 3989149 - RNA, 18 nt, Staphylococcus aureus subsp. aureus Mu50
acagaucucaauccaauu

SEQ ID NO: 3989150 - RNA, 23 nt, Staphylococcus aureus subsp. aureus Mu50
acagaucucaauccaauuaaaua

SEQ ID NO: 3989151 - RNA, 16 nt, Staphylococcus aureus subsp. aureus Mu50
acagaugaugcuucgc

SEQ ID NO: 3989152 - RNA, 16 nt, Staphylococcus aureus subsp. aureus Mu50
acagaugaugcuucuc

SEQ ID NO: 3989153 - RNA, 21 nt, Staphylococcus aureus subsp. aureus Mu50
acagaugcgucguagauugau

SEQ ID NO: 3989154 - RNA, 22 nt, Staphylococcus aureus subsp. aureus Mu50
acagaugcgucguagauugauu

SEQ ID NO: 3989155 - RNA, 23 nt, Staphylococcus aureus subsp. aureus Mu50
acagauuuaccucuugauaaaau

SEQ ID NO: 3989156 - RNA, 16 nt, Staphylococcus aureus subsp. aureus Mu50
acagauuuuaaaaauu

SEQ ID NO: 3989157 - RNA, 15 nt, Staphylococcus aureus subsp. aureus Mu50
acagcacauuuuuag

SEQ ID NO: 3989158 - RNA, 17 nt, Staphylococcus aureus subsp. aureus Mu50
acagcacgagacaauaa

SEQ ID NO: 3989159 - RNA, 22 nt, Staphylococcus aureus subsp. aureus Mu50
acagcaguaagacgauuucaau

SEQ ID NO: 3989160 - RNA, 16 nt, Staphylococcus aureus subsp. aureus Mu50
acagcaguaagauauu

SEQ ID NO: 3989161 - RNA, 22 nt, Staphylococcus aureus subsp. aureus Mu50
acagccgaggcaauauugaaca

SEQ ID NO: 3989162 - RNA, 22 nt, Staphylococcus aureus subsp. aureus Mu50
acagcggaauacagaugaugcu

SEQ ID NO: 3989163 - RNA, 17 nt, Staphylococcus aureus subsp. aureus Mu50
acagcguauuuuaauga

SEQ ID NO: 3989164 - RNA, 23 nt, Staphylococcus aureus subsp. aureus Mu50
acagcuaauguguacuuaaaaau

SEQ ID NO: 3989165 - RNA, 14 nt, Staphylococcus aureus subsp. aureus Mu50
acagcuacaaauaa

SEQ ID NO: 3989166 - RNA, 15 nt, Staphylococcus aureus subsp. aureus Mu50
acagcuacaaauaau

SEQ ID NO: 3989167 - RNA, 13 nt, Staphylococcus aureus subsp. aureus Mu50
acagcuucaaaau

SEQ ID NO: 3989168 - RNA, 14 nt, Staphylococcus aureus subsp. aureus Mu50
acagcuuuuucuac

SEQ ID NO: 3989169 - RNA, 16 nt, Staphylococcus aureus subsp. aureus Mu50
acaggccacacuugag

SEQ ID NO: 3989170 - RNA, 22 nt, Staphylococcus aureus subsp. aureus Mu50
acauccaauuauguuuaucuac

SEQ ID NO: 3989171 - RNA, 23 nt, Staphylococcus aureus subsp. aureus Mu50
acauccaauuauguuuaucuacu

SEQ ID NO: 3989172 - RNA, 21 nt, Staphylococcus aureus subsp. aureus Mu50
acauccacuuuauaauuuuug

SEQ ID NO: 3989173 - RNA, 15 nt, Staphylococcus aureus subsp. aureus Mu50
acauccauacaaauc

SEQ ID NO: 3989174 - RNA, 15 nt, Staphylococcus aureus subsp. aureus Mu50
acauccccaaaaaua

SEQ ID NO: 3989175 - RNA, 15 nt, Staphylococcus aureus subsp. aureus Mu50
acauccucauaauua

SEQ ID NO: 3989176 - RNA, 17 nt, Staphylococcus aureus subsp. aureus Mu50
acauccucauaauuauc

SEQ ID NO: 3989177 - RNA, 18 nt, Staphylococcus aureus subsp. aureus Mu50
acaucgaucuaaauauau

SEQ ID NO: 3989178 - RNA, 21 nt, Staphylococcus aureus subsp. aureus Mu50
acaucgaucuaaauauauuag

SEQ ID NO: 3989179 - RNA, 15 nt, Staphylococcus aureus subsp. aureus Mu50
acaucgccaauuuga

SEQ ID NO: 3989180 - RNA, 21 nt, Staphylococcus aureus subsp. aureus Mu50
acaucguauucuuuuaauaga

SEQ ID NO: 3989181 - RNA, 16 nt, Staphylococcus aureus subsp. aureus Mu50
acaucuaaauuugcca

SEQ ID NO: 3989182 - RNA, 15 nt, Staphylococcus aureus subsp. aureus Mu50
acaucuaauaaauau

SEQ ID NO: 3989183 - RNA, 16 nt, Staphylococcus aureus subsp. aureus Mu50
acaucuaauaaauaua

SEQ ID NO: 3989184 - RNA, 20 nt, Staphylococcus aureus subsp. aureus Mu50
acaucuagaugaaauugugu

SEQ ID NO: 3989185 - RNA, 22 nt, Staphylococcus aureus subsp. aureus Mu50
acaucuagaugaaauuguguug

SEQ ID NO: 3989186 - RNA, 14 nt, Staphylococcus aureus subsp. aureus Mu50
acaucuauuucuug

SEQ ID NO: 3989187 - RNA, 22 nt, Staphylococcus aureus subsp. aureus Mu50
acaucugaaaaaauuaauaauu

SEQ ID NO: 3989188 - RNA, 23 nt, Staphylococcus aureus subsp. aureus Mu50
acaucuuucgagguaauuucacc

SEQ ID NO: 3989189 - RNA, 12 nt, Staphylococcus aureus subsp. aureus Mu50
acaucuuuuguu

SEQ ID NO: 3989190 - RNA, 17 nt, Staphylococcus aureus subsp. aureus Mu50
acaucuuuuguuguuuu

SEQ ID NO: 3989191 - RNA, 20 nt, Staphylococcus aureus subsp. aureus Mu50
acaucuuuuuaaaaggugug

SEQ ID NO: 3989192 - RNA, 15 nt, Staphylococcus aureus subsp. aureus Mu50
acaucuuuuugauaa

SEQ ID NO: 3989193 - RNA, 19 nt, Staphylococcus aureus subsp. aureus Mu50
acaucuuuuugauaauguu

SEQ ID NO: 3989194 - RNA, 16 nt, Staphylococcus aureus subsp. aureus Mu50
acaugaacaaauaauu

SEQ ID NO: 3989195 - RNA, 20 nt, Staphylococcus aureus subsp. aureus Mu50
acaugaacaaucagauaagu

SEQ ID NO: 3989196 - RNA, 21 nt, Staphylococcus aureus subsp. aureus Mu50
acaugaacaaucagauaaguu

SEQ ID NO: 3989197 - RNA, 19 nt, Staphylococcus aureus subsp. aureus Mu50
acaugaauuuuaauauauu

SEQ ID NO: 3989198 - RNA, 23 nt, Staphylococcus aureus subsp. aureus Mu50
acaugaggaucaacugaaauuuu

SEQ ID NO: 3989199 - RNA, 15 nt, Staphylococcus aureus subsp. aureus Mu50
acaugaguaaaacuc

SEQ ID NO: 3989200 - RNA, 12 nt, Staphylococcus aureus subsp. aureus Mu50
acaugauaauuu

SEQ ID NO: 3989201 - RNA, 15 nt, Staphylococcus aureus subsp. aureus Mu50
acaugauaauuuuua

SEQ ID NO: 3989202 - RNA, 16 nt, Staphylococcus aureus subsp. aureus Mu50
acaugauaauuuuuag

SEQ ID NO: 3989203 - RNA, 15 nt, Staphylococcus aureus subsp. aureus Mu50
acaugauacugaaau

SEQ ID NO: 3989204 - RNA, 17 nt, Staphylococcus aureus subsp. aureus Mu50
acaugauacugaaauuu

SEQ ID NO: 3989205 - RNA, 18 nt, Staphylococcus aureus subsp. aureus Mu50
acaugauacugaaauuuc

SEQ ID NO: 3989206 - RNA, 15 nt, Staphylococcus aureus subsp. aureus Mu50
acaugauucaugaua

SEQ ID NO: 3989207 - RNA, 19 nt, Staphylococcus aureus subsp. aureus Mu50
acaugcaccuuuacaacau

SEQ ID NO: 3989208 - RNA, 23 nt, Staphylococcus aureus subsp. aureus Mu50
acaugcacuuuauuaaaaauccu

SEQ ID NO: 3989209 - RNA, 23 nt, Staphylococcus aureus subsp. aureus Mu50
acauggcuuagguuuaauuuuaa

SEQ ID NO: 3989210 - RNA, 14 nt, Staphylococcus aureus subsp. aureus Mu50
acaugguaucuuua

SEQ ID NO: 3989211 - RNA, 16 nt, Staphylococcus aureus subsp. aureus Mu50
acaugguuuucaccag

SEQ ID NO: 3989212 - RNA, 21 nt, Staphylococcus aureus subsp. aureus Mu50
acaugguuuucaccagaccaa

SEQ ID NO: 3989213 - RNA, 19 nt, Staphylococcus aureus subsp. aureus Mu50
acauguaacaaaauacccu

SEQ ID NO: 3989214 - RNA, 18 nt, Staphylococcus aureus subsp. aureus Mu50
acauguacaauuuuuaaa

SEQ ID NO: 3989215 - RNA, 19 nt, Staphylococcus aureus subsp. aureus Mu50
acauguacaauuuuuaaaa

SEQ ID NO: 3989216 - RNA, 22 nt, Staphylococcus aureus subsp. aureus Mu50
acauguacguuuuuuuaaauac

SEQ ID NO: 3989217 - RNA, 23 nt, Staphylococcus aureus subsp. aureus Mu50
acauguacguuuuuuuaaauaca

SEQ ID NO: 3989218 - RNA, 19 nt, Staphylococcus aureus subsp. aureus Mu50
acauguauuggccaaacaa

SEQ ID NO: 3989219 - RNA, 18 nt, Staphylococcus aureus subsp. aureus Mu50
acauguauuuaguaucau

SEQ ID NO: 3989220 - RNA, 15 nt, Staphylococcus aureus subsp. aureus Mu50
acaugugggauaucu

SEQ ID NO: 3989221 - RNA, 19 nt, Staphylococcus aureus subsp. aureus Mu50
acauguuuggaugaacaaa

SEQ ID NO: 3989222 - RNA, 14 nt, Staphylococcus aureus subsp. aureus Mu50
acauuaaaacaaua

SEQ ID NO: 3989223 - RNA, 17 nt, Staphylococcus aureus subsp. aureus Mu50
acauuaaaacaauaauu

SEQ ID NO: 3989224 - RNA, 21 nt, Staphylococcus aureus subsp. aureus Mu50
acauuaaaauguguuuucaac

SEQ ID NO: 3989225 - RNA, 12 nt, Staphylococcus aureus subsp. aureus Mu50
acauuaaauauu

SEQ ID NO: 3989226 - RNA, 14 nt, Staphylococcus aureus subsp. aureus Mu50
acauuaaauuauua

SEQ ID NO: 3989227 - RNA, 15 nt, Staphylococcus aureus subsp. aureus Mu50
acauuaaauuauuag

SEQ ID NO: 3989228 - RNA, 22 nt, Staphylococcus aureus subsp. aureus Mu50
acauuaacaaggccugcaucac

SEQ ID NO: 3989229 - RNA, 17 nt, Staphylococcus aureus subsp. aureus Mu50
acauuaagcuaugcuuu

SEQ ID NO: 3989230 - RNA, 13 nt, Staphylococcus aureus subsp. aureus Mu50
acauuaaguuaaa

SEQ ID NO: 3989231 - RNA, 12 nt, Staphylococcus aureus subsp. aureus Mu50
acauuaauauaa

SEQ ID NO: 3989232 - RNA, 15 nt, Staphylococcus aureus subsp. aureus Mu50
acauuaaucuauaua

SEQ ID NO: 3989233 - RNA, 22 nt, Staphylococcus aureus subsp. aureus Mu50
acauuaaugauagcaaugaauu

SEQ ID NO: 3989234 - RNA, 17 nt, Staphylococcus aureus subsp. aureus Mu50
acauuaauuggauuaaa

SEQ ID NO: 3989235 - RNA, 18 nt, Staphylococcus aureus subsp. aureus Mu50
acauuacauuuaguacau

SEQ ID NO: 3989236 - RNA, 15 nt, Staphylococcus aureus subsp. aureus Mu50
acauuagccacagcu

SEQ ID NO: 3989237 - RNA, 13 nt, Staphylococcus aureus subsp. aureus Mu50
acauuauugaaau

SEQ ID NO: 3989238 - RNA, 12 nt, Staphylococcus aureus subsp. aureus Mu50
acauuauuuaua

SEQ ID NO: 3989239 - RNA, 22 nt, Staphylococcus aureus subsp. aureus Mu50
acauuauuuauauuuagaauau

SEQ ID NO: 3989240 - RNA, 21 nt, Staphylococcus aureus subsp. aureus Mu50
acauucaaauaaaugacauuu

SEQ ID NO: 3989241 - RNA, 22 nt, Staphylococcus aureus subsp. aureus Mu50
acauucaaauaaaugacauuua

SEQ ID NO: 3989242 - RNA, 13 nt, Staphylococcus aureus subsp. aureus Mu50
acauucaauauuu

SEQ ID NO: 3989243 - RNA, 17 nt, Staphylococcus aureus subsp. aureus Mu50
acauucauuuaguuaaa

SEQ ID NO: 3989244 - RNA, 22 nt, Staphylococcus aureus subsp. aureus Mu50
acauuccaaaguaccaucucua

SEQ ID NO: 3989245 - RNA, 19 nt, Staphylococcus aureus subsp. aureus Mu50
acauucccuuaauaauaag

SEQ ID NO: 3989246 - RNA, 22 nt, Staphylococcus aureus subsp. aureus Mu50
acauucccuuaauaauaaguau

SEQ ID NO: 3989247 - RNA, 21 nt, Staphylococcus aureus subsp. aureus Mu50
acauucugcccugcaaugcaa

SEQ ID NO: 3989248 - RNA, 19 nt, Staphylococcus aureus subsp. aureus Mu50
acauucuucaaaaaauaau

SEQ ID NO: 3989249 - RNA, 21 nt, Staphylococcus aureus subsp. aureus Mu50
acauucuucaaaaaauaauag

SEQ ID NO: 3989250 - RNA, 22 nt, Staphylococcus aureus subsp. aureus Mu50
acauugaacgauaacaauuuau

SEQ ID NO: 3989251 - RNA, 12 nt, Staphylococcus aureus subsp. aureus Mu50
acauugaauaaa

SEQ ID NO: 3989252 - RNA, 13 nt, Staphylococcus aureus subsp. aureus Mu50
acauugaauaaau

SEQ ID NO: 3989253 - RNA, 15 nt, Staphylococcus aureus subsp. aureus Mu50
acauugauaaauuuu

SEQ ID NO: 3989254 - RNA, 17 nt, Staphylococcus aureus subsp. aureus Mu50
acauugaugucaauuuc

SEQ ID NO: 3989255 - RNA, 20 nt, Staphylococcus aureus subsp. aureus Mu50
acauugaugucaauuucacg

SEQ ID NO: 3989256 - RNA, 17 nt, Staphylococcus aureus subsp. aureus Mu50
acauuggauuacuucca

SEQ ID NO: 3989257 - RNA, 19 nt, Staphylococcus aureus subsp. aureus Mu50
accaucaacgccauauuua

SEQ ID NO: 3989258 - RNA, 14 nt, Staphylococcus aureus subsp. aureus Mu50
accaucauaaaugu

SEQ ID NO: 3989259 - RNA, 19 nt, Staphylococcus aureus subsp. aureus Mu50
accaucuuuaauacgaauu

SEQ ID NO: 3989260 - RNA, 22 nt, Staphylococcus aureus subsp. aureus Mu50
accaucuuuaauacgaauuuca

SEQ ID NO: 3989261 - RNA, 22 nt, Staphylococcus aureus subsp. aureus Mu50
accaugaugagauaaaaucaua

SEQ ID NO: 3989262 - RNA, 15 nt, Staphylococcus aureus subsp. aureus Mu50
accauguuuuuuaag

SEQ ID NO: 3989263 - RNA, 21 nt, Staphylococcus aureus subsp. aureus Mu50
accauuccaauuucaagugua

SEQ ID NO: 3989264 - RNA, 22 nt, Staphylococcus aureus subsp. aureus Mu50
accauucgaaagccaauuaaua

SEQ ID NO: 3989265 - RNA, 14 nt, Staphylococcus aureus subsp. aureus Mu50
accauugaaugaau

SEQ ID NO: 3989266 - RNA, 17 nt, Staphylococcus aureus subsp. aureus Mu50
accauugugaauaauuu

SEQ ID NO: 3989267 - RNA, 19 nt, Staphylococcus aureus subsp. aureus Mu50
accauugugaugauaauua

SEQ ID NO: 3989268 - RNA, 16 nt, Staphylococcus aureus subsp. aureus Mu50
accauuuaaaaauuga

SEQ ID NO: 3989269 - RNA, 16 nt, Staphylococcus aureus subsp. aureus Mu50
accauuuuuagaaaua

SEQ ID NO: 3989270 - RNA, 17 nt, Staphylococcus aureus subsp. aureus Mu50
accauuuuuagaaauag

SEQ ID NO: 3989271 - RNA, 13 nt, Staphylococcus aureus subsp. aureus Mu50
accauuuuuuuau

SEQ ID NO: 3989272 - RNA, 14 nt, Staphylococcus aureus subsp. aureus Mu50
acccaaaaaauugu

SEQ ID NO: 3989273 - RNA, 11 nt, Staphylococcus aureus subsp. aureus Mu50
acccaaucauu

SEQ ID NO: 3989274 - RNA, 13 nt, Staphylococcus aureus subsp. aureus Mu50
acccaaucuuguu

SEQ ID NO: 3989275 - RNA, 18 nt, Staphylococcus aureus subsp. aureus Mu50
acccacaucuuuuuaaaa

SEQ ID NO: 3989276 - RNA, 18 nt, Staphylococcus aureus subsp. aureus Mu50
acccaccguuaaaauaua

SEQ ID NO: 3989277 - RNA, 21 nt, Staphylococcus aureus subsp. aureus Mu50
acccagaugaauuuuuauuuu

SEQ ID NO: 3989278 - RNA, 22 nt, Staphylococcus aureus subsp. aureus Mu50
acccauacucugggcauuuuga

SEQ ID NO: 3989279 - RNA, 13 nt, Staphylococcus aureus subsp. aureus Mu50
acccauauaauuu

SEQ ID NO: 3989280 - RNA, 16 nt, Staphylococcus aureus subsp. aureus Mu50
acccauauuaaauuuu

SEQ ID NO: 3989281 - RNA, 15 nt, Staphylococcus aureus subsp. aureus Mu50
acccauggauucuga

SEQ ID NO: 3989282 - RNA, 19 nt, Staphylococcus aureus subsp. aureus Mu50
accccauucacuacuuuuu

SEQ ID NO: 3989283 - RNA, 16 nt, Staphylococcus aureus subsp. aureus Mu50
accccgaaaagaggga

SEQ ID NO: 3989284 - RNA, 21 nt, Staphylococcus aureus subsp. aureus Mu50
accccuccuggugcugcacca

SEQ ID NO: 3989285 - RNA, 16 nt, Staphylococcus aureus subsp. aureus Mu50
acccuacuauauauca

SEQ ID NO: 3989286 - RNA, 20 nt, Staphylococcus aureus subsp. aureus Mu50
acccucauuuuuauaaauuu

SEQ ID NO: 3989287 - RNA, 14 nt, Staphylococcus aureus subsp. aureus Mu50
acccuugcaaauau

SEQ ID NO: 3989288 - RNA, 21 nt, Staphylococcus aureus subsp. aureus Mu50
acccuuuaaacauauuuacua

SEQ ID NO: 3989289 - RNA, 19 nt, Staphylococcus aureus subsp. aureus Mu50
accgacaauuauaauaaaa

SEQ ID NO: 3989290 - RNA, 22 nt, Staphylococcus aureus subsp. aureus Mu50
accgacacuccacaaguggaac

SEQ ID NO: 3989291 - RNA, 23 nt, Staphylococcus aureus subsp. aureus Mu50
accgagcggccgugguaugauuu

SEQ ID NO: 3989292 - RNA, 20 nt, Staphylococcus aureus subsp. aureus Mu50
accgauuaauauaauaccua

SEQ ID NO: 3989293 - RNA, 17 nt, Staphylococcus aureus subsp. aureus Mu50
accgauuguuaauuuaa

SEQ ID NO: 3989294 - RNA, 20 nt, Staphylococcus aureus subsp. aureus Mu50
accgauuguuaauuuaaagu

SEQ ID NO: 3989295 - RNA, 15 nt, Staphylococcus aureus subsp. aureus Mu50
accgcacuucuauau

SEQ ID NO: 3989296 - RNA, 19 nt, Staphylococcus aureus subsp. aureus Mu50
accgcacuucuauauuaau

SEQ ID NO: 3989297 - RNA, 21 nt, Staphylococcus aureus subsp. aureus Mu50
accgcacuuucuauuaauaua

SEQ ID NO: 3989298 - RNA, 18 nt, Staphylococcus aureus subsp. aureus Mu50
accgcuucuuuuaaguua

SEQ ID NO: 3989299 - RNA, 15 nt, Staphylococcus aureus subsp. aureus Mu50
accguaaucuuuuaa

SEQ ID NO: 3989300 - RNA, 13 nt, Staphylococcus aureus subsp. aureus Mu50
accguaauuuuaa

SEQ ID NO: 3989301 - RNA, 16 nt, Staphylococcus aureus subsp. aureus Mu50
accguauuuuaauauu

SEQ ID NO: 3989302 - RNA, 15 nt, Staphylococcus aureus subsp. aureus Mu50
accgucaaacuuaaa

SEQ ID NO: 3989303 - RNA, 19 nt, Staphylococcus aureus subsp. aureus Mu50
accgucaaacuuaaaacua

SEQ ID NO: 3989304 - RNA, 17 nt, Staphylococcus aureus subsp. aureus Mu50
accgucacaaaccauuc

SEQ ID NO: 3989305 - RNA, 20 nt, Staphylococcus aureus subsp. aureus Mu50
accgucuucucuaucaguau

SEQ ID NO: 3989306 - RNA, 14 nt, Staphylococcus aureus subsp. aureus Mu50
accgugguucaaaa

SEQ ID NO: 3989307 - RNA, 14 nt, Staphylococcus aureus subsp. aureus Mu50
accguuaaaauaua

SEQ ID NO: 3989308 - RNA, 21 nt, Staphylococcus aureus subsp. aureus Mu50
accguuaguacggcugcuuua

SEQ ID NO: 3989309 - RNA, 14 nt, Staphylococcus aureus subsp. aureus Mu50
accguuuuuauaua

SEQ ID NO: 3989310 - RNA, 18 nt, Staphylococcus aureus subsp. aureus Mu50
accguuuuucaucaaucc

SEQ ID NO: 3989311 - RNA, 13 nt, Staphylococcus aureus subsp. aureus Mu50
accuaaaaacaaa

SEQ ID NO: 3989312 - RNA, 16 nt, Staphylococcus aureus subsp. aureus Mu50
accuaaaaacagcagu

SEQ ID NO: 3989313 - RNA, 12 nt, Staphylococcus aureus subsp. aureus Mu50
accuaaaauacc

SEQ ID NO: 3989314 - RNA, 14 nt, Staphylococcus aureus subsp. aureus Mu50
accuaaaauaccca

SEQ ID NO: 3989315 - RNA, 20 nt, Staphylococcus aureus subsp. aureus Mu50
accuaaaucuccugcugcua

SEQ ID NO: 3989316 - RNA, 19 nt, Staphylococcus aureus subsp. aureus Mu50
accuaaaugauuaauaaca

SEQ ID NO: 3989317 - RNA, 21 nt, Staphylococcus aureus subsp. aureus Mu50
accuaaaugauuaauaacaua

SEQ ID NO: 3989318 - RNA, 19 nt, Staphylococcus aureus subsp. aureus Mu50
accuaagcugauuaaaaug

SEQ ID NO: 3989319 - RNA, 14 nt, Staphylococcus aureus subsp. aureus Mu50
accuaauaacgcau

SEQ ID NO: 3989320 - RNA, 23 nt, Staphylococcus aureus subsp. aureus Mu50
accuaauauauuacuaaccuauu

SEQ ID NO: 3989321 - RNA, 18 nt, Staphylococcus aureus subsp. aureus Mu50
accuaauauuuuaaacgu

SEQ ID NO: 3989322 - RNA, 16 nt, Staphylococcus aureus subsp. aureus Mu50
accuaaucugcaacga

SEQ ID NO: 3989323 - RNA, 16 nt, Staphylococcus aureus subsp. aureus Mu50
accuaauucauauaua

SEQ ID NO: 3989324 - RNA, 18 nt, Staphylococcus aureus subsp. aureus Mu50
accuaauugcuuaauauc

SEQ ID NO: 3989325 - RNA, 16 nt, Staphylococcus aureus subsp. aureus Mu50
accuaauuuaauacca

SEQ ID NO: 3989326 - RNA, 13 nt, Staphylococcus aureus subsp. aureus Mu50
accuacaacacca

SEQ ID NO: 3989327 - RNA, 18 nt, Staphylococcus aureus subsp. aureus Mu50
accuacaauauagaaaau

SEQ ID NO: 3989328 - RNA, 17 nt, Staphylococcus aureus subsp. aureus Mu50
accuacacggucccaag

SEQ ID NO: 3989329 - RNA, 16 nt, Staphylococcus aureus subsp. aureus Mu50
accuaccacaauaauc

SEQ ID NO: 3989330 - RNA, 19 nt, Staphylococcus aureus subsp. aureus Mu50
accuacguguguaguagca

SEQ ID NO: 3989331 - RNA, 19 nt, Staphylococcus aureus subsp. aureus Mu50
accuacuuugauauguuuc

SEQ ID NO: 3989332 - RNA, 22 nt, Staphylococcus aureus subsp. aureus Mu50
accuacuuugauauguuuccuc

SEQ ID NO: 3989333 - RNA, 18 nt, Staphylococcus aureus subsp. aureus Mu50
accuacuuuuucaauaug

SEQ ID NO: 3989334 - RNA, 19 nt, Staphylococcus aureus subsp. aureus Mu50
accuacuuuuucaauaugu

SEQ ID NO: 3989335 - RNA, 14 nt, Staphylococcus aureus subsp. aureus Mu50
accuagguuaaaga

SEQ ID NO: 3989336 - RNA, 15 nt, Staphylococcus aureus subsp. aureus Mu50
accuagguuaaagau

SEQ ID NO: 3989337 - RNA, 16 nt, Staphylococcus aureus subsp. aureus Mu50
accuauaagucucuuu

SEQ ID NO: 3989338 - RNA, 14 nt, Staphylococcus aureus subsp. aureus Mu50
accuauauuaagca

SEQ ID NO: 3989339 - RNA, 23 nt, Staphylococcus aureus subsp. aureus Mu50
accuaucaucaaucguuaauuuc

SEQ ID NO: 3989340 - RNA, 21 nt, Staphylococcus aureus subsp. aureus Mu50
accuaucccuguaaaaccaua

SEQ ID NO: 3989341 - RNA, 20 nt, Staphylococcus aureus subsp. aureus Mu50
accuaucgucgcuaauaaac

SEQ ID NO: 3989342 - RNA, 17 nt, Staphylococcus aureus subsp. aureus Mu50
accuauuccuauuacua

SEQ ID NO: 3989343 - RNA, 12 nt, Staphylococcus aureus subsp. aureus Mu50
accuauuuuuua

SEQ ID NO: 3989344 - RNA, 20 nt, Staphylococcus aureus subsp. aureus Mu50
accucauccgccaauuaaaa

SEQ ID NO: 3989345 - RNA, 17 nt, Staphylococcus aureus subsp. aureus Mu50
acguugcagagaauaua

SEQ ID NO: 3989346 - RNA, 20 nt, Staphylococcus aureus subsp. aureus Mu50
acguugguuuaaaaauugau

SEQ ID NO: 3989347 - RNA, 22 nt, Staphylococcus aureus subsp. aureus Mu50
acguuuaauaccuaugauauau

SEQ ID NO: 3989348 - RNA, 19 nt, Staphylococcus aureus subsp. aureus Mu50
acguuucaauguaucaaga

SEQ ID NO: 3989349 - RNA, 16 nt, Staphylococcus aureus subsp. aureus Mu50
acguuugcauauccuu

SEQ ID NO: 3989350 - RNA, 21 nt, Staphylococcus aureus subsp. aureus Mu50
acguuuuaaagguuaaauauu

SEQ ID NO: 3989351 - RNA, 19 nt, Staphylococcus aureus subsp. aureus Mu50
acguuuuaaauaaaugacu

SEQ ID NO: 3989352 - RNA, 20 nt, Staphylococcus aureus subsp. aureus Mu50
acguuuuaaauaaaugacuu

SEQ ID NO: 3989353 - RNA, 11 nt, Staphylococcus aureus subsp. aureus Mu50
acguuuucuag

SEQ ID NO: 3989354 - RNA, 16 nt, Staphylococcus aureus subsp. aureus Mu50
acguuuucuagguaau

SEQ ID NO: 3989355 - RNA, 21 nt, Staphylococcus aureus subsp. aureus Mu50
acguuuucuagguaauacgaa

SEQ ID NO: 3989356 - RNA, 20 nt, Staphylococcus aureus subsp. aureus Mu50
acguuuugguuguucuuuuu

SEQ ID NO: 3989357 - RNA, 14 nt, Staphylococcus aureus subsp. aureus Mu50
acguuuuucuuuaa

SEQ ID NO: 3989358 - RNA, 15 nt, Staphylococcus aureus subsp. aureus Mu50
acguuuuuuuaaaua

SEQ ID NO: 3989359 - RNA, 15 nt, Staphylococcus aureus subsp. aureus Mu50
acguuuuuuuauaaa

SEQ ID NO: 3989360 - RNA, 23 nt, Staphylococcus aureus subsp. aureus Mu50
acguuuuuuuauaaauuauagua

SEQ ID NO: 3989361 - RNA, 22 nt, Staphylococcus aureus subsp. aureus Mu50
acuaaaaagaagcucccauuaa

SEQ ID NO: 3989362 - RNA, 15 nt, Staphylococcus aureus subsp. aureus Mu50
acuaaaaauauauuu

SEQ ID NO: 3989363 - RNA, 16 nt, Staphylococcus aureus subsp. aureus Mu50
acuaaaaauauauuuc

SEQ ID NO: 3989364 - RNA, 19 nt, Staphylococcus aureus subsp. aureus Mu50
acuaaaacaaauucauauu

SEQ ID NO: 3989365 - RNA, 22 nt, Staphylococcus aureus subsp. aureus Mu50
acuaaaaugucuuugaaaaacu

SEQ ID NO: 3989366 - RNA, 15 nt, Staphylococcus aureus subsp. aureus Mu50
acuaaaccauugaau

SEQ ID NO: 3989367 - RNA, 16 nt, Staphylococcus aureus subsp. aureus Mu50
acuaaacuuuucuuca

SEQ ID NO: 3989368 - RNA, 17 nt, Staphylococcus aureus subsp. aureus Mu50
acuaaaguaaauaacac

SEQ ID NO: 3989369 - RNA, 15 nt, Staphylococcus aureus subsp. aureus Mu50
acuaaauaaguaguu

SEQ ID NO: 3989370 - RNA, 12 nt, Staphylococcus aureus subsp. aureus Mu50
acuaaaugaauu

SEQ ID NO: 3989371 - RNA, 16 nt, Staphylococcus aureus subsp. aureus Mu50
acuaaaugaauugcuu

SEQ ID NO: 3989372 - RNA, 21 nt, Staphylococcus aureus subsp. aureus Mu50
acuaaauguucuggaauaccu

SEQ ID NO: 3989373 - RNA, 16 nt, Staphylococcus aureus subsp. aureus Mu50
acuaaauucaauaauc

SEQ ID NO: 3989374 - RNA, 17 nt, Staphylococcus aureus subsp. aureus Mu50
acuaacauaauuuuuau

SEQ ID NO: 3989375 - RNA, 20 nt, Staphylococcus aureus subsp. aureus Mu50
acuaacauaauuuuuauuua

SEQ ID NO: 3989376 - RNA, 13 nt, Staphylococcus aureus subsp. aureus Mu50
acuaacauguuau

SEQ ID NO: 3989377 - RNA, 22 nt, Staphylococcus aureus subsp. aureus Mu50
acuaacauugguaccuuuuuau

SEQ ID NO: 3989378 - RNA, 16 nt, Staphylococcus aureus subsp. aureus Mu50
acuaaccuauuaaaaa

SEQ ID NO: 3989379 - RNA, 17 nt, Staphylococcus aureus subsp. aureus Mu50
acuaagaccaugagaaa

SEQ ID NO: 3989380 - RNA, 14 nt, Staphylococcus aureus subsp. aureus Mu50
acuaagauauauug

SEQ ID NO: 3989381 - RNA, 15 nt, Staphylococcus aureus subsp. aureus Mu50
acuaagcuuucauua

SEQ ID NO: 3989382 - RNA, 19 nt, Staphylococcus aureus subsp. aureus Mu50
acuaagcuuucauuaauuu

SEQ ID NO: 3989383 - RNA, 19 nt, Staphylococcus aureus subsp. aureus Mu50
acuaaguaaccaagucuaa

SEQ ID NO: 3989384 - RNA, 17 nt, Staphylococcus aureus subsp. aureus Mu50
acuaaguauaguguuaa

SEQ ID NO: 3989385 - RNA, 21 nt, Staphylococcus aureus subsp. aureus Mu50
acuaagucguucaauuguuga

SEQ ID NO: 3989386 - RNA, 18 nt, Staphylococcus aureus subsp. aureus Mu50
acuaaguuuguuuucuuu

SEQ ID NO: 3989387 - RNA, 11 nt, Staphylococcus aureus subsp. aureus Mu50
acuaauaauug

SEQ ID NO: 3989388 - RNA, 13 nt, Staphylococcus aureus subsp. aureus Mu50
acuaauaauuugu

SEQ ID NO: 3989389 - RNA, 16 nt, Staphylococcus aureus subsp. aureus Mu50
acuaauaauuuguaau

SEQ ID NO: 3989390 - RNA, 17 nt, Staphylococcus aureus subsp. aureus Mu50
acuaauaugauugguuu

SEQ ID NO: 3989391 - RNA, 21 nt, Staphylococcus aureus subsp. aureus Mu50
acuaauaugauugguuuguga

SEQ ID NO: 3989392 - RNA, 18 nt, Staphylococcus aureus subsp. aureus Mu50
acuaauauuucuuagaua

SEQ ID NO: 3989393 - RNA, 21 nt, Staphylococcus aureus subsp. aureus Mu50
acuaauauuucuuagauacuc

SEQ ID NO: 3989394 - RNA, 16 nt, Staphylococcus aureus subsp. aureus Mu50
acuaaucaaagaaaaa

SEQ ID NO: 3989395 - RNA, 23 nt, Staphylococcus aureus subsp. aureus Mu50
acuaaucaacuuuuuguuaauuu

SEQ ID NO: 3989396 - RNA, 13 nt, Staphylococcus aureus subsp. aureus Mu50
acuaaucguguau

SEQ ID NO: 3989397 - RNA, 18 nt, Staphylococcus aureus subsp. aureus Mu50
acuaaucguuguggcuuu

SEQ ID NO: 3989398 - RNA, 21 nt, Staphylococcus aureus subsp. aureus Mu50
acuaaucuuaguuaaaauuca

SEQ ID NO: 3989399 - RNA, 17 nt, Staphylococcus aureus subsp. aureus Mu50
acuaaucuuuuuuuaau

SEQ ID NO: 3989400 - RNA, 20 nt, Staphylococcus aureus subsp. aureus Mu50
acuaaucuuuuuuuaauuaa

SEQ ID NO: 3989401 - RNA, 20 nt, Staphylococcus aureus subsp. aureus Mu50
acuaaugauaguacauuuau

SEQ ID NO: 3989402 - RNA, 20 nt, Staphylococcus aureus subsp. aureus Mu50
acuaauggcacuuaauauaa

SEQ ID NO: 3989403 - RNA, 19 nt, Staphylococcus aureus subsp. aureus Mu50
acuaaugucgcacuauaaa

SEQ ID NO: 3989404 - RNA, 15 nt, Staphylococcus aureus subsp. aureus Mu50
acuaauguuaaaaua

SEQ ID NO: 3989405 - RNA, 11 nt, Staphylococcus aureus subsp. aureus Mu50
acuaauuaaag

SEQ ID NO: 3989406 - RNA, 20 nt, Staphylococcus aureus subsp. aureus Mu50
acuaauugaucagcauuuaa

SEQ ID NO: 3989407 - RNA, 15 nt, Staphylococcus aureus subsp. aureus Mu50
acuaauuuaaagcau

SEQ ID NO: 3989408 - RNA, 19 nt, Staphylococcus aureus subsp. aureus Mu50
acuaauuuauuaauuuuau

SEQ ID NO: 3989409 - RNA, 18 nt, Staphylococcus aureus subsp. aureus Mu50
acuaauuucuauagaaaa

SEQ ID NO: 3989410 - RNA, 23 nt, Staphylococcus aureus subsp. aureus Mu50
acuacaaacuugauuauguaauu

SEQ ID NO: 3989411 - RNA, 13 nt, Staphylococcus aureus subsp. aureus Mu50
acuacaacuuaag

SEQ ID NO: 3989412 - RNA, 19 nt, Staphylococcus aureus subsp. aureus Mu50
acuacaagucauuauccaa

SEQ ID NO: 3989413 - RNA, 12 nt, Staphylococcus aureus subsp. aureus Mu50
acuacaagugga

SEQ ID NO: 3989414 - RNA, 19 nt, Staphylococcus aureus subsp. aureus Mu50
acuacacacguagaaagau

SEQ ID NO: 3989415 - RNA, 21 nt, Staphylococcus aureus subsp. aureus Mu50
acuacacacguagaaagaugu

SEQ ID NO: 3989416 - RNA, 22 nt, Staphylococcus aureus subsp. aureus Mu50
acuacacuccccuuaucaaaac

SEQ ID NO: 3989417 - RNA, 15 nt, Staphylococcus aureus subsp. aureus Mu50
acuacaguguaugau

SEQ ID NO: 3989418 - RNA, 14 nt, Staphylococcus aureus subsp. aureus Mu50
acuaccuauuaaua

SEQ ID NO: 3989419 - RNA, 15 nt, Staphylococcus aureus subsp. aureus Mu50
acuaccuauuaauau

SEQ ID NO: 3989420 - RNA, 19 nt, Staphylococcus aureus subsp. aureus Mu50
acuaccuauuaauaucaua

SEQ ID NO: 3989421 - RNA, 16 nt, Staphylococcus aureus subsp. aureus Mu50
acuaccuguuggcuuu

SEQ ID NO: 3989422 - RNA, 14 nt, Staphylococcus aureus subsp. aureus Mu50
acuaccuuccauuu

SEQ ID NO: 3989423 - RNA, 16 nt, Staphylococcus aureus subsp. aureus Mu50
acuacuacauuauuac

SEQ ID NO: 3989424 - RNA, 15 nt, Staphylococcus aureus subsp. aureus Mu50
acuacuauugauauu

SEQ ID NO: 3989425 - RNA, 22 nt, Staphylococcus aureus subsp. aureus Mu50
acuacugauuuauugauaaaua

SEQ ID NO: 3989426 - RNA, 19 nt, Staphylococcus aureus subsp. aureus Mu50
acuacugucucaucuucua

SEQ ID NO: 3989427 - RNA, 22 nt, Staphylococcus aureus subsp. aureus Mu50
acuacuuaaauuaagaauaauc

SEQ ID NO: 3989428 - RNA, 20 nt, Staphylococcus aureus subsp. aureus Mu50
acuacuuaauuaauaauuua

SEQ ID NO: 3989429 - RNA, 15 nt, Staphylococcus aureus subsp. aureus Mu50
acuacuuuauaaaua

SEQ ID NO: 3989430 - RNA, 11 nt, Staphylococcus aureus subsp. aureus Mu50
acuagauaguu

SEQ ID NO: 3989431 - RNA, 13 nt, Staphylococcus aureus subsp. aureus Mu50
acuagauaguuua

SEQ ID NO: 3989432 - RNA, 19 nt, Staphylococcus aureus subsp. aureus Mu50
acucugagcacuuagcaau

SEQ ID NO: 3989433 - RNA, 17 nt, Staphylococcus aureus subsp. aureus Mu50
acucugauuacauauac

SEQ ID NO: 3989434 - RNA, 16 nt, Staphylococcus aureus subsp. aureus Mu50
acucugggcauuuuga

SEQ ID NO: 3989435 - RNA, 16 nt, Staphylococcus aureus subsp. aureus Mu50
acucuggucugugaua

SEQ ID NO: 3989436 - RNA, 22 nt, Staphylococcus aureus subsp. aureus Mu50
acucuguuugucacuuaacuca

SEQ ID NO: 3989437 - RNA, 18 nt, Staphylococcus aureus subsp. aureus Mu50
acucuucaguacgaacaa

SEQ ID NO: 3989438 - RNA, 16 nt, Staphylococcus aureus subsp. aureus Mu50
acugaaacuaaauuaa

SEQ ID NO: 3989439 - RNA, 20 nt, Staphylococcus aureus subsp. aureus Mu50
acugaaauuucauaaaguuu

SEQ ID NO: 3989440 - RNA, 16 nt, Staphylococcus aureus subsp. aureus Mu50
acugaauuaauaucca

SEQ ID NO: 3989441 - RNA, 22 nt, Staphylococcus aureus subsp. aureus Mu50
acugacacuuuaaccacuccuu

SEQ ID NO: 3989442 - RNA, 16 nt, Staphylococcus aureus subsp. aureus Mu50
acugacuagccuucaa

SEQ ID NO: 3989443 - RNA, 22 nt, Staphylococcus aureus subsp. aureus Mu50
acugacuagccuucaauauuuc

SEQ ID NO: 3989444 - RNA, 17 nt, Staphylococcus aureus subsp. aureus Mu50
acugagaaaucuuaaag

SEQ ID NO: 3989445 - RNA, 19 nt, Staphylococcus aureus subsp. aureus Mu50
acugagaaaucuuaaagau

SEQ ID NO: 3989446 - RNA, 22 nt, Staphylococcus aureus subsp. aureus Mu50
acugauaaaaggggaaaucauu

SEQ ID NO: 3989447 - RNA, 13 nt, Staphylococcus aureus subsp. aureus Mu50
acugauaauacug

SEQ ID NO: 3989448 - RNA, 20 nt, Staphylococcus aureus subsp. aureus Mu50
acugauaauacuguuuaaau

SEQ ID NO: 3989449 - RNA, 13 nt, Staphylococcus aureus subsp. aureus Mu50
acugauaauugau

SEQ ID NO: 3989450 - RNA, 15 nt, Staphylococcus aureus subsp. aureus Mu50
acugauggaaaauua

SEQ ID NO: 3989451 - RNA, 20 nt, Staphylococcus aureus subsp. aureus Mu50
acugauuaaacuguuuguuu

SEQ ID NO: 3989452 - RNA, 22 nt, Staphylococcus aureus subsp. aureus Mu50
acugauucaccagguuuuuuau

SEQ ID NO: 3989453 - RNA, 16 nt, Staphylococcus aureus subsp. aureus Mu50
acugauuucgcccacc

SEQ ID NO: 3989454 - RNA, 13 nt, Staphylococcus aureus subsp. aureus Mu50
acugauuuuguuu

SEQ ID NO: 3989455 - RNA, 18 nt, Staphylococcus aureus subsp. aureus Mu50
acugauuuuguuucaaac

SEQ ID NO: 3989456 - RNA, 15 nt, Staphylococcus aureus subsp. aureus Mu50
acugauuuuuuuuau

SEQ ID NO: 3989457 - RNA, 19 nt, Staphylococcus aureus subsp. aureus Mu50
acugcaaacacaguacaaa

SEQ ID NO: 3989458 - RNA, 22 nt, Staphylococcus aureus subsp. aureus Mu50
acugcaaauacgaguguuuuaa

SEQ ID NO: 3989459 - RNA, 18 nt, Staphylococcus aureus subsp. aureus Mu50
acugcaacaccacacagc

SEQ ID NO: 3989460 - RNA, 19 nt, Staphylococcus aureus subsp. aureus Mu50
acugcacaucauaauaaau

SEQ ID NO: 3989461 - RNA, 14 nt, Staphylococcus aureus subsp. aureus Mu50
acugcaccuccaac

SEQ ID NO: 3989462 - RNA, 21 nt, Staphylococcus aureus subsp. aureus Mu50
acugcauagguaaccuuaaau

SEQ ID NO: 3989463 - RNA, 14 nt, Staphylococcus aureus subsp. aureus Mu50
acugcauauaaagu

SEQ ID NO: 3989464 - RNA, 21 nt, Staphylococcus aureus subsp. aureus Mu50
acugccaauaaaaugcaauuu

SEQ ID NO: 3989465 - RNA, 16 nt, Staphylococcus aureus subsp. aureus Mu50
acugccauauguuuua

SEQ ID NO: 3989466 - RNA, 20 nt, Staphylococcus aureus subsp. aureus Mu50
acugccauucuuuuucucaa

SEQ ID NO: 3989467 - RNA, 23 nt, Staphylococcus aureus subsp. aureus Mu50
acugccuaauacacuugauaaaa

SEQ ID NO: 3989468 - RNA, 14 nt, Staphylococcus aureus subsp. aureus Mu50
acugccuuuuugua

SEQ ID NO: 3989469 - RNA, 16 nt, Staphylococcus aureus subsp. aureus Mu50
acugccuuuuuguaau

SEQ ID NO: 3989470 - RNA, 16 nt, Staphylococcus aureus subsp. aureus Mu50
acugcgacauguccau

SEQ ID NO: 3989471 - RNA, 18 nt, Staphylococcus aureus subsp. aureus Mu50
acugcuaauauuagauau

SEQ ID NO: 3989472 - RNA, 14 nt, Staphylococcus aureus subsp. aureus Mu50
acugcuaauuuuuu

SEQ ID NO: 3989473 - RNA, 16 nt, Staphylococcus aureus subsp. aureus Mu50
acugcuaauuuuuuca

SEQ ID NO: 3989474 - RNA, 19 nt, Staphylococcus aureus subsp. aureus Mu50
acugcuaauuuuuucauca

SEQ ID NO: 3989475 - RNA, 22 nt, Staphylococcus aureus subsp. aureus Mu50
acugcuuuggacacaauaccuu

SEQ ID NO: 3989476 - RNA, 13 nt, Staphylococcus aureus subsp. aureus Mu50
acugcuuuuuuau

SEQ ID NO: 3989477 - RNA, 18 nt, Staphylococcus aureus subsp. aureus Mu50
acuguaguggaagacaau

SEQ ID NO: 3989478 - RNA, 12 nt, Staphylococcus aureus subsp. aureus Mu50
acuguauaccuc

SEQ ID NO: 3989479 - RNA, 21 nt, Staphylococcus aureus subsp. aureus Mu50
acuguauaccucuuagcacuu

SEQ ID NO: 3989480 - RNA, 22 nt, Staphylococcus aureus subsp. aureus Mu50
acuguauagcuggcuuuuuaau

SEQ ID NO: 3989481 - RNA, 20 nt, Staphylococcus aureus subsp. aureus Mu50
acuguaugccgccuaauaau

SEQ ID NO: 3989482 - RNA, 22 nt, Staphylococcus aureus subsp. aureus Mu50
acugugacucggggaauuuuua

SEQ ID NO: 3989483 - RNA, 22 nt, Staphylococcus aureus subsp. aureus Mu50
acugugauauuaauugaaaaac

SEQ ID NO: 3989484 - RNA, 19 nt, Staphylococcus aureus subsp. aureus Mu50
acuguguuuagguauauaa

SEQ ID NO: 3989485 - RNA, 22 nt, Staphylococcus aureus subsp. aureus Mu50
acuguuaaagucuguugguuua

SEQ ID NO: 3989486 - RNA, 21 nt, Staphylococcus aureus subsp. aureus Mu50
acuguucuuucgucuuguaaa

SEQ ID NO: 3989487 - RNA, 22 nt, Staphylococcus aureus subsp. aureus Mu50
acuguucuuucgucuuguaaac

SEQ ID NO: 3989488 - RNA, 15 nt, Staphylococcus aureus subsp. aureus Mu50
acuguuggaauaccu

SEQ ID NO: 3989489 - RNA, 16 nt, Staphylococcus aureus subsp. aureus Mu50
acuguuggaauaccuu

SEQ ID NO: 3989490 - RNA, 19 nt, Staphylococcus aureus subsp. aureus Mu50
acuguuuaucaugaugaua

SEQ ID NO: 3989491 - RNA, 17 nt, Staphylococcus aureus subsp. aureus Mu50
acuguuucuguaaaagu

SEQ ID NO: 3989492 - RNA, 16 nt, Staphylococcus aureus subsp. aureus Mu50
acuguuugcuuuauca

SEQ ID NO: 3989493 - RNA, 17 nt, Staphylococcus aureus subsp. aureus Mu50
acuguuuuauaaaugaa

SEQ ID NO: 3989494 - RNA, 18 nt, Staphylococcus aureus subsp. aureus Mu50
acuguuuuauuaugaauu

SEQ ID NO: 3989495 - RNA, 17 nt, Staphylococcus aureus subsp. aureus Mu50
acuuaaaacuauaaccu

SEQ ID NO: 3989496 - RNA, 22 nt, Staphylococcus aureus subsp. aureus Mu50
acuuaaaauuucccuuuauacu

SEQ ID NO: 3989497 - RNA, 23 nt, Staphylococcus aureus subsp. aureus Mu50
acuuaaauaucgacaaauuaaaa

SEQ ID NO: 3989498 - RNA, 18 nt, Staphylococcus aureus subsp. aureus Mu50
acuuaaauggaugauagu

SEQ ID NO: 3989499 - RNA, 16 nt, Staphylococcus aureus subsp. aureus Mu50
acuuaaccauuuaaaa

SEQ ID NO: 3989500 - RNA, 15 nt, Staphylococcus aureus subsp. aureus Mu50
acuuaacuuaagcuc

SEQ ID NO: 3989501 - RNA, 16 nt, Staphylococcus aureus subsp. aureus Mu50
acuuaacuuguguuau

SEQ ID NO: 3989502 - RNA, 16 nt, Staphylococcus aureus subsp. aureus Mu50
acuuaauaaauaauuu

SEQ ID NO: 3989503 - RNA, 13 nt, Staphylococcus aureus subsp. aureus Mu50
acuuaauaaccau

SEQ ID NO: 3989504 - RNA, 14 nt, Staphylococcus aureus subsp. aureus Mu50
acuuaauauaguua

SEQ ID NO: 3989505 - RNA, 13 nt, Staphylococcus aureus subsp. aureus Mu50
acuuaauaucaua

SEQ ID NO: 3989506 - RNA, 16 nt, Staphylococcus aureus subsp. aureus Mu50
acuuaaucguucccau

SEQ ID NO: 3989507 - RNA, 23 nt, Staphylococcus aureus subsp. aureus Mu50
acuuaaugacuucuuuauauuua

SEQ ID NO: 3989508 - RNA, 16 nt, Staphylococcus aureus subsp. aureus Mu50
acuuaaugcuucaaau

SEQ ID NO: 3989509 - RNA, 13 nt, Staphylococcus aureus subsp. aureus Mu50
acuuaauuaaaaa

SEQ ID NO: 3989510 - RNA, 18 nt, Staphylococcus aureus subsp. aureus Mu50
acuuaauuaauaauuuaa

SEQ ID NO: 3989511 - RNA, 12 nt, Staphylococcus aureus subsp. aureus Mu50
acuuacaaauau

SEQ ID NO: 3989512 - RNA, 18 nt, Staphylococcus aureus subsp. aureus Mu50
acuuacaaauauugugga

SEQ ID NO: 3989513 - RNA, 17 nt, Staphylococcus aureus subsp. aureus Mu50
acuuacauuacauauau

SEQ ID NO: 3989514 - RNA, 21 nt, Staphylococcus aureus subsp. aureus Mu50
acuuacauuuuaauaaaauca

SEQ ID NO: 3989515 - RNA, 23 nt, Staphylococcus aureus subsp. aureus Mu50
acuuacauuuuaauaaaaucauc

SEQ ID NO: 3989516 - RNA, 15 nt, Staphylococcus aureus subsp. aureus Mu50
acuuaccuuucaaau

SEQ ID NO: 3989517 - RNA, 17 nt, Staphylococcus aureus subsp. aureus Mu50
acuuaccuuucaaauau

SEQ ID NO: 3989518 - RNA, 19 nt, Staphylococcus aureus subsp. aureus Mu50
acuuacugugaaaauacca

SEQ ID NO: 3989519 - RNA, 20 nt, Staphylococcus aureus subsp. aureus Mu50
acuuacugugaaaauaccaa

SEQ ID NO: 3989520 - RNA, 22 nt, Staphylococcus aureus subsp. aureus Mu50
acuuacuuuucuaaacaacuuc

SEQ ID NO: 3989521 - RNA, 20 nt, Staphylococcus aureus subsp. aureus Mu50
acuuagggugacucaaugaa

SEQ ID NO: 3989522 - RNA, 21 nt, Staphylococcus aureus subsp. aureus Mu50
acuuagggugacucaaugaau

SEQ ID NO: 3989523 - RNA, 15 nt, Staphylococcus aureus subsp. aureus Mu50
acuuaguaauaagac

SEQ ID NO: 3989524 - RNA, 15 nt, Staphylococcus aureus subsp. aureus Mu50
acuuauaacugauaa

SEQ ID NO: 3989525 - RNA, 16 nt, Staphylococcus aureus subsp. aureus Mu50
acuuauaauauuaaau

SEQ ID NO: 3989526 - RNA, 12 nt, Staphylococcus aureus subsp. aureus Mu50
acuuauauauuc

SEQ ID NO: 3989527 - RNA, 20 nt, Staphylococcus aureus subsp. aureus Mu50
acuuauauauucaauaauua

SEQ ID NO: 3989528 - RNA, 15 nt, Staphylococcus aureus subsp. aureus Mu50
acuuaugagcaaagc

SEQ ID NO: 3989529 - RNA, 17 nt, Staphylococcus aureus subsp. aureus Mu50
acuuaugagcaaagcaa

SEQ ID NO: 3989530 - RNA, 23 nt, Staphylococcus aureus subsp. aureus Mu50
acuuauggguucaauaucgauuu

SEQ ID NO: 3989531 - RNA, 21 nt, Staphylococcus aureus subsp. aureus Mu50
acuuauuaauuaauagagaca

SEQ ID NO: 3989532 - RNA, 15 nt, Staphylococcus aureus subsp. aureus Mu50
acuuauuauuuugua

SEQ ID NO: 3989533 - RNA, 18 nt, Staphylococcus aureus subsp. aureus Mu50
acuuauucuucacuuuca

SEQ ID NO: 3989534 - RNA, 14 nt, Staphylococcus aureus subsp. aureus Mu50
acuuauuucuuuuc

SEQ ID NO: 3989535 - RNA, 15 nt, Staphylococcus aureus subsp. aureus Mu50
acuuauuugaaugca

SEQ ID NO: 3989536 - RNA, 18 nt, Staphylococcus aureus subsp. aureus Mu50
acuuauuugaaugcaaau

SEQ ID NO: 3989537 - RNA, 18 nt, Staphylococcus aureus subsp. aureus Mu50
acuuauuugccauauaca

SEQ ID NO: 3989538 - RNA, 20 nt, Staphylococcus aureus subsp. aureus Mu50
acuuauuugccauauacaca

SEQ ID NO: 3989539 - RNA, 17 nt, Staphylococcus aureus subsp. aureus Mu50
acuuauuuuucaucauu

SEQ ID NO: 3989540 - RNA, 12 nt, Staphylococcus aureus subsp. aureus Mu50
acuucaaacaaa

SEQ ID NO: 3989541 - RNA, 16 nt, Staphylococcus aureus subsp. aureus Mu50
acuucaaacaaagggg

SEQ ID NO: 3989542 - RNA, 18 nt, Staphylococcus aureus subsp. aureus Mu50
acuucaaacaaaggggua

SEQ ID NO: 3989543 - RNA, 18 nt, Staphylococcus aureus subsp. aureus Mu50
acuucaauaacaaugcag

SEQ ID NO: 3989544 - RNA, 23 nt, Staphylococcus aureus subsp. aureus Mu50
acuucaauuuaugguaaaaccca

SEQ ID NO: 3989545 - RNA, 12 nt, Staphylococcus aureus subsp. aureus Mu50
acuucacauuua

SEQ ID NO: 3989546 - RNA, 13 nt, Staphylococcus aureus subsp. aureus Mu50
acuucaccaucuu

SEQ ID NO: 3989547 - RNA, 13 nt, Staphylococcus aureus subsp. aureus Mu50
acuucauaaguca

SEQ ID NO: 3989548 - RNA, 18 nt, Staphylococcus aureus subsp. aureus Mu50
acuucauaauauauccug

SEQ ID NO: 3989549 - RNA, 15 nt, Staphylococcus aureus subsp. aureus Mu50
acuucauauaaugcu

SEQ ID NO: 3989550 - RNA, 18 nt, Staphylococcus aureus subsp. aureus Mu50
acuucauauccuucauua

SEQ ID NO: 3989551 - RNA, 16 nt, Staphylococcus aureus subsp. aureus Mu50
acuucaucacucgcaa

SEQ ID NO: 3989552 - RNA, 19 nt, Staphylococcus aureus subsp. aureus Mu50
acuucaucuguaucaauca

SEQ ID NO: 3989553 - RNA, 14 nt, Staphylococcus aureus subsp. aureus Mu50
acuuccaacauaua

SEQ ID NO: 3989554 - RNA, 17 nt, Staphylococcus aureus subsp. aureus Mu50
acuuccgacugcaccuc

SEQ ID NO: 3989555 - RNA, 14 nt, Staphylococcus aureus subsp. aureus Mu50
acuuccuuagucaa

SEQ ID NO: 3989556 - RNA, 14 nt, Staphylococcus aureus subsp. aureus Mu50
acuuccuuccauuc

SEQ ID NO: 3989557 - RNA, 15 nt, Staphylococcus aureus subsp. aureus Mu50
acuuccuuuuuuuaa

SEQ ID NO: 3989558 - RNA, 16 nt, Staphylococcus aureus subsp. aureus Mu50
acuuccuuuuuuuaag

SEQ ID NO: 3989559 - RNA, 16 nt, Staphylococcus aureus subsp. aureus Mu50
acuucuaauuugcaaa

SEQ ID NO: 3989560 - RNA, 22 nt, Staphylococcus aureus subsp. aureus Mu50
acuucuauauuaauagaaagug

SEQ ID NO: 3989561 - RNA, 17 nt, Staphylococcus aureus subsp. aureus Mu50
acuucuauuaauaauuu

SEQ ID NO: 3989562 - RNA, 22 nt, Staphylococcus aureus subsp. aureus Mu50
acuucuauuuuauaauaaauuu

SEQ ID NO: 3989563 - RNA, 16 nt, Staphylococcus aureus subsp. aureus Mu50
acuucucaauuuagua

SEQ ID NO: 3989564 - RNA, 17 nt, Staphylococcus aureus subsp. aureus Mu50
acuucucccuuaaauac

SEQ ID NO: 3989565 - RNA, 16 nt, Staphylococcus aureus subsp. aureus Mu50
acuucucuaucagucc

SEQ ID NO: 3989566 - RNA, 23 nt, Staphylococcus aureus subsp. aureus Mu50
acuucucucuuauuaaaaaagaa

SEQ ID NO: 3989567 - RNA, 16 nt, Staphylococcus aureus subsp. aureus Mu50
acuucugauucuucac

SEQ ID NO: 3989568 - RNA, 23 nt, Staphylococcus aureus subsp. aureus Mu50
acuucugauucuucacuaaaaau

SEQ ID NO: 3989569 - RNA, 22 nt, Staphylococcus aureus subsp. aureus Mu50
acuucuuaaaauaugauuuaaa

SEQ ID NO: 3989570 - RNA, 18 nt, Staphylococcus aureus subsp. aureus Mu50
acuucuuaacuugaaaug

SEQ ID NO: 3989571 - RNA, 17 nt, Staphylococcus aureus subsp. aureus Mu50
acuucuucuucagacca

SEQ ID NO: 3989572 - RNA, 21 nt, Staphylococcus aureus subsp. aureus Mu50
acuucuuguucgauaaucguu

SEQ ID NO: 3989573 - RNA, 15 nt, Staphylococcus aureus subsp. aureus Mu50
acuucuuuauauuua

SEQ ID NO: 3989574 - RNA, 16 nt, Staphylococcus aureus subsp. aureus Mu50
acuucuuuauauuuau

SEQ ID NO: 3989575 - RNA, 18 nt, Staphylococcus aureus subsp. aureus Mu50
acuucuuuauauuuauca

SEQ ID NO: 3989576 - RNA, 22 nt, Staphylococcus aureus subsp. aureus Mu50
acuucuuuucuuugauaacaau

SEQ ID NO: 3989577 - RNA, 15 nt, Staphylococcus aureus subsp. aureus Mu50
acuucuuuugcaaaa

SEQ ID NO: 3989578 - RNA, 20 nt, Staphylococcus aureus subsp. aureus Mu50
acuucuuuuguuuuaccauc

SEQ ID NO: 3989579 - RNA, 15 nt, Staphylococcus aureus subsp. aureus Mu50
acuucuuuuuuguau

SEQ ID NO: 3989580 - RNA, 17 nt, Staphylococcus aureus subsp. aureus Mu50
acuucuuuuuuguaucu

SEQ ID NO: 3989581 - RNA, 22 nt, Staphylococcus aureus subsp. aureus Mu50
acuugaaaauagccauauucau

SEQ ID NO: 3989582 - RNA, 13 nt, Staphylococcus aureus subsp. aureus Mu50
acuugaauauuau

SEQ ID NO: 3989583 - RNA, 16 nt, Staphylococcus aureus subsp. aureus Mu50
acuugaauuuaauaag

SEQ ID NO: 3989584 - RNA, 17 nt, Staphylococcus aureus subsp. aureus Mu50
acuugaccacuuuuguu

SEQ ID NO: 3989585 - RNA, 15 nt, Staphylococcus aureus subsp. aureus Mu50
acuugagcuauucau

SEQ ID NO: 3989586 - RNA, 17 nt, Staphylococcus aureus subsp. aureus Mu50
acuugauaaaaaaugaa

SEQ ID NO: 3989587 - RNA, 19 nt, Staphylococcus aureus subsp. aureus Mu50
acuugauaaaacuaaugau

SEQ ID NO: 3989588 - RNA, 20 nt, Staphylococcus aureus subsp. aureus Mu50
acuugauaaaacuaaugaua

SEQ ID NO: 3989589 - RNA, 18 nt, Staphylococcus aureus subsp. aureus Mu50
acuugaucauuauaaaau

SEQ ID NO: 3989590 - RNA, 22 nt, Staphylococcus aureus subsp. aureus Mu50
acuugcacauuaucguaagcug

SEQ ID NO: 3989591 - RNA, 14 nt, Staphylococcus aureus subsp. aureus Mu50
acuugcgcaugcuu

SEQ ID NO: 3989592 - RNA, 19 nt, Staphylococcus aureus subsp. aureus Mu50
acuugcgccugcuaaaaag

SEQ ID NO: 3989593 - RNA, 19 nt, Staphylococcus aureus subsp. aureus Mu50
acuugcgguucuuugucau

SEQ ID NO: 3989594 - RNA, 20 nt, Staphylococcus aureus subsp. aureus Mu50
acuugcuguugcaauaaaau

SEQ ID NO: 3989595 - RNA, 21 nt, Staphylococcus aureus subsp. aureus Mu50
acuugcuguugcaauaaaauc

SEQ ID NO: 3989596 - RNA, 14 nt, Staphylococcus aureus subsp. aureus Mu50
acuugcuuuguuag

SEQ ID NO: 3989597 - RNA, 18 nt, Staphylococcus aureus subsp. aureus Mu50
acuuggauuaccguuaaa

SEQ ID NO: 3989598 - RNA, 17 nt, Staphylococcus aureus subsp. aureus Mu50
acuuggauucaaaugac

SEQ ID NO: 3989599 - RNA, 18 nt, Staphylococcus aureus subsp. aureus Mu50
acuuggauucaaaugaca

SEQ ID NO: 3989600 - RNA, 15 nt, Staphylococcus aureus subsp. aureus Mu50
acuuggcucaaaacu

SEQ ID NO: 3989601 - RNA, 21 nt, Staphylococcus aureus subsp. aureus Mu50
acuuggcuuaggaugaaaaua

SEQ ID NO: 3989602 - RNA, 13 nt, Staphylococcus aureus subsp. aureus Mu50
acuugggauuuuu

SEQ ID NO: 3989603 - RNA, 21 nt, Staphylococcus aureus subsp. aureus Mu50
acuugguauugguaaauuuau

SEQ ID NO: 3989604 - RNA, 15 nt, Staphylococcus aureus subsp. aureus Mu50
acuuguaaauuuauu

SEQ ID NO: 3989605 - RNA, 13 nt, Staphylococcus aureus subsp. aureus Mu50
acuuguaauauaa

SEQ ID NO: 3989606 - RNA, 16 nt, Staphylococcus aureus subsp. aureus Mu50
acuuguaaucauacca

SEQ ID NO: 3989607 - RNA, 17 nt, Staphylococcus aureus subsp. aureus Mu50
acuuuuucaucuuucac

SEQ ID NO: 3989608 - RNA, 22 nt, Staphylococcus aureus subsp. aureus Mu50
acuuuuugacauauuuuuuaaa

SEQ ID NO: 3989609 - RNA, 22 nt, Staphylococcus aureus subsp. aureus Mu50
acuuuuugaguauccaauacua

SEQ ID NO: 3989610 - RNA, 14 nt, Staphylococcus aureus subsp. aureus Mu50
acuuuuuucauuuc

SEQ ID NO: 3989611 - RNA, 16 nt, Staphylococcus aureus subsp. aureus Mu50
acuuuuuucauuucuu

SEQ ID NO: 3989612 - RNA, 19 nt, Staphylococcus aureus subsp. aureus Mu50
acuuuuuucauuucuuugu

SEQ ID NO: 3989613 - RNA, 19 nt, Staphylococcus aureus subsp. aureus Mu50
acuuuuuugagcauuuuua

SEQ ID NO: 3989614 - RNA, 18 nt, Staphylococcus aureus subsp. aureus Mu50
acuuuuuugugauuauua

SEQ ID NO: 3989615 - RNA, 14 nt, Staphylococcus aureus subsp. aureus Mu50
acuuuuuuguucaa

SEQ ID NO: 3989616 - RNA, 19 nt, Staphylococcus aureus subsp. aureus Mu50
acuuuuuuguucaaucacu

SEQ ID NO: 3989617 - RNA, 23 nt, Staphylococcus aureus subsp. aureus Mu50
acuuuuuuuaaaucuucuauuuu

SEQ ID NO: 3989618 - RNA, 16 nt, Staphylococcus aureus subsp. aureus Mu50
acuuuuuuuaauuuga

SEQ ID NO: 3989619 - RNA, 12 nt, Staphylococcus aureus subsp. aureus Mu50
agaaaaaguauu

SEQ ID NO: 3989620 - RNA, 14 nt, Staphylococcus aureus subsp. aureus Mu50
agaaaaagugauaa

SEQ ID NO: 3989621 - RNA, 17 nt, Staphylococcus aureus subsp. aureus Mu50
agaaaaaguuauaucau

SEQ ID NO: 3989622 - RNA, 17 nt, Staphylococcus aureus subsp. aureus Mu50
agaaaaauucaucaaua

SEQ ID NO: 3989623 - RNA, 17 nt, Staphylococcus aureus subsp. aureus Mu50
agaaaacauaaauacaa

SEQ ID NO: 3989624 - RNA, 16 nt, Staphylococcus aureus subsp. aureus Mu50
agaaaacuagaacuua

SEQ ID NO: 3989625 - RNA, 17 nt, Staphylococcus aureus subsp. aureus Mu50
agaaaacuauuuuaaaa

SEQ ID NO: 3989626 - RNA, 21 nt, Staphylococcus aureus subsp. aureus Mu50
agaaaagcagucgaacaauga

SEQ ID NO: 3989627 - RNA, 22 nt, Staphylococcus aureus subsp. aureus Mu50
agaaaagcagucgaacaaugau

SEQ ID NO: 3989628 - RNA, 23 nt, Staphylococcus aureus subsp. aureus Mu50
agaaaaggcucauuuguuaaauu

SEQ ID NO: 3989629 - RNA, 20 nt, Staphylococcus aureus subsp. aureus Mu50
agaaaagggcaaaaaaggau

SEQ ID NO: 3989630 - RNA, 16 nt, Staphylococcus aureus subsp. aureus Mu50
agaaaaguaaguaaaa

SEQ ID NO: 3989631 - RNA, 15 nt, Staphylococcus aureus subsp. aureus Mu50
agaaaaugaguacaa

SEQ ID NO: 3989632 - RNA, 20 nt, Staphylococcus aureus subsp. aureus Mu50
agaaacaaaacaaaaaauau

SEQ ID NO: 3989633 - RNA, 20 nt, Staphylococcus aureus subsp. aureus Mu50
agaaacacaaggaauauaca

SEQ ID NO: 3989634 - RNA, 13 nt, Staphylococcus aureus subsp. aureus Mu50
agaaacauuauau

SEQ ID NO: 3989635 - RNA, 13 nt, Staphylococcus aureus subsp. aureus Mu50
agaaagaaauugu

SEQ ID NO: 3989636 - RNA, 16 nt, Staphylococcus aureus subsp. aureus Mu50
agaaagcuaauaucaa

SEQ ID NO: 3989637 - RNA, 18 nt, Staphylococcus aureus subsp. aureus Mu50
agaaagcuaauaucaaua

SEQ ID NO: 3989638 - RNA, 17 nt, Staphylococcus aureus subsp. aureus Mu50
agaaagugcgguuauuu

SEQ ID NO: 3989639 - RNA, 15 nt, Staphylococcus aureus subsp. aureus Mu50
agaaauaaucacauu

SEQ ID NO: 3989640 - RNA, 21 nt, Staphylococcus aureus subsp. aureus Mu50
agaaauacuugaauuuaauaa

SEQ ID NO: 3989641 - RNA, 14 nt, Staphylococcus aureus subsp. aureus Mu50
agaaaucaccagau

SEQ ID NO: 3989642 - RNA, 13 nt, Staphylococcus aureus subsp. aureus Mu50
agaaaucuauaac

SEQ ID NO: 3989643 - RNA, 21 nt, Staphylococcus aureus subsp. aureus Mu50
agaaaugacaucaucuauaau

SEQ ID NO: 3989644 - RNA, 22 nt, Staphylococcus aureus subsp. aureus Mu50
agaaauguuaacgauagacauu

SEQ ID NO: 3989645 - RNA, 21 nt, Staphylococcus aureus subsp. aureus Mu50
agaaauuaccguuuauuucgu

SEQ ID NO: 3989646 - RNA, 18 nt, Staphylococcus aureus subsp. aureus Mu50
agaaauuagaaccaucau

SEQ ID NO: 3989647 - RNA, 19 nt, Staphylococcus aureus subsp. aureus Mu50
agaaauucgaaaagaaauu

SEQ ID NO: 3989648 - RNA, 21 nt, Staphylococcus aureus subsp. aureus Mu50
agaaauucgcaagccuucuau

SEQ ID NO: 3989649 - RNA, 17 nt, Staphylococcus aureus subsp. aureus Mu50
agaaauucuacaaacaa

SEQ ID NO: 3989650 - RNA, 23 nt, Staphylococcus aureus subsp. aureus Mu50
agaaauucuacaggcaaugcaag

SEQ ID NO: 3989651 - RNA, 16 nt, Staphylococcus aureus subsp. aureus Mu50
agaaauugaauucucg

SEQ ID NO: 3989652 - RNA, 19 nt, Staphylococcus aureus subsp. aureus Mu50
agaaauugugcuuuuccau

SEQ ID NO: 3989653 - RNA, 13 nt, Staphylococcus aureus subsp. aureus Mu50
agaaauuuuucac

SEQ ID NO: 3989654 - RNA, 19 nt, Staphylococcus aureus subsp. aureus Mu50
agaaauuuuuucuauggca

SEQ ID NO: 3989655 - RNA, 14 nt, Staphylococcus aureus subsp. aureus Mu50
agaacaagaauuau

SEQ ID NO: 3989656 - RNA, 15 nt, Staphylococcus aureus subsp. aureus Mu50
agaacaauaauugau

SEQ ID NO: 3989657 - RNA, 13 nt, Staphylococcus aureus subsp. aureus Mu50
agaacaaucaaua

SEQ ID NO: 3989658 - RNA, 17 nt, Staphylococcus aureus subsp. aureus Mu50
agaacagcacauuuuua

SEQ ID NO: 3989659 - RNA, 15 nt, Staphylococcus aureus subsp. aureus Mu50
agaaccaaaaauuag

SEQ ID NO: 3989660 - RNA, 16 nt, Staphylococcus aureus subsp. aureus Mu50
agaaccaaaaauuagc

SEQ ID NO: 3989661 - RNA, 14 nt, Staphylococcus aureus subsp. aureus Mu50
agaaccaacaauaa

SEQ ID NO: 3989662 - RNA, 18 nt, Staphylococcus aureus subsp. aureus Mu50
agaaccacgcaucaugua

SEQ ID NO: 3989663 - RNA, 22 nt, Staphylococcus aureus subsp. aureus Mu50
agaaccacgcaucauguauaug

SEQ ID NO: 3989664 - RNA, 21 nt, Staphylococcus aureus subsp. aureus Mu50
agaaccaucauucauauggaa

SEQ ID NO: 3989665 - RNA, 15 nt, Staphylococcus aureus subsp. aureus Mu50
agaaccguuuuucau

SEQ ID NO: 3989666 - RNA, 19 nt, Staphylococcus aureus subsp. aureus Mu50
agaaccguuuuucaucaau

SEQ ID NO: 3989667 - RNA, 23 nt, Staphylococcus aureus subsp. aureus Mu50
agaaccuauauuaagcauuuguc

SEQ ID NO: 3989668 - RNA, 17 nt, Staphylococcus aureus subsp. aureus Mu50
agaacgaaacuuuaauu

SEQ ID NO: 3989669 - RNA, 17 nt, Staphylococcus aureus subsp. aureus Mu50
agaacgcuuuauuacuu

SEQ ID NO: 3989670 - RNA, 15 nt, Staphylococcus aureus subsp. aureus Mu50
agaacguucauauau

SEQ ID NO: 3989671 - RNA, 16 nt, Staphylococcus aureus subsp. aureus Mu50
agaacuaacauaauuu

SEQ ID NO: 3989672 - RNA, 19 nt, Staphylococcus aureus subsp. aureus Mu50
agaacuaacauaauuuuua

SEQ ID NO: 3989673 - RNA, 23 nt, Staphylococcus aureus subsp. aureus Mu50
agaacuaagaugugcaucccgaa

SEQ ID NO: 3989674 - RNA, 14 nt, Staphylococcus aureus subsp. aureus Mu50
agaacuaauguaaa

SEQ ID NO: 3989675 - RNA, 20 nt, Staphylococcus aureus subsp. aureus Mu50
agaacuuaguacguaucauu

SEQ ID NO: 3989676 - RNA, 15 nt, Staphylococcus aureus subsp. aureus Mu50
agaacuuuaauaaug

SEQ ID NO: 3989677 - RNA, 15 nt, Staphylococcus aureus subsp. aureus Mu50
agaagcuuucuggaa

SEQ ID NO: 3989678 - RNA, 20 nt, Staphylococcus aureus subsp. aureus Mu50
agaaggggacuuaaccauuu

SEQ ID NO: 3989679 - RNA, 19 nt, Staphylococcus aureus subsp. aureus Mu50
agaaguuguuuagaaaagu

SEQ ID NO: 3989680 - RNA, 18 nt, Staphylococcus aureus subsp. aureus Mu50
agaaguuuccaacguuau

SEQ ID NO: 3989681 - RNA, 13 nt, Staphylococcus aureus subsp. aureus Mu50
agaaguuucuaua

SEQ ID NO: 3989682 - RNA, 16 nt, Staphylococcus aureus subsp. aureus Mu50
agaauaaacaacauac

SEQ ID NO: 3989683 - RNA, 19 nt, Staphylococcus aureus subsp. aureus Mu50
agaauaaauguuaaagauu

SEQ ID NO: 3989684 - RNA, 23 nt, Staphylococcus aureus subsp. aureus Mu50
agaauaaauguuaaagauuauua

SEQ ID NO: 3989685 - RNA, 20 nt, Staphylococcus aureus subsp. aureus Mu50
agaauaacgucauauguuuu

SEQ ID NO: 3989686 - RNA, 16 nt, Staphylococcus aureus subsp. aureus Mu50
agaauacuaaaagugu

SEQ ID NO: 3989687 - RNA, 16 nt, Staphylococcus aureus subsp. aureus Mu50
agaauaguuaccaaaa

SEQ ID NO: 3989688 - RNA, 13 nt, Staphylococcus aureus subsp. aureus Mu50
agaauauauguau

SEQ ID NO: 3989689 - RNA, 21 nt, Staphylococcus aureus subsp. aureus Mu50
agaauauauguauaacauuau

SEQ ID NO: 3989690 - RNA, 11 nt, Staphylococcus aureus subsp. aureus Mu50
agaauauuaag

SEQ ID NO: 3989691 - RNA, 16 nt, Staphylococcus aureus subsp. aureus Mu50
agaauauucagauuuu

SEQ ID NO: 3989692 - RNA, 15 nt, Staphylococcus aureus subsp. aureus Mu50
agaauauuuaaguuu

SEQ ID NO: 3989693 - RNA, 14 nt, Staphylococcus aureus subsp. aureus Mu50
agaaucaauuauug

SEQ ID NO: 3989694 - RNA, 20 nt, Staphylococcus aureus subsp. aureus Mu50
agaguuuuuauuauuaggcg

SEQ ID NO: 3989695 - RNA, 18 nt, Staphylococcus aureus subsp. aureus Mu50
agauaaagcuucgucaau

SEQ ID NO: 3989696 - RNA, 12 nt, Staphylococcus aureus subsp. aureus Mu50
agauaaaucauc

SEQ ID NO: 3989697 - RNA, 19 nt, Staphylococcus aureus subsp. aureus Mu50
agauaaaucgauaaaaugu

SEQ ID NO: 3989698 - RNA, 15 nt, Staphylococcus aureus subsp. aureus Mu50
agauaaauuaauaug

SEQ ID NO: 3989699 - RNA, 16 nt, Staphylococcus aureus subsp. aureus Mu50
agauaaauuaauauga

SEQ ID NO: 3989700 - RNA, 20 nt, Staphylococcus aureus subsp. aureus Mu50
agauaacuagaaugauuaaa

SEQ ID NO: 3989701 - RNA, 15 nt, Staphylococcus aureus subsp. aureus Mu50
agauaacuagcaaau

SEQ ID NO: 3989702 - RNA, 15 nt, Staphylococcus aureus subsp. aureus Mu50
agauaagaauauuua

SEQ ID NO: 3989703 - RNA, 17 nt, Staphylococcus aureus subsp. aureus Mu50
agauaaguaauaauaua

SEQ ID NO: 3989704 - RNA, 23 nt, Staphylococcus aureus subsp. aureus Mu50
agauaaguaguggauaaucacaa

SEQ ID NO: 3989705 - RNA, 14 nt, Staphylococcus aureus subsp. aureus Mu50
agauaauuauuucu

SEQ ID NO: 3989706 - RNA, 16 nt, Staphylococcus aureus subsp. aureus Mu50
agauacacguaacgca

SEQ ID NO: 3989707 - RNA, 14 nt, Staphylococcus aureus subsp. aureus Mu50
agauacguuauuuc

SEQ ID NO: 3989708 - RNA, 15 nt, Staphylococcus aureus subsp. aureus Mu50
agauacugaauuuua

SEQ ID NO: 3989709 - RNA, 17 nt, Staphylococcus aureus subsp. aureus Mu50
agauacugaauuuuaac

SEQ ID NO: 3989710 - RNA, 22 nt, Staphylococcus aureus subsp. aureus Mu50
agauacugcuucuacccuugca

SEQ ID NO: 3989711 - RNA, 20 nt, Staphylococcus aureus subsp. aureus Mu50
agauacugguuaguaaaauu

SEQ ID NO: 3989712 - RNA, 22 nt, Staphylococcus aureus subsp. aureus Mu50
agauagacuuucuugaugaauu

SEQ ID NO: 3989713 - RNA, 17 nt, Staphylococcus aureus subsp. aureus Mu50
agauagauaaaucaaga

SEQ ID NO: 3989714 - RNA, 15 nt, Staphylococcus aureus subsp. aureus Mu50
agauaggaaacuuaa

SEQ ID NO: 3989715 - RNA, 20 nt, Staphylococcus aureus subsp. aureus Mu50
agauaggaaacuuaaauauu

SEQ ID NO: 3989716 - RNA, 22 nt, Staphylococcus aureus subsp. aureus Mu50
agauaggauuuacaccuauacc

SEQ ID NO: 3989717 - RNA, 22 nt, Staphylococcus aureus subsp. aureus Mu50
agauaggauuugcaccuauacc

SEQ ID NO: 3989718 - RNA, 18 nt, Staphylococcus aureus subsp. aureus Mu50
agauauauaauaccccaa

SEQ ID NO: 3989719 - RNA, 15 nt, Staphylococcus aureus subsp. aureus Mu50
agauaucauaauauu

SEQ ID NO: 3989720 - RNA, 19 nt, Staphylococcus aureus subsp. aureus Mu50
agauaucauuuuauccaaa

SEQ ID NO: 3989721 - RNA, 21 nt, Staphylococcus aureus subsp. aureus Mu50
agauaucuuauaacaaaaauu

SEQ ID NO: 3989722 - RNA, 22 nt, Staphylococcus aureus subsp. aureus Mu50
agauauguuuauauugcaaaaa

SEQ ID NO: 3989723 - RNA, 22 nt, Staphylococcus aureus subsp. aureus Mu50
agauauuauaaaaacagcagug

SEQ ID NO: 3989724 - RNA, 21 nt, Staphylococcus aureus subsp. aureus Mu50
agauauuauugugaaaucuau

SEQ ID NO: 3989725 - RNA, 14 nt, Staphylococcus aureus subsp. aureus Mu50
agauauugaaugga

SEQ ID NO: 3989726 - RNA, 12 nt, Staphylococcus aureus subsp. aureus Mu50
agaucaauauca

SEQ ID NO: 3989727 - RNA, 18 nt, Staphylococcus aureus subsp. aureus Mu50
agaucauuaaaaacgauu

SEQ ID NO: 3989728 - RNA, 14 nt, Staphylococcus aureus subsp. aureus Mu50
agaucauuuucaac

SEQ ID NO: 3989729 - RNA, 18 nt, Staphylococcus aureus subsp. aureus Mu50
agaucauuuucaacauaa

SEQ ID NO: 3989730 - RNA, 13 nt, Staphylococcus aureus subsp. aureus Mu50
agaucuaacaaua

SEQ ID NO: 3989731 - RNA, 14 nt, Staphylococcus aureus subsp. aureus Mu50
agaucuaacaauau

SEQ ID NO: 3989732 - RNA, 15 nt, Staphylococcus aureus subsp. aureus Mu50
agaugaaauauucuu

SEQ ID NO: 3989733 - RNA, 21 nt, Staphylococcus aureus subsp. aureus Mu50
agaugaaugccuaauuuugug

SEQ ID NO: 3989734 - RNA, 22 nt, Staphylococcus aureus subsp. aureus Mu50
agaugaaugccuaauuuuguga

SEQ ID NO: 3989735 - RNA, 23 nt, Staphylococcus aureus subsp. aureus Mu50
agaugacuguagaaaacaugcuu

SEQ ID NO: 3989736 - RNA, 19 nt, Staphylococcus aureus subsp. aureus Mu50
agaugauugucuagcagag

SEQ ID NO: 3989737 - RNA, 12 nt, Staphylococcus aureus subsp. aureus Mu50
agaugcauaaaa

SEQ ID NO: 3989738 - RNA, 16 nt, Staphylococcus aureus subsp. aureus Mu50
agaugcggaguucacu

SEQ ID NO: 3989739 - RNA, 19 nt, Staphylococcus aureus subsp. aureus Mu50
agaugcuugaccuucaguu

SEQ ID NO: 3989740 - RNA, 17 nt, Staphylococcus aureus subsp. aureus Mu50
agauggcugcaucaaua

SEQ ID NO: 3989741 - RNA, 20 nt, Staphylococcus aureus subsp. aureus Mu50
agauggucuuuuaauuaaaa

SEQ ID NO: 3989742 - RNA, 15 nt, Staphylococcus aureus subsp. aureus Mu50
agauguauaaaacua

SEQ ID NO: 3989743 - RNA, 17 nt, Staphylococcus aureus subsp. aureus Mu50
agauguauaaaacuaau

SEQ ID NO: 3989744 - RNA, 21 nt, Staphylococcus aureus subsp. aureus Mu50
agaugucacuguuaaagaugu

SEQ ID NO: 3989745 - RNA, 16 nt, Staphylococcus aureus subsp. aureus Mu50
agauguucacauucuu

SEQ ID NO: 3989746 - RNA, 16 nt, Staphylococcus aureus subsp. aureus Mu50
agauguugaugaagua

SEQ ID NO: 3989747 - RNA, 20 nt, Staphylococcus aureus subsp. aureus Mu50
agauguugguucaucaaaca

SEQ ID NO: 3989748 - RNA, 19 nt, Staphylococcus aureus subsp. aureus Mu50
agauuaaaauaugacacau

SEQ ID NO: 3989749 - RNA, 16 nt, Staphylococcus aureus subsp. aureus Mu50
agauuaagcaauguaa

SEQ ID NO: 3989750 - RNA, 13 nt, Staphylococcus aureus subsp. aureus Mu50
agauuagagaaga

SEQ ID NO: 3989751 - RNA, 23 nt, Staphylococcus aureus subsp. aureus Mu50
agauuaguagccacaauuuugac

SEQ ID NO: 3989752 - RNA, 18 nt, Staphylococcus aureus subsp. aureus Mu50
agauuaguagucaaaauu

SEQ ID NO: 3989753 - RNA, 15 nt, Staphylococcus aureus subsp. aureus Mu50
agauuauauuaucau

SEQ ID NO: 3989754 - RNA, 15 nt, Staphylococcus aureus subsp. aureus Mu50
agauuaugacaacau

SEQ ID NO: 3989755 - RNA, 22 nt, Staphylococcus aureus subsp. aureus Mu50
agauuauuauuacaaugaaaaa

SEQ ID NO: 3989756 - RNA, 18 nt, Staphylococcus aureus subsp. aureus Mu50
agauuauugguugaaauu

SEQ ID NO: 3989757 - RNA, 17 nt, Staphylococcus aureus subsp. aureus Mu50
agauuauuuaaaacuug

SEQ ID NO: 3989758 - RNA, 15 nt, Staphylococcus aureus subsp. aureus Mu50
agauucaaauugguu

SEQ ID NO: 3989759 - RNA, 18 nt, Staphylococcus aureus subsp. aureus Mu50
agauucacuguauaaaua

SEQ ID NO: 3989760 - RNA, 20 nt, Staphylococcus aureus subsp. aureus Mu50
agauucauaucuuucaauua

SEQ ID NO: 3989761 - RNA, 14 nt, Staphylococcus aureus subsp. aureus Mu50
agauucauauuuau

SEQ ID NO: 3989762 - RNA, 14 nt, Staphylococcus aureus subsp. aureus Mu50
agauuccugcaaaa

SEQ ID NO: 3989763 - RNA, 15 nt, Staphylococcus aureus subsp. aureus Mu50
agauuccuguaacaa

SEQ ID NO: 3989764 - RNA, 20 nt, Staphylococcus aureus subsp. aureus Mu50
agauucggaaaauaugauaa

SEQ ID NO: 3989765 - RNA, 19 nt, Staphylococcus aureus subsp. aureus Mu50
agauucuucaccaacuuuu

SEQ ID NO: 3989766 - RNA, 21 nt, Staphylococcus aureus subsp. aureus Mu50
agauucuucaccaacuuuuuu

SEQ ID NO: 3989767 - RNA, 22 nt, Staphylococcus aureus subsp. aureus Mu50
agauucuucaccaacuuuuuua

SEQ ID NO: 3989768 - RNA, 16 nt, Staphylococcus aureus subsp. aureus Mu50
agauugauauaaauua

SEQ ID NO: 3989769 - RNA, 19 nt, Staphylococcus aureus subsp. aureus Mu50
agauugccauucauacacu

SEQ ID NO: 3989770 - RNA, 23 nt, Staphylococcus aureus subsp. aureus Mu50
agauugccauucauacacuauca

SEQ ID NO: 3989771 - RNA, 20 nt, Staphylococcus aureus subsp. aureus Mu50
agauuggucaaacuuaucgc

SEQ ID NO: 3989772 - RNA, 23 nt, Staphylococcus aureus subsp. aureus Mu50
agauuguaaaaauacauaauaaa

SEQ ID NO: 3989773 - RNA, 15 nt, Staphylococcus aureus subsp. aureus Mu50
agauuguauuuaaua

SEQ ID NO: 3989774 - RNA, 14 nt, Staphylococcus aureus subsp. aureus Mu50
agauuguuauuaua

SEQ ID NO: 3989775 - RNA, 15 nt, Staphylococcus aureus subsp. aureus Mu50
agauuuaaaauguca

SEQ ID NO: 3989776 - RNA, 23 nt, Staphylococcus aureus subsp. aureus Mu50
agauuuaaacauccaauuauguu

SEQ ID NO: 3989777 - RNA, 22 nt, Staphylococcus aureus subsp. aureus Mu50
agauuuaccucuugauaaaaua

SEQ ID NO: 3989778 - RNA, 16 nt, Staphylococcus aureus subsp. aureus Mu50
agauuuaguuuuuuua

SEQ ID NO: 3989779 - RNA, 22 nt, Staphylococcus aureus subsp. aureus Mu50
agauuuauaacgacguaauccu

SEQ ID NO: 3989780 - RNA, 20 nt, Staphylococcus aureus subsp. aureus Mu50
agauuuauuaaauauaugcg

SEQ ID NO: 3989781 - RNA, 19 nt, Staphylococcus aureus subsp. aureus Mu50
agccauaccuuauuucagc

SEQ ID NO: 3989782 - RNA, 22 nt, Staphylococcus aureus subsp. aureus Mu50
agccauuuccggaagucaagaa

SEQ ID NO: 3989783 - RNA, 18 nt, Staphylococcus aureus subsp. aureus Mu50
agccccagcaaauacuuc

SEQ ID NO: 3989784 - RNA, 14 nt, Staphylococcus aureus subsp. aureus Mu50
agccgauaauuuga

SEQ ID NO: 3989785 - RNA, 20 nt, Staphylococcus aureus subsp. aureus Mu50
agccucuaaugauuaaaaau

SEQ ID NO: 3989786 - RNA, 19 nt, Staphylococcus aureus subsp. aureus Mu50
agccucuugccuugaaauc

SEQ ID NO: 3989787 - RNA, 19 nt, Staphylococcus aureus subsp. aureus Mu50
agccugaaauagaaauguc

SEQ ID NO: 3989788 - RNA, 23 nt, Staphylococcus aureus subsp. aureus Mu50
agccugauguaccacucauaauc

SEQ ID NO: 3989789 - RNA, 17 nt, Staphylococcus aureus subsp. aureus Mu50
agccuuaaaauauuuaa

SEQ ID NO: 3989790 - RNA, 23 nt, Staphylococcus aureus subsp. aureus Mu50
agccuuaaaauauuuaacuuuuu

SEQ ID NO: 3989791 - RNA, 13 nt, Staphylococcus aureus subsp. aureus Mu50
agccuucuaucuu

SEQ ID NO: 3989792 - RNA, 15 nt, Staphylococcus aureus subsp. aureus Mu50
agccuuuucaaacau

SEQ ID NO: 3989793 - RNA, 21 nt, Staphylococcus aureus subsp. aureus Mu50
agcgaaaguaucuaugaaauu

SEQ ID NO: 3989794 - RNA, 17 nt, Staphylococcus aureus subsp. aureus Mu50
agcgauacguuuauauc

SEQ ID NO: 3989795 - RNA, 21 nt, Staphylococcus aureus subsp. aureus Mu50
agcgauuuuaaagaaaaguuu

SEQ ID NO: 3989796 - RNA, 17 nt, Staphylococcus aureus subsp. aureus Mu50
agcgcaccaauuaucaa

SEQ ID NO: 3989797 - RNA, 20 nt, Staphylococcus aureus subsp. aureus Mu50
agcggaaauaugauugaaug

SEQ ID NO: 3989798 - RNA, 22 nt, Staphylococcus aureus subsp. aureus Mu50
agcggaaauaugauugaaugaa

SEQ ID NO: 3989799 - RNA, 13 nt, Staphylococcus aureus subsp. aureus Mu50
agcggaauacaga

SEQ ID NO: 3989800 - RNA, 18 nt, Staphylococcus aureus subsp. aureus Mu50
agcggacugaaagaaaag

SEQ ID NO: 3989801 - RNA, 19 nt, Staphylococcus aureus subsp. aureus Mu50
agcggccgugguaugauuu

SEQ ID NO: 3989802 - RNA, 14 nt, Staphylococcus aureus subsp. aureus Mu50
agcguaauggauua

SEQ ID NO: 3989803 - RNA, 18 nt, Staphylococcus aureus subsp. aureus Mu50
agcguaauggauuauuau

SEQ ID NO: 3989804 - RNA, 16 nt, Staphylococcus aureus subsp. aureus Mu50
agcguaauuauuauaa

SEQ ID NO: 3989805 - RNA, 17 nt, Staphylococcus aureus subsp. aureus Mu50
agcguaauuauuauaau

SEQ ID NO: 3989806 - RNA, 22 nt, Staphylococcus aureus subsp. aureus Mu50
agcguagcgaaaguaucuauga

SEQ ID NO: 3989807 - RNA, 18 nt, Staphylococcus aureus subsp. aureus Mu50
agcguauuuuaaugauuu

SEQ ID NO: 3989808 - RNA, 15 nt, Staphylococcus aureus subsp. aureus Mu50
agcguucaauuuuug

SEQ ID NO: 3989809 - RNA, 19 nt, Staphylococcus aureus subsp. aureus Mu50
agcguuccauuaaugcauu

SEQ ID NO: 3989810 - RNA, 15 nt, Staphylococcus aureus subsp. aureus Mu50
agcguucgugauaga

SEQ ID NO: 3989811 - RNA, 19 nt, Staphylococcus aureus subsp. aureus Mu50
agcguucucuaauuucaca

SEQ ID NO: 3989812 - RNA, 20 nt, Staphylococcus aureus subsp. aureus Mu50
agcguuuaagaaaucaacaa

SEQ ID NO: 3989813 - RNA, 21 nt, Staphylococcus aureus subsp. aureus Mu50
agcguuucuugaucuaaugua

SEQ ID NO: 3989814 - RNA, 14 nt, Staphylococcus aureus subsp. aureus Mu50
agcguuuuuauuac

SEQ ID NO: 3989815 - RNA, 13 nt, Staphylococcus aureus subsp. aureus Mu50
agcuaaaaguuuc

SEQ ID NO: 3989816 - RNA, 14 nt, Staphylococcus aureus subsp. aureus Mu50
agcuaaacgacauu

SEQ ID NO: 3989817 - RNA, 18 nt, Staphylococcus aureus subsp. aureus Mu50
agcuaaacgcaauacgaa

SEQ ID NO: 3989818 - RNA, 13 nt, Staphylococcus aureus subsp. aureus Mu50
agcuaaccaaaua

SEQ ID NO: 3989819 - RNA, 12 nt, Staphylococcus aureus subsp. aureus Mu50
agcuaaguuaaa

SEQ ID NO: 3989820 - RNA, 17 nt, Staphylococcus aureus subsp. aureus Mu50
agcuaauaacgcugcac

SEQ ID NO: 3989821 - RNA, 18 nt, Staphylococcus aureus subsp. aureus Mu50
agcuaaugcaacuaaaac

SEQ ID NO: 3989822 - RNA, 12 nt, Staphylococcus aureus subsp. aureus Mu50
agcuaaugcauu

SEQ ID NO: 3989823 - RNA, 17 nt, Staphylococcus aureus subsp. aureus Mu50
agcuaaugucaugaaaa

SEQ ID NO: 3989824 - RNA, 16 nt, Staphylococcus aureus subsp. aureus Mu50
agcuacaaauaaugag

SEQ ID NO: 3989825 - RNA, 13 nt, Staphylococcus aureus subsp. aureus Mu50
agcuacaauuaaa

SEQ ID NO: 3989826 - RNA, 15 nt, Staphylococcus aureus subsp. aureus Mu50
agcuagaaacaaugc

SEQ ID NO: 3989827 - RNA, 16 nt, Staphylococcus aureus subsp. aureus Mu50
agcuagcauguuuuga

SEQ ID NO: 3989828 - RNA, 14 nt, Staphylococcus aureus subsp. aureus Mu50
agcuaggguuaaaa

SEQ ID NO: 3989829 - RNA, 18 nt, Staphylococcus aureus subsp. aureus Mu50
agcuauaaaaaaucuuuu

SEQ ID NO: 3989830 - RNA, 20 nt, Staphylococcus aureus subsp. aureus Mu50
agcuauaaaaaaucuuuuga

SEQ ID NO: 3989831 - RNA, 16 nt, Staphylococcus aureus subsp. aureus Mu50
agcuauaaaaguacuu

SEQ ID NO: 3989832 - RNA, 19 nt, Staphylococcus aureus subsp. aureus Mu50
agcuauaacucuaaauaua

SEQ ID NO: 3989833 - RNA, 13 nt, Staphylococcus aureus subsp. aureus Mu50
agcuauagaaaug

SEQ ID NO: 3989834 - RNA, 22 nt, Staphylococcus aureus subsp. aureus Mu50
agcuauagaaaugauagggcau

SEQ ID NO: 3989835 - RNA, 14 nt, Staphylococcus aureus subsp. aureus Mu50
agcuauauuuuuuu

SEQ ID NO: 3989836 - RNA, 24 nt, Staphylococcus aureus subsp. aureus Mu50
agcuaucguaaacaacaucgauuu

SEQ ID NO: 3989837 - RNA, 22 nt, Staphylococcus aureus subsp. aureus Mu50
agcuaugcuuuuuuuacaauau

SEQ ID NO: 3989838 - RNA, 15 nt, Staphylococcus aureus subsp. aureus Mu50
agcuauuacuauaaa

SEQ ID NO: 3989839 - RNA, 22 nt, Staphylococcus aureus subsp. aureus Mu50
agcuauucauagaccuaugaau

SEQ ID NO: 3989840 - RNA, 19 nt, Staphylococcus aureus subsp. aureus Mu50
agcucaauaaauuaugaaa

SEQ ID NO: 3989841 - RNA, 14 nt, Staphylococcus aureus subsp. aureus Mu50
agcucauagcaaau

SEQ ID NO: 3989842 - RNA, 19 nt, Staphylococcus aureus subsp. aureus Mu50
agcucaugaaucagaugau

SEQ ID NO: 3989843 - RNA, 23 nt, Staphylococcus aureus subsp. aureus Mu50
agcucauguuucaguauacucau

SEQ ID NO: 3989844 - RNA, 17 nt, Staphylococcus aureus subsp. aureus Mu50
agcucguuaaaucacau

SEQ ID NO: 3989845 - RNA, 15 nt, Staphylococcus aureus subsp. aureus Mu50
agcucguuuuuucau

SEQ ID NO: 3989846 - RNA, 22 nt, Staphylococcus aureus subsp. aureus Mu50
agcucugaaggagacauuuccc

SEQ ID NO: 3989847 - RNA, 12 nt, Staphylococcus aureus subsp. aureus Mu50
agcucuucaaau

SEQ ID NO: 3989848 - RNA, 13 nt, Staphylococcus aureus subsp. aureus Mu50
agcucuucaaauu

SEQ ID NO: 3989849 - RNA, 15 nt, Staphylococcus aureus subsp. aureus Mu50
agcucuucaaauuua

SEQ ID NO: 3989850 - RNA, 20 nt, Staphylococcus aureus subsp. aureus Mu50
agcucuuuuuugauuuggaa

SEQ ID NO: 3989851 - RNA, 21 nt, Staphylococcus aureus subsp. aureus Mu50
agcucuuuuuugauuuggaaa

SEQ ID NO: 3989852 - RNA, 15 nt, Staphylococcus aureus subsp. aureus Mu50
agcugauuaaaaugu

SEQ ID NO: 3989853 - RNA, 17 nt, Staphylococcus aureus subsp. aureus Mu50
agcugauuaaaauguua

SEQ ID NO: 3989854 - RNA, 13 nt, Staphylococcus aureus subsp. aureus Mu50
agcugcaauuuua

SEQ ID NO: 3989855 - RNA, 17 nt, Staphylococcus aureus subsp. aureus Mu50
agcugcucgauauaugu

SEQ ID NO: 3989856 - RNA, 14 nt, Staphylococcus aureus subsp. aureus Mu50
agcugcuucaacua

SEQ ID NO: 3989857 - RNA, 18 nt, Staphylococcus aureus subsp. aureus Mu50
agcuguauaaccauaaug

SEQ ID NO: 3989858 - RNA, 22 nt, Staphylococcus aureus subsp. aureus Mu50
agcugugcugucauuuucugcu

SEQ ID NO: 3989859 - RNA, 23 nt, Staphylococcus aureus subsp. aureus Mu50
agcugugcugucauuuucugcuu

SEQ ID NO: 3989860 - RNA, 21 nt, Staphylococcus aureus subsp. aureus Mu50
agcuuaaauagugcuuuuuca

SEQ ID NO: 3989861 - RNA, 19 nt, Staphylococcus aureus subsp. aureus Mu50
agcuuaauaaauuguauga

SEQ ID NO: 3989862 - RNA, 18 nt, Staphylococcus aureus subsp. aureus Mu50
agcuuacaauagugugca

SEQ ID NO: 3989863 - RNA, 18 nt, Staphylococcus aureus subsp. aureus Mu50
agcuuacugcuuuuuuau

SEQ ID NO: 3989864 - RNA, 22 nt, Staphylococcus aureus subsp. aureus Mu50
agcuuauuaagcuugaaacaag

SEQ ID NO: 3989865 - RNA, 22 nt, Staphylococcus aureus subsp. aureus Mu50
agcuucaguuaaaucacugcuu

SEQ ID NO: 3989866 - RNA, 13 nt, Staphylococcus aureus subsp. aureus Mu50
agcuucauauuua

SEQ ID NO: 3989867 - RNA, 15 nt, Staphylococcus aureus subsp. aureus Mu50
agcuucuaaguaaua

SEQ ID NO: 3989868 - RNA, 22 nt, Staphylococcus aureus subsp. aureus Mu50
aggcuuaaauauaaugauccag

SEQ ID NO: 3989869 - RNA, 21 nt, Staphylococcus aureus subsp. aureus Mu50
aggcuuaugggggauuuuuuu

SEQ ID NO: 3989870 - RNA, 15 nt, Staphylococcus aureus subsp. aureus Mu50
aggcuuauuaacuuu

SEQ ID NO: 3989871 - RNA, 16 nt, Staphylococcus aureus subsp. aureus Mu50
agggagugaggugaga

SEQ ID NO: 3989872 - RNA, 14 nt, Staphylococcus aureus subsp. aureus Mu50
agggcaaaaaagga

SEQ ID NO: 3989873 - RNA, 22 nt, Staphylococcus aureus subsp. aureus Mu50
agggcauugagauuggaagggc

SEQ ID NO: 3989874 - RNA, 11 nt, Staphylococcus aureus subsp. aureus Mu50
agggccccaac

SEQ ID NO: 3989875 - RNA, 15 nt, Staphylococcus aureus subsp. aureus Mu50
agggccccaacacag

SEQ ID NO: 3989876 - RNA, 21 nt, Staphylococcus aureus subsp. aureus Mu50
agggcggucaauuuuaccaug

SEQ ID NO: 3989877 - RNA, 12 nt, Staphylococcus aureus subsp. aureus Mu50
aggggccccaac

SEQ ID NO: 3989878 - RNA, 16 nt, Staphylococcus aureus subsp. aureus Mu50
aggggccccaacacag

SEQ ID NO: 3989879 - RNA, 17 nt, Staphylococcus aureus subsp. aureus Mu50
aggggccccaacacaga

SEQ ID NO: 3989880 - RNA, 14 nt, Staphylococcus aureus subsp. aureus Mu50
aggggcuuuuaugc

SEQ ID NO: 3989881 - RNA, 16 nt, Staphylococcus aureus subsp. aureus Mu50
aggggcuuuuaugcau

SEQ ID NO: 3989882 - RNA, 13 nt, Staphylococcus aureus subsp. aureus Mu50
agggguaaaacuu

SEQ ID NO: 3989883 - RNA, 20 nt, Staphylococcus aureus subsp. aureus Mu50
agggguauauuaaaaauuuc

SEQ ID NO: 3989884 - RNA, 23 nt, Staphylococcus aureus subsp. aureus Mu50
agggguauguuuguuaugugauu

SEQ ID NO: 3989885 - RNA, 19 nt, Staphylococcus aureus subsp. aureus Mu50
aggguuucuggcucuucuu

SEQ ID NO: 3989886 - RNA, 22 nt, Staphylococcus aureus subsp. aureus Mu50
agguaaacggaauaacuuuuua

SEQ ID NO: 3989887 - RNA, 13 nt, Staphylococcus aureus subsp. aureus Mu50
agguaaaucuguu

SEQ ID NO: 3989888 - RNA, 19 nt, Staphylococcus aureus subsp. aureus Mu50
agguaaaucuguuuaaauu

SEQ ID NO: 3989889 - RNA, 18 nt, Staphylococcus aureus subsp. aureus Mu50
agguaaauuuaaaauaau

SEQ ID NO: 3989890 - RNA, 19 nt, Staphylococcus aureus subsp. aureus Mu50
agguaaauuuaaaauaaua

SEQ ID NO: 3989891 - RNA, 22 nt, Staphylococcus aureus subsp. aureus Mu50
agguaaauuuaaaauaauagau

SEQ ID NO: 3989892 - RNA, 17 nt, Staphylococcus aureus subsp. aureus Mu50
agguaaccuuaaauaua

SEQ ID NO: 3989893 - RNA, 15 nt, Staphylococcus aureus subsp. aureus Mu50
agguaacuaaaaugu

SEQ ID NO: 3989894 - RNA, 23 nt, Staphylococcus aureus subsp. aureus Mu50
agguaacugcuuuggaguuucuu

SEQ ID NO: 3989895 - RNA, 13 nt, Staphylococcus aureus subsp. aureus Mu50
agguaagaaaaau

SEQ ID NO: 3989896 - RNA, 15 nt, Staphylococcus aureus subsp. aureus Mu50
agguaagugcucaaa

SEQ ID NO: 3989897 - RNA, 12 nt, Staphylococcus aureus subsp. aureus Mu50
agguaaugcaag

SEQ ID NO: 3989898 - RNA, 23 nt, Staphylococcus aureus subsp. aureus Mu50
agguaaugcaaguuggcggggcc

SEQ ID NO: 3989899 - RNA, 17 nt, Staphylococcus aureus subsp. aureus Mu50
agguaaugcaaguuggg

SEQ ID NO: 3989900 - RNA, 17 nt, Staphylococcus aureus subsp. aureus Mu50
agguacuagaauuaacu

SEQ ID NO: 3989901 - RNA, 14 nt, Staphylococcus aureus subsp. aureus Mu50
agguauaucuucau

SEQ ID NO: 3989902 - RNA, 22 nt, Staphylococcus aureus subsp. aureus Mu50
agguaucacuaggauguucauc

SEQ ID NO: 3989903 - RNA, 19 nt, Staphylococcus aureus subsp. aureus Mu50
agguaugaaauaacaauag

SEQ ID NO: 3989904 - RNA, 11 nt, Staphylococcus aureus subsp. aureus Mu50
agguauucaaa

SEQ ID NO: 3989905 - RNA, 17 nt, Staphylococcus aureus subsp. aureus Mu50
agguauucaaauaaaca

SEQ ID NO: 3989906 - RNA, 19 nt, Staphylococcus aureus subsp. aureus Mu50
agguauuucauugauaagu

SEQ ID NO: 3989907 - RNA, 13 nt, Staphylococcus aureus subsp. aureus Mu50
aggucacuuuuau

SEQ ID NO: 3989908 - RNA, 15 nt, Staphylococcus aureus subsp. aureus Mu50
aggugauuauauaua

SEQ ID NO: 3989909 - RNA, 19 nt, Staphylococcus aureus subsp. aureus Mu50
aggugauuauauauauuaa

SEQ ID NO: 3989910 - RNA, 17 nt, Staphylococcus aureus subsp. aureus Mu50
aggugauugaacaauaa

SEQ ID NO: 3989911 - RNA, 14 nt, Staphylococcus aureus subsp. aureus Mu50
aggugcuuuaaugc

SEQ ID NO: 3989912 - RNA, 17 nt, Staphylococcus aureus subsp. aureus Mu50
agguuaaauauuuaauu

SEQ ID NO: 3989913 - RNA, 15 nt, Staphylococcus aureus subsp. aureus Mu50
agguuauuauaaaau

SEQ ID NO: 3989914 - RNA, 19 nt, Staphylococcus aureus subsp. aureus Mu50
agguuauuugauaaugaua

SEQ ID NO: 3989915 - RNA, 18 nt, Staphylococcus aureus subsp. aureus Mu50
agguucaucuuuaugcaa

SEQ ID NO: 3989916 - RNA, 21 nt, Staphylococcus aureus subsp. aureus Mu50
agguuguuuuucaucauuaaa

SEQ ID NO: 3989917 - RNA, 22 nt, Staphylococcus aureus subsp. aureus Mu50
agguuguuuuucaucauuaaaa

SEQ ID NO: 3989918 - RNA, 23 nt, Staphylococcus aureus subsp. aureus Mu50
agguuguuuuucaucauuaaaau

SEQ ID NO: 3989919 - RNA, 14 nt, Staphylococcus aureus subsp. aureus Mu50
agguuuauaaaaaa

SEQ ID NO: 3989920 - RNA, 20 nt, Staphylococcus aureus subsp. aureus Mu50
agguuuauaaaaaaucaguu

SEQ ID NO: 3989921 - RNA, 13 nt, Staphylococcus aureus subsp. aureus Mu50
agguuuauauauc

SEQ ID NO: 3989922 - RNA, 16 nt, Staphylococcus aureus subsp. aureus Mu50
agguuuguaagacaac

SEQ ID NO: 3989923 - RNA, 14 nt, Staphylococcus aureus subsp. aureus Mu50
agguuuuaugaauu

SEQ ID NO: 3989924 - RNA, 21 nt, Staphylococcus aureus subsp. aureus Mu50
agguuuucauuaaguugaaaa

SEQ ID NO: 3989925 - RNA, 21 nt, Staphylococcus aureus subsp. aureus Mu50
agguuuuuuauuuucauauaa

SEQ ID NO: 3989926 - RNA, 14 nt, Staphylococcus aureus subsp. aureus Mu50
aguaaaaacgaaau

SEQ ID NO: 3989927 - RNA, 14 nt, Staphylococcus aureus subsp. aureus Mu50
aguaaaaauacauu

SEQ ID NO: 3989928 - RNA, 14 nt, Staphylococcus aureus subsp. aureus Mu50
aguaaaacugcaau

SEQ ID NO: 3989929 - RNA, 15 nt, Staphylococcus aureus subsp. aureus Mu50
aguaaaauaaaaaau

SEQ ID NO: 3989930 - RNA, 21 nt, Staphylococcus aureus subsp. aureus Mu50
aguaaaauaaauacaauagaa

SEQ ID NO: 3989931 - RNA, 20 nt, Staphylococcus aureus subsp. aureus Mu50
aguaaaaucuuuaacauuug

SEQ ID NO: 3989932 - RNA, 17 nt, Staphylococcus aureus subsp. aureus Mu50
aguaaacgagacaucau

SEQ ID NO: 3989933 - RNA, 16 nt, Staphylococcus aureus subsp. aureus Mu50
aguaaagugaaauaaa

SEQ ID NO: 3989934 - RNA, 14 nt, Staphylococcus aureus subsp. aureus Mu50
aguaaauguuuuau

SEQ ID NO: 3989935 - RNA, 22 nt, Staphylococcus aureus subsp. aureus Mu50
aguaaauuaauagagaaagaau

SEQ ID NO: 3989936 - RNA, 16 nt, Staphylococcus aureus subsp. aureus Mu50
aguaacaauaacaccu

SEQ ID NO: 3989937 - RNA, 15 nt, Staphylococcus aureus subsp. aureus Mu50
aguaacauacuauaa

SEQ ID NO: 3989938 - RNA, 18 nt, Staphylococcus aureus subsp. aureus Mu50
aguaacauacuauaaaaa

SEQ ID NO: 3989939 - RNA, 19 nt, Staphylococcus aureus subsp. aureus Mu50
aguaacauacuauaaaaau

SEQ ID NO: 3989940 - RNA, 15 nt, Staphylococcus aureus subsp. aureus Mu50
aguaacucaagugau

SEQ ID NO: 3989941 - RNA, 20 nt, Staphylococcus aureus subsp. aureus Mu50
aguaagacgauuucaaugag

SEQ ID NO: 3989942 - RNA, 18 nt, Staphylococcus aureus subsp. aureus Mu50
aguaagauauuuccaaau

SEQ ID NO: 3989943 - RNA, 19 nt, Staphylococcus aureus subsp. aureus Mu50
aguaagauuauuuucaauu

SEQ ID NO: 3989944 - RNA, 15 nt, Staphylococcus aureus subsp. aureus Mu50
aguaaguaaaauaaa

SEQ ID NO: 3989945 - RNA, 14 nt, Staphylococcus aureus subsp. aureus Mu50
aguaaguaauaaaa

SEQ ID NO: 3989946 - RNA, 21 nt, Staphylococcus aureus subsp. aureus Mu50
aguaauaaaagucgauaaaua

SEQ ID NO: 3989947 - RNA, 22 nt, Staphylococcus aureus subsp. aureus Mu50
aguaauaaaagucgauaaauau

SEQ ID NO: 3989948 - RNA, 14 nt, Staphylococcus aureus subsp. aureus Mu50
aguaauaaaaugau

SEQ ID NO: 3989949 - RNA, 13 nt, Staphylococcus aureus subsp. aureus Mu50
aguaauaauauaa

SEQ ID NO: 3989950 - RNA, 21 nt, Staphylococcus aureus subsp. aureus Mu50
aguaauaauggcaauuaaaac

SEQ ID NO: 3989951 - RNA, 16 nt, Staphylococcus aureus subsp. aureus Mu50
aguaauaauuuauuga

SEQ ID NO: 3989952 - RNA, 18 nt, Staphylococcus aureus subsp. aureus Mu50
aguaauagcaaccauauu

SEQ ID NO: 3989953 - RNA, 19 nt, Staphylococcus aureus subsp. aureus Mu50
aguaauagcuauauuuuug

SEQ ID NO: 3989954 - RNA, 16 nt, Staphylococcus aureus subsp. aureus Mu50
aguaauauauaaaagu

SEQ ID NO: 3989955 - RNA, 20 nt, Staphylococcus aureus subsp. aureus Mu50
aguaauauauaaaagucguc

SEQ ID NO: 3989956 - RNA, 14 nt, Staphylococcus aureus subsp. aureus Mu50
agucaacugcugcu

SEQ ID NO: 3989957 - RNA, 17 nt, Staphylococcus aureus subsp. aureus Mu50
agucaacugcugcuaaa

SEQ ID NO: 3989958 - RNA, 21 nt, Staphylococcus aureus subsp. aureus Mu50
agucaaucaaguuaaucagaa

SEQ ID NO: 3989959 - RNA, 18 nt, Staphylococcus aureus subsp. aureus Mu50
agucaauguauauuuaac

SEQ ID NO: 3989960 - RNA, 19 nt, Staphylococcus aureus subsp. aureus Mu50
agucaauguauauuuaaca

SEQ ID NO: 3989961 - RNA, 19 nt, Staphylococcus aureus subsp. aureus Mu50
agucaauuuuuucaucuuu

SEQ ID NO: 3989962 - RNA, 14 nt, Staphylococcus aureus subsp. aureus Mu50
agucaccauauuua

SEQ ID NO: 3989963 - RNA, 17 nt, Staphylococcus aureus subsp. aureus Mu50
agucaccauauuuaaca

SEQ ID NO: 3989964 - RNA, 21 nt, Staphylococcus aureus subsp. aureus Mu50
agucaccugcuuuuuauuauu

SEQ ID NO: 3989965 - RNA, 13 nt, Staphylococcus aureus subsp. aureus Mu50
agucagaaagaau

SEQ ID NO: 3989966 - RNA, 14 nt, Staphylococcus aureus subsp. aureus Mu50
agucaggggcccca

SEQ ID NO: 3989967 - RNA, 19 nt, Staphylococcus aureus subsp. aureus Mu50
agucaggggccccaacaca

SEQ ID NO: 3989968 - RNA, 20 nt, Staphylococcus aureus subsp. aureus Mu50
agucaggggccccaacacag

SEQ ID NO: 3989969 - RNA, 22 nt, Staphylococcus aureus subsp. aureus Mu50
agucaggggccccaacacagag

SEQ ID NO: 3989970 - RNA, 17 nt, Staphylococcus aureus subsp. aureus Mu50
agucaguauaaguuucu

SEQ ID NO: 3989971 - RNA, 16 nt, Staphylococcus aureus subsp. aureus Mu50
agucauaaauauaaaa

SEQ ID NO: 3989972 - RNA, 17 nt, Staphylococcus aureus subsp. aureus Mu50
agucauaaauauaaaau

SEQ ID NO: 3989973 - RNA, 21 nt, Staphylococcus aureus subsp. aureus Mu50
agucauaaauugauuucuaau

SEQ ID NO: 3989974 - RNA, 17 nt, Staphylococcus aureus subsp. aureus Mu50
agucauaacgauuguug

SEQ ID NO: 3989975 - RNA, 15 nt, Staphylococcus aureus subsp. aureus Mu50
agucauaauuuaaaa

SEQ ID NO: 3989976 - RNA, 17 nt, Staphylococcus aureus subsp. aureus Mu50
agucauaauuuaaaaga

SEQ ID NO: 3989977 - RNA, 12 nt, Staphylococcus aureus subsp. aureus Mu50
agucauaugcau

SEQ ID NO: 3989978 - RNA, 16 nt, Staphylococcus aureus subsp. aureus Mu50
agucauaugugccaua

SEQ ID NO: 3989979 - RNA, 22 nt, Staphylococcus aureus subsp. aureus Mu50
agucaucuuagacgcuguuuua

SEQ ID NO: 3989980 - RNA, 22 nt, Staphylococcus aureus subsp. aureus Mu50
agucaucuugagauuuucaaca

SEQ ID NO: 3989981 - RNA, 14 nt, Staphylococcus aureus subsp. aureus Mu50
agucaugucccaua

SEQ ID NO: 3989982 - RNA, 15 nt, Staphylococcus aureus subsp. aureus Mu50
agucaugucccauaa

SEQ ID NO: 3989983 - RNA, 15 nt, Staphylococcus aureus subsp. aureus Mu50
agucauuaaauguac

SEQ ID NO: 3989984 - RNA, 19 nt, Staphylococcus aureus subsp. aureus Mu50
agucauuugauuuaaaaag

SEQ ID NO: 3989985 - RNA, 21 nt, Staphylococcus aureus subsp. aureus Mu50
agucauuugauuuaaaaaguu

SEQ ID NO: 3989986 - RNA, 19 nt, Staphylococcus aureus subsp. aureus Mu50
aguccaauuccaauaaaca

SEQ ID NO: 3989987 - RNA, 12 nt, Staphylococcus aureus subsp. aureus Mu50
aguccauuauug

SEQ ID NO: 3989988 - RNA, 14 nt, Staphylococcus aureus subsp. aureus Mu50
aguccauuuucuuu

SEQ ID NO: 3989989 - RNA, 16 nt, Staphylococcus aureus subsp. aureus Mu50
aguccauuuucuuuuu

SEQ ID NO: 3989990 - RNA, 19 nt, Staphylococcus aureus subsp. aureus Mu50
agucccaaccccuuuauuu

SEQ ID NO: 3989991 - RNA, 14 nt, Staphylococcus aureus subsp. aureus Mu50
agucccgcuuaaaa

SEQ ID NO: 3989992 - RNA, 22 nt, Staphylococcus aureus subsp. aureus Mu50
aguccgcguguacuuuaccauc

SEQ ID NO: 3989993 - RNA, 18 nt, Staphylococcus aureus subsp. aureus Mu50
aguccuucuuugaaauca

SEQ ID NO: 3989994 - RNA, 21 nt, Staphylococcus aureus subsp. aureus Mu50
aguccuucuuugaaaucaaug

SEQ ID NO: 3989995 - RNA, 14 nt, Staphylococcus aureus subsp. aureus Mu50
aguccuuuuuuuau

SEQ ID NO: 3989996 - RNA, 15 nt, Staphylococcus aureus subsp. aureus Mu50
agucgacaugauucu

SEQ ID NO: 3989997 - RNA, 16 nt, Staphylococcus aureus subsp. aureus Mu50
agucgguguuuucuua

SEQ ID NO: 3989998 - RNA, 20 nt, Staphylococcus aureus subsp. aureus Mu50
agucguucaauuguugauuu

SEQ ID NO: 3989999 - RNA, 19 nt, Staphylococcus aureus subsp. aureus Mu50
agucguucucuuaaauaug

SEQ ID NO: 3990000 - RNA, 22 nt, Staphylococcus aureus subsp. aureus Mu50
agucuaacaguuaauaugaauu

SEQ ID NO: 3990001 - RNA, 17 nt, Staphylococcus aureus subsp. aureus Mu50
agucuacaguaaauuga

SEQ ID NO: 3990002 - RNA, 19 nt, Staphylococcus aureus subsp. aureus Mu50
agucuacaguaaauugauu

SEQ ID NO: 3990003 - RNA, 12 nt, Staphylococcus aureus subsp. aureus Mu50
agucuaugaaua

SEQ ID NO: 3990004 - RNA, 16 nt, Staphylococcus aureus subsp. aureus Mu50
agucuaugaauaaugu

SEQ ID NO: 3990005 - RNA, 17 nt, Staphylococcus aureus subsp. aureus Mu50
agucuaugaauaauguu

SEQ ID NO: 3990006 - RNA, 18 nt, Staphylococcus aureus subsp. aureus Mu50
agucucccauaacaccua

SEQ ID NO: 3990007 - RNA, 19 nt, Staphylococcus aureus subsp. aureus Mu50
agucucuaaaacuuuuuca

SEQ ID NO: 3990008 - RNA, 22 nt, Staphylococcus aureus subsp. aureus Mu50
agucugcucuuuuuguaugagu

SEQ ID NO: 3990009 - RNA, 15 nt, Staphylococcus aureus subsp. aureus Mu50
agucuggugaaaacc

SEQ ID NO: 3990010 - RNA, 16 nt, Staphylococcus aureus subsp. aureus Mu50
agucuuaaacauaaca

SEQ ID NO: 3990011 - RNA, 17 nt, Staphylococcus aureus subsp. aureus Mu50
agucuuaaacauaacau

SEQ ID NO: 3990012 - RNA, 22 nt, Staphylococcus aureus subsp. aureus Mu50
agucuucggcuuuguaaaauug

SEQ ID NO: 3990013 - RNA, 16 nt, Staphylococcus aureus subsp. aureus Mu50
agucuucuuacugcaa

SEQ ID NO: 3990014 - RNA, 23 nt, Staphylococcus aureus subsp. aureus Mu50
agucuucuuacugcaauuauuuu

SEQ ID NO: 3990015 - RNA, 17 nt, Staphylococcus aureus subsp. aureus Mu50
agucuucuuuuuuuaac

SEQ ID NO: 3990016 - RNA, 19 nt, Staphylococcus aureus subsp. aureus Mu50
agucuucuuuuuuuaacuu

SEQ ID NO: 3990017 - RNA, 13 nt, Staphylococcus aureus subsp. aureus Mu50
agucuuuaacuuu

SEQ ID NO: 3990018 - RNA, 13 nt, Staphylococcus aureus subsp. aureus Mu50
agucuuuuuuaag

SEQ ID NO: 3990019 - RNA, 19 nt, Staphylococcus aureus subsp. aureus Mu50
agugaaaaaguuucggaaa

SEQ ID NO: 3990020 - RNA, 14 nt, Staphylococcus aureus subsp. aureus Mu50
agugaaaagaacac

SEQ ID NO: 3990021 - RNA, 13 nt, Staphylococcus aureus subsp. aureus Mu50
agugaaauaccuc

SEQ ID NO: 3990022 - RNA, 17 nt, Staphylococcus aureus subsp. aureus Mu50
agugaaaucauuuaaau

SEQ ID NO: 3990023 - RNA, 18 nt, Staphylococcus aureus subsp. aureus Mu50
agugaaggagauuaagca

SEQ ID NO: 3990024 - RNA, 23 nt, Staphylococcus aureus subsp. aureus Mu50
agugaaguuaacuauaacaauag

SEQ ID NO: 3990025 - RNA, 13 nt, Staphylococcus aureus subsp. aureus Mu50
agugacacaccac

SEQ ID NO: 3990026 - RNA, 16 nt, Staphylococcus aureus subsp. aureus Mu50
agugacacaccaccac

SEQ ID NO: 3990027 - RNA, 15 nt, Staphylococcus aureus subsp. aureus Mu50
agugacacuguaacg

SEQ ID NO: 3990028 - RNA, 13 nt, Staphylococcus aureus subsp. aureus Mu50
agugaccucaggu

SEQ ID NO: 3990029 - RNA, 17 nt, Staphylococcus aureus subsp. aureus Mu50
agugaccucagguuguu

SEQ ID NO: 3990030 - RNA, 23 nt, Staphylococcus aureus subsp. aureus Mu50
agugacuuaauaucauauucaaa

SEQ ID NO: 3990031 - RNA, 16 nt, Staphylococcus aureus subsp. aureus Mu50
agugacuuuuauaauu

SEQ ID NO: 3990032 - RNA, 22 nt, Staphylococcus aureus subsp. aureus Mu50
agugagcguauuauuauugaaa

SEQ ID NO: 3990033 - RNA, 20 nt, Staphylococcus aureus subsp. aureus Mu50
agugaguuuuauuuauaaac

SEQ ID NO: 3990034 - RNA, 15 nt, Staphylococcus aureus subsp. aureus Mu50
agugauaauuaaaau

SEQ ID NO: 3990035 - RNA, 21 nt, Staphylococcus aureus subsp. aureus Mu50
agugauaauuaaaauaagaua

SEQ ID NO: 3990036 - RNA, 15 nt, Staphylococcus aureus subsp. aureus Mu50
agugaugaccaauau

SEQ ID NO: 3990037 - RNA, 12 nt, Staphylococcus aureus subsp. aureus Mu50
agugauuuaaaa

SEQ ID NO: 3990038 - RNA, 20 nt, Staphylococcus aureus subsp. aureus Mu50
agugauuucuucauuaucaa

SEQ ID NO: 3990039 - RNA, 14 nt, Staphylococcus aureus subsp. aureus Mu50
agugauuugccaaa

SEQ ID NO: 3990040 - RNA, 15 nt, Staphylococcus aureus subsp. aureus Mu50
agugauuuuuuacau

SEQ ID NO: 3990041 - RNA, 19 nt, Staphylococcus aureus subsp. aureus Mu50
agugcaaguccaaauaaua

SEQ ID NO: 3990042 - RNA, 22 nt, Staphylococcus aureus subsp. aureus Mu50
agugcaauaacaccaauugaau

SEQ ID NO: 3990043 - RNA, 20 nt, Staphylococcus aureus subsp. aureus Mu50
agugcauuuuuuauuuuacu

SEQ ID NO: 3990044 - RNA, 22 nt, Staphylococcus aureus subsp. aureus Mu50
auaaaauccuaagcaucguaaa

SEQ ID NO: 3990045 - RNA, 13 nt, Staphylococcus aureus subsp. aureus Mu50
auaaaaugcaauu

SEQ ID NO: 3990046 - RNA, 17 nt, Staphylococcus aureus subsp. aureus Mu50
auaaaaugcauagcucu

SEQ ID NO: 3990047 - RNA, 21 nt, Staphylococcus aureus subsp. aureus Mu50
auaaaaugcauagcucuucuu

SEQ ID NO: 3990048 - RNA, 22 nt, Staphylococcus aureus subsp. aureus Mu50
auaaaaugcauagcucuucuuu

SEQ ID NO: 3990049 - RNA, 13 nt, Staphylococcus aureus subsp. aureus Mu50
auaaaauggcauc

SEQ ID NO: 3990050 - RNA, 20 nt, Staphylococcus aureus subsp. aureus Mu50
auaaaauggugcgaauaaua

SEQ ID NO: 3990051 - RNA, 13 nt, Staphylococcus aureus subsp. aureus Mu50
auaaaauguuguu

SEQ ID NO: 3990052 - RNA, 13 nt, Staphylococcus aureus subsp. aureus Mu50
auaaaauuaaaac

SEQ ID NO: 3990053 - RNA, 16 nt, Staphylococcus aureus subsp. aureus Mu50
auaaaauuaaaacagc

SEQ ID NO: 3990054 - RNA, 21 nt, Staphylococcus aureus subsp. aureus Mu50
auaaaauuacuugaauauuau

SEQ ID NO: 3990055 - RNA, 14 nt, Staphylococcus aureus subsp. aureus Mu50
auaaaauucaccaa

SEQ ID NO: 3990056 - RNA, 13 nt, Staphylococcus aureus subsp. aureus Mu50
auaaaauuuaaaa

SEQ ID NO: 3990057 - RNA, 15 nt, Staphylococcus aureus subsp. aureus Mu50
auaaaauuuaaaaca

SEQ ID NO: 3990058 - RNA, 14 nt, Staphylococcus aureus subsp. aureus Mu50
auaaaauuucugcu

SEQ ID NO: 3990059 - RNA, 22 nt, Staphylococcus aureus subsp. aureus Mu50
auaaaauuucugcuucuuuuaa

SEQ ID NO: 3990060 - RNA, 15 nt, Staphylococcus aureus subsp. aureus Mu50
auaaaauuuuuuuca

SEQ ID NO: 3990061 - RNA, 16 nt, Staphylococcus aureus subsp. aureus Mu50
auaaaauuuuuuucau

SEQ ID NO: 3990062 - RNA, 22 nt, Staphylococcus aureus subsp. aureus Mu50
auaaaauuuuuuucauaauuaa

SEQ ID NO: 3990063 - RNA, 20 nt, Staphylococcus aureus subsp. aureus Mu50
auaaacaacugcaauagcua

SEQ ID NO: 3990064 - RNA, 11 nt, Staphylococcus aureus subsp. aureus Mu50
auaaacaauaa

SEQ ID NO: 3990065 - RNA, 14 nt, Staphylococcus aureus subsp. aureus Mu50
auaaacaauaacug

SEQ ID NO: 3990066 - RNA, 19 nt, Staphylococcus aureus subsp. aureus Mu50
auaaacaauaacuguucuu

SEQ ID NO: 3990067 - RNA, 14 nt, Staphylococcus aureus subsp. aureus Mu50
auaaaccagcugau

SEQ ID NO: 3990068 - RNA, 23 nt, Staphylococcus aureus subsp. aureus Mu50
auaaaccaugcuuccauaauuug

SEQ ID NO: 3990069 - RNA, 23 nt, Staphylococcus aureus subsp. aureus Mu50
auaaaccgauuguuucaccagcu

SEQ ID NO: 3990070 - RNA, 20 nt, Staphylococcus aureus subsp. aureus Mu50
auaaacgacgcaagugacuu

SEQ ID NO: 3990071 - RNA, 19 nt, Staphylococcus aureus subsp. aureus Mu50
auaaacgauugauuaucau

SEQ ID NO: 3990072 - RNA, 12 nt, Staphylococcus aureus subsp. aureus Mu50
auaaacuaaaaa

SEQ ID NO: 3990073 - RNA, 12 nt, Staphylococcus aureus subsp. aureus Mu50
auaaacuacaca

SEQ ID NO: 3990074 - RNA, 14 nt, Staphylococcus aureus subsp. aureus Mu50
auaaacuacacacg

SEQ ID NO: 3990075 - RNA, 16 nt, Staphylococcus aureus subsp. aureus Mu50
auaaacuuuaugaaau

SEQ ID NO: 3990076 - RNA, 17 nt, Staphylococcus aureus subsp. aureus Mu50
auaaacuuuaugaaauu

SEQ ID NO: 3990077 - RNA, 18 nt, Staphylococcus aureus subsp. aureus Mu50
auaaacuuuaugaaauuu

SEQ ID NO: 3990078 - RNA, 13 nt, Staphylococcus aureus subsp. aureus Mu50
auaaagaaugauu

SEQ ID NO: 3990079 - RNA, 14 nt, Staphylococcus aureus subsp. aureus Mu50
auaaagaaugauuu

SEQ ID NO: 3990080 - RNA, 22 nt, Staphylococcus aureus subsp. aureus Mu50
auaaagaaugauuuauaaaaaa

SEQ ID NO: 3990081 - RNA, 17 nt, Staphylococcus aureus subsp. aureus Mu50
auaaagauuauaucuuu

SEQ ID NO: 3990082 - RNA, 21 nt, Staphylococcus aureus subsp. aureus Mu50
auaaagccaucuaggucacuu

SEQ ID NO: 3990083 - RNA, 15 nt, Staphylococcus aureus subsp. aureus Mu50
auaaagcguucucua

SEQ ID NO: 3990084 - RNA, 19 nt, Staphylococcus aureus subsp. aureus Mu50
auaaagcugauuuuucauu

SEQ ID NO: 3990085 - RNA, 21 nt, Staphylococcus aureus subsp. aureus Mu50
auaaagcugauuuuucauuga

SEQ ID NO: 3990086 - RNA, 17 nt, Staphylococcus aureus subsp. aureus Mu50
auaaagcugcgauauaa

SEQ ID NO: 3990087 - RNA, 20 nt, Staphylococcus aureus subsp. aureus Mu50
auaaagcugcgauauaacua

SEQ ID NO: 3990088 - RNA, 17 nt, Staphylococcus aureus subsp. aureus Mu50
auaaagcuuugacauau

SEQ ID NO: 3990089 - RNA, 14 nt, Staphylococcus aureus subsp. aureus Mu50
auaaaggcaacaaa

SEQ ID NO: 3990090 - RNA, 20 nt, Staphylococcus aureus subsp. aureus Mu50
auaaaggcaacaaauauaau

SEQ ID NO: 3990091 - RNA, 19 nt, Staphylococcus aureus subsp. aureus Mu50
auaaaguaugagugauaga

SEQ ID NO: 3990092 - RNA, 15 nt, Staphylococcus aureus subsp. aureus Mu50
auaaagucauauggu

SEQ ID NO: 3990093 - RNA, 16 nt, Staphylococcus aureus subsp. aureus Mu50
auaaagucauaugguu

SEQ ID NO: 3990094 - RNA, 21 nt, Staphylococcus aureus subsp. aureus Mu50
auaaagucauaugguuaucuu

SEQ ID NO: 3990095 - RNA, 19 nt, Staphylococcus aureus subsp. aureus Mu50
auaaaguugacaauacaaa

SEQ ID NO: 3990096 - RNA, 15 nt, Staphylococcus aureus subsp. aureus Mu50
auaaauaaaaauaca

SEQ ID NO: 3990097 - RNA, 22 nt, Staphylococcus aureus subsp. aureus Mu50
auaaauaaaaauacauaauuaa

SEQ ID NO: 3990098 - RNA, 14 nt, Staphylococcus aureus subsp. aureus Mu50
auaaauaaaagcca

SEQ ID NO: 3990099 - RNA, 23 nt, Staphylococcus aureus subsp. aureus Mu50
auaaauaaaaggcauucuuccaa

SEQ ID NO: 3990100 - RNA, 12 nt, Staphylococcus aureus subsp. aureus Mu50
auaaauaaaaug

SEQ ID NO: 3990101 - RNA, 13 nt, Staphylococcus aureus subsp. aureus Mu50
auaaauaaaaugc

SEQ ID NO: 3990102 - RNA, 14 nt, Staphylococcus aureus subsp. aureus Mu50
auaaauaaaauuuu

SEQ ID NO: 3990103 - RNA, 22 nt, Staphylococcus aureus subsp. aureus Mu50
auaaauaagcaaucauaauacu

SEQ ID NO: 3990104 - RNA, 21 nt, Staphylococcus aureus subsp. aureus Mu50
auaaauaagcaguaagaugac

SEQ ID NO: 3990105 - RNA, 14 nt, Staphylococcus aureus subsp. aureus Mu50
auaaauaagugaua

SEQ ID NO: 3990106 - RNA, 19 nt, Staphylococcus aureus subsp. aureus Mu50
auaaauaagugauaaauaa

SEQ ID NO: 3990107 - RNA, 14 nt, Staphylococcus aureus subsp. aureus Mu50
auaaauaauaaguu

SEQ ID NO: 3990108 - RNA, 21 nt, Staphylococcus aureus subsp. aureus Mu50
auaaauaauuucggauuaucu

SEQ ID NO: 3990109 - RNA, 15 nt, Staphylococcus aureus subsp. aureus Mu50
auaaauacaaaaaua

SEQ ID NO: 3990110 - RNA, 13 nt, Staphylococcus aureus subsp. aureus Mu50
auaaauacaaaua

SEQ ID NO: 3990111 - RNA, 21 nt, Staphylococcus aureus subsp. aureus Mu50
auaaauaccgucuucucuauc

SEQ ID NO: 3990112 - RNA, 13 nt, Staphylococcus aureus subsp. aureus Mu50
auaaauaucaauu

SEQ ID NO: 3990113 - RNA, 20 nt, Staphylococcus aureus subsp. aureus Mu50
auaaauaucauaaaugcaua

SEQ ID NO: 3990114 - RNA, 17 nt, Staphylococcus aureus subsp. aureus Mu50
auaaauaugauguuaaa

SEQ ID NO: 3990115 - RNA, 20 nt, Staphylococcus aureus subsp. aureus Mu50
auaaauaugauguuaaaaaa

SEQ ID NO: 3990116 - RNA, 18 nt, Staphylococcus aureus subsp. aureus Mu50
auaaauauggauuuugaa

SEQ ID NO: 3990117 - RNA, 14 nt, Staphylococcus aureus subsp. aureus Mu50
auaaauauuguguu

SEQ ID NO: 3990118 - RNA, 14 nt, Staphylococcus aureus subsp. aureus Mu50
auaaauauuuaaaa

SEQ ID NO: 3990119 - RNA, 19 nt, Staphylococcus aureus subsp. aureus Mu50
auaaauauuuaaaauauua

SEQ ID NO: 3990120 - RNA, 13 nt, Staphylococcus aureus subsp. aureus Mu50
auaaauauuuuua

SEQ ID NO: 3990121 - RNA, 14 nt, Staphylococcus aureus subsp. aureus Mu50
auaaaucaaagagg

SEQ ID NO: 3990122 - RNA, 15 nt, Staphylococcus aureus subsp. aureus Mu50
auaaaucaauguacu

SEQ ID NO: 3990123 - RNA, 13 nt, Staphylococcus aureus subsp. aureus Mu50
auaaaucaauguu

SEQ ID NO: 3990124 - RNA, 18 nt, Staphylococcus aureus subsp. aureus Mu50
auaaaucacgccauaauc

SEQ ID NO: 3990125 - RNA, 23 nt, Staphylococcus aureus subsp. aureus Mu50
auaaaucacgccauaaucuucau

SEQ ID NO: 3990126 - RNA, 14 nt, Staphylococcus aureus subsp. aureus Mu50
auaaaucaguaguu

SEQ ID NO: 3990127 - RNA, 22 nt, Staphylococcus aureus subsp. aureus Mu50
auaaaucaguaguuuuaaaagu

SEQ ID NO: 3990128 - RNA, 22 nt, Staphylococcus aureus subsp. aureus Mu50
auaaaucauacgagaaauuaga

SEQ ID NO: 3990129 - RNA, 13 nt, Staphylococcus aureus subsp. aureus Mu50
auaaaucaucauu

SEQ ID NO: 3990130 - RNA, 16 nt, Staphylococcus aureus subsp. aureus Mu50
auaaaucauucuuuau

SEQ ID NO: 3990131 - RNA, 21 nt, Staphylococcus aureus subsp. aureus Mu50
auaaauccuaagucuuuuaaa

SEQ ID NO: 3990132 - RNA, 21 nt, Staphylococcus aureus subsp. aureus Mu50
auaacucgcuucguucuaaaa

SEQ ID NO: 3990133 - RNA, 16 nt, Staphylococcus aureus subsp. aureus Mu50
auaacugcuaauuuuu

SEQ ID NO: 3990134 - RNA, 15 nt, Staphylococcus aureus subsp. aureus Mu50
auaacuguuuaucau

SEQ ID NO: 3990135 - RNA, 15 nt, Staphylococcus aureus subsp. aureus Mu50
auaacuucguuuuaa

SEQ ID NO: 3990136 - RNA, 19 nt, Staphylococcus aureus subsp. aureus Mu50
auaacuucguuuuaauaaa

SEQ ID NO: 3990137 - RNA, 16 nt, Staphylococcus aureus subsp. aureus Mu50
auaacuucuauuaaga

SEQ ID NO: 3990138 - RNA, 13 nt, Staphylococcus aureus subsp. aureus Mu50
auaacuuguaaua

SEQ ID NO: 3990139 - RNA, 12 nt, Staphylococcus aureus subsp. aureus Mu50
auaacuuuaaaa

SEQ ID NO: 3990140 - RNA, 13 nt, Staphylococcus aureus subsp. aureus Mu50
auaacuuuaaaaa

SEQ ID NO: 3990141 - RNA, 15 nt, Staphylococcus aureus subsp. aureus Mu50
auaacuuuaaaaauu

SEQ ID NO: 3990142 - RNA, 16 nt, Staphylococcus aureus subsp. aureus Mu50
auaacuuuaaaaauua

SEQ ID NO: 3990143 - RNA, 21 nt, Staphylococcus aureus subsp. aureus Mu50
auaacuuuauauauaaagaaa

SEQ ID NO: 3990144 - RNA, 13 nt, Staphylococcus aureus subsp. aureus Mu50
auaacuuuauggg

SEQ ID NO: 3990145 - RNA, 15 nt, Staphylococcus aureus subsp. aureus Mu50
auaacuuuuuaaagg

SEQ ID NO: 3990146 - RNA, 19 nt, Staphylococcus aureus subsp. aureus Mu50
auaagaaaaaguuauauca

SEQ ID NO: 3990147 - RNA, 14 nt, Staphylococcus aureus subsp. aureus Mu50
auaagaaaauacua

SEQ ID NO: 3990148 - RNA, 15 nt, Staphylococcus aureus subsp. aureus Mu50
auaagaaaauacuaa

SEQ ID NO: 3990149 - RNA, 15 nt, Staphylococcus aureus subsp. aureus Mu50
auaagaauauuuaag

SEQ ID NO: 3990150 - RNA, 12 nt, Staphylococcus aureus subsp. aureus Mu50
auaagaauguga

SEQ ID NO: 3990151 - RNA, 20 nt, Staphylococcus aureus subsp. aureus Mu50
auaagaauuaacaacaaaua

SEQ ID NO: 3990152 - RNA, 10 nt, Staphylococcus aureus subsp. aureus Mu50
auaagaauuu

SEQ ID NO: 3990153 - RNA, 15 nt, Staphylococcus aureus subsp. aureus Mu50
auaagaauuuaaaag

SEQ ID NO: 3990154 - RNA, 15 nt, Staphylococcus aureus subsp. aureus Mu50
auaagacaauaguau

SEQ ID NO: 3990155 - RNA, 19 nt, Staphylococcus aureus subsp. aureus Mu50
auaagacuucccuauaugu

SEQ ID NO: 3990156 - RNA, 21 nt, Staphylococcus aureus subsp. aureus Mu50
auaagacuucccuauauguag

SEQ ID NO: 3990157 - RNA, 18 nt, Staphylococcus aureus subsp. aureus Mu50
auaagagaacuuuucaaa

SEQ ID NO: 3990158 - RNA, 19 nt, Staphylococcus aureus subsp. aureus Mu50
auaagagaacuuuucaaac

SEQ ID NO: 3990159 - RNA, 13 nt, Staphylococcus aureus subsp. aureus Mu50
auaagauuuugaa

SEQ ID NO: 3990160 - RNA, 18 nt, Staphylococcus aureus subsp. aureus Mu50
auaagcaaucauaauacu

SEQ ID NO: 3990161 - RNA, 15 nt, Staphylococcus aureus subsp. aureus Mu50
auaagccauaugcuu

SEQ ID NO: 3990162 - RNA, 16 nt, Staphylococcus aureus subsp. aureus Mu50
auaagccuuuucaaac

SEQ ID NO: 3990163 - RNA, 17 nt, Staphylococcus aureus subsp. aureus Mu50
auaagccuuuucaaaca

SEQ ID NO: 3990164 - RNA, 18 nt, Staphylococcus aureus subsp. aureus Mu50
auaagccuuuucaaacau

SEQ ID NO: 3990165 - RNA, 18 nt, Staphylococcus aureus subsp. aureus Mu50
auaagcgcaauuaaaagu

SEQ ID NO: 3990166 - RNA, 21 nt, Staphylococcus aureus subsp. aureus Mu50
auaagcgcaauuaaaaguacu

SEQ ID NO: 3990167 - RNA, 20 nt, Staphylococcus aureus subsp. aureus Mu50
auaagcugaaaaucaucauu

SEQ ID NO: 3990168 - RNA, 22 nt, Staphylococcus aureus subsp. aureus Mu50
auaagcugaaaaucaucauuau

SEQ ID NO: 3990169 - RNA, 17 nt, Staphylococcus aureus subsp. aureus Mu50
auaagcuuguaacaagc

SEQ ID NO: 3990170 - RNA, 21 nt, Staphylococcus aureus subsp. aureus Mu50
auaagcuuguaacaagcauuu

SEQ ID NO: 3990171 - RNA, 14 nt, Staphylococcus aureus subsp. aureus Mu50
auaaggaaaaggau

SEQ ID NO: 3990172 - RNA, 17 nt, Staphylococcus aureus subsp. aureus Mu50
auaaggaagcguaugau

SEQ ID NO: 3990173 - RNA, 16 nt, Staphylococcus aureus subsp. aureus Mu50
auaaggacucuguuua

SEQ ID NO: 3990174 - RNA, 21 nt, Staphylococcus aureus subsp. aureus Mu50
auaaggcauauccgaaaauug

SEQ ID NO: 3990175 - RNA, 19 nt, Staphylococcus aureus subsp. aureus Mu50
auaagggguauauuaaaaa

SEQ ID NO: 3990176 - RNA, 14 nt, Staphylococcus aureus subsp. aureus Mu50
auaagguugaagaa

SEQ ID NO: 3990177 - RNA, 13 nt, Staphylococcus aureus subsp. aureus Mu50
auaaguaaauaau

SEQ ID NO: 3990178 - RNA, 16 nt, Staphylococcus aureus subsp. aureus Mu50
auaaguaaauaauagu

SEQ ID NO: 3990179 - RNA, 16 nt, Staphylococcus aureus subsp. aureus Mu50
auaaguaauaauauaa

SEQ ID NO: 3990180 - RNA, 18 nt, Staphylococcus aureus subsp. aureus Mu50
auaaguaauaauauaaau

SEQ ID NO: 3990181 - RNA, 19 nt, Staphylococcus aureus subsp. aureus Mu50
auaaguaauaauauaaaua

SEQ ID NO: 3990182 - RNA, 14 nt, Staphylococcus aureus subsp. aureus Mu50
auaaguacaaauaa

SEQ ID NO: 3990183 - RNA, 18 nt, Staphylococcus aureus subsp. aureus Mu50
auaaguacaaauaauaca

SEQ ID NO: 3990184 - RNA, 20 nt, Staphylococcus aureus subsp. aureus Mu50
auaaguacaaauaauacagg

SEQ ID NO: 3990185 - RNA, 22 nt, Staphylococcus aureus subsp. aureus Mu50
auaaguagugauuuuuuacauu

SEQ ID NO: 3990186 - RNA, 13 nt, Staphylococcus aureus subsp. aureus Mu50
auaaguaguucag

SEQ ID NO: 3990187 - RNA, 14 nt, Staphylococcus aureus subsp. aureus Mu50
auaaguauucauac

SEQ ID NO: 3990188 - RNA, 14 nt, Staphylococcus aureus subsp. aureus Mu50
auaagucacauuua

SEQ ID NO: 3990189 - RNA, 20 nt, Staphylococcus aureus subsp. aureus Mu50
auaagucuaauguuggaaaa

SEQ ID NO: 3990190 - RNA, 13 nt, Staphylococcus aureus subsp. aureus Mu50
auaagugauaaau

SEQ ID NO: 3990191 - RNA, 23 nt, Staphylococcus aureus subsp. aureus Mu50
auaagugauuucuucauuaucaa

SEQ ID NO: 3990192 - RNA, 12 nt, Staphylococcus aureus subsp. aureus Mu50
auaaguuaaaaa

SEQ ID NO: 3990193 - RNA, 13 nt, Staphylococcus aureus subsp. aureus Mu50
auaaguuaaaaau

SEQ ID NO: 3990194 - RNA, 13 nt, Staphylococcus aureus subsp. aureus Mu50
auaaguuaaaauu

SEQ ID NO: 3990195 - RNA, 17 nt, Staphylococcus aureus subsp. aureus Mu50
auaaguuaaugugcauu

SEQ ID NO: 3990196 - RNA, 24 nt, Staphylococcus aureus subsp. aureus Mu50
auaaguuacuagcauuagcaaaua

SEQ ID NO: 3990197 - RNA, 15 nt, Staphylococcus aureus subsp. aureus Mu50
auaaguugaauauaa

SEQ ID NO: 3990198 - RNA, 17 nt, Staphylococcus aureus subsp. aureus Mu50
auaaguugcauauaaaa

SEQ ID NO: 3990199 - RNA, 21 nt, Staphylococcus aureus subsp. aureus Mu50
auaaguugucaucuaauuaca

SEQ ID NO: 3990200 - RNA, 19 nt, Staphylococcus aureus subsp. aureus Mu50
auaaguuuuugaauaucua

SEQ ID NO: 3990201 - RNA, 12 nt, Staphylococcus aureus subsp. aureus Mu50
auaauaaaauag

SEQ ID NO: 3990202 - RNA, 14 nt, Staphylococcus aureus subsp. aureus Mu50
auaauaaagauuau

SEQ ID NO: 3990203 - RNA, 13 nt, Staphylococcus aureus subsp. aureus Mu50
auaauaaauagac

SEQ ID NO: 3990204 - RNA, 14 nt, Staphylococcus aureus subsp. aureus Mu50
auaauaaauaggau

SEQ ID NO: 3990205 - RNA, 13 nt, Staphylococcus aureus subsp. aureus Mu50
auaauaaauguca

SEQ ID NO: 3990206 - RNA, 18 nt, Staphylococcus aureus subsp. aureus Mu50
auaauaacuggcaaauca

SEQ ID NO: 3990207 - RNA, 21 nt, Staphylococcus aureus subsp. aureus Mu50
auaauaagagaacuuuucaaa

SEQ ID NO: 3990208 - RNA, 21 nt, Staphylococcus aureus subsp. aureus Mu50
auaauaaguugaauauaaaaa

SEQ ID NO: 3990209 - RNA, 22 nt, Staphylococcus aureus subsp. aureus Mu50
auaauaaguugaauauaaaaaa

SEQ ID NO: 3990210 - RNA, 22 nt, Staphylococcus aureus subsp. aureus Mu50
auaauaccuaauugcuuaauau

SEQ ID NO: 3990211 - RNA, 16 nt, Staphylococcus aureus subsp. aureus Mu50
auaauacguuuugcua

SEQ ID NO: 3990212 - RNA, 14 nt, Staphylococcus aureus subsp. aureus Mu50
auaauacuguauuu

SEQ ID NO: 3990213 - RNA, 17 nt, Staphylococcus aureus subsp. aureus Mu50
auaauacuguauuuuaa

SEQ ID NO: 3990214 - RNA, 13 nt, Staphylococcus aureus subsp. aureus Mu50
auaauagaaauaa

SEQ ID NO: 3990215 - RNA, 16 nt, Staphylococcus aureus subsp. aureus Mu50
auaauagacuuauauu

SEQ ID NO: 3990216 - RNA, 16 nt, Staphylococcus aureus subsp. aureus Mu50
auaauagcaaaauuau

SEQ ID NO: 3990217 - RNA, 18 nt, Staphylococcus aureus subsp. aureus Mu50
auaauagcuugagcaucu

SEQ ID NO: 3990218 - RNA, 22 nt, Staphylococcus aureus subsp. aureus Mu50
auaauaggauaccacaucgcau

SEQ ID NO: 3990219 - RNA, 13 nt, Staphylococcus aureus subsp. aureus Mu50
auaauauaaaaac

SEQ ID NO: 3990220 - RNA, 14 nt, Staphylococcus aureus subsp. aureus Mu50
auaauuaaauaacu

SEQ ID NO: 3990221 - RNA, 14 nt, Staphylococcus aureus subsp. aureus Mu50
auaauuaaauauaa

SEQ ID NO: 3990222 - RNA, 16 nt, Staphylococcus aureus subsp. aureus Mu50
auaauuaaauauaaag

SEQ ID NO: 3990223 - RNA, 14 nt, Staphylococcus aureus subsp. aureus Mu50
auaauuaacacauu

SEQ ID NO: 3990224 - RNA, 13 nt, Staphylococcus aureus subsp. aureus Mu50
auaauuaauaaca

SEQ ID NO: 3990225 - RNA, 13 nt, Staphylococcus aureus subsp. aureus Mu50
auaauuaauguuu

SEQ ID NO: 3990226 - RNA, 18 nt, Staphylococcus aureus subsp. aureus Mu50
auaauuaauuaaaauucu

SEQ ID NO: 3990227 - RNA, 19 nt, Staphylococcus aureus subsp. aureus Mu50
auaauuaauuuuguaauua

SEQ ID NO: 3990228 - RNA, 21 nt, Staphylococcus aureus subsp. aureus Mu50
auaauuaccuuuccauucgua

SEQ ID NO: 3990229 - RNA, 23 nt, Staphylococcus aureus subsp. aureus Mu50
auaauuaccuuuccauucguaua

SEQ ID NO: 3990230 - RNA, 21 nt, Staphylococcus aureus subsp. aureus Mu50
auaauuagauuuaaaauguca

SEQ ID NO: 3990231 - RNA, 22 nt, Staphylococcus aureus subsp. aureus Mu50
auaauuaggauuaacauaacua

SEQ ID NO: 3990232 - RNA, 12 nt, Staphylococcus aureus subsp. aureus Mu50
auaauuaucaua

SEQ ID NO: 3990233 - RNA, 16 nt, Staphylococcus aureus subsp. aureus Mu50
auaauuaugaaaagua

SEQ ID NO: 3990234 - RNA, 14 nt, Staphylococcus aureus subsp. aureus Mu50
auaauuauuaauuu

SEQ ID NO: 3990235 - RNA, 13 nt, Staphylococcus aureus subsp. aureus Mu50
auaauucaacuua

SEQ ID NO: 3990236 - RNA, 16 nt, Staphylococcus aureus subsp. aureus Mu50
auaauucaacuuaaau

SEQ ID NO: 3990237 - RNA, 17 nt, Staphylococcus aureus subsp. aureus Mu50
auaauucagaugaauaa

SEQ ID NO: 3990238 - RNA, 21 nt, Staphylococcus aureus subsp. aureus Mu50
auaauucaguguuacuauaca

SEQ ID NO: 3990239 - RNA, 13 nt, Staphylococcus aureus subsp. aureus Mu50
auaauucaucuug

SEQ ID NO: 3990240 - RNA, 20 nt, Staphylococcus aureus subsp. aureus Mu50
auaauuccugauacaaugau

SEQ ID NO: 3990241 - RNA, 17 nt, Staphylococcus aureus subsp. aureus Mu50
auaauucuucaaauuua

SEQ ID NO: 3990242 - RNA, 12 nt, Staphylococcus aureus subsp. aureus Mu50
auaauugaaaau

SEQ ID NO: 3990243 - RNA, 16 nt, Staphylococcus aureus subsp. aureus Mu50
auaauugaaaaucuaa

SEQ ID NO: 3990244 - RNA, 18 nt, Staphylococcus aureus subsp. aureus Mu50
auaauugauaauggauua

SEQ ID NO: 3990245 - RNA, 23 nt, Staphylococcus aureus subsp. aureus Mu50
auaauugauugucauauaaaaca

SEQ ID NO: 3990246 - RNA, 15 nt, Staphylococcus aureus subsp. aureus Mu50
auaauugcauuacua

SEQ ID NO: 3990247 - RNA, 16 nt, Staphylococcus aureus subsp. aureus Mu50
auaauugcuuuagaaa

SEQ ID NO: 3990248 - RNA, 18 nt, Staphylococcus aureus subsp. aureus Mu50
auaauuggaaucaucuuu

SEQ ID NO: 3990249 - RNA, 22 nt, Staphylococcus aureus subsp. aureus Mu50
auaauuggcugaugaacuucua

SEQ ID NO: 3990250 - RNA, 16 nt, Staphylococcus aureus subsp. aureus Mu50
auaauuguucuucaga

SEQ ID NO: 3990251 - RNA, 14 nt, Staphylococcus aureus subsp. aureus Mu50
auaauuuaaaagau

SEQ ID NO: 3990252 - RNA, 22 nt, Staphylococcus aureus subsp. aureus Mu50
auaauuuaaagaacuauuuuaa

SEQ ID NO: 3990253 - RNA, 19 nt, Staphylococcus aureus subsp. aureus Mu50
auaauuuaaaggcauaaua

SEQ ID NO: 3990254 - RNA, 20 nt, Staphylococcus aureus subsp. aureus Mu50
auaauuuaaaggcauaauaa

SEQ ID NO: 3990255 - RNA, 23 nt, Staphylococcus aureus subsp. aureus Mu50
auaauuuaaaggcauaauaacca

SEQ ID NO: 3990256 - RNA, 15 nt, Staphylococcus aureus subsp. aureus Mu50
auaauuuaauaaugu

SEQ ID NO: 3990257 - RNA, 17 nt, Staphylococcus aureus subsp. aureus Mu50
auaauuuaauaauguac

SEQ ID NO: 3990258 - RNA, 18 nt, Staphylococcus aureus subsp. aureus Mu50
auaauuuaauaauguaca

SEQ ID NO: 3990259 - RNA, 16 nt, Staphylococcus aureus subsp. aureus Mu50
auaauuuaauauuuag

SEQ ID NO: 3990260 - RNA, 13 nt, Staphylococcus aureus subsp. aureus Mu50
auaauuuacauua

SEQ ID NO: 3990261 - RNA, 12 nt, Staphylococcus aureus subsp. aureus Mu50
auaauuuaucuu

SEQ ID NO: 3990262 - RNA, 17 nt, Staphylococcus aureus subsp. aureus Mu50
auaauuuaucuuaauca

SEQ ID NO: 3990263 - RNA, 16 nt, Staphylococcus aureus subsp. aureus Mu50
auaauuuauugauaag

SEQ ID NO: 3990264 - RNA, 22 nt, Staphylococcus aureus subsp. aureus Mu50
auaauuuauuuagcaucuuuac

SEQ ID NO: 3990265 - RNA, 15 nt, Staphylococcus aureus subsp. aureus Mu50
auaauuuccuaaaaa

SEQ ID NO: 3990266 - RNA, 23 nt, Staphylococcus aureus subsp. aureus Mu50
auaauuugaauauggaaaaugua

SEQ ID NO: 3990267 - RNA, 19 nt, Staphylococcus aureus subsp. aureus Mu50
auaauuugguuaauacguu

SEQ ID NO: 3990268 - RNA, 16 nt, Staphylococcus aureus subsp. aureus Mu50
auaauuugugugcgau

SEQ ID NO: 3990269 - RNA, 18 nt, Staphylococcus aureus subsp. aureus Mu50
auaauuuuaaaaauaaaa

SEQ ID NO: 3990270 - RNA, 16 nt, Staphylococcus aureus subsp. aureus Mu50
auaauuuuaauauuau

SEQ ID NO: 3990271 - RNA, 18 nt, Staphylococcus aureus subsp. aureus Mu50
auaauuuuaauauuaugu

SEQ ID NO: 3990272 - RNA, 20 nt, Staphylococcus aureus subsp. aureus Mu50
auaauuuuccaucuauccga

SEQ ID NO: 3990273 - RNA, 20 nt, Staphylococcus aureus subsp. aureus Mu50
auaauuuucuguccaaaaag

SEQ ID NO: 3990274 - RNA, 23 nt, Staphylococcus aureus subsp. aureus Mu50
auaauuuucuguccaaaaagguu

SEQ ID NO: 3990275 - RNA, 22 nt, Staphylococcus aureus subsp. aureus Mu50
auaauuuuuaacagcgugaaua

SEQ ID NO: 3990276 - RNA, 22 nt, Staphylococcus aureus subsp. aureus Mu50
auaauuuuuauuuacacacaug

SEQ ID NO: 3990277 - RNA, 19 nt, Staphylococcus aureus subsp. aureus Mu50
auacaaaacaccucgauau

SEQ ID NO: 3990278 - RNA, 20 nt, Staphylococcus aureus subsp. aureus Mu50
auacaaacccuuuaaacaua

SEQ ID NO: 3990279 - RNA, 23 nt, Staphylococcus aureus subsp. aureus Mu50
auacaaacccuuuaaacauauuu

SEQ ID NO: 3990280 - RNA, 23 nt, Staphylococcus aureus subsp. aureus Mu50
auacaaaucguaaacauaaugac

SEQ ID NO: 3990281 - RNA, 17 nt, Staphylococcus aureus subsp. aureus Mu50
auacaaauuuuuuuuau

SEQ ID NO: 3990282 - RNA, 17 nt, Staphylococcus aureus subsp. aureus Mu50
auacaacucguuuuucc

SEQ ID NO: 3990283 - RNA, 18 nt, Staphylococcus aureus subsp. aureus Mu50
auacaagcaauacgauug

SEQ ID NO: 3990284 - RNA, 15 nt, Staphylococcus aureus subsp. aureus Mu50
auacaagucuuuacu

SEQ ID NO: 3990285 - RNA, 20 nt, Staphylococcus aureus subsp. aureus Mu50
auacaauuauggauaaaauu

SEQ ID NO: 3990286 - RNA, 21 nt, Staphylococcus aureus subsp. aureus Mu50
auacaauuucuucauuuucau

SEQ ID NO: 3990287 - RNA, 15 nt, Staphylococcus aureus subsp. aureus Mu50
auacacaaauuuuuu

SEQ ID NO: 3990288 - RNA, 23 nt, Staphylococcus aureus subsp. aureus Mu50
auacacaaauuuuuuguaaacau

SEQ ID NO: 3990289 - RNA, 17 nt, Staphylococcus aureus subsp. aureus Mu50
auacacagauuacucug

SEQ ID NO: 3990290 - RNA, 21 nt, Staphylococcus aureus subsp. aureus Mu50
auacacgacgcuaaacaaagg

SEQ ID NO: 3990291 - RNA, 22 nt, Staphylococcus aureus subsp. aureus Mu50
auacacugcacaucauaauaaa

SEQ ID NO: 3990292 - RNA, 15 nt, Staphylococcus aureus subsp. aureus Mu50
auacacuuacaaaua

SEQ ID NO: 3990293 - RNA, 18 nt, Staphylococcus aureus subsp. aureus Mu50
auacacuugauaaaacua

SEQ ID NO: 3990294 - RNA, 19 nt, Staphylococcus aureus subsp. aureus Mu50
auacacuugauaaaacuaa

SEQ ID NO: 3990295 - RNA, 20 nt, Staphylococcus aureus subsp. aureus Mu50
auacacuuuuugacauauuu

SEQ ID NO: 3990296 - RNA, 18 nt, Staphylococcus aureus subsp. aureus Mu50
auacagaaccaacaauaa

SEQ ID NO: 3990297 - RNA, 22 nt, Staphylococcus aureus subsp. aureus Mu50
auacagaaccaacaauaaaucu

SEQ ID NO: 3990298 - RNA, 19 nt, Staphylococcus aureus subsp. aureus Mu50
auacagaucucaauccaau

SEQ ID NO: 3990299 - RNA, 15 nt, Staphylococcus aureus subsp. aureus Mu50
auacagaugaugcuu

SEQ ID NO: 3990300 - RNA, 18 nt, Staphylococcus aureus subsp. aureus Mu50
auacagucaauacaaaga

SEQ ID NO: 3990301 - RNA, 23 nt, Staphylococcus aureus subsp. aureus Mu50
auacagucaauacaaagaauuau

SEQ ID NO: 3990302 - RNA, 13 nt, Staphylococcus aureus subsp. aureus Mu50
auacauaaauauu

SEQ ID NO: 3990303 - RNA, 19 nt, Staphylococcus aureus subsp. aureus Mu50
auacauaccacacuuuaaa

SEQ ID NO: 3990304 - RNA, 12 nt, Staphylococcus aureus subsp. aureus Mu50
auacauacugau

SEQ ID NO: 3990305 - RNA, 22 nt, Staphylococcus aureus subsp. aureus Mu50
auacauagguucaucuuuaugc

SEQ ID NO: 3990306 - RNA, 14 nt, Staphylococcus aureus subsp. aureus Mu50
auacauauaagaau

SEQ ID NO: 3990307 - RNA, 12 nt, Staphylococcus aureus subsp. aureus Mu50
auacuaaaacau

SEQ ID NO: 3990308 - RNA, 13 nt, Staphylococcus aureus subsp. aureus Mu50
auacuaaaacaug

SEQ ID NO: 3990309 - RNA, 21 nt, Staphylococcus aureus subsp. aureus Mu50
auacuaaaaguguuaugaauu

SEQ ID NO: 3990310 - RNA, 13 nt, Staphylococcus aureus subsp. aureus Mu50
auacuaaauugag

SEQ ID NO: 3990311 - RNA, 16 nt, Staphylococcus aureus subsp. aureus Mu50
auacuaaauugagaag

SEQ ID NO: 3990312 - RNA, 19 nt, Staphylococcus aureus subsp. aureus Mu50
auacuaauaucuucuuuau

SEQ ID NO: 3990313 - RNA, 22 nt, Staphylococcus aureus subsp. aureus Mu50
auacuaaucaaagaaaaaguga

SEQ ID NO: 3990314 - RNA, 22 nt, Staphylococcus aureus subsp. aureus Mu50
auacuaauuucuauagaaaaag

SEQ ID NO: 3990315 - RNA, 13 nt, Staphylococcus aureus subsp. aureus Mu50
auacuacauauaa

SEQ ID NO: 3990316 - RNA, 17 nt, Staphylococcus aureus subsp. aureus Mu50
auacuacauauaaugcc

SEQ ID NO: 3990317 - RNA, 16 nt, Staphylococcus aureus subsp. aureus Mu50
auacuaccuuccauuu

SEQ ID NO: 3990318 - RNA, 15 nt, Staphylococcus aureus subsp. aureus Mu50
auacuaguucaacuc

SEQ ID NO: 3990319 - RNA, 12 nt, Staphylococcus aureus subsp. aureus Mu50
auacuauaaaaa

SEQ ID NO: 3990320 - RNA, 13 nt, Staphylococcus aureus subsp. aureus Mu50
auacuauaaauac

SEQ ID NO: 3990321 - RNA, 13 nt, Staphylococcus aureus subsp. aureus Mu50
auacuauacugau

SEQ ID NO: 3990322 - RNA, 17 nt, Staphylococcus aureus subsp. aureus Mu50
auacuauaugaaaagag

SEQ ID NO: 3990323 - RNA, 16 nt, Staphylococcus aureus subsp. aureus Mu50
auacuauaugucuuau

SEQ ID NO: 3990324 - RNA, 21 nt, Staphylococcus aureus subsp. aureus Mu50
auacuauaugucuuaucaauu

SEQ ID NO: 3990325 - RNA, 15 nt, Staphylococcus aureus subsp. aureus Mu50
auacuaucuacaaua

SEQ ID NO: 3990326 - RNA, 19 nt, Staphylococcus aureus subsp. aureus Mu50
auacuaucugacauuuaaa

SEQ ID NO: 3990327 - RNA, 14 nt, Staphylococcus aureus subsp. aureus Mu50
auacuauuauucca

SEQ ID NO: 3990328 - RNA, 19 nt, Staphylococcus aureus subsp. aureus Mu50
auacucaucuguccgauau

SEQ ID NO: 3990329 - RNA, 21 nt, Staphylococcus aureus subsp. aureus Mu50
auacucaucuguccgauaucu

SEQ ID NO: 3990330 - RNA, 18 nt, Staphylococcus aureus subsp. aureus Mu50
auacucccgcauuauuau

SEQ ID NO: 3990331 - RNA, 14 nt, Staphylococcus aureus subsp. aureus Mu50
auacucuaaaaaag

SEQ ID NO: 3990332 - RNA, 17 nt, Staphylococcus aureus subsp. aureus Mu50
auacucugggcauuuug

SEQ ID NO: 3990333 - RNA, 14 nt, Staphylococcus aureus subsp. aureus Mu50
auacugaaauuuca

SEQ ID NO: 3990334 - RNA, 15 nt, Staphylococcus aureus subsp. aureus Mu50
auacugaauuuuaac

SEQ ID NO: 3990335 - RNA, 16 nt, Staphylococcus aureus subsp. aureus Mu50
auacugaauuuuaacu

SEQ ID NO: 3990336 - RNA, 16 nt, Staphylococcus aureus subsp. aureus Mu50
auacugauauuuagaa

SEQ ID NO: 3990337 - RNA, 22 nt, Staphylococcus aureus subsp. aureus Mu50
auacugaugaaaacuuaaaaau

SEQ ID NO: 3990338 - RNA, 16 nt, Staphylococcus aureus subsp. aureus Mu50
auacugccauauguuu

SEQ ID NO: 3990339 - RNA, 22 nt, Staphylococcus aureus subsp. aureus Mu50
auacugccccaaauguaagaac

SEQ ID NO: 3990340 - RNA, 22 nt, Staphylococcus aureus subsp. aureus Mu50
auacuggguuuuaccauaaauu

SEQ ID NO: 3990341 - RNA, 14 nt, Staphylococcus aureus subsp. aureus Mu50
auacuguuuaaaua

SEQ ID NO: 3990342 - RNA, 16 nt, Staphylococcus aureus subsp. aureus Mu50
auacuuaauauaguua

SEQ ID NO: 3990343 - RNA, 15 nt, Staphylococcus aureus subsp. aureus Mu50
auacuuaauuuaaau

SEQ ID NO: 3990344 - RNA, 17 nt, Staphylococcus aureus subsp. aureus Mu50
auacuuacugaaacuaa

SEQ ID NO: 3990345 - RNA, 19 nt, Staphylococcus aureus subsp. aureus Mu50
auacuucaaacguauguac

SEQ ID NO: 3990346 - RNA, 13 nt, Staphylococcus aureus subsp. aureus Mu50
auacuucaauaac

SEQ ID NO: 3990347 - RNA, 15 nt, Staphylococcus aureus subsp. aureus Mu50
auacuucaccaucuu

SEQ ID NO: 3990348 - RNA, 19 nt, Staphylococcus aureus subsp. aureus Mu50
auacuucaguacgguuauu

SEQ ID NO: 3990349 - RNA, 14 nt, Staphylococcus aureus subsp. aureus Mu50
auacuucaucugua

SEQ ID NO: 3990350 - RNA, 23 nt, Staphylococcus aureus subsp. aureus Mu50
auacuucuauuuuauaauaaauu

SEQ ID NO: 3990351 - RNA, 13 nt, Staphylococcus aureus subsp. aureus Mu50
auacuucuuguuc

SEQ ID NO: 3990352 - RNA, 21 nt, Staphylococcus aureus subsp. aureus Mu50
auacuucuuuugcaaaacgca

SEQ ID NO: 3990353 - RNA, 15 nt, Staphylococcus aureus subsp. aureus Mu50
auacuugaagaauca

SEQ ID NO: 3990354 - RNA, 17 nt, Staphylococcus aureus subsp. aureus Mu50
auacuugaagcaucgau

SEQ ID NO: 3990355 - RNA, 23 nt, Staphylococcus aureus subsp. aureus Mu50
auacuugaagcaucgauuuauua

SEQ ID NO: 3990356 - RNA, 18 nt, Staphylococcus aureus subsp. aureus Mu50
auacuugaugaaacugau

SEQ ID NO: 3990357 - RNA, 19 nt, Staphylococcus aureus subsp. aureus Mu50
auacuugaugaaacugauu

SEQ ID NO: 3990358 - RNA, 19 nt, Staphylococcus aureus subsp. aureus Mu50
auacuugccuucaaauucu

SEQ ID NO: 3990359 - RNA, 22 nt, Staphylococcus aureus subsp. aureus Mu50
auacuugcucuaauucaaugau

SEQ ID NO: 3990360 - RNA, 22 nt, Staphylococcus aureus subsp. aureus Mu50
auacuugucguauucuucaaua

SEQ ID NO: 3990361 - RNA, 14 nt, Staphylococcus aureus subsp. aureus Mu50
auacuuuuaccauu

SEQ ID NO: 3990362 - RNA, 14 nt, Staphylococcus aureus subsp. aureus Mu50
auacuuuucucgau

SEQ ID NO: 3990363 - RNA, 18 nt, Staphylococcus aureus subsp. aureus Mu50
auacuuuuggucuguuga

SEQ ID NO: 3990364 - RNA, 22 nt, Staphylococcus aureus subsp. aureus Mu50
auacuuuuggucuguugaaguc

SEQ ID NO: 3990365 - RNA, 13 nt, Staphylococcus aureus subsp. aureus Mu50
auacuuuuuaaau

SEQ ID NO: 3990366 - RNA, 21 nt, Staphylococcus aureus subsp. aureus Mu50
auagaaaaugaguacaacaua

SEQ ID NO: 3990367 - RNA, 17 nt, Staphylococcus aureus subsp. aureus Mu50
auagaaaauuaacucag

SEQ ID NO: 3990368 - RNA, 19 nt, Staphylococcus aureus subsp. aureus Mu50
auagaaagaaauuguuccu

SEQ ID NO: 3990369 - RNA, 23 nt, Staphylococcus aureus subsp. aureus Mu50
auagaaagugcgguuauuuauac

SEQ ID NO: 3990370 - RNA, 16 nt, Staphylococcus aureus subsp. aureus Mu50
auagaaauaaucacau

SEQ ID NO: 3990371 - RNA, 12 nt, Staphylococcus aureus subsp. aureus Mu50
auagaaaugaua

SEQ ID NO: 3990372 - RNA, 16 nt, Staphylococcus aureus subsp. aureus Mu50
auagaacgaaauaguu

SEQ ID NO: 3990373 - RNA, 20 nt, Staphylococcus aureus subsp. aureus Mu50
auagaagaacgaagaaugau

SEQ ID NO: 3990374 - RNA, 22 nt, Staphylococcus aureus subsp. aureus Mu50
auagaagaacgaagaaugauac

SEQ ID NO: 3990375 - RNA, 15 nt, Staphylococcus aureus subsp. aureus Mu50
auagaaguauggaug

SEQ ID NO: 3990376 - RNA, 23 nt, Staphylococcus aureus subsp. aureus Mu50
auagaaucuaaggccauuuguag

SEQ ID NO: 3990377 - RNA, 15 nt, Staphylococcus aureus subsp. aureus Mu50
auagaaugucgauau

SEQ ID NO: 3990378 - RNA, 12 nt, Staphylococcus aureus subsp. aureus Mu50
auagaauuuuuc

SEQ ID NO: 3990379 - RNA, 15 nt, Staphylococcus aureus subsp. aureus Mu50
auagacaccaaaaaa

SEQ ID NO: 3990380 - RNA, 13 nt, Staphylococcus aureus subsp. aureus Mu50
auagacaguaguu

SEQ ID NO: 3990381 - RNA, 13 nt, Staphylococcus aureus subsp. aureus Mu50
auagaccuaugaa

SEQ ID NO: 3990382 - RNA, 14 nt, Staphylococcus aureus subsp. aureus Mu50
auagaccuuuauuu

SEQ ID NO: 3990383 - RNA, 14 nt, Staphylococcus aureus subsp. aureus Mu50
auagacguuuuuau

SEQ ID NO: 3990384 - RNA, 22 nt, Staphylococcus aureus subsp. aureus Mu50
auagacuaauuaucuucaucau

SEQ ID NO: 3990385 - RNA, 16 nt, Staphylococcus aureus subsp. aureus Mu50
auagacugccaauaaa

SEQ ID NO: 3990386 - RNA, 15 nt, Staphylococcus aureus subsp. aureus Mu50
auagagaaagaauaa

SEQ ID NO: 3990387 - RNA, 16 nt, Staphylococcus aureus subsp. aureus Mu50
auagagaaagaauaaa

SEQ ID NO: 3990388 - RNA, 14 nt, Staphylococcus aureus subsp. aureus Mu50
auagagaacagcag

SEQ ID NO: 3990389 - RNA, 17 nt, Staphylococcus aureus subsp. aureus Mu50
auagagaacuugcuuug

SEQ ID NO: 3990390 - RNA, 14 nt, Staphylococcus aureus subsp. aureus Mu50
auagagacauuuua

SEQ ID NO: 3990391 - RNA, 17 nt, Staphylococcus aureus subsp. aureus Mu50
auagaggcacaguggau

SEQ ID NO: 3990392 - RNA, 19 nt, Staphylococcus aureus subsp. aureus Mu50
auagauagaaauugugcuu

SEQ ID NO: 3990393 - RNA, 22 nt, Staphylococcus aureus subsp. aureus Mu50
auagauagacuuucuugaugaa

SEQ ID NO: 3990394 - RNA, 15 nt, Staphylococcus aureus subsp. aureus Mu50
auagauaucauuuua

SEQ ID NO: 3990395 - RNA, 18 nt, Staphylococcus aureus subsp. aureus Mu50
auauaaaaacaaaagaaa

SEQ ID NO: 3990396 - RNA, 21 nt, Staphylococcus aureus subsp. aureus Mu50
auauaaaaagaagaucccuca

SEQ ID NO: 3990397 - RNA, 22 nt, Staphylococcus aureus subsp. aureus Mu50
auauaaaaagucccgcuuaaaa

SEQ ID NO: 3990398 - RNA, 15 nt, Staphylococcus aureus subsp. aureus Mu50
auauaaaaagugaaa

SEQ ID NO: 3990399 - RNA, 19 nt, Staphylococcus aureus subsp. aureus Mu50
auauaaaacggacaaguuu

SEQ ID NO: 3990400 - RNA, 16 nt, Staphylococcus aureus subsp. aureus Mu50
auauaaaaucauuaau

SEQ ID NO: 3990401 - RNA, 20 nt, Staphylococcus aureus subsp. aureus Mu50
auauaaaaucauuaauaauu

SEQ ID NO: 3990402 - RNA, 22 nt, Staphylococcus aureus subsp. aureus Mu50
auauaaagaaauaauuuaaagg

SEQ ID NO: 3990403 - RNA, 21 nt, Staphylococcus aureus subsp. aureus Mu50
auauaaagcugcgauauaacu

SEQ ID NO: 3990404 - RNA, 14 nt, Staphylococcus aureus subsp. aureus Mu50
auauaaagcuuuga

SEQ ID NO: 3990405 - RNA, 17 nt, Staphylococcus aureus subsp. aureus Mu50
auauaaaggaauagcua

SEQ ID NO: 3990406 - RNA, 14 nt, Staphylococcus aureus subsp. aureus Mu50
auauaaauaggcag

SEQ ID NO: 3990407 - RNA, 15 nt, Staphylococcus aureus subsp. aureus Mu50
auauaaauaugguuu

SEQ ID NO: 3990408 - RNA, 14 nt, Staphylococcus aureus subsp. aureus Mu50
auauaaaucauuuc

SEQ ID NO: 3990409 - RNA, 17 nt, Staphylococcus aureus subsp. aureus Mu50
auauaaauuaucagaau

SEQ ID NO: 3990410 - RNA, 18 nt, Staphylococcus aureus subsp. aureus Mu50
auauaaauuaucagaauc

SEQ ID NO: 3990411 - RNA, 16 nt, Staphylococcus aureus subsp. aureus Mu50
auauaaccuauuucau

SEQ ID NO: 3990412 - RNA, 15 nt, Staphylococcus aureus subsp. aureus Mu50
auauaacgacacuuu

SEQ ID NO: 3990413 - RNA, 18 nt, Staphylococcus aureus subsp. aureus Mu50
auauaacgacacuuuuua

SEQ ID NO: 3990414 - RNA, 21 nt, Staphylococcus aureus subsp. aureus Mu50
auauaacuauggucaucaauu

SEQ ID NO: 3990415 - RNA, 22 nt, Staphylococcus aureus subsp. aureus Mu50
auauaacuucuauuaagaaaua

SEQ ID NO: 3990416 - RNA, 23 nt, Staphylococcus aureus subsp. aureus Mu50
auauaacuucuauuaagaaauac

SEQ ID NO: 3990417 - RNA, 18 nt, Staphylococcus aureus subsp. aureus Mu50
auauaagaaauccaccua

SEQ ID NO: 3990418 - RNA, 19 nt, Staphylococcus aureus subsp. aureus Mu50
auauaagauucauauuuau

SEQ ID NO: 3990419 - RNA, 15 nt, Staphylococcus aureus subsp. aureus Mu50
auauaaggaaaagga

SEQ ID NO: 3990420 - RNA, 14 nt, Staphylococcus aureus subsp. aureus Mu50
auauaauagaaaua

SEQ ID NO: 3990421 - RNA, 17 nt, Staphylococcus aureus subsp. aureus Mu50
auauaauauacacaaaa

SEQ ID NO: 3990422 - RNA, 21 nt, Staphylococcus aureus subsp. aureus Mu50
auauaaugcugauaauuuuuc

SEQ ID NO: 3990423 - RNA, 22 nt, Staphylococcus aureus subsp. aureus Mu50
auauaaugcugauaauuuuucu

SEQ ID NO: 3990424 - RNA, 19 nt, Staphylococcus aureus subsp. aureus Mu50
auauaauggcacugcaauc

SEQ ID NO: 3990425 - RNA, 14 nt, Staphylococcus aureus subsp. aureus Mu50
auauaaugguugaa

SEQ ID NO: 3990426 - RNA, 21 nt, Staphylococcus aureus subsp. aureus Mu50
auauaaugguugaauaacacu

SEQ ID NO: 3990427 - RNA, 17 nt, Staphylococcus aureus subsp. aureus Mu50
auauaauuaauuuugua

SEQ ID NO: 3990428 - RNA, 15 nt, Staphylococcus aureus subsp. aureus Mu50
auauaauuauuaaac

SEQ ID NO: 3990429 - RNA, 23 nt, Staphylococcus aureus subsp. aureus Mu50
auauaauucgucuguuucauaua

SEQ ID NO: 3990430 - RNA, 14 nt, Staphylococcus aureus subsp. aureus Mu50
auauaauuuaaaga

SEQ ID NO: 3990431 - RNA, 13 nt, Staphylococcus aureus subsp. aureus Mu50
auauaauuuauuu

SEQ ID NO: 3990432 - RNA, 14 nt, Staphylococcus aureus subsp. aureus Mu50
auauaauuuauuua

SEQ ID NO: 3990433 - RNA, 22 nt, Staphylococcus aureus subsp. aureus Mu50
auauaauuuauuuagcaucuuu

SEQ ID NO: 3990434 - RNA, 18 nt, Staphylococcus aureus subsp. aureus Mu50
auauaauuugguuaauac

SEQ ID NO: 3990435 - RNA, 14 nt, Staphylococcus aureus subsp. aureus Mu50
auauaauuuuuuga

SEQ ID NO: 3990436 - RNA, 14 nt, Staphylococcus aureus subsp. aureus Mu50
auauacaaugacag

SEQ ID NO: 3990437 - RNA, 13 nt, Staphylococcus aureus subsp. aureus Mu50
auauaccaaccaa

SEQ ID NO: 3990438 - RNA, 14 nt, Staphylococcus aureus subsp. aureus Mu50
auauaccaaccaaa

SEQ ID NO: 3990439 - RNA, 21 nt, Staphylococcus aureus subsp. aureus Mu50
auauacccagaugaauuuuua

SEQ ID NO: 3990440 - RNA, 19 nt, Staphylococcus aureus subsp. aureus Mu50
auauaccuugauucauuuc

SEQ ID NO: 3990441 - RNA, 16 nt, Staphylococcus aureus subsp. aureus Mu50
auauacgacaaucaca

SEQ ID NO: 3990442 - RNA, 12 nt, Staphylococcus aureus subsp. aureus Mu50
auauacgacauu

SEQ ID NO: 3990443 - RNA, 22 nt, Staphylococcus aureus subsp. aureus Mu50
auauacgauugaguugaaaaua

SEQ ID NO: 3990444 - RNA, 17 nt, Staphylococcus aureus subsp. aureus Mu50
auauacuaaauuugaaa

SEQ ID NO: 3990445 - RNA, 13 nt, Staphylococcus aureus subsp. aureus Mu50
auauacuuaauuu

SEQ ID NO: 3990446 - RNA, 16 nt, Staphylococcus aureus subsp. aureus Mu50
auauacuuaauuuaaa

SEQ ID NO: 3990447 - RNA, 18 nt, Staphylococcus aureus subsp. aureus Mu50
auauacuugccuucaaau

SEQ ID NO: 3990448 - RNA, 23 nt, Staphylococcus aureus subsp. aureus Mu50
auauagaaaaugaguacaacaua

SEQ ID NO: 3990449 - RNA, 22 nt, Staphylococcus aureus subsp. aureus Mu50
auauagacaguaguuaauugaa

SEQ ID NO: 3990450 - RNA, 22 nt, Staphylococcus aureus subsp. aureus Mu50
auauagaguaguucggaugaga

SEQ ID NO: 3990451 - RNA, 17 nt, Staphylococcus aureus subsp. aureus Mu50
auauagauggcuuuuuu

SEQ ID NO: 3990452 - RNA, 22 nt, Staphylococcus aureus subsp. aureus Mu50
auauagauggcuuuuuuugcug

SEQ ID NO: 3990453 - RNA, 21 nt, Staphylococcus aureus subsp. aureus Mu50
auauagauugccauucauaca

SEQ ID NO: 3990454 - RNA, 21 nt, Staphylococcus aureus subsp. aureus Mu50
auauagcgcgcuuauugaaaa

SEQ ID NO: 3990455 - RNA, 18 nt, Staphylococcus aureus subsp. aureus Mu50
auauagcggugucaauau

SEQ ID NO: 3990456 - RNA, 14 nt, Staphylococcus aureus subsp. aureus Mu50
auauagcugugauu

SEQ ID NO: 3990457 - RNA, 14 nt, Staphylococcus aureus subsp. aureus Mu50
auauaguaaaauaa

SEQ ID NO: 3990458 - RNA, 19 nt, Staphylococcus aureus subsp. aureus Mu50
auauaguaaaauaaauaca

SEQ ID NO: 3990459 - RNA, 21 nt, Staphylococcus aureus subsp. aureus Mu50
auauaguaggguauugaaaua

SEQ ID NO: 3990460 - RNA, 14 nt, Staphylococcus aureus subsp. aureus Mu50
auauagucaaugaa

SEQ ID NO: 3990461 - RNA, 19 nt, Staphylococcus aureus subsp. aureus Mu50
auauagucaaugaauaaug

SEQ ID NO: 3990462 - RNA, 19 nt, Staphylococcus aureus subsp. aureus Mu50
auauaguggugguacuuuu

SEQ ID NO: 3990463 - RNA, 22 nt, Staphylococcus aureus subsp. aureus Mu50
auauaguggugguacuuuuuug

SEQ ID NO: 3990464 - RNA, 22 nt, Staphylococcus aureus subsp. aureus Mu50
auauaguuaauguaaucauuau

SEQ ID NO: 3990465 - RNA, 14 nt, Staphylococcus aureus subsp. aureus Mu50
auauaguuauaugu

SEQ ID NO: 3990466 - RNA, 14 nt, Staphylococcus aureus subsp. aureus Mu50
auauaguuggcaau

SEQ ID NO: 3990467 - RNA, 19 nt, Staphylococcus aureus subsp. aureus Mu50
auauauaaaaucauuaaua

SEQ ID NO: 3990468 - RNA, 13 nt, Staphylococcus aureus subsp. aureus Mu50
auauauaaagaaa

SEQ ID NO: 3990469 - RNA, 16 nt, Staphylococcus aureus subsp. aureus Mu50
auauauaaagaaauaa

SEQ ID NO: 3990470 - RNA, 19 nt, Staphylococcus aureus subsp. aureus Mu50
auauauaaagaaauaauuu

SEQ ID NO: 3990471 - RNA, 16 nt, Staphylococcus aureus subsp. aureus Mu50
auauauaacaaguaca

SEQ ID NO: 3990472 - RNA, 13 nt, Staphylococcus aureus subsp. aureus Mu50
auauauaaccaua

SEQ ID NO: 3990473 - RNA, 15 nt, Staphylococcus aureus subsp. aureus Mu50
auauauaaugaaggu

SEQ ID NO: 3990474 - RNA, 19 nt, Staphylococcus aureus subsp. aureus Mu50
auauauagauuaaaccgca

SEQ ID NO: 3990475 - RNA, 11 nt, Staphylococcus aureus subsp. aureus Mu50
auauauauucg

SEQ ID NO: 3990476 - RNA, 12 nt, Staphylococcus aureus subsp. aureus Mu50
auauaucaaaua

SEQ ID NO: 3990477 - RNA, 16 nt, Staphylococcus aureus subsp. aureus Mu50
auauaucaaauacauu

SEQ ID NO: 3990478 - RNA, 20 nt, Staphylococcus aureus subsp. aureus Mu50
auauaucaacguuaauauaa

SEQ ID NO: 3990479 - RNA, 21 nt, Staphylococcus aureus subsp. aureus Mu50
auauaucacaacacauaaauu

SEQ ID NO: 3990480 - RNA, 21 nt, Staphylococcus aureus subsp. aureus Mu50
auauauccugccaauauauuc

SEQ ID NO: 3990481 - RNA, 17 nt, Staphylococcus aureus subsp. aureus Mu50
auauaugaaauauuuau

SEQ ID NO: 3990482 - RNA, 17 nt, Staphylococcus aureus subsp. aureus Mu50
auaucuuuuccaaaaca

SEQ ID NO: 3990483 - RNA, 15 nt, Staphylococcus aureus subsp. aureus Mu50
auaucuuuuuuuuua

SEQ ID NO: 3990484 - RNA, 11 nt, Staphylococcus aureus subsp. aureus Mu50
auaugaaaugu

SEQ ID NO: 3990485 - RNA, 23 nt, Staphylococcus aureus subsp. aureus Mu50
auaugaagcguuuuuauuacaaa

SEQ ID NO: 3990486 - RNA, 20 nt, Staphylococcus aureus subsp. aureus Mu50
auaugaaucuagaauauaac

SEQ ID NO: 3990487 - RNA, 20 nt, Staphylococcus aureus subsp. aureus Mu50
auaugaauuuagaugcauaa

SEQ ID NO: 3990488 - RNA, 23 nt, Staphylococcus aureus subsp. aureus Mu50
auaugaauuuagaugcauaaaaa

SEQ ID NO: 3990489 - RNA, 21 nt, Staphylococcus aureus subsp. aureus Mu50
auaugacgcgugaauuaaaaa

SEQ ID NO: 3990490 - RNA, 17 nt, Staphylococcus aureus subsp. aureus Mu50
auaugacuuuauuucua

SEQ ID NO: 3990491 - RNA, 20 nt, Staphylococcus aureus subsp. aureus Mu50
auaugacuuuuuauuaguau

SEQ ID NO: 3990492 - RNA, 16 nt, Staphylococcus aureus subsp. aureus Mu50
auaugagguucaguag

SEQ ID NO: 3990493 - RNA, 12 nt, Staphylococcus aureus subsp. aureus Mu50
auaugauaacca

SEQ ID NO: 3990494 - RNA, 17 nt, Staphylococcus aureus subsp. aureus Mu50
auaugauaaccaaacca

SEQ ID NO: 3990495 - RNA, 14 nt, Staphylococcus aureus subsp. aureus Mu50
auaugauauuaagu

SEQ ID NO: 3990496 - RNA, 19 nt, Staphylococcus aureus subsp. aureus Mu50
auaugauccuuuaaugcuu

SEQ ID NO: 3990497 - RNA, 17 nt, Staphylococcus aureus subsp. aureus Mu50
auaugauguuaaaaaau

SEQ ID NO: 3990498 - RNA, 16 nt, Staphylococcus aureus subsp. aureus Mu50
auaugauuaaagcgau

SEQ ID NO: 3990499 - RNA, 15 nt, Staphylococcus aureus subsp. aureus Mu50
auaugauugaaugaa

SEQ ID NO: 3990500 - RNA, 17 nt, Staphylococcus aureus subsp. aureus Mu50
auaugauugcaaauuau

SEQ ID NO: 3990501 - RNA, 21 nt, Staphylococcus aureus subsp. aureus Mu50
auaugcaacuuauaauauuaa

SEQ ID NO: 3990502 - RNA, 21 nt, Staphylococcus aureus subsp. aureus Mu50
auaugcaaugcaccuauaaua

SEQ ID NO: 3990503 - RNA, 13 nt, Staphylococcus aureus subsp. aureus Mu50
auaugcaucaaca

SEQ ID NO: 3990504 - RNA, 16 nt, Staphylococcus aureus subsp. aureus Mu50
auaugcaucaacagau

SEQ ID NO: 3990505 - RNA, 22 nt, Staphylococcus aureus subsp. aureus Mu50
auaugccgauugcucuaaucca

SEQ ID NO: 3990506 - RNA, 19 nt, Staphylococcus aureus subsp. aureus Mu50
auaugcguagcaacauuau

SEQ ID NO: 3990507 - RNA, 21 nt, Staphylococcus aureus subsp. aureus Mu50
auaugcguagcaacauuauuu

SEQ ID NO: 3990508 - RNA, 20 nt, Staphylococcus aureus subsp. aureus Mu50
auaugcuauauuuaguuaau

SEQ ID NO: 3990509 - RNA, 18 nt, Staphylococcus aureus subsp. aureus Mu50
auaugcucucuucaaagu

SEQ ID NO: 3990510 - RNA, 23 nt, Staphylococcus aureus subsp. aureus Mu50
auaugcuguuggcaaaacaauau

SEQ ID NO: 3990511 - RNA, 21 nt, Staphylococcus aureus subsp. aureus Mu50
auaugcuuguugugaauaaaa

SEQ ID NO: 3990512 - RNA, 23 nt, Staphylococcus aureus subsp. aureus Mu50
auaugcuuguugugaauaaaauu

SEQ ID NO: 3990513 - RNA, 22 nt, Staphylococcus aureus subsp. aureus Mu50
auaugcuuuaggugaguuucca

SEQ ID NO: 3990514 - RNA, 13 nt, Staphylococcus aureus subsp. aureus Mu50
auauggaauacua

SEQ ID NO: 3990515 - RNA, 16 nt, Staphylococcus aureus subsp. aureus Mu50
auauggaauacuacac

SEQ ID NO: 3990516 - RNA, 16 nt, Staphylococcus aureus subsp. aureus Mu50
auaugguuagagaaaa

SEQ ID NO: 3990517 - RNA, 15 nt, Staphylococcus aureus subsp. aureus Mu50
auaugguucguccau

SEQ ID NO: 3990518 - RNA, 18 nt, Staphylococcus aureus subsp. aureus Mu50
auaugguuguuuuccaau

SEQ ID NO: 3990519 - RNA, 12 nt, Staphylococcus aureus subsp. aureus Mu50
auauguaaauga

SEQ ID NO: 3990520 - RNA, 13 nt, Staphylococcus aureus subsp. aureus Mu50
auauguaaucaga

SEQ ID NO: 3990521 - RNA, 22 nt, Staphylococcus aureus subsp. aureus Mu50
auauguaaucagaguagaaagu

SEQ ID NO: 3990522 - RNA, 15 nt, Staphylococcus aureus subsp. aureus Mu50
auauguacuauuauc

SEQ ID NO: 3990523 - RNA, 20 nt, Staphylococcus aureus subsp. aureus Mu50
auauguauguuuuaucaaua

SEQ ID NO: 3990524 - RNA, 21 nt, Staphylococcus aureus subsp. aureus Mu50
auaugucucucuuucuuauuc

SEQ ID NO: 3990525 - RNA, 12 nt, Staphylococcus aureus subsp. aureus Mu50
auaugugagcaa

SEQ ID NO: 3990526 - RNA, 22 nt, Staphylococcus aureus subsp. aureus Mu50
auaugugcuuuuguaaauuaca

SEQ ID NO: 3990527 - RNA, 22 nt, Staphylococcus aureus subsp. aureus Mu50
auauguggcgcucuuauaaaga

SEQ ID NO: 3990528 - RNA, 19 nt, Staphylococcus aureus subsp. aureus Mu50
auauguguaugauagaaua

SEQ ID NO: 3990529 - RNA, 16 nt, Staphylococcus aureus subsp. aureus Mu50
auauguguuaacugau

SEQ ID NO: 3990530 - RNA, 17 nt, Staphylococcus aureus subsp. aureus Mu50
auauguguuucuagcuu

SEQ ID NO: 3990531 - RNA, 15 nt, Staphylococcus aureus subsp. aureus Mu50
auauguuuccucuuu

SEQ ID NO: 3990532 - RNA, 16 nt, Staphylococcus aureus subsp. aureus Mu50
auauguuuccucuuua

SEQ ID NO: 3990533 - RNA, 19 nt, Staphylococcus aureus subsp. aureus Mu50
auauguuuggauaucuuug

SEQ ID NO: 3990534 - RNA, 22 nt, Staphylococcus aureus subsp. aureus Mu50
auauguuuuauaauaaauguca

SEQ ID NO: 3990535 - RNA, 16 nt, Staphylococcus aureus subsp. aureus Mu50
auauguuuuaugauuu

SEQ ID NO: 3990536 - RNA, 21 nt, Staphylococcus aureus subsp. aureus Mu50
auauguuuuaugauuuucuuu

SEQ ID NO: 3990537 - RNA, 20 nt, Staphylococcus aureus subsp. aureus Mu50
auauguuuuuauuauacacu

SEQ ID NO: 3990538 - RNA, 14 nt, Staphylococcus aureus subsp. aureus Mu50
auauuaaaaauuuc

SEQ ID NO: 3990539 - RNA, 16 nt, Staphylococcus aureus subsp. aureus Mu50
auauuaaaaauuucaa

SEQ ID NO: 3990540 - RNA, 18 nt, Staphylococcus aureus subsp. aureus Mu50
auauuaaaaauuucaaua

SEQ ID NO: 3990541 - RNA, 20 nt, Staphylococcus aureus subsp. aureus Mu50
auauuaaaacaaugaggauu

SEQ ID NO: 3990542 - RNA, 17 nt, Staphylococcus aureus subsp. aureus Mu50
auauuaaaauuaaaacu

SEQ ID NO: 3990543 - RNA, 13 nt, Staphylococcus aureus subsp. aureus Mu50
auauuaaauuucu

SEQ ID NO: 3990544 - RNA, 17 nt, Staphylococcus aureus subsp. aureus Mu50
auauuaaggucauuuuu

SEQ ID NO: 3990545 - RNA, 18 nt, Staphylococcus aureus subsp. aureus Mu50
auauuaaggucauuuuua

SEQ ID NO: 3990546 - RNA, 19 nt, Staphylococcus aureus subsp. aureus Mu50
auauuaaggucauuuuuaa

SEQ ID NO: 3990547 - RNA, 22 nt, Staphylococcus aureus subsp. aureus Mu50
auauuaagucuagcauuagaau

SEQ ID NO: 3990548 - RNA, 15 nt, Staphylococcus aureus subsp. aureus Mu50
auauuaauagaaagu

SEQ ID NO: 3990549 - RNA, 16 nt, Staphylococcus aureus subsp. aureus Mu50
auauuaauauaaaaua

SEQ ID NO: 3990550 - RNA, 19 nt, Staphylococcus aureus subsp. aureus Mu50
auauuaaugauugacgauu

SEQ ID NO: 3990551 - RNA, 18 nt, Staphylococcus aureus subsp. aureus Mu50
auauuaauguuugaugau

SEQ ID NO: 3990552 - RNA, 13 nt, Staphylococcus aureus subsp. aureus Mu50
auauuaauuuuac

SEQ ID NO: 3990553 - RNA, 21 nt, Staphylococcus aureus subsp. aureus Mu50
auauuaauuuuacguuuauuu

SEQ ID NO: 3990554 - RNA, 13 nt, Staphylococcus aureus subsp. aureus Mu50
auauuacauauaa

SEQ ID NO: 3990555 - RNA, 21 nt, Staphylococcus aureus subsp. aureus Mu50
auauuacgccuggaaucgcgu

SEQ ID NO: 3990556 - RNA, 21 nt, Staphylococcus aureus subsp. aureus Mu50
auauuacuaaccuauuaaaaa

SEQ ID NO: 3990557 - RNA, 22 nt, Staphylococcus aureus subsp. aureus Mu50
auauuacuaaccuauuaaaaaa

SEQ ID NO: 3990558 - RNA, 19 nt, Staphylococcus aureus subsp. aureus Mu50
auauuacuuuggaaauuua

SEQ ID NO: 3990559 - RNA, 21 nt, Staphylococcus aureus subsp. aureus Mu50
auauuacuuuggaaauuuauu

SEQ ID NO: 3990560 - RNA, 19 nt, Staphylococcus aureus subsp. aureus Mu50
auauuagauaucuuaaucu

SEQ ID NO: 3990561 - RNA, 17 nt, Staphylococcus aureus subsp. aureus Mu50
auauuaggcuuaaauau

SEQ ID NO: 3990562 - RNA, 15 nt, Staphylococcus aureus subsp. aureus Mu50
auauuaguauaauuu

SEQ ID NO: 3990563 - RNA, 13 nt, Staphylococcus aureus subsp. aureus Mu50
auauuagugacau

SEQ ID NO: 3990564 - RNA, 16 nt, Staphylococcus aureus subsp. aureus Mu50
auauuagugacauuug

SEQ ID NO: 3990565 - RNA, 23 nt, Staphylococcus aureus subsp. aureus Mu50
auauuagugacauuugcaugcuu

SEQ ID NO: 3990566 - RNA, 14 nt, Staphylococcus aureus subsp. aureus Mu50
auauuauaaaaaca

SEQ ID NO: 3990567 - RNA, 12 nt, Staphylococcus aureus subsp. aureus Mu50
auauuauauaua

SEQ ID NO: 3990568 - RNA, 16 nt, Staphylococcus aureus subsp. aureus Mu50
auauuauauuuugaau

SEQ ID NO: 3990569 - RNA, 18 nt, Staphylococcus aureus subsp. aureus Mu50
auauuucaacuuuuuaau

SEQ ID NO: 3990570 - RNA, 20 nt, Staphylococcus aureus subsp. aureus Mu50
auauuuccaaauugaaauua

SEQ ID NO: 3990571 - RNA, 19 nt, Staphylococcus aureus subsp. aureus Mu50
auauuucccuaugaaauaa

SEQ ID NO: 3990572 - RNA, 22 nt, Staphylococcus aureus subsp. aureus Mu50
auauuucggacgauaacagcua

SEQ ID NO: 3990573 - RNA, 15 nt, Staphylococcus aureus subsp. aureus Mu50
auauuucgguauuuu

SEQ ID NO: 3990574 - RNA, 20 nt, Staphylococcus aureus subsp. aureus Mu50
auauuucgguauuuuaaauu

SEQ ID NO: 3990575 - RNA, 21 nt, Staphylococcus aureus subsp. aureus Mu50
auauuucgguuagucuuaauc

SEQ ID NO: 3990576 - RNA, 22 nt, Staphylococcus aureus subsp. aureus Mu50
auauuucgguuagucuuaaucc

SEQ ID NO: 3990577 - RNA, 12 nt, Staphylococcus aureus subsp. aureus Mu50
auauuucuaaac

SEQ ID NO: 3990578 - RNA, 13 nt, Staphylococcus aureus subsp. aureus Mu50
auauuucuaaauu

SEQ ID NO: 3990579 - RNA, 14 nt, Staphylococcus aureus subsp. aureus Mu50
auauuucuaaauua

SEQ ID NO: 3990580 - RNA, 22 nt, Staphylococcus aureus subsp. aureus Mu50
auauuucuaguugcaaucguau

SEQ ID NO: 3990581 - RNA, 21 nt, Staphylococcus aureus subsp. aureus Mu50
auauuucugggcuuucuuuuu

SEQ ID NO: 3990582 - RNA, 13 nt, Staphylococcus aureus subsp. aureus Mu50
auauuucuuacca

SEQ ID NO: 3990583 - RNA, 16 nt, Staphylococcus aureus subsp. aureus Mu50
auauuugaaaauuuca

SEQ ID NO: 3990584 - RNA, 21 nt, Staphylococcus aureus subsp. aureus Mu50
auauuugaaagguaaguacuu

SEQ ID NO: 3990585 - RNA, 20 nt, Staphylococcus aureus subsp. aureus Mu50
auauuugauaaguagaaaau

SEQ ID NO: 3990586 - RNA, 22 nt, Staphylococcus aureus subsp. aureus Mu50
auauuugauaucacuauacaau

SEQ ID NO: 3990587 - RNA, 20 nt, Staphylococcus aureus subsp. aureus Mu50
auauuugcuagucauaauuu

SEQ ID NO: 3990588 - RNA, 12 nt, Staphylococcus aureus subsp. aureus Mu50
auauuuuaaaaa

SEQ ID NO: 3990589 - RNA, 17 nt, Staphylococcus aureus subsp. aureus Mu50
auauuuuaaaaaguaau

SEQ ID NO: 3990590 - RNA, 14 nt, Staphylococcus aureus subsp. aureus Mu50
auauuuuacaaaau

SEQ ID NO: 3990591 - RNA, 19 nt, Staphylococcus aureus subsp. aureus Mu50
auauuuucauguccaucuu

SEQ ID NO: 3990592 - RNA, 11 nt, Staphylococcus aureus subsp. aureus Mu50
auauuuucuuc

SEQ ID NO: 3990593 - RNA, 12 nt, Staphylococcus aureus subsp. aureus Mu50
auauuuugauuu

SEQ ID NO: 3990594 - RNA, 22 nt, Staphylococcus aureus subsp. aureus Mu50
auauuuugcaauaauucaucuu

SEQ ID NO: 3990595 - RNA, 22 nt, Staphylococcus aureus subsp. aureus Mu50
auauuuuguuaauaagcgcauc

SEQ ID NO: 3990596 - RNA, 16 nt, Staphylococcus aureus subsp. aureus Mu50
auauuuuuacauauuu

SEQ ID NO: 3990597 - RNA, 15 nt, Staphylococcus aureus subsp. aureus Mu50
auauuuuucaauuaa

SEQ ID NO: 3990598 - RNA, 23 nt, Staphylococcus aureus subsp. aureus Mu50
auauuuuucgaauuuaaccaguu

SEQ ID NO: 3990599 - RNA, 23 nt, Staphylococcus aureus subsp. aureus Mu50
auauuuuuguauuuauguuuucu

SEQ ID NO: 3990600 - RNA, 14 nt, Staphylococcus aureus subsp. aureus Mu50
auauuuuuucugug

SEQ ID NO: 3990601 - RNA, 12 nt, Staphylococcus aureus subsp. aureus Mu50
auauuuuuuuac

SEQ ID NO: 3990602 - RNA, 18 nt, Staphylococcus aureus subsp. aureus Mu50
aucaaaaauaaaaaugcc

SEQ ID NO: 3990603 - RNA, 19 nt, Staphylococcus aureus subsp. aureus Mu50
aucaaaaauaauuaugaaa

SEQ ID NO: 3990604 - RNA, 12 nt, Staphylococcus aureus subsp. aureus Mu50
aucaaaaauguu

SEQ ID NO: 3990605 - RNA, 20 nt, Staphylococcus aureus subsp. aureus Mu50
aucaaaaccgcuauaaaauu

SEQ ID NO: 3990606 - RNA, 12 nt, Staphylococcus aureus subsp. aureus Mu50
aucaaaaguuug

SEQ ID NO: 3990607 - RNA, 18 nt, Staphylococcus aureus subsp. aureus Mu50
aucaaaaguuuguauauu

SEQ ID NO: 3990608 - RNA, 20 nt, Staphylococcus aureus subsp. aureus Mu50
aucaaaauauaaaauccuaa

SEQ ID NO: 3990609 - RNA, 15 nt, Staphylococcus aureus subsp. aureus Mu50
aucaaaauuaugacu

SEQ ID NO: 3990610 - RNA, 18 nt, Staphylococcus aureus subsp. aureus Mu50
aucaaacuuggcaaugaa

SEQ ID NO: 3990611 - RNA, 23 nt, Staphylococcus aureus subsp. aureus Mu50
aucaaagaaaaagugauaauuaa

SEQ ID NO: 3990612 - RNA, 20 nt, Staphylococcus aureus subsp. aureus Mu50
aucaaagaggaacagcggaa

SEQ ID NO: 3990613 - RNA, 18 nt, Staphylococcus aureus subsp. aureus Mu50
aucaaagaggcuuuaaaa

SEQ ID NO: 3990614 - RNA, 24 nt, Staphylococcus aureus subsp. aureus Mu50
aucaaagggcuucgauucauaaaa

SEQ ID NO: 3990615 - RNA, 21 nt, Staphylococcus aureus subsp. aureus Mu50
aucaaaguacuaacguuuuaa

SEQ ID NO: 3990616 - RNA, 18 nt, Staphylococcus aureus subsp. aureus Mu50
aucaaauacauuucaaaa

SEQ ID NO: 3990617 - RNA, 23 nt, Staphylococcus aureus subsp. aureus Mu50
aucaaauccaaaaucuuuacuug

SEQ ID NO: 3990618 - RNA, 11 nt, Staphylococcus aureus subsp. aureus Mu50
aucaaauuacc

SEQ ID NO: 3990619 - RNA, 21 nt, Staphylococcus aureus subsp. aureus Mu50
aucaaauuagucauccaaaga

SEQ ID NO: 3990620 - RNA, 14 nt, Staphylococcus aureus subsp. aureus Mu50
aucaacaaauuuaa

SEQ ID NO: 3990621 - RNA, 16 nt, Staphylococcus aureus subsp. aureus Mu50
aucaacaaauuuaacu

SEQ ID NO: 3990622 - RNA, 12 nt, Staphylococcus aureus subsp. aureus Mu50
aucaacaacaag

SEQ ID NO: 3990623 - RNA, 14 nt, Staphylococcus aureus subsp. aureus Mu50
aucaacaacaaguu

SEQ ID NO: 3990624 - RNA, 17 nt, Staphylococcus aureus subsp. aureus Mu50
aucaacaaucuuuuuca

SEQ ID NO: 3990625 - RNA, 14 nt, Staphylococcus aureus subsp. aureus Mu50
aucaacacacacag

SEQ ID NO: 3990626 - RNA, 17 nt, Staphylococcus aureus subsp. aureus Mu50
aucaacagcuucaaaau

SEQ ID NO: 3990627 - RNA, 17 nt, Staphylococcus aureus subsp. aureus Mu50
aucaacauaaaauuuaa

SEQ ID NO: 3990628 - RNA, 19 nt, Staphylococcus aureus subsp. aureus Mu50
aucaacaucaucuuuaauu

SEQ ID NO: 3990629 - RNA, 17 nt, Staphylococcus aureus subsp. aureus Mu50
aucaacauuaauaaaua

SEQ ID NO: 3990630 - RNA, 14 nt, Staphylococcus aureus subsp. aureus Mu50
aucaaccuguucuu

SEQ ID NO: 3990631 - RNA, 22 nt, Staphylococcus aureus subsp. aureus Mu50
aucaaccuguucuuuauuuaaa

SEQ ID NO: 3990632 - RNA, 18 nt, Staphylococcus aureus subsp. aureus Mu50
aucaacgccauauuuauu

SEQ ID NO: 3990633 - RNA, 18 nt, Staphylococcus aureus subsp. aureus Mu50
aucaacugaaauuuuucc

SEQ ID NO: 3990634 - RNA, 17 nt, Staphylococcus aureus subsp. aureus Mu50
aucaacugcuucacgau

SEQ ID NO: 3990635 - RNA, 13 nt, Staphylococcus aureus subsp. aureus Mu50
aucaacuuuucua

SEQ ID NO: 3990636 - RNA, 14 nt, Staphylococcus aureus subsp. aureus Mu50
aucaagaaauguua

SEQ ID NO: 3990637 - RNA, 19 nt, Staphylococcus aureus subsp. aureus Mu50
aucaagaaauguuaaauua

SEQ ID NO: 3990638 - RNA, 17 nt, Staphylococcus aureus subsp. aureus Mu50
aucaagaacuuuaaaaa

SEQ ID NO: 3990639 - RNA, 20 nt, Staphylococcus aureus subsp. aureus Mu50
aucaagaacuuuaaaaauug

SEQ ID NO: 3990640 - RNA, 18 nt, Staphylococcus aureus subsp. aureus Mu50
aucaagcugagcuuuaau

SEQ ID NO: 3990641 - RNA, 17 nt, Staphylococcus aureus subsp. aureus Mu50
aucaaguaguuaucuaa

SEQ ID NO: 3990642 - RNA, 18 nt, Staphylococcus aureus subsp. aureus Mu50
aucaagucugcauuaauu

SEQ ID NO: 3990643 - RNA, 15 nt, Staphylococcus aureus subsp. aureus Mu50
aucaaguugauaaug

SEQ ID NO: 3990644 - RNA, 16 nt, Staphylococcus aureus subsp. aureus Mu50
aucaauacaauuuuac

SEQ ID NO: 3990645 - RNA, 21 nt, Staphylococcus aureus subsp. aureus Mu50
aucaauaccauaauuaaauaa

SEQ ID NO: 3990646 - RNA, 17 nt, Staphylococcus aureus subsp. aureus Mu50
aucaauagccauuuccg

SEQ ID NO: 3990647 - RNA, 14 nt, Staphylococcus aureus subsp. aureus Mu50
aucaauaguuuaua

SEQ ID NO: 3990648 - RNA, 15 nt, Staphylococcus aureus subsp. aureus Mu50
aucaauauaauuugg

SEQ ID NO: 3990649 - RNA, 16 nt, Staphylococcus aureus subsp. aureus Mu50
aucaauauaauuuggu

SEQ ID NO: 3990650 - RNA, 22 nt, Staphylococcus aureus subsp. aureus Mu50
aucaauaucuucuaauuccauc

SEQ ID NO: 3990651 - RNA, 24 nt, Staphylococcus aureus subsp. aureus Mu50
aucaauaugaccuuuaugugcauc

SEQ ID NO: 3990652 - RNA, 13 nt, Staphylococcus aureus subsp. aureus Mu50
aucaauauugaua

SEQ ID NO: 3990653 - RNA, 14 nt, Staphylococcus aureus subsp. aureus Mu50
aucaauauugauau

SEQ ID NO: 3990654 - RNA, 15 nt, Staphylococcus aureus subsp. aureus Mu50
aucaauauuuauauu

SEQ ID NO: 3990655 - RNA, 17 nt, Staphylococcus aureus subsp. aureus Mu50
aucaaucgcuuuagcaa

SEQ ID NO: 3990656 - RNA, 22 nt, Staphylococcus aureus subsp. aureus Mu50
aucaaucgcuuuagcaauugaa

SEQ ID NO: 3990657 - RNA, 19 nt, Staphylococcus aureus subsp. aureus Mu50
aucaucuucuggauaggua

SEQ ID NO: 3990658 - RNA, 14 nt, Staphylococcus aureus subsp. aureus Mu50
aucaucuuuuugaa

SEQ ID NO: 3990659 - RNA, 16 nt, Staphylococcus aureus subsp. aureus Mu50
aucaugaaguugguuu

SEQ ID NO: 3990660 - RNA, 19 nt, Staphylococcus aureus subsp. aureus Mu50
aucaugacuauuuuccauc

SEQ ID NO: 3990661 - RNA, 14 nt, Staphylococcus aureus subsp. aureus Mu50
aucaugaugauaaa

SEQ ID NO: 3990662 - RNA, 14 nt, Staphylococcus aureus subsp. aureus Mu50
aucaugcacaauau

SEQ ID NO: 3990663 - RNA, 13 nt, Staphylococcus aureus subsp. aureus Mu50
aucaugccuucau

SEQ ID NO: 3990664 - RNA, 19 nt, Staphylococcus aureus subsp. aureus Mu50
aucaugccuucaugaauaa

SEQ ID NO: 3990665 - RNA, 14 nt, Staphylococcus aureus subsp. aureus Mu50
aucaugcuuuuaau

SEQ ID NO: 3990666 - RNA, 22 nt, Staphylococcus aureus subsp. aureus Mu50
aucauggcuuauacacuuacaa

SEQ ID NO: 3990667 - RNA, 23 nt, Staphylococcus aureus subsp. aureus Mu50
aucauguaaugcuuaaaaacaau

SEQ ID NO: 3990668 - RNA, 19 nt, Staphylococcus aureus subsp. aureus Mu50
aucauguacaguuacuuuc

SEQ ID NO: 3990669 - RNA, 23 nt, Staphylococcus aureus subsp. aureus Mu50
aucauguauauggcaucaucacc

SEQ ID NO: 3990670 - RNA, 20 nt, Staphylococcus aureus subsp. aureus Mu50
aucaugugcuuuguuuauca

SEQ ID NO: 3990671 - RNA, 23 nt, Staphylococcus aureus subsp. aureus Mu50
aucaugugucuuccaaucaacuu

SEQ ID NO: 3990672 - RNA, 16 nt, Staphylococcus aureus subsp. aureus Mu50
aucauguucuuauaaa

SEQ ID NO: 3990673 - RNA, 19 nt, Staphylococcus aureus subsp. aureus Mu50
aucauguucuuauaaaaaa

SEQ ID NO: 3990674 - RNA, 20 nt, Staphylococcus aureus subsp. aureus Mu50
aucauguucuuauaaaaaac

SEQ ID NO: 3990675 - RNA, 11 nt, Staphylococcus aureus subsp. aureus Mu50
aucauuaaaau

SEQ ID NO: 3990676 - RNA, 12 nt, Staphylococcus aureus subsp. aureus Mu50
aucauuaaaauc

SEQ ID NO: 3990677 - RNA, 14 nt, Staphylococcus aureus subsp. aureus Mu50
aucauuaaaucuga

SEQ ID NO: 3990678 - RNA, 15 nt, Staphylococcus aureus subsp. aureus Mu50
aucauuaaauugcuu

SEQ ID NO: 3990679 - RNA, 20 nt, Staphylococcus aureus subsp. aureus Mu50
aucauuaauuggauuuuuac

SEQ ID NO: 3990680 - RNA, 16 nt, Staphylococcus aureus subsp. aureus Mu50
aucauuagcaauuuca

SEQ ID NO: 3990681 - RNA, 18 nt, Staphylococcus aureus subsp. aureus Mu50
aucauuaguguagaaaau

SEQ ID NO: 3990682 - RNA, 19 nt, Staphylococcus aureus subsp. aureus Mu50
aucauuaguguagaaaaua

SEQ ID NO: 3990683 - RNA, 16 nt, Staphylococcus aureus subsp. aureus Mu50
aucauuaguuuuuaaa

SEQ ID NO: 3990684 - RNA, 18 nt, Staphylococcus aureus subsp. aureus Mu50
aucauuaguuuuuaaaau

SEQ ID NO: 3990685 - RNA, 20 nt, Staphylococcus aureus subsp. aureus Mu50
aucauuaguuuuuaaaauua

SEQ ID NO: 3990686 - RNA, 22 nt, Staphylococcus aureus subsp. aureus Mu50
aucauuaguuuuuaaaauuauc

SEQ ID NO: 3990687 - RNA, 13 nt, Staphylococcus aureus subsp. aureus Mu50
aucauuauaaaau

SEQ ID NO: 3990688 - RNA, 14 nt, Staphylococcus aureus subsp. aureus Mu50
aucauuauaaaaug

SEQ ID NO: 3990689 - RNA, 15 nt, Staphylococcus aureus subsp. aureus Mu50
aucauuauaaaaugg

SEQ ID NO: 3990690 - RNA, 14 nt, Staphylococcus aureus subsp. aureus Mu50
aucauuaucaaaua

SEQ ID NO: 3990691 - RNA, 19 nt, Staphylococcus aureus subsp. aureus Mu50
aucauuauucgcaucucca

SEQ ID NO: 3990692 - RNA, 22 nt, Staphylococcus aureus subsp. aureus Mu50
aucauuauuuagaauucuaaaa

SEQ ID NO: 3990693 - RNA, 19 nt, Staphylococcus aureus subsp. aureus Mu50
aucauuauuugauaaauaa

SEQ ID NO: 3990694 - RNA, 13 nt, Staphylococcus aureus subsp. aureus Mu50
aucauucaccuug

SEQ ID NO: 3990695 - RNA, 16 nt, Staphylococcus aureus subsp. aureus Mu50
aucauucauuugcaaa

SEQ ID NO: 3990696 - RNA, 19 nt, Staphylococcus aureus subsp. aureus Mu50
aucauucuguguaaauaua

SEQ ID NO: 3990697 - RNA, 21 nt, Staphylococcus aureus subsp. aureus Mu50
aucauucuguguaaauauaaa

SEQ ID NO: 3990698 - RNA, 23 nt, Staphylococcus aureus subsp. aureus Mu50
aucauucuguguaaauauaaaua

SEQ ID NO: 3990699 - RNA, 22 nt, Staphylococcus aureus subsp. aureus Mu50
aucauugauauagucaaugaau

SEQ ID NO: 3990700 - RNA, 13 nt, Staphylococcus aureus subsp. aureus Mu50
aucauuguggcuu

SEQ ID NO: 3990701 - RNA, 20 nt, Staphylococcus aureus subsp. aureus Mu50
aucauuguggcuuuuuuuau

SEQ ID NO: 3990702 - RNA, 22 nt, Staphylococcus aureus subsp. aureus Mu50
aucauuguguccauaaauauua

SEQ ID NO: 3990703 - RNA, 15 nt, Staphylococcus aureus subsp. aureus Mu50
aucauuuaaaauauu

SEQ ID NO: 3990704 - RNA, 19 nt, Staphylococcus aureus subsp. aureus Mu50
aucauuuaaaauauuuuuu

SEQ ID NO: 3990705 - RNA, 16 nt, Staphylococcus aureus subsp. aureus Mu50
aucauuuaauugaugu

SEQ ID NO: 3990706 - RNA, 15 nt, Staphylococcus aureus subsp. aureus Mu50
aucauuucaaauaag

SEQ ID NO: 3990707 - RNA, 18 nt, Staphylococcus aureus subsp. aureus Mu50
aucauuucagaaauacau

SEQ ID NO: 3990708 - RNA, 16 nt, Staphylococcus aureus subsp. aureus Mu50
aucauuucugucgcuu

SEQ ID NO: 3990709 - RNA, 20 nt, Staphylococcus aureus subsp. aureus Mu50
aucauuucuguuccaauccc

SEQ ID NO: 3990710 - RNA, 20 nt, Staphylococcus aureus subsp. aureus Mu50
aucauuuggcguucaacauu

SEQ ID NO: 3990711 - RNA, 16 nt, Staphylococcus aureus subsp. aureus Mu50
aucauuuguguauaaa

SEQ ID NO: 3990712 - RNA, 21 nt, Staphylococcus aureus subsp. aureus Mu50
aucauuuguguauaaauguca

SEQ ID NO: 3990713 - RNA, 16 nt, Staphylococcus aureus subsp. aureus Mu50
aucauuuguguuuuua

SEQ ID NO: 3990714 - RNA, 22 nt, Staphylococcus aureus subsp. aureus Mu50
aucauuuguguuuuuaauguuu

SEQ ID NO: 3990715 - RNA, 22 nt, Staphylococcus aureus subsp. aureus Mu50
aucauuuucauuuaauccuucu

SEQ ID NO: 3990716 - RNA, 15 nt, Staphylococcus aureus subsp. aureus Mu50
auccaaaacauuuug

SEQ ID NO: 3990717 - RNA, 22 nt, Staphylococcus aureus subsp. aureus Mu50
auccaaaaucuuuacuuguaau

SEQ ID NO: 3990718 - RNA, 16 nt, Staphylococcus aureus subsp. aureus Mu50
auccaaauauuaaaaa

SEQ ID NO: 3990719 - RNA, 20 nt, Staphylococcus aureus subsp. aureus Mu50
auccaaggauguuauaaaau

SEQ ID NO: 3990720 - RNA, 23 nt, Staphylococcus aureus subsp. aureus Mu50
auccaaggauguuauaaaaugaa

SEQ ID NO: 3990721 - RNA, 20 nt, Staphylococcus aureus subsp. aureus Mu50
auccacuuuauaauuuuuga

SEQ ID NO: 3990722 - RNA, 23 nt, Staphylococcus aureus subsp. aureus Mu50
auccacuuuauaauuuuugagua

SEQ ID NO: 3990723 - RNA, 17 nt, Staphylococcus aureus subsp. aureus Mu50
auccaguaaucaaagau

SEQ ID NO: 3990724 - RNA, 13 nt, Staphylococcus aureus subsp. aureus Mu50
auccauaaaaaua

SEQ ID NO: 3990725 - RNA, 14 nt, Staphylococcus aureus subsp. aureus Mu50
auccauaaggauuu

SEQ ID NO: 3990726 - RNA, 14 nt, Staphylococcus aureus subsp. aureus Mu50
auccaucaauacca

SEQ ID NO: 3990727 - RNA, 15 nt, Staphylococcus aureus subsp. aureus Mu50
auccaucaauaccau

SEQ ID NO: 3990728 - RNA, 20 nt, Staphylococcus aureus subsp. aureus Mu50
auccaucaauaccauaauua

SEQ ID NO: 3990729 - RNA, 13 nt, Staphylococcus aureus subsp. aureus Mu50
auccaucuaauuc

SEQ ID NO: 3990730 - RNA, 12 nt, Staphylococcus aureus subsp. aureus Mu50
auccaucuacac

SEQ ID NO: 3990731 - RNA, 14 nt, Staphylococcus aureus subsp. aureus Mu50
auccaucuacaccc

SEQ ID NO: 3990732 - RNA, 15 nt, Staphylococcus aureus subsp. aureus Mu50
auccauucaauguuu

SEQ ID NO: 3990733 - RNA, 15 nt, Staphylococcus aureus subsp. aureus Mu50
auccauugaucuuuu

SEQ ID NO: 3990734 - RNA, 22 nt, Staphylococcus aureus subsp. aureus Mu50
aucccauaccuacaaauaugua

SEQ ID NO: 3990735 - RNA, 14 nt, Staphylococcus aureus subsp. aureus Mu50
auccccauuuaugu

SEQ ID NO: 3990736 - RNA, 23 nt, Staphylococcus aureus subsp. aureus Mu50
auccccauuuauguguuggcuuu

SEQ ID NO: 3990737 - RNA, 23 nt, Staphylococcus aureus subsp. aureus Mu50
auccccgaagcacagaaaauuau

SEQ ID NO: 3990738 - RNA, 22 nt, Staphylococcus aureus subsp. aureus Mu50
auccgauuuugauauaaaaagu

SEQ ID NO: 3990739 - RNA, 17 nt, Staphylococcus aureus subsp. aureus Mu50
auccgccaauuaaaauu

SEQ ID NO: 3990740 - RNA, 18 nt, Staphylococcus aureus subsp. aureus Mu50
auccuaaaaagcucaauc

SEQ ID NO: 3990741 - RNA, 19 nt, Staphylococcus aureus subsp. aureus Mu50
auccuaaaaaggcaagcac

SEQ ID NO: 3990742 - RNA, 15 nt, Staphylococcus aureus subsp. aureus Mu50
auccuaagcauaauu

SEQ ID NO: 3990743 - RNA, 17 nt, Staphylococcus aureus subsp. aureus Mu50
auccuaagcauaauuca

SEQ ID NO: 3990744 - RNA, 13 nt, Staphylococcus aureus subsp. aureus Mu50
aucuaacuggaaa

SEQ ID NO: 3990745 - RNA, 16 nt, Staphylococcus aureus subsp. aureus Mu50
aucuaacuggaaauga

SEQ ID NO: 3990746 - RNA, 18 nt, Staphylococcus aureus subsp. aureus Mu50
aucuaacuggaaaugaua

SEQ ID NO: 3990747 - RNA, 17 nt, Staphylococcus aureus subsp. aureus Mu50
aucuaagauuaauguau

SEQ ID NO: 3990748 - RNA, 22 nt, Staphylococcus aureus subsp. aureus Mu50
aucuaagucgauaaguuuuuga

SEQ ID NO: 3990749 - RNA, 17 nt, Staphylococcus aureus subsp. aureus Mu50
aucuaauacuucaccac

SEQ ID NO: 3990750 - RNA, 17 nt, Staphylococcus aureus subsp. aureus Mu50
aucuaaucuuaauuguc

SEQ ID NO: 3990751 - RNA, 16 nt, Staphylococcus aureus subsp. aureus Mu50
aucuaauucguaauuu

SEQ ID NO: 3990752 - RNA, 17 nt, Staphylococcus aureus subsp. aureus Mu50
aucuacaauauuaaaau

SEQ ID NO: 3990753 - RNA, 19 nt, Staphylococcus aureus subsp. aureus Mu50
aucuacaauauuaaaauua

SEQ ID NO: 3990754 - RNA, 19 nt, Staphylococcus aureus subsp. aureus Mu50
aucuacagagaaucaauua

SEQ ID NO: 3990755 - RNA, 13 nt, Staphylococcus aureus subsp. aureus Mu50
aucuacauaauuu

SEQ ID NO: 3990756 - RNA, 13 nt, Staphylococcus aureus subsp. aureus Mu50
aucuaccauguuu

SEQ ID NO: 3990757 - RNA, 17 nt, Staphylococcus aureus subsp. aureus Mu50
aucuacuacuaaucguu

SEQ ID NO: 3990758 - RNA, 15 nt, Staphylococcus aureus subsp. aureus Mu50
aucuacucaaauaua

SEQ ID NO: 3990759 - RNA, 23 nt, Staphylococcus aureus subsp. aureus Mu50
aucuacuuccuuacagacaaaca

SEQ ID NO: 3990760 - RNA, 21 nt, Staphylococcus aureus subsp. aureus Mu50
aucuacuuuguucugcuuuuu

SEQ ID NO: 3990761 - RNA, 23 nt, Staphylococcus aureus subsp. aureus Mu50
aucuacuuuguucugcuuuuucu

SEQ ID NO: 3990762 - RNA, 15 nt, Staphylococcus aureus subsp. aureus Mu50
aucuagaugaaauug

SEQ ID NO: 3990763 - RNA, 21 nt, Staphylococcus aureus subsp. aureus Mu50
aucuagccugaaauagaaaug

SEQ ID NO: 3990764 - RNA, 14 nt, Staphylococcus aureus subsp. aureus Mu50
aucuaguacaccuc

SEQ ID NO: 3990765 - RNA, 15 nt, Staphylococcus aureus subsp. aureus Mu50
aucuaguuguuuuau

SEQ ID NO: 3990766 - RNA, 20 nt, Staphylococcus aureus subsp. aureus Mu50
aucuauaaauaucaauaauu

SEQ ID NO: 3990767 - RNA, 18 nt, Staphylococcus aureus subsp. aureus Mu50
aucuauacaacaguaauc

SEQ ID NO: 3990768 - RNA, 19 nt, Staphylococcus aureus subsp. aureus Mu50
aucuauacaauuauggaua

SEQ ID NO: 3990769 - RNA, 14 nt, Staphylococcus aureus subsp. aureus Mu50
aucuauauaaaaac

SEQ ID NO: 3990770 - RNA, 13 nt, Staphylococcus aureus subsp. aureus Mu50
aucuauauaaaug

SEQ ID NO: 3990771 - RNA, 16 nt, Staphylococcus aureus subsp. aureus Mu50
aucuauauaaauguuu

SEQ ID NO: 3990772 - RNA, 18 nt, Staphylococcus aureus subsp. aureus Mu50
aucuaucgguaauuuuug

SEQ ID NO: 3990773 - RNA, 21 nt, Staphylococcus aureus subsp. aureus Mu50
aucuauggaaaauguuaucaa

SEQ ID NO: 3990774 - RNA, 18 nt, Staphylococcus aureus subsp. aureus Mu50
aucuauuauuauguuaua

SEQ ID NO: 3990775 - RNA, 21 nt, Staphylococcus aureus subsp. aureus Mu50
aucuauuauuauguuauaaau

SEQ ID NO: 3990776 - RNA, 15 nt, Staphylococcus aureus subsp. aureus Mu50
aucuauucaacugau

SEQ ID NO: 3990777 - RNA, 18 nt, Staphylococcus aureus subsp. aureus Mu50
aucuauugugauauauga

SEQ ID NO: 3990778 - RNA, 14 nt, Staphylococcus aureus subsp. aureus Mu50
aucuauuuaucaua

SEQ ID NO: 3990779 - RNA, 20 nt, Staphylococcus aureus subsp. aureus Mu50
aucuauuuaucauacuucaa

SEQ ID NO: 3990780 - RNA, 15 nt, Staphylococcus aureus subsp. aureus Mu50
aucuauuuuuaacua

SEQ ID NO: 3990781 - RNA, 17 nt, Staphylococcus aureus subsp. aureus Mu50
aucuauuuuuaacuaau

SEQ ID NO: 3990782 - RNA, 12 nt, Staphylococcus aureus subsp. aureus Mu50
aucuauuuuucg

SEQ ID NO: 3990783 - RNA, 19 nt, Staphylococcus aureus subsp. aureus Mu50
aucuauuuuucgauuuuga

SEQ ID NO: 3990784 - RNA, 12 nt, Staphylococcus aureus subsp. aureus Mu50
aucucaaaauuu

SEQ ID NO: 3990785 - RNA, 14 nt, Staphylococcus aureus subsp. aureus Mu50
aucucaaaauuucg

SEQ ID NO: 3990786 - RNA, 14 nt, Staphylococcus aureus subsp. aureus Mu50
aucucaauccaauu

SEQ ID NO: 3990787 - RNA, 13 nt, Staphylococcus aureus subsp. aureus Mu50
aucucauucuuua

SEQ ID NO: 3990788 - RNA, 21 nt, Staphylococcus aureus subsp. aureus Mu50
aucucauucuuuaauauaaau

SEQ ID NO: 3990789 - RNA, 14 nt, Staphylococcus aureus subsp. aureus Mu50
aucuccaucaaagu

SEQ ID NO: 3990790 - RNA, 15 nt, Staphylococcus aureus subsp. aureus Mu50
aucuccaucaaaguu

SEQ ID NO: 3990791 - RNA, 19 nt, Staphylococcus aureus subsp. aureus Mu50
aucuccgcuacaauuauau

SEQ ID NO: 3990792 - RNA, 18 nt, Staphylococcus aureus subsp. aureus Mu50
aucucgucacauauaaau

SEQ ID NO: 3990793 - RNA, 23 nt, Staphylococcus aureus subsp. aureus Mu50
aucucgucacauauaaauauuuu

SEQ ID NO: 3990794 - RNA, 18 nt, Staphylococcus aureus subsp. aureus Mu50
aucucuauuuuuuauguu

SEQ ID NO: 3990795 - RNA, 21 nt, Staphylococcus aureus subsp. aureus Mu50
aucucuauuuuuuauguuuua

SEQ ID NO: 3990796 - RNA, 18 nt, Staphylococcus aureus subsp. aureus Mu50
aucucugcuuuaauauaa

SEQ ID NO: 3990797 - RNA, 13 nt, Staphylococcus aureus subsp. aureus Mu50
aucucuuauaagu

SEQ ID NO: 3990798 - RNA, 18 nt, Staphylococcus aureus subsp. aureus Mu50
aucugaagguaauuuaac

SEQ ID NO: 3990799 - RNA, 12 nt, Staphylococcus aureus subsp. aureus Mu50
aucugaaucugc

SEQ ID NO: 3990800 - RNA, 15 nt, Staphylococcus aureus subsp. aureus Mu50
aucugacauuguugc

SEQ ID NO: 3990801 - RNA, 19 nt, Staphylococcus aureus subsp. aureus Mu50
aucugacauuucaucaaua

SEQ ID NO: 3990802 - RNA, 13 nt, Staphylococcus aureus subsp. aureus Mu50
aucugacugauuu

SEQ ID NO: 3990803 - RNA, 23 nt, Staphylococcus aureus subsp. aureus Mu50
aucugacugauuuuuuuuaugca

SEQ ID NO: 3990804 - RNA, 17 nt, Staphylococcus aureus subsp. aureus Mu50
aucugauaccguuagua

SEQ ID NO: 3990805 - RNA, 14 nt, Staphylococcus aureus subsp. aureus Mu50
aucugauguugauu

SEQ ID NO: 3990806 - RNA, 13 nt, Staphylococcus aureus subsp. aureus Mu50
aucugauuucacu

SEQ ID NO: 3990807 - RNA, 16 nt, Staphylococcus aureus subsp. aureus Mu50
aucugcaaaaugcauu

SEQ ID NO: 3990808 - RNA, 19 nt, Staphylococcus aureus subsp. aureus Mu50
aucugcaaaugccucuuuc

SEQ ID NO: 3990809 - RNA, 17 nt, Staphylococcus aureus subsp. aureus Mu50
aucugcaugguuugcug

SEQ ID NO: 3990810 - RNA, 23 nt, Staphylococcus aureus subsp. aureus Mu50
aucugcuuuauuuuaucaucuau

SEQ ID NO: 3990811 - RNA, 17 nt, Staphylococcus aureus subsp. aureus Mu50
aucuggcaaauugccuu

SEQ ID NO: 3990812 - RNA, 16 nt, Staphylococcus aureus subsp. aureus Mu50
aucugguauuuuauga

SEQ ID NO: 3990813 - RNA, 14 nt, Staphylococcus aureus subsp. aureus Mu50
aucuguaacauaaa

SEQ ID NO: 3990814 - RNA, 13 nt, Staphylococcus aureus subsp. aureus Mu50
aucuguaacuaau

SEQ ID NO: 3990815 - RNA, 18 nt, Staphylococcus aureus subsp. aureus Mu50
aucuguaccguauuuuaa

SEQ ID NO: 3990816 - RNA, 19 nt, Staphylococcus aureus subsp. aureus Mu50
aucuguaccguauuuuaau

SEQ ID NO: 3990817 - RNA, 19 nt, Staphylococcus aureus subsp. aureus Mu50
aucuguagaaacacuuuua

SEQ ID NO: 3990818 - RNA, 13 nt, Staphylococcus aureus subsp. aureus Mu50
aucuguaucaaaa

SEQ ID NO: 3990819 - RNA, 19 nt, Staphylococcus aureus subsp. aureus Mu50
aucuguaucaaaaucgguu

SEQ ID NO: 3990820 - RNA, 16 nt, Staphylococcus aureus subsp. aureus Mu50
aucuguaucaaucaac

SEQ ID NO: 3990821 - RNA, 14 nt, Staphylococcus aureus subsp. aureus Mu50
aucuguccauuuau

SEQ ID NO: 3990822 - RNA, 17 nt, Staphylococcus aureus subsp. aureus Mu50
aucuguccgacuuuuga

SEQ ID NO: 3990823 - RNA, 23 nt, Staphylococcus aureus subsp. aureus Mu50
aucuguuacagguuuuaaaauua

SEQ ID NO: 3990824 - RNA, 14 nt, Staphylococcus aureus subsp. aureus Mu50
aucuguuucuuguu

SEQ ID NO: 3990825 - RNA, 21 nt, Staphylococcus aureus subsp. aureus Mu50
aucuguuuuagguuuguugcu

SEQ ID NO: 3990826 - RNA, 22 nt, Staphylococcus aureus subsp. aureus Mu50
aucuguuuuagguuuguugcuu

SEQ ID NO: 3990827 - RNA, 16 nt, Staphylococcus aureus subsp. aureus Mu50
aucuuaacaacuuuaa

SEQ ID NO: 3990828 - RNA, 18 nt, Staphylococcus aureus subsp. aureus Mu50
aucuuaacaacuuuaauu

SEQ ID NO: 3990829 - RNA, 23 nt, Staphylococcus aureus subsp. aureus Mu50
aucuuaacaacuuuaauuuuuca

SEQ ID NO: 3990830 - RNA, 22 nt, Staphylococcus aureus subsp. aureus Mu50
aucuuaaguacauaaaugcuaa

SEQ ID NO: 3990831 - RNA, 21 nt, Staphylococcus aureus subsp. aureus Mu50
aucuuaagucaucaaucgcuu

SEQ ID NO: 3990832 - RNA, 20 nt, Staphylococcus aureus subsp. aureus Mu50
augaaaauaccucuacauua

SEQ ID NO: 3990833 - RNA, 19 nt, Staphylococcus aureus subsp. aureus Mu50
augaaaauauagugguggu

SEQ ID NO: 3990834 - RNA, 15 nt, Staphylococcus aureus subsp. aureus Mu50
augaaaccguauuau

SEQ ID NO: 3990835 - RNA, 16 nt, Staphylococcus aureus subsp. aureus Mu50
augaaaguaccuaaaa

SEQ ID NO: 3990836 - RNA, 17 nt, Staphylococcus aureus subsp. aureus Mu50
augaaaguaccuaaaau

SEQ ID NO: 3990837 - RNA, 20 nt, Staphylococcus aureus subsp. aureus Mu50
augaaaguaccuaaaauaga

SEQ ID NO: 3990838 - RNA, 15 nt, Staphylococcus aureus subsp. aureus Mu50
augaaauaacuagau

SEQ ID NO: 3990839 - RNA, 18 nt, Staphylococcus aureus subsp. aureus Mu50
augaaauaacuagauguu

SEQ ID NO: 3990840 - RNA, 14 nt, Staphylococcus aureus subsp. aureus Mu50
augaaauucuuuug

SEQ ID NO: 3990841 - RNA, 16 nt, Staphylococcus aureus subsp. aureus Mu50
augaaauuguguugaa

SEQ ID NO: 3990842 - RNA, 18 nt, Staphylococcus aureus subsp. aureus Mu50
augaaauuucaguaucau

SEQ ID NO: 3990843 - RNA, 21 nt, Staphylococcus aureus subsp. aureus Mu50
augaaauuucaguaucauguu

SEQ ID NO: 3990844 - RNA, 19 nt, Staphylococcus aureus subsp. aureus Mu50
augaacaaaaaauaaaaac

SEQ ID NO: 3990845 - RNA, 13 nt, Staphylococcus aureus subsp. aureus Mu50
augaaccaaaaaa

SEQ ID NO: 3990846 - RNA, 22 nt, Staphylococcus aureus subsp. aureus Mu50
augaaccagcuaaccaaauaau

SEQ ID NO: 3990847 - RNA, 15 nt, Staphylococcus aureus subsp. aureus Mu50
augaacuuaaugcuu

SEQ ID NO: 3990848 - RNA, 16 nt, Staphylococcus aureus subsp. aureus Mu50
augaacuuaaugcuuc

SEQ ID NO: 3990849 - RNA, 13 nt, Staphylococcus aureus subsp. aureus Mu50
augaagaauacaa

SEQ ID NO: 3990850 - RNA, 13 nt, Staphylococcus aureus subsp. aureus Mu50
augaagauuuugu

SEQ ID NO: 3990851 - RNA, 21 nt, Staphylococcus aureus subsp. aureus Mu50
augaagcaguuguugguuuug

SEQ ID NO: 3990852 - RNA, 19 nt, Staphylococcus aureus subsp. aureus Mu50
augaagcguuuuuauuaca

SEQ ID NO: 3990853 - RNA, 20 nt, Staphylococcus aureus subsp. aureus Mu50
augaaguaauauauaaaagu

SEQ ID NO: 3990854 - RNA, 19 nt, Staphylococcus aureus subsp. aureus Mu50
augaaguaguuucauugcu

SEQ ID NO: 3990855 - RNA, 13 nt, Staphylococcus aureus subsp. aureus Mu50
augaauaacaaga

SEQ ID NO: 3990856 - RNA, 16 nt, Staphylococcus aureus subsp. aureus Mu50
augaauaacaagaaaa

SEQ ID NO: 3990857 - RNA, 21 nt, Staphylococcus aureus subsp. aureus Mu50
augaauaaugcaauugaccaa

SEQ ID NO: 3990858 - RNA, 15 nt, Staphylococcus aureus subsp. aureus Mu50
augaauaauuaaaaa

SEQ ID NO: 3990859 - RNA, 17 nt, Staphylococcus aureus subsp. aureus Mu50
augaauaauuaaaaaac

SEQ ID NO: 3990860 - RNA, 15 nt, Staphylococcus aureus subsp. aureus Mu50
augaauagauaaucg

SEQ ID NO: 3990861 - RNA, 15 nt, Staphylococcus aureus subsp. aureus Mu50
augaauauaauaaca

SEQ ID NO: 3990862 - RNA, 12 nt, Staphylococcus aureus subsp. aureus Mu50
augaauauauug

SEQ ID NO: 3990863 - RNA, 14 nt, Staphylococcus aureus subsp. aureus Mu50
augaaucaacaauu

SEQ ID NO: 3990864 - RNA, 15 nt, Staphylococcus aureus subsp. aureus Mu50
augaaucaacaauuu

SEQ ID NO: 3990865 - RNA, 14 nt, Staphylococcus aureus subsp. aureus Mu50
augaaucagaugau

SEQ ID NO: 3990866 - RNA, 22 nt, Staphylococcus aureus subsp. aureus Mu50
augaauccugugacucaaugau

SEQ ID NO: 3990867 - RNA, 18 nt, Staphylococcus aureus subsp. aureus Mu50
augaaucgauauaaugaa

SEQ ID NO: 3990868 - RNA, 20 nt, Staphylococcus aureus subsp. aureus Mu50
augaaucgauauaaugaagu

SEQ ID NO: 3990869 - RNA, 21 nt, Staphylococcus aureus subsp. aureus Mu50
augaaucgauauaaugaaguu

SEQ ID NO: 3990870 - RNA, 17 nt, Staphylococcus aureus subsp. aureus Mu50
augaaucgcauuuaaau

SEQ ID NO: 3990871 - RNA, 21 nt, Staphylococcus aureus subsp. aureus Mu50
augaaucgcauuuaaauauaa

SEQ ID NO: 3990872 - RNA, 17 nt, Staphylococcus aureus subsp. aureus Mu50
augaaucuagaauauaa

SEQ ID NO: 3990873 - RNA, 15 nt, Staphylococcus aureus subsp. aureus Mu50
augaaugauugcauu

SEQ ID NO: 3990874 - RNA, 15 nt, Staphylococcus aureus subsp. aureus Mu50
augaaugccuaauuu

SEQ ID NO: 3990875 - RNA, 21 nt, Staphylococcus aureus subsp. aureus Mu50
augaauguaacguacaauuua

SEQ ID NO: 3990876 - RNA, 15 nt, Staphylococcus aureus subsp. aureus Mu50
augaauuaauagcuu

SEQ ID NO: 3990877 - RNA, 18 nt, Staphylococcus aureus subsp. aureus Mu50
augaauuauuuaaaaugc

SEQ ID NO: 3990878 - RNA, 19 nt, Staphylococcus aureus subsp. aureus Mu50
augaauuauuuaaaaugcu

SEQ ID NO: 3990879 - RNA, 19 nt, Staphylococcus aureus subsp. aureus Mu50
augaauucauuuuaucuau

SEQ ID NO: 3990880 - RNA, 16 nt, Staphylococcus aureus subsp. aureus Mu50
augaauugaguauuaa

SEQ ID NO: 3990881 - RNA, 20 nt, Staphylococcus aureus subsp. aureus Mu50
augaauugaguauuaaauuu

SEQ ID NO: 3990882 - RNA, 21 nt, Staphylococcus aureus subsp. aureus Mu50
augaauugaguauuaaauuug

SEQ ID NO: 3990883 - RNA, 22 nt, Staphylococcus aureus subsp. aureus Mu50
augaauugcuuguucuuucuuu

SEQ ID NO: 3990884 - RNA, 19 nt, Staphylococcus aureus subsp. aureus Mu50
augaauugcuuguuuuaaa

SEQ ID NO: 3990885 - RNA, 20 nt, Staphylococcus aureus subsp. aureus Mu50
augaauugcuuguuuuaaau

SEQ ID NO: 3990886 - RNA, 17 nt, Staphylococcus aureus subsp. aureus Mu50
augaauuggauguaaua

SEQ ID NO: 3990887 - RNA, 20 nt, Staphylococcus aureus subsp. aureus Mu50
augaauugucuuaauaugca

SEQ ID NO: 3990888 - RNA, 15 nt, Staphylococcus aureus subsp. aureus Mu50
augaauuguuaguuu

SEQ ID NO: 3990889 - RNA, 12 nt, Staphylococcus aureus subsp. aureus Mu50
augaauuuacuc

SEQ ID NO: 3990890 - RNA, 19 nt, Staphylococcus aureus subsp. aureus Mu50
augaauuuacuccuuacaa

SEQ ID NO: 3990891 - RNA, 22 nt, Staphylococcus aureus subsp. aureus Mu50
augaauuuuaauauauuuggag

SEQ ID NO: 3990892 - RNA, 14 nt, Staphylococcus aureus subsp. aureus Mu50
augaauuuuauaaa

SEQ ID NO: 3990893 - RNA, 18 nt, Staphylococcus aureus subsp. aureus Mu50
augaauuuuauaaauuaa

SEQ ID NO: 3990894 - RNA, 15 nt, Staphylococcus aureus subsp. aureus Mu50
augaauuuuuauuuu

SEQ ID NO: 3990895 - RNA, 19 nt, Staphylococcus aureus subsp. aureus Mu50
augacaaauuaucacucau

SEQ ID NO: 3990896 - RNA, 16 nt, Staphylococcus aureus subsp. aureus Mu50
augacaccuaauacca

SEQ ID NO: 3990897 - RNA, 19 nt, Staphylococcus aureus subsp. aureus Mu50
augacauaggcgcuuuuuu

SEQ ID NO: 3990898 - RNA, 22 nt, Staphylococcus aureus subsp. aureus Mu50
augacauaggcgcuuuuuuuua

SEQ ID NO: 3990899 - RNA, 13 nt, Staphylococcus aureus subsp. aureus Mu50
augacaucaauau

SEQ ID NO: 3990900 - RNA, 14 nt, Staphylococcus aureus subsp. aureus Mu50
augacaucaauauc

SEQ ID NO: 3990901 - RNA, 16 nt, Staphylococcus aureus subsp. aureus Mu50
augacaucaauaucuu

SEQ ID NO: 3990902 - RNA, 21 nt, Staphylococcus aureus subsp. aureus Mu50
augacaucaauaucuucuucu

SEQ ID NO: 3990903 - RNA, 19 nt, Staphylococcus aureus subsp. aureus Mu50
augacauugugaaaguuuu

SEQ ID NO: 3990904 - RNA, 23 nt, Staphylococcus aureus subsp. aureus Mu50
augacauuuuaaaucuaauuauu

SEQ ID NO: 3990905 - RNA, 19 nt, Staphylococcus aureus subsp. aureus Mu50
augaccaauagcaauugaa

SEQ ID NO: 3990906 - RNA, 15 nt, Staphylococcus aureus subsp. aureus Mu50
augaccauugucaug

SEQ ID NO: 3990907 - RNA, 22 nt, Staphylococcus aureus subsp. aureus Mu50
augaccauugucaugccuucau

SEQ ID NO: 3990908 - RNA, 16 nt, Staphylococcus aureus subsp. aureus Mu50
augaccuggaauauug

SEQ ID NO: 3990909 - RNA, 22 nt, Staphylococcus aureus subsp. aureus Mu50
augacgcucgagcucuucaaau

SEQ ID NO: 3990910 - RNA, 23 nt, Staphylococcus aureus subsp. aureus Mu50
augacggugaaaguucauuacaa

SEQ ID NO: 3990911 - RNA, 21 nt, Staphylococcus aureus subsp. aureus Mu50
augacguauacaaauugauuu

SEQ ID NO: 3990912 - RNA, 14 nt, Staphylococcus aureus subsp. aureus Mu50
augacgugcuuuua

SEQ ID NO: 3990913 - RNA, 17 nt, Staphylococcus aureus subsp. aureus Mu50
augacgugcuuuuaaau

SEQ ID NO: 3990914 - RNA, 21 nt, Staphylococcus aureus subsp. aureus Mu50
augacgugcuuuuaaauguau

SEQ ID NO: 3990915 - RNA, 13 nt, Staphylococcus aureus subsp. aureus Mu50
augacuaacgaaa

SEQ ID NO: 3990916 - RNA, 19 nt, Staphylococcus aureus subsp. aureus Mu50
augacuacaacuuaagagu

SEQ ID NO: 3990917 - RNA, 23 nt, Staphylococcus aureus subsp. aureus Mu50
augacuaugcaaaugaaauucuu

SEQ ID NO: 3990918 - RNA, 14 nt, Staphylococcus aureus subsp. aureus Mu50
augacuauuuucca

SEQ ID NO: 3990919 - RNA, 16 nt, Staphylococcus aureus subsp. aureus Mu50
augauuauauuuucuc

SEQ ID NO: 3990920 - RNA, 18 nt, Staphylococcus aureus subsp. aureus Mu50
augauuauucucuuuauu

SEQ ID NO: 3990921 - RNA, 23 nt, Staphylococcus aureus subsp. aureus Mu50
augauucguauucaaaguuuuca

SEQ ID NO: 3990922 - RNA, 15 nt, Staphylococcus aureus subsp. aureus Mu50
augauugaaauccuu

SEQ ID NO: 3990923 - RNA, 16 nt, Staphylococcus aureus subsp. aureus Mu50
augauugcauugauuu

SEQ ID NO: 3990924 - RNA, 14 nt, Staphylococcus aureus subsp. aureus Mu50
augauugcuuauuu

SEQ ID NO: 3990925 - RNA, 22 nt, Staphylococcus aureus subsp. aureus Mu50
augauuggcagugaucuuuuuu

SEQ ID NO: 3990926 - RNA, 20 nt, Staphylococcus aureus subsp. aureus Mu50
augauuggcuugaaguuguu

SEQ ID NO: 3990927 - RNA, 21 nt, Staphylococcus aureus subsp. aureus Mu50
augauugguauacaguuuuac

SEQ ID NO: 3990928 - RNA, 21 nt, Staphylococcus aureus subsp. aureus Mu50
augauuguuuaagaauguaca

SEQ ID NO: 3990929 - RNA, 13 nt, Staphylococcus aureus subsp. aureus Mu50
augauuguuuuaa

SEQ ID NO: 3990930 - RNA, 18 nt, Staphylococcus aureus subsp. aureus Mu50
augauuuaaguuuauaau

SEQ ID NO: 3990931 - RNA, 15 nt, Staphylococcus aureus subsp. aureus Mu50
augauuuauaaaaaa

SEQ ID NO: 3990932 - RNA, 15 nt, Staphylococcus aureus subsp. aureus Mu50
augauuuauaaaaac

SEQ ID NO: 3990933 - RNA, 23 nt, Staphylococcus aureus subsp. aureus Mu50
augauuugauuuggguaauguuu

SEQ ID NO: 3990934 - RNA, 20 nt, Staphylococcus aureus subsp. aureus Mu50
augauuugccccgccauuca

SEQ ID NO: 3990935 - RNA, 18 nt, Staphylococcus aureus subsp. aureus Mu50
augauuugugguaaucau

SEQ ID NO: 3990936 - RNA, 13 nt, Staphylococcus aureus subsp. aureus Mu50
augauuuugcuuu

SEQ ID NO: 3990937 - RNA, 17 nt, Staphylococcus aureus subsp. aureus Mu50
augauuuugcuuuauuu

SEQ ID NO: 3990938 - RNA, 18 nt, Staphylococcus aureus subsp. aureus Mu50
augauuuuuaaaaauaca

SEQ ID NO: 3990939 - RNA, 14 nt, Staphylococcus aureus subsp. aureus Mu50
augauuuuucauca

SEQ ID NO: 3990940 - RNA, 18 nt, Staphylococcus aureus subsp. aureus Mu50
augcaaaacuaaucaaau

SEQ ID NO: 3990941 - RNA, 14 nt, Staphylococcus aureus subsp. aureus Mu50
augcaaaauaauac

SEQ ID NO: 3990942 - RNA, 21 nt, Staphylococcus aureus subsp. aureus Mu50
augcaaaucaaauacaucaau

SEQ ID NO: 3990943 - RNA, 22 nt, Staphylococcus aureus subsp. aureus Mu50
augcaaaucaaauacaucaauu

SEQ ID NO: 3990944 - RNA, 17 nt, Staphylococcus aureus subsp. aureus Mu50
augcaacuaaaacuauc

SEQ ID NO: 3990945 - RNA, 19 nt, Staphylococcus aureus subsp. aureus Mu50
augcaacuuauaauauuaa

SEQ ID NO: 3990946 - RNA, 16 nt, Staphylococcus aureus subsp. aureus Mu50
augcaacuugaucauu

SEQ ID NO: 3990947 - RNA, 19 nt, Staphylococcus aureus subsp. aureus Mu50
augcaagcgacgauuggaa

SEQ ID NO: 3990948 - RNA, 14 nt, Staphylococcus aureus subsp. aureus Mu50
augcaauacauuaa

SEQ ID NO: 3990949 - RNA, 19 nt, Staphylococcus aureus subsp. aureus Mu50
augcaauacauuaauauaa

SEQ ID NO: 3990950 - RNA, 22 nt, Staphylococcus aureus subsp. aureus Mu50
augcaauugguagucaucacga

SEQ ID NO: 3990951 - RNA, 22 nt, Staphylococcus aureus subsp. aureus Mu50
augcaauuuuucacuuauaaca

SEQ ID NO: 3990952 - RNA, 12 nt, Staphylococcus aureus subsp. aureus Mu50
augcacaauauu

SEQ ID NO: 3990953 - RNA, 20 nt, Staphylococcus aureus subsp. aureus Mu50
augcacaucauugauagaua

SEQ ID NO: 3990954 - RNA, 17 nt, Staphylococcus aureus subsp. aureus Mu50
augcaccuuuacaacau

SEQ ID NO: 3990955 - RNA, 18 nt, Staphylococcus aureus subsp. aureus Mu50
augcaccuuuacaacaua

SEQ ID NO: 3990956 - RNA, 19 nt, Staphylococcus aureus subsp. aureus Mu50
augcaccuuuacaacauac

SEQ ID NO: 3990957 - RNA, 21 nt, Staphylococcus aureus subsp. aureus Mu50
augcaccuuuacaacauacau

SEQ ID NO: 3990958 - RNA, 21 nt, Staphylococcus aureus subsp. aureus Mu50
augcacgcgugccaacaucuu

SEQ ID NO: 3990959 - RNA, 14 nt, Staphylococcus aureus subsp. aureus Mu50
augcacuuuauuaa

SEQ ID NO: 3990960 - RNA, 21 nt, Staphylococcus aureus subsp. aureus Mu50
augcacuuuauuaaaaauccu

SEQ ID NO: 3990961 - RNA, 15 nt, Staphylococcus aureus subsp. aureus Mu50
augcacuuuuuuuaa

SEQ ID NO: 3990962 - RNA, 14 nt, Staphylococcus aureus subsp. aureus Mu50
augcagauucuuca

SEQ ID NO: 3990963 - RNA, 13 nt, Staphylococcus aureus subsp. aureus Mu50
augcagcuguauu

SEQ ID NO: 3990964 - RNA, 20 nt, Staphylococcus aureus subsp. aureus Mu50
augcaguaaaaccaaaucgu

SEQ ID NO: 3990965 - RNA, 13 nt, Staphylococcus aureus subsp. aureus Mu50
augcauaaaaaaa

SEQ ID NO: 3990966 - RNA, 20 nt, Staphylococcus aureus subsp. aureus Mu50
augcauaauaccaauugcuu

SEQ ID NO: 3990967 - RNA, 12 nt, Staphylococcus aureus subsp. aureus Mu50
augcauaauuag

SEQ ID NO: 3990968 - RNA, 21 nt, Staphylococcus aureus subsp. aureus Mu50
augcauaauuaggauuaacau

SEQ ID NO: 3990969 - RNA, 21 nt, Staphylococcus aureus subsp. aureus Mu50
augcauacacuugauuaucau

SEQ ID NO: 3990970 - RNA, 14 nt, Staphylococcus aureus subsp. aureus Mu50
augcauauauugag

SEQ ID NO: 3990971 - RNA, 17 nt, Staphylococcus aureus subsp. aureus Mu50
augcauauguaauacaa

SEQ ID NO: 3990972 - RNA, 21 nt, Staphylococcus aureus subsp. aureus Mu50
augcaucaacagauacuucag

SEQ ID NO: 3990973 - RNA, 22 nt, Staphylococcus aureus subsp. aureus Mu50
augcauccaaauauuaaaaaca

SEQ ID NO: 3990974 - RNA, 21 nt, Staphylococcus aureus subsp. aureus Mu50
augcaugccagaugcaaugau

SEQ ID NO: 3990975 - RNA, 21 nt, Staphylococcus aureus subsp. aureus Mu50
augcaugcgcaaaagcgcagg

SEQ ID NO: 3990976 - RNA, 16 nt, Staphylococcus aureus subsp. aureus Mu50
augcauggaaaagugc

SEQ ID NO: 3990977 - RNA, 12 nt, Staphylococcus aureus subsp. aureus Mu50
augccaaauaac

SEQ ID NO: 3990978 - RNA, 23 nt, Staphylococcus aureus subsp. aureus Mu50
augccaaauaacguuaauauaau

SEQ ID NO: 3990979 - RNA, 21 nt, Staphylococcus aureus subsp. aureus Mu50
augccaauggaaguuuuuuag

SEQ ID NO: 3990980 - RNA, 18 nt, Staphylococcus aureus subsp. aureus Mu50
augccagaugcaaugaua

SEQ ID NO: 3990981 - RNA, 21 nt, Staphylococcus aureus subsp. aureus Mu50
augccaucuuuguaaccuaaa

SEQ ID NO: 3990982 - RNA, 16 nt, Staphylococcus aureus subsp. aureus Mu50
augccauuguuaucca

SEQ ID NO: 3990983 - RNA, 19 nt, Staphylococcus aureus subsp. aureus Mu50
augcccaaccacgauaucu

SEQ ID NO: 3990984 - RNA, 23 nt, Staphylococcus aureus subsp. aureus Mu50
augcccgauaaaaccaccuacca

SEQ ID NO: 3990985 - RNA, 20 nt, Staphylococcus aureus subsp. aureus Mu50
augcccuagguuuauauauc

SEQ ID NO: 3990986 - RNA, 15 nt, Staphylococcus aureus subsp. aureus Mu50
augcccuuaaagcac

SEQ ID NO: 3990987 - RNA, 14 nt, Staphylococcus aureus subsp. aureus Mu50
augccgagauuauu

SEQ ID NO: 3990988 - RNA, 17 nt, Staphylococcus aureus subsp. aureus Mu50
augccgccuaauaauaa

SEQ ID NO: 3990989 - RNA, 20 nt, Staphylococcus aureus subsp. aureus Mu50
augccgcuucuaauuuuuca

SEQ ID NO: 3990990 - RNA, 16 nt, Staphylococcus aureus subsp. aureus Mu50
augccguaguuuucuc

SEQ ID NO: 3990991 - RNA, 23 nt, Staphylococcus aureus subsp. aureus Mu50
augccugcccuuuagucauguuu

SEQ ID NO: 3990992 - RNA, 19 nt, Staphylococcus aureus subsp. aureus Mu50
augccuugucuauuguaaa

SEQ ID NO: 3990993 - RNA, 17 nt, Staphylococcus aureus subsp. aureus Mu50
augccuuugauuuuacu

SEQ ID NO: 3990994 - RNA, 22 nt, Staphylococcus aureus subsp. aureus Mu50
augcgaggguuuucuuaauuau

SEQ ID NO: 3990995 - RNA, 16 nt, Staphylococcus aureus subsp. aureus Mu50
augcgauucucauuua

SEQ ID NO: 3990996 - RNA, 15 nt, Staphylococcus aureus subsp. aureus Mu50
augcgauugaugcgu

SEQ ID NO: 3990997 - RNA, 13 nt, Staphylococcus aureus subsp. aureus Mu50
augcgcaaaagcg

SEQ ID NO: 3990998 - RNA, 16 nt, Staphylococcus aureus subsp. aureus Mu50
augcgcaaaagcgcag

SEQ ID NO: 3990999 - RNA, 18 nt, Staphylococcus aureus subsp. aureus Mu50
augcgcaaaagcgcaggc

SEQ ID NO: 3991000 - RNA, 19 nt, Staphylococcus aureus subsp. aureus Mu50
augcgcaaaagcgcaggcg

SEQ ID NO: 3991001 - RNA, 17 nt, Staphylococcus aureus subsp. aureus Mu50
augcgcuuguaacaagc

SEQ ID NO: 3991002 - RNA, 15 nt, Staphylococcus aureus subsp. aureus Mu50
augcguagcaacauu

SEQ ID NO: 3991003 - RNA, 23 nt, Staphylococcus aureus subsp. aureus Mu50
augcgucguagauugauucuaca

SEQ ID NO: 3991004 - RNA, 12 nt, Staphylococcus aureus subsp. aureus Mu50
augcuaauguaa

SEQ ID NO: 3991005 - RNA, 14 nt, Staphylococcus aureus subsp. aureus Mu50
augcuaauuuaacu

SEQ ID NO: 3991006 - RNA, 13 nt, Staphylococcus aureus subsp. aureus Mu50
augguuaucacuu

SEQ ID NO: 3991007 - RNA, 21 nt, Staphylococcus aureus subsp. aureus Mu50
augguuaucacuuauuauuuu

SEQ ID NO: 3991008 - RNA, 16 nt, Staphylococcus aureus subsp. aureus Mu50
augguuccaaguauuu

SEQ ID NO: 3991009 - RNA, 17 nt, Staphylococcus aureus subsp. aureus Mu50
augguucguccauucaa

SEQ ID NO: 3991010 - RNA, 17 nt, Staphylococcus aureus subsp. aureus Mu50
augguucuauaauaaau

SEQ ID NO: 3991011 - RNA, 20 nt, Staphylococcus aureus subsp. aureus Mu50
augguugaauaacacuagaa

SEQ ID NO: 3991012 - RNA, 19 nt, Staphylococcus aureus subsp. aureus Mu50
augguuuaauucaggaaau

SEQ ID NO: 3991013 - RNA, 14 nt, Staphylococcus aureus subsp. aureus Mu50
augguuucauaaac

SEQ ID NO: 3991014 - RNA, 15 nt, Staphylococcus aureus subsp. aureus Mu50
augguuucauaaacu

SEQ ID NO: 3991015 - RNA, 14 nt, Staphylococcus aureus subsp. aureus Mu50
augguuugaguaaa

SEQ ID NO: 3991016 - RNA, 22 nt, Staphylococcus aureus subsp. aureus Mu50
augguuuuguuuugcucuuuaa

SEQ ID NO: 3991017 - RNA, 20 nt, Staphylococcus aureus subsp. aureus Mu50
auguaaaaaauaucuuguca

SEQ ID NO: 3991018 - RNA, 13 nt, Staphylococcus aureus subsp. aureus Mu50
auguaaaauuauu

SEQ ID NO: 3991019 - RNA, 19 nt, Staphylococcus aureus subsp. aureus Mu50
auguaaagaguacagcggu

SEQ ID NO: 3991020 - RNA, 19 nt, Staphylococcus aureus subsp. aureus Mu50
auguaaagccaccuaaauc

SEQ ID NO: 3991021 - RNA, 14 nt, Staphylococcus aureus subsp. aureus Mu50
auguaaagcuaauu

SEQ ID NO: 3991022 - RNA, 15 nt, Staphylococcus aureus subsp. aureus Mu50
auguaaaguugauaa

SEQ ID NO: 3991023 - RNA, 15 nt, Staphylococcus aureus subsp. aureus Mu50
auguaaauaaaaauu

SEQ ID NO: 3991024 - RNA, 16 nt, Staphylococcus aureus subsp. aureus Mu50
auguaaauaaaaauua

SEQ ID NO: 3991025 - RNA, 18 nt, Staphylococcus aureus subsp. aureus Mu50
auguaaauaaaaauuaua

SEQ ID NO: 3991026 - RNA, 19 nt, Staphylococcus aureus subsp. aureus Mu50
auguaaauaaaaauuauau

SEQ ID NO: 3991027 - RNA, 22 nt, Staphylococcus aureus subsp. aureus Mu50
auguaaaucgugcuguuaucau

SEQ ID NO: 3991028 - RNA, 23 nt, Staphylococcus aureus subsp. aureus Mu50
auguaaaucgugcuguuaucaug

SEQ ID NO: 3991029 - RNA, 18 nt, Staphylococcus aureus subsp. aureus Mu50
auguaacguuucuuugua

SEQ ID NO: 3991030 - RNA, 17 nt, Staphylococcus aureus subsp. aureus Mu50
auguaacuuuagacaua

SEQ ID NO: 3991031 - RNA, 15 nt, Staphylococcus aureus subsp. aureus Mu50
auguaagaacgaaac

SEQ ID NO: 3991032 - RNA, 21 nt, Staphylococcus aureus subsp. aureus Mu50
auguaagaacgaaacuuuaau

SEQ ID NO: 3991033 - RNA, 19 nt, Staphylococcus aureus subsp. aureus Mu50
auguaagcaacauaugauu

SEQ ID NO: 3991034 - RNA, 18 nt, Staphylococcus aureus subsp. aureus Mu50
auguaauagagaagggag

SEQ ID NO: 3991035 - RNA, 15 nt, Staphylococcus aureus subsp. aureus Mu50
auguaaucagguuua

SEQ ID NO: 3991036 - RNA, 17 nt, Staphylococcus aureus subsp. aureus Mu50
auguaaucauuauagca

SEQ ID NO: 3991037 - RNA, 12 nt, Staphylococcus aureus subsp. aureus Mu50
auguaauuauuu

SEQ ID NO: 3991038 - RNA, 13 nt, Staphylococcus aureus subsp. aureus Mu50
auguaauuauuuu

SEQ ID NO: 3991039 - RNA, 16 nt, Staphylococcus aureus subsp. aureus Mu50
auguaauuauuuuucu

SEQ ID NO: 3991040 - RNA, 15 nt, Staphylococcus aureus subsp. aureus Mu50
auguaauuguuuuuu

SEQ ID NO: 3991041 - RNA, 22 nt, Staphylococcus aureus subsp. aureus Mu50
auguaauuguuuuuucuuauuu

SEQ ID NO: 3991042 - RNA, 21 nt, Staphylococcus aureus subsp. aureus Mu50
auguacaaccuuugcuuaaac

SEQ ID NO: 3991043 - RNA, 13 nt, Staphylococcus aureus subsp. aureus Mu50
auguacaauaauu

SEQ ID NO: 3991044 - RNA, 14 nt, Staphylococcus aureus subsp. aureus Mu50
auguacaauuuuuu

SEQ ID NO: 3991045 - RNA, 20 nt, Staphylococcus aureus subsp. aureus Mu50
auguacacgagucauuaaau

SEQ ID NO: 3991046 - RNA, 22 nt, Staphylococcus aureus subsp. aureus Mu50
auguacacuuuugauuguuuaa

SEQ ID NO: 3991047 - RNA, 23 nt, Staphylococcus aureus subsp. aureus Mu50
auguacacuuuugauuguuuaaa

SEQ ID NO: 3991048 - RNA, 15 nt, Staphylococcus aureus subsp. aureus Mu50
auguacauguauaaa

SEQ ID NO: 3991049 - RNA, 17 nt, Staphylococcus aureus subsp. aureus Mu50
auguacauguauaaaag

SEQ ID NO: 3991050 - RNA, 18 nt, Staphylococcus aureus subsp. aureus Mu50
auguacauuguaaauaua

SEQ ID NO: 3991051 - RNA, 15 nt, Staphylococcus aureus subsp. aureus Mu50
auguaccgaauccuu

SEQ ID NO: 3991052 - RNA, 16 nt, Staphylococcus aureus subsp. aureus Mu50
auguacguuuuuuuaa

SEQ ID NO: 3991053 - RNA, 18 nt, Staphylococcus aureus subsp. aureus Mu50
auguacguuuuuuuaaau

SEQ ID NO: 3991054 - RNA, 19 nt, Staphylococcus aureus subsp. aureus Mu50
auguacguuuuuuuaaaua

SEQ ID NO: 3991055 - RNA, 23 nt, Staphylococcus aureus subsp. aureus Mu50
auguacguuuuuuuaaauacaua

SEQ ID NO: 3991056 - RNA, 15 nt, Staphylococcus aureus subsp. aureus Mu50
auguacuaggaccua

SEQ ID NO: 3991057 - RNA, 21 nt, Staphylococcus aureus subsp. aureus Mu50
auguacuaggaccuacaauuu

SEQ ID NO: 3991058 - RNA, 13 nt, Staphylococcus aureus subsp. aureus Mu50
auguagcuuugug

SEQ ID NO: 3991059 - RNA, 22 nt, Staphylococcus aureus subsp. aureus Mu50
auguagugaaagucguuguuga

SEQ ID NO: 3991060 - RNA, 12 nt, Staphylococcus aureus subsp. aureus Mu50
auguauaaaaag

SEQ ID NO: 3991061 - RNA, 14 nt, Staphylococcus aureus subsp. aureus Mu50
auguauaaaaagug

SEQ ID NO: 3991062 - RNA, 16 nt, Staphylococcus aureus subsp. aureus Mu50
auguauaaaacuaauu

SEQ ID NO: 3991063 - RNA, 21 nt, Staphylococcus aureus subsp. aureus Mu50
auguauaugaauuuuauaaau

SEQ ID NO: 3991064 - RNA, 18 nt, Staphylococcus aureus subsp. aureus Mu50
auguauauggcaucauca

SEQ ID NO: 3991065 - RNA, 17 nt, Staphylococcus aureus subsp. aureus Mu50
auguaucaagaucaaca

SEQ ID NO: 3991066 - RNA, 14 nt, Staphylococcus aureus subsp. aureus Mu50
auguaucuauacaa

SEQ ID NO: 3991067 - RNA, 23 nt, Staphylococcus aureus subsp. aureus Mu50
auguaugaaaggaguauuuuugc

SEQ ID NO: 3991068 - RNA, 13 nt, Staphylococcus aureus subsp. aureus Mu50
auguaugcuugua

SEQ ID NO: 3991069 - RNA, 21 nt, Staphylococcus aureus subsp. aureus Mu50
auguaugcuuguacaaaaaau

SEQ ID NO: 3991070 - RNA, 12 nt, Staphylococcus aureus subsp. aureus Mu50
auguaugugagu

SEQ ID NO: 3991071 - RNA, 17 nt, Staphylococcus aureus subsp. aureus Mu50
auguaugugaguaauga

SEQ ID NO: 3991072 - RNA, 20 nt, Staphylococcus aureus subsp. aureus Mu50
auguauguuuuaucaauauu

SEQ ID NO: 3991073 - RNA, 23 nt, Staphylococcus aureus subsp. aureus Mu50
auguauuaauugaauugauuaua

SEQ ID NO: 3991074 - RNA, 17 nt, Staphylococcus aureus subsp. aureus Mu50
auguauucuuagauauu

SEQ ID NO: 3991075 - RNA, 13 nt, Staphylococcus aureus subsp. aureus Mu50
auguauugcuaua

SEQ ID NO: 3991076 - RNA, 14 nt, Staphylococcus aureus subsp. aureus Mu50
auguauuuauuacu

SEQ ID NO: 3991077 - RNA, 20 nt, Staphylococcus aureus subsp. aureus Mu50
auguauuuuuacuuuuauaa

SEQ ID NO: 3991078 - RNA, 14 nt, Staphylococcus aureus subsp. aureus Mu50
auguauuuuuauuu

SEQ ID NO: 3991079 - RNA, 17 nt, Staphylococcus aureus subsp. aureus Mu50
auguauuuuuauuuaua

SEQ ID NO: 3991080 - RNA, 20 nt, Staphylococcus aureus subsp. aureus Mu50
augucaaaucggcuauacau

SEQ ID NO: 3991081 - RNA, 24 nt, Staphylococcus aureus subsp. aureus Mu50
augucaaaucggcuauacauugau

SEQ ID NO: 3991082 - RNA, 19 nt, Staphylococcus aureus subsp. aureus Mu50
augucaauagcgguuuaaa

SEQ ID NO: 3991083 - RNA, 23 nt, Staphylococcus aureus subsp. aureus Mu50
augucaauagcgguuuaaaaaug

SEQ ID NO: 3991084 - RNA, 14 nt, Staphylococcus aureus subsp. aureus Mu50
augucacauaugac

SEQ ID NO: 3991085 - RNA, 20 nt, Staphylococcus aureus subsp. aureus Mu50
augucacauaugacuuuauu

SEQ ID NO: 3991086 - RNA, 18 nt, Staphylococcus aureus subsp. aureus Mu50
augucacugcaaacacag

SEQ ID NO: 3991087 - RNA, 23 nt, Staphylococcus aureus subsp. aureus Mu50
augucacugcaaacacaguacaa

SEQ ID NO: 3991088 - RNA, 20 nt, Staphylococcus aureus subsp. aureus Mu50
augucacuguuaaagauguc

SEQ ID NO: 3991089 - RNA, 21 nt, Staphylococcus aureus subsp. aureus Mu50
augucagucguuguaaaacua

SEQ ID NO: 3991090 - RNA, 20 nt, Staphylococcus aureus subsp. aureus Mu50
augucauagacuacgcgauu

SEQ ID NO: 3991091 - RNA, 21 nt, Staphylococcus aureus subsp. aureus Mu50
augucauagccuauuuaaaag

SEQ ID NO: 3991092 - RNA, 17 nt, Staphylococcus aureus subsp. aureus Mu50
augucauaucuuuauuu

SEQ ID NO: 3991093 - RNA, 20 nt, Staphylococcus aureus subsp. aureus Mu50
auguuuaauuugauuaaauu

SEQ ID NO: 3991094 - RNA, 14 nt, Staphylococcus aureus subsp. aureus Mu50
auguuuaauuuucu

SEQ ID NO: 3991095 - RNA, 13 nt, Staphylococcus aureus subsp. aureus Mu50
auguuucaaaaua

SEQ ID NO: 3991096 - RNA, 20 nt, Staphylococcus aureus subsp. aureus Mu50
auguuucauaugcaucaaca

SEQ ID NO: 3991097 - RNA, 13 nt, Staphylococcus aureus subsp. aureus Mu50
auguuuccauuua

SEQ ID NO: 3991098 - RNA, 17 nt, Staphylococcus aureus subsp. aureus Mu50
auguuuccauuuauuaa

SEQ ID NO: 3991099 - RNA, 18 nt, Staphylococcus aureus subsp. aureus Mu50
auguuucuucaauugucu

SEQ ID NO: 3991100 - RNA, 14 nt, Staphylococcus aureus subsp. aureus Mu50
auguuucuuuauua

SEQ ID NO: 3991101 - RNA, 22 nt, Staphylococcus aureus subsp. aureus Mu50
auguuugaugauucguauucaa

SEQ ID NO: 3991102 - RNA, 15 nt, Staphylococcus aureus subsp. aureus Mu50
auguuugauucuaaa

SEQ ID NO: 3991103 - RNA, 11 nt, Staphylococcus aureus subsp. aureus Mu50
auguuugauuu

SEQ ID NO: 3991104 - RNA, 21 nt, Staphylococcus aureus subsp. aureus Mu50
auguuugcauaccuauaaaca

SEQ ID NO: 3991105 - RNA, 19 nt, Staphylococcus aureus subsp. aureus Mu50
auguuugccagguaaaaau

SEQ ID NO: 3991106 - RNA, 21 nt, Staphylococcus aureus subsp. aureus Mu50
auguuugccagguaaaaaucg

SEQ ID NO: 3991107 - RNA, 22 nt, Staphylococcus aureus subsp. aureus Mu50
auguuugggauauagaaaaggg

SEQ ID NO: 3991108 - RNA, 23 nt, Staphylococcus aureus subsp. aureus Mu50
auguuugggauauagaaaaggga

SEQ ID NO: 3991109 - RNA, 18 nt, Staphylococcus aureus subsp. aureus Mu50
auguuuguaaaucaagug

SEQ ID NO: 3991110 - RNA, 21 nt, Staphylococcus aureus subsp. aureus Mu50
auguuuuagugacaaacauuu

SEQ ID NO: 3991111 - RNA, 21 nt, Staphylococcus aureus subsp. aureus Mu50
auguuuuauaauaaaugucac

SEQ ID NO: 3991112 - RNA, 13 nt, Staphylococcus aureus subsp. aureus Mu50
auguuuucuaaau

SEQ ID NO: 3991113 - RNA, 16 nt, Staphylococcus aureus subsp. aureus Mu50
auguuuucuaaaucua

SEQ ID NO: 3991114 - RNA, 16 nt, Staphylococcus aureus subsp. aureus Mu50
auguuuucuauaauau

SEQ ID NO: 3991115 - RNA, 21 nt, Staphylococcus aureus subsp. aureus Mu50
auguuuuuaacagcuuuuucu

SEQ ID NO: 3991116 - RNA, 15 nt, Staphylococcus aureus subsp. aureus Mu50
auguuuuuuaaguac

SEQ ID NO: 3991117 - RNA, 14 nt, Staphylococcus aureus subsp. aureus Mu50
auuaaaaaaagauu

SEQ ID NO: 3991118 - RNA, 16 nt, Staphylococcus aureus subsp. aureus Mu50
auuaaaaaacaauaaa

SEQ ID NO: 3991119 - RNA, 19 nt, Staphylococcus aureus subsp. aureus Mu50
auuaaaaaacaauaaaauu

SEQ ID NO: 3991120 - RNA, 22 nt, Staphylococcus aureus subsp. aureus Mu50
auuaaaaaacaauaaaauuacu

SEQ ID NO: 3991121 - RNA, 12 nt, Staphylococcus aureus subsp. aureus Mu50
auuaaaaaagaa

SEQ ID NO: 3991122 - RNA, 18 nt, Staphylococcus aureus subsp. aureus Mu50
auuaaaaagguacuaaug

SEQ ID NO: 3991123 - RNA, 17 nt, Staphylococcus aureus subsp. aureus Mu50
auuaaaaauuucaauaa

SEQ ID NO: 3991124 - RNA, 18 nt, Staphylococcus aureus subsp. aureus Mu50
auuaaaacagcaaauaaa

SEQ ID NO: 3991125 - RNA, 23 nt, Staphylococcus aureus subsp. aureus Mu50
auuaaaacgaaguuauuuauuca

SEQ ID NO: 3991126 - RNA, 18 nt, Staphylococcus aureus subsp. aureus Mu50
auuaaaacuauaauaaag

SEQ ID NO: 3991127 - RNA, 22 nt, Staphylococcus aureus subsp. aureus Mu50
auuaaaaggaugugacaaauac

SEQ ID NO: 3991128 - RNA, 15 nt, Staphylococcus aureus subsp. aureus Mu50
auuaaaauaauuaaa

SEQ ID NO: 3991129 - RNA, 12 nt, Staphylococcus aureus subsp. aureus Mu50
auuaaaauagag

SEQ ID NO: 3991130 - RNA, 13 nt, Staphylococcus aureus subsp. aureus Mu50
auuaaaauagagu

SEQ ID NO: 3991131 - RNA, 15 nt, Staphylococcus aureus subsp. aureus Mu50
auuaaaauaugacac

SEQ ID NO: 3991132 - RNA, 14 nt, Staphylococcus aureus subsp. aureus Mu50
auuaaaaucugcuu

SEQ ID NO: 3991133 - RNA, 21 nt, Staphylococcus aureus subsp. aureus Mu50
auuaaaaugauaucugacauu

SEQ ID NO: 3991134 - RNA, 18 nt, Staphylococcus aureus subsp. aureus Mu50
auuaaaauguuaauaaug

SEQ ID NO: 3991135 - RNA, 21 nt, Staphylococcus aureus subsp. aureus Mu50
auuaaaauuacgguuugcuuu

SEQ ID NO: 3991136 - RNA, 15 nt, Staphylococcus aureus subsp. aureus Mu50
auuaaacauuuagau

SEQ ID NO: 3991137 - RNA, 21 nt, Staphylococcus aureus subsp. aureus Mu50
auuaaacauuuagauuucaug

SEQ ID NO: 3991138 - RNA, 16 nt, Staphylococcus aureus subsp. aureus Mu50
auuaaaccacuuuuuu

SEQ ID NO: 3991139 - RNA, 20 nt, Staphylococcus aureus subsp. aureus Mu50
auuaaaccgcacuucuauau

SEQ ID NO: 3991140 - RNA, 23 nt, Staphylococcus aureus subsp. aureus Mu50
auuaaaccuacaacgaagaaucc

SEQ ID NO: 3991141 - RNA, 19 nt, Staphylococcus aureus subsp. aureus Mu50
auuaaacgcucaacuauau

SEQ ID NO: 3991142 - RNA, 17 nt, Staphylococcus aureus subsp. aureus Mu50
auuaaacuguuuguuua

SEQ ID NO: 3991143 - RNA, 20 nt, Staphylococcus aureus subsp. aureus Mu50
auuaaacuuaagaauacaug

SEQ ID NO: 3991144 - RNA, 15 nt, Staphylococcus aureus subsp. aureus Mu50
auuaaacuuauaacu

SEQ ID NO: 3991145 - RNA, 17 nt, Staphylococcus aureus subsp. aureus Mu50
auuaaacuuauaacuuu

SEQ ID NO: 3991146 - RNA, 19 nt, Staphylococcus aureus subsp. aureus Mu50
auuaaacuuauaacuuuau

SEQ ID NO: 3991147 - RNA, 17 nt, Staphylococcus aureus subsp. aureus Mu50
auuaaacuuccuuuuuu

SEQ ID NO: 3991148 - RNA, 16 nt, Staphylococcus aureus subsp. aureus Mu50
auuaaagcaaauuaua

SEQ ID NO: 3991149 - RNA, 18 nt, Staphylococcus aureus subsp. aureus Mu50
auuaaagcaucgaacaau

SEQ ID NO: 3991150 - RNA, 15 nt, Staphylococcus aureus subsp. aureus Mu50
auuaaagcgauaaua

SEQ ID NO: 3991151 - RNA, 23 nt, Staphylococcus aureus subsp. aureus Mu50
auuaaagcgauaauagauaccau

SEQ ID NO: 3991152 - RNA, 20 nt, Staphylococcus aureus subsp. aureus Mu50
auuaaagcuagaaacaaugc

SEQ ID NO: 3991153 - RNA, 21 nt, Staphylococcus aureus subsp. aureus Mu50
auuaaaggaaaucaauccauc

SEQ ID NO: 3991154 - RNA, 18 nt, Staphylococcus aureus subsp. aureus Mu50
auuaaagucaauuuaaau

SEQ ID NO: 3991155 - RNA, 18 nt, Staphylococcus aureus subsp. aureus Mu50
auuaaaguguuucaacau

SEQ ID NO: 3991156 - RNA, 16 nt, Staphylococcus aureus subsp. aureus Mu50
auuaaaguuaaagacu

SEQ ID NO: 3991157 - RNA, 15 nt, Staphylococcus aureus subsp. aureus Mu50
auuaaauaacuuuuu

SEQ ID NO: 3991158 - RNA, 16 nt, Staphylococcus aureus subsp. aureus Mu50
auuaaauaagaugaaa

SEQ ID NO: 3991159 - RNA, 11 nt, Staphylococcus aureus subsp. aureus Mu50
auuaaauagau

SEQ ID NO: 3991160 - RNA, 19 nt, Staphylococcus aureus subsp. aureus Mu50
auuaaauauuuagauuggu

SEQ ID NO: 3991161 - RNA, 22 nt, Staphylococcus aureus subsp. aureus Mu50
auuaaauccgcuuguucaacua

SEQ ID NO: 3991162 - RNA, 23 nt, Staphylococcus aureus subsp. aureus Mu50
auuaaauccgcuuguucaacuaa

SEQ ID NO: 3991163 - RNA, 19 nt, Staphylococcus aureus subsp. aureus Mu50
auuaaaucgauuaagaaug

SEQ ID NO: 3991164 - RNA, 20 nt, Staphylococcus aureus subsp. aureus Mu50
auuaaaucuucuaguaauuc

SEQ ID NO: 3991165 - RNA, 19 nt, Staphylococcus aureus subsp. aureus Mu50
auuaaaugaugcaguaaaa

SEQ ID NO: 3991166 - RNA, 22 nt, Staphylococcus aureus subsp. aureus Mu50
auuaaaugaugcaguaaaacca

SEQ ID NO: 3991167 - RNA, 12 nt, Staphylococcus aureus subsp. aureus Mu50
auuaaaugcaau

SEQ ID NO: 3991168 - RNA, 14 nt, Staphylococcus aureus subsp. aureus Mu50
auuaaauguacauu

SEQ ID NO: 3991169 - RNA, 19 nt, Staphylococcus aureus subsp. aureus Mu50
auuaaauguacauuguaaa

SEQ ID NO: 3991170 - RNA, 19 nt, Staphylococcus aureus subsp. aureus Mu50
auuaaauuauauguuuuua

SEQ ID NO: 3991171 - RNA, 20 nt, Staphylococcus aureus subsp. aureus Mu50
auuaaauuauggagcggaag

SEQ ID NO: 3991172 - RNA, 21 nt, Staphylococcus aureus subsp. aureus Mu50
auuaaauucaucuugcaagua

SEQ ID NO: 3991173 - RNA, 22 nt, Staphylococcus aureus subsp. aureus Mu50
auuaaauucuuuucaagaaauu

SEQ ID NO: 3991174 - RNA, 23 nt, Staphylococcus aureus subsp. aureus Mu50
auuaaauugcuugaaauuauuau

SEQ ID NO: 3991175 - RNA, 19 nt, Staphylococcus aureus subsp. aureus Mu50
auuaaauuuuguauaaccu

SEQ ID NO: 3991176 - RNA, 14 nt, Staphylococcus aureus subsp. aureus Mu50
auuaaauuuuguua

SEQ ID NO: 3991177 - RNA, 16 nt, Staphylococcus aureus subsp. aureus Mu50
auuaacaacaaauaua

SEQ ID NO: 3991178 - RNA, 20 nt, Staphylococcus aureus subsp. aureus Mu50
auuaacaacaaauauaaugu

SEQ ID NO: 3991179 - RNA, 16 nt, Staphylococcus aureus subsp. aureus Mu50
auuaacaacuuuauua

SEQ ID NO: 3991180 - RNA, 14 nt, Staphylococcus aureus subsp. aureus Mu50
auuacauaauuuau

SEQ ID NO: 3991181 - RNA, 18 nt, Staphylococcus aureus subsp. aureus Mu50
auuacauauaagauagau

SEQ ID NO: 3991182 - RNA, 16 nt, Staphylococcus aureus subsp. aureus Mu50
auuacaucuauauuug

SEQ ID NO: 3991183 - RNA, 18 nt, Staphylococcus aureus subsp. aureus Mu50
auuacaucuauauuuguu

SEQ ID NO: 3991184 - RNA, 23 nt, Staphylococcus aureus subsp. aureus Mu50
auuacaugcaccuuuacaacaua

SEQ ID NO: 3991185 - RNA, 14 nt, Staphylococcus aureus subsp. aureus Mu50
auuacauuuuaugu

SEQ ID NO: 3991186 - RNA, 18 nt, Staphylococcus aureus subsp. aureus Mu50
auuaccauaacuuuauau

SEQ ID NO: 3991187 - RNA, 13 nt, Staphylococcus aureus subsp. aureus Mu50
auuaccauauaaa

SEQ ID NO: 3991188 - RNA, 15 nt, Staphylococcus aureus subsp. aureus Mu50
auuaccauauaaagc

SEQ ID NO: 3991189 - RNA, 19 nt, Staphylococcus aureus subsp. aureus Mu50
auuacccacaucuuuuuaa

SEQ ID NO: 3991190 - RNA, 21 nt, Staphylococcus aureus subsp. aureus Mu50
auuacccacaucuuuuuaaaa

SEQ ID NO: 3991191 - RNA, 16 nt, Staphylococcus aureus subsp. aureus Mu50
auuacccuuuaaacuc

SEQ ID NO: 3991192 - RNA, 20 nt, Staphylococcus aureus subsp. aureus Mu50
auuaccuggguauacagguu

SEQ ID NO: 3991193 - RNA, 15 nt, Staphylococcus aureus subsp. aureus Mu50
auuaccuuuccauuc

SEQ ID NO: 3991194 - RNA, 21 nt, Staphylococcus aureus subsp. aureus Mu50
auuacgccaccaguuucaagu

SEQ ID NO: 3991195 - RNA, 17 nt, Staphylococcus aureus subsp. aureus Mu50
auuacgcucauaugucu

SEQ ID NO: 3991196 - RNA, 18 nt, Staphylococcus aureus subsp. aureus Mu50
auuacgcucaucaccuuu

SEQ ID NO: 3991197 - RNA, 17 nt, Staphylococcus aureus subsp. aureus Mu50
auuacgucauaaaauac

SEQ ID NO: 3991198 - RNA, 17 nt, Staphylococcus aureus subsp. aureus Mu50
auuacguugguuuaaaa

SEQ ID NO: 3991199 - RNA, 19 nt, Staphylococcus aureus subsp. aureus Mu50
auuacuaaccuauuaaaaa

SEQ ID NO: 3991200 - RNA, 20 nt, Staphylococcus aureus subsp. aureus Mu50
auuacuaaccuauuaaaaaa

SEQ ID NO: 3991201 - RNA, 19 nt, Staphylococcus aureus subsp. aureus Mu50
auuacuaacguaaagguga

SEQ ID NO: 3991202 - RNA, 19 nt, Staphylococcus aureus subsp. aureus Mu50
auuacuacauaauuuauca

SEQ ID NO: 3991203 - RNA, 23 nt, Staphylococcus aureus subsp. aureus Mu50
auuacuacauaauuuaucaauuu

SEQ ID NO: 3991204 - RNA, 14 nt, Staphylococcus aureus subsp. aureus Mu50
auuacuauaaaaaa

SEQ ID NO: 3991205 - RNA, 17 nt, Staphylococcus aureus subsp. aureus Mu50
auuacuauauuuaaauu

SEQ ID NO: 3991206 - RNA, 15 nt, Staphylococcus aureus subsp. aureus Mu50
auuacucaaaauuaa

SEQ ID NO: 3991207 - RNA, 22 nt, Staphylococcus aureus subsp. aureus Mu50
auuacuccaauuaccaaugaau

SEQ ID NO: 3991208 - RNA, 19 nt, Staphylococcus aureus subsp. aureus Mu50
auuacucuggucugugaua

SEQ ID NO: 3991209 - RNA, 14 nt, Staphylococcus aureus subsp. aureus Mu50
auuacucuuuuucu

SEQ ID NO: 3991210 - RNA, 16 nt, Staphylococcus aureus subsp. aureus Mu50
auuacucuuuuucuuu

SEQ ID NO: 3991211 - RNA, 22 nt, Staphylococcus aureus subsp. aureus Mu50
auuacucuuuuucuuucauaau

SEQ ID NO: 3991212 - RNA, 15 nt, Staphylococcus aureus subsp. aureus Mu50
auuacugauuguuaa

SEQ ID NO: 3991213 - RNA, 20 nt, Staphylococcus aureus subsp. aureus Mu50
auuacugcagcaucauaauc

SEQ ID NO: 3991214 - RNA, 20 nt, Staphylococcus aureus subsp. aureus Mu50
auuacugucuuuccauaaua

SEQ ID NO: 3991215 - RNA, 15 nt, Staphylococcus aureus subsp. aureus Mu50
auuacuguuugcuuu

SEQ ID NO: 3991216 - RNA, 13 nt, Staphylococcus aureus subsp. aureus Mu50
auuacuuaucugu

SEQ ID NO: 3991217 - RNA, 18 nt, Staphylococcus aureus subsp. aureus Mu50
auuacuuauuucuuuuca

SEQ ID NO: 3991218 - RNA, 22 nt, Staphylococcus aureus subsp. aureus Mu50
auuacuugaaaauagccauauu

SEQ ID NO: 3991219 - RNA, 13 nt, Staphylococcus aureus subsp. aureus Mu50
auuacuugaauau

SEQ ID NO: 3991220 - RNA, 19 nt, Staphylococcus aureus subsp. aureus Mu50
auuacuugaauauuauuca

SEQ ID NO: 3991221 - RNA, 17 nt, Staphylococcus aureus subsp. aureus Mu50
auuacuugcacaccagu

SEQ ID NO: 3991222 - RNA, 18 nt, Staphylococcus aureus subsp. aureus Mu50
auuacuuuaauuuaguga

SEQ ID NO: 3991223 - RNA, 14 nt, Staphylococcus aureus subsp. aureus Mu50
auuacuuuaucguu

SEQ ID NO: 3991224 - RNA, 21 nt, Staphylococcus aureus subsp. aureus Mu50
auuagaaaaggcucauuuguu

SEQ ID NO: 3991225 - RNA, 23 nt, Staphylococcus aureus subsp. aureus Mu50
auuagaaaaggcucauuuguuaa

SEQ ID NO: 3991226 - RNA, 16 nt, Staphylococcus aureus subsp. aureus Mu50
auuagaauauucagau

SEQ ID NO: 3991227 - RNA, 22 nt, Staphylococcus aureus subsp. aureus Mu50
auuagaaugaaaccguauuauu

SEQ ID NO: 3991228 - RNA, 22 nt, Staphylococcus aureus subsp. aureus Mu50
auuagagaacgcuuuauuacuu

SEQ ID NO: 3991229 - RNA, 21 nt, Staphylococcus aureus subsp. aureus Mu50
auuagagagcacgagaaaugu

SEQ ID NO: 3991230 - RNA, 23 nt, Staphylococcus aureus subsp. aureus Mu50
auuagagagcacgagaaauguca

SEQ ID NO: 3991231 - RNA, 21 nt, Staphylococcus aureus subsp. aureus Mu50
auuagagccuacucauauuca

SEQ ID NO: 3991232 - RNA, 14 nt, Staphylococcus aureus subsp. aureus Mu50
auuagauacuucuu

SEQ ID NO: 3991233 - RNA, 13 nt, Staphylococcus aureus subsp. aureus Mu50
auuagauauauuu

SEQ ID NO: 3991234 - RNA, 17 nt, Staphylococcus aureus subsp. aureus Mu50
auuagauauauuugaaa

SEQ ID NO: 3991235 - RNA, 19 nt, Staphylococcus aureus subsp. aureus Mu50
auuagauauauuugaaagg

SEQ ID NO: 3991236 - RNA, 15 nt, Staphylococcus aureus subsp. aureus Mu50
auuagauaucuuaau

SEQ ID NO: 3991237 - RNA, 18 nt, Staphylococcus aureus subsp. aureus Mu50
auuagaugaaauggaaag

SEQ ID NO: 3991238 - RNA, 16 nt, Staphylococcus aureus subsp. aureus Mu50
auuagaugauauuuaa

SEQ ID NO: 3991239 - RNA, 15 nt, Staphylococcus aureus subsp. aureus Mu50
auuagauuuuaugcu

SEQ ID NO: 3991240 - RNA, 22 nt, Staphylococcus aureus subsp. aureus Mu50
auuagauuuuaugcuuuacuug

SEQ ID NO: 3991241 - RNA, 15 nt, Staphylococcus aureus subsp. aureus Mu50
auuagcaaauauuau

SEQ ID NO: 3991242 - RNA, 15 nt, Staphylococcus aureus subsp. aureus Mu50
auuagcauuauuauu

SEQ ID NO: 3991243 - RNA, 15 nt, Staphylococcus aureus subsp. aureus Mu50
auuagcgaaaaccuc

SEQ ID NO: 3991244 - RNA, 14 nt, Staphylococcus aureus subsp. aureus Mu50
auuagcgaaaacua

SEQ ID NO: 3991245 - RNA, 20 nt, Staphylococcus aureus subsp. aureus Mu50
auuagcgaaaacuaaaggga

SEQ ID NO: 3991246 - RNA, 17 nt, Staphylococcus aureus subsp. aureus Mu50
auuagcgcaagagauaa

SEQ ID NO: 3991247 - RNA, 20 nt, Staphylococcus aureus subsp. aureus Mu50
auuagcuuaaguaagauuua

SEQ ID NO: 3991248 - RNA, 13 nt, Staphylococcus aureus subsp. aureus Mu50
auuaggauuaaca

SEQ ID NO: 3991249 - RNA, 23 nt, Staphylococcus aureus subsp. aureus Mu50
auuaggauuaacauaacuagcaa

SEQ ID NO: 3991250 - RNA, 16 nt, Staphylococcus aureus subsp. aureus Mu50
auuaggauucaauaau

SEQ ID NO: 3991251 - RNA, 23 nt, Staphylococcus aureus subsp. aureus Mu50
auuaggcuuaaauauaaugaucc

SEQ ID NO: 3991252 - RNA, 14 nt, Staphylococcus aureus subsp. aureus Mu50
auuagguaauacuu

SEQ ID NO: 3991253 - RNA, 20 nt, Staphylococcus aureus subsp. aureus Mu50
auuaggucuacgaucaaaau

SEQ ID NO: 3991254 - RNA, 22 nt, Staphylococcus aureus subsp. aureus Mu50
auuaggucuacgaucaaaauca

SEQ ID NO: 3991255 - RNA, 19 nt, Staphylococcus aureus subsp. aureus Mu50
auuagguuucgauucauuu

SEQ ID NO: 3991256 - RNA, 15 nt, Staphylococcus aureus subsp. aureus Mu50
auuaguaaauauagu

SEQ ID NO: 3991257 - RNA, 14 nt, Staphylococcus aureus subsp. aureus Mu50
auuaguaaugauua

SEQ ID NO: 3991258 - RNA, 20 nt, Staphylococcus aureus subsp. aureus Mu50
auuaguacuaaaccgauuaa

SEQ ID NO: 3991259 - RNA, 16 nt, Staphylococcus aureus subsp. aureus Mu50
auuaguagccacaauu

SEQ ID NO: 3991260 - RNA, 13 nt, Staphylococcus aureus subsp. aureus Mu50
auuaguauaauuu

SEQ ID NO: 3991261 - RNA, 14 nt, Staphylococcus aureus subsp. aureus Mu50
auuaguauaauuua

SEQ ID NO: 3991262 - RNA, 15 nt, Staphylococcus aureus subsp. aureus Mu50
auuaguauaauuuau

SEQ ID NO: 3991263 - RNA, 13 nt, Staphylococcus aureus subsp. aureus Mu50
auuaguaugacuu

SEQ ID NO: 3991264 - RNA, 23 nt, Staphylococcus aureus subsp. aureus Mu50
auuagucauccaaagaaacggaa

SEQ ID NO: 3991265 - RNA, 13 nt, Staphylococcus aureus subsp. aureus Mu50
auuaguccuuaac

SEQ ID NO: 3991266 - RNA, 16 nt, Staphylococcus aureus subsp. aureus Mu50
auuaguccuuaacauu

SEQ ID NO: 3991267 - RNA, 17 nt, Staphylococcus aureus subsp. aureus Mu50
auuauguuauaaauucu

SEQ ID NO: 3991268 - RNA, 13 nt, Staphylococcus aureus subsp. aureus Mu50
auuauuaaaucaa

SEQ ID NO: 3991269 - RNA, 18 nt, Staphylococcus aureus subsp. aureus Mu50
auuauuaacuguaccugc

SEQ ID NO: 3991270 - RNA, 22 nt, Staphylococcus aureus subsp. aureus Mu50
auuauuaacuguaccugcuaca

SEQ ID NO: 3991271 - RNA, 15 nt, Staphylococcus aureus subsp. aureus Mu50
auuauuaacuuuaau

SEQ ID NO: 3991272 - RNA, 20 nt, Staphylococcus aureus subsp. aureus Mu50
auuauuaaggggguaauacu

SEQ ID NO: 3991273 - RNA, 12 nt, Staphylococcus aureus subsp. aureus Mu50
auuauuaauaag

SEQ ID NO: 3991274 - RNA, 17 nt, Staphylococcus aureus subsp. aureus Mu50
auuauuaauuccuucua

SEQ ID NO: 3991275 - RNA, 17 nt, Staphylococcus aureus subsp. aureus Mu50
auuauuaauuuaaucca

SEQ ID NO: 3991276 - RNA, 15 nt, Staphylococcus aureus subsp. aureus Mu50
auuauuacaaugaaa

SEQ ID NO: 3991277 - RNA, 16 nt, Staphylococcus aureus subsp. aureus Mu50
auuauuacaaugaaaa

SEQ ID NO: 3991278 - RNA, 13 nt, Staphylococcus aureus subsp. aureus Mu50
auuauuaccauau

SEQ ID NO: 3991279 - RNA, 19 nt, Staphylococcus aureus subsp. aureus Mu50
auuauuaggggagauuaga

SEQ ID NO: 3991280 - RNA, 16 nt, Staphylococcus aureus subsp. aureus Mu50
auuauuauaauaaaua

SEQ ID NO: 3991281 - RNA, 21 nt, Staphylococcus aureus subsp. aureus Mu50
auuauuaucaaagaaauguau

SEQ ID NO: 3991282 - RNA, 19 nt, Staphylococcus aureus subsp. aureus Mu50
auuauuaugccuuugauuu

SEQ ID NO: 3991283 - RNA, 14 nt, Staphylococcus aureus subsp. aureus Mu50
auuauuauuuaaau

SEQ ID NO: 3991284 - RNA, 15 nt, Staphylococcus aureus subsp. aureus Mu50
auuauuauuuaaauu

SEQ ID NO: 3991285 - RNA, 20 nt, Staphylococcus aureus subsp. aureus Mu50
auuauucauaauauauuaac

SEQ ID NO: 3991286 - RNA, 21 nt, Staphylococcus aureus subsp. aureus Mu50
auuauucucucauuuguauag

SEQ ID NO: 3991287 - RNA, 17 nt, Staphylococcus aureus subsp. aureus Mu50
auuauucuucauuuaua

SEQ ID NO: 3991288 - RNA, 14 nt, Staphylococcus aureus subsp. aureus Mu50
auuauucuuugauu

SEQ ID NO: 3991289 - RNA, 19 nt, Staphylococcus aureus subsp. aureus Mu50
auuauucuuugauuaaauc

SEQ ID NO: 3991290 - RNA, 16 nt, Staphylococcus aureus subsp. aureus Mu50
auuauugaaaacaaaa

SEQ ID NO: 3991291 - RNA, 17 nt, Staphylococcus aureus subsp. aureus Mu50
auuauugaaacuaauaa

SEQ ID NO: 3991292 - RNA, 20 nt, Staphylococcus aureus subsp. aureus Mu50
auuauugaaaucgauacuaa

SEQ ID NO: 3991293 - RNA, 22 nt, Staphylococcus aureus subsp. aureus Mu50
auuauugaaaucgauacuaaua

SEQ ID NO: 3991294 - RNA, 12 nt, Staphylococcus aureus subsp. aureus Mu50
auuauugaaauu

SEQ ID NO: 3991295 - RNA, 17 nt, Staphylococcus aureus subsp. aureus Mu50
auuauugagaauauuua

SEQ ID NO: 3991296 - RNA, 18 nt, Staphylococcus aureus subsp. aureus Mu50
auuauugagaauauuuau

SEQ ID NO: 3991297 - RNA, 14 nt, Staphylococcus aureus subsp. aureus Mu50
auuauuuaaaaugc

SEQ ID NO: 3991298 - RNA, 19 nt, Staphylococcus aureus subsp. aureus Mu50
auuauuuaaaaugcuuguu

SEQ ID NO: 3991299 - RNA, 16 nt, Staphylococcus aureus subsp. aureus Mu50
auuauuuaauuuuucu

SEQ ID NO: 3991300 - RNA, 18 nt, Staphylococcus aureus subsp. aureus Mu50
auuauuuaauuuuucuaa

SEQ ID NO: 3991301 - RNA, 14 nt, Staphylococcus aureus subsp. aureus Mu50
auuauuuagaaacu

SEQ ID NO: 3991302 - RNA, 23 nt, Staphylococcus aureus subsp. aureus Mu50
auuauuuagaauucuaaaagaau

SEQ ID NO: 3991303 - RNA, 19 nt, Staphylococcus aureus subsp. aureus Mu50
auuauuuagauaaaaauua

SEQ ID NO: 3991304 - RNA, 12 nt, Staphylococcus aureus subsp. aureus Mu50
auuauuuauauu

SEQ ID NO: 3991305 - RNA, 13 nt, Staphylococcus aureus subsp. aureus Mu50
auuauuuauauuu

SEQ ID NO: 3991306 - RNA, 14 nt, Staphylococcus aureus subsp. aureus Mu50
auuauuuauauuuu

SEQ ID NO: 3991307 - RNA, 16 nt, Staphylococcus aureus subsp. aureus Mu50
auuauuuauauuuuau

SEQ ID NO: 3991308 - RNA, 16 nt, Staphylococcus aureus subsp. aureus Mu50
auuauuuauucauuau

SEQ ID NO: 3991309 - RNA, 16 nt, Staphylococcus aureus subsp. aureus Mu50
auuauuucauuagaaa

SEQ ID NO: 3991310 - RNA, 13 nt, Staphylococcus aureus subsp. aureus Mu50
auuauuugauaaa

SEQ ID NO: 3991311 - RNA, 16 nt, Staphylococcus aureus subsp. aureus Mu50
auuauuugauaaauaa

SEQ ID NO: 3991312 - RNA, 22 nt, Staphylococcus aureus subsp. aureus Mu50
auuauuugauaaauaaaauuuu

SEQ ID NO: 3991313 - RNA, 17 nt, Staphylococcus aureus subsp. aureus Mu50
auuauuugcgauaucag

SEQ ID NO: 3991314 - RNA, 15 nt, Staphylococcus aureus subsp. aureus Mu50
auuauuuuguauuuu

SEQ ID NO: 3991315 - RNA, 18 nt, Staphylococcus aureus subsp. aureus Mu50
auuauuuuguauuuuuca

SEQ ID NO: 3991316 - RNA, 21 nt, Staphylococcus aureus subsp. aureus Mu50
auuauuuuguauuuuucaaau

SEQ ID NO: 3991317 - RNA, 14 nt, Staphylococcus aureus subsp. aureus Mu50
auuauuuuuuuaaa

SEQ ID NO: 3991318 - RNA, 18 nt, Staphylococcus aureus subsp. aureus Mu50
auuauuuuuuuaaaucua

SEQ ID NO: 3991319 - RNA, 22 nt, Staphylococcus aureus subsp. aureus Mu50
auuauuuuuuuaaaucuauaua

SEQ ID NO: 3991320 - RNA, 23 nt, Staphylococcus aureus subsp. aureus Mu50
auucaaaaagguauucaaauaaa

SEQ ID NO: 3991321 - RNA, 22 nt, Staphylococcus aureus subsp. aureus Mu50
auucaaacaguccuuauuauag

SEQ ID NO: 3991322 - RNA, 21 nt, Staphylococcus aureus subsp. aureus Mu50
auucaaacuccuuucuaagau

SEQ ID NO: 3991323 - RNA, 20 nt, Staphylococcus aureus subsp. aureus Mu50
auucaaaguuuucauuuaac

SEQ ID NO: 3991324 - RNA, 17 nt, Staphylococcus aureus subsp. aureus Mu50
auucaaauaaaucaaac

SEQ ID NO: 3991325 - RNA, 15 nt, Staphylococcus aureus subsp. aureus Mu50
auucaacuaauuuaa

SEQ ID NO: 3991326 - RNA, 17 nt, Staphylococcus aureus subsp. aureus Mu50
auucaacuuauuauuua

SEQ ID NO: 3991327 - RNA, 17 nt, Staphylococcus aureus subsp. aureus Mu50
auucaacuuguuuccua

SEQ ID NO: 3991328 - RNA, 19 nt, Staphylococcus aureus subsp. aureus Mu50
auucaacuuguuuccuaca

SEQ ID NO: 3991329 - RNA, 15 nt, Staphylococcus aureus subsp. aureus Mu50
auucaacuuuaauca

SEQ ID NO: 3991330 - RNA, 19 nt, Staphylococcus aureus subsp. aureus Mu50
auucaagcaucauuuuucg

SEQ ID NO: 3991331 - RNA, 13 nt, Staphylococcus aureus subsp. aureus Mu50
auucaauaauuau

SEQ ID NO: 3991332 - RNA, 19 nt, Staphylococcus aureus subsp. aureus Mu50
auucaauaauuauuaauuu

SEQ ID NO: 3991333 - RNA, 22 nt, Staphylococcus aureus subsp. aureus Mu50
auucaauaauuauuaauuuaau

SEQ ID NO: 3991334 - RNA, 21 nt, Staphylococcus aureus subsp. aureus Mu50
auucaauacgaaguguuauaa

SEQ ID NO: 3991335 - RNA, 22 nt, Staphylococcus aureus subsp. aureus Mu50
auucaaucuaaucuuaauuguc

SEQ ID NO: 3991336 - RNA, 23 nt, Staphylococcus aureus subsp. aureus Mu50
auucaaugauuaguaaugauuaa

SEQ ID NO: 3991337 - RNA, 15 nt, Staphylococcus aureus subsp. aureus Mu50
auucaaugauuuuua

SEQ ID NO: 3991338 - RNA, 21 nt, Staphylococcus aureus subsp. aureus Mu50
auucaauguaucaccuaauug

SEQ ID NO: 3991339 - RNA, 14 nt, Staphylococcus aureus subsp. aureus Mu50
auucaauguuuaau

SEQ ID NO: 3991340 - RNA, 20 nt, Staphylococcus aureus subsp. aureus Mu50
auucaauuucucaccagcuc

SEQ ID NO: 3991341 - RNA, 15 nt, Staphylococcus aureus subsp. aureus Mu50
auucacauacauuuu

SEQ ID NO: 3991342 - RNA, 15 nt, Staphylococcus aureus subsp. aureus Mu50
auucacgaacauuac

SEQ ID NO: 3991343 - RNA, 16 nt, Staphylococcus aureus subsp. aureus Mu50
auucacgcguucaaau

SEQ ID NO: 3991344 - RNA, 22 nt, Staphylococcus aureus subsp. aureus Mu50
auucacucuguaauaaagaaua

SEQ ID NO: 3991345 - RNA, 13 nt, Staphylococcus aureus subsp. aureus Mu50
auucacuguauaa

SEQ ID NO: 3991346 - RNA, 22 nt, Staphylococcus aureus subsp. aureus Mu50
auucacuuuacccucuuuaguu

SEQ ID NO: 3991347 - RNA, 12 nt, Staphylococcus aureus subsp. aureus Mu50
auucacuuuuuu

SEQ ID NO: 3991348 - RNA, 16 nt, Staphylococcus aureus subsp. aureus Mu50
auucacuuuuuuuaau

SEQ ID NO: 3991349 - RNA, 22 nt, Staphylococcus aureus subsp. aureus Mu50
auucacuuuuuuuaauuugauu

SEQ ID NO: 3991350 - RNA, 16 nt, Staphylococcus aureus subsp. aureus Mu50
auucagaugaauaaug

SEQ ID NO: 3991351 - RNA, 12 nt, Staphylococcus aureus subsp. aureus Mu50
auucagauuuuc

SEQ ID NO: 3991352 - RNA, 17 nt, Staphylococcus aureus subsp. aureus Mu50
auucagauuuucgagug

SEQ ID NO: 3991353 - RNA, 13 nt, Staphylococcus aureus subsp. aureus Mu50
auucaguaucuaa

SEQ ID NO: 3991354 - RNA, 14 nt, Staphylococcus aureus subsp. aureus Mu50
auucagucaguaaa

SEQ ID NO: 3991355 - RNA, 14 nt, Staphylococcus aureus subsp. aureus Mu50
auucuacaaacaau

SEQ ID NO: 3991356 - RNA, 21 nt, Staphylococcus aureus subsp. aureus Mu50
auucuacaaacaaugcaaguu

SEQ ID NO: 3991357 - RNA, 21 nt, Staphylococcus aureus subsp. aureus Mu50
auucuacaggcaaugcaaguu

SEQ ID NO: 3991358 - RNA, 19 nt, Staphylococcus aureus subsp. aureus Mu50
auucuaccaguugauuuaa

SEQ ID NO: 3991359 - RNA, 19 nt, Staphylococcus aureus subsp. aureus Mu50
auucuagagauaacuagaa

SEQ ID NO: 3991360 - RNA, 17 nt, Staphylococcus aureus subsp. aureus Mu50
auucuauaauuuuaauu

SEQ ID NO: 3991361 - RNA, 14 nt, Staphylococcus aureus subsp. aureus Mu50
auucuauauaagaa

SEQ ID NO: 3991362 - RNA, 11 nt, Staphylococcus aureus subsp. aureus Mu50
auucuauuuuu

SEQ ID NO: 3991363 - RNA, 13 nt, Staphylococcus aureus subsp. aureus Mu50
auucuauuuuuga

SEQ ID NO: 3991364 - RNA, 15 nt, Staphylococcus aureus subsp. aureus Mu50
auucucagucucuuu

SEQ ID NO: 3991365 - RNA, 12 nt, Staphylococcus aureus subsp. aureus Mu50
auucuccuaaua

SEQ ID NO: 3991366 - RNA, 16 nt, Staphylococcus aureus subsp. aureus Mu50
auucucgauaacuuac

SEQ ID NO: 3991367 - RNA, 17 nt, Staphylococcus aureus subsp. aureus Mu50
auucucgauuuuuuuau

SEQ ID NO: 3991368 - RNA, 14 nt, Staphylococcus aureus subsp. aureus Mu50
auucucuaacgauu

SEQ ID NO: 3991369 - RNA, 19 nt, Staphylococcus aureus subsp. aureus Mu50
auucucuaacgauuucuag

SEQ ID NO: 3991370 - RNA, 22 nt, Staphylococcus aureus subsp. aureus Mu50
auucucuguagauaucaaagua

SEQ ID NO: 3991371 - RNA, 22 nt, Staphylococcus aureus subsp. aureus Mu50
auucucuuuauugggagcaauc

SEQ ID NO: 3991372 - RNA, 20 nt, Staphylococcus aureus subsp. aureus Mu50
auucucuuuguuggggccca

SEQ ID NO: 3991373 - RNA, 14 nt, Staphylococcus aureus subsp. aureus Mu50
auucugaaaucagu

SEQ ID NO: 3991374 - RNA, 16 nt, Staphylococcus aureus subsp. aureus Mu50
auucugaaaucaguuu

SEQ ID NO: 3991375 - RNA, 17 nt, Staphylococcus aureus subsp. aureus Mu50
auucugagauugagaau

SEQ ID NO: 3991376 - RNA, 14 nt, Staphylococcus aureus subsp. aureus Mu50
auucugauacagaa

SEQ ID NO: 3991377 - RNA, 21 nt, Staphylococcus aureus subsp. aureus Mu50
auucugauacagaaccaacaa

SEQ ID NO: 3991378 - RNA, 19 nt, Staphylococcus aureus subsp. aureus Mu50
auucugcagcgacaucuuu

SEQ ID NO: 3991379 - RNA, 19 nt, Staphylococcus aureus subsp. aureus Mu50
auucugguuuaaugagcuu

SEQ ID NO: 3991380 - RNA, 16 nt, Staphylococcus aureus subsp. aureus Mu50
auucuguguaaauaua

SEQ ID NO: 3991381 - RNA, 17 nt, Staphylococcus aureus subsp. aureus Mu50
auucuguguaaauauaa

SEQ ID NO: 3991382 - RNA, 15 nt, Staphylococcus aureus subsp. aureus Mu50
auucuguuucaaagc

SEQ ID NO: 3991383 - RNA, 12 nt, Staphylococcus aureus subsp. aureus Mu50
auucuuaucauu

SEQ ID NO: 3991384 - RNA, 22 nt, Staphylococcus aureus subsp. aureus Mu50
auucuuaucauuucaaauaaga

SEQ ID NO: 3991385 - RNA, 12 nt, Staphylococcus aureus subsp. aureus Mu50
auucuucaaaaa

SEQ ID NO: 3991386 - RNA, 14 nt, Staphylococcus aureus subsp. aureus Mu50
auucuucaaaaaau

SEQ ID NO: 3991387 - RNA, 20 nt, Staphylococcus aureus subsp. aureus Mu50
auucuucaaccauuuguucu

SEQ ID NO: 3991388 - RNA, 14 nt, Staphylococcus aureus subsp. aureus Mu50
auucuucaccaacu

SEQ ID NO: 3991389 - RNA, 22 nt, Staphylococcus aureus subsp. aureus Mu50
auucuucaucaauaacuauaau

SEQ ID NO: 3991390 - RNA, 16 nt, Staphylococcus aureus subsp. aureus Mu50
auucuucaucaugacu

SEQ ID NO: 3991391 - RNA, 20 nt, Staphylococcus aureus subsp. aureus Mu50
auucuucaucaugacuauuu

SEQ ID NO: 3991392 - RNA, 16 nt, Staphylococcus aureus subsp. aureus Mu50
auucuugaauaaauuu

SEQ ID NO: 3991393 - RNA, 16 nt, Staphylococcus aureus subsp. aureus Mu50
auucuuggcguauuuu

SEQ ID NO: 3991394 - RNA, 18 nt, Staphylococcus aureus subsp. aureus Mu50
auucuugguuuuuuagau

SEQ ID NO: 3991395 - RNA, 15 nt, Staphylococcus aureus subsp. aureus Mu50
auucuuuaauauaaa

SEQ ID NO: 3991396 - RNA, 23 nt, Staphylococcus aureus subsp. aureus Mu50
auucuuuauagaaaccaaaaaau

SEQ ID NO: 3991397 - RNA, 12 nt, Staphylococcus aureus subsp. aureus Mu50
auucuuuauauu

SEQ ID NO: 3991398 - RNA, 20 nt, Staphylococcus aureus subsp. aureus Mu50
auucuuucguuuucaucaac

SEQ ID NO: 3991399 - RNA, 22 nt, Staphylococcus aureus subsp. aureus Mu50
auucuuucguuuucaucaacga

SEQ ID NO: 3991400 - RNA, 16 nt, Staphylococcus aureus subsp. aureus Mu50
auugaaaaaauaacug

SEQ ID NO: 3991401 - RNA, 21 nt, Staphylococcus aureus subsp. aureus Mu50
auugaaaaauuaaaaaacaaa

SEQ ID NO: 3991402 - RNA, 14 nt, Staphylococcus aureus subsp. aureus Mu50
auugaaaauagaaa

SEQ ID NO: 3991403 - RNA, 14 nt, Staphylococcus aureus subsp. aureus Mu50
auugaaacuaauaa

SEQ ID NO: 3991404 - RNA, 18 nt, Staphylococcus aureus subsp. aureus Mu50
auugaaauaauauaaaaa

SEQ ID NO: 3991405 - RNA, 21 nt, Staphylococcus aureus subsp. aureus Mu50
auugaaaucgucuuacugcug

SEQ ID NO: 3991406 - RNA, 15 nt, Staphylococcus aureus subsp. aureus Mu50
auugaaaugauagau

SEQ ID NO: 3991407 - RNA, 21 nt, Staphylococcus aureus subsp. aureus Mu50
auugaaauuauccuacugcug

SEQ ID NO: 3991408 - RNA, 22 nt, Staphylococcus aureus subsp. aureus Mu50
auugaaauuauccuacugcugu

SEQ ID NO: 3991409 - RNA, 13 nt, Staphylococcus aureus subsp. aureus Mu50
auugaaauuuuua

SEQ ID NO: 3991410 - RNA, 20 nt, Staphylococcus aureus subsp. aureus Mu50
auugaacaauucuucaucau

SEQ ID NO: 3991411 - RNA, 13 nt, Staphylococcus aureus subsp. aureus Mu50
auugaacuucuuu

SEQ ID NO: 3991412 - RNA, 14 nt, Staphylococcus aureus subsp. aureus Mu50
auugaauaaaugaa

SEQ ID NO: 3991413 - RNA, 13 nt, Staphylococcus aureus subsp. aureus Mu50
auugaauaaucau

SEQ ID NO: 3991414 - RNA, 21 nt, Staphylococcus aureus subsp. aureus Mu50
auugaaucuuuguuauauuuu

SEQ ID NO: 3991415 - RNA, 23 nt, Staphylococcus aureus subsp. aureus Mu50
auugaaugaaaaaguugaucuac

SEQ ID NO: 3991416 - RNA, 15 nt, Staphylococcus aureus subsp. aureus Mu50
auugaaugaaaauaa

SEQ ID NO: 3991417 - RNA, 16 nt, Staphylococcus aureus subsp. aureus Mu50
auugaaugaauucauu

SEQ ID NO: 3991418 - RNA, 14 nt, Staphylococcus aureus subsp. aureus Mu50
auugaauugaaaaa

SEQ ID NO: 3991419 - RNA, 21 nt, Staphylococcus aureus subsp. aureus Mu50
auugaauuguagauccaauuc

SEQ ID NO: 3991420 - RNA, 15 nt, Staphylococcus aureus subsp. aureus Mu50
auugacaguuuccau

SEQ ID NO: 3991421 - RNA, 23 nt, Staphylococcus aureus subsp. aureus Mu50
auugacauuaaugauagcaauga

SEQ ID NO: 3991422 - RNA, 21 nt, Staphylococcus aureus subsp. aureus Mu50
auugaccaacguucgauaacg

SEQ ID NO: 3991423 - RNA, 20 nt, Staphylococcus aureus subsp. aureus Mu50
auugaccaccuguaucuaau

SEQ ID NO: 3991424 - RNA, 17 nt, Staphylococcus aureus subsp. aureus Mu50
auugaccaccuuuaucu

SEQ ID NO: 3991425 - RNA, 20 nt, Staphylococcus aureus subsp. aureus Mu50
auugacuaaguuuguuuucu

SEQ ID NO: 3991426 - RNA, 19 nt, Staphylococcus aureus subsp. aureus Mu50
auugacucgaccuuuauau

SEQ ID NO: 3991427 - RNA, 17 nt, Staphylococcus aureus subsp. aureus Mu50
auugacuuacauuuuaa

SEQ ID NO: 3991428 - RNA, 18 nt, Staphylococcus aureus subsp. aureus Mu50
auugacuuacauuuuaau

SEQ ID NO: 3991429 - RNA, 23 nt, Staphylococcus aureus subsp. aureus Mu50
auugacuuacauuuuaauaaaau

SEQ ID NO: 3991430 - RNA, 13 nt, Staphylococcus aureus subsp. aureus Mu50
auugacuuuaauu

SEQ ID NO: 3991431 - RNA, 17 nt, Staphylococcus aureus subsp. aureus Mu50
auugagaaauagcaaca

SEQ ID NO: 3991432 - RNA, 20 nt, Staphylococcus aureus subsp. aureus Mu50
auugagacaacauuguugau

SEQ ID NO: 3991433 - RNA, 23 nt, Staphylococcus aureus subsp. aureus Mu50
auugaggaucaaaaguuguugca

SEQ ID NO: 3991434 - RNA, 16 nt, Staphylococcus aureus subsp. aureus Mu50
auugagggauuuuuau

SEQ ID NO: 3991435 - RNA, 14 nt, Staphylococcus aureus subsp. aureus Mu50
auugaguaucaugc

SEQ ID NO: 3991436 - RNA, 20 nt, Staphylococcus aureus subsp. aureus Mu50
auugaguaucaugcuuuuaa

SEQ ID NO: 3991437 - RNA, 16 nt, Staphylococcus aureus subsp. aureus Mu50
auugaguugaaaauaa

SEQ ID NO: 3991438 - RNA, 15 nt, Staphylococcus aureus subsp. aureus Mu50
auugaguuuuuuaaa

SEQ ID NO: 3991439 - RNA, 19 nt, Staphylococcus aureus subsp. aureus Mu50
auugauaaaauaaucggua

SEQ ID NO: 3991440 - RNA, 18 nt, Staphylococcus aureus subsp. aureus Mu50
auugauaaauauugaaca

SEQ ID NO: 3991441 - RNA, 22 nt, Staphylococcus aureus subsp. aureus Mu50
auugauaaauauugaacaauuu

SEQ ID NO: 3991442 - RNA, 20 nt, Staphylococcus aureus subsp. aureus Mu50
auuguauuauccucaaauau

SEQ ID NO: 3991443 - RNA, 23 nt, Staphylococcus aureus subsp. aureus Mu50
auuguauuauccucaaauauauu

SEQ ID NO: 3991444 - RNA, 20 nt, Staphylococcus aureus subsp. aureus Mu50
auuguauuguuuucaucaug

SEQ ID NO: 3991445 - RNA, 22 nt, Staphylococcus aureus subsp. aureus Mu50
auuguauuguuuucaucaugca

SEQ ID NO: 3991446 - RNA, 22 nt, Staphylococcus aureus subsp. aureus Mu50
auuguauuucuuaacauccuuu

SEQ ID NO: 3991447 - RNA, 13 nt, Staphylococcus aureus subsp. aureus Mu50
auuguauuuuaau

SEQ ID NO: 3991448 - RNA, 15 nt, Staphylococcus aureus subsp. aureus Mu50
auugucauauaaaac

SEQ ID NO: 3991449 - RNA, 15 nt, Staphylococcus aureus subsp. aureus Mu50
auugucaucauguuc

SEQ ID NO: 3991450 - RNA, 19 nt, Staphylococcus aureus subsp. aureus Mu50
auugucaucauguucuaau

SEQ ID NO: 3991451 - RNA, 16 nt, Staphylococcus aureus subsp. aureus Mu50
auugucaugccuucau

SEQ ID NO: 3991452 - RNA, 14 nt, Staphylococcus aureus subsp. aureus Mu50
auugucgacuuuua

SEQ ID NO: 3991453 - RNA, 18 nt, Staphylococcus aureus subsp. aureus Mu50
auugucgacuuuuagauu

SEQ ID NO: 3991454 - RNA, 21 nt, Staphylococcus aureus subsp. aureus Mu50
auugucgacuuuuagauuauc

SEQ ID NO: 3991455 - RNA, 21 nt, Staphylococcus aureus subsp. aureus Mu50
auugucguuguacaucauuaa

SEQ ID NO: 3991456 - RNA, 20 nt, Staphylococcus aureus subsp. aureus Mu50
auugucuagguuagaauuau

SEQ ID NO: 3991457 - RNA, 11 nt, Staphylococcus aureus subsp. aureus Mu50
auugucuuaau

SEQ ID NO: 3991458 - RNA, 19 nt, Staphylococcus aureus subsp. aureus Mu50
auugucuuuauaaaaaaau

SEQ ID NO: 3991459 - RNA, 15 nt, Staphylococcus aureus subsp. aureus Mu50
auugugaaaucuauu

SEQ ID NO: 3991460 - RNA, 17 nt, Staphylococcus aureus subsp. aureus Mu50
auugugcuuggugguuu

SEQ ID NO: 3991461 - RNA, 13 nt, Staphylococcus aureus subsp. aureus Mu50
auuguguccuauu

SEQ ID NO: 3991462 - RNA, 19 nt, Staphylococcus aureus subsp. aureus Mu50
auuguuaaacccucauuuu

SEQ ID NO: 3991463 - RNA, 22 nt, Staphylococcus aureus subsp. aureus Mu50
auuguuaaacuagaaaacauaa

SEQ ID NO: 3991464 - RNA, 22 nt, Staphylococcus aureus subsp. aureus Mu50
auuguuaaagagcaauuaaagu

SEQ ID NO: 3991465 - RNA, 12 nt, Staphylococcus aureus subsp. aureus Mu50
auuguuaaauga

SEQ ID NO: 3991466 - RNA, 14 nt, Staphylococcus aureus subsp. aureus Mu50
auuguuaacgaaua

SEQ ID NO: 3991467 - RNA, 16 nt, Staphylococcus aureus subsp. aureus Mu50
auuguuacuuuaacuu

SEQ ID NO: 3991468 - RNA, 19 nt, Staphylococcus aureus subsp. aureus Mu50
auuguuagauaaucucauu

SEQ ID NO: 3991469 - RNA, 21 nt, Staphylococcus aureus subsp. aureus Mu50
auuguuagauaaucucauucu

SEQ ID NO: 3991470 - RNA, 22 nt, Staphylococcus aureus subsp. aureus Mu50
auuguuauagcguuuaagaaau

SEQ ID NO: 3991471 - RNA, 18 nt, Staphylococcus aureus subsp. aureus Mu50
auuguuauccaaaacauu

SEQ ID NO: 3991472 - RNA, 13 nt, Staphylococcus aureus subsp. aureus Mu50
auuguuauuauaa

SEQ ID NO: 3991473 - RNA, 15 nt, Staphylococcus aureus subsp. aureus Mu50
auuguucaauauuua

SEQ ID NO: 3991474 - RNA, 16 nt, Staphylococcus aureus subsp. aureus Mu50
auuguucaugguuuaa

SEQ ID NO: 3991475 - RNA, 18 nt, Staphylococcus aureus subsp. aureus Mu50
auuguucaugguuuaauu

SEQ ID NO: 3991476 - RNA, 19 nt, Staphylococcus aureus subsp. aureus Mu50
auuguucaugguuuaauuc

SEQ ID NO: 3991477 - RNA, 17 nt, Staphylococcus aureus subsp. aureus Mu50
auuguuccuucgauagu

SEQ ID NO: 3991478 - RNA, 21 nt, Staphylococcus aureus subsp. aureus Mu50
auuguucuaauacaccaaauc

SEQ ID NO: 3991479 - RNA, 12 nt, Staphylococcus aureus subsp. aureus Mu50
auuguucuucag

SEQ ID NO: 3991480 - RNA, 14 nt, Staphylococcus aureus subsp. aureus Mu50
auuguugauaaaug

SEQ ID NO: 3991481 - RNA, 15 nt, Staphylococcus aureus subsp. aureus Mu50
auuguugcaaugauu

SEQ ID NO: 3991482 - RNA, 21 nt, Staphylococcus aureus subsp. aureus Mu50
auuguugcuaaucucagauuu

SEQ ID NO: 3991483 - RNA, 12 nt, Staphylococcus aureus subsp. aureus Mu50
auuguuuaaaca

SEQ ID NO: 3991484 - RNA, 16 nt, Staphylococcus aureus subsp. aureus Mu50
auuguuuaaacaugua

SEQ ID NO: 3991485 - RNA, 17 nt, Staphylococcus aureus subsp. aureus Mu50
auuguuuaauaacaaaa

SEQ ID NO: 3991486 - RNA, 24 nt, Staphylococcus aureus subsp. aureus Mu50
auuguuuauuaggauucaauaaua

SEQ ID NO: 3991487 - RNA, 18 nt, Staphylococcus aureus subsp. aureus Mu50
auuguuucaccagcuugu

SEQ ID NO: 3991488 - RNA, 19 nt, Staphylococcus aureus subsp. aureus Mu50
auuguuugaaaauuaacua

SEQ ID NO: 3991489 - RNA, 15 nt, Staphylococcus aureus subsp. aureus Mu50
auuguuuguuuuuau

SEQ ID NO: 3991490 - RNA, 18 nt, Staphylococcus aureus subsp. aureus Mu50
auuguuuuacuuucacca

SEQ ID NO: 3991491 - RNA, 16 nt, Staphylococcus aureus subsp. aureus Mu50
auuguuuuagguugaa

SEQ ID NO: 3991492 - RNA, 21 nt, Staphylococcus aureus subsp. aureus Mu50
auuguuuuagguugaauuucu

SEQ ID NO: 3991493 - RNA, 19 nt, Staphylococcus aureus subsp. aureus Mu50
auuguuuugagauauuugu

SEQ ID NO: 3991494 - RNA, 16 nt, Staphylococcus aureus subsp. aureus Mu50
auuguuuuuaaaaucu

SEQ ID NO: 3991495 - RNA, 13 nt, Staphylococcus aureus subsp. aureus Mu50
auuuaaaaaaugc

SEQ ID NO: 3991496 - RNA, 17 nt, Staphylococcus aureus subsp. aureus Mu50
auuuaaaaaaugcgcuu

SEQ ID NO: 3991497 - RNA, 17 nt, Staphylococcus aureus subsp. aureus Mu50
auuuaaaaaguuaauaa

SEQ ID NO: 3991498 - RNA, 19 nt, Staphylococcus aureus subsp. aureus Mu50
auuuaaaaaucgaauuuuc

SEQ ID NO: 3991499 - RNA, 18 nt, Staphylococcus aureus subsp. aureus Mu50
auuuaaaaauugaaggaa

SEQ ID NO: 3991500 - RNA, 21 nt, Staphylococcus aureus subsp. aureus Mu50
auuuaaaacaaugauuaaaau

SEQ ID NO: 3991501 - RNA, 15 nt, Staphylococcus aureus subsp. aureus Mu50
auuuaaaacuuguaa

SEQ ID NO: 3991502 - RNA, 13 nt, Staphylococcus aureus subsp. aureus Mu50
auuuaaaagacaa

SEQ ID NO: 3991503 - RNA, 13 nt, Staphylococcus aureus subsp. aureus Mu50
auuuaaaaguuua

SEQ ID NO: 3991504 - RNA, 19 nt, Staphylococcus aureus subsp. aureus Mu50
auuuaaaauaauagauaau

SEQ ID NO: 3991505 - RNA, 18 nt, Staphylococcus aureus subsp. aureus Mu50
auuuaaaauaguucuuua

SEQ ID NO: 3991506 - RNA, 12 nt, Staphylococcus aureus subsp. aureus Mu50
auuuaaaauaua

SEQ ID NO: 3991507 - RNA, 16 nt, Staphylococcus aureus subsp. aureus Mu50
auuuaaaauauaaauu

SEQ ID NO: 3991508 - RNA, 17 nt, Staphylococcus aureus subsp. aureus Mu50
auuuaaaauauaaauuu

SEQ ID NO: 3991509 - RNA, 19 nt, Staphylococcus aureus subsp. aureus Mu50
auuuaaaauauuauuuuua

SEQ ID NO: 3991510 - RNA, 13 nt, Staphylococcus aureus subsp. aureus Mu50
auuuaaaaugauu

SEQ ID NO: 3991511 - RNA, 15 nt, Staphylococcus aureus subsp. aureus Mu50
auuuaaaaugauucu

SEQ ID NO: 3991512 - RNA, 19 nt, Staphylococcus aureus subsp. aureus Mu50
auuuaaaaugcuuguucaa

SEQ ID NO: 3991513 - RNA, 16 nt, Staphylococcus aureus subsp. aureus Mu50
auuuaaacauccaauu

SEQ ID NO: 3991514 - RNA, 19 nt, Staphylococcus aureus subsp. aureus Mu50
auuuaaagaacuauuuuaa

SEQ ID NO: 3991515 - RNA, 19 nt, Staphylococcus aureus subsp. aureus Mu50
auuuaaaggguguuuagau

SEQ ID NO: 3991516 - RNA, 19 nt, Staphylococcus aureus subsp. aureus Mu50
auuuaaagucuucaucuuu

SEQ ID NO: 3991517 - RNA, 22 nt, Staphylococcus aureus subsp. aureus Mu50
auuuaaauaauaauucauaaau

SEQ ID NO: 3991518 - RNA, 19 nt, Staphylococcus aureus subsp. aureus Mu50
auuuaaaucuguacuucua

SEQ ID NO: 3991519 - RNA, 20 nt, Staphylococcus aureus subsp. aureus Mu50
auuuaaaugucuuucaaaua

SEQ ID NO: 3991520 - RNA, 13 nt, Staphylococcus aureus subsp. aureus Mu50
auuuaaauuuuaa

SEQ ID NO: 3991521 - RNA, 13 nt, Staphylococcus aureus subsp. aureus Mu50
auuuaaauuuuca

SEQ ID NO: 3991522 - RNA, 15 nt, Staphylococcus aureus subsp. aureus Mu50
auuuaacaucaauua

SEQ ID NO: 3991523 - RNA, 17 nt, Staphylococcus aureus subsp. aureus Mu50
auuuaacaucaauuacu

SEQ ID NO: 3991524 - RNA, 19 nt, Staphylococcus aureus subsp. aureus Mu50
auuuaacauguauuuagua

SEQ ID NO: 3991525 - RNA, 13 nt, Staphylococcus aureus subsp. aureus Mu50
auuuaaccuuuaa

SEQ ID NO: 3991526 - RNA, 15 nt, Staphylococcus aureus subsp. aureus Mu50
auuuaaccuuuaaaa

SEQ ID NO: 3991527 - RNA, 16 nt, Staphylococcus aureus subsp. aureus Mu50
auuuaacggaaauaca

SEQ ID NO: 3991528 - RNA, 20 nt, Staphylococcus aureus subsp. aureus Mu50
auuuaacggaaauacaauga

SEQ ID NO: 3991529 - RNA, 21 nt, Staphylococcus aureus subsp. aureus Mu50
auuuaacgucuaccucuagga

SEQ ID NO: 3991530 - RNA, 21 nt, Staphylococcus aureus subsp. aureus Mu50
auuuauauagucuaugaauaa

SEQ ID NO: 3991531 - RNA, 14 nt, Staphylococcus aureus subsp. aureus Mu50
auuuauaugauguu

SEQ ID NO: 3991532 - RNA, 17 nt, Staphylococcus aureus subsp. aureus Mu50
auuuauaugauguucaa

SEQ ID NO: 3991533 - RNA, 13 nt, Staphylococcus aureus subsp. aureus Mu50
auuuauauuuuau

SEQ ID NO: 3991534 - RNA, 17 nt, Staphylococcus aureus subsp. aureus Mu50
auuuaucaccuuuaggc

SEQ ID NO: 3991535 - RNA, 20 nt, Staphylococcus aureus subsp. aureus Mu50
auuuaucagcgaaauuugua

SEQ ID NO: 3991536 - RNA, 16 nt, Staphylococcus aureus subsp. aureus Mu50
auuuaucauacuucaa

SEQ ID NO: 3991537 - RNA, 17 nt, Staphylococcus aureus subsp. aureus Mu50
auuuaucgccaauuaau

SEQ ID NO: 3991538 - RNA, 18 nt, Staphylococcus aureus subsp. aureus Mu50
auuuaucugcaaaaugca

SEQ ID NO: 3991539 - RNA, 20 nt, Staphylococcus aureus subsp. aureus Mu50
auuuaucugcaaaaugcauu

SEQ ID NO: 3991540 - RNA, 20 nt, Staphylococcus aureus subsp. aureus Mu50
auuuaucuugauuuuauaaa

SEQ ID NO: 3991541 - RNA, 21 nt, Staphylococcus aureus subsp. aureus Mu50
auuuaucuuuagagacuuauu

SEQ ID NO: 3991542 - RNA, 17 nt, Staphylococcus aureus subsp. aureus Mu50
auuuaucuuuuaaaauc

SEQ ID NO: 3991543 - RNA, 12 nt, Staphylococcus aureus subsp. aureus Mu50
auuuauuaaaua

SEQ ID NO: 3991544 - RNA, 14 nt, Staphylococcus aureus subsp. aureus Mu50
auuuauuaaauaua

SEQ ID NO: 3991545 - RNA, 14 nt, Staphylococcus aureus subsp. aureus Mu50
auuuauuaaggcaa

SEQ ID NO: 3991546 - RNA, 14 nt, Staphylococcus aureus subsp. aureus Mu50
auuuauuaauccau

SEQ ID NO: 3991547 - RNA, 22 nt, Staphylococcus aureus subsp. aureus Mu50
auuuauuaguugugguuguuaa

SEQ ID NO: 3991548 - RNA, 23 nt, Staphylococcus aureus subsp. aureus Mu50
auuuauuaguugugguuguuaau

SEQ ID NO: 3991549 - RNA, 14 nt, Staphylococcus aureus subsp. aureus Mu50
auuuauuauaaaau

SEQ ID NO: 3991550 - RNA, 15 nt, Staphylococcus aureus subsp. aureus Mu50
auuuauuauaaaaua

SEQ ID NO: 3991551 - RNA, 17 nt, Staphylococcus aureus subsp. aureus Mu50
auuuauuuauaaaauaa

SEQ ID NO: 3991552 - RNA, 21 nt, Staphylococcus aureus subsp. aureus Mu50
auuuauuuauaaaauaaaaug

SEQ ID NO: 3991553 - RNA, 15 nt, Staphylococcus aureus subsp. aureus Mu50
auuuauuuuauaaua

SEQ ID NO: 3991554 - RNA, 16 nt, Staphylococcus aureus subsp. aureus Mu50
auuuauuuucaauaaa

SEQ ID NO: 3991555 - RNA, 18 nt, Staphylococcus aureus subsp. aureus Mu50
auuuauuuucaauaaaua

SEQ ID NO: 3991556 - RNA, 19 nt, Staphylococcus aureus subsp. aureus Mu50
auuuauuuucaauaaauaa

SEQ ID NO: 3991557 - RNA, 13 nt, Staphylococcus aureus subsp. aureus Mu50
auuuauuuuuaau

SEQ ID NO: 3991558 - RNA, 15 nt, Staphylococcus aureus subsp. aureus Mu50
auuuauuuuuauaug

SEQ ID NO: 3991559 - RNA, 12 nt, Staphylococcus aureus subsp. aureus Mu50
auuuauuuuuga

SEQ ID NO: 3991560 - RNA, 14 nt, Staphylococcus aureus subsp. aureus Mu50
auuucaaaaauagc

SEQ ID NO: 3991561 - RNA, 15 nt, Staphylococcus aureus subsp. aureus Mu50
auuucaaaaauagcg

SEQ ID NO: 3991562 - RNA, 17 nt, Staphylococcus aureus subsp. aureus Mu50
auuucaaauaagaaugu

SEQ ID NO: 3991563 - RNA, 14 nt, Staphylococcus aureus subsp. aureus Mu50
auuucaacaaacau

SEQ ID NO: 3991564 - RNA, 20 nt, Staphylococcus aureus subsp. aureus Mu50
auuucaaccuuuuaauagua

SEQ ID NO: 3991565 - RNA, 15 nt, Staphylococcus aureus subsp. aureus Mu50
auuucaacuuuuuaa

SEQ ID NO: 3991566 - RNA, 20 nt, Staphylococcus aureus subsp. aureus Mu50
auuucaaguguauuaucuuu

SEQ ID NO: 3991567 - RNA, 16 nt, Staphylococcus aureus subsp. aureus Mu50
auuucaauauuaaaau

SEQ ID NO: 3991568 - RNA, 20 nt, Staphylococcus aureus subsp. aureus Mu50
auuucaaugagaagcugucu

SEQ ID NO: 3991569 - RNA, 22 nt, Staphylococcus aureus subsp. aureus Mu50
auuucaccaguagucacuguuu

SEQ ID NO: 3991570 - RNA, 21 nt, Staphylococcus aureus subsp. aureus Mu50
auuucacgcugaaauuuuuua

SEQ ID NO: 3991571 - RNA, 18 nt, Staphylococcus aureus subsp. aureus Mu50
auuucacuugaccacuuu

SEQ ID NO: 3991572 - RNA, 13 nt, Staphylococcus aureus subsp. aureus Mu50
auuucacuuuaac

SEQ ID NO: 3991573 - RNA, 14 nt, Staphylococcus aureus subsp. aureus Mu50
auuucacuuuaacu

SEQ ID NO: 3991574 - RNA, 15 nt, Staphylococcus aureus subsp. aureus Mu50
auuucacuuuaacuu

SEQ ID NO: 3991575 - RNA, 16 nt, Staphylococcus aureus subsp. aureus Mu50
auuucacuuuaacuuc

SEQ ID NO: 3991576 - RNA, 14 nt, Staphylococcus aureus subsp. aureus Mu50
auuucagaaauaca

SEQ ID NO: 3991577 - RNA, 22 nt, Staphylococcus aureus subsp. aureus Mu50
auuucagaacuaugaauagaug

SEQ ID NO: 3991578 - RNA, 21 nt, Staphylococcus aureus subsp. aureus Mu50
auuucagcaccgacaauuaua

SEQ ID NO: 3991579 - RNA, 23 nt, Staphylococcus aureus subsp. aureus Mu50
auuucagcaccgacaauuauaau

SEQ ID NO: 3991580 - RNA, 15 nt, Staphylococcus aureus subsp. aureus Mu50
auuucagcauuugcu

SEQ ID NO: 3991581 - RNA, 15 nt, Staphylococcus aureus subsp. aureus Mu50
auuucagcgauaacg

SEQ ID NO: 3991582 - RNA, 20 nt, Staphylococcus aureus subsp. aureus Mu50
auuucaggcguuaauacaua

SEQ ID NO: 3991583 - RNA, 16 nt, Staphylococcus aureus subsp. aureus Mu50
auuucaguaccauguu

SEQ ID NO: 3991584 - RNA, 19 nt, Staphylococcus aureus subsp. aureus Mu50
auuucaguaccauguuuuu

SEQ ID NO: 3991585 - RNA, 22 nt, Staphylococcus aureus subsp. aureus Mu50
auuucaguaucauguucuuaua

SEQ ID NO: 3991586 - RNA, 18 nt, Staphylococcus aureus subsp. aureus Mu50
auuucauagggaaauauu

SEQ ID NO: 3991587 - RNA, 21 nt, Staphylococcus aureus subsp. aureus Mu50
auuucaucaaauccaaaaucu

SEQ ID NO: 3991588 - RNA, 13 nt, Staphylococcus aureus subsp. aureus Mu50
auuucaucaugug

SEQ ID NO: 3991589 - RNA, 13 nt, Staphylococcus aureus subsp. aureus Mu50
auuucaugauguu

SEQ ID NO: 3991590 - RNA, 15 nt, Staphylococcus aureus subsp. aureus Mu50
auuucaugauguuaa

SEQ ID NO: 3991591 - RNA, 15 nt, Staphylococcus aureus subsp. aureus Mu50
auuucaugugucaca

SEQ ID NO: 3991592 - RNA, 15 nt, Staphylococcus aureus subsp. aureus Mu50
auuucauguucauaa

SEQ ID NO: 3991593 - RNA, 17 nt, Staphylococcus aureus subsp. aureus Mu50
auuucauguucauaaua

SEQ ID NO: 3991594 - RNA, 14 nt, Staphylococcus aureus subsp. aureus Mu50
auuucauuugaaau

SEQ ID NO: 3991595 - RNA, 18 nt, Staphylococcus aureus subsp. aureus Mu50
auuucccacgugccucau

SEQ ID NO: 3991596 - RNA, 17 nt, Staphylococcus aureus subsp. aureus Mu50
auuucccauuuaucuaa

SEQ ID NO: 3991597 - RNA, 15 nt, Staphylococcus aureus subsp. aureus Mu50
auuucccuaugaaau

SEQ ID NO: 3991598 - RNA, 21 nt, Staphylococcus aureus subsp. aureus Mu50
auuuccuauuaggauccaauu

SEQ ID NO: 3991599 - RNA, 21 nt, Staphylococcus aureus subsp. aureus Mu50
auuuccucgguuuuauuuuua

SEQ ID NO: 3991600 - RNA, 18 nt, Staphylococcus aureus subsp. aureus Mu50
auuuccuuuagcaaaaau

SEQ ID NO: 3991601 - RNA, 22 nt, Staphylococcus aureus subsp. aureus Mu50
auuucgaccgcguauuccauug

SEQ ID NO: 3991602 - RNA, 18 nt, Staphylococcus aureus subsp. aureus Mu50
auuucgauaccuaaaaua

SEQ ID NO: 3991603 - RNA, 19 nt, Staphylococcus aureus subsp. aureus Mu50
auuucgauaccuaaaauac

SEQ ID NO: 3991604 - RNA, 21 nt, Staphylococcus aureus subsp. aureus Mu50
auuucgauugcguuuucuaau

SEQ ID NO: 3991605 - RNA, 13 nt, Staphylococcus aureus subsp. aureus Mu50
auuucgauuuuca

SEQ ID NO: 3991606 - RNA, 19 nt, Staphylococcus aureus subsp. aureus Mu50
auuucgcccaccgcguguu

SEQ ID NO: 3991607 - RNA, 16 nt, Staphylococcus aureus subsp. aureus Mu50
auuucgcuuuuuuuau

SEQ ID NO: 3991608 - RNA, 20 nt, Staphylococcus aureus subsp. aureus Mu50
auuucggggacguucaugga

SEQ ID NO: 3991609 - RNA, 21 nt, Staphylococcus aureus subsp. aureus Mu50
auuucgguauuuuaaauuuau

SEQ ID NO: 3991610 - RNA, 18 nt, Staphylococcus aureus subsp. aureus Mu50
auuucuaaaccauuuuca

SEQ ID NO: 3991611 - RNA, 20 nt, Staphylococcus aureus subsp. aureus Mu50
auuucuaaauuauuuauuca

SEQ ID NO: 3991612 - RNA, 17 nt, Staphylococcus aureus subsp. aureus Mu50
auuucuaauacauacug

SEQ ID NO: 3991613 - RNA, 13 nt, Staphylococcus aureus subsp. aureus Mu50
auuucuaauuuag

SEQ ID NO: 3991614 - RNA, 18 nt, Staphylococcus aureus subsp. aureus Mu50
auuucuacccguuuuuug

SEQ ID NO: 3991615 - RNA, 23 nt, Staphylococcus aureus subsp. aureus Mu50
auuucuacccguuuuuugguucu

SEQ ID NO: 3991616 - RNA, 18 nt, Staphylococcus aureus subsp. aureus Mu50
auuucuagcucuccuaca

SEQ ID NO: 3991617 - RNA, 15 nt, Staphylococcus aureus subsp. aureus Mu50
auuucuauaucuauu

SEQ ID NO: 3991618 - RNA, 16 nt, Staphylococcus aureus subsp. aureus Mu50
auuuuaaaagauaaau

SEQ ID NO: 3991619 - RNA, 14 nt, Staphylococcus aureus subsp. aureus Mu50
auuuuaaacaugaa

SEQ ID NO: 3991620 - RNA, 19 nt, Staphylococcus aureus subsp. aureus Mu50
auuuuaaacaugaacaauc

SEQ ID NO: 3991621 - RNA, 20 nt, Staphylococcus aureus subsp. aureus Mu50
auuuuaaaccguuauauauu

SEQ ID NO: 3991622 - RNA, 23 nt, Staphylococcus aureus subsp. aureus Mu50
auuuuaaacguaucauuuaaaau

SEQ ID NO: 3991623 - RNA, 14 nt, Staphylococcus aureus subsp. aureus Mu50
auuuuaaauaaaau

SEQ ID NO: 3991624 - RNA, 18 nt, Staphylococcus aureus subsp. aureus Mu50
auuuuaaauaaaaugcau

SEQ ID NO: 3991625 - RNA, 20 nt, Staphylococcus aureus subsp. aureus Mu50
auuuuaaauauugauauaaa

SEQ ID NO: 3991626 - RNA, 22 nt, Staphylococcus aureus subsp. aureus Mu50
auuuuaaauauugauauaaaaa

SEQ ID NO: 3991627 - RNA, 13 nt, Staphylococcus aureus subsp. aureus Mu50
auuuuaaauuaca

SEQ ID NO: 3991628 - RNA, 14 nt, Staphylococcus aureus subsp. aureus Mu50
auuuuaaauuacaa

SEQ ID NO: 3991629 - RNA, 16 nt, Staphylococcus aureus subsp. aureus Mu50
auuuuaaauuacaacu

SEQ ID NO: 3991630 - RNA, 15 nt, Staphylococcus aureus subsp. aureus Mu50
auuuuaaauuuauaa

SEQ ID NO: 3991631 - RNA, 17 nt, Staphylococcus aureus subsp. aureus Mu50
auuuuaaauuuauaaua

SEQ ID NO: 3991632 - RNA, 14 nt, Staphylococcus aureus subsp. aureus Mu50
auuuuaacgucauu

SEQ ID NO: 3991633 - RNA, 17 nt, Staphylococcus aureus subsp. aureus Mu50
auuuuaacuuaauuaaa

SEQ ID NO: 3991634 - RNA, 15 nt, Staphylococcus aureus subsp. aureus Mu50
auuuuaacuuauaua

SEQ ID NO: 3991635 - RNA, 13 nt, Staphylococcus aureus subsp. aureus Mu50
auuuuaagugguu

SEQ ID NO: 3991636 - RNA, 18 nt, Staphylococcus aureus subsp. aureus Mu50
auuuuaauaaaaucaucu

SEQ ID NO: 3991637 - RNA, 14 nt, Staphylococcus aureus subsp. aureus Mu50
auuuuaauauauuu

SEQ ID NO: 3991638 - RNA, 15 nt, Staphylococcus aureus subsp. aureus Mu50
auuuuaauauuaugu

SEQ ID NO: 3991639 - RNA, 15 nt, Staphylococcus aureus subsp. aureus Mu50
auuuuaauauuuucu

SEQ ID NO: 3991640 - RNA, 17 nt, Staphylococcus aureus subsp. aureus Mu50
auuuuaaugauuuuuca

SEQ ID NO: 3991641 - RNA, 23 nt, Staphylococcus aureus subsp. aureus Mu50
auuuuaauuaauuauuauauaau

SEQ ID NO: 3991642 - RNA, 13 nt, Staphylococcus aureus subsp. aureus Mu50
auuuuaauuuuca

SEQ ID NO: 3991643 - RNA, 14 nt, Staphylococcus aureus subsp. aureus Mu50
auuuuaauuuucag

SEQ ID NO: 3991644 - RNA, 16 nt, Staphylococcus aureus subsp. aureus Mu50
auuuuacaaucaacuu

SEQ ID NO: 3991645 - RNA, 14 nt, Staphylococcus aureus subsp. aureus Mu50
auuuuaccaucaau

SEQ ID NO: 3991646 - RNA, 19 nt, Staphylococcus aureus subsp. aureus Mu50
auuuuacucuguauggaug

SEQ ID NO: 3991647 - RNA, 17 nt, Staphylococcus aureus subsp. aureus Mu50
auuuuacuuacuuuucu

SEQ ID NO: 3991648 - RNA, 21 nt, Staphylococcus aureus subsp. aureus Mu50
auuuuacuugaauauagcugu

SEQ ID NO: 3991649 - RNA, 18 nt, Staphylococcus aureus subsp. aureus Mu50
auuuuagauuuaguuuuu

SEQ ID NO: 3991650 - RNA, 16 nt, Staphylococcus aureus subsp. aureus Mu50
auuuuagcaaaagcuu

SEQ ID NO: 3991651 - RNA, 17 nt, Staphylococcus aureus subsp. aureus Mu50
auuuuagccaaauuacu

SEQ ID NO: 3991652 - RNA, 17 nt, Staphylococcus aureus subsp. aureus Mu50
auuuuaggcaauguaau

SEQ ID NO: 3991653 - RNA, 15 nt, Staphylococcus aureus subsp. aureus Mu50
auuuuaguucacaug

SEQ ID NO: 3991654 - RNA, 22 nt, Staphylococcus aureus subsp. aureus Mu50
auuuuaguucacaugaauuuua

SEQ ID NO: 3991655 - RNA, 14 nt, Staphylococcus aureus subsp. aureus Mu50
auuuuauaaaguuu

SEQ ID NO: 3991656 - RNA, 17 nt, Staphylococcus aureus subsp. aureus Mu50
auuuuauaaaucaaaga

SEQ ID NO: 3991657 - RNA, 15 nt, Staphylococcus aureus subsp. aureus Mu50
auuuuauaaaucaua

SEQ ID NO: 3991658 - RNA, 17 nt, Staphylococcus aureus subsp. aureus Mu50
auuuuauaaaucauaga

SEQ ID NO: 3991659 - RNA, 13 nt, Staphylococcus aureus subsp. aureus Mu50
auuuuauaagaau

SEQ ID NO: 3991660 - RNA, 14 nt, Staphylococcus aureus subsp. aureus Mu50
auuuuauaagaauu

SEQ ID NO: 3991661 - RNA, 18 nt, Staphylococcus aureus subsp. aureus Mu50
auuuuauaaguauauaau

SEQ ID NO: 3991662 - RNA, 18 nt, Staphylococcus aureus subsp. aureus Mu50
auuuuauacauaaauauu

SEQ ID NO: 3991663 - RNA, 12 nt, Staphylococcus aureus subsp. aureus Mu50
auuuuauauauc

SEQ ID NO: 3991664 - RNA, 18 nt, Staphylococcus aureus subsp. aureus Mu50
auuuuauccaaaccaauu

SEQ ID NO: 3991665 - RNA, 16 nt, Staphylococcus aureus subsp. aureus Mu50
auuuuaucuaaacauu

SEQ ID NO: 3991666 - RNA, 22 nt, Staphylococcus aureus subsp. aureus Mu50
auuuuaucuaaagcuauaaaaa

SEQ ID NO: 3991667 - RNA, 16 nt, Staphylococcus aureus subsp. aureus Mu50
auuuuaucugaaaaua

SEQ ID NO: 3991668 - RNA, 13 nt, Staphylococcus aureus subsp. aureus Mu50
auuuuaucugaau

SEQ ID NO: 3991669 - RNA, 18 nt, Staphylococcus aureus subsp. aureus Mu50
auuuuaucugaaucugcu

SEQ ID NO: 3991670 - RNA, 15 nt, Staphylococcus aureus subsp. aureus Mu50
auuuuaugauuugau

SEQ ID NO: 3991671 - RNA, 18 nt, Staphylococcus aureus subsp. aureus Mu50
auuuuaugauuugauuug

SEQ ID NO: 3991672 - RNA, 13 nt, Staphylococcus aureus subsp. aureus Mu50
auuuuauuauuaa

SEQ ID NO: 3991673 - RNA, 18 nt, Staphylococcus aureus subsp. aureus Mu50
auuuuauuauuaaucguu

SEQ ID NO: 3991674 - RNA, 14 nt, Staphylococcus aureus subsp. aureus Mu50
auuuuauucacuuu

SEQ ID NO: 3991675 - RNA, 15 nt, Staphylococcus aureus subsp. aureus Mu50
auuuuauucacuuuu

SEQ ID NO: 3991676 - RNA, 20 nt, Staphylococcus aureus subsp. aureus Mu50
auuuuauugaguaucaugcu

SEQ ID NO: 3991677 - RNA, 23 nt, Staphylococcus aureus subsp. aureus Mu50
auuuuauugaguaucaugcuuuu

SEQ ID NO: 3991678 - RNA, 13 nt, Staphylococcus aureus subsp. aureus Mu50
auuuuauuuaauu

SEQ ID NO: 3991679 - RNA, 18 nt, Staphylococcus aureus subsp. aureus Mu50
auuuuauuuaauuccauu

SEQ ID NO: 3991680 - RNA, 19 nt, Staphylococcus aureus subsp. aureus Mu50
auuuuauuuuaacuuaauu

SEQ ID NO: 3991681 - RNA, 19 nt, Staphylococcus aureus subsp. aureus Mu50
auuuucaaaaccaauuaau

SEQ ID NO: 3991682 - RNA, 15 nt, Staphylococcus aureus subsp. aureus Mu50
auuuucaaaacugcc

SEQ ID NO: 3991683 - RNA, 19 nt, Staphylococcus aureus subsp. aureus Mu50
auuuucaaaacugccaaaa

SEQ ID NO: 3991684 - RNA, 22 nt, Staphylococcus aureus subsp. aureus Mu50
auuuucaaagacguacaugcuu

SEQ ID NO: 3991685 - RNA, 20 nt, Staphylococcus aureus subsp. aureus Mu50
auuuucaacacacuauuaua

SEQ ID NO: 3991686 - RNA, 20 nt, Staphylococcus aureus subsp. aureus Mu50
auuuucaaguaaugauauua

SEQ ID NO: 3991687 - RNA, 17 nt, Staphylococcus aureus subsp. aureus Mu50
auuuucaaguuuaaaau

SEQ ID NO: 3991688 - RNA, 16 nt, Staphylococcus aureus subsp. aureus Mu50
auuuucaauaaaaaug

SEQ ID NO: 3991689 - RNA, 16 nt, Staphylococcus aureus subsp. aureus Mu50
auuuucaauaaauuuu

SEQ ID NO: 3991690 - RNA, 19 nt, Staphylococcus aureus subsp. aureus Mu50
auuuucaauaaauuuuaua

SEQ ID NO: 3991691 - RNA, 13 nt, Staphylococcus aureus subsp. aureus Mu50
auuuucaauacuu

SEQ ID NO: 3991692 - RNA, 22 nt, Staphylococcus aureus subsp. aureus Mu50
auuuucaauacuugaaagauuu

SEQ ID NO: 3991693 - RNA, 22 nt, Staphylococcus aureus subsp. aureus Mu50
auuuucaaugauuaaaucuucu

SEQ ID NO: 3991694 - RNA, 22 nt, Staphylococcus aureus subsp. aureus Mu50
auuuucaauuagaaaauuucuc

SEQ ID NO: 3991695 - RNA, 15 nt, Staphylococcus aureus subsp. aureus Mu50
auuuucacuaauauu

SEQ ID NO: 3991696 - RNA, 17 nt, Staphylococcus aureus subsp. aureus Mu50
auuuucacuaauauuuc

SEQ ID NO: 3991697 - RNA, 17 nt, Staphylococcus aureus subsp. aureus Mu50
auuuucauguccaucuu

SEQ ID NO: 3991698 - RNA, 19 nt, Staphylococcus aureus subsp. aureus Mu50
auuuucauuguauguugaa

SEQ ID NO: 3991699 - RNA, 14 nt, Staphylococcus aureus subsp. aureus Mu50
auuuucuaaauaua

SEQ ID NO: 3991700 - RNA, 13 nt, Staphylococcus aureus subsp. aureus Mu50
auuuucucccaua

SEQ ID NO: 3991701 - RNA, 17 nt, Staphylococcus aureus subsp. aureus Mu50
auuuucuggccacuaau

SEQ ID NO: 3991702 - RNA, 21 nt, Staphylococcus aureus subsp. aureus Mu50
auuuucuguugcaguuucaau

SEQ ID NO: 3991703 - RNA, 20 nt, Staphylococcus aureus subsp. aureus Mu50
auuuucuguuuaauuaaaau

SEQ ID NO: 3991704 - RNA, 20 nt, Staphylococcus aureus subsp. aureus Mu50
auuuucuuagaaaaucaagu

SEQ ID NO: 3991705 - RNA, 21 nt, Staphylococcus aureus subsp. aureus Mu50
auuuucuuagaaaaucaaguu

SEQ ID NO: 3991706 - RNA, 12 nt, Staphylococcus aureus subsp. aureus Mu50
caaaaaaugaau

SEQ ID NO: 3991707 - RNA, 14 nt, Staphylococcus aureus subsp. aureus Mu50
caaaaaaugaauau

SEQ ID NO: 3991708 - RNA, 12 nt, Staphylococcus aureus subsp. aureus Mu50
caaaaaauugua

SEQ ID NO: 3991709 - RNA, 19 nt, Staphylococcus aureus subsp. aureus Mu50
caaaaaauuguaagucgaa

SEQ ID NO: 3991710 - RNA, 17 nt, Staphylococcus aureus subsp. aureus Mu50
caaaaacaguuacaacu

SEQ ID NO: 3991711 - RNA, 16 nt, Staphylococcus aureus subsp. aureus Mu50
caaaaacgguaauuuc

SEQ ID NO: 3991712 - RNA, 11 nt, Staphylococcus aureus subsp. aureus Mu50
caaaaagaauu

SEQ ID NO: 3991713 - RNA, 18 nt, Staphylococcus aureus subsp. aureus Mu50
caaaaagcccuauuguuu

SEQ ID NO: 3991714 - RNA, 14 nt, Staphylococcus aureus subsp. aureus Mu50
caaaaauaaaaaug

SEQ ID NO: 3991715 - RNA, 14 nt, Staphylococcus aureus subsp. aureus Mu50
caaaaauaaaccau

SEQ ID NO: 3991716 - RNA, 21 nt, Staphylococcus aureus subsp. aureus Mu50
caaaaauaaucaguauuuacu

SEQ ID NO: 3991717 - RNA, 21 nt, Staphylococcus aureus subsp. aureus Mu50
caaaaauaauuaugaaaagua

SEQ ID NO: 3991718 - RNA, 21 nt, Staphylococcus aureus subsp. aureus Mu50
caaaaauagauugaaaaaaua

SEQ ID NO: 3991719 - RNA, 17 nt, Staphylococcus aureus subsp. aureus Mu50
caaaaaucauccauaaa

SEQ ID NO: 3991720 - RNA, 21 nt, Staphylococcus aureus subsp. aureus Mu50
caaaaaugaagaauacaaaua

SEQ ID NO: 3991721 - RNA, 20 nt, Staphylococcus aureus subsp. aureus Mu50
caaaaauugcuauauuagua

SEQ ID NO: 3991722 - RNA, 13 nt, Staphylococcus aureus subsp. aureus Mu50
caaaaauuguaaa

SEQ ID NO: 3991723 - RNA, 13 nt, Staphylococcus aureus subsp. aureus Mu50
caaaacaaaaaau

SEQ ID NO: 3991724 - RNA, 14 nt, Staphylococcus aureus subsp. aureus Mu50
caaaacaaaaaaua

SEQ ID NO: 3991725 - RNA, 19 nt, Staphylococcus aureus subsp. aureus Mu50
caaaacaaaaaauaucuuu

SEQ ID NO: 3991726 - RNA, 22 nt, Staphylococcus aureus subsp. aureus Mu50
caaaacaaaaaauaucuuuuug

SEQ ID NO: 3991727 - RNA, 23 nt, Staphylococcus aureus subsp. aureus Mu50
caaaacaaaaaauaucuuuuugu

SEQ ID NO: 3991728 - RNA, 21 nt, Staphylococcus aureus subsp. aureus Mu50
caaaacaauuuaaaaagcagu

SEQ ID NO: 3991729 - RNA, 19 nt, Staphylococcus aureus subsp. aureus Mu50
caaaacauauucaguauau

SEQ ID NO: 3991730 - RNA, 13 nt, Staphylococcus aureus subsp. aureus Mu50
caaaacauuuugu

SEQ ID NO: 3991731 - RNA, 14 nt, Staphylococcus aureus subsp. aureus Mu50
caaaaccaaaugaa

SEQ ID NO: 3991732 - RNA, 14 nt, Staphylococcus aureus subsp. aureus Mu50
caaaaccaauuaau

SEQ ID NO: 3991733 - RNA, 21 nt, Staphylococcus aureus subsp. aureus Mu50
caaaaccaauuaauuguaaag

SEQ ID NO: 3991734 - RNA, 17 nt, Staphylococcus aureus subsp. aureus Mu50
caaaaccgcuauaaaau

SEQ ID NO: 3991735 - RNA, 18 nt, Staphylococcus aureus subsp. aureus Mu50
caaaacgcauuucaugug

SEQ ID NO: 3991736 - RNA, 20 nt, Staphylococcus aureus subsp. aureus Mu50
caaaacgcauuucauguguc

SEQ ID NO: 3991737 - RNA, 23 nt, Staphylococcus aureus subsp. aureus Mu50
caaaacguuugaagaauguuuca

SEQ ID NO: 3991738 - RNA, 22 nt, Staphylococcus aureus subsp. aureus Mu50
caaaacuagcaguaauauguug

SEQ ID NO: 3991739 - RNA, 13 nt, Staphylococcus aureus subsp. aureus Mu50
caaaacuuguaau

SEQ ID NO: 3991740 - RNA, 21 nt, Staphylococcus aureus subsp. aureus Mu50
caaaacuuguaaucauaccag

SEQ ID NO: 3991741 - RNA, 20 nt, Staphylococcus aureus subsp. aureus Mu50
caaaagaaaguuaauuaugu

SEQ ID NO: 3991742 - RNA, 12 nt, Staphylococcus aureus subsp. aureus Mu50
caaaagaaauuc

SEQ ID NO: 3991743 - RNA, 20 nt, Staphylococcus aureus subsp. aureus Mu50
caaaagauguuucaaaauaa

SEQ ID NO: 3991744 - RNA, 15 nt, Staphylococcus aureus subsp. aureus Mu50
caaaagcgcaggcga

SEQ ID NO: 3991745 - RNA, 16 nt, Staphylococcus aureus subsp. aureus Mu50
caaaagcguucaauuu

SEQ ID NO: 3991746 - RNA, 20 nt, Staphylococcus aureus subsp. aureus Mu50
caaaaggauaagaacgagaa

SEQ ID NO: 3991747 - RNA, 13 nt, Staphylococcus aureus subsp. aureus Mu50
caaaaguaugauu

SEQ ID NO: 3991748 - RNA, 14 nt, Staphylococcus aureus subsp. aureus Mu50
caaaaguaugauuu

SEQ ID NO: 3991749 - RNA, 21 nt, Staphylococcus aureus subsp. aureus Mu50
caaaaguaugauuuguuugau

SEQ ID NO: 3991750 - RNA, 19 nt, Staphylococcus aureus subsp. aureus Mu50
caaaaguuauauaaauuug

SEQ ID NO: 3991751 - RNA, 20 nt, Staphylococcus aureus subsp. aureus Mu50
caaaaguuauauaaauuugu

SEQ ID NO: 3991752 - RNA, 21 nt, Staphylococcus aureus subsp. aureus Mu50
caaaaguuauauaaauuugua

SEQ ID NO: 3991753 - RNA, 15 nt, Staphylococcus aureus subsp. aureus Mu50
caaaauaacauguuu

SEQ ID NO: 3991754 - RNA, 18 nt, Staphylococcus aureus subsp. aureus Mu50
caaaauaauagcaguuuc

SEQ ID NO: 3991755 - RNA, 12 nt, Staphylococcus aureus subsp. aureus Mu50
caaaauauaaaa

SEQ ID NO: 3991756 - RNA, 13 nt, Staphylococcus aureus subsp. aureus Mu50
caaaauauaaaau

SEQ ID NO: 3991757 - RNA, 14 nt, Staphylococcus aureus subsp. aureus Mu50
caaaauauaaaauc

SEQ ID NO: 3991758 - RNA, 15 nt, Staphylococcus aureus subsp. aureus Mu50
caaaauauacuaaau

SEQ ID NO: 3991759 - RNA, 16 nt, Staphylococcus aureus subsp. aureus Mu50
caaaauauacuaaauu

SEQ ID NO: 3991760 - RNA, 23 nt, Staphylococcus aureus subsp. aureus Mu50
caaaauauggaauuucauauaau

SEQ ID NO: 3991761 - RNA, 19 nt, Staphylococcus aureus subsp. aureus Mu50
caaaaucaacccaucaugu

SEQ ID NO: 3991762 - RNA, 21 nt, Staphylococcus aureus subsp. aureus Mu50
caaaaucaccuuuuuuaacuu

SEQ ID NO: 3991763 - RNA, 13 nt, Staphylococcus aureus subsp. aureus Mu50
caaaaugaacaau

SEQ ID NO: 3991764 - RNA, 14 nt, Staphylococcus aureus subsp. aureus Mu50
caaaaugaacaaua

SEQ ID NO: 3991765 - RNA, 22 nt, Staphylococcus aureus subsp. aureus Mu50
caaaaugauugccaccguuaua

SEQ ID NO: 3991766 - RNA, 23 nt, Staphylococcus aureus subsp. aureus Mu50
caaaaugccaagaagacauugga

SEQ ID NO: 3991767 - RNA, 16 nt, Staphylococcus aureus subsp. aureus Mu50
caaaaugguaucaaua

SEQ ID NO: 3991768 - RNA, 14 nt, Staphylococcus aureus subsp. aureus Mu50
caaaauuauguaaa

SEQ ID NO: 3991769 - RNA, 17 nt, Staphylococcus aureus subsp. aureus Mu50
caaaauuauguaaaaaa

SEQ ID NO: 3991770 - RNA, 19 nt, Staphylococcus aureus subsp. aureus Mu50
caaaauuauguaaaaaaua

SEQ ID NO: 3991771 - RNA, 17 nt, Staphylococcus aureus subsp. aureus Mu50
caaaauugaacuuugua

SEQ ID NO: 3991772 - RNA, 12 nt, Staphylococcus aureus subsp. aureus Mu50
caaaauugucuc

SEQ ID NO: 3991773 - RNA, 13 nt, Staphylococcus aureus subsp. aureus Mu50
caaaauuugaaau

SEQ ID NO: 3991774 - RNA, 23 nt, Staphylococcus aureus subsp. aureus Mu50
caaaauuugaaauauaccaacca

SEQ ID NO: 3991775 - RNA, 14 nt, Staphylococcus aureus subsp. aureus Mu50
caaaauuuucuaca

SEQ ID NO: 3991776 - RNA, 18 nt, Staphylococcus aureus subsp. aureus Mu50
caaacaaagcucaauaaa

SEQ ID NO: 3991777 - RNA, 15 nt, Staphylococcus aureus subsp. aureus Mu50
caaacaaagggguau

SEQ ID NO: 3991778 - RNA, 11 nt, Staphylococcus aureus subsp. aureus Mu50
caaacaacauc

SEQ ID NO: 3991779 - RNA, 21 nt, Staphylococcus aureus subsp. aureus Mu50
caaacaaccugugauaaaaau

SEQ ID NO: 3991780 - RNA, 12 nt, Staphylococcus aureus subsp. aureus Mu50
caaacaauacag

SEQ ID NO: 3991781 - RNA, 15 nt, Staphylococcus aureus subsp. aureus Mu50
caaacaauacauaau

SEQ ID NO: 3991782 - RNA, 21 nt, Staphylococcus aureus subsp. aureus Mu50
caaacaguccuuauuauaggg

SEQ ID NO: 3991783 - RNA, 13 nt, Staphylococcus aureus subsp. aureus Mu50
caaacauaaauaa

SEQ ID NO: 3991784 - RNA, 21 nt, Staphylococcus aureus subsp. aureus Mu50
caaacauaauuaccuuuccau

SEQ ID NO: 3991785 - RNA, 20 nt, Staphylococcus aureus subsp. aureus Mu50
caaacauagauacaaaguac

SEQ ID NO: 3991786 - RNA, 21 nt, Staphylococcus aureus subsp. aureus Mu50
caaacauuaaucuauauaaaa

SEQ ID NO: 3991787 - RNA, 20 nt, Staphylococcus aureus subsp. aureus Mu50
caaacauuacccuuuaaacu

SEQ ID NO: 3991788 - RNA, 13 nt, Staphylococcus aureus subsp. aureus Mu50
caaacauuccucu

SEQ ID NO: 3991789 - RNA, 13 nt, Staphylococcus aureus subsp. aureus Mu50
caaaccaccaaaa

SEQ ID NO: 3991790 - RNA, 22 nt, Staphylococcus aureus subsp. aureus Mu50
caaacccuuuaaacauauuuac

SEQ ID NO: 3991791 - RNA, 19 nt, Staphylococcus aureus subsp. aureus Mu50
caaacggcccaacuggauc

SEQ ID NO: 3991792 - RNA, 13 nt, Staphylococcus aureus subsp. aureus Mu50
caaacuauuaaug

SEQ ID NO: 3991793 - RNA, 18 nt, Staphylococcus aureus subsp. aureus Mu50
caaacucuagacgcguuu

SEQ ID NO: 3991794 - RNA, 20 nt, Staphylococcus aureus subsp. aureus Mu50
caaaugaaaaaguaaaaucu

SEQ ID NO: 3991795 - RNA, 15 nt, Staphylococcus aureus subsp. aureus Mu50
caaaugaaccagcua

SEQ ID NO: 3991796 - RNA, 14 nt, Staphylococcus aureus subsp. aureus Mu50
caaaugacauuuua

SEQ ID NO: 3991797 - RNA, 23 nt, Staphylococcus aureus subsp. aureus Mu50
caaaugccgcuucuaauuuuuca

SEQ ID NO: 3991798 - RNA, 10 nt, Staphylococcus aureus subsp. aureus Mu50
caaaugcuua

SEQ ID NO: 3991799 - RNA, 15 nt, Staphylococcus aureus subsp. aureus Mu50
caaaugcuuaauaaa

SEQ ID NO: 3991800 - RNA, 18 nt, Staphylococcus aureus subsp. aureus Mu50
caaaugcuuaauaaaauc

SEQ ID NO: 3991801 - RNA, 15 nt, Staphylococcus aureus subsp. aureus Mu50
caaauguaacauuaa

SEQ ID NO: 3991802 - RNA, 22 nt, Staphylococcus aureus subsp. aureus Mu50
caaaugugguggguauauaauu

SEQ ID NO: 3991803 - RNA, 23 nt, Staphylococcus aureus subsp. aureus Mu50
caaaugugguggguauauaauuu

SEQ ID NO: 3991804 - RNA, 13 nt, Staphylococcus aureus subsp. aureus Mu50
caaauguugaaug

SEQ ID NO: 3991805 - RNA, 18 nt, Staphylococcus aureus subsp. aureus Mu50
caaauguugaauguggaa

SEQ ID NO: 3991806 - RNA, 13 nt, Staphylococcus aureus subsp. aureus Mu50
caaauuaaaaaac

SEQ ID NO: 3991807 - RNA, 16 nt, Staphylococcus aureus subsp. aureus Mu50
caaauuaaaaaacaau

SEQ ID NO: 3991808 - RNA, 20 nt, Staphylococcus aureus subsp. aureus Mu50
caaauuacacccuuuaaauu

SEQ ID NO: 3991809 - RNA, 22 nt, Staphylococcus aureus subsp. aureus Mu50
caaauuacugucuuuccauaau

SEQ ID NO: 3991810 - RNA, 14 nt, Staphylococcus aureus subsp. aureus Mu50
caaauuaguaugac

SEQ ID NO: 3991811 - RNA, 15 nt, Staphylococcus aureus subsp. aureus Mu50
caaauuaucauuaaa

SEQ ID NO: 3991812 - RNA, 16 nt, Staphylococcus aureus subsp. aureus Mu50
caaauuaucauuaaau

SEQ ID NO: 3991813 - RNA, 12 nt, Staphylococcus aureus subsp. aureus Mu50
caaauuaucugu

SEQ ID NO: 3991814 - RNA, 16 nt, Staphylococcus aureus subsp. aureus Mu50
caaauucaacuuuaau

SEQ ID NO: 3991815 - RNA, 16 nt, Staphylococcus aureus subsp. aureus Mu50
caaauucauauuaacu

SEQ ID NO: 3991816 - RNA, 17 nt, Staphylococcus aureus subsp. aureus Mu50
caaauucauauuaacug

SEQ ID NO: 3991817 - RNA, 15 nt, Staphylococcus aureus subsp. aureus Mu50
caaauucauuuguau

SEQ ID NO: 3991818 - RNA, 15 nt, Staphylococcus aureus subsp. aureus Mu50
caaauugaacuucuu

SEQ ID NO: 3991819 - RNA, 18 nt, Staphylococcus aureus subsp. aureus Mu50
caaauugaccgacaaaac

SEQ ID NO: 3991820 - RNA, 19 nt, Staphylococcus aureus subsp. aureus Mu50
caaauugcaaaguaacaau

SEQ ID NO: 3991821 - RNA, 19 nt, Staphylococcus aureus subsp. aureus Mu50
caaauugccuuucauuuua

SEQ ID NO: 3991822 - RNA, 18 nt, Staphylococcus aureus subsp. aureus Mu50
caaauuggauaauuucuu

SEQ ID NO: 3991823 - RNA, 14 nt, Staphylococcus aureus subsp. aureus Mu50
caaauugugauuua

SEQ ID NO: 3991824 - RNA, 14 nt, Staphylococcus aureus subsp. aureus Mu50
caaauuuugaguau

SEQ ID NO: 3991825 - RNA, 13 nt, Staphylococcus aureus subsp. aureus Mu50
caacaaaaagaau

SEQ ID NO: 3991826 - RNA, 13 nt, Staphylococcus aureus subsp. aureus Mu50
caacaaaagaugu

SEQ ID NO: 3991827 - RNA, 12 nt, Staphylococcus aureus subsp. aureus Mu50
caacaaacauaa

SEQ ID NO: 3991828 - RNA, 20 nt, Staphylococcus aureus subsp. aureus Mu50
caacaaacgcugauuuaaua

SEQ ID NO: 3991829 - RNA, 19 nt, Staphylococcus aureus subsp. aureus Mu50
caacaaagugcaauuauuu

SEQ ID NO: 3991830 - RNA, 13 nt, Staphylococcus aureus subsp. aureus Mu50
caacaaauauaau

SEQ ID NO: 3991831 - RNA, 17 nt, Staphylococcus aureus subsp. aureus Mu50
caacaaauugugauuua

SEQ ID NO: 3991832 - RNA, 15 nt, Staphylococcus aureus subsp. aureus Mu50
caacaacaaguucuu

SEQ ID NO: 3991833 - RNA, 18 nt, Staphylococcus aureus subsp. aureus Mu50
caacaacuuuacgauaaa

SEQ ID NO: 3991834 - RNA, 20 nt, Staphylococcus aureus subsp. aureus Mu50
caacaaucacgauuaauguc

SEQ ID NO: 3991835 - RNA, 15 nt, Staphylococcus aureus subsp. aureus Mu50
caacaauugacgugu

SEQ ID NO: 3991836 - RNA, 12 nt, Staphylococcus aureus subsp. aureus Mu50
caacaauuuuau

SEQ ID NO: 3991837 - RNA, 12 nt, Staphylococcus aureus subsp. aureus Mu50
caacacaaagaa

SEQ ID NO: 3991838 - RNA, 13 nt, Staphylococcus aureus subsp. aureus Mu50
caacacaaagaau

SEQ ID NO: 3991839 - RNA, 16 nt, Staphylococcus aureus subsp. aureus Mu50
caacacaaagaauuuc

SEQ ID NO: 3991840 - RNA, 10 nt, Staphylococcus aureus subsp. aureus Mu50
caacacagaa

SEQ ID NO: 3991841 - RNA, 12 nt, Staphylococcus aureus subsp. aureus Mu50
caacacagagaa

SEQ ID NO: 3991842 - RNA, 16 nt, Staphylococcus aureus subsp. aureus Mu50
caacacagagaaauuc

SEQ ID NO: 3991843 - RNA, 22 nt, Staphylococcus aureus subsp. aureus Mu50
caacacagaggcugguggaaag

SEQ ID NO: 3991844 - RNA, 17 nt, Staphylococcus aureus subsp. aureus Mu50
caacaccaauugaaauu

SEQ ID NO: 3991845 - RNA, 16 nt, Staphylococcus aureus subsp. aureus Mu50
caacacguuguuguug

SEQ ID NO: 3991846 - RNA, 22 nt, Staphylococcus aureus subsp. aureus Mu50
caacacugagaauuucuaauua

SEQ ID NO: 3991847 - RNA, 16 nt, Staphylococcus aureus subsp. aureus Mu50
caacagggguaaaacu

SEQ ID NO: 3991848 - RNA, 16 nt, Staphylococcus aureus subsp. aureus Mu50
caacagggguuuuuau

SEQ ID NO: 3991849 - RNA, 23 nt, Staphylococcus aureus subsp. aureus Mu50
caacaguauuugccuuuugaaua

SEQ ID NO: 3991850 - RNA, 21 nt, Staphylococcus aureus subsp. aureus Mu50
caacaguuucuuggucugcug

SEQ ID NO: 3991851 - RNA, 14 nt, Staphylococcus aureus subsp. aureus Mu50
caacaguuuuaaag

SEQ ID NO: 3991852 - RNA, 13 nt, Staphylococcus aureus subsp. aureus Mu50
caacauacaugcc

SEQ ID NO: 3991853 - RNA, 14 nt, Staphylococcus aureus subsp. aureus Mu50
caacauauuauaua

SEQ ID NO: 3991854 - RNA, 22 nt, Staphylococcus aureus subsp. aureus Mu50
caacaucaucuuuaauuuucuu

SEQ ID NO: 3991855 - RNA, 13 nt, Staphylococcus aureus subsp. aureus Mu50
caacaucuucaac

SEQ ID NO: 3991856 - RNA, 22 nt, Staphylococcus aureus subsp. aureus Mu50
caacaugauacguacguugaug

SEQ ID NO: 3991857 - RNA, 15 nt, Staphylococcus aureus subsp. aureus Mu50
caacaugauuucuuc

SEQ ID NO: 3991858 - RNA, 22 nt, Staphylococcus aureus subsp. aureus Mu50
caacauguuccgcuacaaaaca

SEQ ID NO: 3991859 - RNA, 12 nt, Staphylococcus aureus subsp. aureus Mu50
caacauguuugg

SEQ ID NO: 3991860 - RNA, 14 nt, Staphylococcus aureus subsp. aureus Mu50
caacauguuuggau

SEQ ID NO: 3991861 - RNA, 14 nt, Staphylococcus aureus subsp. aureus Mu50
caacauuaaauuau

SEQ ID NO: 3991862 - RNA, 16 nt, Staphylococcus aureus subsp. aureus Mu50
caacauuaaauuauua

SEQ ID NO: 3991863 - RNA, 13 nt, Staphylococcus aureus subsp. aureus Mu50
caacauuaauaaa

SEQ ID NO: 3991864 - RNA, 16 nt, Staphylococcus aureus subsp. aureus Mu50
caacauuaauaaauaa

SEQ ID NO: 3991865 - RNA, 15 nt, Staphylococcus aureus subsp. aureus Mu50
caacauuacaugcac

SEQ ID NO: 3991866 - RNA, 17 nt, Staphylococcus aureus subsp. aureus Mu50
caacauuacuaauugau

SEQ ID NO: 3991867 - RNA, 18 nt, Staphylococcus aureus subsp. aureus Mu50
caacauuacuaauugauc

SEQ ID NO: 3991868 - RNA, 14 nt, Staphylococcus aureus subsp. aureus Mu50
caacauuugauaac

SEQ ID NO: 3991869 - RNA, 23 nt, Staphylococcus aureus subsp. aureus Mu50
caacauuuugauacguaaacacu

SEQ ID NO: 3991870 - RNA, 12 nt, Staphylococcus aureus subsp. aureus Mu50
caacauuuuuua

SEQ ID NO: 3991871 - RNA, 15 nt, Staphylococcus aureus subsp. aureus Mu50
caacauuuuuuauag

SEQ ID NO: 3991872 - RNA, 13 nt, Staphylococcus aureus subsp. aureus Mu50
caaccaaaaccaa

SEQ ID NO: 3991873 - RNA, 18 nt, Staphylococcus aureus subsp. aureus Mu50
caaccagucagaaagaau

SEQ ID NO: 3991874 - RNA, 14 nt, Staphylococcus aureus subsp. aureus Mu50
caaccauauuuuua

SEQ ID NO: 3991875 - RNA, 14 nt, Staphylococcus aureus subsp. aureus Mu50
caaccucugaugug

SEQ ID NO: 3991876 - RNA, 18 nt, Staphylococcus aureus subsp. aureus Mu50
caaccugugauaaaaauc

SEQ ID NO: 3991877 - RNA, 19 nt, Staphylococcus aureus subsp. aureus Mu50
caaccugugauaaaaaucu

SEQ ID NO: 3991878 - RNA, 22 nt, Staphylococcus aureus subsp. aureus Mu50
caaccuguucuuuauuuaaagg

SEQ ID NO: 3991879 - RNA, 22 nt, Staphylococcus aureus subsp. aureus Mu50
caaccuuugguuguuaggggcu

SEQ ID NO: 3991880 - RNA, 14 nt, Staphylococcus aureus subsp. aureus Mu50
caacgaugaaacuc

SEQ ID NO: 3991881 - RNA, 15 nt, Staphylococcus aureus subsp. aureus Mu50
caacgauguccuuua

SEQ ID NO: 3991882 - RNA, 23 nt, Staphylococcus aureus subsp. aureus Mu50
caacgauguccuuuaguguguuu

SEQ ID NO: 3991883 - RNA, 22 nt, Staphylococcus aureus subsp. aureus Mu50
caagucuuuacucuacacucaa

SEQ ID NO: 3991884 - RNA, 14 nt, Staphylococcus aureus subsp. aureus Mu50
caagugacaacauu

SEQ ID NO: 3991885 - RNA, 20 nt, Staphylococcus aureus subsp. aureus Mu50
caagugccauuuuuaaauua

SEQ ID NO: 3991886 - RNA, 17 nt, Staphylococcus aureus subsp. aureus Mu50
caagugcuugauuaaca

SEQ ID NO: 3991887 - RNA, 18 nt, Staphylococcus aureus subsp. aureus Mu50
caaguguaucgcccauac

SEQ ID NO: 3991888 - RNA, 20 nt, Staphylococcus aureus subsp. aureus Mu50
caagugucaaauacguauca

SEQ ID NO: 3991889 - RNA, 17 nt, Staphylococcus aureus subsp. aureus Mu50
caaguguuguuugccuu

SEQ ID NO: 3991890 - RNA, 19 nt, Staphylococcus aureus subsp. aureus Mu50
caaguuaugcugucaaaca

SEQ ID NO: 3991891 - RNA, 13 nt, Staphylococcus aureus subsp. aureus Mu50
caaguugaucaaa

SEQ ID NO: 3991892 - RNA, 19 nt, Staphylococcus aureus subsp. aureus Mu50
caaguugcugaauaaaaua

SEQ ID NO: 3991893 - RNA, 22 nt, Staphylococcus aureus subsp. aureus Mu50
caaguugcugaauaaaauauau

SEQ ID NO: 3991894 - RNA, 16 nt, Staphylococcus aureus subsp. aureus Mu50
caaguuggcggggccc

SEQ ID NO: 3991895 - RNA, 23 nt, Staphylococcus aureus subsp. aureus Mu50
caaguuggcuggcccccaacacu

SEQ ID NO: 3991896 - RNA, 22 nt, Staphylococcus aureus subsp. aureus Mu50
caaguuggggaaggacaggaau

SEQ ID NO: 3991897 - RNA, 22 nt, Staphylococcus aureus subsp. aureus Mu50
caaguuggggaugggccccaac

SEQ ID NO: 3991898 - RNA, 19 nt, Staphylococcus aureus subsp. aureus Mu50
caaguuuauaaucuuuuuu

SEQ ID NO: 3991899 - RNA, 19 nt, Staphylococcus aureus subsp. aureus Mu50
caauaaaaaaccaagugca

SEQ ID NO: 3991900 - RNA, 20 nt, Staphylococcus aureus subsp. aureus Mu50
caauaaaaaugguauucgca

SEQ ID NO: 3991901 - RNA, 22 nt, Staphylococcus aureus subsp. aureus Mu50
caauaaaacuauguguauaugu

SEQ ID NO: 3991902 - RNA, 10 nt, Staphylococcus aureus subsp. aureus Mu50
caauaaaauu

SEQ ID NO: 3991903 - RNA, 16 nt, Staphylococcus aureus subsp. aureus Mu50
caauaaauaaacaacu

SEQ ID NO: 3991904 - RNA, 18 nt, Staphylococcus aureus subsp. aureus Mu50
caauaaauauugauucua

SEQ ID NO: 3991905 - RNA, 19 nt, Staphylococcus aureus subsp. aureus Mu50
caauaaaucaguaguuuua

SEQ ID NO: 3991906 - RNA, 12 nt, Staphylococcus aureus subsp. aureus Mu50
caauaaaucuuu

SEQ ID NO: 3991907 - RNA, 14 nt, Staphylococcus aureus subsp. aureus Mu50
caauaaaucuuucc

SEQ ID NO: 3991908 - RNA, 23 nt, Staphylococcus aureus subsp. aureus Mu50
caauaaauuucaagguauacaca

SEQ ID NO: 3991909 - RNA, 15 nt, Staphylococcus aureus subsp. aureus Mu50
caauaaauuuuauau

SEQ ID NO: 3991910 - RNA, 17 nt, Staphylococcus aureus subsp. aureus Mu50
caauaacaaugcagcug

SEQ ID NO: 3991911 - RNA, 17 nt, Staphylococcus aureus subsp. aureus Mu50
caauaacaccaauugaa

SEQ ID NO: 3991912 - RNA, 23 nt, Staphylococcus aureus subsp. aureus Mu50
caauaacaccuguuacuugagaa

SEQ ID NO: 3991913 - RNA, 16 nt, Staphylococcus aureus subsp. aureus Mu50
caauaacaggugcuua

SEQ ID NO: 3991914 - RNA, 23 nt, Staphylococcus aureus subsp. aureus Mu50
caauaacaggugcuuacuuuuaa

SEQ ID NO: 3991915 - RNA, 15 nt, Staphylococcus aureus subsp. aureus Mu50
caauaaccauuucau

SEQ ID NO: 3991916 - RNA, 16 nt, Staphylococcus aureus subsp. aureus Mu50
caauaacuauaaucau

SEQ ID NO: 3991917 - RNA, 15 nt, Staphylococcus aureus subsp. aureus Mu50
caauaauaaaccuaa

SEQ ID NO: 3991918 - RNA, 21 nt, Staphylococcus aureus subsp. aureus Mu50
caauaauaaauaggaugaaaa

SEQ ID NO: 3991919 - RNA, 14 nt, Staphylococcus aureus subsp. aureus Mu50
caauaauaaaucac

SEQ ID NO: 3991920 - RNA, 19 nt, Staphylococcus aureus subsp. aureus Mu50
caauaauccgagucauacu

SEQ ID NO: 3991921 - RNA, 12 nt, Staphylococcus aureus subsp. aureus Mu50
caauaaugugca

SEQ ID NO: 3991922 - RNA, 19 nt, Staphylococcus aureus subsp. aureus Mu50
caauaaugugcaaguuggg

SEQ ID NO: 3991923 - RNA, 18 nt, Staphylococcus aureus subsp. aureus Mu50
caauaaugugucaaauag

SEQ ID NO: 3991924 - RNA, 11 nt, Staphylococcus aureus subsp. aureus Mu50
caauaauguua

SEQ ID NO: 3991925 - RNA, 17 nt, Staphylococcus aureus subsp. aureus Mu50
caauaauguuacgcugu

SEQ ID NO: 3991926 - RNA, 14 nt, Staphylococcus aureus subsp. aureus Mu50
caauaauuauuaau

SEQ ID NO: 3991927 - RNA, 15 nt, Staphylococcus aureus subsp. aureus Mu50
caauaauugaugaaa

SEQ ID NO: 3991928 - RNA, 12 nt, Staphylococcus aureus subsp. aureus Mu50
caauaauuuuau

SEQ ID NO: 3991929 - RNA, 15 nt, Staphylococcus aureus subsp. aureus Mu50
caauacaaagaauua

SEQ ID NO: 3991930 - RNA, 20 nt, Staphylococcus aureus subsp. aureus Mu50
caauacaaagaauuauguau

SEQ ID NO: 3991931 - RNA, 14 nt, Staphylococcus aureus subsp. aureus Mu50
caauacaaaucgau

SEQ ID NO: 3991932 - RNA, 17 nt, Staphylococcus aureus subsp. aureus Mu50
caauacagaacuuuaau

SEQ ID NO: 3991933 - RNA, 20 nt, Staphylococcus aureus subsp. aureus Mu50
caauacagaacuuuaauaau

SEQ ID NO: 3991934 - RNA, 17 nt, Staphylococcus aureus subsp. aureus Mu50
caauacauaaugguuca

SEQ ID NO: 3991935 - RNA, 12 nt, Staphylococcus aureus subsp. aureus Mu50
caauacauuaau

SEQ ID NO: 3991936 - RNA, 17 nt, Staphylococcus aureus subsp. aureus Mu50
caauacauuaauauaaa

SEQ ID NO: 3991937 - RNA, 18 nt, Staphylococcus aureus subsp. aureus Mu50
caauacauuaauauaaau

SEQ ID NO: 3991938 - RNA, 15 nt, Staphylococcus aureus subsp. aureus Mu50
caauaccauaauuaa

SEQ ID NO: 3991939 - RNA, 17 nt, Staphylococcus aureus subsp. aureus Mu50
caauaccauaauuaaau

SEQ ID NO: 3991940 - RNA, 16 nt, Staphylococcus aureus subsp. aureus Mu50
caauaccgaauaauuu

SEQ ID NO: 3991941 - RNA, 20 nt, Staphylococcus aureus subsp. aureus Mu50
caauaccgaauaauuuugau

SEQ ID NO: 3991942 - RNA, 17 nt, Staphylococcus aureus subsp. aureus Mu50
caauaccgcgauaaaua

SEQ ID NO: 3991943 - RNA, 20 nt, Staphylococcus aureus subsp. aureus Mu50
caauaccuaauuuacguacu

SEQ ID NO: 3991944 - RNA, 20 nt, Staphylococcus aureus subsp. aureus Mu50
caauacgaaaucaaaaauaa

SEQ ID NO: 3991945 - RNA, 21 nt, Staphylococcus aureus subsp. aureus Mu50
caauacgaaaucaaaaauaau

SEQ ID NO: 3991946 - RNA, 18 nt, Staphylococcus aureus subsp. aureus Mu50
caauacgaaguuucaugu

SEQ ID NO: 3991947 - RNA, 19 nt, Staphylococcus aureus subsp. aureus Mu50
caauacgaaguuucauguu

SEQ ID NO: 3991948 - RNA, 16 nt, Staphylococcus aureus subsp. aureus Mu50
caauacgaauaucugu

SEQ ID NO: 3991949 - RNA, 23 nt, Staphylococcus aureus subsp. aureus Mu50
caauacgaugaugauuuauaaaa

SEQ ID NO: 3991950 - RNA, 17 nt, Staphylococcus aureus subsp. aureus Mu50
caauacgauugcaauug

SEQ ID NO: 3991951 - RNA, 15 nt, Staphylococcus aureus subsp. aureus Mu50
caauacguuuccaau

SEQ ID NO: 3991952 - RNA, 20 nt, Staphylococcus aureus subsp. aureus Mu50
caauacuaccuuccauuucg

SEQ ID NO: 3991953 - RNA, 14 nt, Staphylococcus aureus subsp. aureus Mu50
caauacuacuuaau

SEQ ID NO: 3991954 - RNA, 14 nt, Staphylococcus aureus subsp. aureus Mu50
caauagaugaaaau

SEQ ID NO: 3991955 - RNA, 15 nt, Staphylococcus aureus subsp. aureus Mu50
caauagaugaaaauu

SEQ ID NO: 3991956 - RNA, 19 nt, Staphylococcus aureus subsp. aureus Mu50
caauagaugaaaauuuaau

SEQ ID NO: 3991957 - RNA, 16 nt, Staphylococcus aureus subsp. aureus Mu50
caauagcaauugaaua

SEQ ID NO: 3991958 - RNA, 14 nt, Staphylococcus aureus subsp. aureus Mu50
caauagccauuucc

SEQ ID NO: 3991959 - RNA, 17 nt, Staphylococcus aureus subsp. aureus Mu50
caauagcgguuuaaaaa

SEQ ID NO: 3991960 - RNA, 16 nt, Staphylococcus aureus subsp. aureus Mu50
caauagguacaacuaa

SEQ ID NO: 3991961 - RNA, 17 nt, Staphylococcus aureus subsp. aureus Mu50
caauagguacaacuaaa

SEQ ID NO: 3991962 - RNA, 15 nt, Staphylococcus aureus subsp. aureus Mu50
caauaguauaaauau

SEQ ID NO: 3991963 - RNA, 18 nt, Staphylococcus aureus subsp. aureus Mu50
caauaguauuaacuauaa

SEQ ID NO: 3991964 - RNA, 19 nt, Staphylococcus aureus subsp. aureus Mu50
caauagugugcaaguuggc

SEQ ID NO: 3991965 - RNA, 16 nt, Staphylococcus aureus subsp. aureus Mu50
caauaguuuauaaauu

SEQ ID NO: 3991966 - RNA, 15 nt, Staphylococcus aureus subsp. aureus Mu50
caauauaacaucaaa

SEQ ID NO: 3991967 - RNA, 17 nt, Staphylococcus aureus subsp. aureus Mu50
caauauaauuuccuaaa

SEQ ID NO: 3991968 - RNA, 19 nt, Staphylococcus aureus subsp. aureus Mu50
caauauaauuugguuaaua

SEQ ID NO: 3991969 - RNA, 16 nt, Staphylococcus aureus subsp. aureus Mu50
caauauacaaugcuga

SEQ ID NO: 3991970 - RNA, 14 nt, Staphylococcus aureus subsp. aureus Mu50
caauauacuuuuua

SEQ ID NO: 3991971 - RNA, 17 nt, Staphylococcus aureus subsp. aureus Mu50
caauguuuaauuuucua

SEQ ID NO: 3991972 - RNA, 19 nt, Staphylococcus aureus subsp. aureus Mu50
caauuaaaacuauaauaaa

SEQ ID NO: 3991973 - RNA, 13 nt, Staphylococcus aureus subsp. aureus Mu50
caauuaaaaguac

SEQ ID NO: 3991974 - RNA, 14 nt, Staphylococcus aureus subsp. aureus Mu50
caauuaaagucaau

SEQ ID NO: 3991975 - RNA, 15 nt, Staphylococcus aureus subsp. aureus Mu50
caauuaaagugaaua

SEQ ID NO: 3991976 - RNA, 13 nt, Staphylococcus aureus subsp. aureus Mu50
caauuaaaucgau

SEQ ID NO: 3991977 - RNA, 19 nt, Staphylococcus aureus subsp. aureus Mu50
caauuaacuugauaucauc

SEQ ID NO: 3991978 - RNA, 13 nt, Staphylococcus aureus subsp. aureus Mu50
caauuaauaaaca

SEQ ID NO: 3991979 - RNA, 12 nt, Staphylococcus aureus subsp. aureus Mu50
caauuaauguaa

SEQ ID NO: 3991980 - RNA, 15 nt, Staphylococcus aureus subsp. aureus Mu50
caauuaauguaauga

SEQ ID NO: 3991981 - RNA, 12 nt, Staphylococcus aureus subsp. aureus Mu50
caauuaauugua

SEQ ID NO: 3991982 - RNA, 22 nt, Staphylococcus aureus subsp. aureus Mu50
caauuaauuuagucauuacaaa

SEQ ID NO: 3991983 - RNA, 23 nt, Staphylococcus aureus subsp. aureus Mu50
caauuaauuuagucauuacaaau

SEQ ID NO: 3991984 - RNA, 15 nt, Staphylococcus aureus subsp. aureus Mu50
caauuacucuuuuuc

SEQ ID NO: 3991985 - RNA, 16 nt, Staphylococcus aureus subsp. aureus Mu50
caauuacucuuuuucu

SEQ ID NO: 3991986 - RNA, 20 nt, Staphylococcus aureus subsp. aureus Mu50
caauuacucuuuuucuuuca

SEQ ID NO: 3991987 - RNA, 24 nt, Staphylococcus aureus subsp. aureus Mu50
caauuacucuuuuucuuucauaau

SEQ ID NO: 3991988 - RNA, 23 nt, Staphylococcus aureus subsp. aureus Mu50
caauuagaaaacaucuuacugcu

SEQ ID NO: 3991989 - RNA, 13 nt, Staphylococcus aureus subsp. aureus Mu50
caauuagaaaauu

SEQ ID NO: 3991990 - RNA, 12 nt, Staphylococcus aureus subsp. aureus Mu50
caauuaguucug

SEQ ID NO: 3991991 - RNA, 17 nt, Staphylococcus aureus subsp. aureus Mu50
caauuaucaacauaaua

SEQ ID NO: 3991992 - RNA, 12 nt, Staphylococcus aureus subsp. aureus Mu50
caauuauggaua

SEQ ID NO: 3991993 - RNA, 15 nt, Staphylococcus aureus subsp. aureus Mu50
caauuauggauaaaa

SEQ ID NO: 3991994 - RNA, 16 nt, Staphylococcus aureus subsp. aureus Mu50
caauuauggauaaaau

SEQ ID NO: 3991995 - RNA, 18 nt, Staphylococcus aureus subsp. aureus Mu50
caauuauugaaaacaaaa

SEQ ID NO: 3991996 - RNA, 17 nt, Staphylococcus aureus subsp. aureus Mu50
caauuauuuuucaaaua

SEQ ID NO: 3991997 - RNA, 11 nt, Staphylococcus aureus subsp. aureus Mu50
caauucaaacu

SEQ ID NO: 3991998 - RNA, 12 nt, Staphylococcus aureus subsp. aureus Mu50
caauucaaugua

SEQ ID NO: 3991999 - RNA, 23 nt, Staphylococcus aureus subsp. aureus Mu50
caauucaauguaucaccuaauug

SEQ ID NO: 3992000 - RNA, 20 nt, Staphylococcus aureus subsp. aureus Mu50
caauucauuuuauaaaucaa

SEQ ID NO: 3992001 - RNA, 14 nt, Staphylococcus aureus subsp. aureus Mu50
caauuccuuggugu

SEQ ID NO: 3992002 - RNA, 16 nt, Staphylococcus aureus subsp. aureus Mu50
caauucggauuauauu

SEQ ID NO: 3992003 - RNA, 17 nt, Staphylococcus aureus subsp. aureus Mu50
caauucuuacaccugca

SEQ ID NO: 3992004 - RNA, 12 nt, Staphylococcus aureus subsp. aureus Mu50
caauucuucaau

SEQ ID NO: 3992005 - RNA, 18 nt, Staphylococcus aureus subsp. aureus Mu50
caauugaaucaaauacau

SEQ ID NO: 3992006 - RNA, 18 nt, Staphylococcus aureus subsp. aureus Mu50
caauugcauacguaaaug

SEQ ID NO: 3992007 - RNA, 13 nt, Staphylococcus aureus subsp. aureus Mu50
caauugcuuuacc

SEQ ID NO: 3992008 - RNA, 16 nt, Staphylococcus aureus subsp. aureus Mu50
caauuguuacuuuaac

SEQ ID NO: 3992009 - RNA, 20 nt, Staphylococcus aureus subsp. aureus Mu50
caauuguugcaaaauacgau

SEQ ID NO: 3992010 - RNA, 12 nt, Staphylococcus aureus subsp. aureus Mu50
caauuuaaauaa

SEQ ID NO: 3992011 - RNA, 13 nt, Staphylococcus aureus subsp. aureus Mu50
caauuuaaauaag

SEQ ID NO: 3992012 - RNA, 20 nt, Staphylococcus aureus subsp. aureus Mu50
caauuuaauuaagaaaauca

SEQ ID NO: 3992013 - RNA, 19 nt, Staphylococcus aureus subsp. aureus Mu50
caauuuaguauaaauaaaa

SEQ ID NO: 3992014 - RNA, 20 nt, Staphylococcus aureus subsp. aureus Mu50
caauuuauguaaauucaaaa

SEQ ID NO: 3992015 - RNA, 19 nt, Staphylococcus aureus subsp. aureus Mu50
caauuuauuaacuguguau

SEQ ID NO: 3992016 - RNA, 17 nt, Staphylococcus aureus subsp. aureus Mu50
caauuuauuauuaacug

SEQ ID NO: 3992017 - RNA, 16 nt, Staphylococcus aureus subsp. aureus Mu50
caauuuauuuuuauau

SEQ ID NO: 3992018 - RNA, 23 nt, Staphylococcus aureus subsp. aureus Mu50
caauuucacgcugaaauuuuuua

SEQ ID NO: 3992019 - RNA, 15 nt, Staphylococcus aureus subsp. aureus Mu50
caauuucauuugaaa

SEQ ID NO: 3992020 - RNA, 19 nt, Staphylococcus aureus subsp. aureus Mu50
caauuucauuuuugauaac

SEQ ID NO: 3992021 - RNA, 22 nt, Staphylococcus aureus subsp. aureus Mu50
caauuucucuuucgacuucgau

SEQ ID NO: 3992022 - RNA, 15 nt, Staphylococcus aureus subsp. aureus Mu50
caauuucuucauuuu

SEQ ID NO: 3992023 - RNA, 17 nt, Staphylococcus aureus subsp. aureus Mu50
caauuucuucauuuuca

SEQ ID NO: 3992024 - RNA, 18 nt, Staphylococcus aureus subsp. aureus Mu50
caauuuggucauauaaac

SEQ ID NO: 3992025 - RNA, 20 nt, Staphylococcus aureus subsp. aureus Mu50
caauuuggucauauaaacaa

SEQ ID NO: 3992026 - RNA, 13 nt, Staphylococcus aureus subsp. aureus Mu50
caauuuuaccaug

SEQ ID NO: 3992027 - RNA, 23 nt, Staphylococcus aureus subsp. aureus Mu50
caauuuuaccuucgcauacuuuu

SEQ ID NO: 3992028 - RNA, 21 nt, Staphylococcus aureus subsp. aureus Mu50
caauuuuagccaaauuacugu

SEQ ID NO: 3992029 - RNA, 17 nt, Staphylococcus aureus subsp. aureus Mu50
caauuuugacuacuaau

SEQ ID NO: 3992030 - RNA, 15 nt, Staphylococcus aureus subsp. aureus Mu50
caauuuuuaaaaacc

SEQ ID NO: 3992031 - RNA, 16 nt, Staphylococcus aureus subsp. aureus Mu50
caauuuuuaaaaaccu

SEQ ID NO: 3992032 - RNA, 23 nt, Staphylococcus aureus subsp. aureus Mu50
caauuuuuaaaaaccuagggaua

SEQ ID NO: 3992033 - RNA, 16 nt, Staphylococcus aureus subsp. aureus Mu50
caauuuuuaacaaaau

SEQ ID NO: 3992034 - RNA, 19 nt, Staphylococcus aureus subsp. aureus Mu50
caauuuuucacuuauaaca

SEQ ID NO: 3992035 - RNA, 15 nt, Staphylococcus aureus subsp. aureus Mu50
caauuuuuucaucuu

SEQ ID NO: 3992036 - RNA, 21 nt, Staphylococcus aureus subsp. aureus Mu50
caauuuuuucaugauuuacua

SEQ ID NO: 3992037 - RNA, 18 nt, Staphylococcus aureus subsp. aureus Mu50
cacaaaaagacuuccaau

SEQ ID NO: 3992038 - RNA, 14 nt, Staphylococcus aureus subsp. aureus Mu50
cacaaaaaugaaga

SEQ ID NO: 3992039 - RNA, 21 nt, Staphylococcus aureus subsp. aureus Mu50
cacaaaaaugaagaauacaaa

SEQ ID NO: 3992040 - RNA, 21 nt, Staphylococcus aureus subsp. aureus Mu50
cacaaagaauuucgaaaagaa

SEQ ID NO: 3992041 - RNA, 19 nt, Staphylococcus aureus subsp. aureus Mu50
cacaaagauauguuuauau

SEQ ID NO: 3992042 - RNA, 14 nt, Staphylococcus aureus subsp. aureus Mu50
cacaaauaaaggca

SEQ ID NO: 3992043 - RNA, 22 nt, Staphylococcus aureus subsp. aureus Mu50
cacaaaugaauggagcaugauu

SEQ ID NO: 3992044 - RNA, 14 nt, Staphylococcus aureus subsp. aureus Mu50
cacaaauuugaaua

SEQ ID NO: 3992045 - RNA, 23 nt, Staphylococcus aureus subsp. aureus Mu50
cacaaauuugaauauacuuaauu

SEQ ID NO: 3992046 - RNA, 21 nt, Staphylococcus aureus subsp. aureus Mu50
cacaacaaucacgauuaaugu

SEQ ID NO: 3992047 - RNA, 17 nt, Staphylococcus aureus subsp. aureus Mu50
cacaacacauaaauuaa

SEQ ID NO: 3992048 - RNA, 23 nt, Staphylococcus aureus subsp. aureus Mu50
cacaacauguuuggaugaacaaa

SEQ ID NO: 3992049 - RNA, 23 nt, Staphylococcus aureus subsp. aureus Mu50
cacaaguuuacagguugaauaaa

SEQ ID NO: 3992050 - RNA, 17 nt, Staphylococcus aureus subsp. aureus Mu50
cacaauaauccaagaua

SEQ ID NO: 3992051 - RNA, 17 nt, Staphylococcus aureus subsp. aureus Mu50
cacaaucuguucauaau

SEQ ID NO: 3992052 - RNA, 17 nt, Staphylococcus aureus subsp. aureus Mu50
cacaaugauugaauauu

SEQ ID NO: 3992053 - RNA, 20 nt, Staphylococcus aureus subsp. aureus Mu50
cacacagguaaauuuaaaau

SEQ ID NO: 3992054 - RNA, 21 nt, Staphylococcus aureus subsp. aureus Mu50
cacacagguaaauuuaaaaua

SEQ ID NO: 3992055 - RNA, 22 nt, Staphylococcus aureus subsp. aureus Mu50
cacacagguaaauuuaaaauaa

SEQ ID NO: 3992056 - RNA, 13 nt, Staphylococcus aureus subsp. aureus Mu50
cacacaugauaau

SEQ ID NO: 3992057 - RNA, 22 nt, Staphylococcus aureus subsp. aureus Mu50
cacaccaccaccugugacaaau

SEQ ID NO: 3992058 - RNA, 18 nt, Staphylococcus aureus subsp. aureus Mu50
cacguguauuguauuuua

SEQ ID NO: 3992059 - RNA, 19 nt, Staphylococcus aureus subsp. aureus Mu50
cacguucuugguauuuuuu

SEQ ID NO: 3992060 - RNA, 20 nt, Staphylococcus aureus subsp. aureus Mu50
cacguucuugguauuuuuua

SEQ ID NO: 3992061 - RNA, 16 nt, Staphylococcus aureus subsp. aureus Mu50
cacuaaaaauauauuu

SEQ ID NO: 3992062 - RNA, 19 nt, Staphylococcus aureus subsp. aureus Mu50
cacuaaaugugacuuuaaa

SEQ ID NO: 3992063 - RNA, 23 nt, Staphylococcus aureus subsp. aureus Mu50
cacuaaauguucuggaauaccua

SEQ ID NO: 3992064 - RNA, 17 nt, Staphylococcus aureus subsp. aureus Mu50
cacuaauauuucuuaga

SEQ ID NO: 3992065 - RNA, 16 nt, Staphylococcus aureus subsp. aureus Mu50
cacuaaugcauaauua

SEQ ID NO: 3992066 - RNA, 17 nt, Staphylococcus aureus subsp. aureus Mu50
cacuaauggcacuuaau

SEQ ID NO: 3992067 - RNA, 22 nt, Staphylococcus aureus subsp. aureus Mu50
cacuacaguguaugaugaacuu

SEQ ID NO: 3992068 - RNA, 20 nt, Staphylococcus aureus subsp. aureus Mu50
cacuaccauagauuauauua

SEQ ID NO: 3992069 - RNA, 15 nt, Staphylococcus aureus subsp. aureus Mu50
cacuaggaucuuuuc

SEQ ID NO: 3992070 - RNA, 11 nt, Staphylococcus aureus subsp. aureus Mu50
cacuauaaaag

SEQ ID NO: 3992071 - RNA, 15 nt, Staphylococcus aureus subsp. aureus Mu50
cacuauaaaauucac

SEQ ID NO: 3992072 - RNA, 22 nt, Staphylococcus aureus subsp. aureus Mu50
cacuauaaaauucaccaacuga

SEQ ID NO: 3992073 - RNA, 15 nt, Staphylococcus aureus subsp. aureus Mu50
cacuauaauuucuua

SEQ ID NO: 3992074 - RNA, 16 nt, Staphylococcus aureus subsp. aureus Mu50
cacuauauccuuuuug

SEQ ID NO: 3992075 - RNA, 13 nt, Staphylococcus aureus subsp. aureus Mu50
cacuaucauuauc

SEQ ID NO: 3992076 - RNA, 17 nt, Staphylococcus aureus subsp. aureus Mu50
cacuaucguuuuuauua

SEQ ID NO: 3992077 - RNA, 20 nt, Staphylococcus aureus subsp. aureus Mu50
cacuaucuguuguuauauaa

SEQ ID NO: 3992078 - RNA, 21 nt, Staphylococcus aureus subsp. aureus Mu50
cacuaucuguuguuauauaaa

SEQ ID NO: 3992079 - RNA, 11 nt, Staphylococcus aureus subsp. aureus Mu50
cacuaucuuuu

SEQ ID NO: 3992080 - RNA, 12 nt, Staphylococcus aureus subsp. aureus Mu50
cacuauuuuuau

SEQ ID NO: 3992081 - RNA, 17 nt, Staphylococcus aureus subsp. aureus Mu50
cacucaauucucuaacu

SEQ ID NO: 3992082 - RNA, 12 nt, Staphylococcus aureus subsp. aureus Mu50
cacucauaaccg

SEQ ID NO: 3992083 - RNA, 20 nt, Staphylococcus aureus subsp. aureus Mu50
cacucauaaccgcuucuuuu

SEQ ID NO: 3992084 - RNA, 21 nt, Staphylococcus aureus subsp. aureus Mu50
cacucauaaucaagucugcau

SEQ ID NO: 3992085 - RNA, 17 nt, Staphylococcus aureus subsp. aureus Mu50
cacucauucaauuuagu

SEQ ID NO: 3992086 - RNA, 15 nt, Staphylococcus aureus subsp. aureus Mu50
cacuccuauuguuuu

SEQ ID NO: 3992087 - RNA, 15 nt, Staphylococcus aureus subsp. aureus Mu50
cacuccucuauuuua

SEQ ID NO: 3992088 - RNA, 22 nt, Staphylococcus aureus subsp. aureus Mu50
cacuccucuauuuuaugauuug

SEQ ID NO: 3992089 - RNA, 15 nt, Staphylococcus aureus subsp. aureus Mu50
cacuccuuaaacaaa

SEQ ID NO: 3992090 - RNA, 23 nt, Staphylococcus aureus subsp. aureus Mu50
cacucuagagguaaaucuaucua

SEQ ID NO: 3992091 - RNA, 14 nt, Staphylococcus aureus subsp. aureus Mu50
cacugaaaucuaga

SEQ ID NO: 3992092 - RNA, 15 nt, Staphylococcus aureus subsp. aureus Mu50
cacugacaugauaaa

SEQ ID NO: 3992093 - RNA, 17 nt, Staphylococcus aureus subsp. aureus Mu50
cacugacaugauaaauu

SEQ ID NO: 3992094 - RNA, 17 nt, Staphylococcus aureus subsp. aureus Mu50
cacugagaauuucuaau

SEQ ID NO: 3992095 - RNA, 14 nt, Staphylococcus aureus subsp. aureus Mu50
cacugcaacauuug

SEQ ID NO: 3992096 - RNA, 20 nt, Staphylococcus aureus subsp. aureus Mu50
cacugcacaucauaauaaau

SEQ ID NO: 3992097 - RNA, 17 nt, Staphylococcus aureus subsp. aureus Mu50
cacugcauauaaaguca

SEQ ID NO: 3992098 - RNA, 16 nt, Staphylococcus aureus subsp. aureus Mu50
cacugccaaucauucg

SEQ ID NO: 3992099 - RNA, 14 nt, Staphylococcus aureus subsp. aureus Mu50
cacugccuuuuugu

SEQ ID NO: 3992100 - RNA, 23 nt, Staphylococcus aureus subsp. aureus Mu50
cacuguaacgaguccauuuucuu

SEQ ID NO: 3992101 - RNA, 21 nt, Staphylococcus aureus subsp. aureus Mu50
cacuguauggucuggaauaaa

SEQ ID NO: 3992102 - RNA, 14 nt, Staphylococcus aureus subsp. aureus Mu50
cacuguauuuacua

SEQ ID NO: 3992103 - RNA, 13 nt, Staphylococcus aureus subsp. aureus Mu50
cacuuaacucaaa

SEQ ID NO: 3992104 - RNA, 11 nt, Staphylococcus aureus subsp. aureus Mu50
cacuuaauaag

SEQ ID NO: 3992105 - RNA, 15 nt, Staphylococcus aureus subsp. aureus Mu50
cacuuaauauaagga

SEQ ID NO: 3992106 - RNA, 16 nt, Staphylococcus aureus subsp. aureus Mu50
cacuuaauauaaggaa

SEQ ID NO: 3992107 - RNA, 19 nt, Staphylococcus aureus subsp. aureus Mu50
cacuuacugugaaaauacc

SEQ ID NO: 3992108 - RNA, 21 nt, Staphylococcus aureus subsp. aureus Mu50
cacuuacugugaaaauaccaa

SEQ ID NO: 3992109 - RNA, 23 nt, Staphylococcus aureus subsp. aureus Mu50
cacuuagauuccccuuuuugucu

SEQ ID NO: 3992110 - RNA, 14 nt, Staphylococcus aureus subsp. aureus Mu50
cacuuaucaucaca

SEQ ID NO: 3992111 - RNA, 12 nt, Staphylococcus aureus subsp. aureus Mu50
cacuuauuauuu

SEQ ID NO: 3992112 - RNA, 14 nt, Staphylococcus aureus subsp. aureus Mu50
cacuucaaaagaaa

SEQ ID NO: 3992113 - RNA, 17 nt, Staphylococcus aureus subsp. aureus Mu50
cacuucaguuaaaccuu

SEQ ID NO: 3992114 - RNA, 20 nt, Staphylococcus aureus subsp. aureus Mu50
cacuucaguuaaaccuucua

SEQ ID NO: 3992115 - RNA, 11 nt, Staphylococcus aureus subsp. aureus Mu50
cacuucauaaa

SEQ ID NO: 3992116 - RNA, 14 nt, Staphylococcus aureus subsp. aureus Mu50
cacuucgccaagcc

SEQ ID NO: 3992117 - RNA, 23 nt, Staphylococcus aureus subsp. aureus Mu50
cacuucgccaagccaucuuucuu

SEQ ID NO: 3992118 - RNA, 13 nt, Staphylococcus aureus subsp. aureus Mu50
cacuuggauucaa

SEQ ID NO: 3992119 - RNA, 14 nt, Staphylococcus aureus subsp. aureus Mu50
cacuuggauuuuaa

SEQ ID NO: 3992120 - RNA, 21 nt, Staphylococcus aureus subsp. aureus Mu50
cacuuggauuuuaauuauuug

SEQ ID NO: 3992121 - RNA, 13 nt, Staphylococcus aureus subsp. aureus Mu50
cacuugguacacc

SEQ ID NO: 3992122 - RNA, 23 nt, Staphylococcus aureus subsp. aureus Mu50
cacuuuaaacaagcaucaugaaa

SEQ ID NO: 3992123 - RNA, 16 nt, Staphylococcus aureus subsp. aureus Mu50
cacuuuaggguucauu

SEQ ID NO: 3992124 - RNA, 13 nt, Staphylococcus aureus subsp. aureus Mu50
cacuuuauaauuu

SEQ ID NO: 3992125 - RNA, 16 nt, Staphylococcus aureus subsp. aureus Mu50
cacuuuauaauuuuug

SEQ ID NO: 3992126 - RNA, 15 nt, Staphylococcus aureus subsp. aureus Mu50
cacuuucuacucuga

SEQ ID NO: 3992127 - RNA, 19 nt, Staphylococcus aureus subsp. aureus Mu50
cacuuuuagaaucaaccgu

SEQ ID NO: 3992128 - RNA, 19 nt, Staphylococcus aureus subsp. aureus Mu50
cacuuuuauggagugauau

SEQ ID NO: 3992129 - RNA, 14 nt, Staphylococcus aureus subsp. aureus Mu50
cacuuuucaugaug

SEQ ID NO: 3992130 - RNA, 14 nt, Staphylococcus aureus subsp. aureus Mu50
cacuuuugauuguu

SEQ ID NO: 3992131 - RNA, 14 nt, Staphylococcus aureus subsp. aureus Mu50
cacuuuuguuaaaa

SEQ ID NO: 3992132 - RNA, 18 nt, Staphylococcus aureus subsp. aureus Mu50
cacuuuuguuaaaaaaug

SEQ ID NO: 3992133 - RNA, 20 nt, Staphylococcus aureus subsp. aureus Mu50
cacuuuuuuuaaaucuucua

SEQ ID NO: 3992134 - RNA, 18 nt, Staphylococcus aureus subsp. aureus Mu50
cacuuuuuuuaauuugau

SEQ ID NO: 3992135 - RNA, 22 nt, Staphylococcus aureus subsp. aureus Mu50
cagaaaagcagucgaacaauga

SEQ ID NO: 3992136 - RNA, 18 nt, Staphylococcus aureus subsp. aureus Mu50
cagaaaagggcaaaaaag

SEQ ID NO: 3992137 - RNA, 20 nt, Staphylococcus aureus subsp. aureus Mu50
cagaaaagggcaaaaaagga

SEQ ID NO: 3992138 - RNA, 16 nt, Staphylococcus aureus subsp. aureus Mu50
cagaaaauuauacugu

SEQ ID NO: 3992139 - RNA, 15 nt, Staphylococcus aureus subsp. aureus Mu50
cagaaacccuuggua

SEQ ID NO: 3992140 - RNA, 21 nt, Staphylococcus aureus subsp. aureus Mu50
cagaaacccuugguauaagag

SEQ ID NO: 3992141 - RNA, 13 nt, Staphylococcus aureus subsp. aureus Mu50
cagaaaguugcac

SEQ ID NO: 3992142 - RNA, 17 nt, Staphylococcus aureus subsp. aureus Mu50
cagaaaugacaucaucu

SEQ ID NO: 3992143 - RNA, 22 nt, Staphylococcus aureus subsp. aureus Mu50
cagaaaugacaucaucuauaau

SEQ ID NO: 3992144 - RNA, 15 nt, Staphylococcus aureus subsp. aureus Mu50
cagaaauuuaauauu

SEQ ID NO: 3992145 - RNA, 19 nt, Staphylococcus aureus subsp. aureus Mu50
cagaaauuuaauauuguua

SEQ ID NO: 3992146 - RNA, 17 nt, Staphylococcus aureus subsp. aureus Mu50
caguaauuuucauuguu

SEQ ID NO: 3992147 - RNA, 14 nt, Staphylococcus aureus subsp. aureus Mu50
caguacaaauaaca

SEQ ID NO: 3992148 - RNA, 14 nt, Staphylococcus aureus subsp. aureus Mu50
caguacgaacaacu

SEQ ID NO: 3992149 - RNA, 15 nt, Staphylococcus aureus subsp. aureus Mu50
caguagucacuguuu

SEQ ID NO: 3992150 - RNA, 18 nt, Staphylococcus aureus subsp. aureus Mu50
caguaguuaauugaauga

SEQ ID NO: 3992151 - RNA, 19 nt, Staphylococcus aureus subsp. aureus Mu50
caguaguuaauugaaugaa

SEQ ID NO: 3992152 - RNA, 20 nt, Staphylococcus aureus subsp. aureus Mu50
caguauaaccauguauaucu

SEQ ID NO: 3992153 - RNA, 23 nt, Staphylococcus aureus subsp. aureus Mu50
caguauaaguuucuggcauaucg

SEQ ID NO: 3992154 - RNA, 15 nt, Staphylococcus aureus subsp. aureus Mu50
caguauaauuuucug

SEQ ID NO: 3992155 - RNA, 23 nt, Staphylococcus aureus subsp. aureus Mu50
caguauuugccuuuugaauaauu

SEQ ID NO: 3992156 - RNA, 23 nt, Staphylococcus aureus subsp. aureus Mu50
cagucaacugcugcuaaaauaaa

SEQ ID NO: 3992157 - RNA, 20 nt, Staphylococcus aureus subsp. aureus Mu50
cagucaauuuuuucaucuuu

SEQ ID NO: 3992158 - RNA, 16 nt, Staphylococcus aureus subsp. aureus Mu50
cagucaguaaaaauac

SEQ ID NO: 3992159 - RNA, 17 nt, Staphylococcus aureus subsp. aureus Mu50
cagucauuugauuuaaa

SEQ ID NO: 3992160 - RNA, 17 nt, Staphylococcus aureus subsp. aureus Mu50
caguccauuauugggcu

SEQ ID NO: 3992161 - RNA, 15 nt, Staphylococcus aureus subsp. aureus Mu50
cagucucuaaaacuu

SEQ ID NO: 3992162 - RNA, 15 nt, Staphylococcus aureus subsp. aureus Mu50
cagugaaguuaacua

SEQ ID NO: 3992163 - RNA, 18 nt, Staphylococcus aureus subsp. aureus Mu50
cagugaaguuaacuauaa

SEQ ID NO: 3992164 - RNA, 19 nt, Staphylococcus aureus subsp. aureus Mu50
cagugaaguuaacuauaac

SEQ ID NO: 3992165 - RNA, 22 nt, Staphylococcus aureus subsp. aureus Mu50
cagugaaucuaaacuauaauaa

SEQ ID NO: 3992166 - RNA, 18 nt, Staphylococcus aureus subsp. aureus Mu50
cagugaucuuuuuuauau

SEQ ID NO: 3992167 - RNA, 15 nt, Staphylococcus aureus subsp. aureus Mu50
cagugccuugcugga

SEQ ID NO: 3992168 - RNA, 16 nt, Staphylococcus aureus subsp. aureus Mu50
cagugcuauguauuuu

SEQ ID NO: 3992169 - RNA, 17 nt, Staphylococcus aureus subsp. aureus Mu50
cagugcuauguauuuuu

SEQ ID NO: 3992170 - RNA, 23 nt, Staphylococcus aureus subsp. aureus Mu50
cagugcuauguauuuuucuuaau

SEQ ID NO: 3992171 - RNA, 17 nt, Staphylococcus aureus subsp. aureus Mu50
caguggauuacagauga

SEQ ID NO: 3992172 - RNA, 21 nt, Staphylococcus aureus subsp. aureus Mu50
caguguaaucauuguggcuuu

SEQ ID NO: 3992173 - RNA, 17 nt, Staphylococcus aureus subsp. aureus Mu50
caguguugaauuucaaa

SEQ ID NO: 3992174 - RNA, 18 nt, Staphylococcus aureus subsp. aureus Mu50
caguguuugacugaauga

SEQ ID NO: 3992175 - RNA, 11 nt, Staphylococcus aureus subsp. aureus Mu50
caguuaaauua

SEQ ID NO: 3992176 - RNA, 12 nt, Staphylococcus aureus subsp. aureus Mu50
caguuaauaauu

SEQ ID NO: 3992177 - RNA, 14 nt, Staphylococcus aureus subsp. aureus Mu50
caguuaauaauuuu

SEQ ID NO: 3992178 - RNA, 12 nt, Staphylococcus aureus subsp. aureus Mu50
caguuagugcuu

SEQ ID NO: 3992179 - RNA, 23 nt, Staphylococcus aureus subsp. aureus Mu50
caguuagugcuuguuacacauga

SEQ ID NO: 3992180 - RNA, 18 nt, Staphylococcus aureus subsp. aureus Mu50
caguuauuuuaauaacga

SEQ ID NO: 3992181 - RNA, 14 nt, Staphylococcus aureus subsp. aureus Mu50
caguucuuagauuu

SEQ ID NO: 3992182 - RNA, 19 nt, Staphylococcus aureus subsp. aureus Mu50
caguugacuguaaaacaau

SEQ ID NO: 3992183 - RNA, 15 nt, Staphylococcus aureus subsp. aureus Mu50
caguugagucaauuu

SEQ ID NO: 3992184 - RNA, 22 nt, Staphylococcus aureus subsp. aureus Mu50
caguuggagguccauaaucuuu

SEQ ID NO: 3992185 - RNA, 22 nt, Staphylococcus aureus subsp. aureus Mu50
caguugguauaucgaaagguaa

SEQ ID NO: 3992186 - RNA, 14 nt, Staphylococcus aureus subsp. aureus Mu50
caguuguuuuuuug

SEQ ID NO: 3992187 - RNA, 18 nt, Staphylococcus aureus subsp. aureus Mu50
caguuuauugaggauaau

SEQ ID NO: 3992188 - RNA, 21 nt, Staphylococcus aureus subsp. aureus Mu50
caguuucaagugcuugguuaa

SEQ ID NO: 3992189 - RNA, 16 nt, Staphylococcus aureus subsp. aureus Mu50
caguuuccauaaauaa

SEQ ID NO: 3992190 - RNA, 17 nt, Staphylococcus aureus subsp. aureus Mu50
caguuuccauaaauaaa

SEQ ID NO: 3992191 - RNA, 14 nt, Staphylococcus aureus subsp. aureus Mu50
caguuuuaaagacu

SEQ ID NO: 3992192 - RNA, 15 nt, Staphylococcus aureus subsp. aureus Mu50
caguuuuauuaucuu

SEQ ID NO: 3992193 - RNA, 18 nt, Staphylococcus aureus subsp. aureus Mu50
caguuuuauuaucuuugu

SEQ ID NO: 3992194 - RNA, 19 nt, Staphylococcus aureus subsp. aureus Mu50
caguuuugaagaauaaaaa

SEQ ID NO: 3992195 - RNA, 12 nt, Staphylococcus aureus subsp. aureus Mu50
caguuuuuaaau

SEQ ID NO: 3992196 - RNA, 13 nt, Staphylococcus aureus subsp. aureus Mu50
caguuuuuaaauc

SEQ ID NO: 3992197 - RNA, 12 nt, Staphylococcus aureus subsp. aureus Mu50
caguuuuuauau

SEQ ID NO: 3992198 - RNA, 15 nt, Staphylococcus aureus subsp. aureus Mu50
cauaaaaaaagaacu

SEQ ID NO: 3992199 - RNA, 13 nt, Staphylococcus aureus subsp. aureus Mu50
cauaaaaaaagag

SEQ ID NO: 3992200 - RNA, 12 nt, Staphylococcus aureus subsp. aureus Mu50
cauaaaaauaau

SEQ ID NO: 3992201 - RNA, 18 nt, Staphylococcus aureus subsp. aureus Mu50
cauaaaaaucauaaauaa

SEQ ID NO: 3992202 - RNA, 18 nt, Staphylococcus aureus subsp. aureus Mu50
cauaaaacuuacauuaca

SEQ ID NO: 3992203 - RNA, 23 nt, Staphylococcus aureus subsp. aureus Mu50
cauaaaacuuacauuacauauau

SEQ ID NO: 3992204 - RNA, 16 nt, Staphylococcus aureus subsp. aureus Mu50
cauaaaagacagaaau

SEQ ID NO: 3992205 - RNA, 12 nt, Staphylococcus aureus subsp. aureus Mu50
cauaaaauuuaa

SEQ ID NO: 3992206 - RNA, 18 nt, Staphylococcus aureus subsp. aureus Mu50
cauaaaauuuaaaacaau

SEQ ID NO: 3992207 - RNA, 14 nt, Staphylococcus aureus subsp. aureus Mu50
cauaaaauuucugc

SEQ ID NO: 3992208 - RNA, 19 nt, Staphylococcus aureus subsp. aureus Mu50
cauaaagugcguuuuucga

SEQ ID NO: 3992209 - RNA, 20 nt, Staphylococcus aureus subsp. aureus Mu50
cauaaauaaacuuuaugaaa

SEQ ID NO: 3992210 - RNA, 16 nt, Staphylococcus aureus subsp. aureus Mu50
cauaaauacaaaaaua

SEQ ID NO: 3992211 - RNA, 17 nt, Staphylococcus aureus subsp. aureus Mu50
cauaaauacaaaaauau

SEQ ID NO: 3992212 - RNA, 20 nt, Staphylococcus aureus subsp. aureus Mu50
cauaaauacaaaaauauagc

SEQ ID NO: 3992213 - RNA, 13 nt, Staphylococcus aureus subsp. aureus Mu50
cauaaauauaaaa

SEQ ID NO: 3992214 - RNA, 14 nt, Staphylococcus aureus subsp. aureus Mu50
cauaaauauaaaau

SEQ ID NO: 3992215 - RNA, 23 nt, Staphylococcus aureus subsp. aureus Mu50
cauaaauauuuaaaauauuauuu

SEQ ID NO: 3992216 - RNA, 21 nt, Staphylococcus aureus subsp. aureus Mu50
cauaaaugacugaauuaauau

SEQ ID NO: 3992217 - RNA, 23 nt, Staphylococcus aureus subsp. aureus Mu50
cauaaaugcuucugguucuucaa

SEQ ID NO: 3992218 - RNA, 13 nt, Staphylococcus aureus subsp. aureus Mu50
cauaaauuaauau

SEQ ID NO: 3992219 - RNA, 15 nt, Staphylococcus aureus subsp. aureus Mu50
cauaaauuagaugaa

SEQ ID NO: 3992220 - RNA, 21 nt, Staphylococcus aureus subsp. aureus Mu50
cauaaauuaggucauuuuuau

SEQ ID NO: 3992221 - RNA, 14 nt, Staphylococcus aureus subsp. aureus Mu50
cauaacaaagaacc

SEQ ID NO: 3992222 - RNA, 15 nt, Staphylococcus aureus subsp. aureus Mu50
cauaacaaucauuuc

SEQ ID NO: 3992223 - RNA, 21 nt, Staphylococcus aureus subsp. aureus Mu50
cauaacaauuuuguugcauga

SEQ ID NO: 3992224 - RNA, 16 nt, Staphylococcus aureus subsp. aureus Mu50
cauaacaccauuuacu

SEQ ID NO: 3992225 - RNA, 19 nt, Staphylococcus aureus subsp. aureus Mu50
cauaaccuguaauugauga

SEQ ID NO: 3992226 - RNA, 19 nt, Staphylococcus aureus subsp. aureus Mu50
cauaaccuugcuuugcaua

SEQ ID NO: 3992227 - RNA, 23 nt, Staphylococcus aureus subsp. aureus Mu50
cauaacgacaacuugaacuaaaa

SEQ ID NO: 3992228 - RNA, 17 nt, Staphylococcus aureus subsp. aureus Mu50
cauaacuagcaauuuga

SEQ ID NO: 3992229 - RNA, 18 nt, Staphylococcus aureus subsp. aureus Mu50
cauaacucaaauaucuaa

SEQ ID NO: 3992230 - RNA, 16 nt, Staphylococcus aureus subsp. aureus Mu50
cauaacugaauaaacc

SEQ ID NO: 3992231 - RNA, 22 nt, Staphylococcus aureus subsp. aureus Mu50
cauaacuguaguuucuuaauua

SEQ ID NO: 3992232 - RNA, 17 nt, Staphylococcus aureus subsp. aureus Mu50
cauaacuuuauauauaa

SEQ ID NO: 3992233 - RNA, 15 nt, Staphylococcus aureus subsp. aureus Mu50
cauaagaaaauacua

SEQ ID NO: 3992234 - RNA, 20 nt, Staphylococcus aureus subsp. aureus Mu50
cauaguugaaucggugucuu

SEQ ID NO: 3992235 - RNA, 16 nt, Staphylococcus aureus subsp. aureus Mu50
cauauaaaaaauuauu

SEQ ID NO: 3992236 - RNA, 18 nt, Staphylococcus aureus subsp. aureus Mu50
cauauaaaaaauuauuaa

SEQ ID NO: 3992237 - RNA, 19 nt, Staphylococcus aureus subsp. aureus Mu50
cauauaaaaaauuauuaaa

SEQ ID NO: 3992238 - RNA, 14 nt, Staphylococcus aureus subsp. aureus Mu50
cauauaaacaacug

SEQ ID NO: 3992239 - RNA, 19 nt, Staphylococcus aureus subsp. aureus Mu50
cauauaaagucguaucaua

SEQ ID NO: 3992240 - RNA, 11 nt, Staphylococcus aureus subsp. aureus Mu50
cauauaaauag

SEQ ID NO: 3992241 - RNA, 17 nt, Staphylococcus aureus subsp. aureus Mu50
cauauaaauauuuuuaa

SEQ ID NO: 3992242 - RNA, 23 nt, Staphylococcus aureus subsp. aureus Mu50
cauauaaauauuuuuaauuauuu

SEQ ID NO: 3992243 - RNA, 12 nt, Staphylococcus aureus subsp. aureus Mu50
cauauaaaucaa

SEQ ID NO: 3992244 - RNA, 22 nt, Staphylococcus aureus subsp. aureus Mu50
cauauaaaucaaauauacuuuu

SEQ ID NO: 3992245 - RNA, 11 nt, Staphylococcus aureus subsp. aureus Mu50
cauauaaaugu

SEQ ID NO: 3992246 - RNA, 13 nt, Staphylococcus aureus subsp. aureus Mu50
cauauaaauguug

SEQ ID NO: 3992247 - RNA, 15 nt, Staphylococcus aureus subsp. aureus Mu50
cauauaauaugugca

SEQ ID NO: 3992248 - RNA, 18 nt, Staphylococcus aureus subsp. aureus Mu50
cauauaaugguugaauaa

SEQ ID NO: 3992249 - RNA, 23 nt, Staphylococcus aureus subsp. aureus Mu50
cauauaaugguugaauaacacua

SEQ ID NO: 3992250 - RNA, 21 nt, Staphylococcus aureus subsp. aureus Mu50
cauauacacacuaaggaaaau

SEQ ID NO: 3992251 - RNA, 15 nt, Staphylococcus aureus subsp. aureus Mu50
cauauacgacauuuu

SEQ ID NO: 3992252 - RNA, 18 nt, Staphylococcus aureus subsp. aureus Mu50
cauauacgacauuuuuag

SEQ ID NO: 3992253 - RNA, 19 nt, Staphylococcus aureus subsp. aureus Mu50
cauauacgacauuuuuaga

SEQ ID NO: 3992254 - RNA, 16 nt, Staphylococcus aureus subsp. aureus Mu50
cauauacucuaaaaaa

SEQ ID NO: 3992255 - RNA, 19 nt, Staphylococcus aureus subsp. aureus Mu50
cauauauauucguuacaaa

SEQ ID NO: 3992256 - RNA, 19 nt, Staphylococcus aureus subsp. aureus Mu50
cauauaugauaaauauugu

SEQ ID NO: 3992257 - RNA, 20 nt, Staphylococcus aureus subsp. aureus Mu50
cauauaugccgauugcucua

SEQ ID NO: 3992258 - RNA, 16 nt, Staphylococcus aureus subsp. aureus Mu50
cauauaugucucucuu

SEQ ID NO: 3992259 - RNA, 14 nt, Staphylococcus aureus subsp. aureus Mu50
cauauauuuuguua

SEQ ID NO: 3992260 - RNA, 13 nt, Staphylococcus aureus subsp. aureus Mu50
cauaucuuucaau

SEQ ID NO: 3992261 - RNA, 13 nt, Staphylococcus aureus subsp. aureus Mu50
cauaugaacaaua

SEQ ID NO: 3992262 - RNA, 19 nt, Staphylococcus aureus subsp. aureus Mu50
cauaugacuuuauuucuau

SEQ ID NO: 3992263 - RNA, 17 nt, Staphylococcus aureus subsp. aureus Mu50
cauaugauaauuaauua

SEQ ID NO: 3992264 - RNA, 18 nt, Staphylococcus aureus subsp. aureus Mu50
cauaugauaauuaauuau

SEQ ID NO: 3992265 - RNA, 14 nt, Staphylococcus aureus subsp. aureus Mu50
cauaugauuacaac

SEQ ID NO: 3992266 - RNA, 12 nt, Staphylococcus aureus subsp. aureus Mu50
cauaugauuugc

SEQ ID NO: 3992267 - RNA, 21 nt, Staphylococcus aureus subsp. aureus Mu50
cauaugcuuguugugaauaaa

SEQ ID NO: 3992268 - RNA, 23 nt, Staphylococcus aureus subsp. aureus Mu50
cauauggugaacuguuaaacuca

SEQ ID NO: 3992269 - RNA, 13 nt, Staphylococcus aureus subsp. aureus Mu50
cauauguaauaca

SEQ ID NO: 3992270 - RNA, 17 nt, Staphylococcus aureus subsp. aureus Mu50
cauauguacuauuaucu

SEQ ID NO: 3992271 - RNA, 14 nt, Staphylococcus aureus subsp. aureus Mu50
cauaugugguggcu

SEQ ID NO: 3992272 - RNA, 14 nt, Staphylococcus aureus subsp. aureus Mu50
cauauguuggauuc

SEQ ID NO: 3992273 - RNA, 16 nt, Staphylococcus aureus subsp. aureus Mu50
cauauguuuuauaaua

SEQ ID NO: 3992274 - RNA, 18 nt, Staphylococcus aureus subsp. aureus Mu50
cauauguuuuauaauaaa

SEQ ID NO: 3992275 - RNA, 13 nt, Staphylococcus aureus subsp. aureus Mu50
cauauuaaauuuu

SEQ ID NO: 3992276 - RNA, 14 nt, Staphylococcus aureus subsp. aureus Mu50
cauauuaacuguua

SEQ ID NO: 3992277 - RNA, 12 nt, Staphylococcus aureus subsp. aureus Mu50
cauauuacccca

SEQ ID NO: 3992278 - RNA, 20 nt, Staphylococcus aureus subsp. aureus Mu50
cauauuacuuuggaaauuua

SEQ ID NO: 3992279 - RNA, 20 nt, Staphylococcus aureus subsp. aureus Mu50
cauauucauaauaucgauga

SEQ ID NO: 3992280 - RNA, 16 nt, Staphylococcus aureus subsp. aureus Mu50
cauauucauauuacuu

SEQ ID NO: 3992281 - RNA, 17 nt, Staphylococcus aureus subsp. aureus Mu50
cauauucuauuguuguu

SEQ ID NO: 3992282 - RNA, 22 nt, Staphylococcus aureus subsp. aureus Mu50
cauauuuagguaauacaucauc

SEQ ID NO: 3992283 - RNA, 13 nt, Staphylococcus aureus subsp. aureus Mu50
cauauuuauauuu

SEQ ID NO: 3992284 - RNA, 20 nt, Staphylococcus aureus subsp. aureus Mu50
cauauuuaucgcgauuauua

SEQ ID NO: 3992285 - RNA, 23 nt, Staphylococcus aureus subsp. aureus Mu50
cauauuuaucgcgauuauuacca

SEQ ID NO: 3992286 - RNA, 20 nt, Staphylococcus aureus subsp. aureus Mu50
cauauuuaucucuuucuuca

SEQ ID NO: 3992287 - RNA, 13 nt, Staphylococcus aureus subsp. aureus Mu50
cauauuuauggug

SEQ ID NO: 3992288 - RNA, 16 nt, Staphylococcus aureus subsp. aureus Mu50
cauauuucuaaauuau

SEQ ID NO: 3992289 - RNA, 19 nt, Staphylococcus aureus subsp. aureus Mu50
cauauuucuaaauuauuua

SEQ ID NO: 3992290 - RNA, 15 nt, Staphylococcus aureus subsp. aureus Mu50
cauauuuugauuuac

SEQ ID NO: 3992291 - RNA, 16 nt, Staphylococcus aureus subsp. aureus Mu50
cauauuuuuuaaauuu

SEQ ID NO: 3992292 - RNA, 17 nt, Staphylococcus aureus subsp. aureus Mu50
cauauuuuuuaaauuua

SEQ ID NO: 3992293 - RNA, 13 nt, Staphylococcus aureus subsp. aureus Mu50
caucaaaaaugag

SEQ ID NO: 3992294 - RNA, 13 nt, Staphylococcus aureus subsp. aureus Mu50
caucaaacaacau

SEQ ID NO: 3992295 - RNA, 14 nt, Staphylococcus aureus subsp. aureus Mu50
caucaaacaacauc

SEQ ID NO: 3992296 - RNA, 19 nt, Staphylococcus aureus subsp. aureus Mu50
caucaaauagacaccaaaa

SEQ ID NO: 3992297 - RNA, 18 nt, Staphylococcus aureus subsp. aureus Mu50
caucaacgauguccuuua

SEQ ID NO: 3992298 - RNA, 18 nt, Staphylococcus aureus subsp. aureus Mu50
caucaacgccauauuuau

SEQ ID NO: 3992299 - RNA, 22 nt, Staphylococcus aureus subsp. aureus Mu50
caucaaguauaaauguuauugc

SEQ ID NO: 3992300 - RNA, 14 nt, Staphylococcus aureus subsp. aureus Mu50
caucaaguugauaa

SEQ ID NO: 3992301 - RNA, 19 nt, Staphylococcus aureus subsp. aureus Mu50
caucaauaaauauugauuc

SEQ ID NO: 3992302 - RNA, 14 nt, Staphylococcus aureus subsp. aureus Mu50
caucaauaacuaua

SEQ ID NO: 3992303 - RNA, 17 nt, Staphylococcus aureus subsp. aureus Mu50
caucaauaccauaauua

SEQ ID NO: 3992304 - RNA, 14 nt, Staphylococcus aureus subsp. aureus Mu50
caucaauaucaaau

SEQ ID NO: 3992305 - RNA, 19 nt, Staphylococcus aureus subsp. aureus Mu50
caucaauaucuucuucuaa

SEQ ID NO: 3992306 - RNA, 22 nt, Staphylococcus aureus subsp. aureus Mu50
caucaauaucuucuucuaacca

SEQ ID NO: 3992307 - RNA, 13 nt, Staphylococcus aureus subsp. aureus Mu50
caucaauauugau

SEQ ID NO: 3992308 - RNA, 21 nt, Staphylococcus aureus subsp. aureus Mu50
caucaaucgcuuuagcaauug

SEQ ID NO: 3992309 - RNA, 17 nt, Staphylococcus aureus subsp. aureus Mu50
caucaaucguaacuaac

SEQ ID NO: 3992310 - RNA, 21 nt, Staphylococcus aureus subsp. aureus Mu50
caucaaucguaacuaacaugu

SEQ ID NO: 3992311 - RNA, 19 nt, Staphylococcus aureus subsp. aureus Mu50
caucaauuuaguccuucuu

SEQ ID NO: 3992312 - RNA, 12 nt, Staphylococcus aureus subsp. aureus Mu50
caucaauuucua

SEQ ID NO: 3992313 - RNA, 13 nt, Staphylococcus aureus subsp. aureus Mu50
caucaauuucugu

SEQ ID NO: 3992314 - RNA, 18 nt, Staphylococcus aureus subsp. aureus Mu50
caucaauuucuguaauaa

SEQ ID NO: 3992315 - RNA, 22 nt, Staphylococcus aureus subsp. aureus Mu50
caucaauuucuguaauaauauc

SEQ ID NO: 3992316 - RNA, 16 nt, Staphylococcus aureus subsp. aureus Mu50
caucacaguguugaau

SEQ ID NO: 3992317 - RNA, 15 nt, Staphylococcus aureus subsp. aureus Mu50
caucacauaacuaug

SEQ ID NO: 3992318 - RNA, 18 nt, Staphylococcus aureus subsp. aureus Mu50
caucacgugauaaugacu

SEQ ID NO: 3992319 - RNA, 18 nt, Staphylococcus aureus subsp. aureus Mu50
caucacuaaaguaaauaa

SEQ ID NO: 3992320 - RNA, 18 nt, Staphylococcus aureus subsp. aureus Mu50
caucacucgcaaucgaga

SEQ ID NO: 3992321 - RNA, 13 nt, Staphylococcus aureus subsp. aureus Mu50
caucacuugcugu

SEQ ID NO: 3992322 - RNA, 14 nt, Staphylococcus aureus subsp. aureus Mu50
caugacgauaauga

SEQ ID NO: 3992323 - RNA, 17 nt, Staphylococcus aureus subsp. aureus Mu50
caugacuauuuuccauc

SEQ ID NO: 3992324 - RNA, 21 nt, Staphylococcus aureus subsp. aureus Mu50
caugagaaugccguaacccau

SEQ ID NO: 3992325 - RNA, 17 nt, Staphylococcus aureus subsp. aureus Mu50
caugauacugaaauuuc

SEQ ID NO: 3992326 - RNA, 19 nt, Staphylococcus aureus subsp. aureus Mu50
caugauacugaaauuucau

SEQ ID NO: 3992327 - RNA, 14 nt, Staphylococcus aureus subsp. aureus Mu50
caugaugauaaauu

SEQ ID NO: 3992328 - RNA, 20 nt, Staphylococcus aureus subsp. aureus Mu50
caugaugauaaauugaguuu

SEQ ID NO: 3992329 - RNA, 17 nt, Staphylococcus aureus subsp. aureus Mu50
caugauucaugauaugu

SEQ ID NO: 3992330 - RNA, 16 nt, Staphylococcus aureus subsp. aureus Mu50
caugauugaaauccuu

SEQ ID NO: 3992331 - RNA, 12 nt, Staphylococcus aureus subsp. aureus Mu50
caugauuuacua

SEQ ID NO: 3992332 - RNA, 17 nt, Staphylococcus aureus subsp. aureus Mu50
caugauuuacuaaugcu

SEQ ID NO: 3992333 - RNA, 20 nt, Staphylococcus aureus subsp. aureus Mu50
caugccagaugcaaugauac

SEQ ID NO: 3992334 - RNA, 21 nt, Staphylococcus aureus subsp. aureus Mu50
caugcccucuauuagauacau

SEQ ID NO: 3992335 - RNA, 14 nt, Staphylococcus aureus subsp. aureus Mu50
caugccuucaugaa

SEQ ID NO: 3992336 - RNA, 15 nt, Staphylococcus aureus subsp. aureus Mu50
caugcgauucaaucu

SEQ ID NO: 3992337 - RNA, 16 nt, Staphylococcus aureus subsp. aureus Mu50
caugcgauucaaucua

SEQ ID NO: 3992338 - RNA, 17 nt, Staphylococcus aureus subsp. aureus Mu50
caugcgauucaaucuaa

SEQ ID NO: 3992339 - RNA, 23 nt, Staphylococcus aureus subsp. aureus Mu50
caugcgcaaaagcgcaggcgaac

SEQ ID NO: 3992340 - RNA, 17 nt, Staphylococcus aureus subsp. aureus Mu50
caugcuuaauuuaugug

SEQ ID NO: 3992341 - RNA, 14 nt, Staphylococcus aureus subsp. aureus Mu50
caugcuuuuaauau

SEQ ID NO: 3992342 - RNA, 17 nt, Staphylococcus aureus subsp. aureus Mu50
cauggaaaagugcgauu

SEQ ID NO: 3992343 - RNA, 15 nt, Staphylococcus aureus subsp. aureus Mu50
cauggaacgugcuuu

SEQ ID NO: 3992344 - RNA, 15 nt, Staphylococcus aureus subsp. aureus Mu50
cauggauucugauuc

SEQ ID NO: 3992345 - RNA, 16 nt, Staphylococcus aureus subsp. aureus Mu50
cauggcgauuccaauc

SEQ ID NO: 3992346 - RNA, 15 nt, Staphylococcus aureus subsp. aureus Mu50
caugggcuucugcua

SEQ ID NO: 3992347 - RNA, 15 nt, Staphylococcus aureus subsp. aureus Mu50
caugguaucuuuaau

SEQ ID NO: 3992348 - RNA, 22 nt, Staphylococcus aureus subsp. aureus Mu50
caugguuuucuuuuuaucauga

SEQ ID NO: 3992349 - RNA, 16 nt, Staphylococcus aureus subsp. aureus Mu50
cauguaaugcuuaaaa

SEQ ID NO: 3992350 - RNA, 15 nt, Staphylococcus aureus subsp. aureus Mu50
cauguacauugguuu

SEQ ID NO: 3992351 - RNA, 18 nt, Staphylococcus aureus subsp. aureus Mu50
cauguaccacauuuuccu

SEQ ID NO: 3992352 - RNA, 20 nt, Staphylococcus aureus subsp. aureus Mu50
cauguacguuuuuuuaaaua

SEQ ID NO: 3992353 - RNA, 19 nt, Staphylococcus aureus subsp. aureus Mu50
cauguauauggcaucauca

SEQ ID NO: 3992354 - RNA, 20 nt, Staphylococcus aureus subsp. aureus Mu50
cauguauucuuagauauuau

SEQ ID NO: 3992355 - RNA, 15 nt, Staphylococcus aureus subsp. aureus Mu50
cauguauuggccaaa

SEQ ID NO: 3992356 - RNA, 19 nt, Staphylococcus aureus subsp. aureus Mu50
cauguauuuaguaucauga

SEQ ID NO: 3992357 - RNA, 14 nt, Staphylococcus aureus subsp. aureus Mu50
caugucaauuuuuu

SEQ ID NO: 3992358 - RNA, 15 nt, Staphylococcus aureus subsp. aureus Mu50
caugucaauuuuuuc

SEQ ID NO: 3992359 - RNA, 14 nt, Staphylococcus aureus subsp. aureus Mu50
caugucccauaaca

SEQ ID NO: 3992360 - RNA, 21 nt, Staphylococcus aureus subsp. aureus Mu50
caugugacauaacagcuaaaa

SEQ ID NO: 3992361 - RNA, 17 nt, Staphylococcus aureus subsp. aureus Mu50
caugugcuuuguuuauc

SEQ ID NO: 3992362 - RNA, 23 nt, Staphylococcus aureus subsp. aureus Mu50
caugugcuuuguuuaucaauuuc

SEQ ID NO: 3992363 - RNA, 14 nt, Staphylococcus aureus subsp. aureus Mu50
cauguggacguuga

SEQ ID NO: 3992364 - RNA, 23 nt, Staphylococcus aureus subsp. aureus Mu50
cauguggcuggacaaucuuauca

SEQ ID NO: 3992365 - RNA, 15 nt, Staphylococcus aureus subsp. aureus Mu50
caugugucauaaucc

SEQ ID NO: 3992366 - RNA, 16 nt, Staphylococcus aureus subsp. aureus Mu50
caugugucuuccaauc

SEQ ID NO: 3992367 - RNA, 15 nt, Staphylococcus aureus subsp. aureus Mu50
cauguucauaauaua

SEQ ID NO: 3992368 - RNA, 22 nt, Staphylococcus aureus subsp. aureus Mu50
cauguuccccauuaauuaacaa

SEQ ID NO: 3992369 - RNA, 15 nt, Staphylococcus aureus subsp. aureus Mu50
cauguuccgcuacaa

SEQ ID NO: 3992370 - RNA, 16 nt, Staphylococcus aureus subsp. aureus Mu50
cauguucuuauaaaaa

SEQ ID NO: 3992371 - RNA, 18 nt, Staphylococcus aureus subsp. aureus Mu50
cauguucuuauaaaaaac

SEQ ID NO: 3992372 - RNA, 19 nt, Staphylococcus aureus subsp. aureus Mu50
cauguucuuguaauccuaa

SEQ ID NO: 3992373 - RNA, 18 nt, Staphylococcus aureus subsp. aureus Mu50
cauguugauaaaaaggau

SEQ ID NO: 3992374 - RNA, 16 nt, Staphylococcus aureus subsp. aureus Mu50
cauguuggcaauuguu

SEQ ID NO: 3992375 - RNA, 23 nt, Staphylococcus aureus subsp. aureus Mu50
cauguuuaaauaucaugcaaaac

SEQ ID NO: 3992376 - RNA, 19 nt, Staphylococcus aureus subsp. aureus Mu50
cauguuuggaugaacaaaa

SEQ ID NO: 3992377 - RNA, 21 nt, Staphylococcus aureus subsp. aureus Mu50
cauguuuggaugaacaaaaua

SEQ ID NO: 3992378 - RNA, 12 nt, Staphylococcus aureus subsp. aureus Mu50
cauuaaaaaauc

SEQ ID NO: 3992379 - RNA, 21 nt, Staphylococcus aureus subsp. aureus Mu50
cauuaaaaaaucgaacuagac

SEQ ID NO: 3992380 - RNA, 22 nt, Staphylococcus aureus subsp. aureus Mu50
cauuaaaaacgauucauuauau

SEQ ID NO: 3992381 - RNA, 14 nt, Staphylococcus aureus subsp. aureus Mu50
cauuaaaaauaaaa

SEQ ID NO: 3992382 - RNA, 23 nt, Staphylococcus aureus subsp. aureus Mu50
cauuaaaaggaugugacaaauac

SEQ ID NO: 3992383 - RNA, 14 nt, Staphylococcus aureus subsp. aureus Mu50
cauuaaaauaauua

SEQ ID NO: 3992384 - RNA, 21 nt, Staphylococcus aureus subsp. aureus Mu50
cauuaaaauaauuaaauaaaa

SEQ ID NO: 3992385 - RNA, 12 nt, Staphylococcus aureus subsp. aureus Mu50
cauuaaaccacu

SEQ ID NO: 3992386 - RNA, 13 nt, Staphylococcus aureus subsp. aureus Mu50
cauuaaauugcuu

SEQ ID NO: 3992387 - RNA, 19 nt, Staphylococcus aureus subsp. aureus Mu50
cauuaagcuaugcuuuuuu

SEQ ID NO: 3992388 - RNA, 22 nt, Staphylococcus aureus subsp. aureus Mu50
cauuaaggagcuauaacccuaa

SEQ ID NO: 3992389 - RNA, 18 nt, Staphylococcus aureus subsp. aureus Mu50
cauuaaggauaguucuuu

SEQ ID NO: 3992390 - RNA, 15 nt, Staphylococcus aureus subsp. aureus Mu50
cauuaaggcuuuagu

SEQ ID NO: 3992391 - RNA, 19 nt, Staphylococcus aureus subsp. aureus Mu50
cauuaaguaaucugcaaau

SEQ ID NO: 3992392 - RNA, 15 nt, Staphylococcus aureus subsp. aureus Mu50
cauuaauaaauaaua

SEQ ID NO: 3992393 - RNA, 18 nt, Staphylococcus aureus subsp. aureus Mu50
cauuaauaauuaaacaag

SEQ ID NO: 3992394 - RNA, 20 nt, Staphylococcus aureus subsp. aureus Mu50
cauuaauacaagucuuuacu

SEQ ID NO: 3992395 - RNA, 14 nt, Staphylococcus aureus subsp. aureus Mu50
cauuaauauaaaua

SEQ ID NO: 3992396 - RNA, 16 nt, Staphylococcus aureus subsp. aureus Mu50
cauuaauccuuuauau

SEQ ID NO: 3992397 - RNA, 16 nt, Staphylococcus aureus subsp. aureus Mu50
cauuaaucguauuuuu

SEQ ID NO: 3992398 - RNA, 21 nt, Staphylococcus aureus subsp. aureus Mu50
cauuaaucuauauaaaaacug

SEQ ID NO: 3992399 - RNA, 19 nt, Staphylococcus aureus subsp. aureus Mu50
cauuaaugauagcaaugaa

SEQ ID NO: 3992400 - RNA, 16 nt, Staphylococcus aureus subsp. aureus Mu50
cauuaauuggauuaaa

SEQ ID NO: 3992401 - RNA, 21 nt, Staphylococcus aureus subsp. aureus Mu50
cauuaauuggauuaaauacgc

SEQ ID NO: 3992402 - RNA, 17 nt, Staphylococcus aureus subsp. aureus Mu50
cauuaauuucaugugca

SEQ ID NO: 3992403 - RNA, 22 nt, Staphylococcus aureus subsp. aureus Mu50
cauuaauuugucauuucuucuu

SEQ ID NO: 3992404 - RNA, 13 nt, Staphylococcus aureus subsp. aureus Mu50
cauuaauuuuuca

SEQ ID NO: 3992405 - RNA, 17 nt, Staphylococcus aureus subsp. aureus Mu50
cauuacagauaauuauu

SEQ ID NO: 3992406 - RNA, 19 nt, Staphylococcus aureus subsp. aureus Mu50
cauuacauguuacugauga

SEQ ID NO: 3992407 - RNA, 23 nt, Staphylococcus aureus subsp. aureus Mu50
cauuacauuuggcguaaugauau

SEQ ID NO: 3992408 - RNA, 16 nt, Staphylococcus aureus subsp. aureus Mu50
cauuacccuuuaaacu

SEQ ID NO: 3992409 - RNA, 16 nt, Staphylococcus aureus subsp. aureus Mu50
cauuguugauaaaugg

SEQ ID NO: 3992410 - RNA, 19 nt, Staphylococcus aureus subsp. aureus Mu50
cauuguugauaaauggaaa

SEQ ID NO: 3992411 - RNA, 17 nt, Staphylococcus aureus subsp. aureus Mu50
cauuguuucagcugcaa

SEQ ID NO: 3992412 - RNA, 21 nt, Staphylococcus aureus subsp. aureus Mu50
cauuguuucagcugcaauuuu

SEQ ID NO: 3992413 - RNA, 17 nt, Staphylococcus aureus subsp. aureus Mu50
cauuguuuuacagucaa

SEQ ID NO: 3992414 - RNA, 21 nt, Staphylococcus aureus subsp. aureus Mu50
cauuuaaaauauuuuuucugu

SEQ ID NO: 3992415 - RNA, 13 nt, Staphylococcus aureus subsp. aureus Mu50
cauuuaaauauaa

SEQ ID NO: 3992416 - RNA, 16 nt, Staphylococcus aureus subsp. aureus Mu50
cauuuaauacuuuucu

SEQ ID NO: 3992417 - RNA, 23 nt, Staphylococcus aureus subsp. aureus Mu50
cauuuaauacuuuucucgauuaa

SEQ ID NO: 3992418 - RNA, 15 nt, Staphylococcus aureus subsp. aureus Mu50
cauuuaauccuucuc

SEQ ID NO: 3992419 - RNA, 17 nt, Staphylococcus aureus subsp. aureus Mu50
cauuuacgauacaucau

SEQ ID NO: 3992420 - RNA, 16 nt, Staphylococcus aureus subsp. aureus Mu50
cauuuacuucauaagu

SEQ ID NO: 3992421 - RNA, 18 nt, Staphylococcus aureus subsp. aureus Mu50
cauuuacuugauuagauu

SEQ ID NO: 3992422 - RNA, 23 nt, Staphylococcus aureus subsp. aureus Mu50
cauuuacuugauuagauuugugu

SEQ ID NO: 3992423 - RNA, 22 nt, Staphylococcus aureus subsp. aureus Mu50
cauuuagaugauucuuaucauu

SEQ ID NO: 3992424 - RNA, 20 nt, Staphylococcus aureus subsp. aureus Mu50
cauuuaguacauauguuguu

SEQ ID NO: 3992425 - RNA, 15 nt, Staphylococcus aureus subsp. aureus Mu50
cauuuaguuaaauac

SEQ ID NO: 3992426 - RNA, 16 nt, Staphylococcus aureus subsp. aureus Mu50
cauuuaguuaaauaca

SEQ ID NO: 3992427 - RNA, 17 nt, Staphylococcus aureus subsp. aureus Mu50
cauuuaguuaaauacaa

SEQ ID NO: 3992428 - RNA, 18 nt, Staphylococcus aureus subsp. aureus Mu50
cauuuaguuaaauacaaa

SEQ ID NO: 3992429 - RNA, 17 nt, Staphylococcus aureus subsp. aureus Mu50
cauuuauaugauguuca

SEQ ID NO: 3992430 - RNA, 19 nt, Staphylococcus aureus subsp. aureus Mu50
cauuuaucaacaauggaaa

SEQ ID NO: 3992431 - RNA, 15 nt, Staphylococcus aureus subsp. aureus Mu50
cauuuaucuaacaau

SEQ ID NO: 3992432 - RNA, 16 nt, Staphylococcus aureus subsp. aureus Mu50
cauuuaucuaacaauc

SEQ ID NO: 3992433 - RNA, 14 nt, Staphylococcus aureus subsp. aureus Mu50
cauuuaugauuguu

SEQ ID NO: 3992434 - RNA, 21 nt, Staphylococcus aureus subsp. aureus Mu50
cauuuauguguuggcuuuuau

SEQ ID NO: 3992435 - RNA, 12 nt, Staphylococcus aureus subsp. aureus Mu50
cauuuauuuuca

SEQ ID NO: 3992436 - RNA, 19 nt, Staphylococcus aureus subsp. aureus Mu50
cauuuauuuucuuugguga

SEQ ID NO: 3992437 - RNA, 15 nt, Staphylococcus aureus subsp. aureus Mu50
cauuucaauauuaaa

SEQ ID NO: 3992438 - RNA, 16 nt, Staphylococcus aureus subsp. aureus Mu50
cauuucaauauuaaaa

SEQ ID NO: 3992439 - RNA, 13 nt, Staphylococcus aureus subsp. aureus Mu50
cauuucagaaaua

SEQ ID NO: 3992440 - RNA, 14 nt, Staphylococcus aureus subsp. aureus Mu50
cauuucaucauaau

SEQ ID NO: 3992441 - RNA, 16 nt, Staphylococcus aureus subsp. aureus Mu50
cauuuccuaugugcug

SEQ ID NO: 3992442 - RNA, 21 nt, Staphylococcus aureus subsp. aureus Mu50
cauuucgauaccuaaaauacc

SEQ ID NO: 3992443 - RNA, 22 nt, Staphylococcus aureus subsp. aureus Mu50
cauuugcaacaauauaauauac

SEQ ID NO: 3992444 - RNA, 12 nt, Staphylococcus aureus subsp. aureus Mu50
cauuugcuuuuu

SEQ ID NO: 3992445 - RNA, 15 nt, Staphylococcus aureus subsp. aureus Mu50
cauuugguucuucua

SEQ ID NO: 3992446 - RNA, 22 nt, Staphylococcus aureus subsp. aureus Mu50
cauuuguaaauauuuuuuaaaa

SEQ ID NO: 3992447 - RNA, 15 nt, Staphylococcus aureus subsp. aureus Mu50
cauuugucauaauag

SEQ ID NO: 3992448 - RNA, 23 nt, Staphylococcus aureus subsp. aureus Mu50
cauuugucauaauagauaaugca

SEQ ID NO: 3992449 - RNA, 17 nt, Staphylococcus aureus subsp. aureus Mu50
cauuugucuuaauuuuu

SEQ ID NO: 3992450 - RNA, 13 nt, Staphylococcus aureus subsp. aureus Mu50
cauuuguguaaau

SEQ ID NO: 3992451 - RNA, 18 nt, Staphylococcus aureus subsp. aureus Mu50
cauuuguguuccugcuac

SEQ ID NO: 3992452 - RNA, 13 nt, Staphylococcus aureus subsp. aureus Mu50
cauuuguguuuuu

SEQ ID NO: 3992453 - RNA, 23 nt, Staphylococcus aureus subsp. aureus Mu50
cauuuguuaaauucaucuuauca

SEQ ID NO: 3992454 - RNA, 10 nt, Staphylococcus aureus subsp. aureus Mu50
cauuuuaaag

SEQ ID NO: 3992455 - RNA, 12 nt, Staphylococcus aureus subsp. aureus Mu50
cauuuuaaauaa

SEQ ID NO: 3992456 - RNA, 17 nt, Staphylococcus aureus subsp. aureus Mu50
cauuuuaaaucuaauua

SEQ ID NO: 3992457 - RNA, 21 nt, Staphylococcus aureus subsp. aureus Mu50
cauuuuaaauucaacuaugaa

SEQ ID NO: 3992458 - RNA, 16 nt, Staphylococcus aureus subsp. aureus Mu50
cauuuuaauaaaauca

SEQ ID NO: 3992459 - RNA, 21 nt, Staphylococcus aureus subsp. aureus Mu50
cauuuuagauugacuaaguuu

SEQ ID NO: 3992460 - RNA, 20 nt, Staphylococcus aureus subsp. aureus Mu50
cauuuuagcaaaagcuuuua

SEQ ID NO: 3992461 - RNA, 21 nt, Staphylococcus aureus subsp. aureus Mu50
cauuuuagugccgagcuuuuu

SEQ ID NO: 3992462 - RNA, 16 nt, Staphylococcus aureus subsp. aureus Mu50
cauuuuaguuauacua

SEQ ID NO: 3992463 - RNA, 16 nt, Staphylococcus aureus subsp. aureus Mu50
cauuuuauaaaucaaa

SEQ ID NO: 3992464 - RNA, 16 nt, Staphylococcus aureus subsp. aureus Mu50
cauuuuauauuuuagu

SEQ ID NO: 3992465 - RNA, 15 nt, Staphylococcus aureus subsp. aureus Mu50
cauuuuauccaaacc

SEQ ID NO: 3992466 - RNA, 17 nt, Staphylococcus aureus subsp. aureus Mu50
cauuuucaaaacuagca

SEQ ID NO: 3992467 - RNA, 19 nt, Staphylococcus aureus subsp. aureus Mu50
cauuuucaaguuuaaaaua

SEQ ID NO: 3992468 - RNA, 23 nt, Staphylococcus aureus subsp. aureus Mu50
cauuuucaaguuuaaaauacgac

SEQ ID NO: 3992469 - RNA, 23 nt, Staphylococcus aureus subsp. aureus Mu50
cauuuucaauacuugaaagauuu

SEQ ID NO: 3992470 - RNA, 17 nt, Staphylococcus aureus subsp. aureus Mu50
cauuuucauuguauguu

SEQ ID NO: 3992471 - RNA, 22 nt, Staphylococcus aureus subsp. aureus Mu50
cauuuucauuguauguugaaag

SEQ ID NO: 3992472 - RNA, 17 nt, Staphylococcus aureus subsp. aureus Mu50
cauuuucauuuaauccu

SEQ ID NO: 3992473 - RNA, 12 nt, Staphylococcus aureus subsp. aureus Mu50
cauuuucugcuu

SEQ ID NO: 3992474 - RNA, 20 nt, Staphylococcus aureus subsp. aureus Mu50
cauuuugagucguagauacu

SEQ ID NO: 3992475 - RNA, 15 nt, Staphylococcus aureus subsp. aureus Mu50
cauuuugauuaagug

SEQ ID NO: 3992476 - RNA, 16 nt, Staphylococcus aureus subsp. aureus Mu50
cauuuuuaauuuugac

SEQ ID NO: 3992477 - RNA, 21 nt, Staphylococcus aureus subsp. aureus Mu50
cauuuuuaauuuugacauaaa

SEQ ID NO: 3992478 - RNA, 14 nt, Staphylococcus aureus subsp. aureus Mu50
cauuuuuaguuaga

SEQ ID NO: 3992479 - RNA, 23 nt, Staphylococcus aureus subsp. aureus Mu50
cauuuuuauacaacuucacuucu

SEQ ID NO: 3992480 - RNA, 15 nt, Staphylococcus aureus subsp. aureus Mu50
cauuuuuauguuaaa

SEQ ID NO: 3992481 - RNA, 20 nt, Staphylococcus aureus subsp. aureus Mu50
cauuuuuauuuaacacuuca

SEQ ID NO: 3992482 - RNA, 13 nt, Staphylococcus aureus subsp. aureus Mu50
cauuuuuggcuua

SEQ ID NO: 3992483 - RNA, 16 nt, Staphylococcus aureus subsp. aureus Mu50
cauuuuuucauuauua

SEQ ID NO: 3992484 - RNA, 20 nt, Staphylococcus aureus subsp. aureus Mu50
cauuuuuuuccaagcaucau

SEQ ID NO: 3992485 - RNA, 21 nt, Staphylococcus aureus subsp. aureus Mu50
ccaaaaauuagccgaaaaaca

SEQ ID NO: 3992486 - RNA, 15 nt, Staphylococcus aureus subsp. aureus Mu50
ccaaaaauuguucaa

SEQ ID NO: 3992487 - RNA, 16 nt, Staphylococcus aureus subsp. aureus Mu50
ccaaaacauuuuguga

SEQ ID NO: 3992488 - RNA, 17 nt, Staphylococcus aureus subsp. aureus Mu50
ccaaaaguuauauaaau

SEQ ID NO: 3992489 - RNA, 16 nt, Staphylococcus aureus subsp. aureus Mu50
ccaaaaugguuaaaau

SEQ ID NO: 3992490 - RNA, 21 nt, Staphylococcus aureus subsp. aureus Mu50
ccaaacaaccugugauaaaaa

SEQ ID NO: 3992491 - RNA, 22 nt, Staphylococcus aureus subsp. aureus Mu50
ccaaacaaccugugauaaaaau

SEQ ID NO: 3992492 - RNA, 13 nt, Staphylococcus aureus subsp. aureus Mu50
ccaaacaauacau

SEQ ID NO: 3992493 - RNA, 15 nt, Staphylococcus aureus subsp. aureus Mu50
ccaaacauaauuacc

SEQ ID NO: 3992494 - RNA, 15 nt, Staphylococcus aureus subsp. aureus Mu50
ccaaauaaauuaaau

SEQ ID NO: 3992495 - RNA, 21 nt, Staphylococcus aureus subsp. aureus Mu50
ccaaauaacguuaauauaauu

SEQ ID NO: 3992496 - RNA, 18 nt, Staphylococcus aureus subsp. aureus Mu50
ccaguugauuuaagauuu

SEQ ID NO: 3992497 - RNA, 14 nt, Staphylococcus aureus subsp. aureus Mu50
ccauaaauauuaaa

SEQ ID NO: 3992498 - RNA, 17 nt, Staphylococcus aureus subsp. aureus Mu50
ccauaaauauuuaaaau

SEQ ID NO: 3992499 - RNA, 16 nt, Staphylococcus aureus subsp. aureus Mu50
ccauaacaaucauuuc

SEQ ID NO: 3992500 - RNA, 19 nt, Staphylococcus aureus subsp. aureus Mu50
ccauaacuuuauauauaaa

SEQ ID NO: 3992501 - RNA, 13 nt, Staphylococcus aureus subsp. aureus Mu50
ccauaaguaaaac

SEQ ID NO: 3992502 - RNA, 20 nt, Staphylococcus aureus subsp. aureus Mu50
ccauaauaaugccgcugcac

SEQ ID NO: 3992503 - RNA, 20 nt, Staphylococcus aureus subsp. aureus Mu50
ccauaaucuuuauuaauaaa

SEQ ID NO: 3992504 - RNA, 20 nt, Staphylococcus aureus subsp. aureus Mu50
ccauaaugacuauaacacca

SEQ ID NO: 3992505 - RNA, 13 nt, Staphylococcus aureus subsp. aureus Mu50
ccauaauuuaaau

SEQ ID NO: 3992506 - RNA, 21 nt, Staphylococcus aureus subsp. aureus Mu50
ccauacaaaucguaaacauaa

SEQ ID NO: 3992507 - RNA, 19 nt, Staphylococcus aureus subsp. aureus Mu50
ccauacauaugcuauauuu

SEQ ID NO: 3992508 - RNA, 23 nt, Staphylococcus aureus subsp. aureus Mu50
ccauacauaugcuauauuuaguu

SEQ ID NO: 3992509 - RNA, 15 nt, Staphylococcus aureus subsp. aureus Mu50
ccauacuaaauaagu

SEQ ID NO: 3992510 - RNA, 21 nt, Staphylococcus aureus subsp. aureus Mu50
ccauacuaaauaaguaguuca

SEQ ID NO: 3992511 - RNA, 20 nt, Staphylococcus aureus subsp. aureus Mu50
ccauacuaaucguuccaaca

SEQ ID NO: 3992512 - RNA, 14 nt, Staphylococcus aureus subsp. aureus Mu50
ccauacucuaacuu

SEQ ID NO: 3992513 - RNA, 14 nt, Staphylococcus aureus subsp. aureus Mu50
ccauacucugggca

SEQ ID NO: 3992514 - RNA, 20 nt, Staphylococcus aureus subsp. aureus Mu50
ccauacucugggcauuuuga

SEQ ID NO: 3992515 - RNA, 14 nt, Staphylococcus aureus subsp. aureus Mu50
ccauacuucuauuu

SEQ ID NO: 3992516 - RNA, 22 nt, Staphylococcus aureus subsp. aureus Mu50
ccauacuucuauuuuauaauaa

SEQ ID NO: 3992517 - RNA, 24 nt, Staphylococcus aureus subsp. aureus Mu50
ccauacuucuauuuuauaauaaau

SEQ ID NO: 3992518 - RNA, 11 nt, Staphylococcus aureus subsp. aureus Mu50
ccauagauuau

SEQ ID NO: 3992519 - RNA, 18 nt, Staphylococcus aureus subsp. aureus Mu50
ccauaguaauaaaaugau

SEQ ID NO: 3992520 - RNA, 23 nt, Staphylococcus aureus subsp. aureus Mu50
ccauauaaagcugcgauauaacu

SEQ ID NO: 3992521 - RNA, 17 nt, Staphylococcus aureus subsp. aureus Mu50
ccauaugugguggcuau

SEQ ID NO: 3992522 - RNA, 23 nt, Staphylococcus aureus subsp. aureus Mu50
ccauaugugguggcuauauaauu

SEQ ID NO: 3992523 - RNA, 17 nt, Staphylococcus aureus subsp. aureus Mu50
ccauauuuuuuaguaau

SEQ ID NO: 3992524 - RNA, 23 nt, Staphylococcus aureus subsp. aureus Mu50
ccaucaauccaacuacugcaaca

SEQ ID NO: 3992525 - RNA, 17 nt, Staphylococcus aureus subsp. aureus Mu50
ccaucaauuucuguaau

SEQ ID NO: 3992526 - RNA, 19 nt, Staphylococcus aureus subsp. aureus Mu50
ccaucauaaauguuauuaa

SEQ ID NO: 3992527 - RNA, 19 nt, Staphylococcus aureus subsp. aureus Mu50
ccaucaucucugcuuuaau

SEQ ID NO: 3992528 - RNA, 15 nt, Staphylococcus aureus subsp. aureus Mu50
ccaucauuuguguuu

SEQ ID NO: 3992529 - RNA, 21 nt, Staphylococcus aureus subsp. aureus Mu50
ccaucccaacuuaauaaccau

SEQ ID NO: 3992530 - RNA, 16 nt, Staphylococcus aureus subsp. aureus Mu50
ccaucgcaacugauaa

SEQ ID NO: 3992531 - RNA, 18 nt, Staphylococcus aureus subsp. aureus Mu50
ccaucuccaccauuaaua

SEQ ID NO: 3992532 - RNA, 19 nt, Staphylococcus aureus subsp. aureus Mu50
ccaucugugucagcauuca

SEQ ID NO: 3992533 - RNA, 15 nt, Staphylococcus aureus subsp. aureus Mu50
ccaucuuaucuuuau

SEQ ID NO: 3992534 - RNA, 11 nt, Staphylococcus aureus subsp. aureus Mu50
ccaucuuuaag

SEQ ID NO: 3992535 - RNA, 20 nt, Staphylococcus aureus subsp. aureus Mu50
ccaucuuuuagguaauaauu

SEQ ID NO: 3992536 - RNA, 18 nt, Staphylococcus aureus subsp. aureus Mu50
ccaugaaaaggaaaaacu

SEQ ID NO: 3992537 - RNA, 16 nt, Staphylococcus aureus subsp. aureus Mu50
ccaugagaaaccgcuu

SEQ ID NO: 3992538 - RNA, 19 nt, Staphylococcus aureus subsp. aureus Mu50
ccaugcccgauaaaaccac

SEQ ID NO: 3992539 - RNA, 19 nt, Staphylococcus aureus subsp. aureus Mu50
ccauguauaucuaauacuu

SEQ ID NO: 3992540 - RNA, 19 nt, Staphylococcus aureus subsp. aureus Mu50
ccaugugccuuugcuuuuu

SEQ ID NO: 3992541 - RNA, 19 nt, Staphylococcus aureus subsp. aureus Mu50
ccauuacaaugcgcaauga

SEQ ID NO: 3992542 - RNA, 23 nt, Staphylococcus aureus subsp. aureus Mu50
ccauuacugcagcaucauaaucu

SEQ ID NO: 3992543 - RNA, 18 nt, Staphylococcus aureus subsp. aureus Mu50
ccauuaguucuguugaua

SEQ ID NO: 3992544 - RNA, 16 nt, Staphylococcus aureus subsp. aureus Mu50
ccauucaauguuuaau

SEQ ID NO: 3992545 - RNA, 12 nt, Staphylococcus aureus subsp. aureus Mu50
ccauucguaaua

SEQ ID NO: 3992546 - RNA, 14 nt, Staphylococcus aureus subsp. aureus Mu50
ccauucugcagcga

SEQ ID NO: 3992547 - RNA, 23 nt, Staphylococcus aureus subsp. aureus Mu50
ccauugaaugaaucccauaauga

SEQ ID NO: 3992548 - RNA, 22 nt, Staphylococcus aureus subsp. aureus Mu50
ccauugcacaguuucaucuuca

SEQ ID NO: 3992549 - RNA, 20 nt, Staphylococcus aureus subsp. aureus Mu50
ccauugcgcuucgucuuuau

SEQ ID NO: 3992550 - RNA, 15 nt, Staphylococcus aureus subsp. aureus Mu50
ccauuguuauccaaa

SEQ ID NO: 3992551 - RNA, 17 nt, Staphylococcus aureus subsp. aureus Mu50
ccauuguugauaaaugg

SEQ ID NO: 3992552 - RNA, 17 nt, Staphylococcus aureus subsp. aureus Mu50
ccauuuaaggauuuccu

SEQ ID NO: 3992553 - RNA, 13 nt, Staphylococcus aureus subsp. aureus Mu50
ccauuuaucuuua

SEQ ID NO: 3992554 - RNA, 22 nt, Staphylococcus aureus subsp. aureus Mu50
ccauuucgauaccuaaaauacc

SEQ ID NO: 3992555 - RNA, 22 nt, Staphylococcus aureus subsp. aureus Mu50
ccauuugcuggcgcaaugauau

SEQ ID NO: 3992556 - RNA, 20 nt, Staphylococcus aureus subsp. aureus Mu50
ccauuuuauuuuaacuuaau

SEQ ID NO: 3992557 - RNA, 21 nt, Staphylococcus aureus subsp. aureus Mu50
ccauuuuuuuaucuguagaaa

SEQ ID NO: 3992558 - RNA, 14 nt, Staphylococcus aureus subsp. aureus Mu50
cccaaaaaauugua

SEQ ID NO: 3992559 - RNA, 18 nt, Staphylococcus aureus subsp. aureus Mu50
cccaaauguaagaacgaa

SEQ ID NO: 3992560 - RNA, 14 nt, Staphylococcus aureus subsp. aureus Mu50
cccaacuuaauaac

SEQ ID NO: 3992561 - RNA, 18 nt, Staphylococcus aureus subsp. aureus Mu50
cccaagaugguauugcuu

SEQ ID NO: 3992562 - RNA, 20 nt, Staphylococcus aureus subsp. aureus Mu50
cccaaucgauuuuauaucuu

SEQ ID NO: 3992563 - RNA, 19 nt, Staphylococcus aureus subsp. aureus Mu50
cccaaugcuugaauuuuau

SEQ ID NO: 3992564 - RNA, 22 nt, Staphylococcus aureus subsp. aureus Mu50
cccaauuaaccuugauuuaauu

SEQ ID NO: 3992565 - RNA, 20 nt, Staphylococcus aureus subsp. aureus Mu50
cccaauucggauuauauuua

SEQ ID NO: 3992566 - RNA, 13 nt, Staphylococcus aureus subsp. aureus Mu50
cccacaccccaac

SEQ ID NO: 3992567 - RNA, 14 nt, Staphylococcus aureus subsp. aureus Mu50
cccacaccccaacu

SEQ ID NO: 3992568 - RNA, 18 nt, Staphylococcus aureus subsp. aureus Mu50
cccagauucauaucuuuc

SEQ ID NO: 3992569 - RNA, 22 nt, Staphylococcus aureus subsp. aureus Mu50
cccagcuugaccgccuaugaua

SEQ ID NO: 3992570 - RNA, 12 nt, Staphylococcus aureus subsp. aureus Mu50
cccauaacaccu

SEQ ID NO: 3992571 - RNA, 17 nt, Staphylococcus aureus subsp. aureus Mu50
cccauaccuacaaauau

SEQ ID NO: 3992572 - RNA, 18 nt, Staphylococcus aureus subsp. aureus Mu50
cccauggauucugauucg

SEQ ID NO: 3992573 - RNA, 19 nt, Staphylococcus aureus subsp. aureus Mu50
cccauuuuuaaaauuauga

SEQ ID NO: 3992574 - RNA, 11 nt, Staphylococcus aureus subsp. aureus Mu50
ccccaacacag

SEQ ID NO: 3992575 - RNA, 16 nt, Staphylococcus aureus subsp. aureus Mu50
ccccaacacagagaau

SEQ ID NO: 3992576 - RNA, 23 nt, Staphylococcus aureus subsp. aureus Mu50
ccccaacacugagaauuucuaau

SEQ ID NO: 3992577 - RNA, 15 nt, Staphylococcus aureus subsp. aureus Mu50
ccccaacucgcauug

SEQ ID NO: 3992578 - RNA, 17 nt, Staphylococcus aureus subsp. aureus Mu50
ccccucauucacaauga

SEQ ID NO: 3992579 - RNA, 13 nt, Staphylococcus aureus subsp. aureus Mu50
cccguuugauuuc

SEQ ID NO: 3992580 - RNA, 22 nt, Staphylococcus aureus subsp. aureus Mu50
cccuacaaaguuuauacuuaau

SEQ ID NO: 3992581 - RNA, 19 nt, Staphylococcus aureus subsp. aureus Mu50
cccuagguuuauauaucac

SEQ ID NO: 3992582 - RNA, 21 nt, Staphylococcus aureus subsp. aureus Mu50
cccuccuggugcugcaccaag

SEQ ID NO: 3992583 - RNA, 15 nt, Staphylococcus aureus subsp. aureus Mu50
ccucauaauuaucau

SEQ ID NO: 3992584 - RNA, 18 nt, Staphylococcus aureus subsp. aureus Mu50
ccucauaauuaucauaua

SEQ ID NO: 3992585 - RNA, 11 nt, Staphylococcus aureus subsp. aureus Mu50
ccucauucaca

SEQ ID NO: 3992586 - RNA, 17 nt, Staphylococcus aureus subsp. aureus Mu50
ccucauuccaggaagga

SEQ ID NO: 3992587 - RNA, 16 nt, Staphylococcus aureus subsp. aureus Mu50
ccucauuuuuauaaau

SEQ ID NO: 3992588 - RNA, 12 nt, Staphylococcus aureus subsp. aureus Mu50
ccuccaaagcua

SEQ ID NO: 3992589 - RNA, 16 nt, Staphylococcus aureus subsp. aureus Mu50
ccucgguauucaauuc

SEQ ID NO: 3992590 - RNA, 17 nt, Staphylococcus aureus subsp. aureus Mu50
ccucguuccgggaagga

SEQ ID NO: 3992591 - RNA, 10 nt, Staphylococcus aureus subsp. aureus Mu50
ccucuuuaaa

SEQ ID NO: 3992592 - RNA, 17 nt, Staphylococcus aureus subsp. aureus Mu50
ccugaaaagaauaaguu

SEQ ID NO: 3992593 - RNA, 17 nt, Staphylococcus aureus subsp. aureus Mu50
ccugagccauaacugaa

SEQ ID NO: 3992594 - RNA, 21 nt, Staphylococcus aureus subsp. aureus Mu50
ccugauauuucaacuuuuuaa

SEQ ID NO: 3992595 - RNA, 20 nt, Staphylococcus aureus subsp. aureus Mu50
ccugcaauuuguaauacaag

SEQ ID NO: 3992596 - RNA, 15 nt, Staphylococcus aureus subsp. aureus Mu50
ccugcuuuuuuuaua

SEQ ID NO: 3992597 - RNA, 14 nt, Staphylococcus aureus subsp. aureus Mu50
ccuggaauauuaac

SEQ ID NO: 3992598 - RNA, 21 nt, Staphylococcus aureus subsp. aureus Mu50
ccuggaauauuaacaccagau

SEQ ID NO: 3992599 - RNA, 19 nt, Staphylococcus aureus subsp. aureus Mu50
ccuggaaucgaaaauauca

SEQ ID NO: 3992600 - RNA, 15 nt, Staphylococcus aureus subsp. aureus Mu50
ccuguacauccacuu

SEQ ID NO: 3992601 - RNA, 15 nt, Staphylococcus aureus subsp. aureus Mu50
ccuguagaauuucuu

SEQ ID NO: 3992602 - RNA, 14 nt, Staphylococcus aureus subsp. aureus Mu50
ccugucuuaauuca

SEQ ID NO: 3992603 - RNA, 15 nt, Staphylococcus aureus subsp. aureus Mu50
ccuguugaauauacu

SEQ ID NO: 3992604 - RNA, 12 nt, Staphylococcus aureus subsp. aureus Mu50
ccuguuggcuuu

SEQ ID NO: 3992605 - RNA, 14 nt, Staphylococcus aureus subsp. aureus Mu50
ccuuaaaauauuua

SEQ ID NO: 3992606 - RNA, 15 nt, Staphylococcus aureus subsp. aureus Mu50
ccuuaaaauauuuaa

SEQ ID NO: 3992607 - RNA, 18 nt, Staphylococcus aureus subsp. aureus Mu50
ccuuaacuucauaauaua

SEQ ID NO: 3992608 - RNA, 15 nt, Staphylococcus aureus subsp. aureus Mu50
ccuuaauaucaugca

SEQ ID NO: 3992609 - RNA, 18 nt, Staphylococcus aureus subsp. aureus Mu50
ccuuacccaaaaaauugu

SEQ ID NO: 3992610 - RNA, 15 nt, Staphylococcus aureus subsp. aureus Mu50
ccuuagcaauaucau

SEQ ID NO: 3992611 - RNA, 20 nt, Staphylococcus aureus subsp. aureus Mu50
ccuucaaagauuuuaccuug

SEQ ID NO: 3992612 - RNA, 20 nt, Staphylococcus aureus subsp. aureus Mu50
ccuucaauguucaauucacg

SEQ ID NO: 3992613 - RNA, 15 nt, Staphylococcus aureus subsp. aureus Mu50
ccuucaucaauaaau

SEQ ID NO: 3992614 - RNA, 13 nt, Staphylococcus aureus subsp. aureus Mu50
ccuucaucacuau

SEQ ID NO: 3992615 - RNA, 21 nt, Staphylococcus aureus subsp. aureus Mu50
ccuucauuagccaaaucuuua

SEQ ID NO: 3992616 - RNA, 15 nt, Staphylococcus aureus subsp. aureus Mu50
ccuuccaauaauaaa

SEQ ID NO: 3992617 - RNA, 19 nt, Staphylococcus aureus subsp. aureus Mu50
ccuucgauaguuuauuaau

SEQ ID NO: 3992618 - RNA, 23 nt, Staphylococcus aureus subsp. aureus Mu50
ccuucgauaguuuauuaauauua

SEQ ID NO: 3992619 - RNA, 17 nt, Staphylococcus aureus subsp. aureus Mu50
ccuucgcauacuuuuuc

SEQ ID NO: 3992620 - RNA, 19 nt, Staphylococcus aureus subsp. aureus Mu50
ccuucgcauacuuuuucag

SEQ ID NO: 3992621 - RNA, 16 nt, Staphylococcus aureus subsp. aureus Mu50
ccuucuauauaguaaa

SEQ ID NO: 3992622 - RNA, 15 nt, Staphylococcus aureus subsp. aureus Mu50
ccuucucaucauuuu

SEQ ID NO: 3992623 - RNA, 22 nt, Staphylococcus aureus subsp. aureus Mu50
ccuucuccaaaaauaauuaaau

SEQ ID NO: 3992624 - RNA, 21 nt, Staphylococcus aureus subsp. aureus Mu50
ccuucuguacguuuuaaauaa

SEQ ID NO: 3992625 - RNA, 15 nt, Staphylococcus aureus subsp. aureus Mu50
ccuucuuuauaacuu

SEQ ID NO: 3992626 - RNA, 17 nt, Staphylococcus aureus subsp. aureus Mu50
ccuucuuuauaacuuuc

SEQ ID NO: 3992627 - RNA, 15 nt, Staphylococcus aureus subsp. aureus Mu50
ccuucuuucgcuuca

SEQ ID NO: 3992628 - RNA, 17 nt, Staphylococcus aureus subsp. aureus Mu50
ccuucuuugaaaucaau

SEQ ID NO: 3992629 - RNA, 18 nt, Staphylococcus aureus subsp. aureus Mu50
ccuucuuugaaaucaaug

SEQ ID NO: 3992630 - RNA, 16 nt, Staphylococcus aureus subsp. aureus Mu50
ccuugaaugauauuaa

SEQ ID NO: 3992631 - RNA, 20 nt, Staphylococcus aureus subsp. aureus Mu50
ccuugaccuacuuuuucaau

SEQ ID NO: 3992632 - RNA, 22 nt, Staphylococcus aureus subsp. aureus Mu50
ccuugagcucacgauuaauaaa

SEQ ID NO: 3992633 - RNA, 15 nt, Staphylococcus aureus subsp. aureus Mu50
ccuugcuaucaaacu

SEQ ID NO: 3992634 - RNA, 15 nt, Staphylococcus aureus subsp. aureus Mu50
ccuuguaaauuuaaa

SEQ ID NO: 3992635 - RNA, 19 nt, Staphylococcus aureus subsp. aureus Mu50
ccuuguuggcuuuuuuaau

SEQ ID NO: 3992636 - RNA, 21 nt, Staphylococcus aureus subsp. aureus Mu50
ccuuguuuaaguuuuucaggg

SEQ ID NO: 3992637 - RNA, 13 nt, Staphylococcus aureus subsp. aureus Mu50
ccuuuaauaauau

SEQ ID NO: 3992638 - RNA, 17 nt, Staphylococcus aureus subsp. aureus Mu50
ccuuuaauaauauugaa

SEQ ID NO: 3992639 - RNA, 15 nt, Staphylococcus aureus subsp. aureus Mu50
ccuuuaauuacacua

SEQ ID NO: 3992640 - RNA, 18 nt, Staphylococcus aureus subsp. aureus Mu50
ccuuuaauuacacuacgc

SEQ ID NO: 3992641 - RNA, 22 nt, Staphylococcus aureus subsp. aureus Mu50
ccuuuaauuguuaaaucaccaa

SEQ ID NO: 3992642 - RNA, 23 nt, Staphylococcus aureus subsp. aureus Mu50
ccuuuaauuguuaaaucaccaac

SEQ ID NO: 3992643 - RNA, 19 nt, Staphylococcus aureus subsp. aureus Mu50
ccuuuacaacauacaugcc

SEQ ID NO: 3992644 - RNA, 17 nt, Staphylococcus aureus subsp. aureus Mu50
ccuuuagccaaugcuuc

SEQ ID NO: 3992645 - RNA, 15 nt, Staphylococcus aureus subsp. aureus Mu50
ccuuuagucauguuu

SEQ ID NO: 3992646 - RNA, 17 nt, Staphylococcus aureus subsp. aureus Mu50
ccuuuauauuuaguuag

SEQ ID NO: 3992647 - RNA, 20 nt, Staphylococcus aureus subsp. aureus Mu50
ccuuuauuuugauagacuaa

SEQ ID NO: 3992648 - RNA, 17 nt, Staphylococcus aureus subsp. aureus Mu50
ccuuucaaauauaucua

SEQ ID NO: 3992649 - RNA, 19 nt, Staphylococcus aureus subsp. aureus Mu50
ccuuucaaauauaucuaau

SEQ ID NO: 3992650 - RNA, 12 nt, Staphylococcus aureus subsp. aureus Mu50
ccuuucauuuua

SEQ ID NO: 3992651 - RNA, 17 nt, Staphylococcus aureus subsp. aureus Mu50
ccuuuccauuguugaua

SEQ ID NO: 3992652 - RNA, 16 nt, Staphylococcus aureus subsp. aureus Mu50
ccuuucgauaaacuac

SEQ ID NO: 3992653 - RNA, 20 nt, Staphylococcus aureus subsp. aureus Mu50
ccuuucuaagauguguugaa

SEQ ID NO: 3992654 - RNA, 14 nt, Staphylococcus aureus subsp. aureus Mu50
ccuuucuuuuucga

SEQ ID NO: 3992655 - RNA, 24 nt, Staphylococcus aureus subsp. aureus Mu50
ccuuugauguuuucuauaauauuu

SEQ ID NO: 3992656 - RNA, 18 nt, Staphylococcus aureus subsp. aureus Mu50
ccuuugcuuaaaccuuaa

SEQ ID NO: 3992657 - RNA, 20 nt, Staphylococcus aureus subsp. aureus Mu50
ccuuuuauaagcuuguaauc

SEQ ID NO: 3992658 - RNA, 11 nt, Staphylococcus aureus subsp. aureus Mu50
ccuuuucaaau

SEQ ID NO: 3992659 - RNA, 22 nt, Staphylococcus aureus subsp. aureus Mu50
ccuuuugauguuuaugacaaag

SEQ ID NO: 3992660 - RNA, 17 nt, Staphylococcus aureus subsp. aureus Mu50
ccuuuuuauuuuuugga

SEQ ID NO: 3992661 - RNA, 17 nt, Staphylococcus aureus subsp. aureus Mu50
ccuuuuugacucagaau

SEQ ID NO: 3992662 - RNA, 13 nt, Staphylococcus aureus subsp. aureus Mu50
ccuuuuuguaauu

SEQ ID NO: 3992663 - RNA, 17 nt, Staphylococcus aureus subsp. aureus Mu50
ccuuuuuguaauuguaa

SEQ ID NO: 3992664 - RNA, 18 nt, Staphylococcus aureus subsp. aureus Mu50
ccuuuuuuuauguuuaaa

SEQ ID NO: 3992665 - RNA, 23 nt, Staphylococcus aureus subsp. aureus Mu50
cgaaaaacaucauuucugaaguu

SEQ ID NO: 3992666 - RNA, 21 nt, Staphylococcus aureus subsp. aureus Mu50
cgaaaaaugccaacuauaccu

SEQ ID NO: 3992667 - RNA, 23 nt, Staphylococcus aureus subsp. aureus Mu50
cgaaaagaaauucuacaggcaau

SEQ ID NO: 3992668 - RNA, 16 nt, Staphylococcus aureus subsp. aureus Mu50
cgaaaaguauaugaau

SEQ ID NO: 3992669 - RNA, 19 nt, Staphylococcus aureus subsp. aureus Mu50
cgaaaauagcuauuaaaau

SEQ ID NO: 3992670 - RNA, 20 nt, Staphylococcus aureus subsp. aureus Mu50
cgaaaauagcuauuaaaaua

SEQ ID NO: 3992671 - RNA, 16 nt, Staphylococcus aureus subsp. aureus Mu50
cgaaaauaucaauuua

SEQ ID NO: 3992672 - RNA, 18 nt, Staphylococcus aureus subsp. aureus Mu50
cgaaaauaucaauuuauu

SEQ ID NO: 3992673 - RNA, 24 nt, Staphylococcus aureus subsp. aureus Mu50
cgaaaauuucaggcguuaauacau

SEQ ID NO: 3992674 - RNA, 16 nt, Staphylococcus aureus subsp. aureus Mu50
cgaaacacacuaaaag

SEQ ID NO: 3992675 - RNA, 15 nt, Staphylococcus aureus subsp. aureus Mu50
cgaaacauuaaaaua

SEQ ID NO: 3992676 - RNA, 17 nt, Staphylococcus aureus subsp. aureus Mu50
cgaaagaugauauauuc

SEQ ID NO: 3992677 - RNA, 12 nt, Staphylococcus aureus subsp. aureus Mu50
cgaaaguacaag

SEQ ID NO: 3992678 - RNA, 14 nt, Staphylococcus aureus subsp. aureus Mu50
cgaaauauuguaau

SEQ ID NO: 3992679 - RNA, 15 nt, Staphylococcus aureus subsp. aureus Mu50
cgaaaugaaugagug

SEQ ID NO: 3992680 - RNA, 21 nt, Staphylococcus aureus subsp. aureus Mu50
cgaaaugcaaugagcaucuug

SEQ ID NO: 3992681 - RNA, 18 nt, Staphylococcus aureus subsp. aureus Mu50
cgaaauggugaacuaaau

SEQ ID NO: 3992682 - RNA, 13 nt, Staphylococcus aureus subsp. aureus Mu50
cgaaauuacuguu

SEQ ID NO: 3992683 - RNA, 14 nt, Staphylococcus aureus subsp. aureus Mu50
cgaaauuacuguua

SEQ ID NO: 3992684 - RNA, 19 nt, Staphylococcus aureus subsp. aureus Mu50
cgaaauucucuuuguuggg

SEQ ID NO: 3992685 - RNA, 14 nt, Staphylococcus aureus subsp. aureus Mu50
cgaacauaaauaaa

SEQ ID NO: 3992686 - RNA, 16 nt, Staphylococcus aureus subsp. aureus Mu50
cgaacaucugaaaaaa

SEQ ID NO: 3992687 - RNA, 21 nt, Staphylococcus aureus subsp. aureus Mu50
cgaacaugguaucuuuaauuu

SEQ ID NO: 3992688 - RNA, 23 nt, Staphylococcus aureus subsp. aureus Mu50
cgaaccgaagcgcagugaccuca

SEQ ID NO: 3992689 - RNA, 18 nt, Staphylococcus aureus subsp. aureus Mu50
cgaacgauagauucugau

SEQ ID NO: 3992690 - RNA, 15 nt, Staphylococcus aureus subsp. aureus Mu50
cgaacuuuuguucua

SEQ ID NO: 3992691 - RNA, 16 nt, Staphylococcus aureus subsp. aureus Mu50
cgaagaaacauuauau

SEQ ID NO: 3992692 - RNA, 13 nt, Staphylococcus aureus subsp. aureus Mu50
cgaagaauccuau

SEQ ID NO: 3992693 - RNA, 13 nt, Staphylococcus aureus subsp. aureus Mu50
cgaagaaugauac

SEQ ID NO: 3992694 - RNA, 19 nt, Staphylococcus aureus subsp. aureus Mu50
cgaagcgaguuauauuguu

SEQ ID NO: 3992695 - RNA, 18 nt, Staphylococcus aureus subsp. aureus Mu50
cgaagggcggucaauuuu

SEQ ID NO: 3992696 - RNA, 16 nt, Staphylococcus aureus subsp. aureus Mu50
cgaauaacuguuuauc

SEQ ID NO: 3992697 - RNA, 17 nt, Staphylococcus aureus subsp. aureus Mu50
cgaauaucuuaaagaau

SEQ ID NO: 3992698 - RNA, 17 nt, Staphylococcus aureus subsp. aureus Mu50
cgaauccuaaaaagcuc

SEQ ID NO: 3992699 - RNA, 22 nt, Staphylococcus aureus subsp. aureus Mu50
cgaauguauugcuauaagaacu

SEQ ID NO: 3992700 - RNA, 22 nt, Staphylococcus aureus subsp. aureus Mu50
cgaauguuccuuguuuuaaacu

SEQ ID NO: 3992701 - RNA, 14 nt, Staphylococcus aureus subsp. aureus Mu50
cgaauucauuaacg

SEQ ID NO: 3992702 - RNA, 22 nt, Staphylococcus aureus subsp. aureus Mu50
cgaauucucgauuuuuuuauau

SEQ ID NO: 3992703 - RNA, 17 nt, Staphylococcus aureus subsp. aureus Mu50
cgaauugguaaaaaucu

SEQ ID NO: 3992704 - RNA, 15 nt, Staphylococcus aureus subsp. aureus Mu50
cgaauuucauaguua

SEQ ID NO: 3992705 - RNA, 18 nt, Staphylococcus aureus subsp. aureus Mu50
cgacaaaacuuguaauca

SEQ ID NO: 3992706 - RNA, 14 nt, Staphylococcus aureus subsp. aureus Mu50
cgacaagaauuaau

SEQ ID NO: 3992707 - RNA, 19 nt, Staphylococcus aureus subsp. aureus Mu50
cgacaaucacagcaauaau

SEQ ID NO: 3992708 - RNA, 13 nt, Staphylococcus aureus subsp. aureus Mu50
cgacaauuauaau

SEQ ID NO: 3992709 - RNA, 20 nt, Staphylococcus aureus subsp. aureus Mu50
cgacaauuauaauaaaacuu

SEQ ID NO: 3992710 - RNA, 16 nt, Staphylococcus aureus subsp. aureus Mu50
cgacaccaacauauuu

SEQ ID NO: 3992711 - RNA, 17 nt, Staphylococcus aureus subsp. aureus Mu50
cgacacgaacaacauua

SEQ ID NO: 3992712 - RNA, 18 nt, Staphylococcus aureus subsp. aureus Mu50
cgacaucgccaauuugau

SEQ ID NO: 3992713 - RNA, 10 nt, Staphylococcus aureus subsp. aureus Mu50
cgacaucuag

SEQ ID NO: 3992714 - RNA, 20 nt, Staphylococcus aureus subsp. aureus Mu50
cgacauguccauaauauccu

SEQ ID NO: 3992715 - RNA, 18 nt, Staphylococcus aureus subsp. aureus Mu50
cgacauuuguaaauauuu

SEQ ID NO: 3992716 - RNA, 20 nt, Staphylococcus aureus subsp. aureus Mu50
cgacauuuuuagacauuaaa

SEQ ID NO: 3992717 - RNA, 14 nt, Staphylococcus aureus subsp. aureus Mu50
cgacguuuaaaugc

SEQ ID NO: 3992718 - RNA, 16 nt, Staphylococcus aureus subsp. aureus Mu50
cgacguuuaaaugccc

SEQ ID NO: 3992719 - RNA, 14 nt, Staphylococcus aureus subsp. aureus Mu50
cgacuaauuuuucu

SEQ ID NO: 3992720 - RNA, 14 nt, Staphylococcus aureus subsp. aureus Mu50
cgacuuaacuuaag

SEQ ID NO: 3992721 - RNA, 16 nt, Staphylococcus aureus subsp. aureus Mu50
cgagauuuuauaagua

SEQ ID NO: 3992722 - RNA, 13 nt, Staphylococcus aureus subsp. aureus Mu50
cgagcaauucuuc

SEQ ID NO: 3992723 - RNA, 17 nt, Staphylococcus aureus subsp. aureus Mu50
cgagccauuauuauuuu

SEQ ID NO: 3992724 - RNA, 20 nt, Staphylococcus aureus subsp. aureus Mu50
cgagccauuauuauuuuuuu

SEQ ID NO: 3992725 - RNA, 20 nt, Staphylococcus aureus subsp. aureus Mu50
cgagcuaauaugucuagacu

SEQ ID NO: 3992726 - RNA, 20 nt, Staphylococcus aureus subsp. aureus Mu50
cgagcugcuucaacuacuuc

SEQ ID NO: 3992727 - RNA, 22 nt, Staphylococcus aureus subsp. aureus Mu50
cgagcuggugagaaauugaauu

SEQ ID NO: 3992728 - RNA, 20 nt, Staphylococcus aureus subsp. aureus Mu50
cgagcuuugcucauagauga

SEQ ID NO: 3992729 - RNA, 13 nt, Staphylococcus aureus subsp. aureus Mu50
cgaguuauaucuu

SEQ ID NO: 3992730 - RNA, 23 nt, Staphylococcus aureus subsp. aureus Mu50
cgaguuuguuucuaaauucuuuu

SEQ ID NO: 3992731 - RNA, 17 nt, Staphylococcus aureus subsp. aureus Mu50
cgauaaaaguuguauuc

SEQ ID NO: 3992732 - RNA, 13 nt, Staphylococcus aureus subsp. aureus Mu50
cgauaaauaauaa

SEQ ID NO: 3992733 - RNA, 15 nt, Staphylococcus aureus subsp. aureus Mu50
cgauaacaauuuauu

SEQ ID NO: 3992734 - RNA, 19 nt, Staphylococcus aureus subsp. aureus Mu50
cgauaagauagcuauauuu

SEQ ID NO: 3992735 - RNA, 17 nt, Staphylococcus aureus subsp. aureus Mu50
cgauaagcaaaaauucu

SEQ ID NO: 3992736 - RNA, 14 nt, Staphylococcus aureus subsp. aureus Mu50
cgauaauagauacc

SEQ ID NO: 3992737 - RNA, 17 nt, Staphylococcus aureus subsp. aureus Mu50
cgauaaugaaauacgau

SEQ ID NO: 3992738 - RNA, 20 nt, Staphylococcus aureus subsp. aureus Mu50
cgauaauguauaucgacacc

SEQ ID NO: 3992739 - RNA, 22 nt, Staphylococcus aureus subsp. aureus Mu50
cgauaauuugagaaaugaaacu

SEQ ID NO: 3992740 - RNA, 14 nt, Staphylococcus aureus subsp. aureus Mu50
cgauacauaaaaca

SEQ ID NO: 3992741 - RNA, 15 nt, Staphylococcus aureus subsp. aureus Mu50
cgauaccuaaaauac

SEQ ID NO: 3992742 - RNA, 15 nt, Staphylococcus aureus subsp. aureus Mu50
cgauaccuuuaauau

SEQ ID NO: 3992743 - RNA, 15 nt, Staphylococcus aureus subsp. aureus Mu50
cgauacugcuuugga

SEQ ID NO: 3992744 - RNA, 12 nt, Staphylococcus aureus subsp. aureus Mu50
cgauacuuuuug

SEQ ID NO: 3992745 - RNA, 13 nt, Staphylococcus aureus subsp. aureus Mu50
cgauagauaucau

SEQ ID NO: 3992746 - RNA, 19 nt, Staphylococcus aureus subsp. aureus Mu50
cgauauaacauuaaaauga

SEQ ID NO: 3992747 - RNA, 19 nt, Staphylococcus aureus subsp. aureus Mu50
cgauaucuaagucgauaag

SEQ ID NO: 3992748 - RNA, 21 nt, Staphylococcus aureus subsp. aureus Mu50
cgauaucuuuuaauucuuaau

SEQ ID NO: 3992749 - RNA, 21 nt, Staphylococcus aureus subsp. aureus Mu50
cgauauguuuggauaucuuug

SEQ ID NO: 3992750 - RNA, 20 nt, Staphylococcus aureus subsp. aureus Mu50
cgauauuaugucgagguguu

SEQ ID NO: 3992751 - RNA, 12 nt, Staphylococcus aureus subsp. aureus Mu50
cgauauucuaca

SEQ ID NO: 3992752 - RNA, 17 nt, Staphylococcus aureus subsp. aureus Mu50
cgauauuucuaguugca

SEQ ID NO: 3992753 - RNA, 14 nt, Staphylococcus aureus subsp. aureus Mu50
cgauauuuguuugu

SEQ ID NO: 3992754 - RNA, 20 nt, Staphylococcus aureus subsp. aureus Mu50
cgauauuuuaaaaaguaauu

SEQ ID NO: 3992755 - RNA, 18 nt, Staphylococcus aureus subsp. aureus Mu50
cgaucauaaauauuuucu

SEQ ID NO: 3992756 - RNA, 20 nt, Staphylococcus aureus subsp. aureus Mu50
cgaucauuagcaauuucauc

SEQ ID NO: 3992757 - RNA, 17 nt, Staphylococcus aureus subsp. aureus Mu50
cgaucuuuaaugauaag

SEQ ID NO: 3992758 - RNA, 14 nt, Staphylococcus aureus subsp. aureus Mu50
cgaugacuuuuuaa

SEQ ID NO: 3992759 - RNA, 18 nt, Staphylococcus aureus subsp. aureus Mu50
cggggccccaacacagag

SEQ ID NO: 3992760 - RNA, 20 nt, Staphylococcus aureus subsp. aureus Mu50
cggggccccaacacagagaa

SEQ ID NO: 3992761 - RNA, 23 nt, Staphylococcus aureus subsp. aureus Mu50
cgggggacauagguauaaucauu

SEQ ID NO: 3992762 - RNA, 20 nt, Staphylococcus aureus subsp. aureus Mu50
cgggggauuauuuauauuuu

SEQ ID NO: 3992763 - RNA, 19 nt, Staphylococcus aureus subsp. aureus Mu50
cgguauuuuaaauuuauaa

SEQ ID NO: 3992764 - RNA, 15 nt, Staphylococcus aureus subsp. aureus Mu50
cgguuaaauuauuua

SEQ ID NO: 3992765 - RNA, 23 nt, Staphylococcus aureus subsp. aureus Mu50
cgguuaaauuauuuaauuuuucu

SEQ ID NO: 3992766 - RNA, 15 nt, Staphylococcus aureus subsp. aureus Mu50
cgguuauuuaauaau

SEQ ID NO: 3992767 - RNA, 17 nt, Staphylococcus aureus subsp. aureus Mu50
cgguuguauuucaucau

SEQ ID NO: 3992768 - RNA, 18 nt, Staphylococcus aureus subsp. aureus Mu50
cgguuuaaucuauauaua

SEQ ID NO: 3992769 - RNA, 17 nt, Staphylococcus aureus subsp. aureus Mu50
cgguuugaaaaauggug

SEQ ID NO: 3992770 - RNA, 18 nt, Staphylococcus aureus subsp. aureus Mu50
cguaaauuuuaucuaaac

SEQ ID NO: 3992771 - RNA, 13 nt, Staphylococcus aureus subsp. aureus Mu50
cguaacauuuaaa

SEQ ID NO: 3992772 - RNA, 18 nt, Staphylococcus aureus subsp. aureus Mu50
cguaacauuuaaaaaaug

SEQ ID NO: 3992773 - RNA, 17 nt, Staphylococcus aureus subsp. aureus Mu50
cguaacucuuuaauuuu

SEQ ID NO: 3992774 - RNA, 19 nt, Staphylococcus aureus subsp. aureus Mu50
cguaacucuuuaauuuuac

SEQ ID NO: 3992775 - RNA, 20 nt, Staphylococcus aureus subsp. aureus Mu50
cguaagcaguuaauaagaaa

SEQ ID NO: 3992776 - RNA, 15 nt, Staphylococcus aureus subsp. aureus Mu50
cguaaugauauuacc

SEQ ID NO: 3992777 - RNA, 15 nt, Staphylococcus aureus subsp. aureus Mu50
cguaauuauuauaau

SEQ ID NO: 3992778 - RNA, 20 nt, Staphylococcus aureus subsp. aureus Mu50
cguacauuuaugauuguuua

SEQ ID NO: 3992779 - RNA, 16 nt, Staphylococcus aureus subsp. aureus Mu50
cguacuuucaaauaau

SEQ ID NO: 3992780 - RNA, 14 nt, Staphylococcus aureus subsp. aureus Mu50
cguaguuguccauu

SEQ ID NO: 3992781 - RNA, 23 nt, Staphylococcus aureus subsp. aureus Mu50
cguauaagggguauauuaaaaau

SEQ ID NO: 3992782 - RNA, 22 nt, Staphylococcus aureus subsp. aureus Mu50
cguauaauuuuaauauuauguu

SEQ ID NO: 3992783 - RNA, 18 nt, Staphylococcus aureus subsp. aureus Mu50
cguauacuuucgaucuuc

SEQ ID NO: 3992784 - RNA, 20 nt, Staphylococcus aureus subsp. aureus Mu50
cguauauauauauuaaaaca

SEQ ID NO: 3992785 - RNA, 20 nt, Staphylococcus aureus subsp. aureus Mu50
cguaucaagaaaaaguuuuu

SEQ ID NO: 3992786 - RNA, 13 nt, Staphylococcus aureus subsp. aureus Mu50
cguaucauuuaaa

SEQ ID NO: 3992787 - RNA, 16 nt, Staphylococcus aureus subsp. aureus Mu50
cguaucauuuaaaaua

SEQ ID NO: 3992788 - RNA, 14 nt, Staphylococcus aureus subsp. aureus Mu50
cguauguaacaauu

SEQ ID NO: 3992789 - RNA, 17 nt, Staphylococcus aureus subsp. aureus Mu50
cguauuagccaauaaaa

SEQ ID NO: 3992790 - RNA, 13 nt, Staphylococcus aureus subsp. aureus Mu50
cguauuauuauug

SEQ ID NO: 3992791 - RNA, 12 nt, Staphylococcus aureus subsp. aureus Mu50
cguauuccauug

SEQ ID NO: 3992792 - RNA, 14 nt, Staphylococcus aureus subsp. aureus Mu50
cguauugaaugaau

SEQ ID NO: 3992793 - RNA, 15 nt, Staphylococcus aureus subsp. aureus Mu50
cguauuuaccuucuu

SEQ ID NO: 3992794 - RNA, 17 nt, Staphylococcus aureus subsp. aureus Mu50
cguauuucaaauguaau

SEQ ID NO: 3992795 - RNA, 14 nt, Staphylococcus aureus subsp. aureus Mu50
cguauuuuaauauu

SEQ ID NO: 3992796 - RNA, 14 nt, Staphylococcus aureus subsp. aureus Mu50
cguauuuuaaugau

SEQ ID NO: 3992797 - RNA, 15 nt, Staphylococcus aureus subsp. aureus Mu50
cguauuuuaaugauu

SEQ ID NO: 3992798 - RNA, 12 nt, Staphylococcus aureus subsp. aureus Mu50
cgucaaguuuuc

SEQ ID NO: 3992799 - RNA, 16 nt, Staphylococcus aureus subsp. aureus Mu50
cgucacauauaaauau

SEQ ID NO: 3992800 - RNA, 23 nt, Staphylococcus aureus subsp. aureus Mu50
cgucacaugccaucuuuguaacc

SEQ ID NO: 3992801 - RNA, 14 nt, Staphylococcus aureus subsp. aureus Mu50
cgucacuuuauuaa

SEQ ID NO: 3992802 - RNA, 19 nt, Staphylococcus aureus subsp. aureus Mu50
cgucaucaaaacguuugaa

SEQ ID NO: 3992803 - RNA, 14 nt, Staphylococcus aureus subsp. aureus Mu50
cguccaaaaugaac

SEQ ID NO: 3992804 - RNA, 17 nt, Staphylococcus aureus subsp. aureus Mu50
cgucgaauauaauuuuu

SEQ ID NO: 3992805 - RNA, 18 nt, Staphylococcus aureus subsp. aureus Mu50
cgucguaaugaagauuuu

SEQ ID NO: 3992806 - RNA, 23 nt, Staphylococcus aureus subsp. aureus Mu50
cgucguaaugaagauuuuguuga

SEQ ID NO: 3992807 - RNA, 20 nt, Staphylococcus aureus subsp. aureus Mu50
cgucuauacuccaguuuaua

SEQ ID NO: 3992808 - RNA, 13 nt, Staphylococcus aureus subsp. aureus Mu50
cgucuguuucaua

SEQ ID NO: 3992809 - RNA, 13 nt, Staphylococcus aureus subsp. aureus Mu50
cgucuucucuauc

SEQ ID NO: 3992810 - RNA, 12 nt, Staphylococcus aureus subsp. aureus Mu50
cgucuuguaaac

SEQ ID NO: 3992811 - RNA, 16 nt, Staphylococcus aureus subsp. aureus Mu50
cgucuuguaaacuucu

SEQ ID NO: 3992812 - RNA, 17 nt, Staphylococcus aureus subsp. aureus Mu50
cgucuuguaaacuucuu

SEQ ID NO: 3992813 - RNA, 22 nt, Staphylococcus aureus subsp. aureus Mu50
cgugaauucgaugacuuuuuaa

SEQ ID NO: 3992814 - RNA, 13 nt, Staphylococcus aureus subsp. aureus Mu50
cgugauuuuucau

SEQ ID NO: 3992815 - RNA, 16 nt, Staphylococcus aureus subsp. aureus Mu50
cgugcauuuagaugau

SEQ ID NO: 3992816 - RNA, 17 nt, Staphylococcus aureus subsp. aureus Mu50
cgugccuuaacuucaua

SEQ ID NO: 3992817 - RNA, 17 nt, Staphylococcus aureus subsp. aureus Mu50
cguggauguguuuuaau

SEQ ID NO: 3992818 - RNA, 17 nt, Staphylococcus aureus subsp. aureus Mu50
cgugguaugauuuuuga

SEQ ID NO: 3992819 - RNA, 21 nt, Staphylococcus aureus subsp. aureus Mu50
cgugguucaaaaaucauacca

SEQ ID NO: 3992820 - RNA, 13 nt, Staphylococcus aureus subsp. aureus Mu50
cgugguucccaau

SEQ ID NO: 3992821 - RNA, 15 nt, Staphylococcus aureus subsp. aureus Mu50
cguguaaaaugcaau

SEQ ID NO: 3992822 - RNA, 15 nt, Staphylococcus aureus subsp. aureus Mu50
cgugucaaaugccgc

SEQ ID NO: 3992823 - RNA, 19 nt, Staphylococcus aureus subsp. aureus Mu50
cgugucaaaugccgcuucu

SEQ ID NO: 3992824 - RNA, 12 nt, Staphylococcus aureus subsp. aureus Mu50
cguguguaguag

SEQ ID NO: 3992825 - RNA, 13 nt, Staphylococcus aureus subsp. aureus Mu50
cguguucuaaaag

SEQ ID NO: 3992826 - RNA, 10 nt, Staphylococcus aureus subsp. aureus Mu50
cguuaauaau

SEQ ID NO: 3992827 - RNA, 17 nt, Staphylococcus aureus subsp. aureus Mu50
cguuaauaauuuguuuu

SEQ ID NO: 3992828 - RNA, 16 nt, Staphylococcus aureus subsp. aureus Mu50
cguuaauguauaaaaa

SEQ ID NO: 3992829 - RNA, 20 nt, Staphylococcus aureus subsp. aureus Mu50
cguuacuaccuauuaauauc

SEQ ID NO: 3992830 - RNA, 22 nt, Staphylococcus aureus subsp. aureus Mu50
cguuaguacggcugcuuuaacu

SEQ ID NO: 3992831 - RNA, 20 nt, Staphylococcus aureus subsp. aureus Mu50
cguuagugauaccuuuaauu

SEQ ID NO: 3992832 - RNA, 19 nt, Staphylococcus aureus subsp. aureus Mu50
cguuauaaguacaaauaau

SEQ ID NO: 3992833 - RNA, 21 nt, Staphylococcus aureus subsp. aureus Mu50
cguuauaaguacaaauaauac

SEQ ID NO: 3992834 - RNA, 15 nt, Staphylococcus aureus subsp. aureus Mu50
cguuauagcucauua

SEQ ID NO: 3992835 - RNA, 13 nt, Staphylococcus aureus subsp. aureus Mu50
cguuauucauuug

SEQ ID NO: 3992836 - RNA, 12 nt, Staphylococcus aureus subsp. aureus Mu50
cguuauuuuuug

SEQ ID NO: 3992837 - RNA, 18 nt, Staphylococcus aureus subsp. aureus Mu50
cguucaagaacaaucaau

SEQ ID NO: 3992838 - RNA, 19 nt, Staphylococcus aureus subsp. aureus Mu50
cguucaagaacaaucaaua

SEQ ID NO: 3992839 - RNA, 12 nt, Staphylococcus aureus subsp. aureus Mu50
cguucaauuuuu

SEQ ID NO: 3992840 - RNA, 13 nt, Staphylococcus aureus subsp. aureus Mu50
cguucauauauuu

SEQ ID NO: 3992841 - RNA, 14 nt, Staphylococcus aureus subsp. aureus Mu50
cguucauauauuuu

SEQ ID NO: 3992842 - RNA, 14 nt, Staphylococcus aureus subsp. aureus Mu50
cguucuguuuugcg

SEQ ID NO: 3992843 - RNA, 21 nt, Staphylococcus aureus subsp. aureus Mu50
cguucuugguauuuuuuaaau

SEQ ID NO: 3992844 - RNA, 16 nt, Staphylococcus aureus subsp. aureus Mu50
cguucuuguauuuccu

SEQ ID NO: 3992845 - RNA, 21 nt, Staphylococcus aureus subsp. aureus Mu50
cguugaauuaacaauauuaaa

SEQ ID NO: 3992846 - RNA, 16 nt, Staphylococcus aureus subsp. aureus Mu50
cguugaccuuguucuu

SEQ ID NO: 3992847 - RNA, 11 nt, Staphylococcus aureus subsp. aureus Mu50
cuaaauugucg

SEQ ID NO: 3992848 - RNA, 13 nt, Staphylococcus aureus subsp. aureus Mu50
cuaaauuuauaua

SEQ ID NO: 3992849 - RNA, 21 nt, Staphylococcus aureus subsp. aureus Mu50
cuaaauuuauauagucuauga

SEQ ID NO: 3992850 - RNA, 18 nt, Staphylococcus aureus subsp. aureus Mu50
cuaaauuuucuaaaugug

SEQ ID NO: 3992851 - RNA, 21 nt, Staphylococcus aureus subsp. aureus Mu50
cuaacaauuugaggauacaua

SEQ ID NO: 3992852 - RNA, 18 nt, Staphylococcus aureus subsp. aureus Mu50
cuaacagcauuuccuaug

SEQ ID NO: 3992853 - RNA, 15 nt, Staphylococcus aureus subsp. aureus Mu50
cuaacaguuaauaug

SEQ ID NO: 3992854 - RNA, 18 nt, Staphylococcus aureus subsp. aureus Mu50
cuaacauaauuuuuauuu

SEQ ID NO: 3992855 - RNA, 16 nt, Staphylococcus aureus subsp. aureus Mu50
cuaaccacuucuucac

SEQ ID NO: 3992856 - RNA, 18 nt, Staphylococcus aureus subsp. aureus Mu50
cuaaccaucauaaauguu

SEQ ID NO: 3992857 - RNA, 20 nt, Staphylococcus aureus subsp. aureus Mu50
cuaaccauucguaauaaaca

SEQ ID NO: 3992858 - RNA, 14 nt, Staphylococcus aureus subsp. aureus Mu50
cuaaccuauuaaaa

SEQ ID NO: 3992859 - RNA, 22 nt, Staphylococcus aureus subsp. aureus Mu50
cuaaccuguuugagauauauua

SEQ ID NO: 3992860 - RNA, 19 nt, Staphylococcus aureus subsp. aureus Mu50
cuaacgauuucuaguuuau

SEQ ID NO: 3992861 - RNA, 13 nt, Staphylococcus aureus subsp. aureus Mu50
cuaacguuuuaaa

SEQ ID NO: 3992862 - RNA, 14 nt, Staphylococcus aureus subsp. aureus Mu50
cuaacucaccugca

SEQ ID NO: 3992863 - RNA, 18 nt, Staphylococcus aureus subsp. aureus Mu50
cuaacuuuaccaauauca

SEQ ID NO: 3992864 - RNA, 22 nt, Staphylococcus aureus subsp. aureus Mu50
cuaacuuuaugggguguauuuu

SEQ ID NO: 3992865 - RNA, 12 nt, Staphylococcus aureus subsp. aureus Mu50
cuaagaaccuuu

SEQ ID NO: 3992866 - RNA, 17 nt, Staphylococcus aureus subsp. aureus Mu50
cuaagaguugaaauacu

SEQ ID NO: 3992867 - RNA, 20 nt, Staphylococcus aureus subsp. aureus Mu50
cuaagcucguuaauuuuauu

SEQ ID NO: 3992868 - RNA, 18 nt, Staphylococcus aureus subsp. aureus Mu50
cuaagcugauuaaaaugu

SEQ ID NO: 3992869 - RNA, 16 nt, Staphylococcus aureus subsp. aureus Mu50
cuaagcuuucauuaau

SEQ ID NO: 3992870 - RNA, 15 nt, Staphylococcus aureus subsp. aureus Mu50
cuaaggacuuuaugc

SEQ ID NO: 3992871 - RNA, 18 nt, Staphylococcus aureus subsp. aureus Mu50
cuaaggacuuuaugcccu

SEQ ID NO: 3992872 - RNA, 17 nt, Staphylococcus aureus subsp. aureus Mu50
cuaaguaaccaagucua

SEQ ID NO: 3992873 - RNA, 15 nt, Staphylococcus aureus subsp. aureus Mu50
cuaaguaauauaauu

SEQ ID NO: 3992874 - RNA, 18 nt, Staphylococcus aureus subsp. aureus Mu50
cuaagucguucaauuguu

SEQ ID NO: 3992875 - RNA, 20 nt, Staphylococcus aureus subsp. aureus Mu50
cuaagugauauacgacaauc

SEQ ID NO: 3992876 - RNA, 14 nt, Staphylococcus aureus subsp. aureus Mu50
cuaaguuaaaaccu

SEQ ID NO: 3992877 - RNA, 16 nt, Staphylococcus aureus subsp. aureus Mu50
cuaaguuaauuuaucg

SEQ ID NO: 3992878 - RNA, 13 nt, Staphylococcus aureus subsp. aureus Mu50
cuaaguuugaauc

SEQ ID NO: 3992879 - RNA, 22 nt, Staphylococcus aureus subsp. aureus Mu50
cuaauaaaaccgguacuuucau

SEQ ID NO: 3992880 - RNA, 14 nt, Staphylococcus aureus subsp. aureus Mu50
cuaauaaauaucuu

SEQ ID NO: 3992881 - RNA, 14 nt, Staphylococcus aureus subsp. aureus Mu50
cuaauaacaaauag

SEQ ID NO: 3992882 - RNA, 14 nt, Staphylococcus aureus subsp. aureus Mu50
cuaauaauaaaaua

SEQ ID NO: 3992883 - RNA, 17 nt, Staphylococcus aureus subsp. aureus Mu50
cuaauacacuugauaaa

SEQ ID NO: 3992884 - RNA, 22 nt, Staphylococcus aureus subsp. aureus Mu50
cuaauacacuugauaaaacuaa

SEQ ID NO: 3992885 - RNA, 23 nt, Staphylococcus aureus subsp. aureus Mu50
cuaauacuucaccacauaaaaau

SEQ ID NO: 3992886 - RNA, 19 nt, Staphylococcus aureus subsp. aureus Mu50
cuaauacuuucaaacaaau

SEQ ID NO: 3992887 - RNA, 18 nt, Staphylococcus aureus subsp. aureus Mu50
cuaauacuuucacuuuuu

SEQ ID NO: 3992888 - RNA, 14 nt, Staphylococcus aureus subsp. aureus Mu50
cuaauagcauuugu

SEQ ID NO: 3992889 - RNA, 15 nt, Staphylococcus aureus subsp. aureus Mu50
cuaauagcauuugua

SEQ ID NO: 3992890 - RNA, 20 nt, Staphylococcus aureus subsp. aureus Mu50
cuaauagcauuuguaaacag

SEQ ID NO: 3992891 - RNA, 15 nt, Staphylococcus aureus subsp. aureus Mu50
cuaauaggaucaccu

SEQ ID NO: 3992892 - RNA, 17 nt, Staphylococcus aureus subsp. aureus Mu50
cuaauagguuauguuau

SEQ ID NO: 3992893 - RNA, 15 nt, Staphylococcus aureus subsp. aureus Mu50
cuaauauauuaauuu

SEQ ID NO: 3992894 - RNA, 14 nt, Staphylococcus aureus subsp. aureus Mu50
cuaauaucaauaau

SEQ ID NO: 3992895 - RNA, 22 nt, Staphylococcus aureus subsp. aureus Mu50
cuaauaucaucuuguuguucug

SEQ ID NO: 3992896 - RNA, 18 nt, Staphylococcus aureus subsp. aureus Mu50
cuaauauuagauaucuua

SEQ ID NO: 3992897 - RNA, 15 nt, Staphylococcus aureus subsp. aureus Mu50
cuaaucguuaauaaa

SEQ ID NO: 3992898 - RNA, 13 nt, Staphylococcus aureus subsp. aureus Mu50
cuaaucuaaauuc

SEQ ID NO: 3992899 - RNA, 11 nt, Staphylococcus aureus subsp. aureus Mu50
cuaaucuauuu

SEQ ID NO: 3992900 - RNA, 14 nt, Staphylococcus aureus subsp. aureus Mu50
cuaaucucagauuu

SEQ ID NO: 3992901 - RNA, 15 nt, Staphylococcus aureus subsp. aureus Mu50
cuaaucuuaauuguc

SEQ ID NO: 3992902 - RNA, 15 nt, Staphylococcus aureus subsp. aureus Mu50
cuaaucuuuuuuuaa

SEQ ID NO: 3992903 - RNA, 22 nt, Staphylococcus aureus subsp. aureus Mu50
cuaaucuuuuuuuaauuaaguu

SEQ ID NO: 3992904 - RNA, 19 nt, Staphylococcus aureus subsp. aureus Mu50
cuaaugauaguacauuuau

SEQ ID NO: 3992905 - RNA, 22 nt, Staphylococcus aureus subsp. aureus Mu50
cuaaugaucaucuauauuuaau

SEQ ID NO: 3992906 - RNA, 18 nt, Staphylococcus aureus subsp. aureus Mu50
cuaaugauuaaaaaucaa

SEQ ID NO: 3992907 - RNA, 13 nt, Staphylococcus aureus subsp. aureus Mu50
cuaaugauuuauu

SEQ ID NO: 3992908 - RNA, 19 nt, Staphylococcus aureus subsp. aureus Mu50
cuaaugcacgugagaaacu

SEQ ID NO: 3992909 - RNA, 19 nt, Staphylococcus aureus subsp. aureus Mu50
cuaaugcauuauuauaaua

SEQ ID NO: 3992910 - RNA, 17 nt, Staphylococcus aureus subsp. aureus Mu50
cuaaugcuaauuuaacu

SEQ ID NO: 3992911 - RNA, 18 nt, Staphylococcus aureus subsp. aureus Mu50
cuaaugcuaauuuaacug

SEQ ID NO: 3992912 - RNA, 12 nt, Staphylococcus aureus subsp. aureus Mu50
cuaaugcuauau

SEQ ID NO: 3992913 - RNA, 16 nt, Staphylococcus aureus subsp. aureus Mu50
cuaaugcuuuaauaaa

SEQ ID NO: 3992914 - RNA, 19 nt, Staphylococcus aureus subsp. aureus Mu50
cuaaugcuuuaauaaaucg

SEQ ID NO: 3992915 - RNA, 21 nt, Staphylococcus aureus subsp. aureus Mu50
cuaauggaugaauauauugag

SEQ ID NO: 3992916 - RNA, 18 nt, Staphylococcus aureus subsp. aureus Mu50
cuaaugucgcacuauaaa

SEQ ID NO: 3992917 - RNA, 16 nt, Staphylococcus aureus subsp. aureus Mu50
cuaauguguacuuaaa

SEQ ID NO: 3992918 - RNA, 19 nt, Staphylococcus aureus subsp. aureus Mu50
cuaauguguggauuuaauu

SEQ ID NO: 3992919 - RNA, 15 nt, Staphylococcus aureus subsp. aureus Mu50
cuaauguuaaucaaa

SEQ ID NO: 3992920 - RNA, 22 nt, Staphylococcus aureus subsp. aureus Mu50
cuaauuagguauaguguuugac

SEQ ID NO: 3992921 - RNA, 12 nt, Staphylococcus aureus subsp. aureus Mu50
cuaauuauauua

SEQ ID NO: 3992922 - RNA, 14 nt, Staphylococcus aureus subsp. aureus Mu50
cuaauucgccaucu

SEQ ID NO: 3992923 - RNA, 19 nt, Staphylococcus aureus subsp. aureus Mu50
cuaauucgccaucuuuuuu

SEQ ID NO: 3992924 - RNA, 14 nt, Staphylococcus aureus subsp. aureus Mu50
cuaauucugaaauc

SEQ ID NO: 3992925 - RNA, 13 nt, Staphylococcus aureus subsp. aureus Mu50
cuaauucuguuuc

SEQ ID NO: 3992926 - RNA, 21 nt, Staphylococcus aureus subsp. aureus Mu50
cuaauugaaggccauuuuuau

SEQ ID NO: 3992927 - RNA, 20 nt, Staphylococcus aureus subsp. aureus Mu50
cuaauugaucagcauuuaag

SEQ ID NO: 3992928 - RNA, 16 nt, Staphylococcus aureus subsp. aureus Mu50
cuaauugcuuaauauc

SEQ ID NO: 3992929 - RNA, 21 nt, Staphylococcus aureus subsp. aureus Mu50
cuaauuuaaaugauuucacuu

SEQ ID NO: 3992930 - RNA, 17 nt, Staphylococcus aureus subsp. aureus Mu50
cuaauuuacguacuuca

SEQ ID NO: 3992931 - RNA, 14 nt, Staphylococcus aureus subsp. aureus Mu50
cuaauuuauuaauu

SEQ ID NO: 3992932 - RNA, 12 nt, Staphylococcus aureus subsp. aureus Mu50
cuaauuucacaa

SEQ ID NO: 3992933 - RNA, 22 nt, Staphylococcus aureus subsp. aureus Mu50
cuaauuucuaauacauacugau

SEQ ID NO: 3992934 - RNA, 23 nt, Staphylococcus aureus subsp. aureus Mu50
cuaauuucuaauacauacugauu

SEQ ID NO: 3992935 - RNA, 17 nt, Staphylococcus aureus subsp. aureus Mu50
cuagguuagaauuauuu

SEQ ID NO: 3992936 - RNA, 17 nt, Staphylococcus aureus subsp. aureus Mu50
cuaguaaugccauuaau

SEQ ID NO: 3992937 - RNA, 17 nt, Staphylococcus aureus subsp. aureus Mu50
cuagucaggggccccaa

SEQ ID NO: 3992938 - RNA, 18 nt, Staphylococcus aureus subsp. aureus Mu50
cuagucaggggccccaac

SEQ ID NO: 3992939 - RNA, 23 nt, Staphylococcus aureus subsp. aureus Mu50
cuagucaggggccccaacacaga

SEQ ID NO: 3992940 - RNA, 12 nt, Staphylococcus aureus subsp. aureus Mu50
cuagucuuuaac

SEQ ID NO: 3992941 - RNA, 18 nt, Staphylococcus aureus subsp. aureus Mu50
cuaguguucucauuauaa

SEQ ID NO: 3992942 - RNA, 14 nt, Staphylococcus aureus subsp. aureus Mu50
cuaguucagcuucu

SEQ ID NO: 3992943 - RNA, 15 nt, Staphylococcus aureus subsp. aureus Mu50
cuaguucagcuucua

SEQ ID NO: 3992944 - RNA, 18 nt, Staphylococcus aureus subsp. aureus Mu50
cuaguucagcuucuaagu

SEQ ID NO: 3992945 - RNA, 21 nt, Staphylococcus aureus subsp. aureus Mu50
cuaguucgauucaugaauaau

SEQ ID NO: 3992946 - RNA, 16 nt, Staphylococcus aureus subsp. aureus Mu50
cuaguucgauuuuuua

SEQ ID NO: 3992947 - RNA, 12 nt, Staphylococcus aureus subsp. aureus Mu50
cuaguuguuuua

SEQ ID NO: 3992948 - RNA, 15 nt, Staphylococcus aureus subsp. aureus Mu50
cuaguuguuuuauag

SEQ ID NO: 3992949 - RNA, 15 nt, Staphylococcus aureus subsp. aureus Mu50
cuaguuuguaauaau

SEQ ID NO: 3992950 - RNA, 19 nt, Staphylococcus aureus subsp. aureus Mu50
cuauaaaaguacuuuaaaa

SEQ ID NO: 3992951 - RNA, 23 nt, Staphylococcus aureus subsp. aureus Mu50
cuauaaaaguacuuuaaaauugu

SEQ ID NO: 3992952 - RNA, 23 nt, Staphylococcus aureus subsp. aureus Mu50
cuauaaaaucaucguauuucaua

SEQ ID NO: 3992953 - RNA, 14 nt, Staphylococcus aureus subsp. aureus Mu50
cuauaaaauucacc

SEQ ID NO: 3992954 - RNA, 16 nt, Staphylococcus aureus subsp. aureus Mu50
cuauaaaauucaccaa

SEQ ID NO: 3992955 - RNA, 15 nt, Staphylococcus aureus subsp. aureus Mu50
cuauaaaauuuugaa

SEQ ID NO: 3992956 - RNA, 22 nt, Staphylococcus aureus subsp. aureus Mu50
cuauaaacgucacuuuauuaaa

SEQ ID NO: 3992957 - RNA, 13 nt, Staphylococcus aureus subsp. aureus Mu50
cuauaaauacaaa

SEQ ID NO: 3992958 - RNA, 21 nt, Staphylococcus aureus subsp. aureus Mu50
cuauaaauacgucaucuuuau

SEQ ID NO: 3992959 - RNA, 23 nt, Staphylococcus aureus subsp. aureus Mu50
cuauaaauacgucaucuuuauuu

SEQ ID NO: 3992960 - RNA, 15 nt, Staphylococcus aureus subsp. aureus Mu50
cuauaaauaucaaua

SEQ ID NO: 3992961 - RNA, 17 nt, Staphylococcus aureus subsp. aureus Mu50
cuauaaauaucaauaau

SEQ ID NO: 3992962 - RNA, 16 nt, Staphylococcus aureus subsp. aureus Mu50
cuauaacaccaauuaa

SEQ ID NO: 3992963 - RNA, 19 nt, Staphylococcus aureus subsp. aureus Mu50
cuauaacucuaaauauaau

SEQ ID NO: 3992964 - RNA, 18 nt, Staphylococcus aureus subsp. aureus Mu50
cuauaauaccuaauugcu

SEQ ID NO: 3992965 - RNA, 23 nt, Staphylococcus aureus subsp. aureus Mu50
cuauaauaccuaauugcuuaaua

SEQ ID NO: 3992966 - RNA, 20 nt, Staphylococcus aureus subsp. aureus Mu50
cuauaaucauuaaguaaucu

SEQ ID NO: 3992967 - RNA, 14 nt, Staphylococcus aureus subsp. aureus Mu50
cuauaaucuaucuu

SEQ ID NO: 3992968 - RNA, 16 nt, Staphylococcus aureus subsp. aureus Mu50
cuauaaucuaucuugu

SEQ ID NO: 3992969 - RNA, 20 nt, Staphylococcus aureus subsp. aureus Mu50
cuauaauuggcagauagaau

SEQ ID NO: 3992970 - RNA, 16 nt, Staphylococcus aureus subsp. aureus Mu50
cuauaauuuuaauuau

SEQ ID NO: 3992971 - RNA, 21 nt, Staphylococcus aureus subsp. aureus Mu50
cuauaauuuuaauuauuuucu

SEQ ID NO: 3992972 - RNA, 16 nt, Staphylococcus aureus subsp. aureus Mu50
cuauacaacaguaauc

SEQ ID NO: 3992973 - RNA, 18 nt, Staphylococcus aureus subsp. aureus Mu50
cuauacaacaguaaucau

SEQ ID NO: 3992974 - RNA, 19 nt, Staphylococcus aureus subsp. aureus Mu50
cuauacaaucauaaagugc

SEQ ID NO: 3992975 - RNA, 17 nt, Staphylococcus aureus subsp. aureus Mu50
cuauacauugauaaauu

SEQ ID NO: 3992976 - RNA, 17 nt, Staphylococcus aureus subsp. aureus Mu50
cuauaccauuccaaaaa

SEQ ID NO: 3992977 - RNA, 21 nt, Staphylococcus aureus subsp. aureus Mu50
cuauaccauuccaaaaauugu

SEQ ID NO: 3992978 - RNA, 13 nt, Staphylococcus aureus subsp. aureus Mu50
cuauaccauuuuu

SEQ ID NO: 3992979 - RNA, 11 nt, Staphylococcus aureus subsp. aureus Mu50
cuauagaaaaa

SEQ ID NO: 3992980 - RNA, 14 nt, Staphylococcus aureus subsp. aureus Mu50
cuauagaaaaagua

SEQ ID NO: 3992981 - RNA, 16 nt, Staphylococcus aureus subsp. aureus Mu50
cuauagaauuuuucau

SEQ ID NO: 3992982 - RNA, 19 nt, Staphylococcus aureus subsp. aureus Mu50
cuauagauaggauauuuuu

SEQ ID NO: 3992983 - RNA, 19 nt, Staphylococcus aureus subsp. aureus Mu50
cuauagcaccauuauuaaa

SEQ ID NO: 3992984 - RNA, 17 nt, Staphylococcus aureus subsp. aureus Mu50
cuauagguuuauaaaaa

SEQ ID NO: 3992985 - RNA, 19 nt, Staphylococcus aureus subsp. aureus Mu50
cuauagguuuauaaaaaau

SEQ ID NO: 3992986 - RNA, 13 nt, Staphylococcus aureus subsp. aureus Mu50
cuauauaaaaacu

SEQ ID NO: 3992987 - RNA, 21 nt, Staphylococcus aureus subsp. aureus Mu50
cuauauaaaguugacaauaca

SEQ ID NO: 3992988 - RNA, 22 nt, Staphylococcus aureus subsp. aureus Mu50
cuauauaaaguugacaauacaa

SEQ ID NO: 3992989 - RNA, 12 nt, Staphylococcus aureus subsp. aureus Mu50
cuauauaaaugu

SEQ ID NO: 3992990 - RNA, 18 nt, Staphylococcus aureus subsp. aureus Mu50
cuauauaauuuauaaaaa

SEQ ID NO: 3992991 - RNA, 14 nt, Staphylococcus aureus subsp. aureus Mu50
cuauauaauuuauu

SEQ ID NO: 3992992 - RNA, 18 nt, Staphylococcus aureus subsp. aureus Mu50
cuauauaguaaaauaaau

SEQ ID NO: 3992993 - RNA, 22 nt, Staphylococcus aureus subsp. aureus Mu50
cuauauaguaaaauaaauacaa

SEQ ID NO: 3992994 - RNA, 18 nt, Staphylococcus aureus subsp. aureus Mu50
cuauauauauaugcaucc

SEQ ID NO: 3992995 - RNA, 21 nt, Staphylococcus aureus subsp. aureus Mu50
cuauaucaaauuggacugaug

SEQ ID NO: 3992996 - RNA, 13 nt, Staphylococcus aureus subsp. aureus Mu50
cuauaugaaaaga

SEQ ID NO: 3992997 - RNA, 14 nt, Staphylococcus aureus subsp. aureus Mu50
cuauauuuaauuuu

SEQ ID NO: 3992998 - RNA, 16 nt, Staphylococcus aureus subsp. aureus Mu50
cuauauuuagaaugau

SEQ ID NO: 3992999 - RNA, 17 nt, Staphylococcus aureus subsp. aureus Mu50
cuauauuuagaaugaug

SEQ ID NO: 3993000 - RNA, 16 nt, Staphylococcus aureus subsp. aureus Mu50
cuauauuuaguuaauu

SEQ ID NO: 3993001 - RNA, 20 nt, Staphylococcus aureus subsp. aureus Mu50
cuauauuuaguuaauuauuu

SEQ ID NO: 3993002 - RNA, 13 nt, Staphylococcus aureus subsp. aureus Mu50
cuauauuuauuag

SEQ ID NO: 3993003 - RNA, 22 nt, Staphylococcus aureus subsp. aureus Mu50
cuauauuucgguauuuuaaauu

SEQ ID NO: 3993004 - RNA, 13 nt, Staphylococcus aureus subsp. aureus Mu50
cuaucaauauaau

SEQ ID NO: 3993005 - RNA, 16 nt, Staphylococcus aureus subsp. aureus Mu50
cuauccgauuuaaguu

SEQ ID NO: 3993006 - RNA, 15 nt, Staphylococcus aureus subsp. aureus Mu50
cuaucguaaacaaca

SEQ ID NO: 3993007 - RNA, 14 nt, Staphylococcus aureus subsp. aureus Mu50
cuaucuauaaacgu

SEQ ID NO: 3993008 - RNA, 16 nt, Staphylococcus aureus subsp. aureus Mu50
cuaucuauaaacguca

SEQ ID NO: 3993009 - RNA, 21 nt, Staphylococcus aureus subsp. aureus Mu50
cuaucuauaaacgucacuuua

SEQ ID NO: 3993010 - RNA, 20 nt, Staphylococcus aureus subsp. aureus Mu50
cuaucucuuuaguuaaaagu

SEQ ID NO: 3993011 - RNA, 15 nt, Staphylococcus aureus subsp. aureus Mu50
cuaucugacauuuaa

SEQ ID NO: 3993012 - RNA, 23 nt, Staphylococcus aureus subsp. aureus Mu50
cuaugaaauuggaauagauguug

SEQ ID NO: 3993013 - RNA, 19 nt, Staphylococcus aureus subsp. aureus Mu50
cuaugaagaaaucuauaac

SEQ ID NO: 3993014 - RNA, 23 nt, Staphylococcus aureus subsp. aureus Mu50
cuaugaauuuagcaucaaaaaua

SEQ ID NO: 3993015 - RNA, 14 nt, Staphylococcus aureus subsp. aureus Mu50
cuaugaccaugaua

SEQ ID NO: 3993016 - RNA, 23 nt, Staphylococcus aureus subsp. aureus Mu50
cuaugaugcuucuaacugaauua

SEQ ID NO: 3993017 - RNA, 14 nt, Staphylococcus aureus subsp. aureus Mu50
cuaugccaaauaac

SEQ ID NO: 3993018 - RNA, 22 nt, Staphylococcus aureus subsp. aureus Mu50
cuaugcuuuuuuuacaauauga

SEQ ID NO: 3993019 - RNA, 20 nt, Staphylococcus aureus subsp. aureus Mu50
cuauggaaaauguuaucaau

SEQ ID NO: 3993020 - RNA, 19 nt, Staphylococcus aureus subsp. aureus Mu50
cuauggcgcaauuuuuaac

SEQ ID NO: 3993021 - RNA, 23 nt, Staphylococcus aureus subsp. aureus Mu50
cuauggcgcaauuuuuaacaaaa

SEQ ID NO: 3993022 - RNA, 13 nt, Staphylococcus aureus subsp. aureus Mu50
cucauuaauaaau

SEQ ID NO: 3993023 - RNA, 18 nt, Staphylococcus aureus subsp. aureus Mu50
cucauuagcgaaaacuaa

SEQ ID NO: 3993024 - RNA, 20 nt, Staphylococcus aureus subsp. aureus Mu50
cucauuagcgaaaacuaaag

SEQ ID NO: 3993025 - RNA, 14 nt, Staphylococcus aureus subsp. aureus Mu50
cucauuauaaugau

SEQ ID NO: 3993026 - RNA, 20 nt, Staphylococcus aureus subsp. aureus Mu50
cucauuauaaugauuuuuau

SEQ ID NO: 3993027 - RNA, 13 nt, Staphylococcus aureus subsp. aureus Mu50
cucauucuuuaau

SEQ ID NO: 3993028 - RNA, 16 nt, Staphylococcus aureus subsp. aureus Mu50
cucauugugcuugaua

SEQ ID NO: 3993029 - RNA, 17 nt, Staphylococcus aureus subsp. aureus Mu50
cucauuuagcucuacua

SEQ ID NO: 3993030 - RNA, 16 nt, Staphylococcus aureus subsp. aureus Mu50
cucauuugacauauca

SEQ ID NO: 3993031 - RNA, 21 nt, Staphylococcus aureus subsp. aureus Mu50
cucauuuguauagauuguauu

SEQ ID NO: 3993032 - RNA, 20 nt, Staphylococcus aureus subsp. aureus Mu50
cucauuuuuauaaauuuugg

SEQ ID NO: 3993033 - RNA, 14 nt, Staphylococcus aureus subsp. aureus Mu50
cucauuuuuuuaau

SEQ ID NO: 3993034 - RNA, 23 nt, Staphylococcus aureus subsp. aureus Mu50
cucauuuuuuuaauuauuucccu

SEQ ID NO: 3993035 - RNA, 12 nt, Staphylococcus aureus subsp. aureus Mu50
cuccaaauauug

SEQ ID NO: 3993036 - RNA, 17 nt, Staphylococcus aureus subsp. aureus Mu50
cuccaacucuaacagcu

SEQ ID NO: 3993037 - RNA, 20 nt, Staphylococcus aureus subsp. aureus Mu50
cuccaagauuaugacaacau

SEQ ID NO: 3993038 - RNA, 18 nt, Staphylococcus aureus subsp. aureus Mu50
cuccaauuaccaaugaau

SEQ ID NO: 3993039 - RNA, 16 nt, Staphylococcus aureus subsp. aureus Mu50
cuccaguggaaaugau

SEQ ID NO: 3993040 - RNA, 18 nt, Staphylococcus aureus subsp. aureus Mu50
cuccaguggaaaugauaa

SEQ ID NO: 3993041 - RNA, 23 nt, Staphylococcus aureus subsp. aureus Mu50
cuccaguggaaaugauaauuuaa

SEQ ID NO: 3993042 - RNA, 17 nt, Staphylococcus aureus subsp. aureus Mu50
cucccauaacaccuacu

SEQ ID NO: 3993043 - RNA, 19 nt, Staphylococcus aureus subsp. aureus Mu50
cucccauaacaccuacuga

SEQ ID NO: 3993044 - RNA, 14 nt, Staphylococcus aureus subsp. aureus Mu50
cuccgaucaugccu

SEQ ID NO: 3993045 - RNA, 15 nt, Staphylococcus aureus subsp. aureus Mu50
cuccgaucaugccuu

SEQ ID NO: 3993046 - RNA, 19 nt, Staphylococcus aureus subsp. aureus Mu50
cuccguauuuaccuucuuc

SEQ ID NO: 3993047 - RNA, 22 nt, Staphylococcus aureus subsp. aureus Mu50
cuccuaaagguaacuuuuuaac

SEQ ID NO: 3993048 - RNA, 20 nt, Staphylococcus aureus subsp. aureus Mu50
cuccuaccgcuaaaauucuu

SEQ ID NO: 3993049 - RNA, 13 nt, Staphylococcus aureus subsp. aureus Mu50
cuccucuauuuua

SEQ ID NO: 3993050 - RNA, 15 nt, Staphylococcus aureus subsp. aureus Mu50
cuccucuauuuuaug

SEQ ID NO: 3993051 - RNA, 23 nt, Staphylococcus aureus subsp. aureus Mu50
cuccucuauuuuaugauuugauu

SEQ ID NO: 3993052 - RNA, 20 nt, Staphylococcus aureus subsp. aureus Mu50
cuccucuuuuauuuaugagu

SEQ ID NO: 3993053 - RNA, 12 nt, Staphylococcus aureus subsp. aureus Mu50
cuccuuacaaua

SEQ ID NO: 3993054 - RNA, 15 nt, Staphylococcus aureus subsp. aureus Mu50
cuccuuacaauaaag

SEQ ID NO: 3993055 - RNA, 18 nt, Staphylococcus aureus subsp. aureus Mu50
cucgaaaauaaaacaaau

SEQ ID NO: 3993056 - RNA, 23 nt, Staphylococcus aureus subsp. aureus Mu50
cucgaaaauaaaacaaauuauua

SEQ ID NO: 3993057 - RNA, 15 nt, Staphylococcus aureus subsp. aureus Mu50
cucgaagucagcgau

SEQ ID NO: 3993058 - RNA, 15 nt, Staphylococcus aureus subsp. aureus Mu50
cucgauauaugucuc

SEQ ID NO: 3993059 - RNA, 17 nt, Staphylococcus aureus subsp. aureus Mu50
cucgcauacugucaucu

SEQ ID NO: 3993060 - RNA, 14 nt, Staphylococcus aureus subsp. aureus Mu50
cucgcuaaauuuau

SEQ ID NO: 3993061 - RNA, 23 nt, Staphylococcus aureus subsp. aureus Mu50
cucgguuuuuucgguuuauuuaa

SEQ ID NO: 3993062 - RNA, 13 nt, Staphylococcus aureus subsp. aureus Mu50
cucguaaauuguu

SEQ ID NO: 3993063 - RNA, 12 nt, Staphylococcus aureus subsp. aureus Mu50
cucguaauaaug

SEQ ID NO: 3993064 - RNA, 13 nt, Staphylococcus aureus subsp. aureus Mu50
cucguuaauuuua

SEQ ID NO: 3993065 - RNA, 21 nt, Staphylococcus aureus subsp. aureus Mu50
cucguuuuuucauuguaauaa

SEQ ID NO: 3993066 - RNA, 19 nt, Staphylococcus aureus subsp. aureus Mu50
cucuaaaacauguugauaa

SEQ ID NO: 3993067 - RNA, 15 nt, Staphylococcus aureus subsp. aureus Mu50
cucuaaaacuuuuuc

SEQ ID NO: 3993068 - RNA, 17 nt, Staphylococcus aureus subsp. aureus Mu50
cucuaaaagccaucuua

SEQ ID NO: 3993069 - RNA, 16 nt, Staphylococcus aureus subsp. aureus Mu50
cucuaaauauaauaga

SEQ ID NO: 3993070 - RNA, 17 nt, Staphylococcus aureus subsp. aureus Mu50
cucuaacgauuucuagu

SEQ ID NO: 3993071 - RNA, 18 nt, Staphylococcus aureus subsp. aureus Mu50
cucuaacguuaacaauau

SEQ ID NO: 3993072 - RNA, 18 nt, Staphylococcus aureus subsp. aureus Mu50
cucuaacuuuaccaauau

SEQ ID NO: 3993073 - RNA, 23 nt, Staphylococcus aureus subsp. aureus Mu50
cucuaacuuuaccaauaucaugc

SEQ ID NO: 3993074 - RNA, 19 nt, Staphylococcus aureus subsp. aureus Mu50
cucuaagcauucaguuaau

SEQ ID NO: 3993075 - RNA, 13 nt, Staphylococcus aureus subsp. aureus Mu50
cucuaauuucaca

SEQ ID NO: 3993076 - RNA, 15 nt, Staphylococcus aureus subsp. aureus Mu50
cucuagugcuuuguc

SEQ ID NO: 3993077 - RNA, 17 nt, Staphylococcus aureus subsp. aureus Mu50
cucuauagcaacagcaa

SEQ ID NO: 3993078 - RNA, 19 nt, Staphylococcus aureus subsp. aureus Mu50
cucuaucaaauuaccauuc

SEQ ID NO: 3993079 - RNA, 17 nt, Staphylococcus aureus subsp. aureus Mu50
cucuaucaguccgcuuu

SEQ ID NO: 3993080 - RNA, 15 nt, Staphylococcus aureus subsp. aureus Mu50
cucuauuuuaugauu

SEQ ID NO: 3993081 - RNA, 20 nt, Staphylococcus aureus subsp. aureus Mu50
cucuauuuuaugauuugauu

SEQ ID NO: 3993082 - RNA, 21 nt, Staphylococcus aureus subsp. aureus Mu50
cucucaaugcauuuaauuuaa

SEQ ID NO: 3993083 - RNA, 14 nt, Staphylococcus aureus subsp. aureus Mu50
cucucuuauuaaaa

SEQ ID NO: 3993084 - RNA, 15 nt, Staphylococcus aureus subsp. aureus Mu50
cucugaaaaacuucu

SEQ ID NO: 3993085 - RNA, 19 nt, Staphylococcus aureus subsp. aureus Mu50
cucugaaaagccuacuuug

SEQ ID NO: 3993086 - RNA, 12 nt, Staphylococcus aureus subsp. aureus Mu50
cucugauaaaug

SEQ ID NO: 3993087 - RNA, 17 nt, Staphylococcus aureus subsp. aureus Mu50
cucugauauugaucuga

SEQ ID NO: 3993088 - RNA, 22 nt, Staphylococcus aureus subsp. aureus Mu50
cucugcgauuucuaaagcgauu

SEQ ID NO: 3993089 - RNA, 21 nt, Staphylococcus aureus subsp. aureus Mu50
cucuggauuuuucuuauaaaa

SEQ ID NO: 3993090 - RNA, 14 nt, Staphylococcus aureus subsp. aureus Mu50
cucuguuuaacagg

SEQ ID NO: 3993091 - RNA, 14 nt, Staphylococcus aureus subsp. aureus Mu50
cucuuaaauaugaa

SEQ ID NO: 3993092 - RNA, 23 nt, Staphylococcus aureus subsp. aureus Mu50
cucuuaaaucacuagcuaaugca

SEQ ID NO: 3993093 - RNA, 13 nt, Staphylococcus aureus subsp. aureus Mu50
cucuuaguuuuaa

SEQ ID NO: 3993094 - RNA, 22 nt, Staphylococcus aureus subsp. aureus Mu50
cucuuauaaagacaccuucaau

SEQ ID NO: 3993095 - RNA, 12 nt, Staphylococcus aureus subsp. aureus Mu50
cucuuauuaaaa

SEQ ID NO: 3993096 - RNA, 14 nt, Staphylococcus aureus subsp. aureus Mu50
cucuuauuaaaaaa

SEQ ID NO: 3993097 - RNA, 16 nt, Staphylococcus aureus subsp. aureus Mu50
cucuucaaucuaccaa

SEQ ID NO: 3993098 - RNA, 22 nt, Staphylococcus aureus subsp. aureus Mu50
cucuucaaucuaccaauacguu

SEQ ID NO: 3993099 - RNA, 23 nt, Staphylococcus aureus subsp. aureus Mu50
cucuucaguacgaacaacuaaca

SEQ ID NO: 3993100 - RNA, 19 nt, Staphylococcus aureus subsp. aureus Mu50
cucuuccuccgccaucaau

SEQ ID NO: 3993101 - RNA, 15 nt, Staphylococcus aureus subsp. aureus Mu50
cucuugauaaaauaa

SEQ ID NO: 3993102 - RNA, 16 nt, Staphylococcus aureus subsp. aureus Mu50
cucuugauaaaauaaa

SEQ ID NO: 3993103 - RNA, 18 nt, Staphylococcus aureus subsp. aureus Mu50
cucuugggaauugaccac

SEQ ID NO: 3993104 - RNA, 13 nt, Staphylococcus aureus subsp. aureus Mu50
cucuuguguuuca

SEQ ID NO: 3993105 - RNA, 22 nt, Staphylococcus aureus subsp. aureus Mu50
cucuuuaaacucguaaauuuua

SEQ ID NO: 3993106 - RNA, 20 nt, Staphylococcus aureus subsp. aureus Mu50
cucuuuaaagcuaaauguua

SEQ ID NO: 3993107 - RNA, 17 nt, Staphylococcus aureus subsp. aureus Mu50
cucuuuacaccauugca

SEQ ID NO: 3993108 - RNA, 14 nt, Staphylococcus aureus subsp. aureus Mu50
cucuuuaguuaauu

SEQ ID NO: 3993109 - RNA, 21 nt, Staphylococcus aureus subsp. aureus Mu50
cucuuuguuggggcccacacc

SEQ ID NO: 3993110 - RNA, 18 nt, Staphylococcus aureus subsp. aureus Mu50
cuuaaaauuuaaauauug

SEQ ID NO: 3993111 - RNA, 21 nt, Staphylococcus aureus subsp. aureus Mu50
cuuaaaauuucccuuuauacu

SEQ ID NO: 3993112 - RNA, 13 nt, Staphylococcus aureus subsp. aureus Mu50
cuuaaacaaauaa

SEQ ID NO: 3993113 - RNA, 19 nt, Staphylococcus aureus subsp. aureus Mu50
cuuaaauacaaacccuuua

SEQ ID NO: 3993114 - RNA, 23 nt, Staphylococcus aureus subsp. aureus Mu50
cuuaaauacaaacccuuuaaaca

SEQ ID NO: 3993115 - RNA, 21 nt, Staphylococcus aureus subsp. aureus Mu50
cuuaaauacaauuucuucauu

SEQ ID NO: 3993116 - RNA, 19 nt, Staphylococcus aureus subsp. aureus Mu50
cuuaaauagugcuuuuuca

SEQ ID NO: 3993117 - RNA, 14 nt, Staphylococcus aureus subsp. aureus Mu50
cuuaaauauaauga

SEQ ID NO: 3993118 - RNA, 15 nt, Staphylococcus aureus subsp. aureus Mu50
cuuaaauauaaugau

SEQ ID NO: 3993119 - RNA, 18 nt, Staphylococcus aureus subsp. aureus Mu50
cuuaaauaucgacaaauu

SEQ ID NO: 3993120 - RNA, 21 nt, Staphylococcus aureus subsp. aureus Mu50
cuuaaauaucgacaaauuaaa

SEQ ID NO: 3993121 - RNA, 15 nt, Staphylococcus aureus subsp. aureus Mu50
cuuaaauggaugaua

SEQ ID NO: 3993122 - RNA, 16 nt, Staphylococcus aureus subsp. aureus Mu50
cuuaaauuaagaauaa

SEQ ID NO: 3993123 - RNA, 12 nt, Staphylococcus aureus subsp. aureus Mu50
cuuaacaacaug

SEQ ID NO: 3993124 - RNA, 20 nt, Staphylococcus aureus subsp. aureus Mu50
cuuaacaacaugauuucuuc

SEQ ID NO: 3993125 - RNA, 14 nt, Staphylococcus aureus subsp. aureus Mu50
cuuaacauaaaaug

SEQ ID NO: 3993126 - RNA, 16 nt, Staphylococcus aureus subsp. aureus Mu50
cuuaacauaaaaugag

SEQ ID NO: 3993127 - RNA, 18 nt, Staphylococcus aureus subsp. aureus Mu50
cuuaaccauuuaaaaauu

SEQ ID NO: 3993128 - RNA, 16 nt, Staphylococcus aureus subsp. aureus Mu50
cuuaacucaaagaaac

SEQ ID NO: 3993129 - RNA, 13 nt, Staphylococcus aureus subsp. aureus Mu50
cuuaacuugaaau

SEQ ID NO: 3993130 - RNA, 14 nt, Staphylococcus aureus subsp. aureus Mu50
cuuaacuuguguua

SEQ ID NO: 3993131 - RNA, 18 nt, Staphylococcus aureus subsp. aureus Mu50
cuuaagaaauuuuuucua

SEQ ID NO: 3993132 - RNA, 23 nt, Staphylococcus aureus subsp. aureus Mu50
cuuaagcucauuucaauauuaaa

SEQ ID NO: 3993133 - RNA, 21 nt, Staphylococcus aureus subsp. aureus Mu50
cuuaagcuuuaaucauagcau

SEQ ID NO: 3993134 - RNA, 21 nt, Staphylococcus aureus subsp. aureus Mu50
cuuaaguaagauuuaaacauc

SEQ ID NO: 3993135 - RNA, 14 nt, Staphylococcus aureus subsp. aureus Mu50
cuuaagucaucaau

SEQ ID NO: 3993136 - RNA, 15 nt, Staphylococcus aureus subsp. aureus Mu50
cuuaauaagcugaaa

SEQ ID NO: 3993137 - RNA, 22 nt, Staphylococcus aureus subsp. aureus Mu50
cuuaauaauuaauaagcauuaa

SEQ ID NO: 3993138 - RNA, 18 nt, Staphylococcus aureus subsp. aureus Mu50
cuuaauacgauaauaacu

SEQ ID NO: 3993139 - RNA, 18 nt, Staphylococcus aureus subsp. aureus Mu50
cuuaauagagguauaauu

SEQ ID NO: 3993140 - RNA, 20 nt, Staphylococcus aureus subsp. aureus Mu50
cuuaauauaacgacacuuuu

SEQ ID NO: 3993141 - RNA, 18 nt, Staphylococcus aureus subsp. aureus Mu50
cuuaauaucauauucaaa

SEQ ID NO: 3993142 - RNA, 22 nt, Staphylococcus aureus subsp. aureus Mu50
cuuaauaucaugggcaguaauu

SEQ ID NO: 3993143 - RNA, 18 nt, Staphylococcus aureus subsp. aureus Mu50
cuuaauauugauuaaucu

SEQ ID NO: 3993144 - RNA, 15 nt, Staphylococcus aureus subsp. aureus Mu50
cuuaaucaagcuagc

SEQ ID NO: 3993145 - RNA, 22 nt, Staphylococcus aureus subsp. aureus Mu50
cuuaaucaagcuagcaucaugu

SEQ ID NO: 3993146 - RNA, 22 nt, Staphylococcus aureus subsp. aureus Mu50
cuuaaucagcuauaaaaguacu

SEQ ID NO: 3993147 - RNA, 17 nt, Staphylococcus aureus subsp. aureus Mu50
cuuaaucgcucuaaaua

SEQ ID NO: 3993148 - RNA, 16 nt, Staphylococcus aureus subsp. aureus Mu50
cuuaaucucuuuuuga

SEQ ID NO: 3993149 - RNA, 15 nt, Staphylococcus aureus subsp. aureus Mu50
cuuaaugcuucaaau

SEQ ID NO: 3993150 - RNA, 21 nt, Staphylococcus aureus subsp. aureus Mu50
cuuaaugguaaacaaaaaacu

SEQ ID NO: 3993151 - RNA, 19 nt, Staphylococcus aureus subsp. aureus Mu50
cuuaauuaauaauuuaacu

SEQ ID NO: 3993152 - RNA, 18 nt, Staphylococcus aureus subsp. aureus Mu50
cuuaauuacaauauaauu

SEQ ID NO: 3993153 - RNA, 12 nt, Staphylococcus aureus subsp. aureus Mu50
cuuaauucuuca

SEQ ID NO: 3993154 - RNA, 21 nt, Staphylococcus aureus subsp. aureus Mu50
cuuaauucuucaucaauaacu

SEQ ID NO: 3993155 - RNA, 23 nt, Staphylococcus aureus subsp. aureus Mu50
cuuaauuuaaaucuguacuucua

SEQ ID NO: 3993156 - RNA, 14 nt, Staphylococcus aureus subsp. aureus Mu50
cuuaauuuaaauug

SEQ ID NO: 3993157 - RNA, 15 nt, Staphylococcus aureus subsp. aureus Mu50
cuuaauuuguuuuaa

SEQ ID NO: 3993158 - RNA, 13 nt, Staphylococcus aureus subsp. aureus Mu50
cuuaauuuugcaa

SEQ ID NO: 3993159 - RNA, 20 nt, Staphylococcus aureus subsp. aureus Mu50
cuuaauuuugcaacauuaaa

SEQ ID NO: 3993160 - RNA, 14 nt, Staphylococcus aureus subsp. aureus Mu50
cuuacaaauauacu

SEQ ID NO: 3993161 - RNA, 20 nt, Staphylococcus aureus subsp. aureus Mu50
cuuacaaccuuugguuguua

SEQ ID NO: 3993162 - RNA, 15 nt, Staphylococcus aureus subsp. aureus Mu50
cuuacaauaaagaca

SEQ ID NO: 3993163 - RNA, 14 nt, Staphylococcus aureus subsp. aureus Mu50
cuuacaauaaucac

SEQ ID NO: 3993164 - RNA, 16 nt, Staphylococcus aureus subsp. aureus Mu50
cuuacaauaaucacuu

SEQ ID NO: 3993165 - RNA, 13 nt, Staphylococcus aureus subsp. aureus Mu50
cuuacaauaaugu

SEQ ID NO: 3993166 - RNA, 17 nt, Staphylococcus aureus subsp. aureus Mu50
cuuacagacaaacauua

SEQ ID NO: 3993167 - RNA, 17 nt, Staphylococcus aureus subsp. aureus Mu50
cuuacauaggauaucua

SEQ ID NO: 3993168 - RNA, 13 nt, Staphylococcus aureus subsp. aureus Mu50
cuuacauugauaa

SEQ ID NO: 3993169 - RNA, 16 nt, Staphylococcus aureus subsp. aureus Mu50
cuuacauuuuaauaaa

SEQ ID NO: 3993170 - RNA, 19 nt, Staphylococcus aureus subsp. aureus Mu50
cuuacauuuuaauaaaauc

SEQ ID NO: 3993171 - RNA, 13 nt, Staphylococcus aureus subsp. aureus Mu50
cuuacccaaaaaa

SEQ ID NO: 3993172 - RNA, 15 nt, Staphylococcus aureus subsp. aureus Mu50
cuuacccaaaaaauu

SEQ ID NO: 3993173 - RNA, 17 nt, Staphylococcus aureus subsp. aureus Mu50
cuuacccaaaaaauugu

SEQ ID NO: 3993174 - RNA, 17 nt, Staphylococcus aureus subsp. aureus Mu50
cuuaccuacuuuuuugg

SEQ ID NO: 3993175 - RNA, 19 nt, Staphylococcus aureus subsp. aureus Mu50
cuuaccuuuauguucaaau

SEQ ID NO: 3993176 - RNA, 18 nt, Staphylococcus aureus subsp. aureus Mu50
cuuaccuuucaaauauau

SEQ ID NO: 3993177 - RNA, 18 nt, Staphylococcus aureus subsp. aureus Mu50
cuuacuacgcauuauuaa

SEQ ID NO: 3993178 - RNA, 19 nt, Staphylococcus aureus subsp. aureus Mu50
cuuacuacgcauuauuaag

SEQ ID NO: 3993179 - RNA, 15 nt, Staphylococcus aureus subsp. aureus Mu50
cuuacuacuuaauua

SEQ ID NO: 3993180 - RNA, 13 nt, Staphylococcus aureus subsp. aureus Mu50
cuuacugaaacua

SEQ ID NO: 3993181 - RNA, 16 nt, Staphylococcus aureus subsp. aureus Mu50
cuuacugaaacuaaau

SEQ ID NO: 3993182 - RNA, 16 nt, Staphylococcus aureus subsp. aureus Mu50
cuuacugcaauuauuu

SEQ ID NO: 3993183 - RNA, 13 nt, Staphylococcus aureus subsp. aureus Mu50
cuuacugcuuuuu

SEQ ID NO: 3993184 - RNA, 15 nt, Staphylococcus aureus subsp. aureus Mu50
cuuacuuuuaaauua

SEQ ID NO: 3993185 - RNA, 14 nt, Staphylococcus aureus subsp. aureus Mu50
cuuagaauuuacaa

SEQ ID NO: 3993186 - RNA, 23 nt, Staphylococcus aureus subsp. aureus Mu50
cuuagacaaacgacuaaccacau

SEQ ID NO: 3993187 - RNA, 19 nt, Staphylococcus aureus subsp. aureus Mu50
cuuagacgcuguuuuaaau

SEQ ID NO: 3993188 - RNA, 21 nt, Staphylococcus aureus subsp. aureus Mu50
cuuagacgcuguuuuaaauug

SEQ ID NO: 3993189 - RNA, 15 nt, Staphylococcus aureus subsp. aureus Mu50
cuuagauaaauuaau

SEQ ID NO: 3993190 - RNA, 21 nt, Staphylococcus aureus subsp. aureus Mu50
cuuagauuccccuuuuugucu

SEQ ID NO: 3993191 - RNA, 21 nt, Staphylococcus aureus subsp. aureus Mu50
cuuagauuuucacuaauauuu

SEQ ID NO: 3993192 - RNA, 16 nt, Staphylococcus aureus subsp. aureus Mu50
cuuagcaaucucuuua

SEQ ID NO: 3993193 - RNA, 23 nt, Staphylococcus aureus subsp. aureus Mu50
cuuagcacuuggauuuuaauuau

SEQ ID NO: 3993194 - RNA, 18 nt, Staphylococcus aureus subsp. aureus Mu50
cuuaggugucaucgcuuu

SEQ ID NO: 3993195 - RNA, 21 nt, Staphylococcus aureus subsp. aureus Mu50
cuuagguuauuauaaaauaaa

SEQ ID NO: 3993196 - RNA, 18 nt, Staphylococcus aureus subsp. aureus Mu50
cuuaguaaggaauauuuc

SEQ ID NO: 3993197 - RNA, 17 nt, Staphylococcus aureus subsp. aureus Mu50
cuuaguaauaagacaau

SEQ ID NO: 3993198 - RNA, 16 nt, Staphylococcus aureus subsp. aureus Mu50
cuucaucaauaacuau

SEQ ID NO: 3993199 - RNA, 15 nt, Staphylococcus aureus subsp. aureus Mu50
cuucaucuguaucaa

SEQ ID NO: 3993200 - RNA, 15 nt, Staphylococcus aureus subsp. aureus Mu50
cuucaucuuuaaaga

SEQ ID NO: 3993201 - RNA, 19 nt, Staphylococcus aureus subsp. aureus Mu50
cuucauguucuaaugauau

SEQ ID NO: 3993202 - RNA, 21 nt, Staphylococcus aureus subsp. aureus Mu50
cuucauuaguugcauaaucaa

SEQ ID NO: 3993203 - RNA, 22 nt, Staphylococcus aureus subsp. aureus Mu50
cuucauuaucaauagaugaaaa

SEQ ID NO: 3993204 - RNA, 14 nt, Staphylococcus aureus subsp. aureus Mu50
cuucauugaugaug

SEQ ID NO: 3993205 - RNA, 15 nt, Staphylococcus aureus subsp. aureus Mu50
cuucauugaugaugu

SEQ ID NO: 3993206 - RNA, 18 nt, Staphylococcus aureus subsp. aureus Mu50
cuucauuuauaacauuua

SEQ ID NO: 3993207 - RNA, 17 nt, Staphylococcus aureus subsp. aureus Mu50
cuuccaacacccauaua

SEQ ID NO: 3993208 - RNA, 18 nt, Staphylococcus aureus subsp. aureus Mu50
cuuccaacauauaaaaaa

SEQ ID NO: 3993209 - RNA, 16 nt, Staphylococcus aureus subsp. aureus Mu50
cuuccaauaauaaauc

SEQ ID NO: 3993210 - RNA, 19 nt, Staphylococcus aureus subsp. aureus Mu50
cuuccaauacuguugucuu

SEQ ID NO: 3993211 - RNA, 14 nt, Staphylococcus aureus subsp. aureus Mu50
cuuccaaucaacuu

SEQ ID NO: 3993212 - RNA, 17 nt, Staphylococcus aureus subsp. aureus Mu50
cuuccauucggauaaau

SEQ ID NO: 3993213 - RNA, 14 nt, Staphylococcus aureus subsp. aureus Mu50
cuucccaaggaagu

SEQ ID NO: 3993214 - RNA, 14 nt, Staphylococcus aureus subsp. aureus Mu50
cuucccaucuuuua

SEQ ID NO: 3993215 - RNA, 16 nt, Staphylococcus aureus subsp. aureus Mu50
cuuccccuacaaaguu

SEQ ID NO: 3993216 - RNA, 21 nt, Staphylococcus aureus subsp. aureus Mu50
cuuccuaaaauuuacaaaugu

SEQ ID NO: 3993217 - RNA, 20 nt, Staphylococcus aureus subsp. aureus Mu50
cuuccuuccauucggauaaa

SEQ ID NO: 3993218 - RNA, 14 nt, Staphylococcus aureus subsp. aureus Mu50
cuucgaagucauau

SEQ ID NO: 3993219 - RNA, 13 nt, Staphylococcus aureus subsp. aureus Mu50
cuucgagugcuuu

SEQ ID NO: 3993220 - RNA, 22 nt, Staphylococcus aureus subsp. aureus Mu50
cuucgauaguuuauuaauauua

SEQ ID NO: 3993221 - RNA, 23 nt, Staphylococcus aureus subsp. aureus Mu50
cuucgucgcuaagaaccuuucuu

SEQ ID NO: 3993222 - RNA, 12 nt, Staphylococcus aureus subsp. aureus Mu50
cuucguuuuaau

SEQ ID NO: 3993223 - RNA, 14 nt, Staphylococcus aureus subsp. aureus Mu50
cuucguuuuaauaa

SEQ ID NO: 3993224 - RNA, 22 nt, Staphylococcus aureus subsp. aureus Mu50
cuucguuuuuaguguuaauuga

SEQ ID NO: 3993225 - RNA, 19 nt, Staphylococcus aureus subsp. aureus Mu50
cuucuaaaacuaaagguau

SEQ ID NO: 3993226 - RNA, 14 nt, Staphylococcus aureus subsp. aureus Mu50
cuucuaaccacuuc

SEQ ID NO: 3993227 - RNA, 17 nt, Staphylococcus aureus subsp. aureus Mu50
cuucuaacucaccugca

SEQ ID NO: 3993228 - RNA, 20 nt, Staphylococcus aureus subsp. aureus Mu50
cuucuaaucguuaauaaacc

SEQ ID NO: 3993229 - RNA, 15 nt, Staphylococcus aureus subsp. aureus Mu50
cuucuaauucguuuu

SEQ ID NO: 3993230 - RNA, 17 nt, Staphylococcus aureus subsp. aureus Mu50
cuucuaauuugcaaaau

SEQ ID NO: 3993231 - RNA, 21 nt, Staphylococcus aureus subsp. aureus Mu50
cuucuacccauaauuuaaaug

SEQ ID NO: 3993232 - RNA, 22 nt, Staphylococcus aureus subsp. aureus Mu50
cuucuacccauaauuuaaauga

SEQ ID NO: 3993233 - RNA, 14 nt, Staphylococcus aureus subsp. aureus Mu50
cuucuaguaauucu

SEQ ID NO: 3993234 - RNA, 13 nt, Staphylococcus aureus subsp. aureus Mu50
cuucuaucucuuu

SEQ ID NO: 3993235 - RNA, 14 nt, Staphylococcus aureus subsp. aureus Mu50
cuucuaucuuuauu

SEQ ID NO: 3993236 - RNA, 18 nt, Staphylococcus aureus subsp. aureus Mu50
cuucuauuaaacauuuuu

SEQ ID NO: 3993237 - RNA, 14 nt, Staphylococcus aureus subsp. aureus Mu50
cuucucaauuuagu

SEQ ID NO: 3993238 - RNA, 23 nt, Staphylococcus aureus subsp. aureus Mu50
cuucucacaacugcauauaaagu

SEQ ID NO: 3993239 - RNA, 13 nt, Staphylococcus aureus subsp. aureus Mu50
cuucucaucauuu

SEQ ID NO: 3993240 - RNA, 12 nt, Staphylococcus aureus subsp. aureus Mu50
cuucucauugaa

SEQ ID NO: 3993241 - RNA, 15 nt, Staphylococcus aureus subsp. aureus Mu50
cuucucauugaaauc

SEQ ID NO: 3993242 - RNA, 15 nt, Staphylococcus aureus subsp. aureus Mu50
cuucucccuuaaaua

SEQ ID NO: 3993243 - RNA, 18 nt, Staphylococcus aureus subsp. aureus Mu50
cuucucccuuaaauacaa

SEQ ID NO: 3993244 - RNA, 23 nt, Staphylococcus aureus subsp. aureus Mu50
cuucuccguauuuaccuucuucu

SEQ ID NO: 3993245 - RNA, 12 nt, Staphylococcus aureus subsp. aureus Mu50
cuucucuaauca

SEQ ID NO: 3993246 - RNA, 20 nt, Staphylococcus aureus subsp. aureus Mu50
cuucucucuuauuaaaaaag

SEQ ID NO: 3993247 - RNA, 16 nt, Staphylococcus aureus subsp. aureus Mu50
cuucugcauagcgcuc

SEQ ID NO: 3993248 - RNA, 20 nt, Staphylococcus aureus subsp. aureus Mu50
cuucuggauagguaucacua

SEQ ID NO: 3993249 - RNA, 18 nt, Staphylococcus aureus subsp. aureus Mu50
cuucuguguuggggccca

SEQ ID NO: 3993250 - RNA, 23 nt, Staphylococcus aureus subsp. aureus Mu50
cuucuguguuggggcccacaccc

SEQ ID NO: 3993251 - RNA, 21 nt, Staphylococcus aureus subsp. aureus Mu50
cuucuuaaaauaugauuuaaa

SEQ ID NO: 3993252 - RNA, 24 nt, Staphylococcus aureus subsp. aureus Mu50
cuucuuaaaucaacaucaucuuua

SEQ ID NO: 3993253 - RNA, 20 nt, Staphylococcus aureus subsp. aureus Mu50
cuucuuaacuugaaauguug

SEQ ID NO: 3993254 - RNA, 16 nt, Staphylococcus aureus subsp. aureus Mu50
cuucuuacugcaauua

SEQ ID NO: 3993255 - RNA, 14 nt, Staphylococcus aureus subsp. aureus Mu50
cuucuuaucuuuuu

SEQ ID NO: 3993256 - RNA, 21 nt, Staphylococcus aureus subsp. aureus Mu50
cuucuucaggaauaucuuuca

SEQ ID NO: 3993257 - RNA, 22 nt, Staphylococcus aureus subsp. aureus Mu50
cuucuucaggaauaucuuucaa

SEQ ID NO: 3993258 - RNA, 20 nt, Staphylococcus aureus subsp. aureus Mu50
cuucuucgucgcugauacau

SEQ ID NO: 3993259 - RNA, 22 nt, Staphylococcus aureus subsp. aureus Mu50
cuucuucuaaccacuucuucac

SEQ ID NO: 3993260 - RNA, 17 nt, Staphylococcus aureus subsp. aureus Mu50
cuucuucucuaaucacu

SEQ ID NO: 3993261 - RNA, 13 nt, Staphylococcus aureus subsp. aureus Mu50
cuucuuggcauuu

SEQ ID NO: 3993262 - RNA, 15 nt, Staphylococcus aureus subsp. aureus Mu50
cuucuuguuucaaac

SEQ ID NO: 3993263 - RNA, 21 nt, Staphylococcus aureus subsp. aureus Mu50
cuucuuuaaaggaaauggcuc

SEQ ID NO: 3993264 - RNA, 16 nt, Staphylococcus aureus subsp. aureus Mu50
cuucuuucaauuaauc

SEQ ID NO: 3993265 - RNA, 22 nt, Staphylococcus aureus subsp. aureus Mu50
cuucuuuguuuuuaauuuuuaa

SEQ ID NO: 3993266 - RNA, 13 nt, Staphylococcus aureus subsp. aureus Mu50
cuucuuuuaaguu

SEQ ID NO: 3993267 - RNA, 14 nt, Staphylococcus aureus subsp. aureus Mu50
cuucuuuuaaguua

SEQ ID NO: 3993268 - RNA, 15 nt, Staphylococcus aureus subsp. aureus Mu50
cuucuuuugcaaaac

SEQ ID NO: 3993269 - RNA, 20 nt, Staphylococcus aureus subsp. aureus Mu50
cuucuuuuucccaaucgauu

SEQ ID NO: 3993270 - RNA, 18 nt, Staphylococcus aureus subsp. aureus Mu50
cuucuuuuucuugcauac

SEQ ID NO: 3993271 - RNA, 17 nt, Staphylococcus aureus subsp. aureus Mu50
cuucuuuuuuguaucuc

SEQ ID NO: 3993272 - RNA, 23 nt, Staphylococcus aureus subsp. aureus Mu50
cuucuuuuuuuguuuauuuagaa

SEQ ID NO: 3993273 - RNA, 13 nt, Staphylococcus aureus subsp. aureus Mu50
cuugaacuaaaac

SEQ ID NO: 3993274 - RNA, 16 nt, Staphylococcus aureus subsp. aureus Mu50
cuugaagcaucgauuu

SEQ ID NO: 3993275 - RNA, 20 nt, Staphylococcus aureus subsp. aureus Mu50
cuugaauaaauuuuauucuu

SEQ ID NO: 3993276 - RNA, 15 nt, Staphylococcus aureus subsp. aureus Mu50
cuugaauaauauauu

SEQ ID NO: 3993277 - RNA, 14 nt, Staphylococcus aureus subsp. aureus Mu50
cuugaauguuugaa

SEQ ID NO: 3993278 - RNA, 16 nt, Staphylococcus aureus subsp. aureus Mu50
cuugaauuuaauaagu

SEQ ID NO: 3993279 - RNA, 20 nt, Staphylococcus aureus subsp. aureus Mu50
cuugaccuacuuuuucaaua

SEQ ID NO: 3993280 - RNA, 16 nt, Staphylococcus aureus subsp. aureus Mu50
cuugaccuucaguuuc

SEQ ID NO: 3993281 - RNA, 14 nt, Staphylococcus aureus subsp. aureus Mu50
cuugagcaucuuuu

SEQ ID NO: 3993282 - RNA, 15 nt, Staphylococcus aureus subsp. aureus Mu50
cuugagcuauucaua

SEQ ID NO: 3993283 - RNA, 19 nt, Staphylococcus aureus subsp. aureus Mu50
cuugagcuguuacacuuuu

SEQ ID NO: 3993284 - RNA, 22 nt, Staphylococcus aureus subsp. aureus Mu50
cuugagcuuuguuagcaucugc

SEQ ID NO: 3993285 - RNA, 14 nt, Staphylococcus aureus subsp. aureus Mu50
cuugauaaaaaaug

SEQ ID NO: 3993286 - RNA, 17 nt, Staphylococcus aureus subsp. aureus Mu50
cuuuaacuuuaauuaaa

SEQ ID NO: 3993287 - RNA, 16 nt, Staphylococcus aureus subsp. aureus Mu50
cuuuaagaacauaacc

SEQ ID NO: 3993288 - RNA, 16 nt, Staphylococcus aureus subsp. aureus Mu50
cuuuaagcccuucccc

SEQ ID NO: 3993289 - RNA, 16 nt, Staphylococcus aureus subsp. aureus Mu50
cuuuaaguaauucauu

SEQ ID NO: 3993290 - RNA, 20 nt, Staphylococcus aureus subsp. aureus Mu50
cuuuaaguaauucauuugcu

SEQ ID NO: 3993291 - RNA, 21 nt, Staphylococcus aureus subsp. aureus Mu50
cuuuaagugacacaccaccac

SEQ ID NO: 3993292 - RNA, 23 nt, Staphylococcus aureus subsp. aureus Mu50
cuuuaagugacacaccaccaccu

SEQ ID NO: 3993293 - RNA, 12 nt, Staphylococcus aureus subsp. aureus Mu50
cuuuaauacuac

SEQ ID NO: 3993294 - RNA, 21 nt, Staphylococcus aureus subsp. aureus Mu50
cuuuaauacuaccguuuuuau

SEQ ID NO: 3993295 - RNA, 19 nt, Staphylococcus aureus subsp. aureus Mu50
cuuuaauagcgucaaguuu

SEQ ID NO: 3993296 - RNA, 17 nt, Staphylococcus aureus subsp. aureus Mu50
cuuuaauauagauuuga

SEQ ID NO: 3993297 - RNA, 12 nt, Staphylococcus aureus subsp. aureus Mu50
cuuuaauaucua

SEQ ID NO: 3993298 - RNA, 13 nt, Staphylococcus aureus subsp. aureus Mu50
cuuuaaucaaaaa

SEQ ID NO: 3993299 - RNA, 20 nt, Staphylococcus aureus subsp. aureus Mu50
cuuuaaugauaaguggauuu

SEQ ID NO: 3993300 - RNA, 17 nt, Staphylococcus aureus subsp. aureus Mu50
cuuuaauguaauuauuu

SEQ ID NO: 3993301 - RNA, 18 nt, Staphylococcus aureus subsp. aureus Mu50
cuuuaauuaaaguuaaag

SEQ ID NO: 3993302 - RNA, 21 nt, Staphylococcus aureus subsp. aureus Mu50
cuuuaauuaauguucaaaaaa

SEQ ID NO: 3993303 - RNA, 12 nt, Staphylococcus aureus subsp. aureus Mu50
cuuuaauugcuc

SEQ ID NO: 3993304 - RNA, 14 nt, Staphylococcus aureus subsp. aureus Mu50
cuuuaauugcucuu

SEQ ID NO: 3993305 - RNA, 16 nt, Staphylococcus aureus subsp. aureus Mu50
cuuuaauuguuaaauc

SEQ ID NO: 3993306 - RNA, 21 nt, Staphylococcus aureus subsp. aureus Mu50
cuuuaauuguuaaaucaccaa

SEQ ID NO: 3993307 - RNA, 18 nt, Staphylococcus aureus subsp. aureus Mu50
cuuuaauuuucuugccau

SEQ ID NO: 3993308 - RNA, 17 nt, Staphylococcus aureus subsp. aureus Mu50
cuuuaauuuuucauuaa

SEQ ID NO: 3993309 - RNA, 23 nt, Staphylococcus aureus subsp. aureus Mu50
cuuuaauuuuucauuaauacaag

SEQ ID NO: 3993310 - RNA, 13 nt, Staphylococcus aureus subsp. aureus Mu50
cuuuaauuuuuug

SEQ ID NO: 3993311 - RNA, 15 nt, Staphylococcus aureus subsp. aureus Mu50
cuuuaccaauaucau

SEQ ID NO: 3993312 - RNA, 12 nt, Staphylococcus aureus subsp. aureus Mu50
cuuuaccaucuu

SEQ ID NO: 3993313 - RNA, 19 nt, Staphylococcus aureus subsp. aureus Mu50
cuuuacuccaaaguaacau

SEQ ID NO: 3993314 - RNA, 21 nt, Staphylococcus aureus subsp. aureus Mu50
cuuuacuugcuuuuucaaaua

SEQ ID NO: 3993315 - RNA, 13 nt, Staphylococcus aureus subsp. aureus Mu50
cuuuacuuucauu

SEQ ID NO: 3993316 - RNA, 14 nt, Staphylococcus aureus subsp. aureus Mu50
cuuuagaaagugau

SEQ ID NO: 3993317 - RNA, 22 nt, Staphylococcus aureus subsp. aureus Mu50
cuuuagaugagauuucguuaga

SEQ ID NO: 3993318 - RNA, 14 nt, Staphylococcus aureus subsp. aureus Mu50
cuuuagcaauugaa

SEQ ID NO: 3993319 - RNA, 18 nt, Staphylococcus aureus subsp. aureus Mu50
cuuuagcaauugaaucaa

SEQ ID NO: 3993320 - RNA, 22 nt, Staphylococcus aureus subsp. aureus Mu50
cuuuagcauauucgcuuaaaaa

SEQ ID NO: 3993321 - RNA, 13 nt, Staphylococcus aureus subsp. aureus Mu50
cuuuagguaaaag

SEQ ID NO: 3993322 - RNA, 15 nt, Staphylococcus aureus subsp. aureus Mu50
cuuuagguaaaagag

SEQ ID NO: 3993323 - RNA, 21 nt, Staphylococcus aureus subsp. aureus Mu50
cuuuaguaguguauucauuuu

SEQ ID NO: 3993324 - RNA, 19 nt, Staphylococcus aureus subsp. aureus Mu50
cuuuagucgguguuuucuu

SEQ ID NO: 3993325 - RNA, 14 nt, Staphylococcus aureus subsp. aureus Mu50
cuuuaguguguuua

SEQ ID NO: 3993326 - RNA, 18 nt, Staphylococcus aureus subsp. aureus Mu50
cuuuaguuaauucuccua

SEQ ID NO: 3993327 - RNA, 12 nt, Staphylococcus aureus subsp. aureus Mu50
cuuuaguuacua

SEQ ID NO: 3993328 - RNA, 23 nt, Staphylococcus aureus subsp. aureus Mu50
cuuuauaaauaucuuuuucuaag

SEQ ID NO: 3993329 - RNA, 18 nt, Staphylococcus aureus subsp. aureus Mu50
cuuuauauauaaaaucau

SEQ ID NO: 3993330 - RNA, 21 nt, Staphylococcus aureus subsp. aureus Mu50
cuuuauauauaaagaaauaau

SEQ ID NO: 3993331 - RNA, 12 nt, Staphylococcus aureus subsp. aureus Mu50
cuuuauaugaag

SEQ ID NO: 3993332 - RNA, 14 nt, Staphylococcus aureus subsp. aureus Mu50
cuuuauaugagaaa

SEQ ID NO: 3993333 - RNA, 14 nt, Staphylococcus aureus subsp. aureus Mu50
cuuuauauuuauca

SEQ ID NO: 3993334 - RNA, 13 nt, Staphylococcus aureus subsp. aureus Mu50
cuuuaucuauaug

SEQ ID NO: 3993335 - RNA, 23 nt, Staphylococcus aureus subsp. aureus Mu50
cuuuaucuauaugcauauauuga

SEQ ID NO: 3993336 - RNA, 16 nt, Staphylococcus aureus subsp. aureus Mu50
cuuuaugaaucauuuu

SEQ ID NO: 3993337 - RNA, 19 nt, Staphylococcus aureus subsp. aureus Mu50
cuuuaugcaaaauuaauga

SEQ ID NO: 3993338 - RNA, 21 nt, Staphylococcus aureus subsp. aureus Mu50
cuuuaugcaaaauuaaugaac

SEQ ID NO: 3993339 - RNA, 23 nt, Staphylococcus aureus subsp. aureus Mu50
cuuuaugggagugggacagaaau

SEQ ID NO: 3993340 - RNA, 14 nt, Staphylococcus aureus subsp. aureus Mu50
cuuuauuaaaaauc

SEQ ID NO: 3993341 - RNA, 14 nt, Staphylococcus aureus subsp. aureus Mu50
cuuuauuacuuuaa

SEQ ID NO: 3993342 - RNA, 13 nt, Staphylococcus aureus subsp. aureus Mu50
cuuuauuauacau

SEQ ID NO: 3993343 - RNA, 13 nt, Staphylococcus aureus subsp. aureus Mu50
cuuuauuaucauu

SEQ ID NO: 3993344 - RNA, 16 nt, Staphylococcus aureus subsp. aureus Mu50
cuuuauuauuuaaucu

SEQ ID NO: 3993345 - RNA, 14 nt, Staphylococcus aureus subsp. aureus Mu50
cuuuauucuuccca

SEQ ID NO: 3993346 - RNA, 22 nt, Staphylococcus aureus subsp. aureus Mu50
cuuuauugggagcaaucaauac

SEQ ID NO: 3993347 - RNA, 20 nt, Staphylococcus aureus subsp. aureus Mu50
cuuuauuuacaauguuaucu

SEQ ID NO: 3993348 - RNA, 20 nt, Staphylococcus aureus subsp. aureus Mu50
cuuuauuugauucuucacca

SEQ ID NO: 3993349 - RNA, 16 nt, Staphylococcus aureus subsp. aureus Mu50
cuuuauuuuuaugauu

SEQ ID NO: 3993350 - RNA, 17 nt, Staphylococcus aureus subsp. aureus Mu50
cuuuauuuuuuaucauu

SEQ ID NO: 3993351 - RNA, 23 nt, Staphylococcus aureus subsp. aureus Mu50
cuuucaaauauaucuaauacuuu

SEQ ID NO: 3993352 - RNA, 19 nt, Staphylococcus aureus subsp. aureus Mu50
cuuucaaaugcuuaauaaa

SEQ ID NO: 3993353 - RNA, 15 nt, Staphylococcus aureus subsp. aureus Mu50
cuuucaauuaauuua

SEQ ID NO: 3993354 - RNA, 16 nt, Staphylococcus aureus subsp. aureus Mu50
cuuucaccauuuacuu

SEQ ID NO: 3993355 - RNA, 20 nt, Staphylococcus aureus subsp. aureus Mu50
cuuucaccauuuacuucaua

SEQ ID NO: 3993356 - RNA, 21 nt, Staphylococcus aureus subsp. aureus Mu50
cuuucaggcuuuguuuuucac

SEQ ID NO: 3993357 - RNA, 13 nt, Staphylococcus aureus subsp. aureus Mu50
cuuucaguuuuug

SEQ ID NO: 3993358 - RNA, 17 nt, Staphylococcus aureus subsp. aureus Mu50
cuuucauacauaacaca

SEQ ID NO: 3993359 - RNA, 20 nt, Staphylococcus aureus subsp. aureus Mu50
cuuucauaguuauuaaaucu

SEQ ID NO: 3993360 - RNA, 21 nt, Staphylococcus aureus subsp. aureus Mu50
cuuucauuguuaaacauugaa

SEQ ID NO: 3993361 - RNA, 13 nt, Staphylococcus aureus subsp. aureus Mu50
cuuuccaccauau

SEQ ID NO: 3993362 - RNA, 21 nt, Staphylococcus aureus subsp. aureus Mu50
cuuuccauuguugauaaaugg

SEQ ID NO: 3993363 - RNA, 21 nt, Staphylococcus aureus subsp. aureus Mu50
cuuuccucacuagauaguuua

SEQ ID NO: 3993364 - RNA, 18 nt, Staphylococcus aureus subsp. aureus Mu50
cuuucgagguaauuucac

SEQ ID NO: 3993365 - RNA, 21 nt, Staphylococcus aureus subsp. aureus Mu50
cuuucuaagauguguugaaac

SEQ ID NO: 3993366 - RNA, 11 nt, Staphylococcus aureus subsp. aureus Mu50
cuuucugaaga

SEQ ID NO: 3993367 - RNA, 21 nt, Staphylococcus aureus subsp. aureus Mu50
cuuucugaucgacuaauuuuu

SEQ ID NO: 3993368 - RNA, 23 nt, Staphylococcus aureus subsp. aureus Mu50
cuuucugaucgacuaauuuuucu

SEQ ID NO: 3993369 - RNA, 20 nt, Staphylococcus aureus subsp. aureus Mu50
cuuucuuagugaaucuucua

SEQ ID NO: 3993370 - RNA, 23 nt, Staphylococcus aureus subsp. aureus Mu50
cuuucuucagaaccuugaaugau

SEQ ID NO: 3993371 - RNA, 24 nt, Staphylococcus aureus subsp. aureus Mu50
cuuucuucagaaccuugaaugaua

SEQ ID NO: 3993372 - RNA, 11 nt, Staphylococcus aureus subsp. aureus Mu50
cuuucuuuucu

SEQ ID NO: 3993373 - RNA, 14 nt, Staphylococcus aureus subsp. aureus Mu50
cuuuuguuaaaaaa

SEQ ID NO: 3993374 - RNA, 15 nt, Staphylococcus aureus subsp. aureus Mu50
cuuuuguuuuaccau

SEQ ID NO: 3993375 - RNA, 17 nt, Staphylococcus aureus subsp. aureus Mu50
cuuuuguuuuuauauua

SEQ ID NO: 3993376 - RNA, 12 nt, Staphylococcus aureus subsp. aureus Mu50
cuuuuuaaaaaa

SEQ ID NO: 3993377 - RNA, 15 nt, Staphylococcus aureus subsp. aureus Mu50
cuuuuuaaaaaauuu

SEQ ID NO: 3993378 - RNA, 14 nt, Staphylococcus aureus subsp. aureus Mu50
cuuuuuaaaaucgu

SEQ ID NO: 3993379 - RNA, 15 nt, Staphylococcus aureus subsp. aureus Mu50
cuuuuuaaaaucguu

SEQ ID NO: 3993380 - RNA, 23 nt, Staphylococcus aureus subsp. aureus Mu50
cuuuuuaaacguacauuuuuaug

SEQ ID NO: 3993381 - RNA, 12 nt, Staphylococcus aureus subsp. aureus Mu50
cuuuuuaaagga

SEQ ID NO: 3993382 - RNA, 23 nt, Staphylococcus aureus subsp. aureus Mu50
cuuuuuaacuauguuacuuauau

SEQ ID NO: 3993383 - RNA, 21 nt, Staphylococcus aureus subsp. aureus Mu50
cuuuuuacuaggaauauaaaa

SEQ ID NO: 3993384 - RNA, 20 nt, Staphylococcus aureus subsp. aureus Mu50
cuuuuuacuauguaacuuua

SEQ ID NO: 3993385 - RNA, 23 nt, Staphylococcus aureus subsp. aureus Mu50
cuuuuuagccccagcaaauacuu

SEQ ID NO: 3993386 - RNA, 17 nt, Staphylococcus aureus subsp. aureus Mu50
cuuuuuaggaaugauag

SEQ ID NO: 3993387 - RNA, 15 nt, Staphylococcus aureus subsp. aureus Mu50
cuuuuuauaucaaaa

SEQ ID NO: 3993388 - RNA, 19 nt, Staphylococcus aureus subsp. aureus Mu50
cuuuuuaucaugauuaauu

SEQ ID NO: 3993389 - RNA, 22 nt, Staphylococcus aureus subsp. aureus Mu50
cuuuuuaucaugauuaauuaaa

SEQ ID NO: 3993390 - RNA, 21 nt, Staphylococcus aureus subsp. aureus Mu50
cuuuuuauuuuaauauuuucu

SEQ ID NO: 3993391 - RNA, 21 nt, Staphylococcus aureus subsp. aureus Mu50
cuuuuucaaauaauauaaaac

SEQ ID NO: 3993392 - RNA, 22 nt, Staphylococcus aureus subsp. aureus Mu50
cuuuuucaaauaauauaaaacg

SEQ ID NO: 3993393 - RNA, 13 nt, Staphylococcus aureus subsp. aureus Mu50
cuuuuucaucuuu

SEQ ID NO: 3993394 - RNA, 16 nt, Staphylococcus aureus subsp. aureus Mu50
cuuuuucuaaauaaac

SEQ ID NO: 3993395 - RNA, 14 nt, Staphylococcus aureus subsp. aureus Mu50
cuuuuucuauacaa

SEQ ID NO: 3993396 - RNA, 12 nt, Staphylococcus aureus subsp. aureus Mu50
cuuuuucuuuca

SEQ ID NO: 3993397 - RNA, 22 nt, Staphylococcus aureus subsp. aureus Mu50
cuuuuugaaauuucgacaucua

SEQ ID NO: 3993398 - RNA, 21 nt, Staphylococcus aureus subsp. aureus Mu50
cuuuuugacauauuuuuuaaa

SEQ ID NO: 3993399 - RNA, 16 nt, Staphylococcus aureus subsp. aureus Mu50
cuuuuugaucaacuau

SEQ ID NO: 3993400 - RNA, 17 nt, Staphylococcus aureus subsp. aureus Mu50
cuuuuugcguuuuuaaa

SEQ ID NO: 3993401 - RNA, 15 nt, Staphylococcus aureus subsp. aureus Mu50
cuuuuugcuuaguac

SEQ ID NO: 3993402 - RNA, 15 nt, Staphylococcus aureus subsp. aureus Mu50
cuuuuuguguaucug

SEQ ID NO: 3993403 - RNA, 15 nt, Staphylococcus aureus subsp. aureus Mu50
cuuuuuguuaauuuu

SEQ ID NO: 3993404 - RNA, 13 nt, Staphylococcus aureus subsp. aureus Mu50
cuuuuuguuuauc

SEQ ID NO: 3993405 - RNA, 14 nt, Staphylococcus aureus subsp. aureus Mu50
cuuuuuguuuucaa

SEQ ID NO: 3993406 - RNA, 16 nt, Staphylococcus aureus subsp. aureus Mu50
cuuuuuuaagaucaau

SEQ ID NO: 3993407 - RNA, 12 nt, Staphylococcus aureus subsp. aureus Mu50
cuuuuuuaaguu

SEQ ID NO: 3993408 - RNA, 13 nt, Staphylococcus aureus subsp. aureus Mu50
cuuuuuuauauuc

SEQ ID NO: 3993409 - RNA, 15 nt, Staphylococcus aureus subsp. aureus Mu50
cuuuuuuaucuacau

SEQ ID NO: 3993410 - RNA, 13 nt, Staphylococcus aureus subsp. aureus Mu50
cuuuuuugugauu

SEQ ID NO: 3993411 - RNA, 16 nt, Staphylococcus aureus subsp. aureus Mu50
cuuuuuuuaaaucuuc

SEQ ID NO: 3993412 - RNA, 23 nt, Staphylococcus aureus subsp. aureus Mu50
cuuuuuuuaaaucuucuauuuuc

SEQ ID NO: 3993413 - RNA, 21 nt, Staphylococcus aureus subsp. aureus Mu50
cuuuuuuuguuuauuuagaau

SEQ ID NO: 3993414 - RNA, 19 nt, Staphylococcus aureus subsp. aureus Mu50
gaaaaaccaaguuuugcac

SEQ ID NO: 3993415 - RNA, 12 nt, Staphylococcus aureus subsp. aureus Mu50
gaaaaaccaaua

SEQ ID NO: 3993416 - RNA, 18 nt, Staphylococcus aureus subsp. aureus Mu50
gaaaaacugcucauugug

SEQ ID NO: 3993417 - RNA, 23 nt, Staphylococcus aureus subsp. aureus Mu50
gaaaaacuucuuaacuugaaaug

SEQ ID NO: 3993418 - RNA, 14 nt, Staphylococcus aureus subsp. aureus Mu50
gaaaaacuuuucau

SEQ ID NO: 3993419 - RNA, 18 nt, Staphylococcus aureus subsp. aureus Mu50
gaaaaagaugaaaaaguc

SEQ ID NO: 3993420 - RNA, 20 nt, Staphylococcus aureus subsp. aureus Mu50
gaaaaagauucggaaaauau

SEQ ID NO: 3993421 - RNA, 20 nt, Staphylococcus aureus subsp. aureus Mu50
gaaaaagugauaauuaaaau

SEQ ID NO: 3993422 - RNA, 16 nt, Staphylococcus aureus subsp. aureus Mu50
gaaaaaguuauaucau

SEQ ID NO: 3993423 - RNA, 18 nt, Staphylococcus aureus subsp. aureus Mu50
gaaaaauuucaaaaauag

SEQ ID NO: 3993424 - RNA, 20 nt, Staphylococcus aureus subsp. aureus Mu50
gaaaaauuucaaaaauagcg

SEQ ID NO: 3993425 - RNA, 22 nt, Staphylococcus aureus subsp. aureus Mu50
gaaaacauaaauacaaaaauau

SEQ ID NO: 3993426 - RNA, 23 nt, Staphylococcus aureus subsp. aureus Mu50
gaaaacguugaguauuacuugaa

SEQ ID NO: 3993427 - RNA, 16 nt, Staphylococcus aureus subsp. aureus Mu50
gaaaacuauuuuaaaa

SEQ ID NO: 3993428 - RNA, 19 nt, Staphylococcus aureus subsp. aureus Mu50
gaaaagaaauucuacaggu

SEQ ID NO: 3993429 - RNA, 16 nt, Staphylococcus aureus subsp. aureus Mu50
gaaaagaacacgauau

SEQ ID NO: 3993430 - RNA, 20 nt, Staphylococcus aureus subsp. aureus Mu50
gaaaagggaauggauuacag

SEQ ID NO: 3993431 - RNA, 20 nt, Staphylococcus aureus subsp. aureus Mu50
gaaaaggucaaaaaauuaau

SEQ ID NO: 3993432 - RNA, 16 nt, Staphylococcus aureus subsp. aureus Mu50
gaaaaguaauuaaaua

SEQ ID NO: 3993433 - RNA, 16 nt, Staphylococcus aureus subsp. aureus Mu50
gaaaagucacagugua

SEQ ID NO: 3993434 - RNA, 19 nt, Staphylococcus aureus subsp. aureus Mu50
gaaaagucagcuuacaaua

SEQ ID NO: 3993435 - RNA, 18 nt, Staphylococcus aureus subsp. aureus Mu50
gaaaagugcgauuaucag

SEQ ID NO: 3993436 - RNA, 22 nt, Staphylococcus aureus subsp. aureus Mu50
gaaaaguuuuuuacuuuucauc

SEQ ID NO: 3993437 - RNA, 17 nt, Staphylococcus aureus subsp. aureus Mu50
gaaaauaaaacaaauua

SEQ ID NO: 3993438 - RNA, 19 nt, Staphylococcus aureus subsp. aureus Mu50
gaaaauaaaacaaauuauu

SEQ ID NO: 3993439 - RNA, 15 nt, Staphylococcus aureus subsp. aureus Mu50
gaaaauaagauuauu

SEQ ID NO: 3993440 - RNA, 23 nt, Staphylococcus aureus subsp. aureus Mu50
gaaaauaagcuuguaacaagcau

SEQ ID NO: 3993441 - RNA, 10 nt, Staphylococcus aureus subsp. aureus Mu50
gaaaauaaua

SEQ ID NO: 3993442 - RNA, 21 nt, Staphylococcus aureus subsp. aureus Mu50
gaaaauaccucuacauuauau

SEQ ID NO: 3993443 - RNA, 17 nt, Staphylococcus aureus subsp. aureus Mu50
gaaaauacuauacugau

SEQ ID NO: 3993444 - RNA, 15 nt, Staphylococcus aureus subsp. aureus Mu50
gaaaauagaaagaaa

SEQ ID NO: 3993445 - RNA, 18 nt, Staphylococcus aureus subsp. aureus Mu50
gaaaauagcuauuaaaau

SEQ ID NO: 3993446 - RNA, 19 nt, Staphylococcus aureus subsp. aureus Mu50
gaaaauagcuauuaaaaua

SEQ ID NO: 3993447 - RNA, 21 nt, Staphylococcus aureus subsp. aureus Mu50
gaaaauagcuauuaaaauaga

SEQ ID NO: 3993448 - RNA, 22 nt, Staphylococcus aureus subsp. aureus Mu50
gaaaauagcuauuaaaauagag

SEQ ID NO: 3993449 - RNA, 20 nt, Staphylococcus aureus subsp. aureus Mu50
gaaaauagcuguuugauauu

SEQ ID NO: 3993450 - RNA, 12 nt, Staphylococcus aureus subsp. aureus Mu50
gaaaauaucauu

SEQ ID NO: 3993451 - RNA, 13 nt, Staphylococcus aureus subsp. aureus Mu50
gaaaauaugauaa

SEQ ID NO: 3993452 - RNA, 15 nt, Staphylococcus aureus subsp. aureus Mu50
gaaaauaugauaacu

SEQ ID NO: 3993453 - RNA, 13 nt, Staphylococcus aureus subsp. aureus Mu50
gaaaaucaucauu

SEQ ID NO: 3993454 - RNA, 17 nt, Staphylococcus aureus subsp. aureus Mu50
gaaaaucauucauuugc

SEQ ID NO: 3993455 - RNA, 22 nt, Staphylococcus aureus subsp. aureus Mu50
gaaaaugacgauacguauauag

SEQ ID NO: 3993456 - RNA, 16 nt, Staphylococcus aureus subsp. aureus Mu50
gaaaaugaguacaaca

SEQ ID NO: 3993457 - RNA, 17 nt, Staphylococcus aureus subsp. aureus Mu50
gaaaauucgcuuguaac

SEQ ID NO: 3993458 - RNA, 18 nt, Staphylococcus aureus subsp. aureus Mu50
gaaaauucgcuuguaaca

SEQ ID NO: 3993459 - RNA, 22 nt, Staphylococcus aureus subsp. aureus Mu50
gaaaauucgcuuguaacaagcu

SEQ ID NO: 3993460 - RNA, 21 nt, Staphylococcus aureus subsp. aureus Mu50
gaacagauauacuacuuguuu

SEQ ID NO: 3993461 - RNA, 16 nt, Staphylococcus aureus subsp. aureus Mu50
gaacagcacauuuuua

SEQ ID NO: 3993462 - RNA, 17 nt, Staphylococcus aureus subsp. aureus Mu50
gaacaguuagugcuugu

SEQ ID NO: 3993463 - RNA, 15 nt, Staphylococcus aureus subsp. aureus Mu50
gaacauauuauaaaa

SEQ ID NO: 3993464 - RNA, 11 nt, Staphylococcus aureus subsp. aureus Mu50
gaacaucuaau

SEQ ID NO: 3993465 - RNA, 15 nt, Staphylococcus aureus subsp. aureus Mu50
gaacaucuaguuauu

SEQ ID NO: 3993466 - RNA, 19 nt, Staphylococcus aureus subsp. aureus Mu50
gaacaucuaguuauuucau

SEQ ID NO: 3993467 - RNA, 12 nt, Staphylococcus aureus subsp. aureus Mu50
gaacaucugaaa

SEQ ID NO: 3993468 - RNA, 16 nt, Staphylococcus aureus subsp. aureus Mu50
gaacaucugaaaaaau

SEQ ID NO: 3993469 - RNA, 18 nt, Staphylococcus aureus subsp. aureus Mu50
gaacaugguaucuuuaau

SEQ ID NO: 3993470 - RNA, 15 nt, Staphylococcus aureus subsp. aureus Mu50
gaacauguuucuaga

SEQ ID NO: 3993471 - RNA, 14 nt, Staphylococcus aureus subsp. aureus Mu50
gaaccaacaauaaa

SEQ ID NO: 3993472 - RNA, 23 nt, Staphylococcus aureus subsp. aureus Mu50
gaaccaauccaauauacaaugcu

SEQ ID NO: 3993473 - RNA, 21 nt, Staphylococcus aureus subsp. aureus Mu50
gaaccagcuaaccaaauaauu

SEQ ID NO: 3993474 - RNA, 17 nt, Staphylococcus aureus subsp. aureus Mu50
gaaccauacucuaacuu

SEQ ID NO: 3993475 - RNA, 18 nt, Staphylococcus aureus subsp. aureus Mu50
gaaccguaacuauaugaa

SEQ ID NO: 3993476 - RNA, 13 nt, Staphylococcus aureus subsp. aureus Mu50
gaaccuauuuuuu

SEQ ID NO: 3993477 - RNA, 21 nt, Staphylococcus aureus subsp. aureus Mu50
gaaccuauuuuuuauaugaug

SEQ ID NO: 3993478 - RNA, 15 nt, Staphylococcus aureus subsp. aureus Mu50
gaacgaaacuuuaau

SEQ ID NO: 3993479 - RNA, 19 nt, Staphylococcus aureus subsp. aureus Mu50
gaacgcuagcauaucuuua

SEQ ID NO: 3993480 - RNA, 18 nt, Staphylococcus aureus subsp. aureus Mu50
gaacguguuugaauggca

SEQ ID NO: 3993481 - RNA, 14 nt, Staphylococcus aureus subsp. aureus Mu50
gaacuaacauaauu

SEQ ID NO: 3993482 - RNA, 17 nt, Staphylococcus aureus subsp. aureus Mu50
gaacuagacaagaugcu

SEQ ID NO: 3993483 - RNA, 18 nt, Staphylococcus aureus subsp. aureus Mu50
gaacuaguacgaaaugca

SEQ ID NO: 3993484 - RNA, 21 nt, Staphylococcus aureus subsp. aureus Mu50
gaacuaucaauauaauuuggu

SEQ ID NO: 3993485 - RNA, 20 nt, Staphylococcus aureus subsp. aureus Mu50
gaacucguucguauauuaca

SEQ ID NO: 3993486 - RNA, 21 nt, Staphylococcus aureus subsp. aureus Mu50
gaacucguucguauauuacau

SEQ ID NO: 3993487 - RNA, 16 nt, Staphylococcus aureus subsp. aureus Mu50
gaacucugagcacuua

SEQ ID NO: 3993488 - RNA, 22 nt, Staphylococcus aureus subsp. aureus Mu50
gaacucuuuuaacccacauuaa

SEQ ID NO: 3993489 - RNA, 19 nt, Staphylococcus aureus subsp. aureus Mu50
gaacuucuuuuuuguaucu

SEQ ID NO: 3993490 - RNA, 13 nt, Staphylococcus aureus subsp. aureus Mu50
gaacuuuaaaaau

SEQ ID NO: 3993491 - RNA, 15 nt, Staphylococcus aureus subsp. aureus Mu50
gaacuuuaauaccag

SEQ ID NO: 3993492 - RNA, 20 nt, Staphylococcus aureus subsp. aureus Mu50
gaacuuuuauuuuuuauaaa

SEQ ID NO: 3993493 - RNA, 15 nt, Staphylococcus aureus subsp. aureus Mu50
gaagaaacauuauau

SEQ ID NO: 3993494 - RNA, 19 nt, Staphylococcus aureus subsp. aureus Mu50
gaagaaacuuaaucaagcu

SEQ ID NO: 3993495 - RNA, 17 nt, Staphylococcus aureus subsp. aureus Mu50
gaagacaccuuaucacu

SEQ ID NO: 3993496 - RNA, 14 nt, Staphylococcus aureus subsp. aureus Mu50
gaagagaugaaaga

SEQ ID NO: 3993497 - RNA, 17 nt, Staphylococcus aureus subsp. aureus Mu50
gaagauaggauuuacac

SEQ ID NO: 3993498 - RNA, 17 nt, Staphylococcus aureus subsp. aureus Mu50
gaagauaggauuugcac

SEQ ID NO: 3993499 - RNA, 19 nt, Staphylococcus aureus subsp. aureus Mu50
gaagcaucuccaauuuaau

SEQ ID NO: 3993500 - RNA, 18 nt, Staphylococcus aureus subsp. aureus Mu50
gaaggaaaauaaaaacca

SEQ ID NO: 3993501 - RNA, 19 nt, Staphylococcus aureus subsp. aureus Mu50
gaaggaacguguucuaaaa

SEQ ID NO: 3993502 - RNA, 21 nt, Staphylococcus aureus subsp. aureus Mu50
gaaggaauaauuuuaaaaaua

SEQ ID NO: 3993503 - RNA, 22 nt, Staphylococcus aureus subsp. aureus Mu50
gaaggccauuuuuauuuaacac

SEQ ID NO: 3993504 - RNA, 16 nt, Staphylococcus aureus subsp. aureus Mu50
gaagggaguauuuuuu

SEQ ID NO: 3993505 - RNA, 21 nt, Staphylococcus aureus subsp. aureus Mu50
gaaguacuuaccuuucaaaua

SEQ ID NO: 3993506 - RNA, 22 nt, Staphylococcus aureus subsp. aureus Mu50
gaagucuugugauaauucuuca

SEQ ID NO: 3993507 - RNA, 18 nt, Staphylococcus aureus subsp. aureus Mu50
gaagugcgggggauuauu

SEQ ID NO: 3993508 - RNA, 14 nt, Staphylococcus aureus subsp. aureus Mu50
gaaguuaacuauaa

SEQ ID NO: 3993509 - RNA, 22 nt, Staphylococcus aureus subsp. aureus Mu50
gaaguugcucgcgcucuucuuc

SEQ ID NO: 3993510 - RNA, 13 nt, Staphylococcus aureus subsp. aureus Mu50
gaauaaaaaaguu

SEQ ID NO: 3993511 - RNA, 13 nt, Staphylococcus aureus subsp. aureus Mu50
gaauaaaauauau

SEQ ID NO: 3993512 - RNA, 15 nt, Staphylococcus aureus subsp. aureus Mu50
gaauaaauagauaau

SEQ ID NO: 3993513 - RNA, 21 nt, Staphylococcus aureus subsp. aureus Mu50
gaauaaauuuugcgaaaauau

SEQ ID NO: 3993514 - RNA, 13 nt, Staphylococcus aureus subsp. aureus Mu50
gaauaacaagaaa

SEQ ID NO: 3993515 - RNA, 18 nt, Staphylococcus aureus subsp. aureus Mu50
gaauaacaagaaaaaccu

SEQ ID NO: 3993516 - RNA, 13 nt, Staphylococcus aureus subsp. aureus Mu50
gaauaacacuaga

SEQ ID NO: 3993517 - RNA, 15 nt, Staphylococcus aureus subsp. aureus Mu50
gaauaacgucauaug

SEQ ID NO: 3993518 - RNA, 19 nt, Staphylococcus aureus subsp. aureus Mu50
gaauaacuguuuaucauga

SEQ ID NO: 3993519 - RNA, 12 nt, Staphylococcus aureus subsp. aureus Mu50
gaauaauauauu

SEQ ID NO: 3993520 - RNA, 13 nt, Staphylococcus aureus subsp. aureus Mu50
gaauaauauauuu

SEQ ID NO: 3993521 - RNA, 18 nt, Staphylococcus aureus subsp. aureus Mu50
gaauaauauauuuaggac

SEQ ID NO: 3993522 - RNA, 21 nt, Staphylococcus aureus subsp. aureus Mu50
gaauaaucauccauauaugcc

SEQ ID NO: 3993523 - RNA, 20 nt, Staphylococcus aureus subsp. aureus Mu50
gaauaauguuuccauuuauu

SEQ ID NO: 3993524 - RNA, 17 nt, Staphylococcus aureus subsp. aureus Mu50
gaauaauuuuaaaaaua

SEQ ID NO: 3993525 - RNA, 15 nt, Staphylococcus aureus subsp. aureus Mu50
gaauacaaauauuaa

SEQ ID NO: 3993526 - RNA, 22 nt, Staphylococcus aureus subsp. aureus Mu50
gaauacaauaguacuaagcuuu

SEQ ID NO: 3993527 - RNA, 21 nt, Staphylococcus aureus subsp. aureus Mu50
gaauacacgacgcuaaacaaa

SEQ ID NO: 3993528 - RNA, 18 nt, Staphylococcus aureus subsp. aureus Mu50
gaauacagaugaugcuuc

SEQ ID NO: 3993529 - RNA, 14 nt, Staphylococcus aureus subsp. aureus Mu50
gaauacuaaaagug

SEQ ID NO: 3993530 - RNA, 18 nt, Staphylococcus aureus subsp. aureus Mu50
gaauacucuucaaucuac

SEQ ID NO: 3993531 - RNA, 16 nt, Staphylococcus aureus subsp. aureus Mu50
gaauacuuuuuaacug

SEQ ID NO: 3993532 - RNA, 14 nt, Staphylococcus aureus subsp. aureus Mu50
gaauagauugauug

SEQ ID NO: 3993533 - RNA, 23 nt, Staphylococcus aureus subsp. aureus Mu50
gaauauaacaacuacuuaaauua

SEQ ID NO: 3993534 - RNA, 13 nt, Staphylococcus aureus subsp. aureus Mu50
gaauauaacgaau

SEQ ID NO: 3993535 - RNA, 22 nt, Staphylococcus aureus subsp. aureus Mu50
gaauauaaguaaucauaauaau

SEQ ID NO: 3993536 - RNA, 15 nt, Staphylococcus aureus subsp. aureus Mu50
gaauauaauaacaau

SEQ ID NO: 3993537 - RNA, 20 nt, Staphylococcus aureus subsp. aureus Mu50
gaauauaauaacaaucaaag

SEQ ID NO: 3993538 - RNA, 20 nt, Staphylococcus aureus subsp. aureus Mu50
gaauauacuaaaguucaaca

SEQ ID NO: 3993539 - RNA, 23 nt, Staphylococcus aureus subsp. aureus Mu50
gaauauagauuuuguauuagcau

SEQ ID NO: 3993540 - RNA, 21 nt, Staphylococcus aureus subsp. aureus Mu50
gaauaugaauugcuuguuuua

SEQ ID NO: 3993541 - RNA, 19 nt, Staphylococcus aureus subsp. aureus Mu50
gaauauuaagauguauaug

SEQ ID NO: 3993542 - RNA, 21 nt, Staphylococcus aureus subsp. aureus Mu50
gaauauuguauugaucuacau

SEQ ID NO: 3993543 - RNA, 23 nt, Staphylococcus aureus subsp. aureus Mu50
gaauauuucccuaugaaauaacu

SEQ ID NO: 3993544 - RNA, 23 nt, Staphylococcus aureus subsp. aureus Mu50
gaauauuugcuuuuuguguaucu

SEQ ID NO: 3993545 - RNA, 12 nt, Staphylococcus aureus subsp. aureus Mu50
gaaucaacaauu

SEQ ID NO: 3993546 - RNA, 19 nt, Staphylococcus aureus subsp. aureus Mu50
gaaucaacaauuuaaacgc

SEQ ID NO: 3993547 - RNA, 20 nt, Staphylococcus aureus subsp. aureus Mu50
gacauucauuuaguuaaaua

SEQ ID NO: 3993548 - RNA, 13 nt, Staphylococcus aureus subsp. aureus Mu50
gacauugaauaaa

SEQ ID NO: 3993549 - RNA, 22 nt, Staphylococcus aureus subsp. aureus Mu50
gacauugaugucaauuucacgc

SEQ ID NO: 3993550 - RNA, 17 nt, Staphylococcus aureus subsp. aureus Mu50
gacauuguaaaaugcuc

SEQ ID NO: 3993551 - RNA, 16 nt, Staphylococcus aureus subsp. aureus Mu50
gacauugugaaaguuu

SEQ ID NO: 3993552 - RNA, 19 nt, Staphylococcus aureus subsp. aureus Mu50
gacauuuaauacuuuucuc

SEQ ID NO: 3993553 - RNA, 15 nt, Staphylococcus aureus subsp. aureus Mu50
gacauuuguaaauau

SEQ ID NO: 3993554 - RNA, 15 nt, Staphylococcus aureus subsp. aureus Mu50
gacauuuuuggcuua

SEQ ID NO: 3993555 - RNA, 23 nt, Staphylococcus aureus subsp. aureus Mu50
gacauuuuuggcuuaucaagcac

SEQ ID NO: 3993556 - RNA, 13 nt, Staphylococcus aureus subsp. aureus Mu50
gaccaaguaugag

SEQ ID NO: 3993557 - RNA, 14 nt, Staphylococcus aureus subsp. aureus Mu50
gaccaaguaugaga

SEQ ID NO: 3993558 - RNA, 14 nt, Staphylococcus aureus subsp. aureus Mu50
gaccaauagcaauu

SEQ ID NO: 3993559 - RNA, 17 nt, Staphylococcus aureus subsp. aureus Mu50
gaccaccugauaaugca

SEQ ID NO: 3993560 - RNA, 17 nt, Staphylococcus aureus subsp. aureus Mu50
gaccaccuuuaucugua

SEQ ID NO: 3993561 - RNA, 17 nt, Staphylococcus aureus subsp. aureus Mu50
gaccacggucuugauau

SEQ ID NO: 3993562 - RNA, 22 nt, Staphylococcus aureus subsp. aureus Mu50
gaccacuuuuguuaaaaaaugg

SEQ ID NO: 3993563 - RNA, 18 nt, Staphylococcus aureus subsp. aureus Mu50
gaccagucgcauauuuug

SEQ ID NO: 3993564 - RNA, 17 nt, Staphylococcus aureus subsp. aureus Mu50
gaccauuuuauauuuua

SEQ ID NO: 3993565 - RNA, 14 nt, Staphylococcus aureus subsp. aureus Mu50
gaccggcauauaau

SEQ ID NO: 3993566 - RNA, 23 nt, Staphylococcus aureus subsp. aureus Mu50
gaccuacaauuuuccuuccaaua

SEQ ID NO: 3993567 - RNA, 19 nt, Staphylococcus aureus subsp. aureus Mu50
gacgaaacacacuaaaagc

SEQ ID NO: 3993568 - RNA, 20 nt, Staphylococcus aureus subsp. aureus Mu50
gacgaaacacacuaaaagcu

SEQ ID NO: 3993569 - RNA, 21 nt, Staphylococcus aureus subsp. aureus Mu50
gacgaucuucaugaacagcau

SEQ ID NO: 3993570 - RNA, 19 nt, Staphylococcus aureus subsp. aureus Mu50
gacgauuuauuaguuuuua

SEQ ID NO: 3993571 - RNA, 14 nt, Staphylococcus aureus subsp. aureus Mu50
gacgguauuuucaa

SEQ ID NO: 3993572 - RNA, 14 nt, Staphylococcus aureus subsp. aureus Mu50
gacguaauuaauag

SEQ ID NO: 3993573 - RNA, 17 nt, Staphylococcus aureus subsp. aureus Mu50
gacgugucauuggugga

SEQ ID NO: 3993574 - RNA, 15 nt, Staphylococcus aureus subsp. aureus Mu50
gacguucauggauuc

SEQ ID NO: 3993575 - RNA, 17 nt, Staphylococcus aureus subsp. aureus Mu50
gacguugugucaugcug

SEQ ID NO: 3993576 - RNA, 12 nt, Staphylococcus aureus subsp. aureus Mu50
gacguuuuccau

SEQ ID NO: 3993577 - RNA, 15 nt, Staphylococcus aureus subsp. aureus Mu50
gacuaaaaagaagcu

SEQ ID NO: 3993578 - RNA, 17 nt, Staphylococcus aureus subsp. aureus Mu50
gacuaaccacauuauaa

SEQ ID NO: 3993579 - RNA, 17 nt, Staphylococcus aureus subsp. aureus Mu50
gacuacaaguuuauaau

SEQ ID NO: 3993580 - RNA, 16 nt, Staphylococcus aureus subsp. aureus Mu50
gacuacuaaucuuagu

SEQ ID NO: 3993581 - RNA, 11 nt, Staphylococcus aureus subsp. aureus Mu50
gacuacucaau

SEQ ID NO: 3993582 - RNA, 17 nt, Staphylococcus aureus subsp. aureus Mu50
gacuaugcaaaugaaau

SEQ ID NO: 3993583 - RNA, 20 nt, Staphylococcus aureus subsp. aureus Mu50
gacuauuuuugaaaagagcg

SEQ ID NO: 3993584 - RNA, 14 nt, Staphylococcus aureus subsp. aureus Mu50
gacucaagugaauc

SEQ ID NO: 3993585 - RNA, 14 nt, Staphylococcus aureus subsp. aureus Mu50
gacucacuucuuaa

SEQ ID NO: 3993586 - RNA, 13 nt, Staphylococcus aureus subsp. aureus Mu50
gacucaguuauau

SEQ ID NO: 3993587 - RNA, 14 nt, Staphylococcus aureus subsp. aureus Mu50
gacucaguuauauu

SEQ ID NO: 3993588 - RNA, 19 nt, Staphylococcus aureus subsp. aureus Mu50
gacugaaagaaaagugaaa

SEQ ID NO: 3993589 - RNA, 19 nt, Staphylococcus aureus subsp. aureus Mu50
gacugaacgaaaaugcgcu

SEQ ID NO: 3993590 - RNA, 20 nt, Staphylococcus aureus subsp. aureus Mu50
gacugaacgaaaaugcgcuu

SEQ ID NO: 3993591 - RNA, 15 nt, Staphylococcus aureus subsp. aureus Mu50
gacugacuaauaaaa

SEQ ID NO: 3993592 - RNA, 19 nt, Staphylococcus aureus subsp. aureus Mu50
gacugagaaaaauauuucu

SEQ ID NO: 3993593 - RNA, 20 nt, Staphylococcus aureus subsp. aureus Mu50
gacugauucaccagguuuuu

SEQ ID NO: 3993594 - RNA, 18 nt, Staphylococcus aureus subsp. aureus Mu50
gacugccaauaaaaugca

SEQ ID NO: 3993595 - RNA, 23 nt, Staphylococcus aureus subsp. aureus Mu50
gacuguuuuuuuguuugguguga

SEQ ID NO: 3993596 - RNA, 23 nt, Staphylococcus aureus subsp. aureus Mu50
gacuuaacuuaagcucauuucaa

SEQ ID NO: 3993597 - RNA, 23 nt, Staphylococcus aureus subsp. aureus Mu50
gacuuaauaucauauucaaaaua

SEQ ID NO: 3993598 - RNA, 18 nt, Staphylococcus aureus subsp. aureus Mu50
gacuuauuuuucaucauu

SEQ ID NO: 3993599 - RNA, 18 nt, Staphylococcus aureus subsp. aureus Mu50
gacuucuaucuucacacu

SEQ ID NO: 3993600 - RNA, 15 nt, Staphylococcus aureus subsp. aureus Mu50
gacuucuuucaauua

SEQ ID NO: 3993601 - RNA, 15 nt, Staphylococcus aureus subsp. aureus Mu50
gacuugauaaaaaau

SEQ ID NO: 3993602 - RNA, 16 nt, Staphylococcus aureus subsp. aureus Mu50
gacuugauagcauuuc

SEQ ID NO: 3993603 - RNA, 22 nt, Staphylococcus aureus subsp. aureus Mu50
gacuugugcgcgacguuuaaau

SEQ ID NO: 3993604 - RNA, 17 nt, Staphylococcus aureus subsp. aureus Mu50
gacuuuaaaguuaaagu

SEQ ID NO: 3993605 - RNA, 18 nt, Staphylococcus aureus subsp. aureus Mu50
gacuuuuaaaaaacauac

SEQ ID NO: 3993606 - RNA, 23 nt, Staphylococcus aureus subsp. aureus Mu50
gacuuuuaaaaaacauaccugca

SEQ ID NO: 3993607 - RNA, 17 nt, Staphylococcus aureus subsp. aureus Mu50
gacuuuuagauuaucuu

SEQ ID NO: 3993608 - RNA, 19 nt, Staphylococcus aureus subsp. aureus Mu50
gacuuuuagauuaucuuuc

SEQ ID NO: 3993609 - RNA, 19 nt, Staphylococcus aureus subsp. aureus Mu50
gagaaauucgaaaagaaau

SEQ ID NO: 3993610 - RNA, 14 nt, Staphylococcus aureus subsp. aureus Mu50
gagaaccuuuaaaa

SEQ ID NO: 3993611 - RNA, 14 nt, Staphylococcus aureus subsp. aureus Mu50
gagaaucaauuauu

SEQ ID NO: 3993612 - RNA, 14 nt, Staphylococcus aureus subsp. aureus Mu50
gagaaucuccauuu

SEQ ID NO: 3993613 - RNA, 16 nt, Staphylococcus aureus subsp. aureus Mu50
gagaaugugcuuguaa

SEQ ID NO: 3993614 - RNA, 17 nt, Staphylococcus aureus subsp. aureus Mu50
gagaaugugcuuguaac

SEQ ID NO: 3993615 - RNA, 13 nt, Staphylococcus aureus subsp. aureus Mu50
gagaauuaauaau

SEQ ID NO: 3993616 - RNA, 15 nt, Staphylococcus aureus subsp. aureus Mu50
gagacaauaaugcac

SEQ ID NO: 3993617 - RNA, 17 nt, Staphylococcus aureus subsp. aureus Mu50
gagacauuuuaucugaa

SEQ ID NO: 3993618 - RNA, 15 nt, Staphylococcus aureus subsp. aureus Mu50
gagacuguuuuuuug

SEQ ID NO: 3993619 - RNA, 16 nt, Staphylococcus aureus subsp. aureus Mu50
gagaguaauguuccau

SEQ ID NO: 3993620 - RNA, 14 nt, Staphylococcus aureus subsp. aureus Mu50
gagauauaaaggaa

SEQ ID NO: 3993621 - RNA, 21 nt, Staphylococcus aureus subsp. aureus Mu50
gagauauauuaauguuugaug

SEQ ID NO: 3993622 - RNA, 13 nt, Staphylococcus aureus subsp. aureus Mu50
gagaucuaacaau

SEQ ID NO: 3993623 - RNA, 16 nt, Staphylococcus aureus subsp. aureus Mu50
gagaugaaagauacug

SEQ ID NO: 3993624 - RNA, 20 nt, Staphylococcus aureus subsp. aureus Mu50
gagauuaucuuuagacauaa

SEQ ID NO: 3993625 - RNA, 21 nt, Staphylococcus aureus subsp. aureus Mu50
gagauuauuuuuuuaaaucua

SEQ ID NO: 3993626 - RNA, 18 nt, Staphylococcus aureus subsp. aureus Mu50
gagauucucgguuuuuuc

SEQ ID NO: 3993627 - RNA, 14 nt, Staphylococcus aureus subsp. aureus Mu50
gagauugagaauuc

SEQ ID NO: 3993628 - RNA, 19 nt, Staphylococcus aureus subsp. aureus Mu50
gagcaagucuucuaaaaaa

SEQ ID NO: 3993629 - RNA, 14 nt, Staphylococcus aureus subsp. aureus Mu50
gagcaauucuucaa

SEQ ID NO: 3993630 - RNA, 15 nt, Staphylococcus aureus subsp. aureus Mu50
gagcaauucuucaau

SEQ ID NO: 3993631 - RNA, 14 nt, Staphylococcus aureus subsp. aureus Mu50
gagcacgagaaaug

SEQ ID NO: 3993632 - RNA, 14 nt, Staphylococcus aureus subsp. aureus Mu50
gagcacuuaauaag

SEQ ID NO: 3993633 - RNA, 21 nt, Staphylococcus aureus subsp. aureus Mu50
gagcccgagacauaaauuaau

SEQ ID NO: 3993634 - RNA, 15 nt, Staphylococcus aureus subsp. aureus Mu50
gagcggaaauaugau

SEQ ID NO: 3993635 - RNA, 17 nt, Staphylococcus aureus subsp. aureus Mu50
gauacuauacuuaaaau

SEQ ID NO: 3993636 - RNA, 15 nt, Staphylococcus aureus subsp. aureus Mu50
gauacugccauaugu

SEQ ID NO: 3993637 - RNA, 23 nt, Staphylococcus aureus subsp. aureus Mu50
gauacuggguuuuaccauaaauu

SEQ ID NO: 3993638 - RNA, 21 nt, Staphylococcus aureus subsp. aureus Mu50
gauacuguauuuauaauuuca

SEQ ID NO: 3993639 - RNA, 16 nt, Staphylococcus aureus subsp. aureus Mu50
gauacuuuuaaauuau

SEQ ID NO: 3993640 - RNA, 14 nt, Staphylococcus aureus subsp. aureus Mu50
gauagaaaggcagg

SEQ ID NO: 3993641 - RNA, 22 nt, Staphylococcus aureus subsp. aureus Mu50
gauagaaguuuuuugauuagua

SEQ ID NO: 3993642 - RNA, 15 nt, Staphylococcus aureus subsp. aureus Mu50
gauagaauacuaaaa

SEQ ID NO: 3993643 - RNA, 20 nt, Staphylococcus aureus subsp. aureus Mu50
gauagaauacuaaaaguguu

SEQ ID NO: 3993644 - RNA, 14 nt, Staphylococcus aureus subsp. aureus Mu50
gauagaugaaaaug

SEQ ID NO: 3993645 - RNA, 15 nt, Staphylococcus aureus subsp. aureus Mu50
gauagaugauacauu

SEQ ID NO: 3993646 - RNA, 22 nt, Staphylococcus aureus subsp. aureus Mu50
gauagaugcuggcuuaguaguu

SEQ ID NO: 3993647 - RNA, 14 nt, Staphylococcus aureus subsp. aureus Mu50
gauagccuuuucua

SEQ ID NO: 3993648 - RNA, 19 nt, Staphylococcus aureus subsp. aureus Mu50
gauagcggauuuauuuuuu

SEQ ID NO: 3993649 - RNA, 14 nt, Staphylococcus aureus subsp. aureus Mu50
gauagcuaaacauu

SEQ ID NO: 3993650 - RNA, 16 nt, Staphylococcus aureus subsp. aureus Mu50
gauagcugcuauccuu

SEQ ID NO: 3993651 - RNA, 16 nt, Staphylococcus aureus subsp. aureus Mu50
gauagucauaacgauu

SEQ ID NO: 3993652 - RNA, 16 nt, Staphylococcus aureus subsp. aureus Mu50
gauauaaaaaaccgua

SEQ ID NO: 3993653 - RNA, 16 nt, Staphylococcus aureus subsp. aureus Mu50
gauauaaaaagugaaa

SEQ ID NO: 3993654 - RNA, 23 nt, Staphylococcus aureus subsp. aureus Mu50
gauauaaaaagugaaaguauuag

SEQ ID NO: 3993655 - RNA, 14 nt, Staphylococcus aureus subsp. aureus Mu50
gauauaaacauuua

SEQ ID NO: 3993656 - RNA, 20 nt, Staphylococcus aureus subsp. aureus Mu50
gauauaacauuaaaaugaua

SEQ ID NO: 3993657 - RNA, 19 nt, Staphylococcus aureus subsp. aureus Mu50
gauauaagauucauauuua

SEQ ID NO: 3993658 - RNA, 17 nt, Staphylococcus aureus subsp. aureus Mu50
gauauaaugaaguuaug

SEQ ID NO: 3993659 - RNA, 15 nt, Staphylococcus aureus subsp. aureus Mu50
gauauacgaauccuc

SEQ ID NO: 3993660 - RNA, 20 nt, Staphylococcus aureus subsp. aureus Mu50
gauauagaccguugaaaugu

SEQ ID NO: 3993661 - RNA, 22 nt, Staphylococcus aureus subsp. aureus Mu50
gauauagugcuuguuuauuaca

SEQ ID NO: 3993662 - RNA, 20 nt, Staphylococcus aureus subsp. aureus Mu50
gauauauguaacauaaagcu

SEQ ID NO: 3993663 - RNA, 21 nt, Staphylococcus aureus subsp. aureus Mu50
gauaucaaaguacuaacguuu

SEQ ID NO: 3993664 - RNA, 13 nt, Staphylococcus aureus subsp. aureus Mu50
gauaucaauguau

SEQ ID NO: 3993665 - RNA, 19 nt, Staphylococcus aureus subsp. aureus Mu50
gauaucagcuaaguuaaau

SEQ ID NO: 3993666 - RNA, 21 nt, Staphylococcus aureus subsp. aureus Mu50
gauaucuaagucgauaaguuu

SEQ ID NO: 3993667 - RNA, 15 nt, Staphylococcus aureus subsp. aureus Mu50
gauaucugaaguaga

SEQ ID NO: 3993668 - RNA, 20 nt, Staphylococcus aureus subsp. aureus Mu50
gauaucugacauuucaucaa

SEQ ID NO: 3993669 - RNA, 21 nt, Staphylococcus aureus subsp. aureus Mu50
gauaucuuaaucuaaaaauag

SEQ ID NO: 3993670 - RNA, 19 nt, Staphylococcus aureus subsp. aureus Mu50
gauaucuuuuaauucuuaa

SEQ ID NO: 3993671 - RNA, 21 nt, Staphylococcus aureus subsp. aureus Mu50
gauaucuuuuccaaaacaaaa

SEQ ID NO: 3993672 - RNA, 19 nt, Staphylococcus aureus subsp. aureus Mu50
gauaugcucucuucaaagu

SEQ ID NO: 3993673 - RNA, 13 nt, Staphylococcus aureus subsp. aureus Mu50
gauauguuuauau

SEQ ID NO: 3993674 - RNA, 20 nt, Staphylococcus aureus subsp. aureus Mu50
gauauguuuggauaucuuug

SEQ ID NO: 3993675 - RNA, 22 nt, Staphylococcus aureus subsp. aureus Mu50
gauauuaauugaaaaaccaagu

SEQ ID NO: 3993676 - RNA, 13 nt, Staphylococcus aureus subsp. aureus Mu50
gauauuacauaua

SEQ ID NO: 3993677 - RNA, 16 nt, Staphylococcus aureus subsp. aureus Mu50
gauauuaggcuuaaau

SEQ ID NO: 3993678 - RNA, 17 nt, Staphylococcus aureus subsp. aureus Mu50
gauauuaggcuuaaaua

SEQ ID NO: 3993679 - RNA, 21 nt, Staphylococcus aureus subsp. aureus Mu50
gauauuauaaaaacagcagug

SEQ ID NO: 3993680 - RNA, 19 nt, Staphylococcus aureus subsp. aureus Mu50
gauauucuaaaaaauuaaa

SEQ ID NO: 3993681 - RNA, 16 nt, Staphylococcus aureus subsp. aureus Mu50
gauauugaucugauuu

SEQ ID NO: 3993682 - RNA, 11 nt, Staphylococcus aureus subsp. aureus Mu50
gauauugauug

SEQ ID NO: 3993683 - RNA, 11 nt, Staphylococcus aureus subsp. aureus Mu50
gauauuuagaa

SEQ ID NO: 3993684 - RNA, 22 nt, Staphylococcus aureus subsp. aureus Mu50
gauauuuagaauaagaaauaaa

SEQ ID NO: 3993685 - RNA, 18 nt, Staphylococcus aureus subsp. aureus Mu50
gauauuucaucugacuga

SEQ ID NO: 3993686 - RNA, 18 nt, Staphylococcus aureus subsp. aureus Mu50
gauauuucuaaauugucg

SEQ ID NO: 3993687 - RNA, 13 nt, Staphylococcus aureus subsp. aureus Mu50
gauauuugaucgu

SEQ ID NO: 3993688 - RNA, 22 nt, Staphylococcus aureus subsp. aureus Mu50
gauauuuuaaaaaguaauuaau

SEQ ID NO: 3993689 - RNA, 22 nt, Staphylococcus aureus subsp. aureus Mu50
gauauuuucuucucaacaaauc

SEQ ID NO: 3993690 - RNA, 15 nt, Staphylococcus aureus subsp. aureus Mu50
gaucaacuauauaua

SEQ ID NO: 3993691 - RNA, 17 nt, Staphylococcus aureus subsp. aureus Mu50
gaucaacugaaauuuuu

SEQ ID NO: 3993692 - RNA, 16 nt, Staphylococcus aureus subsp. aureus Mu50
gaucaagcugagcuuu

SEQ ID NO: 3993693 - RNA, 14 nt, Staphylococcus aureus subsp. aureus Mu50
gaucaagugcagau

SEQ ID NO: 3993694 - RNA, 24 nt, Staphylococcus aureus subsp. aureus Mu50
gaucaauuaaacuuaagaauacau

SEQ ID NO: 3993695 - RNA, 18 nt, Staphylococcus aureus subsp. aureus Mu50
gaucacgauaauguauau

SEQ ID NO: 3993696 - RNA, 19 nt, Staphylococcus aureus subsp. aureus Mu50
gaucacuuacugugaaaau

SEQ ID NO: 3993697 - RNA, 15 nt, Staphylococcus aureus subsp. aureus Mu50
gaucauaaucauaaa

SEQ ID NO: 3993698 - RNA, 14 nt, Staphylococcus aureus subsp. aureus Mu50
gaucaucguauaga

SEQ ID NO: 3993699 - RNA, 17 nt, Staphylococcus aureus subsp. aureus Mu50
gaucaugccuucaugaa

SEQ ID NO: 3993700 - RNA, 23 nt, Staphylococcus aureus subsp. aureus Mu50
gaucaugccuucaugaauaaaua

SEQ ID NO: 3993701 - RNA, 18 nt, Staphylococcus aureus subsp. aureus Mu50
gaucauuagcaauuucau

SEQ ID NO: 3993702 - RNA, 17 nt, Staphylococcus aureus subsp. aureus Mu50
gaucauuaguguagaaa

SEQ ID NO: 3993703 - RNA, 17 nt, Staphylococcus aureus subsp. aureus Mu50
gaucauuauuuagaauu

SEQ ID NO: 3993704 - RNA, 17 nt, Staphylococcus aureus subsp. aureus Mu50
gaucauuuucaacauaa

SEQ ID NO: 3993705 - RNA, 15 nt, Staphylococcus aureus subsp. aureus Mu50
gaucgauacuuuuug

SEQ ID NO: 3993706 - RNA, 14 nt, Staphylococcus aureus subsp. aureus Mu50
gaucgcauguuugu

SEQ ID NO: 3993707 - RNA, 19 nt, Staphylococcus aureus subsp. aureus Mu50
gaucgcccauacuaaauaa

SEQ ID NO: 3993708 - RNA, 13 nt, Staphylococcus aureus subsp. aureus Mu50
gaucgguauuuuc

SEQ ID NO: 3993709 - RNA, 18 nt, Staphylococcus aureus subsp. aureus Mu50
gaucguaacauuagcaug

SEQ ID NO: 3993710 - RNA, 18 nt, Staphylococcus aureus subsp. aureus Mu50
gaucuucaugaacagcau

SEQ ID NO: 3993711 - RNA, 18 nt, Staphylococcus aureus subsp. aureus Mu50
gaucuucccaucuuuuag

SEQ ID NO: 3993712 - RNA, 16 nt, Staphylococcus aureus subsp. aureus Mu50
gaucuuuuccauucau

SEQ ID NO: 3993713 - RNA, 17 nt, Staphylococcus aureus subsp. aureus Mu50
gaucuuuuuuauauuca

SEQ ID NO: 3993714 - RNA, 21 nt, Staphylococcus aureus subsp. aureus Mu50
gaugaaaacuuaaaaaugaaa

SEQ ID NO: 3993715 - RNA, 22 nt, Staphylococcus aureus subsp. aureus Mu50
gaugaaaacuuaaaaaugaaau

SEQ ID NO: 3993716 - RNA, 21 nt, Staphylococcus aureus subsp. aureus Mu50
gaugaaagacugacuaauaaa

SEQ ID NO: 3993717 - RNA, 21 nt, Staphylococcus aureus subsp. aureus Mu50
gaugaaauuguguugaaucaa

SEQ ID NO: 3993718 - RNA, 16 nt, Staphylococcus aureus subsp. aureus Mu50
gaugaacaaaauaaca

SEQ ID NO: 3993719 - RNA, 19 nt, Staphylococcus aureus subsp. aureus Mu50
gaugaacaaaauaacaugu

SEQ ID NO: 3993720 - RNA, 19 nt, Staphylococcus aureus subsp. aureus Mu50
gaugaacauaccugcauau

SEQ ID NO: 3993721 - RNA, 14 nt, Staphylococcus aureus subsp. aureus Mu50
gaugaaccaaaaaa

SEQ ID NO: 3993722 - RNA, 21 nt, Staphylococcus aureus subsp. aureus Mu50
gauugacuaaguuuguuuucu

SEQ ID NO: 3993723 - RNA, 16 nt, Staphylococcus aureus subsp. aureus Mu50
gauugaguugaaaaua

SEQ ID NO: 3993724 - RNA, 22 nt, Staphylococcus aureus subsp. aureus Mu50
gauugauauaaauuaucagaau

SEQ ID NO: 3993725 - RNA, 21 nt, Staphylococcus aureus subsp. aureus Mu50
gauugaucagcucuuaaauca

SEQ ID NO: 3993726 - RNA, 21 nt, Staphylococcus aureus subsp. aureus Mu50
gauugcaaauuaucauuaaau

SEQ ID NO: 3993727 - RNA, 18 nt, Staphylococcus aureus subsp. aureus Mu50
gauugcgagacuguuuuu

SEQ ID NO: 3993728 - RNA, 20 nt, Staphylococcus aureus subsp. aureus Mu50
gauugcucuaauccaaaaua

SEQ ID NO: 3993729 - RNA, 21 nt, Staphylococcus aureus subsp. aureus Mu50
gauuggcuugaaguuguuucu

SEQ ID NO: 3993730 - RNA, 16 nt, Staphylococcus aureus subsp. aureus Mu50
gauuguaccaguaaca

SEQ ID NO: 3993731 - RNA, 17 nt, Staphylococcus aureus subsp. aureus Mu50
gauuguauuuaauaagu

SEQ ID NO: 3993732 - RNA, 20 nt, Staphylococcus aureus subsp. aureus Mu50
gauuguuauuauaaacuaca

SEQ ID NO: 3993733 - RNA, 16 nt, Staphylococcus aureus subsp. aureus Mu50
gauuguuucaccagcu

SEQ ID NO: 3993734 - RNA, 23 nt, Staphylococcus aureus subsp. aureus Mu50
gauuguuucaccagcuuguaaau

SEQ ID NO: 3993735 - RNA, 22 nt, Staphylococcus aureus subsp. aureus Mu50
gauuuaaaaaauuuaauguuuu

SEQ ID NO: 3993736 - RNA, 23 nt, Staphylococcus aureus subsp. aureus Mu50
gauuuaaaaaauuuaauguuuuc

SEQ ID NO: 3993737 - RNA, 19 nt, Staphylococcus aureus subsp. aureus Mu50
gauuuaaaaaguuaauaaa

SEQ ID NO: 3993738 - RNA, 21 nt, Staphylococcus aureus subsp. aureus Mu50
gauuuaaaauauaaauuucuu

SEQ ID NO: 3993739 - RNA, 22 nt, Staphylococcus aureus subsp. aureus Mu50
gauuuaacauaaaaaugcucaa

SEQ ID NO: 3993740 - RNA, 16 nt, Staphylococcus aureus subsp. aureus Mu50
gauuuaaguuuauaau

SEQ ID NO: 3993741 - RNA, 19 nt, Staphylococcus aureus subsp. aureus Mu50
gauuuaauaaagugucuaa

SEQ ID NO: 3993742 - RNA, 11 nt, Staphylococcus aureus subsp. aureus Mu50
gauuuaauaau

SEQ ID NO: 3993743 - RNA, 21 nt, Staphylococcus aureus subsp. aureus Mu50
gauuuaguuuuuuuaaaguuu

SEQ ID NO: 3993744 - RNA, 14 nt, Staphylococcus aureus subsp. aureus Mu50
gauuuaucauuauu

SEQ ID NO: 3993745 - RNA, 13 nt, Staphylococcus aureus subsp. aureus Mu50
gauuuauuauuac

SEQ ID NO: 3993746 - RNA, 18 nt, Staphylococcus aureus subsp. aureus Mu50
gauuuauuuuuuucuuca

SEQ ID NO: 3993747 - RNA, 14 nt, Staphylococcus aureus subsp. aureus Mu50
gauuucaaugagaa

SEQ ID NO: 3993748 - RNA, 16 nt, Staphylococcus aureus subsp. aureus Mu50
gauuucacuucauaaa

SEQ ID NO: 3993749 - RNA, 15 nt, Staphylococcus aureus subsp. aureus Mu50
gauuucacuucuaaa

SEQ ID NO: 3993750 - RNA, 22 nt, Staphylococcus aureus subsp. aureus Mu50
gauuucacuugaccacuuuugu

SEQ ID NO: 3993751 - RNA, 17 nt, Staphylococcus aureus subsp. aureus Mu50
gauuuccucgguuuuau

SEQ ID NO: 3993752 - RNA, 20 nt, Staphylococcus aureus subsp. aureus Mu50
gauuucuaauugaaaucauc

SEQ ID NO: 3993753 - RNA, 20 nt, Staphylococcus aureus subsp. aureus Mu50
gauuucuaguuuaucuucag

SEQ ID NO: 3993754 - RNA, 15 nt, Staphylococcus aureus subsp. aureus Mu50
gauuucuaucaaaua

SEQ ID NO: 3993755 - RNA, 17 nt, Staphylococcus aureus subsp. aureus Mu50
gauuucuaucaaauaau

SEQ ID NO: 3993756 - RNA, 16 nt, Staphylococcus aureus subsp. aureus Mu50
gauuugauaagugaug

SEQ ID NO: 3993757 - RNA, 14 nt, Staphylococcus aureus subsp. aureus Mu50
gauuugcaccuaua

SEQ ID NO: 3993758 - RNA, 23 nt, Staphylococcus aureus subsp. aureus Mu50
gauuugccaaaaguuauauaaau

SEQ ID NO: 3993759 - RNA, 16 nt, Staphylococcus aureus subsp. aureus Mu50
gauuuuaaaagauaaa

SEQ ID NO: 3993760 - RNA, 17 nt, Staphylococcus aureus subsp. aureus Mu50
gauuuuaaaagauaaau

SEQ ID NO: 3993761 - RNA, 20 nt, Staphylococcus aureus subsp. aureus Mu50
gauuuuaaaagauaaauaaa

SEQ ID NO: 3993762 - RNA, 17 nt, Staphylococcus aureus subsp. aureus Mu50
gauuuuaaagaaaaguu

SEQ ID NO: 3993763 - RNA, 13 nt, Staphylococcus aureus subsp. aureus Mu50
gauuuuauaucuu

SEQ ID NO: 3993764 - RNA, 20 nt, Staphylococcus aureus subsp. aureus Mu50
gauuuucuuuaauaacuaaa

SEQ ID NO: 3993765 - RNA, 15 nt, Staphylococcus aureus subsp. aureus Mu50
gauuuugaauaaaaa

SEQ ID NO: 3993766 - RNA, 22 nt, Staphylococcus aureus subsp. aureus Mu50
gauuuugcugccaaaaaguauu

SEQ ID NO: 3993767 - RNA, 12 nt, Staphylococcus aureus subsp. aureus Mu50
gauuuuguuuca

SEQ ID NO: 3993768 - RNA, 13 nt, Staphylococcus aureus subsp. aureus Mu50
gauuuuuaaaaug

SEQ ID NO: 3993769 - RNA, 13 nt, Staphylococcus aureus subsp. aureus Mu50
gauuuuuaauaau

SEQ ID NO: 3993770 - RNA, 16 nt, Staphylococcus aureus subsp. aureus Mu50
gauuuuucauauuuuu

SEQ ID NO: 3993771 - RNA, 13 nt, Staphylococcus aureus subsp. aureus Mu50
gauuuuucuuaua

SEQ ID NO: 3993772 - RNA, 17 nt, Staphylococcus aureus subsp. aureus Mu50
gauuuuuguaauugaug

SEQ ID NO: 3993773 - RNA, 13 nt, Staphylococcus aureus subsp. aureus Mu50
gcaaaaauacuuu

SEQ ID NO: 3993774 - RNA, 12 nt, Staphylococcus aureus subsp. aureus Mu50
gcaaaacaauau

SEQ ID NO: 3993775 - RNA, 16 nt, Staphylococcus aureus subsp. aureus Mu50
gcaaaacgcauuucau

SEQ ID NO: 3993776 - RNA, 22 nt, Staphylococcus aureus subsp. aureus Mu50
gcaaaacgcauuucauguguca

SEQ ID NO: 3993777 - RNA, 14 nt, Staphylococcus aureus subsp. aureus Mu50
gcaaaagcgcaggc

SEQ ID NO: 3993778 - RNA, 19 nt, Staphylococcus aureus subsp. aureus Mu50
gcaaaauacgauuuguuca

SEQ ID NO: 3993779 - RNA, 21 nt, Staphylococcus aureus subsp. aureus Mu50
gcaaaauuauguaaaaaauau

SEQ ID NO: 3993780 - RNA, 18 nt, Staphylococcus aureus subsp. aureus Mu50
gcaaacacaguacaaaua

SEQ ID NO: 3993781 - RNA, 18 nt, Staphylococcus aureus subsp. aureus Mu50
gcaaacggcccaacugga

SEQ ID NO: 3993782 - RNA, 15 nt, Staphylococcus aureus subsp. aureus Mu50
gcaaagaauccuuaa

SEQ ID NO: 3993783 - RNA, 13 nt, Staphylococcus aureus subsp. aureus Mu50
gcaaagacucaau

SEQ ID NO: 3993784 - RNA, 14 nt, Staphylococcus aureus subsp. aureus Mu50
gcaaagcuucauuu

SEQ ID NO: 3993785 - RNA, 14 nt, Staphylococcus aureus subsp. aureus Mu50
gcaaaguaacaaua

SEQ ID NO: 3993786 - RNA, 19 nt, Staphylococcus aureus subsp. aureus Mu50
gcaaagucauuaaauguac

SEQ ID NO: 3993787 - RNA, 15 nt, Staphylococcus aureus subsp. aureus Mu50
gcaaauaaaaaaguu

SEQ ID NO: 3993788 - RNA, 17 nt, Staphylococcus aureus subsp. aureus Mu50
gcaaauaaaaucauaac

SEQ ID NO: 3993789 - RNA, 11 nt, Staphylococcus aureus subsp. aureus Mu50
gcaaauacuuc

SEQ ID NO: 3993790 - RNA, 13 nt, Staphylococcus aureus subsp. aureus Mu50
gcaaauauuaaau

SEQ ID NO: 3993791 - RNA, 14 nt, Staphylococcus aureus subsp. aureus Mu50
gcaaauauuaaauu

SEQ ID NO: 3993792 - RNA, 16 nt, Staphylococcus aureus subsp. aureus Mu50
gcaaauauuauuaaau

SEQ ID NO: 3993793 - RNA, 19 nt, Staphylococcus aureus subsp. aureus Mu50
gcaaauauuauuaaaucaa

SEQ ID NO: 3993794 - RNA, 13 nt, Staphylococcus aureus subsp. aureus Mu50
gcaaaucaaacaa

SEQ ID NO: 3993795 - RNA, 22 nt, Staphylococcus aureus subsp. aureus Mu50
gcaaaucccuucucaacgauaa

SEQ ID NO: 3993796 - RNA, 18 nt, Staphylococcus aureus subsp. aureus Mu50
gcaaauuauauagaaaac

SEQ ID NO: 3993797 - RNA, 13 nt, Staphylococcus aureus subsp. aureus Mu50
gcaaauuaucauu

SEQ ID NO: 3993798 - RNA, 14 nt, Staphylococcus aureus subsp. aureus Mu50
gcaaauuaucauua

SEQ ID NO: 3993799 - RNA, 17 nt, Staphylococcus aureus subsp. aureus Mu50
gcaaauuaucauuaaau

SEQ ID NO: 3993800 - RNA, 20 nt, Staphylococcus aureus subsp. aureus Mu50
gcaacaaacgcugauuuaau

SEQ ID NO: 3993801 - RNA, 12 nt, Staphylococcus aureus subsp. aureus Mu50
gcaacauauuuu

SEQ ID NO: 3993802 - RNA, 22 nt, Staphylococcus aureus subsp. aureus Mu50
gcaacauauuuucacaaucaua

SEQ ID NO: 3993803 - RNA, 13 nt, Staphylococcus aureus subsp. aureus Mu50
gcaacauuaaauu

SEQ ID NO: 3993804 - RNA, 23 nt, Staphylococcus aureus subsp. aureus Mu50
gcaacgauaccaaauauauuuuu

SEQ ID NO: 3993805 - RNA, 15 nt, Staphylococcus aureus subsp. aureus Mu50
gcaacgguuugaaaa

SEQ ID NO: 3993806 - RNA, 21 nt, Staphylococcus aureus subsp. aureus Mu50
gcaacuaaaacuaucugauua

SEQ ID NO: 3993807 - RNA, 13 nt, Staphylococcus aureus subsp. aureus Mu50
gcaacuuauaaua

SEQ ID NO: 3993808 - RNA, 21 nt, Staphylococcus aureus subsp. aureus Mu50
gcaagaauagauugauuguau

SEQ ID NO: 3993809 - RNA, 13 nt, Staphylococcus aureus subsp. aureus Mu50
gcaagauaauagc

SEQ ID NO: 3993810 - RNA, 15 nt, Staphylococcus aureus subsp. aureus Mu50
gcaugcgcaaaagcg

SEQ ID NO: 3993811 - RNA, 16 nt, Staphylococcus aureus subsp. aureus Mu50
gcaugcuucucaauuu

SEQ ID NO: 3993812 - RNA, 17 nt, Staphylococcus aureus subsp. aureus Mu50
gcauguccugaauguuc

SEQ ID NO: 3993813 - RNA, 15 nt, Staphylococcus aureus subsp. aureus Mu50
gcauuaaauuccaug

SEQ ID NO: 3993814 - RNA, 18 nt, Staphylococcus aureus subsp. aureus Mu50
gcauuaagaugauugucu

SEQ ID NO: 3993815 - RNA, 13 nt, Staphylococcus aureus subsp. aureus Mu50
gcauuaaugauuc

SEQ ID NO: 3993816 - RNA, 21 nt, Staphylococcus aureus subsp. aureus Mu50
gcauuaauguucaauuuauau

SEQ ID NO: 3993817 - RNA, 13 nt, Staphylococcus aureus subsp. aureus Mu50
gcauuaauuucau

SEQ ID NO: 3993818 - RNA, 17 nt, Staphylococcus aureus subsp. aureus Mu50
gcauuacgccaccaguu

SEQ ID NO: 3993819 - RNA, 15 nt, Staphylococcus aureus subsp. aureus Mu50
gcauuacuacaaacu

SEQ ID NO: 3993820 - RNA, 18 nt, Staphylococcus aureus subsp. aureus Mu50
gcauuacuacuuuauaaa

SEQ ID NO: 3993821 - RNA, 18 nt, Staphylococcus aureus subsp. aureus Mu50
gcauuacuaucuucauca

SEQ ID NO: 3993822 - RNA, 20 nt, Staphylococcus aureus subsp. aureus Mu50
gcauuacuaucuucaucaua

SEQ ID NO: 3993823 - RNA, 21 nt, Staphylococcus aureus subsp. aureus Mu50
gcauuauagaugacuguagaa

SEQ ID NO: 3993824 - RNA, 16 nt, Staphylococcus aureus subsp. aureus Mu50
gcauuauuauuucauu

SEQ ID NO: 3993825 - RNA, 20 nt, Staphylococcus aureus subsp. aureus Mu50
gcauuauugccuaaccuguu

SEQ ID NO: 3993826 - RNA, 15 nt, Staphylococcus aureus subsp. aureus Mu50
gcauucaguuaaugu

SEQ ID NO: 3993827 - RNA, 16 nt, Staphylococcus aureus subsp. aureus Mu50
gcauuccuaauuauau

SEQ ID NO: 3993828 - RNA, 19 nt, Staphylococcus aureus subsp. aureus Mu50
gcauugccccaucuauuag

SEQ ID NO: 3993829 - RNA, 20 nt, Staphylococcus aureus subsp. aureus Mu50
gcauuguaauaccaauuuuu

SEQ ID NO: 3993830 - RNA, 16 nt, Staphylococcus aureus subsp. aureus Mu50
gcauuuaaacaaagcu

SEQ ID NO: 3993831 - RNA, 22 nt, Staphylococcus aureus subsp. aureus Mu50
gcauuuaaauauaaaccagcug

SEQ ID NO: 3993832 - RNA, 22 nt, Staphylococcus aureus subsp. aureus Mu50
gcauuuagacuuggauaaaaau

SEQ ID NO: 3993833 - RNA, 15 nt, Staphylococcus aureus subsp. aureus Mu50
gcauuucuuuauuag

SEQ ID NO: 3993834 - RNA, 17 nt, Staphylococcus aureus subsp. aureus Mu50
gcauuuguaaacaguau

SEQ ID NO: 3993835 - RNA, 15 nt, Staphylococcus aureus subsp. aureus Mu50
gcauuuuaaauaaaa

SEQ ID NO: 3993836 - RNA, 19 nt, Staphylococcus aureus subsp. aureus Mu50
gcauuuuguuucaacauuu

SEQ ID NO: 3993837 - RNA, 14 nt, Staphylococcus aureus subsp. aureus Mu50
gcauuuuucaauua

SEQ ID NO: 3993838 - RNA, 13 nt, Staphylococcus aureus subsp. aureus Mu50
gccaacaguaauu

SEQ ID NO: 3993839 - RNA, 20 nt, Staphylococcus aureus subsp. aureus Mu50
gccaacaucuucaacauaac

SEQ ID NO: 3993840 - RNA, 14 nt, Staphylococcus aureus subsp. aureus Mu50
gccaagaagacauu

SEQ ID NO: 3993841 - RNA, 23 nt, Staphylococcus aureus subsp. aureus Mu50
gccaaucacaauauaacaucaaa

SEQ ID NO: 3993842 - RNA, 21 nt, Staphylococcus aureus subsp. aureus Mu50
gccaaucuauugcaauauagu

SEQ ID NO: 3993843 - RNA, 22 nt, Staphylococcus aureus subsp. aureus Mu50
gccaccuuguuuaaguuuuuca

SEQ ID NO: 3993844 - RNA, 14 nt, Staphylococcus aureus subsp. aureus Mu50
gccaggugauugac

SEQ ID NO: 3993845 - RNA, 14 nt, Staphylococcus aureus subsp. aureus Mu50
gccauaaucuucau

SEQ ID NO: 3993846 - RNA, 18 nt, Staphylococcus aureus subsp. aureus Mu50
gccauacccauauuaaau

SEQ ID NO: 3993847 - RNA, 17 nt, Staphylococcus aureus subsp. aureus Mu50
gccauagaaaugugcug

SEQ ID NO: 3993848 - RNA, 16 nt, Staphylococcus aureus subsp. aureus Mu50
gccauaguaauaaugg

SEQ ID NO: 3993849 - RNA, 19 nt, Staphylococcus aureus subsp. aureus Mu50
gccauauucauauuacuuc

SEQ ID NO: 3993850 - RNA, 16 nt, Staphylococcus aureus subsp. aureus Mu50
gccaucaauauugaua

SEQ ID NO: 3993851 - RNA, 21 nt, Staphylococcus aureus subsp. aureus Mu50
gccaucaauauugauaucgaa

SEQ ID NO: 3993852 - RNA, 21 nt, Staphylococcus aureus subsp. aureus Mu50
gccaucuaggucacuuuuaug

SEQ ID NO: 3993853 - RNA, 11 nt, Staphylococcus aureus subsp. aureus Mu50
gccaucuuuuu

SEQ ID NO: 3993854 - RNA, 22 nt, Staphylococcus aureus subsp. aureus Mu50
gccaucuuuuuuagcugaacca

SEQ ID NO: 3993855 - RNA, 17 nt, Staphylococcus aureus subsp. aureus Mu50
gccaugaaaaggaaaaa

SEQ ID NO: 3993856 - RNA, 23 nt, Staphylococcus aureus subsp. aureus Mu50
gccaugaaaaggaaaaacuuuuc

SEQ ID NO: 3993857 - RNA, 21 nt, Staphylococcus aureus subsp. aureus Mu50
gccaugacguauacaaauuga

SEQ ID NO: 3993858 - RNA, 13 nt, Staphylococcus aureus subsp. aureus Mu50
gccaugauuuaag

SEQ ID NO: 3993859 - RNA, 15 nt, Staphylococcus aureus subsp. aureus Mu50
gccauuaaaauuacg

SEQ ID NO: 3993860 - RNA, 23 nt, Staphylococcus aureus subsp. aureus Mu50
gccauuuuuauuuaacacuucag

SEQ ID NO: 3993861 - RNA, 13 nt, Staphylococcus aureus subsp. aureus Mu50
gcccacaccccaa

SEQ ID NO: 3993862 - RNA, 18 nt, Staphylococcus aureus subsp. aureus Mu50
gcccacaccccaacuugc

SEQ ID NO: 3993863 - RNA, 15 nt, Staphylococcus aureus subsp. aureus Mu50
gcccagaauguguug

SEQ ID NO: 3993864 - RNA, 22 nt, Staphylococcus aureus subsp. aureus Mu50
gcccauucugcagcgacaucuu

SEQ ID NO: 3993865 - RNA, 13 nt, Staphylococcus aureus subsp. aureus Mu50
gccccaacaaaga

SEQ ID NO: 3993866 - RNA, 11 nt, Staphylococcus aureus subsp. aureus Mu50
gccccaacaca

SEQ ID NO: 3993867 - RNA, 15 nt, Staphylococcus aureus subsp. aureus Mu50
gccccaacacagaga

SEQ ID NO: 3993868 - RNA, 16 nt, Staphylococcus aureus subsp. aureus Mu50
gcccccaacacaaaga

SEQ ID NO: 3993869 - RNA, 21 nt, Staphylococcus aureus subsp. aureus Mu50
gcccuagguuuauauaucaca

SEQ ID NO: 3993870 - RNA, 21 nt, Staphylococcus aureus subsp. aureus Mu50
gccgagauuauuauguggaaa

SEQ ID NO: 3993871 - RNA, 19 nt, Staphylococcus aureus subsp. aureus Mu50
gccguauucuuuaccuuua

SEQ ID NO: 3993872 - RNA, 18 nt, Staphylococcus aureus subsp. aureus Mu50
gccguauuucaaauguaa

SEQ ID NO: 3993873 - RNA, 14 nt, Staphylococcus aureus subsp. aureus Mu50
gccguuauuuucaa

SEQ ID NO: 3993874 - RNA, 16 nt, Staphylococcus aureus subsp. aureus Mu50
gccuaaaaauaaaauc

SEQ ID NO: 3993875 - RNA, 17 nt, Staphylococcus aureus subsp. aureus Mu50
gccuaauaauaaaauag

SEQ ID NO: 3993876 - RNA, 14 nt, Staphylococcus aureus subsp. aureus Mu50
gccuauuuaaaaga

SEQ ID NO: 3993877 - RNA, 18 nt, Staphylococcus aureus subsp. aureus Mu50
gccucuaaugauuaaaaa

SEQ ID NO: 3993878 - RNA, 19 nt, Staphylococcus aureus subsp. aureus Mu50
gccuucaauauuucuugcu

SEQ ID NO: 3993879 - RNA, 21 nt, Staphylococcus aureus subsp. aureus Mu50
gccuucuauauaguaaaauaa

SEQ ID NO: 3993880 - RNA, 12 nt, Staphylococcus aureus subsp. aureus Mu50
gccuuucuaaua

SEQ ID NO: 3993881 - RNA, 14 nt, Staphylococcus aureus subsp. aureus Mu50
gccuuuugaauaau

SEQ ID NO: 3993882 - RNA, 15 nt, Staphylococcus aureus subsp. aureus Mu50
gccuuuugaauaauu

SEQ ID NO: 3993883 - RNA, 17 nt, Staphylococcus aureus subsp. aureus Mu50
gccuuuuuuauuguaau

SEQ ID NO: 3993884 - RNA, 20 nt, Staphylococcus aureus subsp. aureus Mu50
gcgaacaugguaucuuuaau

SEQ ID NO: 3993885 - RNA, 19 nt, Staphylococcus aureus subsp. aureus Mu50
gcgaaccgaagcgcaguga

SEQ ID NO: 3993886 - RNA, 14 nt, Staphylococcus aureus subsp. aureus Mu50
gcgaacguuauuuu

SEQ ID NO: 3993887 - RNA, 19 nt, Staphylococcus aureus subsp. aureus Mu50
gcgacauguccauaauauc

SEQ ID NO: 3993888 - RNA, 15 nt, Staphylococcus aureus subsp. aureus Mu50
gcgacauguccuguu

SEQ ID NO: 3993889 - RNA, 23 nt, Staphylococcus aureus subsp. aureus Mu50
gcgacguuuaaaugcccaccaug

SEQ ID NO: 3993890 - RNA, 13 nt, Staphylococcus aureus subsp. aureus Mu50
gcgauaaaguaug

SEQ ID NO: 3993891 - RNA, 15 nt, Staphylococcus aureus subsp. aureus Mu50
gcgaucauuagcaau

SEQ ID NO: 3993892 - RNA, 19 nt, Staphylococcus aureus subsp. aureus Mu50
gcgcaaaagcgcaggcgaa

SEQ ID NO: 3993893 - RNA, 17 nt, Staphylococcus aureus subsp. aureus Mu50
gcgcaagagauaagaaa

SEQ ID NO: 3993894 - RNA, 15 nt, Staphylococcus aureus subsp. aureus Mu50
gcgcagcaaaugcuu

SEQ ID NO: 3993895 - RNA, 14 nt, Staphylococcus aureus subsp. aureus Mu50
gcgccauaaucauu

SEQ ID NO: 3993896 - RNA, 15 nt, Staphylococcus aureus subsp. aureus Mu50
gcgccauaaucauua

SEQ ID NO: 3993897 - RNA, 21 nt, Staphylococcus aureus subsp. aureus Mu50
gcgccuuguucaauucagcaa

SEQ ID NO: 3993898 - RNA, 12 nt, Staphylococcus aureus subsp. aureus Mu50
gcugugucuuuu

SEQ ID NO: 3993899 - RNA, 20 nt, Staphylococcus aureus subsp. aureus Mu50
gcugugucuuuugauuuuuu

SEQ ID NO: 3993900 - RNA, 17 nt, Staphylococcus aureus subsp. aureus Mu50
gcuguucaacaucuuua

SEQ ID NO: 3993901 - RNA, 21 nt, Staphylococcus aureus subsp. aureus Mu50
gcuguuuaguuaauguaaagu

SEQ ID NO: 3993902 - RNA, 13 nt, Staphylococcus aureus subsp. aureus Mu50
gcuguuugauauu

SEQ ID NO: 3993903 - RNA, 14 nt, Staphylococcus aureus subsp. aureus Mu50
gcuguuuuauucaa

SEQ ID NO: 3993904 - RNA, 20 nt, Staphylococcus aureus subsp. aureus Mu50
gcuguuuuuauuauaauaga

SEQ ID NO: 3993905 - RNA, 13 nt, Staphylococcus aureus subsp. aureus Mu50
gcuuaaaccuuaa

SEQ ID NO: 3993906 - RNA, 15 nt, Staphylococcus aureus subsp. aureus Mu50
gcuuaacuuccuuuu

SEQ ID NO: 3993907 - RNA, 19 nt, Staphylococcus aureus subsp. aureus Mu50
gcuuaauuuguuuuaaaua

SEQ ID NO: 3993908 - RNA, 16 nt, Staphylococcus aureus subsp. aureus Mu50
gcuuacaauaaucacu

SEQ ID NO: 3993909 - RNA, 13 nt, Staphylococcus aureus subsp. aureus Mu50
gcuuagauaaauu

SEQ ID NO: 3993910 - RNA, 22 nt, Staphylococcus aureus subsp. aureus Mu50
gcuuagcaguucuauugucagc

SEQ ID NO: 3993911 - RNA, 23 nt, Staphylococcus aureus subsp. aureus Mu50
gcuuagggcuuuguuuucugucc

SEQ ID NO: 3993912 - RNA, 22 nt, Staphylococcus aureus subsp. aureus Mu50
gcuuauauaaacaaaaaucuac

SEQ ID NO: 3993913 - RNA, 17 nt, Staphylococcus aureus subsp. aureus Mu50
gcuuaucaacagcuuca

SEQ ID NO: 3993914 - RNA, 12 nt, Staphylococcus aureus subsp. aureus Mu50
gcuuaucauuac

SEQ ID NO: 3993915 - RNA, 12 nt, Staphylococcus aureus subsp. aureus Mu50
gcuuauugaaaa

SEQ ID NO: 3993916 - RNA, 17 nt, Staphylococcus aureus subsp. aureus Mu50
gcuuauugaaaagauaa

SEQ ID NO: 3993917 - RNA, 21 nt, Staphylococcus aureus subsp. aureus Mu50
gcuuauugaaaagauaaacaa

SEQ ID NO: 3993918 - RNA, 17 nt, Staphylococcus aureus subsp. aureus Mu50
gcuuauuuuuguauucu

SEQ ID NO: 3993919 - RNA, 16 nt, Staphylococcus aureus subsp. aureus Mu50
gcuucaaagucaaaaa

SEQ ID NO: 3993920 - RNA, 15 nt, Staphylococcus aureus subsp. aureus Mu50
gcuucaaauguaaca

SEQ ID NO: 3993921 - RNA, 19 nt, Staphylococcus aureus subsp. aureus Mu50
gcuucaggcauaacuguau

SEQ ID NO: 3993922 - RNA, 20 nt, Staphylococcus aureus subsp. aureus Mu50
gcuucaguuaaaucacugcu

SEQ ID NO: 3993923 - RNA, 22 nt, Staphylococcus aureus subsp. aureus Mu50
gcuucauauuuagguaauacau

SEQ ID NO: 3993924 - RNA, 14 nt, Staphylococcus aureus subsp. aureus Mu50
gcuucauguucuaa

SEQ ID NO: 3993925 - RNA, 22 nt, Staphylococcus aureus subsp. aureus Mu50
gcuucauuaguugcauaaucaa

SEQ ID NO: 3993926 - RNA, 21 nt, Staphylococcus aureus subsp. aureus Mu50
gcuucauuauauaauucuuca

SEQ ID NO: 3993927 - RNA, 21 nt, Staphylococcus aureus subsp. aureus Mu50
gcuuccaauuuaaaaugauuc

SEQ ID NO: 3993928 - RNA, 18 nt, Staphylococcus aureus subsp. aureus Mu50
gcuucgcuagaaccugcu

SEQ ID NO: 3993929 - RNA, 14 nt, Staphylococcus aureus subsp. aureus Mu50
gcuucuaacaaauu

SEQ ID NO: 3993930 - RNA, 16 nt, Staphylococcus aureus subsp. aureus Mu50
gcuucugguucuucaa

SEQ ID NO: 3993931 - RNA, 18 nt, Staphylococcus aureus subsp. aureus Mu50
gcuucuguguuggggccc

SEQ ID NO: 3993932 - RNA, 22 nt, Staphylococcus aureus subsp. aureus Mu50
gcuucuguguuggggcccacac

SEQ ID NO: 3993933 - RNA, 17 nt, Staphylococcus aureus subsp. aureus Mu50
gcuucuuuaaaggaaau

SEQ ID NO: 3993934 - RNA, 16 nt, Staphylococcus aureus subsp. aureus Mu50
gcuugaauaauauauu

SEQ ID NO: 3993935 - RNA, 23 nt, Staphylococcus aureus subsp. aureus Mu50
gcuugagcaucuuuuacugcuuc

SEQ ID NO: 3993936 - RNA, 15 nt, Staphylococcus aureus subsp. aureus Mu50
gcuugauuaacauuu

SEQ ID NO: 3993937 - RNA, 15 nt, Staphylococcus aureus subsp. aureus Mu50
gcuugauuaauuuua

SEQ ID NO: 3993938 - RNA, 17 nt, Staphylococcus aureus subsp. aureus Mu50
gcuugauuaauuuuauc

SEQ ID NO: 3993939 - RNA, 13 nt, Staphylococcus aureus subsp. aureus Mu50
gcuuggauuuuuu

SEQ ID NO: 3993940 - RNA, 14 nt, Staphylococcus aureus subsp. aureus Mu50
gcuugguuaaaguu

SEQ ID NO: 3993941 - RNA, 18 nt, Staphylococcus aureus subsp. aureus Mu50
gcuuguaacaagcauuuu

SEQ ID NO: 3993942 - RNA, 18 nt, Staphylococcus aureus subsp. aureus Mu50
gcuuguaauccuuguucu

SEQ ID NO: 3993943 - RNA, 17 nt, Staphylococcus aureus subsp. aureus Mu50
gcuugugaaugguugau

SEQ ID NO: 3993944 - RNA, 15 nt, Staphylococcus aureus subsp. aureus Mu50
gcuuuaauaaaucgu

SEQ ID NO: 3993945 - RNA, 13 nt, Staphylococcus aureus subsp. aureus Mu50
gcuuuaauauaau

SEQ ID NO: 3993946 - RNA, 12 nt, Staphylococcus aureus subsp. aureus Mu50
gcuuuaauuuga

SEQ ID NO: 3993947 - RNA, 16 nt, Staphylococcus aureus subsp. aureus Mu50
gcuuuagcaauugaau

SEQ ID NO: 3993948 - RNA, 20 nt, Staphylococcus aureus subsp. aureus Mu50
gcuuuaguaguguauucauu

SEQ ID NO: 3993949 - RNA, 19 nt, Staphylococcus aureus subsp. aureus Mu50
gcuuuagucgguguuuucu

SEQ ID NO: 3993950 - RNA, 18 nt, Staphylococcus aureus subsp. aureus Mu50
gcuuuaucaacaaauuuu

SEQ ID NO: 3993951 - RNA, 15 nt, Staphylococcus aureus subsp. aureus Mu50
gcuuuauuuuaucau

SEQ ID NO: 3993952 - RNA, 13 nt, Staphylococcus aureus subsp. aureus Mu50
gcuuucauuaauu

SEQ ID NO: 3993953 - RNA, 16 nt, Staphylococcus aureus subsp. aureus Mu50
gcuuucauuaauuuuu

SEQ ID NO: 3993954 - RNA, 16 nt, Staphylococcus aureus subsp. aureus Mu50
gcuuucguuucuuuua

SEQ ID NO: 3993955 - RNA, 23 nt, Staphylococcus aureus subsp. aureus Mu50
gcuuucuuuuuugcuguauauau

SEQ ID NO: 3993956 - RNA, 19 nt, Staphylococcus aureus subsp. aureus Mu50
gcuuugaagggagcauuuc

SEQ ID NO: 3993957 - RNA, 21 nt, Staphylococcus aureus subsp. aureus Mu50
gcuuugcauacauaucuuuug

SEQ ID NO: 3993958 - RNA, 19 nt, Staphylococcus aureus subsp. aureus Mu50
gcuuugcugcuuuuccagu

SEQ ID NO: 3993959 - RNA, 17 nt, Staphylococcus aureus subsp. aureus Mu50
gcuuuggauuucuuuuu

SEQ ID NO: 3993960 - RNA, 22 nt, Staphylococcus aureus subsp. aureus Mu50
gcuuuguaaaauugugacgcug

SEQ ID NO: 3993961 - RNA, 23 nt, Staphylococcus aureus subsp. aureus Mu50
gcuuugucacgauagauuuauca

SEQ ID NO: 3993962 - RNA, 18 nt, Staphylococcus aureus subsp. aureus Mu50
gcuuuuaaucaaauuauc

SEQ ID NO: 3993963 - RNA, 13 nt, Staphylococcus aureus subsp. aureus Mu50
gcuuuuaugcaug

SEQ ID NO: 3993964 - RNA, 14 nt, Staphylococcus aureus subsp. aureus Mu50
gcuuuuaugcaugc

SEQ ID NO: 3993965 - RNA, 18 nt, Staphylococcus aureus subsp. aureus Mu50
gcuuuuaugcaugcgcaa

SEQ ID NO: 3993966 - RNA, 18 nt, Staphylococcus aureus subsp. aureus Mu50
gcuuuuccauaaauauuu

SEQ ID NO: 3993967 - RNA, 17 nt, Staphylococcus aureus subsp. aureus Mu50
gcuuuuguaaagcuuua

SEQ ID NO: 3993968 - RNA, 15 nt, Staphylococcus aureus subsp. aureus Mu50
gcuuuuuauuuuguu

SEQ ID NO: 3993969 - RNA, 20 nt, Staphylococcus aureus subsp. aureus Mu50
gcuuuuuauuuuguuuaucu

SEQ ID NO: 3993970 - RNA, 23 nt, Staphylococcus aureus subsp. aureus Mu50
gcuuuuuauuuuguuuaucugua

SEQ ID NO: 3993971 - RNA, 15 nt, Staphylococcus aureus subsp. aureus Mu50
gcuuuuucaaauaau

SEQ ID NO: 3993972 - RNA, 18 nt, Staphylococcus aureus subsp. aureus Mu50
gcuuuuucaaauaauaua

SEQ ID NO: 3993973 - RNA, 16 nt, Staphylococcus aureus subsp. aureus Mu50
gcuuuuuuaccagcau

SEQ ID NO: 3993974 - RNA, 17 nt, Staphylococcus aureus subsp. aureus Mu50
gcuuuuuuauucuaaua

SEQ ID NO: 3993975 - RNA, 21 nt, Staphylococcus aureus subsp. aureus Mu50
gcuuuuuugugauuuuuaaua

SEQ ID NO: 3993976 - RNA, 19 nt, Staphylococcus aureus subsp. aureus Mu50
ggaaaauaaaaaccagcua

SEQ ID NO: 3993977 - RNA, 18 nt, Staphylococcus aureus subsp. aureus Mu50
ggaaaccguuuagaaaga

SEQ ID NO: 3993978 - RNA, 13 nt, Staphylococcus aureus subsp. aureus Mu50
ggaaagaugggau

SEQ ID NO: 3993979 - RNA, 15 nt, Staphylococcus aureus subsp. aureus Mu50
ggaaauaaaaaauaa

SEQ ID NO: 3993980 - RNA, 17 nt, Staphylococcus aureus subsp. aureus Mu50
ggaaauauuccuuacua

SEQ ID NO: 3993981 - RNA, 16 nt, Staphylococcus aureus subsp. aureus Mu50
ggaaauauuugaaaau

SEQ ID NO: 3993982 - RNA, 19 nt, Staphylococcus aureus subsp. aureus Mu50
ggaaauggcuccauuuaau

SEQ ID NO: 3993983 - RNA, 15 nt, Staphylococcus aureus subsp. aureus Mu50
ggaaauuuauuauaa

SEQ ID NO: 3993984 - RNA, 22 nt, Staphylococcus aureus subsp. aureus Mu50
ggaaauuuauuauaaaauagaa

SEQ ID NO: 3993985 - RNA, 16 nt, Staphylococcus aureus subsp. aureus Mu50
ggaacaugauucauga

SEQ ID NO: 3993986 - RNA, 15 nt, Staphylococcus aureus subsp. aureus Mu50
gggugagggccccaa

SEQ ID NO: 3993987 - RNA, 19 nt, Staphylococcus aureus subsp. aureus Mu50
gggugagggccccaacaca

SEQ ID NO: 3993988 - RNA, 17 nt, Staphylococcus aureus subsp. aureus Mu50
gggugggacgacgaaau

SEQ ID NO: 3993989 - RNA, 19 nt, Staphylococcus aureus subsp. aureus Mu50
gggugggacgacgaaauaa

SEQ ID NO: 3993990 - RNA, 11 nt, Staphylococcus aureus subsp. aureus Mu50
gguaaaaaguu

SEQ ID NO: 3993991 - RNA, 18 nt, Staphylococcus aureus subsp. aureus Mu50
gguaaaaaucucaaaauu

SEQ ID NO: 3993992 - RNA, 22 nt, Staphylococcus aureus subsp. aureus Mu50
gguaaaucuguuuaaauuuaaa

SEQ ID NO: 3993993 - RNA, 19 nt, Staphylococcus aureus subsp. aureus Mu50
gguaagaccccgaaaagag

SEQ ID NO: 3993994 - RNA, 17 nt, Staphylococcus aureus subsp. aureus Mu50
gguaaguauaauuaaac

SEQ ID NO: 3993995 - RNA, 21 nt, Staphylococcus aureus subsp. aureus Mu50
gguaauacuauaugaaaagag

SEQ ID NO: 3993996 - RNA, 12 nt, Staphylococcus aureus subsp. aureus Mu50
gguaauacuuuu

SEQ ID NO: 3993997 - RNA, 17 nt, Staphylococcus aureus subsp. aureus Mu50
gguaaugauuuugcuuu

SEQ ID NO: 3993998 - RNA, 14 nt, Staphylococcus aureus subsp. aureus Mu50
gguaauuuaacauu

SEQ ID NO: 3993999 - RNA, 22 nt, Staphylococcus aureus subsp. aureus Mu50
gguacaccuacaaauauuucua

SEQ ID NO: 3994000 - RNA, 20 nt, Staphylococcus aureus subsp. aureus Mu50
gguacagauaagaauauuua

SEQ ID NO: 3994001 - RNA, 17 nt, Staphylococcus aureus subsp. aureus Mu50
gguacauaaauaccugg

SEQ ID NO: 3994002 - RNA, 13 nt, Staphylococcus aureus subsp. aureus Mu50
gguacauaauaga

SEQ ID NO: 3994003 - RNA, 22 nt, Staphylococcus aureus subsp. aureus Mu50
gguaccuuuuuauuaucuuuaa

SEQ ID NO: 3994004 - RNA, 18 nt, Staphylococcus aureus subsp. aureus Mu50
gguagccaauaucauauu

SEQ ID NO: 3994005 - RNA, 18 nt, Staphylococcus aureus subsp. aureus Mu50
gguauaucuucauuuaaa

SEQ ID NO: 3994006 - RNA, 20 nt, Staphylococcus aureus subsp. aureus Mu50
gguauauuaaaaauuucaau

SEQ ID NO: 3994007 - RNA, 18 nt, Staphylococcus aureus subsp. aureus Mu50
gguauccuucucaucauu

SEQ ID NO: 3994008 - RNA, 22 nt, Staphylococcus aureus subsp. aureus Mu50
gguauccuucucaucauuuuca

SEQ ID NO: 3994009 - RNA, 16 nt, Staphylococcus aureus subsp. aureus Mu50
gguaugaaauaacaau

SEQ ID NO: 3994010 - RNA, 15 nt, Staphylococcus aureus subsp. aureus Mu50
gguaugacugcaaau

SEQ ID NO: 3994011 - RNA, 21 nt, Staphylococcus aureus subsp. aureus Mu50
gguaugauauuucuaaauugu

SEQ ID NO: 3994012 - RNA, 14 nt, Staphylococcus aureus subsp. aureus Mu50
gguauucaaauaaa

SEQ ID NO: 3994013 - RNA, 19 nt, Staphylococcus aureus subsp. aureus Mu50
gguauucaaauaaacacau

SEQ ID NO: 3994014 - RNA, 18 nt, Staphylococcus aureus subsp. aureus Mu50
gguauuuauagauuuaaa

SEQ ID NO: 3994015 - RNA, 17 nt, Staphylococcus aureus subsp. aureus Mu50
ggucaacuguaguggaa

SEQ ID NO: 3994016 - RNA, 20 nt, Staphylococcus aureus subsp. aureus Mu50
ggucaaugacugagaaaaau

SEQ ID NO: 3994017 - RNA, 18 nt, Staphylococcus aureus subsp. aureus Mu50
ggucacacccauacucug

SEQ ID NO: 3994018 - RNA, 18 nt, Staphylococcus aureus subsp. aureus Mu50
ggucauagaaauuuuaaa

SEQ ID NO: 3994019 - RNA, 21 nt, Staphylococcus aureus subsp. aureus Mu50
ggucuacgaucaaaaucaugc

SEQ ID NO: 3994020 - RNA, 17 nt, Staphylococcus aureus subsp. aureus Mu50
ggucuucgcaaucauua

SEQ ID NO: 3994021 - RNA, 13 nt, Staphylococcus aureus subsp. aureus Mu50
ggugagggcccca

SEQ ID NO: 3994022 - RNA, 21 nt, Staphylococcus aureus subsp. aureus Mu50
ggugagggccccaacacagaa

SEQ ID NO: 3994023 - RNA, 23 nt, Staphylococcus aureus subsp. aureus Mu50
ggugauauuugcuagucauaauu

SEQ ID NO: 3994024 - RNA, 13 nt, Staphylococcus aureus subsp. aureus Mu50
ggugcuaaauuua

SEQ ID NO: 3994025 - RNA, 21 nt, Staphylococcus aureus subsp. aureus Mu50
ggugcuuuuggaugauuggua

SEQ ID NO: 3994026 - RNA, 23 nt, Staphylococcus aureus subsp. aureus Mu50
gguguagauaaaucgauaaaaug

SEQ ID NO: 3994027 - RNA, 15 nt, Staphylococcus aureus subsp. aureus Mu50
ggugugaauugauuu

SEQ ID NO: 3994028 - RNA, 16 nt, Staphylococcus aureus subsp. aureus Mu50
ggugugauguacuacu

SEQ ID NO: 3994029 - RNA, 16 nt, Staphylococcus aureus subsp. aureus Mu50
gguguggugugaugua

SEQ ID NO: 3994030 - RNA, 17 nt, Staphylococcus aureus subsp. aureus Mu50
gguguugaaaaguaauu

SEQ ID NO: 3994031 - RNA, 18 nt, Staphylococcus aureus subsp. aureus Mu50
gguguuuauaucuuugug

SEQ ID NO: 3994032 - RNA, 11 nt, Staphylococcus aureus subsp. aureus Mu50
gguuauggugu

SEQ ID NO: 3994033 - RNA, 18 nt, Staphylococcus aureus subsp. aureus Mu50
gguuauuauaaaauaaau

SEQ ID NO: 3994034 - RNA, 13 nt, Staphylococcus aureus subsp. aureus Mu50
gguucaaaaauca

SEQ ID NO: 3994035 - RNA, 11 nt, Staphylococcus aureus subsp. aureus Mu50
gguucaaaucc

SEQ ID NO: 3994036 - RNA, 21 nt, Staphylococcus aureus subsp. aureus Mu50
gguucauuagcauuauuauuu

SEQ ID NO: 3994037 - RNA, 18 nt, Staphylococcus aureus subsp. aureus Mu50
gguucccaauucggauua

SEQ ID NO: 3994038 - RNA, 20 nt, Staphylococcus aureus subsp. aureus Mu50
gguugaacgguuguauuuca

SEQ ID NO: 3994039 - RNA, 17 nt, Staphylococcus aureus subsp. aureus Mu50
gguugauuauauuucuc

SEQ ID NO: 3994040 - RNA, 19 nt, Staphylococcus aureus subsp. aureus Mu50
gguuguuuuucaucauuaa

SEQ ID NO: 3994041 - RNA, 21 nt, Staphylococcus aureus subsp. aureus Mu50
gguuuaaucuauauauauaug

SEQ ID NO: 3994042 - RNA, 22 nt, Staphylococcus aureus subsp. aureus Mu50
gguuuaaugagcuuuucuaaug

SEQ ID NO: 3994043 - RNA, 21 nt, Staphylococcus aureus subsp. aureus Mu50
gguuuaucagcuuuaauaaua

SEQ ID NO: 3994044 - RNA, 24 nt, Staphylococcus aureus subsp. aureus Mu50
gguuuaucagcuuuaauaauauga

SEQ ID NO: 3994045 - RNA, 18 nt, Staphylococcus aureus subsp. aureus Mu50
gguuucuuauuaaauaag

SEQ ID NO: 3994046 - RNA, 20 nt, Staphylococcus aureus subsp. aureus Mu50
gguuugaguaaauuaauaga

SEQ ID NO: 3994047 - RNA, 23 nt, Staphylococcus aureus subsp. aureus Mu50
gguuugaguaaauuaauagagaa

SEQ ID NO: 3994048 - RNA, 17 nt, Staphylococcus aureus subsp. aureus Mu50
gguuuuuuauuuucaua

SEQ ID NO: 3994049 - RNA, 18 nt, Staphylococcus aureus subsp. aureus Mu50
guaaaaacguucaaucgu

SEQ ID NO: 3994050 - RNA, 23 nt, Staphylococcus aureus subsp. aureus Mu50
guaaaacaaauuacacccuuuaa

SEQ ID NO: 3994051 - RNA, 21 nt, Staphylococcus aureus subsp. aureus Mu50
guaaaacauucccuuaauaau

SEQ ID NO: 3994052 - RNA, 20 nt, Staphylococcus aureus subsp. aureus Mu50
guaaaaccaaaucguuucau

SEQ ID NO: 3994053 - RNA, 21 nt, Staphylococcus aureus subsp. aureus Mu50
guaaaaccuuacccaaaaaau

SEQ ID NO: 3994054 - RNA, 13 nt, Staphylococcus aureus subsp. aureus Mu50
guaaaacugcaau

SEQ ID NO: 3994055 - RNA, 13 nt, Staphylococcus aureus subsp. aureus Mu50
guaaaauauacuu

SEQ ID NO: 3994056 - RNA, 21 nt, Staphylococcus aureus subsp. aureus Mu50
guaaaauauacuugaagcauc

SEQ ID NO: 3994057 - RNA, 22 nt, Staphylococcus aureus subsp. aureus Mu50
guaaaauuuucguguuaauaac

SEQ ID NO: 3994058 - RNA, 14 nt, Staphylococcus aureus subsp. aureus Mu50
guaaacacuauaaa

SEQ ID NO: 3994059 - RNA, 17 nt, Staphylococcus aureus subsp. aureus Mu50
guaaacacuauaaaagc

SEQ ID NO: 3994060 - RNA, 16 nt, Staphylococcus aureus subsp. aureus Mu50
guaaacacuuuaguau

SEQ ID NO: 3994061 - RNA, 23 nt, Staphylococcus aureus subsp. aureus Mu50
guaaaccgaggugucaauaaauu

SEQ ID NO: 3994062 - RNA, 18 nt, Staphylococcus aureus subsp. aureus Mu50
guaaaccuacuaauauau

SEQ ID NO: 3994063 - RNA, 16 nt, Staphylococcus aureus subsp. aureus Mu50
guaaacuucuuuucuu

SEQ ID NO: 3994064 - RNA, 22 nt, Staphylococcus aureus subsp. aureus Mu50
guaaagaguacagcgguuugua

SEQ ID NO: 3994065 - RNA, 14 nt, Staphylococcus aureus subsp. aureus Mu50
guaaagcaugaaua

SEQ ID NO: 3994066 - RNA, 16 nt, Staphylococcus aureus subsp. aureus Mu50
guaaagccaccuaaau

SEQ ID NO: 3994067 - RNA, 11 nt, Staphylococcus aureus subsp. aureus Mu50
guaaagcuuua

SEQ ID NO: 3994068 - RNA, 21 nt, Staphylococcus aureus subsp. aureus Mu50
guaaagggagguauauacaau

SEQ ID NO: 3994069 - RNA, 19 nt, Staphylococcus aureus subsp. aureus Mu50
guaaauaaaaauuauauaa

SEQ ID NO: 3994070 - RNA, 13 nt, Staphylococcus aureus subsp. aureus Mu50
guaaauaauagua

SEQ ID NO: 3994071 - RNA, 21 nt, Staphylococcus aureus subsp. aureus Mu50
guaaauauaguaauaaaaguc

SEQ ID NO: 3994072 - RNA, 19 nt, Staphylococcus aureus subsp. aureus Mu50
guaaauauucguugauagu

SEQ ID NO: 3994073 - RNA, 17 nt, Staphylococcus aureus subsp. aureus Mu50
guacauauguuguuucu

SEQ ID NO: 3994074 - RNA, 18 nt, Staphylococcus aureus subsp. aureus Mu50
guacauccacuuuauaau

SEQ ID NO: 3994075 - RNA, 11 nt, Staphylococcus aureus subsp. aureus Mu50
guacauguauu

SEQ ID NO: 3994076 - RNA, 16 nt, Staphylococcus aureus subsp. aureus Mu50
guacauguauuggcca

SEQ ID NO: 3994077 - RNA, 15 nt, Staphylococcus aureus subsp. aureus Mu50
guacauugguuuuua

SEQ ID NO: 3994078 - RNA, 16 nt, Staphylococcus aureus subsp. aureus Mu50
guacauuguaaauaua

SEQ ID NO: 3994079 - RNA, 18 nt, Staphylococcus aureus subsp. aureus Mu50
guacauuuaauggucuaa

SEQ ID NO: 3994080 - RNA, 24 nt, Staphylococcus aureus subsp. aureus Mu50
guacauuuaauggucuaauaucaa

SEQ ID NO: 3994081 - RNA, 14 nt, Staphylococcus aureus subsp. aureus Mu50
guacauuuauuuuc

SEQ ID NO: 3994082 - RNA, 20 nt, Staphylococcus aureus subsp. aureus Mu50
guacauuuauuuucaauaaa

SEQ ID NO: 3994083 - RNA, 22 nt, Staphylococcus aureus subsp. aureus Mu50
guacauuuauuuucaauaaaua

SEQ ID NO: 3994084 - RNA, 21 nt, Staphylococcus aureus subsp. aureus Mu50
guaccacauacauaucuuuug

SEQ ID NO: 3994085 - RNA, 15 nt, Staphylococcus aureus subsp. aureus Mu50
guaccaccccaacuu

SEQ ID NO: 3994086 - RNA, 18 nt, Staphylococcus aureus subsp. aureus Mu50
guaccaucucuauuuuuu

SEQ ID NO: 3994087 - RNA, 12 nt, Staphylococcus aureus subsp. aureus Mu50
guaccuaaaaua

SEQ ID NO: 3994088 - RNA, 13 nt, Staphylococcus aureus subsp. aureus Mu50
guaccuaaaauag

SEQ ID NO: 3994089 - RNA, 15 nt, Staphylococcus aureus subsp. aureus Mu50
guaccuaaaauagaa

SEQ ID NO: 3994090 - RNA, 15 nt, Staphylococcus aureus subsp. aureus Mu50
guacgaggaccaucu

SEQ ID NO: 3994091 - RNA, 14 nt, Staphylococcus aureus subsp. aureus Mu50
guacgauucaauuu

SEQ ID NO: 3994092 - RNA, 19 nt, Staphylococcus aureus subsp. aureus Mu50
guacgcaauuuaauauuau

SEQ ID NO: 3994093 - RNA, 17 nt, Staphylococcus aureus subsp. aureus Mu50
guacgguagucucccau

SEQ ID NO: 3994094 - RNA, 20 nt, Staphylococcus aureus subsp. aureus Mu50
guacgguuauuuaauaaugc

SEQ ID NO: 3994095 - RNA, 14 nt, Staphylococcus aureus subsp. aureus Mu50
guacguuugcauau

SEQ ID NO: 3994096 - RNA, 15 nt, Staphylococcus aureus subsp. aureus Mu50
guacguuuuaaauaa

SEQ ID NO: 3994097 - RNA, 20 nt, Staphylococcus aureus subsp. aureus Mu50
guacguuuuuuuaaauacau

SEQ ID NO: 3994098 - RNA, 17 nt, Staphylococcus aureus subsp. aureus Mu50
guacuaacguuuuaaag

SEQ ID NO: 3994099 - RNA, 15 nt, Staphylococcus aureus subsp. aureus Mu50
guacuaagcuuucau

SEQ ID NO: 3994100 - RNA, 18 nt, Staphylococcus aureus subsp. aureus Mu50
guacuaagcuuucauuaa

SEQ ID NO: 3994101 - RNA, 20 nt, Staphylococcus aureus subsp. aureus Mu50
guacuacauaccgauuuuca

SEQ ID NO: 3994102 - RNA, 21 nt, Staphylococcus aureus subsp. aureus Mu50
guacuaggaccuacaauuuuc

SEQ ID NO: 3994103 - RNA, 21 nt, Staphylococcus aureus subsp. aureus Mu50
guacuguguuuagguauauaa

SEQ ID NO: 3994104 - RNA, 21 nt, Staphylococcus aureus subsp. aureus Mu50
guacuuaccuuucaaauauau

SEQ ID NO: 3994105 - RNA, 16 nt, Staphylococcus aureus subsp. aureus Mu50
guacuuccuuccauuc

SEQ ID NO: 3994106 - RNA, 20 nt, Staphylococcus aureus subsp. aureus Mu50
guacuuucauuguuaaacau

SEQ ID NO: 3994107 - RNA, 19 nt, Staphylococcus aureus subsp. aureus Mu50
guacuuuuuugagcauuuu

SEQ ID NO: 3994108 - RNA, 21 nt, Staphylococcus aureus subsp. aureus Mu50
guagacguaaguguaaaugaa

SEQ ID NO: 3994109 - RNA, 19 nt, Staphylococcus aureus subsp. aureus Mu50
guagauaaaucgauaaaau

SEQ ID NO: 3994110 - RNA, 18 nt, Staphylococcus aureus subsp. aureus Mu50
guagauuacuuugcuaaa

SEQ ID NO: 3994111 - RNA, 18 nt, Staphylococcus aureus subsp. aureus Mu50
guagauucaaauugguuu

SEQ ID NO: 3994112 - RNA, 22 nt, Staphylococcus aureus subsp. aureus Mu50
guagauugauauccuuaacaug

SEQ ID NO: 3994113 - RNA, 19 nt, Staphylococcus aureus subsp. aureus Mu50
guagauuuauuaaauauau

SEQ ID NO: 3994114 - RNA, 15 nt, Staphylococcus aureus subsp. aureus Mu50
guagccaaauaaauu

SEQ ID NO: 3994115 - RNA, 17 nt, Staphylococcus aureus subsp. aureus Mu50
guagcugaggauuuuuu

SEQ ID NO: 3994116 - RNA, 14 nt, Staphylococcus aureus subsp. aureus Mu50
guagcuugaauaau

SEQ ID NO: 3994117 - RNA, 18 nt, Staphylococcus aureus subsp. aureus Mu50
guaggaggcuuuugcuuu

SEQ ID NO: 3994118 - RNA, 20 nt, Staphylococcus aureus subsp. aureus Mu50
guaggggagucuuauuuuua

SEQ ID NO: 3994119 - RNA, 19 nt, Staphylococcus aureus subsp. aureus Mu50
guaguacacgaauucauua

SEQ ID NO: 3994120 - RNA, 21 nt, Staphylococcus aureus subsp. aureus Mu50
guagucgaagaagauuaugaa

SEQ ID NO: 3994121 - RNA, 17 nt, Staphylococcus aureus subsp. aureus Mu50
guagugguucuuauaca

SEQ ID NO: 3994122 - RNA, 22 nt, Staphylococcus aureus subsp. aureus Mu50
guaguuaagauaccuuuuucua

SEQ ID NO: 3994123 - RNA, 22 nt, Staphylococcus aureus subsp. aureus Mu50
guaguuggcugauagaugaaaa

SEQ ID NO: 3994124 - RNA, 23 nt, Staphylococcus aureus subsp. aureus Mu50
guaguuggcugauagaugaaaau

SEQ ID NO: 3994125 - RNA, 20 nt, Staphylococcus aureus subsp. aureus Mu50
guaguugguggaugucaugu

SEQ ID NO: 3994126 - RNA, 14 nt, Staphylococcus aureus subsp. aureus Mu50
guaguuuauaucaa

SEQ ID NO: 3994127 - RNA, 10 nt, Staphylococcus aureus subsp. aureus Mu50
guauaaaaca

SEQ ID NO: 3994128 - RNA, 22 nt, Staphylococcus aureus subsp. aureus Mu50
guauaaagggcuauuugauaca

SEQ ID NO: 3994129 - RNA, 12 nt, Staphylococcus aureus subsp. aureus Mu50
guauaaauaaaa

SEQ ID NO: 3994130 - RNA, 22 nt, Staphylococcus aureus subsp. aureus Mu50
guauaaauaucauaaaugcaua

SEQ ID NO: 3994131 - RNA, 17 nt, Staphylococcus aureus subsp. aureus Mu50
guauaaaugcagcugua

SEQ ID NO: 3994132 - RNA, 14 nt, Staphylococcus aureus subsp. aureus Mu50
guauaaccauaaug

SEQ ID NO: 3994133 - RNA, 19 nt, Staphylococcus aureus subsp. aureus Mu50
guauaaccauaaugaacag

SEQ ID NO: 3994134 - RNA, 21 nt, Staphylococcus aureus subsp. aureus Mu50
guauaaccauaaugaacagua

SEQ ID NO: 3994135 - RNA, 21 nt, Staphylococcus aureus subsp. aureus Mu50
guauaagggguauauuaaaaa

SEQ ID NO: 3994136 - RNA, 21 nt, Staphylococcus aureus subsp. aureus Mu50
guauaauggacgguauuuuca

SEQ ID NO: 3994137 - RNA, 14 nt, Staphylococcus aureus subsp. aureus Mu50
guauaauuaaacua

SEQ ID NO: 3994138 - RNA, 16 nt, Staphylococcus aureus subsp. aureus Mu50
guauacaacaugugua

SEQ ID NO: 3994139 - RNA, 15 nt, Staphylococcus aureus subsp. aureus Mu50
guauaccucuuagca

SEQ ID NO: 3994140 - RNA, 15 nt, Staphylococcus aureus subsp. aureus Mu50
guauacuaaacuuuu

SEQ ID NO: 3994141 - RNA, 17 nt, Staphylococcus aureus subsp. aureus Mu50
guauagaugcuaaugua

SEQ ID NO: 3994142 - RNA, 22 nt, Staphylococcus aureus subsp. aureus Mu50
guauagauuguauuuaauaagu

SEQ ID NO: 3994143 - RNA, 17 nt, Staphylococcus aureus subsp. aureus Mu50
guauauaaguuaaaauu

SEQ ID NO: 3994144 - RNA, 16 nt, Staphylococcus aureus subsp. aureus Mu50
guauauacaaugacag

SEQ ID NO: 3994145 - RNA, 16 nt, Staphylococcus aureus subsp. aureus Mu50
guauaugaaucgauau

SEQ ID NO: 3994146 - RNA, 13 nt, Staphylococcus aureus subsp. aureus Mu50
guauauguauaga

SEQ ID NO: 3994147 - RNA, 21 nt, Staphylococcus aureus subsp. aureus Mu50
guauauucaacagggguaaaa

SEQ ID NO: 3994148 - RNA, 20 nt, Staphylococcus aureus subsp. aureus Mu50
guauauucuuuuuaacuaug

SEQ ID NO: 3994149 - RNA, 12 nt, Staphylococcus aureus subsp. aureus Mu50
guauauugcuua

SEQ ID NO: 3994150 - RNA, 13 nt, Staphylococcus aureus subsp. aureus Mu50
guaucaaaauuuu

SEQ ID NO: 3994151 - RNA, 19 nt, Staphylococcus aureus subsp. aureus Mu50
guaucaacauuaauaaaua

SEQ ID NO: 3994152 - RNA, 16 nt, Staphylococcus aureus subsp. aureus Mu50
guaucaagaaaaaguu

SEQ ID NO: 3994153 - RNA, 22 nt, Staphylococcus aureus subsp. aureus Mu50
guaucaagaaaaaguuuuucug

SEQ ID NO: 3994154 - RNA, 22 nt, Staphylococcus aureus subsp. aureus Mu50
guaucacauucaauauuugaac

SEQ ID NO: 3994155 - RNA, 21 nt, Staphylococcus aureus subsp. aureus Mu50
guaucacuaggauguucauca

SEQ ID NO: 3994156 - RNA, 20 nt, Staphylococcus aureus subsp. aureus Mu50
guaucagaagauaauacguu

SEQ ID NO: 3994157 - RNA, 17 nt, Staphylococcus aureus subsp. aureus Mu50
guaucauaauuuuguuu

SEQ ID NO: 3994158 - RNA, 16 nt, Staphylococcus aureus subsp. aureus Mu50
guaucaucaaaguuua

SEQ ID NO: 3994159 - RNA, 15 nt, Staphylococcus aureus subsp. aureus Mu50
guaucauuuaaaaua

SEQ ID NO: 3994160 - RNA, 13 nt, Staphylococcus aureus subsp. aureus Mu50
gucccguaggagu

SEQ ID NO: 3994161 - RNA, 15 nt, Staphylococcus aureus subsp. aureus Mu50
guccgacuugauaaa

SEQ ID NO: 3994162 - RNA, 19 nt, Staphylococcus aureus subsp. aureus Mu50
guccgacuugauaaaaaau

SEQ ID NO: 3994163 - RNA, 17 nt, Staphylococcus aureus subsp. aureus Mu50
guccgcuuuuucauaga

SEQ ID NO: 3994164 - RNA, 19 nt, Staphylococcus aureus subsp. aureus Mu50
guccguuuuauauuuauuu

SEQ ID NO: 3994165 - RNA, 23 nt, Staphylococcus aureus subsp. aureus Mu50
guccuagacgaucuuuaaugaua

SEQ ID NO: 3994166 - RNA, 14 nt, Staphylococcus aureus subsp. aureus Mu50
guccucuaaaacau

SEQ ID NO: 3994167 - RNA, 15 nt, Staphylococcus aureus subsp. aureus Mu50
guccuguacauccac

SEQ ID NO: 3994168 - RNA, 16 nt, Staphylococcus aureus subsp. aureus Mu50
gucgaaaauagcuauu

SEQ ID NO: 3994169 - RNA, 19 nt, Staphylococcus aureus subsp. aureus Mu50
gucgaaaauagcuauuaaa

SEQ ID NO: 3994170 - RNA, 22 nt, Staphylococcus aureus subsp. aureus Mu50
gucgaaaauagcuauuaaaaua

SEQ ID NO: 3994171 - RNA, 18 nt, Staphylococcus aureus subsp. aureus Mu50
gucgaaauuguucuaaua

SEQ ID NO: 3994172 - RNA, 14 nt, Staphylococcus aureus subsp. aureus Mu50
gucgaagaagauua

SEQ ID NO: 3994173 - RNA, 17 nt, Staphylococcus aureus subsp. aureus Mu50
gucgaauauaauuuuuu

SEQ ID NO: 3994174 - RNA, 16 nt, Staphylococcus aureus subsp. aureus Mu50
gucgagauuuuauaag

SEQ ID NO: 3994175 - RNA, 22 nt, Staphylococcus aureus subsp. aureus Mu50
gucgauaaauaugauguuaaaa

SEQ ID NO: 3994176 - RNA, 14 nt, Staphylococcus aureus subsp. aureus Mu50
gucgauaaguuuuu

SEQ ID NO: 3994177 - RNA, 20 nt, Staphylococcus aureus subsp. aureus Mu50
gucgcuucuucuucagaaau

SEQ ID NO: 3994178 - RNA, 20 nt, Staphylococcus aureus subsp. aureus Mu50
gucguaacucuuuaauuuua

SEQ ID NO: 3994179 - RNA, 20 nt, Staphylococcus aureus subsp. aureus Mu50
gucgucaaaaacagacgaaa

SEQ ID NO: 3994180 - RNA, 18 nt, Staphylococcus aureus subsp. aureus Mu50
gucguucucguguaaaau

SEQ ID NO: 3994181 - RNA, 16 nt, Staphylococcus aureus subsp. aureus Mu50
gucguuguaaaacuaa

SEQ ID NO: 3994182 - RNA, 17 nt, Staphylococcus aureus subsp. aureus Mu50
gucuaaagcuuauuaaa

SEQ ID NO: 3994183 - RNA, 13 nt, Staphylococcus aureus subsp. aureus Mu50
gucuaacaguuaa

SEQ ID NO: 3994184 - RNA, 19 nt, Staphylococcus aureus subsp. aureus Mu50
gucuaauguuggaaaaggu

SEQ ID NO: 3994185 - RNA, 18 nt, Staphylococcus aureus subsp. aureus Mu50
gucuagauuuuaaaucaa

SEQ ID NO: 3994186 - RNA, 19 nt, Staphylococcus aureus subsp. aureus Mu50
gucuaucgccuaaaaauaa

SEQ ID NO: 3994187 - RNA, 22 nt, Staphylococcus aureus subsp. aureus Mu50
gucuaugaauaauguuuucauu

SEQ ID NO: 3994188 - RNA, 15 nt, Staphylococcus aureus subsp. aureus Mu50
gucuauguacaauaa

SEQ ID NO: 3994189 - RNA, 20 nt, Staphylococcus aureus subsp. aureus Mu50
gucuauguacaauaauuagu

SEQ ID NO: 3994190 - RNA, 21 nt, Staphylococcus aureus subsp. aureus Mu50
gucuauuguaaaaacguucaa

SEQ ID NO: 3994191 - RNA, 22 nt, Staphylococcus aureus subsp. aureus Mu50
gucucccauaacaccuacugau

SEQ ID NO: 3994192 - RNA, 14 nt, Staphylococcus aureus subsp. aureus Mu50
gucucguugcacaa

SEQ ID NO: 3994193 - RNA, 19 nt, Staphylococcus aureus subsp. aureus Mu50
gucugaugucgaaaauagc

SEQ ID NO: 3994194 - RNA, 13 nt, Staphylococcus aureus subsp. aureus Mu50
gucuggaauaaau

SEQ ID NO: 3994195 - RNA, 23 nt, Staphylococcus aureus subsp. aureus Mu50
gucuguaaauuaucuaaagaaau

SEQ ID NO: 3994196 - RNA, 22 nt, Staphylococcus aureus subsp. aureus Mu50
gucuuaacaaauuaaaaaggua

SEQ ID NO: 3994197 - RNA, 18 nt, Staphylococcus aureus subsp. aureus Mu50
gucuuacuuuuaaauuaa

SEQ ID NO: 3994198 - RNA, 19 nt, Staphylococcus aureus subsp. aureus Mu50
gucuuccaaucaacuucau

SEQ ID NO: 3994199 - RNA, 22 nt, Staphylococcus aureus subsp. aureus Mu50
gucuuccaaucaacuucauaua

SEQ ID NO: 3994200 - RNA, 14 nt, Staphylococcus aureus subsp. aureus Mu50
gucuucucuaucag

SEQ ID NO: 3994201 - RNA, 22 nt, Staphylococcus aureus subsp. aureus Mu50
gucuugauggugguaccacaua

SEQ ID NO: 3994202 - RNA, 16 nt, Staphylococcus aureus subsp. aureus Mu50
gucuugcaauaccucc

SEQ ID NO: 3994203 - RNA, 15 nt, Staphylococcus aureus subsp. aureus Mu50
gucuuguaaacuucu

SEQ ID NO: 3994204 - RNA, 20 nt, Staphylococcus aureus subsp. aureus Mu50
gucuuguaaacuucuuuucu

SEQ ID NO: 3994205 - RNA, 20 nt, Staphylococcus aureus subsp. aureus Mu50
gucuuguaucaacauuaaua

SEQ ID NO: 3994206 - RNA, 14 nt, Staphylococcus aureus subsp. aureus Mu50
gucuugugauaauu

SEQ ID NO: 3994207 - RNA, 16 nt, Staphylococcus aureus subsp. aureus Mu50
gucuugugauaauucu

SEQ ID NO: 3994208 - RNA, 20 nt, Staphylococcus aureus subsp. aureus Mu50
gucuuguggcacauaaccga

SEQ ID NO: 3994209 - RNA, 19 nt, Staphylococcus aureus subsp. aureus Mu50
gucuuuauguuugauuuua

SEQ ID NO: 3994210 - RNA, 20 nt, Staphylococcus aureus subsp. aureus Mu50
gucuuucucggcgauaaaau

SEQ ID NO: 3994211 - RNA, 17 nt, Staphylococcus aureus subsp. aureus Mu50
gucuuuuaauuaaaagu

SEQ ID NO: 3994212 - RNA, 12 nt, Staphylococcus aureus subsp. aureus Mu50
gucuuuuuauuu

SEQ ID NO: 3994213 - RNA, 22 nt, Staphylococcus aureus subsp. aureus Mu50
gugaaaacccugaagauaauag

SEQ ID NO: 3994214 - RNA, 11 nt, Staphylococcus aureus subsp. aureus Mu50
gugaaaagugu

SEQ ID NO: 3994215 - RNA, 23 nt, Staphylococcus aureus subsp. aureus Mu50
gugaaaguacuuggaaaauacua

SEQ ID NO: 3994216 - RNA, 21 nt, Staphylococcus aureus subsp. aureus Mu50
gugaaaguauuagauauauuu

SEQ ID NO: 3994217 - RNA, 22 nt, Staphylococcus aureus subsp. aureus Mu50
gugaaauuagaaaaauaugauu

SEQ ID NO: 3994218 - RNA, 23 nt, Staphylococcus aureus subsp. aureus Mu50
gugaauauaaguaaucauaauaa

SEQ ID NO: 3994219 - RNA, 16 nt, Staphylococcus aureus subsp. aureus Mu50
gugaaucuaaacuaua

SEQ ID NO: 3994220 - RNA, 20 nt, Staphylococcus aureus subsp. aureus Mu50
gugaaucuuauuuuguuuua

SEQ ID NO: 3994221 - RNA, 22 nt, Staphylococcus aureus subsp. aureus Mu50
gugaauguuuucuaaaucuaac

SEQ ID NO: 3994222 - RNA, 21 nt, Staphylococcus aureus subsp. aureus Mu50
gugaauucgaugacuuuuuaa

SEQ ID NO: 3994223 - RNA, 12 nt, Staphylococcus aureus subsp. aureus Mu50
gugacaacauua

SEQ ID NO: 3994224 - RNA, 13 nt, Staphylococcus aureus subsp. aureus Mu50
gugacauuuucaa

SEQ ID NO: 3994225 - RNA, 17 nt, Staphylococcus aureus subsp. aureus Mu50
gugaccucagguuguua

SEQ ID NO: 3994226 - RNA, 18 nt, Staphylococcus aureus subsp. aureus Mu50
gugacgcugguaauauuu

SEQ ID NO: 3994227 - RNA, 17 nt, Staphylococcus aureus subsp. aureus Mu50
gugacucaguuauauua

SEQ ID NO: 3994228 - RNA, 22 nt, Staphylococcus aureus subsp. aureus Mu50
gugacuuuuauaauucuaaguc

SEQ ID NO: 3994229 - RNA, 20 nt, Staphylococcus aureus subsp. aureus Mu50
gugagauacguuauuucaau

SEQ ID NO: 3994230 - RNA, 14 nt, Staphylococcus aureus subsp. aureus Mu50
gugaggcaccaaug

SEQ ID NO: 3994231 - RNA, 18 nt, Staphylococcus aureus subsp. aureus Mu50
gugagggacgucaucaug

SEQ ID NO: 3994232 - RNA, 15 nt, Staphylococcus aureus subsp. aureus Mu50
gugagggccccaaca

SEQ ID NO: 3994233 - RNA, 19 nt, Staphylococcus aureus subsp. aureus Mu50
gugagggccccaacacaga

SEQ ID NO: 3994234 - RNA, 14 nt, Staphylococcus aureus subsp. aureus Mu50
gugagguaaaacua

SEQ ID NO: 3994235 - RNA, 17 nt, Staphylococcus aureus subsp. aureus Mu50
gugauaauguacaugua

SEQ ID NO: 3994236 - RNA, 15 nt, Staphylococcus aureus subsp. aureus Mu50
gugauaauuaaaaua

SEQ ID NO: 3994237 - RNA, 19 nt, Staphylococcus aureus subsp. aureus Mu50
gugauauaugaaauauuua

SEQ ID NO: 3994238 - RNA, 12 nt, Staphylococcus aureus subsp. aureus Mu50
gugauaucuugc

SEQ ID NO: 3994239 - RNA, 19 nt, Staphylococcus aureus subsp. aureus Mu50
gugauaucuugcuuggaua

SEQ ID NO: 3994240 - RNA, 20 nt, Staphylococcus aureus subsp. aureus Mu50
gugauauuaauugaaaaacc

SEQ ID NO: 3994241 - RNA, 14 nt, Staphylococcus aureus subsp. aureus Mu50
gugaugguaaauca

SEQ ID NO: 3994242 - RNA, 21 nt, Staphylococcus aureus subsp. aureus Mu50
gugauuucccacgugccucau

SEQ ID NO: 3994243 - RNA, 22 nt, Staphylococcus aureus subsp. aureus Mu50
gugauuuuggaacauauucaua

SEQ ID NO: 3994244 - RNA, 21 nt, Staphylococcus aureus subsp. aureus Mu50
gugauuuuuaauaauuugaau

SEQ ID NO: 3994245 - RNA, 18 nt, Staphylococcus aureus subsp. aureus Mu50
gugcaaauaaaaaaguua

SEQ ID NO: 3994246 - RNA, 22 nt, Staphylococcus aureus subsp. aureus Mu50
gugcaacaaacgcugauuuaau

SEQ ID NO: 3994247 - RNA, 14 nt, Staphylococcus aureus subsp. aureus Mu50
guuaauguaaaguu

SEQ ID NO: 3994248 - RNA, 16 nt, Staphylococcus aureus subsp. aureus Mu50
guuaaugugcauuuau

SEQ ID NO: 3994249 - RNA, 18 nt, Staphylococcus aureus subsp. aureus Mu50
guuaaugugcauuuaucu

SEQ ID NO: 3994250 - RNA, 16 nt, Staphylococcus aureus subsp. aureus Mu50
guuaauuauguauuuu

SEQ ID NO: 3994251 - RNA, 13 nt, Staphylococcus aureus subsp. aureus Mu50
guuaauucaacgg

SEQ ID NO: 3994252 - RNA, 16 nt, Staphylococcus aureus subsp. aureus Mu50
guuaauucuccuaaua

SEQ ID NO: 3994253 - RNA, 19 nt, Staphylococcus aureus subsp. aureus Mu50
guuaauucuccuaauaauu

SEQ ID NO: 3994254 - RNA, 19 nt, Staphylococcus aureus subsp. aureus Mu50
guuaauuggguuuaauaac

SEQ ID NO: 3994255 - RNA, 21 nt, Staphylococcus aureus subsp. aureus Mu50
guuaauuggguuuaauaacau

SEQ ID NO: 3994256 - RNA, 16 nt, Staphylococcus aureus subsp. aureus Mu50
guuaauuucaacauua

SEQ ID NO: 3994257 - RNA, 17 nt, Staphylococcus aureus subsp. aureus Mu50
guuacacuuuucuuauc

SEQ ID NO: 3994258 - RNA, 18 nt, Staphylococcus aureus subsp. aureus Mu50
guuacagguuuuaaaauu

SEQ ID NO: 3994259 - RNA, 15 nt, Staphylococcus aureus subsp. aureus Mu50
guuacauauugcauu

SEQ ID NO: 3994260 - RNA, 16 nt, Staphylococcus aureus subsp. aureus Mu50
guuacauauugcauuu

SEQ ID NO: 3994261 - RNA, 19 nt, Staphylococcus aureus subsp. aureus Mu50
guuaccaaaauuugaaaua

SEQ ID NO: 3994262 - RNA, 17 nt, Staphylococcus aureus subsp. aureus Mu50
guuaccaaguaaugaua

SEQ ID NO: 3994263 - RNA, 18 nt, Staphylococcus aureus subsp. aureus Mu50
guuaccaaguaaugauac

SEQ ID NO: 3994264 - RNA, 20 nt, Staphylococcus aureus subsp. aureus Mu50
guuaccaucuuuaauacgaa

SEQ ID NO: 3994265 - RNA, 20 nt, Staphylococcus aureus subsp. aureus Mu50
guuacucugcgauuucuaaa

SEQ ID NO: 3994266 - RNA, 16 nt, Staphylococcus aureus subsp. aureus Mu50
guuacuuauauauuca

SEQ ID NO: 3994267 - RNA, 22 nt, Staphylococcus aureus subsp. aureus Mu50
guuacuuauauauucaauaauu

SEQ ID NO: 3994268 - RNA, 16 nt, Staphylococcus aureus subsp. aureus Mu50
guuacuucuaauagua

SEQ ID NO: 3994269 - RNA, 16 nt, Staphylococcus aureus subsp. aureus Mu50
guuagacuaaaaaacu

SEQ ID NO: 3994270 - RNA, 15 nt, Staphylococcus aureus subsp. aureus Mu50
guuaggagagaugua

SEQ ID NO: 3994271 - RNA, 12 nt, Staphylococcus aureus subsp. aureus Mu50
guuaggauaaag

SEQ ID NO: 3994272 - RNA, 20 nt, Staphylococcus aureus subsp. aureus Mu50
guuaggggcuuuuaugcaug

SEQ ID NO: 3994273 - RNA, 22 nt, Staphylococcus aureus subsp. aureus Mu50
guuaggggcuuuuaugcaugcg

SEQ ID NO: 3994274 - RNA, 21 nt, Staphylococcus aureus subsp. aureus Mu50
guuagguccuuucacauacca

SEQ ID NO: 3994275 - RNA, 21 nt, Staphylococcus aureus subsp. aureus Mu50
guuaguauaaacguccaaaca

SEQ ID NO: 3994276 - RNA, 22 nt, Staphylococcus aureus subsp. aureus Mu50
guuagugauaccuuuaauuguu

SEQ ID NO: 3994277 - RNA, 13 nt, Staphylococcus aureus subsp. aureus Mu50
guuauaaaaugaa

SEQ ID NO: 3994278 - RNA, 22 nt, Staphylococcus aureus subsp. aureus Mu50
guuauaaaggaagacauacuca

SEQ ID NO: 3994279 - RNA, 19 nt, Staphylococcus aureus subsp. aureus Mu50
guuauaaauuauauuuauu

SEQ ID NO: 3994280 - RNA, 16 nt, Staphylococcus aureus subsp. aureus Mu50
guuauaaguacaaaua

SEQ ID NO: 3994281 - RNA, 23 nt, Staphylococcus aureus subsp. aureus Mu50
guuauaaguacaaauaauacagg

SEQ ID NO: 3994282 - RNA, 21 nt, Staphylococcus aureus subsp. aureus Mu50
guuauacuacuauugauauuc

SEQ ID NO: 3994283 - RNA, 14 nt, Staphylococcus aureus subsp. aureus Mu50
guuauauauuccuu

SEQ ID NO: 3994284 - RNA, 14 nt, Staphylococcus aureus subsp. aureus Mu50
guuauaucaucaac

SEQ ID NO: 3994285 - RNA, 20 nt, Staphylococcus aureus subsp. aureus Mu50
guuauaucaucaacaaucuu

SEQ ID NO: 3994286 - RNA, 12 nt, Staphylococcus aureus subsp. aureus Mu50
guuauauuaaac

SEQ ID NO: 3994287 - RNA, 12 nt, Staphylococcus aureus subsp. aureus Mu50
guuauauuuuua

SEQ ID NO: 3994288 - RNA, 15 nt, Staphylococcus aureus subsp. aureus Mu50
guuauccguaacacu

SEQ ID NO: 3994289 - RNA, 14 nt, Staphylococcus aureus subsp. aureus Mu50
guuaucuaaugauc

SEQ ID NO: 3994290 - RNA, 14 nt, Staphylococcus aureus subsp. aureus Mu50
guuaucugcuuuuc

SEQ ID NO: 3994291 - RNA, 22 nt, Staphylococcus aureus subsp. aureus Mu50
guuaucuugcuuauugauauaa

SEQ ID NO: 3994292 - RNA, 15 nt, Staphylococcus aureus subsp. aureus Mu50
guuaugguauuuaua

SEQ ID NO: 3994293 - RNA, 14 nt, Staphylococcus aureus subsp. aureus Mu50
guuauguaugaaag

SEQ ID NO: 3994294 - RNA, 21 nt, Staphylococcus aureus subsp. aureus Mu50
guuauuaaaucuuuuacuaaa

SEQ ID NO: 3994295 - RNA, 15 nt, Staphylococcus aureus subsp. aureus Mu50
guuauuaaccaucau

SEQ ID NO: 3994296 - RNA, 15 nt, Staphylococcus aureus subsp. aureus Mu50
guuauuauaaaauaa

SEQ ID NO: 3994297 - RNA, 18 nt, Staphylococcus aureus subsp. aureus Mu50
guuauuauaaaauaaaua

SEQ ID NO: 3994298 - RNA, 17 nt, Staphylococcus aureus subsp. aureus Mu50
guuauuaucguaaaaaa

SEQ ID NO: 3994299 - RNA, 18 nt, Staphylococcus aureus subsp. aureus Mu50
guuauucguuaacaauca

SEQ ID NO: 3994300 - RNA, 17 nt, Staphylococcus aureus subsp. aureus Mu50
guuauugcuuauuuuug

SEQ ID NO: 3994301 - RNA, 15 nt, Staphylococcus aureus subsp. aureus Mu50
guuauuuauuugauu

SEQ ID NO: 3994302 - RNA, 22 nt, Staphylococcus aureus subsp. aureus Mu50
guuauuuuaauaacgauaagca

SEQ ID NO: 3994303 - RNA, 21 nt, Staphylococcus aureus subsp. aureus Mu50
guuauuuuugcuauuucaaca

SEQ ID NO: 3994304 - RNA, 15 nt, Staphylococcus aureus subsp. aureus Mu50
guucaaaauacucaa

SEQ ID NO: 3994305 - RNA, 20 nt, Staphylococcus aureus subsp. aureus Mu50
guucaaauaacgcaaugucu

SEQ ID NO: 3994306 - RNA, 21 nt, Staphylococcus aureus subsp. aureus Mu50
guucaaauugaacuucuuuuu

SEQ ID NO: 3994307 - RNA, 18 nt, Staphylococcus aureus subsp. aureus Mu50
guucaacuaaauuuucua

SEQ ID NO: 3994308 - RNA, 18 nt, Staphylococcus aureus subsp. aureus Mu50
guucaagcuuuauuuuuu

SEQ ID NO: 3994309 - RNA, 16 nt, Staphylococcus aureus subsp. aureus Mu50
guucaauauuuaucaa

SEQ ID NO: 3994310 - RNA, 18 nt, Staphylococcus aureus subsp. aureus Mu50
guucaauguuauuaaacc

SEQ ID NO: 3994311 - RNA, 12 nt, Staphylococcus aureus subsp. aureus Mu50
guucacaacaaa

SEQ ID NO: 3994312 - RNA, 17 nt, Staphylococcus aureus subsp. aureus Mu50
guucacaugaauuuuaa

SEQ ID NO: 3994313 - RNA, 15 nt, Staphylococcus aureus subsp. aureus Mu50
guucacguuaucaua

SEQ ID NO: 3994314 - RNA, 14 nt, Staphylococcus aureus subsp. aureus Mu50
guucacuugguaca

SEQ ID NO: 3994315 - RNA, 16 nt, Staphylococcus aureus subsp. aureus Mu50
guucacuugguacacc

SEQ ID NO: 3994316 - RNA, 14 nt, Staphylococcus aureus subsp. aureus Mu50
guucaguaggaauu

SEQ ID NO: 3994317 - RNA, 16 nt, Staphylococcus aureus subsp. aureus Mu50
guucaucaaacaacau

SEQ ID NO: 3994318 - RNA, 18 nt, Staphylococcus aureus subsp. aureus Mu50
guucaucaaacaacauca

SEQ ID NO: 3994319 - RNA, 14 nt, Staphylococcus aureus subsp. aureus Mu50
guucaucaacauga

SEQ ID NO: 3994320 - RNA, 17 nt, Staphylococcus aureus subsp. aureus Mu50
guucaugguuuaauuca

SEQ ID NO: 3994321 - RNA, 15 nt, Staphylococcus aureus subsp. aureus Mu50
guuccaaauucauuu

SEQ ID NO: 3994322 - RNA, 14 nt, Staphylococcus aureus subsp. aureus Mu50
guuccaaucuuuuu

SEQ ID NO: 3994323 - RNA, 18 nt, Staphylococcus aureus subsp. aureus Mu50
guuccaccgaauccuguu

SEQ ID NO: 3994324 - RNA, 22 nt, Staphylococcus aureus subsp. aureus Mu50
guuccccugaaaagaauaaguu

SEQ ID NO: 3994325 - RNA, 15 nt, Staphylococcus aureus subsp. aureus Mu50
guuccguugaauuaa

SEQ ID NO: 3994326 - RNA, 22 nt, Staphylococcus aureus subsp. aureus Mu50
guuccugcuacaacuucuucuc

SEQ ID NO: 3994327 - RNA, 14 nt, Staphylococcus aureus subsp. aureus Mu50
guucgggaauuuuu

SEQ ID NO: 3994328 - RNA, 15 nt, Staphylococcus aureus subsp. aureus Mu50
guucgggaauuuuuu

SEQ ID NO: 3994329 - RNA, 12 nt, Staphylococcus aureus subsp. aureus Mu50
guucuaaaauaa

SEQ ID NO: 3994330 - RNA, 12 nt, Staphylococcus aureus subsp. aureus Mu50
guucuaaaucuu

SEQ ID NO: 3994331 - RNA, 21 nt, Staphylococcus aureus subsp. aureus Mu50
guucuaaccauucguaauaaa

SEQ ID NO: 3994332 - RNA, 19 nt, Staphylococcus aureus subsp. aureus Mu50
guucuaguuuuuuuuauau

SEQ ID NO: 3994333 - RNA, 13 nt, Staphylococcus aureus subsp. aureus Mu50
guucuauaauaaa

SEQ ID NO: 3994334 - RNA, 15 nt, Staphylococcus aureus subsp. aureus Mu50
guucuauauaauuua

SEQ ID NO: 3994335 - RNA, 20 nt, Staphylococcus aureus subsp. aureus Mu50
guuucaaacgugauuuuauc

SEQ ID NO: 3994336 - RNA, 14 nt, Staphylococcus aureus subsp. aureus Mu50
guuucaacauauua

SEQ ID NO: 3994337 - RNA, 16 nt, Staphylococcus aureus subsp. aureus Mu50
guuucaacauauuaua

SEQ ID NO: 3994338 - RNA, 23 nt, Staphylococcus aureus subsp. aureus Mu50
guuucaacauuucagcauuugcu

SEQ ID NO: 3994339 - RNA, 15 nt, Staphylococcus aureus subsp. aureus Mu50
guuucaagugcuugg

SEQ ID NO: 3994340 - RNA, 22 nt, Staphylococcus aureus subsp. aureus Mu50
guuucaaugaguucuaguuuuu

SEQ ID NO: 3994341 - RNA, 12 nt, Staphylococcus aureus subsp. aureus Mu50
guuucaaugccu

SEQ ID NO: 3994342 - RNA, 23 nt, Staphylococcus aureus subsp. aureus Mu50
guuucaucuucaacuuuaucuaa

SEQ ID NO: 3994343 - RNA, 21 nt, Staphylococcus aureus subsp. aureus Mu50
guuucaugcacuuuaacauaa

SEQ ID NO: 3994344 - RNA, 13 nt, Staphylococcus aureus subsp. aureus Mu50
guuuccaaucuau

SEQ ID NO: 3994345 - RNA, 14 nt, Staphylococcus aureus subsp. aureus Mu50
guuuccauaaauaa

SEQ ID NO: 3994346 - RNA, 11 nt, Staphylococcus aureus subsp. aureus Mu50
guuucccaagc

SEQ ID NO: 3994347 - RNA, 20 nt, Staphylococcus aureus subsp. aureus Mu50
guuucggaaaaagaugaaaa

SEQ ID NO: 3994348 - RNA, 21 nt, Staphylococcus aureus subsp. aureus Mu50
guuucuaaauucuuuuuguuc

SEQ ID NO: 3994349 - RNA, 14 nt, Staphylococcus aureus subsp. aureus Mu50
guuucuccaguuuu

SEQ ID NO: 3994350 - RNA, 20 nt, Staphylococcus aureus subsp. aureus Mu50
guuucuccuacuauaaaauc

SEQ ID NO: 3994351 - RNA, 14 nt, Staphylococcus aureus subsp. aureus Mu50
guuucugacuuuua

SEQ ID NO: 3994352 - RNA, 16 nt, Staphylococcus aureus subsp. aureus Mu50
guuucuggcucuucuu

SEQ ID NO: 3994353 - RNA, 19 nt, Staphylococcus aureus subsp. aureus Mu50
guuucuggcucuucuuauc

SEQ ID NO: 3994354 - RNA, 20 nt, Staphylococcus aureus subsp. aureus Mu50
guuucuggcucuucuuaucu

SEQ ID NO: 3994355 - RNA, 16 nt, Staphylococcus aureus subsp. aureus Mu50
guuucuucaauugucu

SEQ ID NO: 3994356 - RNA, 17 nt, Staphylococcus aureus subsp. aureus Mu50
guuucuuccgcacugcc

SEQ ID NO: 3994357 - RNA, 15 nt, Staphylococcus aureus subsp. aureus Mu50
guuugaaaauuaacu

SEQ ID NO: 3994358 - RNA, 15 nt, Staphylococcus aureus subsp. aureus Mu50
guuugaaucauuuga

SEQ ID NO: 3994359 - RNA, 15 nt, Staphylococcus aureus subsp. aureus Mu50
guuugaauggcaaau

SEQ ID NO: 3994360 - RNA, 21 nt, Staphylococcus aureus subsp. aureus Mu50
guuugaauguuuuugauagua

SEQ ID NO: 3994361 - RNA, 23 nt, Staphylococcus aureus subsp. aureus Mu50
guuugacaaagcuaaagugaagu

SEQ ID NO: 3994362 - RNA, 15 nt, Staphylococcus aureus subsp. aureus Mu50
guuugacucuuuucu

SEQ ID NO: 3994363 - RNA, 16 nt, Staphylococcus aureus subsp. aureus Mu50
guuugaguaaauuaau

SEQ ID NO: 3994364 - RNA, 16 nt, Staphylococcus aureus subsp. aureus Mu50
guuugaucauaauuca

SEQ ID NO: 3994365 - RNA, 15 nt, Staphylococcus aureus subsp. aureus Mu50
guuugauuaaaaucu

SEQ ID NO: 3994366 - RNA, 15 nt, Staphylococcus aureus subsp. aureus Mu50
guuugauucuaaaua

SEQ ID NO: 3994367 - RNA, 13 nt, Staphylococcus aureus subsp. aureus Mu50
guuugauuucacu

SEQ ID NO: 3994368 - RNA, 15 nt, Staphylococcus aureus subsp. aureus Mu50
guuugcaacauauuu

SEQ ID NO: 3994369 - RNA, 13 nt, Staphylococcus aureus subsp. aureus Mu50
guuugcuuuuugu

SEQ ID NO: 3994370 - RNA, 15 nt, Staphylococcus aureus subsp. aureus Mu50
guuuggauaaaauga

SEQ ID NO: 3994371 - RNA, 17 nt, Staphylococcus aureus subsp. aureus Mu50
guuuggcauaauaauau

SEQ ID NO: 3994372 - RNA, 22 nt, Staphylococcus aureus subsp. aureus Mu50
guuuguaagacaacaaaucgau

SEQ ID NO: 3994373 - RNA, 13 nt, Staphylococcus aureus subsp. aureus Mu50
guuuguaauaauu

SEQ ID NO: 3994374 - RNA, 20 nt, Staphylococcus aureus subsp. aureus Mu50
guuuguggcaccucuuuugu

SEQ ID NO: 3994375 - RNA, 19 nt, Staphylococcus aureus subsp. aureus Mu50
guuuguuacauauugcauu

SEQ ID NO: 3994376 - RNA, 21 nt, Staphylococcus aureus subsp. aureus Mu50
guuuguuucuaaauucuuuuu

SEQ ID NO: 3994377 - RNA, 14 nt, Staphylococcus aureus subsp. aureus Mu50
guuuguuuucuuuc

SEQ ID NO: 3994378 - RNA, 12 nt, Staphylococcus aureus subsp. aureus Mu50
guuuuaaaagua

SEQ ID NO: 3994379 - RNA, 18 nt, Staphylococcus aureus subsp. aureus Mu50
guuuuaaacuuauuaauu

SEQ ID NO: 3994380 - RNA, 20 nt, Staphylococcus aureus subsp. aureus Mu50
guuuuaaagacugaaccgua

SEQ ID NO: 3994381 - RNA, 17 nt, Staphylococcus aureus subsp. aureus Mu50
guuuuaaagguuaaaua

SEQ ID NO: 3994382 - RNA, 20 nt, Staphylococcus aureus subsp. aureus Mu50
guuuuaauaauaucuuuugc

SEQ ID NO: 3994383 - RNA, 14 nt, Staphylococcus aureus subsp. aureus Mu50
guuuuaaucuuauu

SEQ ID NO: 3994384 - RNA, 13 nt, Staphylococcus aureus subsp. aureus Mu50
guuuuaauuucuu

SEQ ID NO: 3994385 - RNA, 20 nt, Staphylococcus aureus subsp. aureus Mu50
guuuuaccauaaauugaagu

SEQ ID NO: 3994386 - RNA, 14 nt, Staphylococcus aureus subsp. aureus Mu50
guuuuaccaucacg

SEQ ID NO: 3994387 - RNA, 18 nt, Staphylococcus aureus subsp. aureus Mu50
guuuuaccccuguugaau

SEQ ID NO: 3994388 - RNA, 22 nt, Staphylococcus aureus subsp. aureus Mu50
guuuuacuacugucucaucuuc

SEQ ID NO: 3994389 - RNA, 18 nt, Staphylococcus aureus subsp. aureus Mu50
guuuuacuuucaccauuu

SEQ ID NO: 3994390 - RNA, 23 nt, Staphylococcus aureus subsp. aureus Mu50
guuuuauggcgguuugaaaauga

SEQ ID NO: 3994391 - RNA, 15 nt, Staphylococcus aureus subsp. aureus Mu50
guuuuauuuauaaac

SEQ ID NO: 3994392 - RNA, 22 nt, Staphylococcus aureus subsp. aureus Mu50
guuuucaauucgcauuaaauaa

SEQ ID NO: 3994393 - RNA, 22 nt, Staphylococcus aureus subsp. aureus Mu50
guuuucacuguuuuaucuacag

SEQ ID NO: 3994394 - RNA, 12 nt, Staphylococcus aureus subsp. aureus Mu50
guuuucaucaac

SEQ ID NO: 3994395 - RNA, 21 nt, Staphylococcus aureus subsp. aureus Mu50
guuuucuuuauuuuaaacaug

SEQ ID NO: 3994396 - RNA, 15 nt, Staphylococcus aureus subsp. aureus Mu50
guuuugaagaauaaa

SEQ ID NO: 3994397 - RNA, 12 nt, Staphylococcus aureus subsp. aureus Mu50
guuuugagagau

SEQ ID NO: 3994398 - RNA, 12 nt, Staphylococcus aureus subsp. aureus Mu50
guuuugcuaacc

SEQ ID NO: 3994399 - RNA, 17 nt, Staphylococcus aureus subsp. aureus Mu50
guuuugcuaaccaucau

SEQ ID NO: 3994400 - RNA, 20 nt, Staphylococcus aureus subsp. aureus Mu50
guuuuguagauauagcaucu

SEQ ID NO: 3994401 - RNA, 13 nt, Staphylococcus aureus subsp. aureus Mu50
guuuuuaaaauua

SEQ ID NO: 3994402 - RNA, 14 nt, Staphylococcus aureus subsp. aureus Mu50
guuuuuaaauaauc

SEQ ID NO: 3994403 - RNA, 12 nt, Staphylococcus aureus subsp. aureus Mu50
guuuuuacuaua

SEQ ID NO: 3994404 - RNA, 12 nt, Staphylococcus aureus subsp. aureus Mu50
guuuuucaucaa

SEQ ID NO: 3994405 - RNA, 16 nt, Staphylococcus aureus subsp. aureus Mu50
guuuuugguagcauuu

SEQ ID NO: 3994406 - RNA, 22 nt, Staphylococcus aureus subsp. aureus Mu50
guuuuuuuagcuauagaaauga

SEQ ID NO: 3994407 - RNA, 23 nt, Staphylococcus aureus subsp. aureus Mu50
uaaaaaaaaccacgcacaucuaa

SEQ ID NO: 3994408 - RNA, 22 nt, Staphylococcus aureus subsp. aureus Mu50
uaaaaaaacgucgugucugaau

SEQ ID NO: 3994409 - RNA, 23 nt, Staphylococcus aureus subsp. aureus Mu50
uaaaaaaacgucuuuccauuuau

SEQ ID NO: 3994410 - RNA, 15 nt, Staphylococcus aureus subsp. aureus Mu50
uaaaaaaagacauga

SEQ ID NO: 3994411 - RNA, 21 nt, Staphylococcus aureus subsp. aureus Mu50
uaaaaaaaucacgcuaacauu

SEQ ID NO: 3994412 - RNA, 15 nt, Staphylococcus aureus subsp. aureus Mu50
uaaaaaaauuaacua

SEQ ID NO: 3994413 - RNA, 17 nt, Staphylococcus aureus subsp. aureus Mu50
uaaaaaacaauaaaauu

SEQ ID NO: 3994414 - RNA, 21 nt, Staphylococcus aureus subsp. aureus Mu50
uaaaaaacagcaguaagauau

SEQ ID NO: 3994415 - RNA, 17 nt, Staphylococcus aureus subsp. aureus Mu50
uaaaaaaccaauaaucc

SEQ ID NO: 3994416 - RNA, 20 nt, Staphylococcus aureus subsp. aureus Mu50
uaaaaaaccugaaacaaauu

SEQ ID NO: 3994417 - RNA, 17 nt, Staphylococcus aureus subsp. aureus Mu50
uaaaaaacgauaguagu

SEQ ID NO: 3994418 - RNA, 16 nt, Staphylococcus aureus subsp. aureus Mu50
uaaaaaacgguacaga

SEQ ID NO: 3994419 - RNA, 16 nt, Staphylococcus aureus subsp. aureus Mu50
uaaaaaaggaagaaca

SEQ ID NO: 3994420 - RNA, 13 nt, Staphylococcus aureus subsp. aureus Mu50
uaaaaaaguuauc

SEQ ID NO: 3994421 - RNA, 19 nt, Staphylococcus aureus subsp. aureus Mu50
uaaaaaauacucccuucaa

SEQ ID NO: 3994422 - RNA, 23 nt, Staphylococcus aureus subsp. aureus Mu50
uaaaaaauccggaacauuaaaag

SEQ ID NO: 3994423 - RNA, 14 nt, Staphylococcus aureus subsp. aureus Mu50
uaaaagauuagaug

SEQ ID NO: 3994424 - RNA, 21 nt, Staphylococcus aureus subsp. aureus Mu50
uaaaagauuagaugauauuua

SEQ ID NO: 3994425 - RNA, 18 nt, Staphylococcus aureus subsp. aureus Mu50
uaaaagccaacacauaaa

SEQ ID NO: 3994426 - RNA, 19 nt, Staphylococcus aureus subsp. aureus Mu50
uaaaagccaucuuaccuuu

SEQ ID NO: 3994427 - RNA, 13 nt, Staphylococcus aureus subsp. aureus Mu50
uaaaagccucuaa

SEQ ID NO: 3994428 - RNA, 23 nt, Staphylococcus aureus subsp. aureus Mu50
uaaaagccucuaaugauuaaaaa

SEQ ID NO: 3994429 - RNA, 22 nt, Staphylococcus aureus subsp. aureus Mu50
uaaaaggaagcaucuccaauuu

SEQ ID NO: 3994430 - RNA, 22 nt, Staphylococcus aureus subsp. aureus Mu50
uaaaaggaugugacaaauacuu

SEQ ID NO: 3994431 - RNA, 15 nt, Staphylococcus aureus subsp. aureus Mu50
uaaaaggcgaaacau

SEQ ID NO: 3994432 - RNA, 21 nt, Staphylococcus aureus subsp. aureus Mu50
uaaaaggcgaaacauuaaaau

SEQ ID NO: 3994433 - RNA, 22 nt, Staphylococcus aureus subsp. aureus Mu50
uaaaaggcgaaacauuaaaaua

SEQ ID NO: 3994434 - RNA, 16 nt, Staphylococcus aureus subsp. aureus Mu50
uaaaaggggaaaucau

SEQ ID NO: 3994435 - RNA, 21 nt, Staphylococcus aureus subsp. aureus Mu50
uaaaaggugugggcuuuauua

SEQ ID NO: 3994436 - RNA, 22 nt, Staphylococcus aureus subsp. aureus Mu50
uaaaaguaacauacuauaaaaa

SEQ ID NO: 3994437 - RNA, 18 nt, Staphylococcus aureus subsp. aureus Mu50
uaaaaguaagcaccuguu

SEQ ID NO: 3994438 - RNA, 17 nt, Staphylococcus aureus subsp. aureus Mu50
uaaaagucgauaaauau

SEQ ID NO: 3994439 - RNA, 23 nt, Staphylococcus aureus subsp. aureus Mu50
uaaaaguguugacuuuaucaauu

SEQ ID NO: 3994440 - RNA, 19 nt, Staphylococcus aureus subsp. aureus Mu50
uaaaaguuaccuacuacau

SEQ ID NO: 3994441 - RNA, 17 nt, Staphylococcus aureus subsp. aureus Mu50
uaaaaguuguaauuuaa

SEQ ID NO: 3994442 - RNA, 19 nt, Staphylococcus aureus subsp. aureus Mu50
uaaaaguuguaauuuaaaa

SEQ ID NO: 3994443 - RNA, 15 nt, Staphylococcus aureus subsp. aureus Mu50
uaaaaguuguauucu

SEQ ID NO: 3994444 - RNA, 20 nt, Staphylococcus aureus subsp. aureus Mu50
uaaaauaaaaaaugcacuga

SEQ ID NO: 3994445 - RNA, 15 nt, Staphylococcus aureus subsp. aureus Mu50
uaaaauaaaaugcaa

SEQ ID NO: 3994446 - RNA, 20 nt, Staphylococcus aureus subsp. aureus Mu50
uaaaauaaaaugguucucca

SEQ ID NO: 3994447 - RNA, 14 nt, Staphylococcus aureus subsp. aureus Mu50
uaaaauaaaauuaa

SEQ ID NO: 3994448 - RNA, 19 nt, Staphylococcus aureus subsp. aureus Mu50
uaaaauaaaguuugggcau

SEQ ID NO: 3994449 - RNA, 19 nt, Staphylococcus aureus subsp. aureus Mu50
uaaaauaacaacgauaauu

SEQ ID NO: 3994450 - RNA, 15 nt, Staphylococcus aureus subsp. aureus Mu50
uaaaauaagauauau

SEQ ID NO: 3994451 - RNA, 16 nt, Staphylococcus aureus subsp. aureus Mu50
uaaaauaauagauaau

SEQ ID NO: 3994452 - RNA, 18 nt, Staphylococcus aureus subsp. aureus Mu50
uaaaauaauagauaauag

SEQ ID NO: 3994453 - RNA, 13 nt, Staphylococcus aureus subsp. aureus Mu50
uaaaauaaucggu

SEQ ID NO: 3994454 - RNA, 20 nt, Staphylococcus aureus subsp. aureus Mu50
uaaaauaaucgguaauuacu

SEQ ID NO: 3994455 - RNA, 20 nt, Staphylococcus aureus subsp. aureus Mu50
uaaaauaaugauauauuaca

SEQ ID NO: 3994456 - RNA, 22 nt, Staphylococcus aureus subsp. aureus Mu50
uaaaauaaugucuuacuuuuaa

SEQ ID NO: 3994457 - RNA, 15 nt, Staphylococcus aureus subsp. aureus Mu50
uaaaauagaaaaauu

SEQ ID NO: 3994458 - RNA, 18 nt, Staphylococcus aureus subsp. aureus Mu50
uaaaauagaaaaauuuca

SEQ ID NO: 3994459 - RNA, 19 nt, Staphylococcus aureus subsp. aureus Mu50
uaaaauagaaaaauuucaa

SEQ ID NO: 3994460 - RNA, 21 nt, Staphylococcus aureus subsp. aureus Mu50
uaaaauagaguagacguaagu

SEQ ID NO: 3994461 - RNA, 15 nt, Staphylococcus aureus subsp. aureus Mu50
uaaaauagcugcaau

SEQ ID NO: 3994462 - RNA, 15 nt, Staphylococcus aureus subsp. aureus Mu50
uaaaauaguucuuua

SEQ ID NO: 3994463 - RNA, 16 nt, Staphylococcus aureus subsp. aureus Mu50
uaaaauaguucuuuaa

SEQ ID NO: 3994464 - RNA, 13 nt, Staphylococcus aureus subsp. aureus Mu50
uaaaauauaucuu

SEQ ID NO: 3994465 - RNA, 23 nt, Staphylococcus aureus subsp. aureus Mu50
uaaaauauaucuuaugauacuuu

SEQ ID NO: 3994466 - RNA, 19 nt, Staphylococcus aureus subsp. aureus Mu50
uaaaauauaugaauaaguc

SEQ ID NO: 3994467 - RNA, 20 nt, Staphylococcus aureus subsp. aureus Mu50
uaaaauaucaaaauauaaaa

SEQ ID NO: 3994468 - RNA, 16 nt, Staphylococcus aureus subsp. aureus Mu50
uaaaauaugacacaua

SEQ ID NO: 3994469 - RNA, 14 nt, Staphylococcus aureus subsp. aureus Mu50
uaaaaucaacuuuu

SEQ ID NO: 3994470 - RNA, 21 nt, Staphylococcus aureus subsp. aureus Mu50
uaaaaucacuugguaaaacau

SEQ ID NO: 3994471 - RNA, 19 nt, Staphylococcus aureus subsp. aureus Mu50
uaaaaucauaugucuuaac

SEQ ID NO: 3994472 - RNA, 15 nt, Staphylococcus aureus subsp. aureus Mu50
uaaaaucaucguauu

SEQ ID NO: 3994473 - RNA, 20 nt, Staphylococcus aureus subsp. aureus Mu50
uaaaaucauuaauaauuaaa

SEQ ID NO: 3994474 - RNA, 16 nt, Staphylococcus aureus subsp. aureus Mu50
uaaaaucgcgucugau

SEQ ID NO: 3994475 - RNA, 17 nt, Staphylococcus aureus subsp. aureus Mu50
uaaaaucgcgucugauu

SEQ ID NO: 3994476 - RNA, 23 nt, Staphylococcus aureus subsp. aureus Mu50
uaaaaucgcgucugauucucuaa

SEQ ID NO: 3994477 - RNA, 22 nt, Staphylococcus aureus subsp. aureus Mu50
uaaaaucuauaccauuccaaaa

SEQ ID NO: 3994478 - RNA, 13 nt, Staphylococcus aureus subsp. aureus Mu50
uaaaaucucauaa

SEQ ID NO: 3994479 - RNA, 17 nt, Staphylococcus aureus subsp. aureus Mu50
uaaaaucucauaauaau

SEQ ID NO: 3994480 - RNA, 17 nt, Staphylococcus aureus subsp. aureus Mu50
uaaaaucugcuuuauuu

SEQ ID NO: 3994481 - RNA, 20 nt, Staphylococcus aureus subsp. aureus Mu50
uaaaaucugcuuuauuuuau

SEQ ID NO: 3994482 - RNA, 20 nt, Staphylococcus aureus subsp. aureus Mu50
uaaaaugauagcuaaacauu

SEQ ID NO: 3994483 - RNA, 20 nt, Staphylococcus aureus subsp. aureus Mu50
uaaaaugauaucugacauuu

SEQ ID NO: 3994484 - RNA, 17 nt, Staphylococcus aureus subsp. aureus Mu50
uaaaaugauuguuuuaa

SEQ ID NO: 3994485 - RNA, 14 nt, Staphylococcus aureus subsp. aureus Mu50
uaaaaugcauagcu

SEQ ID NO: 3994486 - RNA, 20 nt, Staphylococcus aureus subsp. aureus Mu50
uaaaaugcuacaauuuccua

SEQ ID NO: 3994487 - RNA, 17 nt, Staphylococcus aureus subsp. aureus Mu50
uaaaauguuaauaauga

SEQ ID NO: 3994488 - RNA, 17 nt, Staphylococcus aureus subsp. aureus Mu50
uaaaauguuaggugaaa

SEQ ID NO: 3994489 - RNA, 20 nt, Staphylococcus aureus subsp. aureus Mu50
uaaaauguuaggugaaacca

SEQ ID NO: 3994490 - RNA, 23 nt, Staphylococcus aureus subsp. aureus Mu50
uaaaauguuaggugaaaccauac

SEQ ID NO: 3994491 - RNA, 15 nt, Staphylococcus aureus subsp. aureus Mu50
uaaaauuaaaacagc

SEQ ID NO: 3994492 - RNA, 21 nt, Staphylococcus aureus subsp. aureus Mu50
uaaaauuaaaccuacaacgaa

SEQ ID NO: 3994493 - RNA, 17 nt, Staphylococcus aureus subsp. aureus Mu50
uaaaauuaacuuaaaau

SEQ ID NO: 3994494 - RNA, 21 nt, Staphylococcus aureus subsp. aureus Mu50
uaaaauuaacuuaaaauuuaa

SEQ ID NO: 3994495 - RNA, 22 nt, Staphylococcus aureus subsp. aureus Mu50
uaaaauuaacuuaaaauuuaaa

SEQ ID NO: 3994496 - RNA, 20 nt, Staphylococcus aureus subsp. aureus Mu50
uaaaauuacuugaauauuau

SEQ ID NO: 3994497 - RNA, 12 nt, Staphylococcus aureus subsp. aureus Mu50
uaaaauuaucaa

SEQ ID NO: 3994498 - RNA, 14 nt, Staphylococcus aureus subsp. aureus Mu50
uaaaauucuuucag

SEQ ID NO: 3994499 - RNA, 20 nt, Staphylococcus aureus subsp. aureus Mu50
uaaaauugccaguaucucuu

SEQ ID NO: 3994500 - RNA, 22 nt, Staphylococcus aureus subsp. aureus Mu50
uaaaauuguauagaauguguau

SEQ ID NO: 3994501 - RNA, 16 nt, Staphylococcus aureus subsp. aureus Mu50
uaaaauuuaaaacaau

SEQ ID NO: 3994502 - RNA, 15 nt, Staphylococcus aureus subsp. aureus Mu50
uaaaauuuaaauauu

SEQ ID NO: 3994503 - RNA, 18 nt, Staphylococcus aureus subsp. aureus Mu50
uaaaauuuacaaauguau

SEQ ID NO: 3994504 - RNA, 20 nt, Staphylococcus aureus subsp. aureus Mu50
uaaaauuuacaaauguauaa

SEQ ID NO: 3994505 - RNA, 20 nt, Staphylococcus aureus subsp. aureus Mu50
uaaaauuucugcuucuuuua

SEQ ID NO: 3994506 - RNA, 14 nt, Staphylococcus aureus subsp. aureus Mu50
uaaaauuuuaauua

SEQ ID NO: 3994507 - RNA, 18 nt, Staphylococcus aureus subsp. aureus Mu50
uaaaauuuugaagaagug

SEQ ID NO: 3994508 - RNA, 22 nt, Staphylococcus aureus subsp. aureus Mu50
uaaaauuuugaagaagugccgu

SEQ ID NO: 3994509 - RNA, 18 nt, Staphylococcus aureus subsp. aureus Mu50
uaaaauuuuuaaaaaaau

SEQ ID NO: 3994510 - RNA, 18 nt, Staphylococcus aureus subsp. aureus Mu50
uaaagucaauuuaaauaa

SEQ ID NO: 3994511 - RNA, 21 nt, Staphylococcus aureus subsp. aureus Mu50
uaaagucguaucauauauuga

SEQ ID NO: 3994512 - RNA, 23 nt, Staphylococcus aureus subsp. aureus Mu50
uaaagucuucaucuuuaaagaaa

SEQ ID NO: 3994513 - RNA, 17 nt, Staphylococcus aureus subsp. aureus Mu50
uaaagugcguuuuucga

SEQ ID NO: 3994514 - RNA, 17 nt, Staphylococcus aureus subsp. aureus Mu50
uaaaguguuucaacaua

SEQ ID NO: 3994515 - RNA, 12 nt, Staphylococcus aureus subsp. aureus Mu50
uaaaguuacaug

SEQ ID NO: 3994516 - RNA, 18 nt, Staphylococcus aureus subsp. aureus Mu50
uaaaguuacaugcucuuu

SEQ ID NO: 3994517 - RNA, 15 nt, Staphylococcus aureus subsp. aureus Mu50
uaaaguuauaaauua

SEQ ID NO: 3994518 - RNA, 16 nt, Staphylococcus aureus subsp. aureus Mu50
uaaaguuauaaauuau

SEQ ID NO: 3994519 - RNA, 23 nt, Staphylococcus aureus subsp. aureus Mu50
uaaaguugacaauacaaaucgau

SEQ ID NO: 3994520 - RNA, 19 nt, Staphylococcus aureus subsp. aureus Mu50
uaaaguuuaaauauucacg

SEQ ID NO: 3994521 - RNA, 23 nt, Staphylococcus aureus subsp. aureus Mu50
uaaaguuuauuuauguucgauua

SEQ ID NO: 3994522 - RNA, 15 nt, Staphylococcus aureus subsp. aureus Mu50
uaaaguuuuguucaa

SEQ ID NO: 3994523 - RNA, 19 nt, Staphylococcus aureus subsp. aureus Mu50
uaaauaaaaauacauaauu

SEQ ID NO: 3994524 - RNA, 14 nt, Staphylococcus aureus subsp. aureus Mu50
uaaauaaaaauuau

SEQ ID NO: 3994525 - RNA, 15 nt, Staphylococcus aureus subsp. aureus Mu50
uaaauaaaaauuaua

SEQ ID NO: 3994526 - RNA, 20 nt, Staphylococcus aureus subsp. aureus Mu50
uaaauaaaaauuauauaaau

SEQ ID NO: 3994527 - RNA, 18 nt, Staphylococcus aureus subsp. aureus Mu50
uaaauaaaaggcauucuu

SEQ ID NO: 3994528 - RNA, 23 nt, Staphylococcus aureus subsp. aureus Mu50
uaaauaaaaguuaccuacuacau

SEQ ID NO: 3994529 - RNA, 13 nt, Staphylococcus aureus subsp. aureus Mu50
uaaauaaaaugca

SEQ ID NO: 3994530 - RNA, 15 nt, Staphylococcus aureus subsp. aureus Mu50
uaaauaaaauuguug

SEQ ID NO: 3994531 - RNA, 11 nt, Staphylococcus aureus subsp. aureus Mu50
uaaauaaacaa

SEQ ID NO: 3994532 - RNA, 14 nt, Staphylococcus aureus subsp. aureus Mu50
uaaauaaacaacug

SEQ ID NO: 3994533 - RNA, 15 nt, Staphylococcus aureus subsp. aureus Mu50
uaaauaaacaacugc

SEQ ID NO: 3994534 - RNA, 16 nt, Staphylococcus aureus subsp. aureus Mu50
uaaauaaacucaccaa

SEQ ID NO: 3994535 - RNA, 20 nt, Staphylococcus aureus subsp. aureus Mu50
uaaauaaacuuuaugaaauu

SEQ ID NO: 3994536 - RNA, 19 nt, Staphylococcus aureus subsp. aureus Mu50
uaaauaacaguuaauuaua

SEQ ID NO: 3994537 - RNA, 20 nt, Staphylococcus aureus subsp. aureus Mu50
uaaauaaccgcacuuucuau

SEQ ID NO: 3994538 - RNA, 21 nt, Staphylococcus aureus subsp. aureus Mu50
uaaauaaccgcacuuucuauu

SEQ ID NO: 3994539 - RNA, 13 nt, Staphylococcus aureus subsp. aureus Mu50
uaaauaacuucgu

SEQ ID NO: 3994540 - RNA, 21 nt, Staphylococcus aureus subsp. aureus Mu50
uaaauaacuucguuuuaauaa

SEQ ID NO: 3994541 - RNA, 15 nt, Staphylococcus aureus subsp. aureus Mu50
uaaauaacuuuacca

SEQ ID NO: 3994542 - RNA, 17 nt, Staphylococcus aureus subsp. aureus Mu50
uaaauaacuuuaccacc

SEQ ID NO: 3994543 - RNA, 19 nt, Staphylococcus aureus subsp. aureus Mu50
uaaauaacuuuuuaaagga

SEQ ID NO: 3994544 - RNA, 19 nt, Staphylococcus aureus subsp. aureus Mu50
uaaauaagcaaucauaaua

SEQ ID NO: 3994545 - RNA, 13 nt, Staphylococcus aureus subsp. aureus Mu50
uaaauaaguaguu

SEQ ID NO: 3994546 - RNA, 14 nt, Staphylococcus aureus subsp. aureus Mu50
uaaauaauaaaugc

SEQ ID NO: 3994547 - RNA, 14 nt, Staphylococcus aureus subsp. aureus Mu50
uaaauaauaauuca

SEQ ID NO: 3994548 - RNA, 19 nt, Staphylococcus aureus subsp. aureus Mu50
uaaauaaucgaaaauuuca

SEQ ID NO: 3994549 - RNA, 19 nt, Staphylococcus aureus subsp. aureus Mu50
uaaauaaucgaagauagag

SEQ ID NO: 3994550 - RNA, 23 nt, Staphylococcus aureus subsp. aureus Mu50
uaaauaauguugucacuuggauu

SEQ ID NO: 3994551 - RNA, 17 nt, Staphylococcus aureus subsp. aureus Mu50
uaaauacaaaaauauag

SEQ ID NO: 3994552 - RNA, 20 nt, Staphylococcus aureus subsp. aureus Mu50
uaaauacaaagccuuaauau

SEQ ID NO: 3994553 - RNA, 22 nt, Staphylococcus aureus subsp. aureus Mu50
uaaauacaaagccuuaauauca

SEQ ID NO: 3994554 - RNA, 11 nt, Staphylococcus aureus subsp. aureus Mu50
uaaauacaaua

SEQ ID NO: 3994555 - RNA, 16 nt, Staphylococcus aureus subsp. aureus Mu50
uaaauacaauguuauu

SEQ ID NO: 3994556 - RNA, 16 nt, Staphylococcus aureus subsp. aureus Mu50
uaaauacaauuucuuc

SEQ ID NO: 3994557 - RNA, 17 nt, Staphylococcus aureus subsp. aureus Mu50
uaaauacaauuucuuca

SEQ ID NO: 3994558 - RNA, 13 nt, Staphylococcus aureus subsp. aureus Mu50
uaaauacaucgga

SEQ ID NO: 3994559 - RNA, 20 nt, Staphylococcus aureus subsp. aureus Mu50
uaaauacgccaaauaucagu

SEQ ID NO: 3994560 - RNA, 18 nt, Staphylococcus aureus subsp. aureus Mu50
uaaauagcuucuuaaauc

SEQ ID NO: 3994561 - RNA, 13 nt, Staphylococcus aureus subsp. aureus Mu50
uaaauaggaugaa

SEQ ID NO: 3994562 - RNA, 22 nt, Staphylococcus aureus subsp. aureus Mu50
uaaauaguaagguuugaacucu

SEQ ID NO: 3994563 - RNA, 16 nt, Staphylococcus aureus subsp. aureus Mu50
uaaauaguauagcgca

SEQ ID NO: 3994564 - RNA, 18 nt, Staphylococcus aureus subsp. aureus Mu50
uaaauagugcuuuuucaa

SEQ ID NO: 3994565 - RNA, 21 nt, Staphylococcus aureus subsp. aureus Mu50
uaaauagugcuuuuucaaaau

SEQ ID NO: 3994566 - RNA, 17 nt, Staphylococcus aureus subsp. aureus Mu50
uaaauaguuuuucauau

SEQ ID NO: 3994567 - RNA, 20 nt, Staphylococcus aureus subsp. aureus Mu50
uaaauauaaaccagcugauu

SEQ ID NO: 3994568 - RNA, 15 nt, Staphylococcus aureus subsp. aureus Mu50
uaaauauaaauauga

SEQ ID NO: 3994569 - RNA, 17 nt, Staphylococcus aureus subsp. aureus Mu50
uaaauauaaauaugaau

SEQ ID NO: 3994570 - RNA, 15 nt, Staphylococcus aureus subsp. aureus Mu50
uaaauauaaugaucc

SEQ ID NO: 3994571 - RNA, 17 nt, Staphylococcus aureus subsp. aureus Mu50
uaaauauaguaauaaaa

SEQ ID NO: 3994572 - RNA, 23 nt, Staphylococcus aureus subsp. aureus Mu50
uaaauauauugcacauaaaaaau

SEQ ID NO: 3994573 - RNA, 15 nt, Staphylococcus aureus subsp. aureus Mu50
uaaauaucaauaauu

SEQ ID NO: 3994574 - RNA, 12 nt, Staphylococcus aureus subsp. aureus Mu50
uaaauaucaauu

SEQ ID NO: 3994575 - RNA, 16 nt, Staphylococcus aureus subsp. aureus Mu50
uaaauaucauaaaugc

SEQ ID NO: 3994576 - RNA, 20 nt, Staphylococcus aureus subsp. aureus Mu50
uaaauaucauaccguacaaa

SEQ ID NO: 3994577 - RNA, 19 nt, Staphylococcus aureus subsp. aureus Mu50
uaaauaucgacaaauuaaa

SEQ ID NO: 3994578 - RNA, 20 nt, Staphylococcus aureus subsp. aureus Mu50
uaaauaucuuaguauguuca

SEQ ID NO: 3994579 - RNA, 19 nt, Staphylococcus aureus subsp. aureus Mu50
uaaauaucuuuuucuaagu

SEQ ID NO: 3994580 - RNA, 13 nt, Staphylococcus aureus subsp. aureus Mu50
uaaauaugaaucu

SEQ ID NO: 3994581 - RNA, 22 nt, Staphylococcus aureus subsp. aureus Mu50
uaaauaugacgcgugaauuaaa

SEQ ID NO: 3994582 - RNA, 19 nt, Staphylococcus aureus subsp. aureus Mu50
uaaauaugauguuaaaaaa

SEQ ID NO: 3994583 - RNA, 23 nt, Staphylococcus aureus subsp. aureus Mu50
uaaauaugauguuaaaaaauaug

SEQ ID NO: 3994584 - RNA, 17 nt, Staphylococcus aureus subsp. aureus Mu50
uaaauaugguuucuuau

SEQ ID NO: 3994585 - RNA, 18 nt, Staphylococcus aureus subsp. aureus Mu50
uaaauaugguuucuuauu

SEQ ID NO: 3994586 - RNA, 14 nt, Staphylococcus aureus subsp. aureus Mu50
uaaauauuaaauua

SEQ ID NO: 3994587 - RNA, 16 nt, Staphylococcus aureus subsp. aureus Mu50
uaaauauuaaauucau

SEQ ID NO: 3994588 - RNA, 22 nt, Staphylococcus aureus subsp. aureus Mu50
uaaauauuauuuugcaauugca

SEQ ID NO: 3994589 - RNA, 13 nt, Staphylococcus aureus subsp. aureus Mu50
uaaauauugaaca

SEQ ID NO: 3994590 - RNA, 15 nt, Staphylococcus aureus subsp. aureus Mu50
uaaauauugauauaa

SEQ ID NO: 3994591 - RNA, 19 nt, Staphylococcus aureus subsp. aureus Mu50
uaaauauugauauaaaaaa

SEQ ID NO: 3994592 - RNA, 21 nt, Staphylococcus aureus subsp. aureus Mu50
uaaauauugauucuagugaaa

SEQ ID NO: 3994593 - RNA, 18 nt, Staphylococcus aureus subsp. aureus Mu50
uaaauauuggaauacucu

SEQ ID NO: 3994594 - RNA, 19 nt, Staphylococcus aureus subsp. aureus Mu50
uaaauauuuaaaauauuau

SEQ ID NO: 3994595 - RNA, 18 nt, Staphylococcus aureus subsp. aureus Mu50
uaaauauuuaauuggauu

SEQ ID NO: 3994596 - RNA, 15 nt, Staphylococcus aureus subsp. aureus Mu50
uaaauauuuuuaauu

SEQ ID NO: 3994597 - RNA, 21 nt, Staphylococcus aureus subsp. aureus Mu50
uaaauugagcaacucaggaau

SEQ ID NO: 3994598 - RNA, 14 nt, Staphylococcus aureus subsp. aureus Mu50
uaaauugauucuuu

SEQ ID NO: 3994599 - RNA, 18 nt, Staphylococcus aureus subsp. aureus Mu50
uaaauugcacgucuugua

SEQ ID NO: 3994600 - RNA, 15 nt, Staphylococcus aureus subsp. aureus Mu50
uaaauuguauuucuu

SEQ ID NO: 3994601 - RNA, 17 nt, Staphylococcus aureus subsp. aureus Mu50
uaaauuguauuucuuaa

SEQ ID NO: 3994602 - RNA, 21 nt, Staphylococcus aureus subsp. aureus Mu50
uaaauuguuaucguucaaugu

SEQ ID NO: 3994603 - RNA, 17 nt, Staphylococcus aureus subsp. aureus Mu50
uaaauuguuuacuauac

SEQ ID NO: 3994604 - RNA, 20 nt, Staphylococcus aureus subsp. aureus Mu50
uaaauuguuuacuauacuuu

SEQ ID NO: 3994605 - RNA, 17 nt, Staphylococcus aureus subsp. aureus Mu50
uaaauuuaaaagaaaaa

SEQ ID NO: 3994606 - RNA, 14 nt, Staphylococcus aureus subsp. aureus Mu50
uaaauuuaaaauaa

SEQ ID NO: 3994607 - RNA, 16 nt, Staphylococcus aureus subsp. aureus Mu50
uaaauuuaaaauaaua

SEQ ID NO: 3994608 - RNA, 23 nt, Staphylococcus aureus subsp. aureus Mu50
uaaauuuaacucaacuuaaauau

SEQ ID NO: 3994609 - RNA, 19 nt, Staphylococcus aureus subsp. aureus Mu50
uaaauuuagauauuauaaa

SEQ ID NO: 3994610 - RNA, 14 nt, Staphylococcus aureus subsp. aureus Mu50
uaaauuuaguaucu

SEQ ID NO: 3994611 - RNA, 13 nt, Staphylococcus aureus subsp. aureus Mu50
uaaauuucaaggu

SEQ ID NO: 3994612 - RNA, 14 nt, Staphylococcus aureus subsp. aureus Mu50
uaaauuuccaaagu

SEQ ID NO: 3994613 - RNA, 17 nt, Staphylococcus aureus subsp. aureus Mu50
uaaauuucugaacauaa

SEQ ID NO: 3994614 - RNA, 13 nt, Staphylococcus aureus subsp. aureus Mu50
uaaauuugaaagu

SEQ ID NO: 3994615 - RNA, 15 nt, Staphylococcus aureus subsp. aureus Mu50
uaaauuugaaaguaa

SEQ ID NO: 3994616 - RNA, 17 nt, Staphylococcus aureus subsp. aureus Mu50
uaaauuugaaaguaaau

SEQ ID NO: 3994617 - RNA, 17 nt, Staphylococcus aureus subsp. aureus Mu50
uaaauuuguguucaaau

SEQ ID NO: 3994618 - RNA, 18 nt, Staphylococcus aureus subsp. aureus Mu50
uaaauuuuacgaaaauau

SEQ ID NO: 3994619 - RNA, 20 nt, Staphylococcus aureus subsp. aureus Mu50
uaaauuuuacgaaaauauca

SEQ ID NO: 3994620 - RNA, 17 nt, Staphylococcus aureus subsp. aureus Mu50
uaaauuuuauauauccu

SEQ ID NO: 3994621 - RNA, 18 nt, Staphylococcus aureus subsp. aureus Mu50
uaaauuuuauauauccug

SEQ ID NO: 3994622 - RNA, 18 nt, Staphylococcus aureus subsp. aureus Mu50
uaaauuuuaucuaaacau

SEQ ID NO: 3994623 - RNA, 19 nt, Staphylococcus aureus subsp. aureus Mu50
uaaauuuuaucuaaacauu

SEQ ID NO: 3994624 - RNA, 20 nt, Staphylococcus aureus subsp. aureus Mu50
uaaauuuuaucuaaacauuu

SEQ ID NO: 3994625 - RNA, 12 nt, Staphylococcus aureus subsp. aureus Mu50
uaaauuuucauc

SEQ ID NO: 3994626 - RNA, 20 nt, Staphylococcus aureus subsp. aureus Mu50
uaaauuuucaucauaaucug

SEQ ID NO: 3994627 - RNA, 20 nt, Staphylococcus aureus subsp. aureus Mu50
uaaauuuucuguuuaauuaa

SEQ ID NO: 3994628 - RNA, 15 nt, Staphylococcus aureus subsp. aureus Mu50
uaaauuuuguauaac

SEQ ID NO: 3994629 - RNA, 17 nt, Staphylococcus aureus subsp. aureus Mu50
uaacaaaauuaagaaga

SEQ ID NO: 3994630 - RNA, 20 nt, Staphylococcus aureus subsp. aureus Mu50
uaacaaaauuaagaagaaau

SEQ ID NO: 3994631 - RNA, 13 nt, Staphylococcus aureus subsp. aureus Mu50
uaacaaagucucu

SEQ ID NO: 3994632 - RNA, 14 nt, Staphylococcus aureus subsp. aureus Mu50
uaacaaauuagaau

SEQ ID NO: 3994633 - RNA, 17 nt, Staphylococcus aureus subsp. aureus Mu50
uaacaacacuacccaca

SEQ ID NO: 3994634 - RNA, 20 nt, Staphylococcus aureus subsp. aureus Mu50
uaacaaccgucccauaaaag

SEQ ID NO: 3994635 - RNA, 14 nt, Staphylococcus aureus subsp. aureus Mu50
uaacaagaaguaau

SEQ ID NO: 3994636 - RNA, 19 nt, Staphylococcus aureus subsp. aureus Mu50
uaacaagaaguaauguuaa

SEQ ID NO: 3994637 - RNA, 20 nt, Staphylococcus aureus subsp. aureus Mu50
uaacaagcauuuuucaauua

SEQ ID NO: 3994638 - RNA, 23 nt, Staphylococcus aureus subsp. aureus Mu50
uaacaagcauuuuucaauuauag

SEQ ID NO: 3994639 - RNA, 13 nt, Staphylococcus aureus subsp. aureus Mu50
uaacaagcuuuuu

SEQ ID NO: 3994640 - RNA, 20 nt, Staphylococcus aureus subsp. aureus Mu50
uaacaagcuuuuuucaauuc

SEQ ID NO: 3994641 - RNA, 18 nt, Staphylococcus aureus subsp. aureus Mu50
uaacaaggccugcaucac

SEQ ID NO: 3994642 - RNA, 20 nt, Staphylococcus aureus subsp. aureus Mu50
uaacaaguacaauaauaccu

SEQ ID NO: 3994643 - RNA, 18 nt, Staphylococcus aureus subsp. aureus Mu50
uaacaaguaguaugucau

SEQ ID NO: 3994644 - RNA, 13 nt, Staphylococcus aureus subsp. aureus Mu50
uaacaaguauaaa

SEQ ID NO: 3994645 - RNA, 16 nt, Staphylococcus aureus subsp. aureus Mu50
uaacaaguauaaaugc

SEQ ID NO: 3994646 - RNA, 21 nt, Staphylococcus aureus subsp. aureus Mu50
uaacaauacgcaauuagaguu

SEQ ID NO: 3994647 - RNA, 19 nt, Staphylococcus aureus subsp. aureus Mu50
uaacaauagugacuuuuau

SEQ ID NO: 3994648 - RNA, 23 nt, Staphylococcus aureus subsp. aureus Mu50
uaacaaugcagcuguauuuaaua

SEQ ID NO: 3994649 - RNA, 13 nt, Staphylococcus aureus subsp. aureus Mu50
uaacaaugcgauu

SEQ ID NO: 3994650 - RNA, 20 nt, Staphylococcus aureus subsp. aureus Mu50
uaacaauuacgacaagaauu

SEQ ID NO: 3994651 - RNA, 16 nt, Staphylococcus aureus subsp. aureus Mu50
uaacaauuuauuaaaa

SEQ ID NO: 3994652 - RNA, 22 nt, Staphylococcus aureus subsp. aureus Mu50
uaacaauuuauuaaaacgaagu

SEQ ID NO: 3994653 - RNA, 13 nt, Staphylococcus aureus subsp. aureus Mu50
uaacaauuuuaaa

SEQ ID NO: 3994654 - RNA, 17 nt, Staphylococcus aureus subsp. aureus Mu50
uaacaauuuuaaaucuu

SEQ ID NO: 3994655 - RNA, 15 nt, Staphylococcus aureus subsp. aureus Mu50
uaacaauuuuaucug

SEQ ID NO: 3994656 - RNA, 21 nt, Staphylococcus aureus subsp. aureus Mu50
uaacaauuuuguugcaugacu

SEQ ID NO: 3994657 - RNA, 18 nt, Staphylococcus aureus subsp. aureus Mu50
uaacacauucaaauaaau

SEQ ID NO: 3994658 - RNA, 21 nt, Staphylococcus aureus subsp. aureus Mu50
uaacacauucuuauuugaaau

SEQ ID NO: 3994659 - RNA, 19 nt, Staphylococcus aureus subsp. aureus Mu50
uaacaccaauuaaaucgau

SEQ ID NO: 3994660 - RNA, 16 nt, Staphylococcus aureus subsp. aureus Mu50
uaacacgauaauuaua

SEQ ID NO: 3994661 - RNA, 18 nt, Staphylococcus aureus subsp. aureus Mu50
uaacacgcucuuuucaaa

SEQ ID NO: 3994662 - RNA, 23 nt, Staphylococcus aureus subsp. aureus Mu50
uaacacucuagagguaaaucuau

SEQ ID NO: 3994663 - RNA, 15 nt, Staphylococcus aureus subsp. aureus Mu50
uaacagcuaaaaauu

SEQ ID NO: 3994664 - RNA, 16 nt, Staphylococcus aureus subsp. aureus Mu50
uaacagcuaaaaauuc

SEQ ID NO: 3994665 - RNA, 16 nt, Staphylococcus aureus subsp. aureus Mu50
uaacagcuacaaauaa

SEQ ID NO: 3994666 - RNA, 18 nt, Staphylococcus aureus subsp. aureus Mu50
uaacagcuacaaauaaug

SEQ ID NO: 3994667 - RNA, 21 nt, Staphylococcus aureus subsp. aureus Mu50
uaacagucccaaccccuuuau

SEQ ID NO: 3994668 - RNA, 13 nt, Staphylococcus aureus subsp. aureus Mu50
uaacauaaaaaug

SEQ ID NO: 3994669 - RNA, 20 nt, Staphylococcus aureus subsp. aureus Mu50
uaacauaaaaaugcucaagu

SEQ ID NO: 3994670 - RNA, 13 nt, Staphylococcus aureus subsp. aureus Mu50
uaacauaauuuuu

SEQ ID NO: 3994671 - RNA, 17 nt, Staphylococcus aureus subsp. aureus Mu50
uaacauacuauaaaaau

SEQ ID NO: 3994672 - RNA, 18 nt, Staphylococcus aureus subsp. aureus Mu50
uaacauacuauaaaaauu

SEQ ID NO: 3994673 - RNA, 18 nt, Staphylococcus aureus subsp. aureus Mu50
uaacauagcuuaauaauu

SEQ ID NO: 3994674 - RNA, 15 nt, Staphylococcus aureus subsp. aureus Mu50
uaacauaucagcuuu

SEQ ID NO: 3994675 - RNA, 22 nt, Staphylococcus aureus subsp. aureus Mu50
uaacauaucgcgcaucaaaaau

SEQ ID NO: 3994676 - RNA, 16 nt, Staphylococcus aureus subsp. aureus Mu50
uaacauauguacuauu

SEQ ID NO: 3994677 - RNA, 16 nt, Staphylococcus aureus subsp. aureus Mu50
uaacaucaaauagaca

SEQ ID NO: 3994678 - RNA, 22 nt, Staphylococcus aureus subsp. aureus Mu50
uaacaucaaauagacaccaaaa

SEQ ID NO: 3994679 - RNA, 14 nt, Staphylococcus aureus subsp. aureus Mu50
uaacaucaauuacu

SEQ ID NO: 3994680 - RNA, 21 nt, Staphylococcus aureus subsp. aureus Mu50
uaacauccugcuuauuaauug

SEQ ID NO: 3994681 - RNA, 22 nt, Staphylococcus aureus subsp. aureus Mu50
uaacauccuuugauguuuucua

SEQ ID NO: 3994682 - RNA, 21 nt, Staphylococcus aureus subsp. aureus Mu50
uaacaucuucauguaugaagu

SEQ ID NO: 3994683 - RNA, 19 nt, Staphylococcus aureus subsp. aureus Mu50
uaacaugaccuaauauauu

SEQ ID NO: 3994684 - RNA, 14 nt, Staphylococcus aureus subsp. aureus Mu50
uaacuugauaucau

SEQ ID NO: 3994685 - RNA, 17 nt, Staphylococcus aureus subsp. aureus Mu50
uaacuuguguuauguau

SEQ ID NO: 3994686 - RNA, 21 nt, Staphylococcus aureus subsp. aureus Mu50
uaacuuuaauauaaguauaau

SEQ ID NO: 3994687 - RNA, 14 nt, Staphylococcus aureus subsp. aureus Mu50
uaacuuuaccaaua

SEQ ID NO: 3994688 - RNA, 18 nt, Staphylococcus aureus subsp. aureus Mu50
uaacuuuaccaauaucau

SEQ ID NO: 3994689 - RNA, 13 nt, Staphylococcus aureus subsp. aureus Mu50
uaacuuuaucacu

SEQ ID NO: 3994690 - RNA, 22 nt, Staphylococcus aureus subsp. aureus Mu50
uaacuuuaucuaguuguuuuau

SEQ ID NO: 3994691 - RNA, 16 nt, Staphylococcus aureus subsp. aureus Mu50
uaacuuucagcaccag

SEQ ID NO: 3994692 - RNA, 22 nt, Staphylococcus aureus subsp. aureus Mu50
uaacuuucuaauuguuucauug

SEQ ID NO: 3994693 - RNA, 18 nt, Staphylococcus aureus subsp. aureus Mu50
uaacuuuuuaauaauugu

SEQ ID NO: 3994694 - RNA, 21 nt, Staphylococcus aureus subsp. aureus Mu50
uaacuuuuuaauaauuguauc

SEQ ID NO: 3994695 - RNA, 21 nt, Staphylococcus aureus subsp. aureus Mu50
uaagaaaaaguuauaucauca

SEQ ID NO: 3994696 - RNA, 14 nt, Staphylococcus aureus subsp. aureus Mu50
uaagaagcuuucug

SEQ ID NO: 3994697 - RNA, 13 nt, Staphylococcus aureus subsp. aureus Mu50
uaagaauuaacaa

SEQ ID NO: 3994698 - RNA, 13 nt, Staphylococcus aureus subsp. aureus Mu50
uaagaauuuaaaa

SEQ ID NO: 3994699 - RNA, 14 nt, Staphylococcus aureus subsp. aureus Mu50
uaagaauuuaaaag

SEQ ID NO: 3994700 - RNA, 17 nt, Staphylococcus aureus subsp. aureus Mu50
uaagacagcuucucauu

SEQ ID NO: 3994701 - RNA, 16 nt, Staphylococcus aureus subsp. aureus Mu50
uaagacauaugcagug

SEQ ID NO: 3994702 - RNA, 23 nt, Staphylococcus aureus subsp. aureus Mu50
uaagaccacaucgauaucuaagu

SEQ ID NO: 3994703 - RNA, 14 nt, Staphylococcus aureus subsp. aureus Mu50
uaagacuucccaau

SEQ ID NO: 3994704 - RNA, 17 nt, Staphylococcus aureus subsp. aureus Mu50
uaagagaacuuuucaaa

SEQ ID NO: 3994705 - RNA, 20 nt, Staphylococcus aureus subsp. aureus Mu50
uaagagaacuuuucaaacaa

SEQ ID NO: 3994706 - RNA, 22 nt, Staphylococcus aureus subsp. aureus Mu50
uaagagaacuuuucaaacaaua

SEQ ID NO: 3994707 - RNA, 21 nt, Staphylococcus aureus subsp. aureus Mu50
uaagagucuucuuacugcaau

SEQ ID NO: 3994708 - RNA, 23 nt, Staphylococcus aureus subsp. aureus Mu50
uaagagucuucuuacugcaauua

SEQ ID NO: 3994709 - RNA, 18 nt, Staphylococcus aureus subsp. aureus Mu50
uaagauaacgagugaaaa

SEQ ID NO: 3994710 - RNA, 20 nt, Staphylococcus aureus subsp. aureus Mu50
uaagauacuuuuaaauuaug

SEQ ID NO: 3994711 - RNA, 12 nt, Staphylococcus aureus subsp. aureus Mu50
uaagauauauug

SEQ ID NO: 3994712 - RNA, 22 nt, Staphylococcus aureus subsp. aureus Mu50
uaagauguauaugaauuuuaua

SEQ ID NO: 3994713 - RNA, 12 nt, Staphylococcus aureus subsp. aureus Mu50
uaagauuauuug

SEQ ID NO: 3994714 - RNA, 14 nt, Staphylococcus aureus subsp. aureus Mu50
uaagcaauuucuac

SEQ ID NO: 3994715 - RNA, 22 nt, Staphylococcus aureus subsp. aureus Mu50
uaagcagagccauaaugagagu

SEQ ID NO: 3994716 - RNA, 20 nt, Staphylococcus aureus subsp. aureus Mu50
uaagcaguuaauaagaaacu

SEQ ID NO: 3994717 - RNA, 21 nt, Staphylococcus aureus subsp. aureus Mu50
uaagcaguuaauaagaaacuu

SEQ ID NO: 3994718 - RNA, 20 nt, Staphylococcus aureus subsp. aureus Mu50
uaagcauaauucaacuuaaa

SEQ ID NO: 3994719 - RNA, 18 nt, Staphylococcus aureus subsp. aureus Mu50
uaagcaucacauaugucc

SEQ ID NO: 3994720 - RNA, 13 nt, Staphylococcus aureus subsp. aureus Mu50
uaagccauaugcu

SEQ ID NO: 3994721 - RNA, 17 nt, Staphylococcus aureus subsp. aureus Mu50
uaagccuuuucaaacau

SEQ ID NO: 3994722 - RNA, 21 nt, Staphylococcus aureus subsp. aureus Mu50
uaagcgcaauggccauuugau

SEQ ID NO: 3994723 - RNA, 18 nt, Staphylococcus aureus subsp. aureus Mu50
uaagcgcaauuaaaagua

SEQ ID NO: 3994724 - RNA, 16 nt, Staphylococcus aureus subsp. aureus Mu50
uaagcguuuaaucaca

SEQ ID NO: 3994725 - RNA, 21 nt, Staphylococcus aureus subsp. aureus Mu50
uaagcucauuucaauauuaaa

SEQ ID NO: 3994726 - RNA, 19 nt, Staphylococcus aureus subsp. aureus Mu50
uaagcugaaaaucaucauu

SEQ ID NO: 3994727 - RNA, 12 nt, Staphylococcus aureus subsp. aureus Mu50
uaagcugaaaua

SEQ ID NO: 3994728 - RNA, 21 nt, Staphylococcus aureus subsp. aureus Mu50
uaagcuuaucaacgauuuugu

SEQ ID NO: 3994729 - RNA, 13 nt, Staphylococcus aureus subsp. aureus Mu50
uaagcuuguaaca

SEQ ID NO: 3994730 - RNA, 17 nt, Staphylococcus aureus subsp. aureus Mu50
uaagcuuguaacaagca

SEQ ID NO: 3994731 - RNA, 13 nt, Staphylococcus aureus subsp. aureus Mu50
uaagcuuguaauc

SEQ ID NO: 3994732 - RNA, 12 nt, Staphylococcus aureus subsp. aureus Mu50
uaagcuuucauu

SEQ ID NO: 3994733 - RNA, 14 nt, Staphylococcus aureus subsp. aureus Mu50
uaagcuuucauuaa

SEQ ID NO: 3994734 - RNA, 15 nt, Staphylococcus aureus subsp. aureus Mu50
uaagcuuuguuugac

SEQ ID NO: 3994735 - RNA, 13 nt, Staphylococcus aureus subsp. aureus Mu50
uaaggaaaauuau

SEQ ID NO: 3994736 - RNA, 23 nt, Staphylococcus aureus subsp. aureus Mu50
uaaggcuaaugauaauccaccaa

SEQ ID NO: 3994737 - RNA, 23 nt, Staphylococcus aureus subsp. aureus Mu50
uaagggguauauuaaaaauuuca

SEQ ID NO: 3994738 - RNA, 18 nt, Staphylococcus aureus subsp. aureus Mu50
uaaggucauuuuuaauug

SEQ ID NO: 3994739 - RNA, 20 nt, Staphylococcus aureus subsp. aureus Mu50
uaaggugauugaacaauaau

SEQ ID NO: 3994740 - RNA, 14 nt, Staphylococcus aureus subsp. aureus Mu50
uaagguucuuuuuu

SEQ ID NO: 3994741 - RNA, 16 nt, Staphylococcus aureus subsp. aureus Mu50
uaaguaaaacugcaau

SEQ ID NO: 3994742 - RNA, 20 nt, Staphylococcus aureus subsp. aureus Mu50
uaaguaaaauaaaaaaugca

SEQ ID NO: 3994743 - RNA, 18 nt, Staphylococcus aureus subsp. aureus Mu50
uaaguaagauuuaaacau

SEQ ID NO: 3994744 - RNA, 14 nt, Staphylococcus aureus subsp. aureus Mu50
uaaguaauaaaaua

SEQ ID NO: 3994745 - RNA, 16 nt, Staphylococcus aureus subsp. aureus Mu50
uaaguaauaauauaaa

SEQ ID NO: 3994746 - RNA, 20 nt, Staphylococcus aureus subsp. aureus Mu50
uaaguaauaauauaaauaaa

SEQ ID NO: 3994747 - RNA, 15 nt, Staphylococcus aureus subsp. aureus Mu50
uaaguaauaauuuau

SEQ ID NO: 3994748 - RNA, 13 nt, Staphylococcus aureus subsp. aureus Mu50
uaaguaauauaau

SEQ ID NO: 3994749 - RNA, 18 nt, Staphylococcus aureus subsp. aureus Mu50
uaaguaaucauaauaauc

SEQ ID NO: 3994750 - RNA, 17 nt, Staphylococcus aureus subsp. aureus Mu50
uaaguacagcauauaau

SEQ ID NO: 3994751 - RNA, 14 nt, Staphylococcus aureus subsp. aureus Mu50
uaaguacauaaaug

SEQ ID NO: 3994752 - RNA, 15 nt, Staphylococcus aureus subsp. aureus Mu50
uaaguacauaaaugc

SEQ ID NO: 3994753 - RNA, 15 nt, Staphylococcus aureus subsp. aureus Mu50
uaaguacuuuuacaa

SEQ ID NO: 3994754 - RNA, 17 nt, Staphylococcus aureus subsp. aureus Mu50
uaaguagaaaauaugac

SEQ ID NO: 3994755 - RNA, 16 nt, Staphylococcus aureus subsp. aureus Mu50
uaaguagaugauuagu

SEQ ID NO: 3994756 - RNA, 22 nt, Staphylococcus aureus subsp. aureus Mu50
uaaguaguugguggaugucaug

SEQ ID NO: 3994757 - RNA, 20 nt, Staphylococcus aureus subsp. aureus Mu50
uaaguauaaugaugugccuc

SEQ ID NO: 3994758 - RNA, 13 nt, Staphylococcus aureus subsp. aureus Mu50
uaaguauaauuaa

SEQ ID NO: 3994759 - RNA, 19 nt, Staphylococcus aureus subsp. aureus Mu50
uaaguaucgccaucauuca

SEQ ID NO: 3994760 - RNA, 19 nt, Staphylococcus aureus subsp. aureus Mu50
uaaguaucggugauuuaau

SEQ ID NO: 3994761 - RNA, 21 nt, Staphylococcus aureus subsp. aureus Mu50
uaaguaucggugauuuaauug

SEQ ID NO: 3994762 - RNA, 20 nt, Staphylococcus aureus subsp. aureus Mu50
uaagucgccuaacuuuuauu

SEQ ID NO: 3994763 - RNA, 20 nt, Staphylococcus aureus subsp. aureus Mu50
uaagucguucaauuguugau

SEQ ID NO: 3994764 - RNA, 20 nt, Staphylococcus aureus subsp. aureus Mu50
uaagucugaugucgaaaaua

SEQ ID NO: 3994765 - RNA, 16 nt, Staphylococcus aureus subsp. aureus Mu50
uaagucuuuuaaauga

SEQ ID NO: 3994766 - RNA, 15 nt, Staphylococcus aureus subsp. aureus Mu50
uaagugauaaauaau

SEQ ID NO: 3994767 - RNA, 16 nt, Staphylococcus aureus subsp. aureus Mu50
uaagugauaaauaaug

SEQ ID NO: 3994768 - RNA, 19 nt, Staphylococcus aureus subsp. aureus Mu50
uaagugauaaauaaugcau

SEQ ID NO: 3994769 - RNA, 17 nt, Staphylococcus aureus subsp. aureus Mu50
uaagugauauacgacaa

SEQ ID NO: 3994770 - RNA, 22 nt, Staphylococcus aureus subsp. aureus Mu50
uaagugauauacgacaaucaca

SEQ ID NO: 3994771 - RNA, 14 nt, Staphylococcus aureus subsp. aureus Mu50
uaauagaaauaauc

SEQ ID NO: 3994772 - RNA, 17 nt, Staphylococcus aureus subsp. aureus Mu50
uaauagaacgaaauagu

SEQ ID NO: 3994773 - RNA, 15 nt, Staphylococcus aureus subsp. aureus Mu50
uaauagauaaugcac

SEQ ID NO: 3994774 - RNA, 17 nt, Staphylococcus aureus subsp. aureus Mu50
uaauagcaaaauuaugu

SEQ ID NO: 3994775 - RNA, 18 nt, Staphylococcus aureus subsp. aureus Mu50
uaauagccauucgaugcu

SEQ ID NO: 3994776 - RNA, 15 nt, Staphylococcus aureus subsp. aureus Mu50
uaauagcgucaaguu

SEQ ID NO: 3994777 - RNA, 14 nt, Staphylococcus aureus subsp. aureus Mu50
uaauagcuauauuu

SEQ ID NO: 3994778 - RNA, 17 nt, Staphylococcus aureus subsp. aureus Mu50
uaauagcuuguacacau

SEQ ID NO: 3994779 - RNA, 21 nt, Staphylococcus aureus subsp. aureus Mu50
uaauagguuauguuauguaaa

SEQ ID NO: 3994780 - RNA, 21 nt, Staphylococcus aureus subsp. aureus Mu50
uaauagguuauuugauaauga

SEQ ID NO: 3994781 - RNA, 16 nt, Staphylococcus aureus subsp. aureus Mu50
uaauaguacagucauc

SEQ ID NO: 3994782 - RNA, 14 nt, Staphylococcus aureus subsp. aureus Mu50
uaauaguacuuaau

SEQ ID NO: 3994783 - RNA, 15 nt, Staphylococcus aureus subsp. aureus Mu50
uaauaguguuauauu

SEQ ID NO: 3994784 - RNA, 12 nt, Staphylococcus aureus subsp. aureus Mu50
uaauauaaaaac

SEQ ID NO: 3994785 - RNA, 19 nt, Staphylococcus aureus subsp. aureus Mu50
uaauauaaaaacaaaagaa

SEQ ID NO: 3994786 - RNA, 20 nt, Staphylococcus aureus subsp. aureus Mu50
uaauauaaaaacaaaagaaa

SEQ ID NO: 3994787 - RNA, 14 nt, Staphylococcus aureus subsp. aureus Mu50
uaauauaaaauaaa

SEQ ID NO: 3994788 - RNA, 20 nt, Staphylococcus aureus subsp. aureus Mu50
uaauauaacaaguauaaaug

SEQ ID NO: 3994789 - RNA, 17 nt, Staphylococcus aureus subsp. aureus Mu50
uaauauaacuucuauua

SEQ ID NO: 3994790 - RNA, 17 nt, Staphylococcus aureus subsp. aureus Mu50
uaauauaauuaaacauu

SEQ ID NO: 3994791 - RNA, 14 nt, Staphylococcus aureus subsp. aureus Mu50
uaauauaauuaauu

SEQ ID NO: 3994792 - RNA, 15 nt, Staphylococcus aureus subsp. aureus Mu50
uaauauaauuauuaa

SEQ ID NO: 3994793 - RNA, 14 nt, Staphylococcus aureus subsp. aureus Mu50
uaauauauaaaagu

SEQ ID NO: 3994794 - RNA, 15 nt, Staphylococcus aureus subsp. aureus Mu50
uaauauauaaaaguc

SEQ ID NO: 3994795 - RNA, 13 nt, Staphylococcus aureus subsp. aureus Mu50
uaauauauuaauu

SEQ ID NO: 3994796 - RNA, 14 nt, Staphylococcus aureus subsp. aureus Mu50
uaauauauuacuaa

SEQ ID NO: 3994797 - RNA, 16 nt, Staphylococcus aureus subsp. aureus Mu50
uaauauauuauaaccc

SEQ ID NO: 3994798 - RNA, 14 nt, Staphylococcus aureus subsp. aureus Mu50
uaauauauuuauuu

SEQ ID NO: 3994799 - RNA, 14 nt, Staphylococcus aureus subsp. aureus Mu50
uaauauauuuggag

SEQ ID NO: 3994800 - RNA, 14 nt, Staphylococcus aureus subsp. aureus Mu50
uaauaucaauaaug

SEQ ID NO: 3994801 - RNA, 16 nt, Staphylococcus aureus subsp. aureus Mu50
uaauaucaauaaugcu

SEQ ID NO: 3994802 - RNA, 21 nt, Staphylococcus aureus subsp. aureus Mu50
uaauaucaauuuuuacuaaau

SEQ ID NO: 3994803 - RNA, 21 nt, Staphylococcus aureus subsp. aureus Mu50
uaauaucacgaucuuuaaagu

SEQ ID NO: 3994804 - RNA, 17 nt, Staphylococcus aureus subsp. aureus Mu50
uaauaucauauucaaaa

SEQ ID NO: 3994805 - RNA, 21 nt, Staphylococcus aureus subsp. aureus Mu50
uaauaucauauucaaaauaac

SEQ ID NO: 3994806 - RNA, 15 nt, Staphylococcus aureus subsp. aureus Mu50
uaauauccugcaguu

SEQ ID NO: 3994807 - RNA, 15 nt, Staphylococcus aureus subsp. aureus Mu50
uaauaucuaaagauu

SEQ ID NO: 3994808 - RNA, 21 nt, Staphylococcus aureus subsp. aureus Mu50
uaauaucuaauucuguuucaa

SEQ ID NO: 3994809 - RNA, 21 nt, Staphylococcus aureus subsp. aureus Mu50
uaauaucuuacuacuuaauua

SEQ ID NO: 3994810 - RNA, 16 nt, Staphylococcus aureus subsp. aureus Mu50
uaauaugaauuuagau

SEQ ID NO: 3994811 - RNA, 21 nt, Staphylococcus aureus subsp. aureus Mu50
uaauaugaauuuagaugcaua

SEQ ID NO: 3994812 - RNA, 23 nt, Staphylococcus aureus subsp. aureus Mu50
uaauaugaauuuagaugcauaaa

SEQ ID NO: 3994813 - RNA, 13 nt, Staphylococcus aureus subsp. aureus Mu50
uaauauuauaagu

SEQ ID NO: 3994814 - RNA, 13 nt, Staphylococcus aureus subsp. aureus Mu50
uaauauucaacuu

SEQ ID NO: 3994815 - RNA, 14 nt, Staphylococcus aureus subsp. aureus Mu50
uaauauucaacuug

SEQ ID NO: 3994816 - RNA, 19 nt, Staphylococcus aureus subsp. aureus Mu50
uaauauucaacuuguuaag

SEQ ID NO: 3994817 - RNA, 22 nt, Staphylococcus aureus subsp. aureus Mu50
uaauauugaugaauaaauagau

SEQ ID NO: 3994818 - RNA, 19 nt, Staphylococcus aureus subsp. aureus Mu50
uaauauuuagauacugaau

SEQ ID NO: 3994819 - RNA, 15 nt, Staphylococcus aureus subsp. aureus Mu50
uaauauuucuuagau

SEQ ID NO: 3994820 - RNA, 22 nt, Staphylococcus aureus subsp. aureus Mu50
uaauauuuuaaacguaucauuu

SEQ ID NO: 3994821 - RNA, 12 nt, Staphylococcus aureus subsp. aureus Mu50
uaauauuuucuu

SEQ ID NO: 3994822 - RNA, 16 nt, Staphylococcus aureus subsp. aureus Mu50
uaauauuuucuuagaa

SEQ ID NO: 3994823 - RNA, 15 nt, Staphylococcus aureus subsp. aureus Mu50
uaaucaaaccaccaa

SEQ ID NO: 3994824 - RNA, 21 nt, Staphylococcus aureus subsp. aureus Mu50
uaaucaaaccaccaaaaauca

SEQ ID NO: 3994825 - RNA, 20 nt, Staphylococcus aureus subsp. aureus Mu50
uaaucaaaguaucagucauu

SEQ ID NO: 3994826 - RNA, 22 nt, Staphylococcus aureus subsp. aureus Mu50
uaaucaacaaagugcaauuauu

SEQ ID NO: 3994827 - RNA, 14 nt, Staphylococcus aureus subsp. aureus Mu50
uaaucaacuuuuug

SEQ ID NO: 3994828 - RNA, 21 nt, Staphylococcus aureus subsp. aureus Mu50
uaaucaagaauauaagugauu

SEQ ID NO: 3994829 - RNA, 15 nt, Staphylococcus aureus subsp. aureus Mu50
uaaucaagcaaugca

SEQ ID NO: 3994830 - RNA, 20 nt, Staphylococcus aureus subsp. aureus Mu50
uaaucaagucugcauuaauu

SEQ ID NO: 3994831 - RNA, 13 nt, Staphylococcus aureus subsp. aureus Mu50
uaaucacauuaau

SEQ ID NO: 3994832 - RNA, 17 nt, Staphylococcus aureus subsp. aureus Mu50
uaaucacauuaauugga

SEQ ID NO: 3994833 - RNA, 22 nt, Staphylococcus aureus subsp. aureus Mu50
uaaucacuuggcgacauuugua

SEQ ID NO: 3994834 - RNA, 18 nt, Staphylococcus aureus subsp. aureus Mu50
uaaucagcuauaaaagua

SEQ ID NO: 3994835 - RNA, 16 nt, Staphylococcus aureus subsp. aureus Mu50
uaaucagcuuuuucac

SEQ ID NO: 3994836 - RNA, 15 nt, Staphylococcus aureus subsp. aureus Mu50
uaaucagugaaauau

SEQ ID NO: 3994837 - RNA, 19 nt, Staphylococcus aureus subsp. aureus Mu50
uaaucagugaaauaucaag

SEQ ID NO: 3994838 - RNA, 21 nt, Staphylococcus aureus subsp. aureus Mu50
uaaucagugaaauaucaagau

SEQ ID NO: 3994839 - RNA, 15 nt, Staphylococcus aureus subsp. aureus Mu50
uaaucaguuuccgca

SEQ ID NO: 3994840 - RNA, 17 nt, Staphylococcus aureus subsp. aureus Mu50
uaaucauguaaugcuua

SEQ ID NO: 3994841 - RNA, 21 nt, Staphylococcus aureus subsp. aureus Mu50
uaaucauguaaugcuuaaaaa

SEQ ID NO: 3994842 - RNA, 20 nt, Staphylococcus aureus subsp. aureus Mu50
uaaucauugguuucaucaua

SEQ ID NO: 3994843 - RNA, 19 nt, Staphylococcus aureus subsp. aureus Mu50
uaauccaauuuaauagcuu

SEQ ID NO: 3994844 - RNA, 20 nt, Staphylococcus aureus subsp. aureus Mu50
uaauccagcgacauguccug

SEQ ID NO: 3994845 - RNA, 13 nt, Staphylococcus aureus subsp. aureus Mu50
uaauccauccauu

SEQ ID NO: 3994846 - RNA, 15 nt, Staphylococcus aureus subsp. aureus Mu50
uaauccauccauuaa

SEQ ID NO: 3994847 - RNA, 19 nt, Staphylococcus aureus subsp. aureus Mu50
uaaucccauuuuaaaguca

SEQ ID NO: 3994848 - RNA, 18 nt, Staphylococcus aureus subsp. aureus Mu50
uaauccgauuuugauaua

SEQ ID NO: 3994849 - RNA, 16 nt, Staphylococcus aureus subsp. aureus Mu50
uaauccuucuccaaaa

SEQ ID NO: 3994850 - RNA, 20 nt, Staphylococcus aureus subsp. aureus Mu50
uaauccuucuccaaaaauaa

SEQ ID NO: 3994851 - RNA, 18 nt, Staphylococcus aureus subsp. aureus Mu50
uaaucgaacauaaauaaa

SEQ ID NO: 3994852 - RNA, 14 nt, Staphylococcus aureus subsp. aureus Mu50
uaaucgauugguaa

SEQ ID NO: 3994853 - RNA, 20 nt, Staphylococcus aureus subsp. aureus Mu50
uaaucgauugguaaaucuac

SEQ ID NO: 3994854 - RNA, 13 nt, Staphylococcus aureus subsp. aureus Mu50
uaaucgcauucuu

SEQ ID NO: 3994855 - RNA, 14 nt, Staphylococcus aureus subsp. aureus Mu50
uaaucggaucauua

SEQ ID NO: 3994856 - RNA, 16 nt, Staphylococcus aureus subsp. aureus Mu50
uaaucgguaauuacuu

SEQ ID NO: 3994857 - RNA, 15 nt, Staphylococcus aureus subsp. aureus Mu50
uaaucguauuuuuaa

SEQ ID NO: 3994858 - RNA, 14 nt, Staphylococcus aureus subsp. aureus Mu50
uaaucguucccauu

SEQ ID NO: 3994859 - RNA, 13 nt, Staphylococcus aureus subsp. aureus Mu50
uaauguuccauau

SEQ ID NO: 3994860 - RNA, 18 nt, Staphylococcus aureus subsp. aureus Mu50
uaauguuccauauaaccu

SEQ ID NO: 3994861 - RNA, 19 nt, Staphylococcus aureus subsp. aureus Mu50
uaauguuuccauuuauuaa

SEQ ID NO: 3994862 - RNA, 21 nt, Staphylococcus aureus subsp. aureus Mu50
uaauguuuccugauauuucaa

SEQ ID NO: 3994863 - RNA, 23 nt, Staphylococcus aureus subsp. aureus Mu50
uaauguuucuucaauugucucaa

SEQ ID NO: 3994864 - RNA, 18 nt, Staphylococcus aureus subsp. aureus Mu50
uaauguuugcuuuuugua

SEQ ID NO: 3994865 - RNA, 17 nt, Staphylococcus aureus subsp. aureus Mu50
uaauguuuucauuggau

SEQ ID NO: 3994866 - RNA, 16 nt, Staphylococcus aureus subsp. aureus Mu50
uaauguuuuuacaaau

SEQ ID NO: 3994867 - RNA, 20 nt, Staphylococcus aureus subsp. aureus Mu50
uaauuaaaacaugacaacuu

SEQ ID NO: 3994868 - RNA, 22 nt, Staphylococcus aureus subsp. aureus Mu50
uaauuaaaauaagauauauaau

SEQ ID NO: 3994869 - RNA, 14 nt, Staphylococcus aureus subsp. aureus Mu50
uaauuaaaauacaa

SEQ ID NO: 3994870 - RNA, 16 nt, Staphylococcus aureus subsp. aureus Mu50
uaauuaaaauacaaau

SEQ ID NO: 3994871 - RNA, 16 nt, Staphylococcus aureus subsp. aureus Mu50
uaauuaaaauucucuu

SEQ ID NO: 3994872 - RNA, 21 nt, Staphylococcus aureus subsp. aureus Mu50
uaauuaaacgcucaacuauau

SEQ ID NO: 3994873 - RNA, 14 nt, Staphylococcus aureus subsp. aureus Mu50
uaauuaaagauuaa

SEQ ID NO: 3994874 - RNA, 17 nt, Staphylococcus aureus subsp. aureus Mu50
uaauuaaagauuaaaau

SEQ ID NO: 3994875 - RNA, 15 nt, Staphylococcus aureus subsp. aureus Mu50
uaauuaaagcaucuu

SEQ ID NO: 3994876 - RNA, 12 nt, Staphylococcus aureus subsp. aureus Mu50
uaauuaaauaaa

SEQ ID NO: 3994877 - RNA, 16 nt, Staphylococcus aureus subsp. aureus Mu50
uaauuaaauaaaaaua

SEQ ID NO: 3994878 - RNA, 14 nt, Staphylococcus aureus subsp. aureus Mu50
uaauuaaauaacuu

SEQ ID NO: 3994879 - RNA, 22 nt, Staphylococcus aureus subsp. aureus Mu50
uaauuaaauauaaagacgauuu

SEQ ID NO: 3994880 - RNA, 18 nt, Staphylococcus aureus subsp. aureus Mu50
uaauuaacacauucaaau

SEQ ID NO: 3994881 - RNA, 20 nt, Staphylococcus aureus subsp. aureus Mu50
uaauuaacacauucaaauaa

SEQ ID NO: 3994882 - RNA, 21 nt, Staphylococcus aureus subsp. aureus Mu50
uaauuaacacauucaaauaaa

SEQ ID NO: 3994883 - RNA, 22 nt, Staphylococcus aureus subsp. aureus Mu50
uaauuaacacauucaaauaaau

SEQ ID NO: 3994884 - RNA, 22 nt, Staphylococcus aureus subsp. aureus Mu50
uaauuaacuuacuuuuguaaaa

SEQ ID NO: 3994885 - RNA, 17 nt, Staphylococcus aureus subsp. aureus Mu50
uaauuaagaaaaucauu

SEQ ID NO: 3994886 - RNA, 19 nt, Staphylococcus aureus subsp. aureus Mu50
uaauuaagaaaaucauuca

SEQ ID NO: 3994887 - RNA, 20 nt, Staphylococcus aureus subsp. aureus Mu50
uaauuaagaaaaucauucau

SEQ ID NO: 3994888 - RNA, 17 nt, Staphylococcus aureus subsp. aureus Mu50
uaauuaaguuaaaauaa

SEQ ID NO: 3994889 - RNA, 19 nt, Staphylococcus aureus subsp. aureus Mu50
uaauuaauaaaaaaaucac

SEQ ID NO: 3994890 - RNA, 17 nt, Staphylococcus aureus subsp. aureus Mu50
uaauuaauaagcauuaa

SEQ ID NO: 3994891 - RNA, 13 nt, Staphylococcus aureus subsp. aureus Mu50
uaauuaauaauuu

SEQ ID NO: 3994892 - RNA, 15 nt, Staphylococcus aureus subsp. aureus Mu50
uaauuaauaauuuaa

SEQ ID NO: 3994893 - RNA, 14 nt, Staphylococcus aureus subsp. aureus Mu50
uaauuaaugccauu

SEQ ID NO: 3994894 - RNA, 15 nt, Staphylococcus aureus subsp. aureus Mu50
uaauuaauguuucuu

SEQ ID NO: 3994895 - RNA, 13 nt, Staphylococcus aureus subsp. aureus Mu50
uaauuaauuaaaa

SEQ ID NO: 3994896 - RNA, 14 nt, Staphylococcus aureus subsp. aureus Mu50
uaauuaauuaaaau

SEQ ID NO: 3994897 - RNA, 16 nt, Staphylococcus aureus subsp. aureus Mu50
uaauuaauuuuguaau

SEQ ID NO: 3994898 - RNA, 16 nt, Staphylococcus aureus subsp. aureus Mu50
uaauuaccuuuccauu

SEQ ID NO: 3994899 - RNA, 14 nt, Staphylococcus aureus subsp. aureus Mu50
uaauuacuuucauu

SEQ ID NO: 3994900 - RNA, 20 nt, Staphylococcus aureus subsp. aureus Mu50
uaauuacuuucauuguaaau

SEQ ID NO: 3994901 - RNA, 22 nt, Staphylococcus aureus subsp. aureus Mu50
uaauuaggauuuccggaacaau

SEQ ID NO: 3994902 - RNA, 23 nt, Staphylococcus aureus subsp. aureus Mu50
uaauuaggauuuccggaacaaua

SEQ ID NO: 3994903 - RNA, 11 nt, Staphylococcus aureus subsp. aureus Mu50
uaauuaguugg

SEQ ID NO: 3994904 - RNA, 19 nt, Staphylococcus aureus subsp. aureus Mu50
uaauuauacguuacuaaac

SEQ ID NO: 3994905 - RNA, 17 nt, Staphylococcus aureus subsp. aureus Mu50
uaauuauauuaaugauu

SEQ ID NO: 3994906 - RNA, 12 nt, Staphylococcus aureus subsp. aureus Mu50
uaauuaucauaa

SEQ ID NO: 3994907 - RNA, 14 nt, Staphylococcus aureus subsp. aureus Mu50
uaauuaucauaaag

SEQ ID NO: 3994908 - RNA, 13 nt, Staphylococcus aureus subsp. aureus Mu50
uaauuaucauaua

SEQ ID NO: 3994909 - RNA, 16 nt, Staphylococcus aureus subsp. aureus Mu50
uaauuaucauauaaau

SEQ ID NO: 3994910 - RNA, 17 nt, Staphylococcus aureus subsp. aureus Mu50
uaauuaucuuaagucau

SEQ ID NO: 3994911 - RNA, 13 nt, Staphylococcus aureus subsp. aureus Mu50
uaauuauguauuu

SEQ ID NO: 3994912 - RNA, 15 nt, Staphylococcus aureus subsp. aureus Mu50
uaauuauucaugaau

SEQ ID NO: 3994913 - RNA, 17 nt, Staphylococcus aureus subsp. aureus Mu50
uaauuauuucucuuucc

SEQ ID NO: 3994914 - RNA, 15 nt, Staphylococcus aureus subsp. aureus Mu50
uaauuauuuuaaaaa

SEQ ID NO: 3994915 - RNA, 17 nt, Staphylococcus aureus subsp. aureus Mu50
uaauucaacuuaaaugg

SEQ ID NO: 3994916 - RNA, 14 nt, Staphylococcus aureus subsp. aureus Mu50
uaauucaauaccua

SEQ ID NO: 3994917 - RNA, 14 nt, Staphylococcus aureus subsp. aureus Mu50
uaauucaaugcuau

SEQ ID NO: 3994918 - RNA, 22 nt, Staphylococcus aureus subsp. aureus Mu50
uaauucacuuuacccucuuuag

SEQ ID NO: 3994919 - RNA, 22 nt, Staphylococcus aureus subsp. aureus Mu50
uaauucaucaaguugauaaugu

SEQ ID NO: 3994920 - RNA, 18 nt, Staphylococcus aureus subsp. aureus Mu50
uaauuccaguauuaacug

SEQ ID NO: 3994921 - RNA, 19 nt, Staphylococcus aureus subsp. aureus Mu50
uaauuccaguauuaacugu

SEQ ID NO: 3994922 - RNA, 17 nt, Staphylococcus aureus subsp. aureus Mu50
uaauucccuguuaugaa

SEQ ID NO: 3994923 - RNA, 23 nt, Staphylococcus aureus subsp. aureus Mu50
uaauuccucuggaacuuuaauac

SEQ ID NO: 3994924 - RNA, 15 nt, Staphylococcus aureus subsp. aureus Mu50
uaauuccugauacaa

SEQ ID NO: 3994925 - RNA, 12 nt, Staphylococcus aureus subsp. aureus Mu50
uaauuccuggug

SEQ ID NO: 3994926 - RNA, 21 nt, Staphylococcus aureus subsp. aureus Mu50
uaauuccuggugcaauaauaa

SEQ ID NO: 3994927 - RNA, 15 nt, Staphylococcus aureus subsp. aureus Mu50
uaauucgccaucuuu

SEQ ID NO: 3994928 - RNA, 22 nt, Staphylococcus aureus subsp. aureus Mu50
uaauucgccaucuuuuuuagcu

SEQ ID NO: 3994929 - RNA, 17 nt, Staphylococcus aureus subsp. aureus Mu50
uaauucguaauuuauga

SEQ ID NO: 3994930 - RNA, 16 nt, Staphylococcus aureus subsp. aureus Mu50
uaauucuauuuuugau

SEQ ID NO: 3994931 - RNA, 17 nt, Staphylococcus aureus subsp. aureus Mu50
uaauucuccuaauaauu

SEQ ID NO: 3994932 - RNA, 12 nt, Staphylococcus aureus subsp. aureus Mu50
uaauucugaaau

SEQ ID NO: 3994933 - RNA, 13 nt, Staphylococcus aureus subsp. aureus Mu50
uaauucugaaauc

SEQ ID NO: 3994934 - RNA, 13 nt, Staphylococcus aureus subsp. aureus Mu50
uaauucuuaaucg

SEQ ID NO: 3994935 - RNA, 16 nt, Staphylococcus aureus subsp. aureus Mu50
uaauucuuaaucgagu

SEQ ID NO: 3994936 - RNA, 20 nt, Staphylococcus aureus subsp. aureus Mu50
uaauucuuaaucgagugauu

SEQ ID NO: 3994937 - RNA, 23 nt, Staphylococcus aureus subsp. aureus Mu50
uaauucuuaaucgagugauucag

SEQ ID NO: 3994938 - RNA, 17 nt, Staphylococcus aureus subsp. aureus Mu50
uaauucuucaaccauuu

SEQ ID NO: 3994939 - RNA, 13 nt, Staphylococcus aureus subsp. aureus Mu50
uaauucuucauca

SEQ ID NO: 3994940 - RNA, 14 nt, Staphylococcus aureus subsp. aureus Mu50
uaauucuucaucaa

SEQ ID NO: 3994941 - RNA, 23 nt, Staphylococcus aureus subsp. aureus Mu50
uaauucuucaucaauaacuauaa

SEQ ID NO: 3994942 - RNA, 15 nt, Staphylococcus aureus subsp. aureus Mu50
uaauugaaaaaccaa

SEQ ID NO: 3994943 - RNA, 15 nt, Staphylococcus aureus subsp. aureus Mu50
uaauugaaaaucuaa

SEQ ID NO: 3994944 - RNA, 22 nt, Staphylococcus aureus subsp. aureus Mu50
uaauugaaaugauagaugcugg

SEQ ID NO: 3994945 - RNA, 22 nt, Staphylococcus aureus subsp. aureus Mu50
uaauugaaguaugcacaucauu

SEQ ID NO: 3994946 - RNA, 12 nt, Staphylococcus aureus subsp. aureus Mu50
uaauugaaugaa

SEQ ID NO: 3994947 - RNA, 23 nt, Staphylococcus aureus subsp. aureus Mu50
uaauuuuuuauuuuuuucacuaa

SEQ ID NO: 3994948 - RNA, 13 nt, Staphylococcus aureus subsp. aureus Mu50
uaauuuuuugaca

SEQ ID NO: 3994949 - RNA, 18 nt, Staphylococcus aureus subsp. aureus Mu50
uaauuuuuugacacgucg

SEQ ID NO: 3994950 - RNA, 13 nt, Staphylococcus aureus subsp. aureus Mu50
uacaaaacauauu

SEQ ID NO: 3994951 - RNA, 17 nt, Staphylococcus aureus subsp. aureus Mu50
uacaaaacauauucagu

SEQ ID NO: 3994952 - RNA, 23 nt, Staphylococcus aureus subsp. aureus Mu50
uacaaaauaaaacgacucauuau

SEQ ID NO: 3994953 - RNA, 15 nt, Staphylococcus aureus subsp. aureus Mu50
uacaaaauugucuca

SEQ ID NO: 3994954 - RNA, 17 nt, Staphylococcus aureus subsp. aureus Mu50
uacaaacaaugcaaguu

SEQ ID NO: 3994955 - RNA, 22 nt, Staphylococcus aureus subsp. aureus Mu50
uacaaacauuccucuauuguau

SEQ ID NO: 3994956 - RNA, 16 nt, Staphylococcus aureus subsp. aureus Mu50
uacaaaccuaucauca

SEQ ID NO: 3994957 - RNA, 17 nt, Staphylococcus aureus subsp. aureus Mu50
uacaaacuucacaucau

SEQ ID NO: 3994958 - RNA, 18 nt, Staphylococcus aureus subsp. aureus Mu50
uacaaagccuuaauauca

SEQ ID NO: 3994959 - RNA, 17 nt, Staphylococcus aureus subsp. aureus Mu50
uacaaaggauuauuaac

SEQ ID NO: 3994960 - RNA, 14 nt, Staphylococcus aureus subsp. aureus Mu50
uacaaagucugucu

SEQ ID NO: 3994961 - RNA, 24 nt, Staphylococcus aureus subsp. aureus Mu50
uacaaagucugucugaauuagauu

SEQ ID NO: 3994962 - RNA, 15 nt, Staphylococcus aureus subsp. aureus Mu50
uacaaagugauuuaa

SEQ ID NO: 3994963 - RNA, 19 nt, Staphylococcus aureus subsp. aureus Mu50
uacaaaguuaaccauacau

SEQ ID NO: 3994964 - RNA, 18 nt, Staphylococcus aureus subsp. aureus Mu50
uacaaaguuauaauggca

SEQ ID NO: 3994965 - RNA, 16 nt, Staphylococcus aureus subsp. aureus Mu50
uacaaaguuuauacuu

SEQ ID NO: 3994966 - RNA, 20 nt, Staphylococcus aureus subsp. aureus Mu50
uacaaaguuuauacuuaaua

SEQ ID NO: 3994967 - RNA, 21 nt, Staphylococcus aureus subsp. aureus Mu50
uacaaaguuuauacuuaauau

SEQ ID NO: 3994968 - RNA, 14 nt, Staphylococcus aureus subsp. aureus Mu50
uacaaauaacaaac

SEQ ID NO: 3994969 - RNA, 14 nt, Staphylococcus aureus subsp. aureus Mu50
uacaaauauaucua

SEQ ID NO: 3994970 - RNA, 22 nt, Staphylococcus aureus subsp. aureus Mu50
uacaaauauuguggaaaacgug

SEQ ID NO: 3994971 - RNA, 13 nt, Staphylococcus aureus subsp. aureus Mu50
uacaaauauuucu

SEQ ID NO: 3994972 - RNA, 23 nt, Staphylococcus aureus subsp. aureus Mu50
uacaaauauuucuaaaccauuuu

SEQ ID NO: 3994973 - RNA, 21 nt, Staphylococcus aureus subsp. aureus Mu50
uacaaaucgauauugagaaua

SEQ ID NO: 3994974 - RNA, 18 nt, Staphylococcus aureus subsp. aureus Mu50
uacaaaucguaaacauaa

SEQ ID NO: 3994975 - RNA, 19 nt, Staphylococcus aureus subsp. aureus Mu50
uacaaauguauaaauaaua

SEQ ID NO: 3994976 - RNA, 23 nt, Staphylococcus aureus subsp. aureus Mu50
uacaaauguauaaauaauaaaug

SEQ ID NO: 3994977 - RNA, 18 nt, Staphylococcus aureus subsp. aureus Mu50
uacaaauuacaauaagcg

SEQ ID NO: 3994978 - RNA, 13 nt, Staphylococcus aureus subsp. aureus Mu50
uacaaauuauaaa

SEQ ID NO: 3994979 - RNA, 15 nt, Staphylococcus aureus subsp. aureus Mu50
uacaaauuauaaauu

SEQ ID NO: 3994980 - RNA, 16 nt, Staphylococcus aureus subsp. aureus Mu50
uacaaauuauaaauuu

SEQ ID NO: 3994981 - RNA, 23 nt, Staphylococcus aureus subsp. aureus Mu50
uacaaauuuuuuuuauuaauuaa

SEQ ID NO: 3994982 - RNA, 18 nt, Staphylococcus aureus subsp. aureus Mu50
uacaacaccaauugaaau

SEQ ID NO: 3994983 - RNA, 21 nt, Staphylococcus aureus subsp. aureus Mu50
uacaacaccaauugaaauuaa

SEQ ID NO: 3994984 - RNA, 15 nt, Staphylococcus aureus subsp. aureus Mu50
uacaacaguaaucau

SEQ ID NO: 3994985 - RNA, 13 nt, Staphylococcus aureus subsp. aureus Mu50
uacaacauacaug

SEQ ID NO: 3994986 - RNA, 22 nt, Staphylococcus aureus subsp. aureus Mu50
uacaaccuuugcuuaaaccuua

SEQ ID NO: 3994987 - RNA, 21 nt, Staphylococcus aureus subsp. aureus Mu50
uacaacgacacgaacaacauu

SEQ ID NO: 3994988 - RNA, 17 nt, Staphylococcus aureus subsp. aureus Mu50
uacaacucguuuuucca

SEQ ID NO: 3994989 - RNA, 18 nt, Staphylococcus aureus subsp. aureus Mu50
uacaacucguuuuuccau

SEQ ID NO: 3994990 - RNA, 23 nt, Staphylococcus aureus subsp. aureus Mu50
uacaacugaaucuccuugcucau

SEQ ID NO: 3994991 - RNA, 19 nt, Staphylococcus aureus subsp. aureus Mu50
uacaacuguuggaauaccu

SEQ ID NO: 3994992 - RNA, 20 nt, Staphylococcus aureus subsp. aureus Mu50
uacaacuguuggaauaccuu

SEQ ID NO: 3994993 - RNA, 15 nt, Staphylococcus aureus subsp. aureus Mu50
uacaacuuuuagagu

SEQ ID NO: 3994994 - RNA, 13 nt, Staphylococcus aureus subsp. aureus Mu50
uacaagaucgugg

SEQ ID NO: 3994995 - RNA, 17 nt, Staphylococcus aureus subsp. aureus Mu50
uacaagucuuauuuguu

SEQ ID NO: 3994996 - RNA, 23 nt, Staphylococcus aureus subsp. aureus Mu50
uacaagucuuauuuguuuaauua

SEQ ID NO: 3994997 - RNA, 14 nt, Staphylococcus aureus subsp. aureus Mu50
uacaauaaccauuu

SEQ ID NO: 3994998 - RNA, 21 nt, Staphylococcus aureus subsp. aureus Mu50
uacaauaagcgcaauuaaaag

SEQ ID NO: 3994999 - RNA, 13 nt, Staphylococcus aureus subsp. aureus Mu50
uacaauaaucacu

SEQ ID NO: 3995000 - RNA, 15 nt, Staphylococcus aureus subsp. aureus Mu50
uacaauaaugugcaa

SEQ ID NO: 3995001 - RNA, 17 nt, Staphylococcus aureus subsp. aureus Mu50
uacaauaguauaaauau

SEQ ID NO: 3995002 - RNA, 15 nt, Staphylococcus aureus subsp. aureus Mu50
uacaauauagaaaau

SEQ ID NO: 3995003 - RNA, 17 nt, Staphylococcus aureus subsp. aureus Mu50
uacaauauagaaaauga

SEQ ID NO: 3995004 - RNA, 15 nt, Staphylococcus aureus subsp. aureus Mu50
uacaauaugauuaau

SEQ ID NO: 3995005 - RNA, 17 nt, Staphylococcus aureus subsp. aureus Mu50
uacaauauuaaaauuaa

SEQ ID NO: 3995006 - RNA, 18 nt, Staphylococcus aureus subsp. aureus Mu50
uacaauauuaaaauuaaa

SEQ ID NO: 3995007 - RNA, 16 nt, Staphylococcus aureus subsp. aureus Mu50
uacaauauucaauaau

SEQ ID NO: 3995008 - RNA, 18 nt, Staphylococcus aureus subsp. aureus Mu50
uacaauauucaauaauuc

SEQ ID NO: 3995009 - RNA, 19 nt, Staphylococcus aureus subsp. aureus Mu50
uacaauauucaauaauuca

SEQ ID NO: 3995010 - RNA, 13 nt, Staphylococcus aureus subsp. aureus Mu50
uacaaugaaaaaa

SEQ ID NO: 3995011 - RNA, 23 nt, Staphylococcus aureus subsp. aureus Mu50
uacaaugaauuguuaguuuucuu

SEQ ID NO: 3995012 - RNA, 17 nt, Staphylococcus aureus subsp. aureus Mu50
uacaaugaauuucuaau

SEQ ID NO: 3995013 - RNA, 18 nt, Staphylococcus aureus subsp. aureus Mu50
uacaaugcgguauugcau

SEQ ID NO: 3995014 - RNA, 17 nt, Staphylococcus aureus subsp. aureus Mu50
uacaauuaaagugaaua

SEQ ID NO: 3995015 - RNA, 23 nt, Staphylococcus aureus subsp. aureus Mu50
uacaauuaauuacuguaaauaug

SEQ ID NO: 3995016 - RNA, 16 nt, Staphylococcus aureus subsp. aureus Mu50
uacaauuauaaaugau

SEQ ID NO: 3995017 - RNA, 13 nt, Staphylococcus aureus subsp. aureus Mu50
uacaauuuccuac

SEQ ID NO: 3995018 - RNA, 21 nt, Staphylococcus aureus subsp. aureus Mu50
uacaauuucuucauuuucauu

SEQ ID NO: 3995019 - RNA, 17 nt, Staphylococcus aureus subsp. aureus Mu50
uacaauuuuccuuccaa

SEQ ID NO: 3995020 - RNA, 22 nt, Staphylococcus aureus subsp. aureus Mu50
uacaauuuuccuuccaauaaua

SEQ ID NO: 3995021 - RNA, 23 nt, Staphylococcus aureus subsp. aureus Mu50
uacaauuuuccuuccaauaauaa

SEQ ID NO: 3995022 - RNA, 17 nt, Staphylococcus aureus subsp. aureus Mu50
uacaauuuucucauuaa

SEQ ID NO: 3995023 - RNA, 22 nt, Staphylococcus aureus subsp. aureus Mu50
uacacaaauuuuuuguaaacau

SEQ ID NO: 3995024 - RNA, 18 nt, Staphylococcus aureus subsp. aureus Mu50
uacacacuaaggaaaauu

SEQ ID NO: 3995025 - RNA, 20 nt, Staphylococcus aureus subsp. aureus Mu50
uacacacuaaggaaaauuau

SEQ ID NO: 3995026 - RNA, 19 nt, Staphylococcus aureus subsp. aureus Mu50
uacacaucgaucuaaauau

SEQ ID NO: 3995027 - RNA, 21 nt, Staphylococcus aureus subsp. aureus Mu50
uacacaucgaucuaaauauau

SEQ ID NO: 3995028 - RNA, 22 nt, Staphylococcus aureus subsp. aureus Mu50
uacacaucgaucuaaauauauu

SEQ ID NO: 3995029 - RNA, 24 nt, Staphylococcus aureus subsp. aureus Mu50
uacacaucgaucuaaauauauuag

SEQ ID NO: 3995030 - RNA, 15 nt, Staphylococcus aureus subsp. aureus Mu50
uacaccacuuaggau

SEQ ID NO: 3995031 - RNA, 16 nt, Staphylococcus aureus subsp. aureus Mu50
uacaccuacaaauauu

SEQ ID NO: 3995032 - RNA, 17 nt, Staphylococcus aureus subsp. aureus Mu50
uacaccuacaacuguug

SEQ ID NO: 3995033 - RNA, 17 nt, Staphylococcus aureus subsp. aureus Mu50
uacaccugcaauauagc

SEQ ID NO: 3995034 - RNA, 14 nt, Staphylococcus aureus subsp. aureus Mu50
uacauuguaaauau

SEQ ID NO: 3995035 - RNA, 22 nt, Staphylococcus aureus subsp. aureus Mu50
uacauuuaauggucuaauauca

SEQ ID NO: 3995036 - RNA, 22 nt, Staphylococcus aureus subsp. aureus Mu50
uacauuuauuuucaauaaauaa

SEQ ID NO: 3995037 - RNA, 23 nt, Staphylococcus aureus subsp. aureus Mu50
uacauuuauuuucaauaaauaaa

SEQ ID NO: 3995038 - RNA, 13 nt, Staphylococcus aureus subsp. aureus Mu50
uacauuucaaaaa

SEQ ID NO: 3995039 - RNA, 23 nt, Staphylococcus aureus subsp. aureus Mu50
uacauuucucguuucgucagauu

SEQ ID NO: 3995040 - RNA, 16 nt, Staphylococcus aureus subsp. aureus Mu50
uacauuuuaauaaaau

SEQ ID NO: 3995041 - RNA, 22 nt, Staphylococcus aureus subsp. aureus Mu50
uacauuuuaauaaaaucaucuu

SEQ ID NO: 3995042 - RNA, 20 nt, Staphylococcus aureus subsp. aureus Mu50
uacauuuucaaaaccaauua

SEQ ID NO: 3995043 - RNA, 21 nt, Staphylococcus aureus subsp. aureus Mu50
uacauuuugaaacaucuaaau

SEQ ID NO: 3995044 - RNA, 20 nt, Staphylococcus aureus subsp. aureus Mu50
uacauuuuuauacaacuuca

SEQ ID NO: 3995045 - RNA, 22 nt, Staphylococcus aureus subsp. aureus Mu50
uacauuuuuaugagcuucuuua

SEQ ID NO: 3995046 - RNA, 13 nt, Staphylococcus aureus subsp. aureus Mu50
uaccaaacugccu

SEQ ID NO: 3995047 - RNA, 18 nt, Staphylococcus aureus subsp. aureus Mu50
uaccaaagaaaucaccag

SEQ ID NO: 3995048 - RNA, 16 nt, Staphylococcus aureus subsp. aureus Mu50
uaccaaauaaauaagu

SEQ ID NO: 3995049 - RNA, 12 nt, Staphylococcus aureus subsp. aureus Mu50
uaccaaauauau

SEQ ID NO: 3995050 - RNA, 18 nt, Staphylococcus aureus subsp. aureus Mu50
uaccaaccaaaaccaaau

SEQ ID NO: 3995051 - RNA, 19 nt, Staphylococcus aureus subsp. aureus Mu50
uaccaaccaaaaccaaaug

SEQ ID NO: 3995052 - RNA, 15 nt, Staphylococcus aureus subsp. aureus Mu50
uaccaagaaauacuc

SEQ ID NO: 3995053 - RNA, 18 nt, Staphylococcus aureus subsp. aureus Mu50
uaccaaggguuucuggcu

SEQ ID NO: 3995054 - RNA, 19 nt, Staphylococcus aureus subsp. aureus Mu50
uaccaagugcuuuuuuacc

SEQ ID NO: 3995055 - RNA, 22 nt, Staphylococcus aureus subsp. aureus Mu50
uaccaagugcuuuuuuaccagc

SEQ ID NO: 3995056 - RNA, 19 nt, Staphylococcus aureus subsp. aureus Mu50
uaccaaugaauaaauugau

SEQ ID NO: 3995057 - RNA, 17 nt, Staphylococcus aureus subsp. aureus Mu50
uaccaauuguuucagcu

SEQ ID NO: 3995058 - RNA, 17 nt, Staphylococcus aureus subsp. aureus Mu50
uaccaauuuuuagcauu

SEQ ID NO: 3995059 - RNA, 18 nt, Staphylococcus aureus subsp. aureus Mu50
uaccacacuuuaaacaag

SEQ ID NO: 3995060 - RNA, 16 nt, Staphylococcus aureus subsp. aureus Mu50
uaccacauuuuccuug

SEQ ID NO: 3995061 - RNA, 11 nt, Staphylococcus aureus subsp. aureus Mu50
uaccaccccaa

SEQ ID NO: 3995062 - RNA, 15 nt, Staphylococcus aureus subsp. aureus Mu50
uaccacuguauuuac

SEQ ID NO: 3995063 - RNA, 17 nt, Staphylococcus aureus subsp. aureus Mu50
uaccacuguauuuacua

SEQ ID NO: 3995064 - RNA, 14 nt, Staphylococcus aureus subsp. aureus Mu50
uaccacuuauaaca

SEQ ID NO: 3995065 - RNA, 15 nt, Staphylococcus aureus subsp. aureus Mu50
uaccacuugaauacu

SEQ ID NO: 3995066 - RNA, 19 nt, Staphylococcus aureus subsp. aureus Mu50
uaccacuugaauacuuuuu

SEQ ID NO: 3995067 - RNA, 22 nt, Staphylococcus aureus subsp. aureus Mu50
uaccacuugaauacuuuuuaac

SEQ ID NO: 3995068 - RNA, 23 nt, Staphylococcus aureus subsp. aureus Mu50
uaccacuugaauacuuuuuaacu

SEQ ID NO: 3995069 - RNA, 15 nt, Staphylococcus aureus subsp. aureus Mu50
uaccaguaucauugu

SEQ ID NO: 3995070 - RNA, 15 nt, Staphylococcus aureus subsp. aureus Mu50
uaccaguugauuuaa

SEQ ID NO: 3995071 - RNA, 20 nt, Staphylococcus aureus subsp. aureus Mu50
uaccauaauuaaauaacuuu

SEQ ID NO: 3995072 - RNA, 16 nt, Staphylococcus aureus subsp. aureus Mu50
uaccauagauuauauu

SEQ ID NO: 3995073 - RNA, 18 nt, Staphylococcus aureus subsp. aureus Mu50
uaccauagauuauauuau

SEQ ID NO: 3995074 - RNA, 14 nt, Staphylococcus aureus subsp. aureus Mu50
uaccaucuuuaaua

SEQ ID NO: 3995075 - RNA, 23 nt, Staphylococcus aureus subsp. aureus Mu50
uaccaugaugagauaaaaucaua

SEQ ID NO: 3995076 - RNA, 18 nt, Staphylococcus aureus subsp. aureus Mu50
uaccauguuuuuuaagua

SEQ ID NO: 3995077 - RNA, 13 nt, Staphylococcus aureus subsp. aureus Mu50
uaccauuccaaaa

SEQ ID NO: 3995078 - RNA, 17 nt, Staphylococcus aureus subsp. aureus Mu50
uaccauugugaauaauu

SEQ ID NO: 3995079 - RNA, 18 nt, Staphylococcus aureus subsp. aureus Mu50
uaccauugugaugauaau

SEQ ID NO: 3995080 - RNA, 12 nt, Staphylococcus aureus subsp. aureus Mu50
uaccauuugcug

SEQ ID NO: 3995081 - RNA, 18 nt, Staphylococcus aureus subsp. aureus Mu50
uacccacuuauaaacaaa

SEQ ID NO: 3995082 - RNA, 22 nt, Staphylococcus aureus subsp. aureus Mu50
uacccauaauuuaaaugauauu

SEQ ID NO: 3995083 - RNA, 16 nt, Staphylococcus aureus subsp. aureus Mu50
uacccauuacauuugg

SEQ ID NO: 3995084 - RNA, 19 nt, Staphylococcus aureus subsp. aureus Mu50
uacccauuuuuuuccaagc

SEQ ID NO: 3995085 - RNA, 20 nt, Staphylococcus aureus subsp. aureus Mu50
uaccccuguugaauauacua

SEQ ID NO: 3995086 - RNA, 22 nt, Staphylococcus aureus subsp. aureus Mu50
uaccccuguugaauauacuaaa

SEQ ID NO: 3995087 - RNA, 15 nt, Staphylococcus aureus subsp. aureus Mu50
uacccuauuuuacaa

SEQ ID NO: 3995088 - RNA, 21 nt, Staphylococcus aureus subsp. aureus Mu50
uacccucuuuaguuaauucuc

SEQ ID NO: 3995089 - RNA, 19 nt, Staphylococcus aureus subsp. aureus Mu50
uaccgaauccuucaucaau

SEQ ID NO: 3995090 - RNA, 18 nt, Staphylococcus aureus subsp. aureus Mu50
uaccguauuuuaauauug

SEQ ID NO: 3995091 - RNA, 11 nt, Staphylococcus aureus subsp. aureus Mu50
uaccuaaaaua

SEQ ID NO: 3995092 - RNA, 14 nt, Staphylococcus aureus subsp. aureus Mu50
uaccuaaaauaccc

SEQ ID NO: 3995093 - RNA, 18 nt, Staphylococcus aureus subsp. aureus Mu50
uaccuaaaauagaaaaau

SEQ ID NO: 3995094 - RNA, 19 nt, Staphylococcus aureus subsp. aureus Mu50
uaccuaaaauagaaaaauu

SEQ ID NO: 3995095 - RNA, 18 nt, Staphylococcus aureus subsp. aureus Mu50
uaccuaagcugauuaaaa

SEQ ID NO: 3995096 - RNA, 21 nt, Staphylococcus aureus subsp. aureus Mu50
uaccuaagcugauuaaaaugu

SEQ ID NO: 3995097 - RNA, 15 nt, Staphylococcus aureus subsp. aureus Mu50
uaccuaauaggauuu

SEQ ID NO: 3995098 - RNA, 23 nt, Staphylococcus aureus subsp. aureus Mu50
uaccuaauucaauaccuaauuua

SEQ ID NO: 3995099 - RNA, 19 nt, Staphylococcus aureus subsp. aureus Mu50
uaccuaauugcuuaauauc

SEQ ID NO: 3995100 - RNA, 19 nt, Staphylococcus aureus subsp. aureus Mu50
uaccuacacggucccaaga

SEQ ID NO: 3995101 - RNA, 21 nt, Staphylococcus aureus subsp. aureus Mu50
uaccuacagaauggauaccua

SEQ ID NO: 3995102 - RNA, 17 nt, Staphylococcus aureus subsp. aureus Mu50
uaccuauuaauaucaua

SEQ ID NO: 3995103 - RNA, 18 nt, Staphylococcus aureus subsp. aureus Mu50
uaccuccccaacuuaaua

SEQ ID NO: 3995104 - RNA, 19 nt, Staphylococcus aureus subsp. aureus Mu50
uaccucgaaauuacuguua

SEQ ID NO: 3995105 - RNA, 19 nt, Staphylococcus aureus subsp. aureus Mu50
uaccucugauaaaugaauu

SEQ ID NO: 3995106 - RNA, 20 nt, Staphylococcus aureus subsp. aureus Mu50
uaccugguucgauuguaaua

SEQ ID NO: 3995107 - RNA, 14 nt, Staphylococcus aureus subsp. aureus Mu50
uaccuuaaauacaa

SEQ ID NO: 3995108 - RNA, 18 nt, Staphylococcus aureus subsp. aureus Mu50
uaccuuaaauacaaaccc

SEQ ID NO: 3995109 - RNA, 20 nt, Staphylococcus aureus subsp. aureus Mu50
uaccuuaucaguguaaguuu

SEQ ID NO: 3995110 - RNA, 20 nt, Staphylococcus aureus subsp. aureus Mu50
uaccuugauucauuucgauu

SEQ ID NO: 3995111 - RNA, 18 nt, Staphylococcus aureus subsp. aureus Mu50
uaccuuuaaaucuacuuu

SEQ ID NO: 3995112 - RNA, 13 nt, Staphylococcus aureus subsp. aureus Mu50
uaccuuuaauaau

SEQ ID NO: 3995113 - RNA, 16 nt, Staphylococcus aureus subsp. aureus Mu50
uaccuuuaauaauauu

SEQ ID NO: 3995114 - RNA, 18 nt, Staphylococcus aureus subsp. aureus Mu50
uaccuuuaauaauauuga

SEQ ID NO: 3995115 - RNA, 14 nt, Staphylococcus aureus subsp. aureus Mu50
uaccuuuaauaucu

SEQ ID NO: 3995116 - RNA, 15 nt, Staphylococcus aureus subsp. aureus Mu50
uaccuuuaauaucua

SEQ ID NO: 3995117 - RNA, 14 nt, Staphylococcus aureus subsp. aureus Mu50
uaccuuuaauuguu

SEQ ID NO: 3995118 - RNA, 16 nt, Staphylococcus aureus subsp. aureus Mu50
uaccuuuacuuucauu

SEQ ID NO: 3995119 - RNA, 17 nt, Staphylococcus aureus subsp. aureus Mu50
uaccuuuacuuucauua

SEQ ID NO: 3995120 - RNA, 14 nt, Staphylococcus aureus subsp. aureus Mu50
uaccuuuauuauuu

SEQ ID NO: 3995121 - RNA, 13 nt, Staphylococcus aureus subsp. aureus Mu50
uacuauacuuuga

SEQ ID NO: 3995122 - RNA, 13 nt, Staphylococcus aureus subsp. aureus Mu50
uacuauauauaau

SEQ ID NO: 3995123 - RNA, 13 nt, Staphylococcus aureus subsp. aureus Mu50
uacuauaugaaaa

SEQ ID NO: 3995124 - RNA, 15 nt, Staphylococcus aureus subsp. aureus Mu50
uacuauauucaauga

SEQ ID NO: 3995125 - RNA, 16 nt, Staphylococcus aureus subsp. aureus Mu50
uacuauauuuaaauug

SEQ ID NO: 3995126 - RNA, 18 nt, Staphylococcus aureus subsp. aureus Mu50
uacuaucuucaucauauu

SEQ ID NO: 3995127 - RNA, 19 nt, Staphylococcus aureus subsp. aureus Mu50
uacuaucuucaucauauuc

SEQ ID NO: 3995128 - RNA, 12 nt, Staphylococcus aureus subsp. aureus Mu50
uacuauuaaagg

SEQ ID NO: 3995129 - RNA, 19 nt, Staphylococcus aureus subsp. aureus Mu50
uacuauuaaaggaaaucaa

SEQ ID NO: 3995130 - RNA, 14 nt, Staphylococcus aureus subsp. aureus Mu50
uacuauuaaauaau

SEQ ID NO: 3995131 - RNA, 16 nt, Staphylococcus aureus subsp. aureus Mu50
uacuauuaaauaaucg

SEQ ID NO: 3995132 - RNA, 20 nt, Staphylococcus aureus subsp. aureus Mu50
uacucaaaccaucuuaucuu

SEQ ID NO: 3995133 - RNA, 18 nt, Staphylococcus aureus subsp. aureus Mu50
uacucaauccuaaauuau

SEQ ID NO: 3995134 - RNA, 13 nt, Staphylococcus aureus subsp. aureus Mu50
uacucauuuagcu

SEQ ID NO: 3995135 - RNA, 24 nt, Staphylococcus aureus subsp. aureus Mu50
uacuccaauuaccaaugaauaaau

SEQ ID NO: 3995136 - RNA, 12 nt, Staphylococcus aureus subsp. aureus Mu50
uacucugaaaag

SEQ ID NO: 3995137 - RNA, 19 nt, Staphylococcus aureus subsp. aureus Mu50
uacucugaaaagccuacuu

SEQ ID NO: 3995138 - RNA, 18 nt, Staphylococcus aureus subsp. aureus Mu50
uacucugggcauuuugac

SEQ ID NO: 3995139 - RNA, 17 nt, Staphylococcus aureus subsp. aureus Mu50
uacucuggucugugaua

SEQ ID NO: 3995140 - RNA, 16 nt, Staphylococcus aureus subsp. aureus Mu50
uacucuucguuuuaau

SEQ ID NO: 3995141 - RNA, 23 nt, Staphylococcus aureus subsp. aureus Mu50
uacucuucguuuuaauaaagcac

SEQ ID NO: 3995142 - RNA, 14 nt, Staphylococcus aureus subsp. aureus Mu50
uacucuuuuucuuu

SEQ ID NO: 3995143 - RNA, 23 nt, Staphylococcus aureus subsp. aureus Mu50
uacucuuuuucuuucauaauuaa

SEQ ID NO: 3995144 - RNA, 21 nt, Staphylococcus aureus subsp. aureus Mu50
uacugaaacaugagcuccucu

SEQ ID NO: 3995145 - RNA, 20 nt, Staphylococcus aureus subsp. aureus Mu50
uacugaaacuaaauuaaaag

SEQ ID NO: 3995146 - RNA, 20 nt, Staphylococcus aureus subsp. aureus Mu50
uacugacuagccuucaauau

SEQ ID NO: 3995147 - RNA, 21 nt, Staphylococcus aureus subsp. aureus Mu50
uacugacucuuaauuuugcaa

SEQ ID NO: 3995148 - RNA, 19 nt, Staphylococcus aureus subsp. aureus Mu50
uacugaugaacauaccugc

SEQ ID NO: 3995149 - RNA, 14 nt, Staphylococcus aureus subsp. aureus Mu50
uacugauugaaugu

SEQ ID NO: 3995150 - RNA, 22 nt, Staphylococcus aureus subsp. aureus Mu50
uacugcaauuauuuuucaaaua

SEQ ID NO: 3995151 - RNA, 21 nt, Staphylococcus aureus subsp. aureus Mu50
uacugcagcaucauaaucuuu

SEQ ID NO: 3995152 - RNA, 22 nt, Staphylococcus aureus subsp. aureus Mu50
uacugcccaauguguuuaacuu

SEQ ID NO: 3995153 - RNA, 23 nt, Staphylococcus aureus subsp. aureus Mu50
uacugcucuuuauauauaaaauc

SEQ ID NO: 3995154 - RNA, 15 nt, Staphylococcus aureus subsp. aureus Mu50
uacugcugcuuuuaa

SEQ ID NO: 3995155 - RNA, 15 nt, Staphylococcus aureus subsp. aureus Mu50
uacugcugucuuuuu

SEQ ID NO: 3995156 - RNA, 19 nt, Staphylococcus aureus subsp. aureus Mu50
uacugcuguuuuuuauagu

SEQ ID NO: 3995157 - RNA, 18 nt, Staphylococcus aureus subsp. aureus Mu50
uacugcuucaaucgucac

SEQ ID NO: 3995158 - RNA, 18 nt, Staphylococcus aureus subsp. aureus Mu50
uacugcuucgacauugau

SEQ ID NO: 3995159 - RNA, 23 nt, Staphylococcus aureus subsp. aureus Mu50
uacugcuucgcuaauaucaucuu

SEQ ID NO: 3995160 - RNA, 16 nt, Staphylococcus aureus subsp. aureus Mu50
uacugguuaguaaaau

SEQ ID NO: 3995161 - RNA, 17 nt, Staphylococcus aureus subsp. aureus Mu50
uacuguaguacuauagu

SEQ ID NO: 3995162 - RNA, 21 nt, Staphylococcus aureus subsp. aureus Mu50
uacuguaguacuauagucauu

SEQ ID NO: 3995163 - RNA, 13 nt, Staphylococcus aureus subsp. aureus Mu50
uacuguauuuuaa

SEQ ID NO: 3995164 - RNA, 20 nt, Staphylococcus aureus subsp. aureus Mu50
uacugucucaucuucuaaau

SEQ ID NO: 3995165 - RNA, 18 nt, Staphylococcus aureus subsp. aureus Mu50
uacuguuuaaauaaaauu

SEQ ID NO: 3995166 - RNA, 16 nt, Staphylococcus aureus subsp. aureus Mu50
uacuuaaauuaagaau

SEQ ID NO: 3995167 - RNA, 14 nt, Staphylococcus aureus subsp. aureus Mu50
uacuuaauauaguu

SEQ ID NO: 3995168 - RNA, 20 nt, Staphylococcus aureus subsp. aureus Mu50
uacuuaaugacuucuuuaua

SEQ ID NO: 3995169 - RNA, 15 nt, Staphylococcus aureus subsp. aureus Mu50
uacuuaauuaauaau

SEQ ID NO: 3995170 - RNA, 16 nt, Staphylococcus aureus subsp. aureus Mu50
uacuuaauuaauaauu

SEQ ID NO: 3995171 - RNA, 12 nt, Staphylococcus aureus subsp. aureus Mu50
uacuuaauuuaa

SEQ ID NO: 3995172 - RNA, 21 nt, Staphylococcus aureus subsp. aureus Mu50
uacuuaauuuaaaucuguacu

SEQ ID NO: 3995173 - RNA, 18 nt, Staphylococcus aureus subsp. aureus Mu50
uacuuacgccaaucacaa

SEQ ID NO: 3995174 - RNA, 22 nt, Staphylococcus aureus subsp. aureus Mu50
uacuuacuuuucuaaacaacuu

SEQ ID NO: 3995175 - RNA, 19 nt, Staphylococcus aureus subsp. aureus Mu50
uacuuaguaaggaauauuu

SEQ ID NO: 3995176 - RNA, 15 nt, Staphylococcus aureus subsp. aureus Mu50
uacuuauauauucaa

SEQ ID NO: 3995177 - RNA, 17 nt, Staphylococcus aureus subsp. aureus Mu50
uacuuaucuguagauua

SEQ ID NO: 3995178 - RNA, 15 nt, Staphylococcus aureus subsp. aureus Mu50
uacuuauuucuuuuc

SEQ ID NO: 3995179 - RNA, 17 nt, Staphylococcus aureus subsp. aureus Mu50
uacuuauuucuuuucau

SEQ ID NO: 3995180 - RNA, 19 nt, Staphylococcus aureus subsp. aureus Mu50
uacuuauuucuuuucauua

SEQ ID NO: 3995181 - RNA, 17 nt, Staphylococcus aureus subsp. aureus Mu50
uacuucaccaucuuuaa

SEQ ID NO: 3995182 - RNA, 20 nt, Staphylococcus aureus subsp. aureus Mu50
uacuucaguuugguuugcuu

SEQ ID NO: 3995183 - RNA, 15 nt, Staphylococcus aureus subsp. aureus Mu50
uacuucuaauuugca

SEQ ID NO: 3995184 - RNA, 14 nt, Staphylococcus aureus subsp. aureus Mu50
uacuucucaauuua

SEQ ID NO: 3995185 - RNA, 15 nt, Staphylococcus aureus subsp. aureus Mu50
uacuucucaauuuag

SEQ ID NO: 3995186 - RNA, 21 nt, Staphylococcus aureus subsp. aureus Mu50
uacuucucaauuuaguauaaa

SEQ ID NO: 3995187 - RNA, 18 nt, Staphylococcus aureus subsp. aureus Mu50
uacuucucccuuaaauac

SEQ ID NO: 3995188 - RNA, 16 nt, Staphylococcus aureus subsp. aureus Mu50
uacuucuuuggucuaa

SEQ ID NO: 3995189 - RNA, 17 nt, Staphylococcus aureus subsp. aureus Mu50
uacuucuuuugcaaaac

SEQ ID NO: 3995190 - RNA, 23 nt, Staphylococcus aureus subsp. aureus Mu50
uacuugaagcaucgauuuauuau

SEQ ID NO: 3995191 - RNA, 17 nt, Staphylococcus aureus subsp. aureus Mu50
uacuugaauaccuuuua

SEQ ID NO: 3995192 - RNA, 19 nt, Staphylococcus aureus subsp. aureus Mu50
uacuugaauaccuuuuauu

SEQ ID NO: 3995193 - RNA, 18 nt, Staphylococcus aureus subsp. aureus Mu50
uacuugaauuuaauaagu

SEQ ID NO: 3995194 - RNA, 16 nt, Staphylococcus aureus subsp. aureus Mu50
uacuugcacaccagug

SEQ ID NO: 3995195 - RNA, 23 nt, Staphylococcus aureus subsp. aureus Mu50
uacuuggaaaauacuauacugau

SEQ ID NO: 3995196 - RNA, 16 nt, Staphylococcus aureus subsp. aureus Mu50
uacuuggaaauguaua

SEQ ID NO: 3995197 - RNA, 20 nt, Staphylococcus aureus subsp. aureus Mu50
uacuuggcucaaaacuuuua

SEQ ID NO: 3995198 - RNA, 15 nt, Staphylococcus aureus subsp. aureus Mu50
uacuuguaauuaaua

SEQ ID NO: 3995199 - RNA, 20 nt, Staphylococcus aureus subsp. aureus Mu50
uacuuguaauuaauacauca

SEQ ID NO: 3995200 - RNA, 18 nt, Staphylococcus aureus subsp. aureus Mu50
uacuugucguauucuuca

SEQ ID NO: 3995201 - RNA, 15 nt, Staphylococcus aureus subsp. aureus Mu50
uacuuuaaaauugua

SEQ ID NO: 3995202 - RNA, 17 nt, Staphylococcus aureus subsp. aureus Mu50
uacuuuacauuucucgu

SEQ ID NO: 3995203 - RNA, 14 nt, Staphylococcus aureus subsp. aureus Mu50
uacuuuauaaauau

SEQ ID NO: 3995204 - RNA, 17 nt, Staphylococcus aureus subsp. aureus Mu50
uacuuuauaaauaucuu

SEQ ID NO: 3995205 - RNA, 15 nt, Staphylococcus aureus subsp. aureus Mu50
uacuuuaucguugua

SEQ ID NO: 3995206 - RNA, 16 nt, Staphylococcus aureus subsp. aureus Mu50
uacuuucaaacaaauc

SEQ ID NO: 3995207 - RNA, 20 nt, Staphylococcus aureus subsp. aureus Mu50
uacuuucaaacaaaucuuuu

SEQ ID NO: 3995208 - RNA, 23 nt, Staphylococcus aureus subsp. aureus Mu50
uagauagaaauugugcuuuucca

SEQ ID NO: 3995209 - RNA, 17 nt, Staphylococcus aureus subsp. aureus Mu50
uagauagcggauuuauu

SEQ ID NO: 3995210 - RNA, 20 nt, Staphylococcus aureus subsp. aureus Mu50
uagauaggauauuuuuuaau

SEQ ID NO: 3995211 - RNA, 14 nt, Staphylococcus aureus subsp. aureus Mu50
uagauauagcaucu

SEQ ID NO: 3995212 - RNA, 18 nt, Staphylococcus aureus subsp. aureus Mu50
uagauaucuuaaucuaaa

SEQ ID NO: 3995213 - RNA, 19 nt, Staphylococcus aureus subsp. aureus Mu50
uagaucaauauucuaugcu

SEQ ID NO: 3995214 - RNA, 23 nt, Staphylococcus aureus subsp. aureus Mu50
uagaugaaauuguguugaaucaa

SEQ ID NO: 3995215 - RNA, 15 nt, Staphylococcus aureus subsp. aureus Mu50
uagaugcauaaaaaa

SEQ ID NO: 3995216 - RNA, 18 nt, Staphylococcus aureus subsp. aureus Mu50
uagaugcauaaaaaaaga

SEQ ID NO: 3995217 - RNA, 18 nt, Staphylococcus aureus subsp. aureus Mu50
uagaugcuugaccuucag

SEQ ID NO: 3995218 - RNA, 15 nt, Staphylococcus aureus subsp. aureus Mu50
uagauuaucuuucaa

SEQ ID NO: 3995219 - RNA, 18 nt, Staphylococcus aureus subsp. aureus Mu50
uagauugacuaaguuugu

SEQ ID NO: 3995220 - RNA, 21 nt, Staphylococcus aureus subsp. aureus Mu50
uagauugauuguauuuuucaa

SEQ ID NO: 3995221 - RNA, 15 nt, Staphylococcus aureus subsp. aureus Mu50
uagauuuaaaauguc

SEQ ID NO: 3995222 - RNA, 14 nt, Staphylococcus aureus subsp. aureus Mu50
uagauuuacgguua

SEQ ID NO: 3995223 - RNA, 17 nt, Staphylococcus aureus subsp. aureus Mu50
uagauuuaggagagcca

SEQ ID NO: 3995224 - RNA, 18 nt, Staphylococcus aureus subsp. aureus Mu50
uagauuuaucgccaauua

SEQ ID NO: 3995225 - RNA, 12 nt, Staphylococcus aureus subsp. aureus Mu50
uagauuuuaaac

SEQ ID NO: 3995226 - RNA, 17 nt, Staphylococcus aureus subsp. aureus Mu50
uagauuuuauauaaaaa

SEQ ID NO: 3995227 - RNA, 16 nt, Staphylococcus aureus subsp. aureus Mu50
uagauuuucacuaaua

SEQ ID NO: 3995228 - RNA, 15 nt, Staphylococcus aureus subsp. aureus Mu50
uagcaaaaauacuuu

SEQ ID NO: 3995229 - RNA, 21 nt, Staphylococcus aureus subsp. aureus Mu50
uagcaaaagcuuuuacgccuu

SEQ ID NO: 3995230 - RNA, 16 nt, Staphylococcus aureus subsp. aureus Mu50
uagcaaaauuauguaa

SEQ ID NO: 3995231 - RNA, 17 nt, Staphylococcus aureus subsp. aureus Mu50
uagcaaauauuauuaaa

SEQ ID NO: 3995232 - RNA, 15 nt, Staphylococcus aureus subsp. aureus Mu50
uagcaaauauuucug

SEQ ID NO: 3995233 - RNA, 22 nt, Staphylococcus aureus subsp. aureus Mu50
uagcaaccauauuuuuagaaaa

SEQ ID NO: 3995234 - RNA, 16 nt, Staphylococcus aureus subsp. aureus Mu50
uagcaacugaucauuu

SEQ ID NO: 3995235 - RNA, 19 nt, Staphylococcus aureus subsp. aureus Mu50
uagcaagaauagauugauu

SEQ ID NO: 3995236 - RNA, 12 nt, Staphylococcus aureus subsp. aureus Mu50
uagcaauaucau

SEQ ID NO: 3995237 - RNA, 14 nt, Staphylococcus aureus subsp. aureus Mu50
uagcaauaucauca

SEQ ID NO: 3995238 - RNA, 16 nt, Staphylococcus aureus subsp. aureus Mu50
uagcaauaucaucauu

SEQ ID NO: 3995239 - RNA, 12 nt, Staphylococcus aureus subsp. aureus Mu50
uagcaaugaauu

SEQ ID NO: 3995240 - RNA, 13 nt, Staphylococcus aureus subsp. aureus Mu50
uagcaccauuauu

SEQ ID NO: 3995241 - RNA, 22 nt, Staphylococcus aureus subsp. aureus Mu50
uagcaccguaacauauguacua

SEQ ID NO: 3995242 - RNA, 11 nt, Staphylococcus aureus subsp. aureus Mu50
uagcagcaguu

SEQ ID NO: 3995243 - RNA, 16 nt, Staphylococcus aureus subsp. aureus Mu50
uagcaggcaacuuuua

SEQ ID NO: 3995244 - RNA, 20 nt, Staphylococcus aureus subsp. aureus Mu50
uagcagggugcuaaauuuac

SEQ ID NO: 3995245 - RNA, 18 nt, Staphylococcus aureus subsp. aureus Mu50
uagcaguaauauguugcu

SEQ ID NO: 3995246 - RNA, 15 nt, Staphylococcus aureus subsp. aureus Mu50
uagcauaaaauuucu

SEQ ID NO: 3995247 - RNA, 22 nt, Staphylococcus aureus subsp. aureus Mu50
uagcauaucuuuaucauuauuc

SEQ ID NO: 3995248 - RNA, 18 nt, Staphylococcus aureus subsp. aureus Mu50
uagcauauucgcuuaaaa

SEQ ID NO: 3995249 - RNA, 17 nt, Staphylococcus aureus subsp. aureus Mu50
uagcaucaaaaauaaaa

SEQ ID NO: 3995250 - RNA, 19 nt, Staphylococcus aureus subsp. aureus Mu50
uagcaugacauuaaggcuu

SEQ ID NO: 3995251 - RNA, 17 nt, Staphylococcus aureus subsp. aureus Mu50
uagcauguuuugagcaa

SEQ ID NO: 3995252 - RNA, 22 nt, Staphylococcus aureus subsp. aureus Mu50
uagcauuagcaaauauuauuaa

SEQ ID NO: 3995253 - RNA, 15 nt, Staphylococcus aureus subsp. aureus Mu50
uagcauuauuugcug

SEQ ID NO: 3995254 - RNA, 17 nt, Staphylococcus aureus subsp. aureus Mu50
uagcauuccuaauuaua

SEQ ID NO: 3995255 - RNA, 13 nt, Staphylococcus aureus subsp. aureus Mu50
uagccaaauaaau

SEQ ID NO: 3995256 - RNA, 23 nt, Staphylococcus aureus subsp. aureus Mu50
uagccaaugcuuccaucacauca

SEQ ID NO: 3995257 - RNA, 16 nt, Staphylococcus aureus subsp. aureus Mu50
uagccuagauaccaaa

SEQ ID NO: 3995258 - RNA, 14 nt, Staphylococcus aureus subsp. aureus Mu50
uagccuauuuaaaa

SEQ ID NO: 3995259 - RNA, 15 nt, Staphylococcus aureus subsp. aureus Mu50
uagccugaaauagaa

SEQ ID NO: 3995260 - RNA, 22 nt, Staphylococcus aureus subsp. aureus Mu50
uagccugaaauagaaaugucau

SEQ ID NO: 3995261 - RNA, 17 nt, Staphylococcus aureus subsp. aureus Mu50
uagccuucaauauuucu

SEQ ID NO: 3995262 - RNA, 15 nt, Staphylococcus aureus subsp. aureus Mu50
uagccuuuucuagcu

SEQ ID NO: 3995263 - RNA, 22 nt, Staphylococcus aureus subsp. aureus Mu50
uagcgcaagagauaagaaaaua

SEQ ID NO: 3995264 - RNA, 18 nt, Staphylococcus aureus subsp. aureus Mu50
uagcgcgcuuauugaaaa

SEQ ID NO: 3995265 - RNA, 21 nt, Staphylococcus aureus subsp. aureus Mu50
uagcgcgcuuauugaaaagau

SEQ ID NO: 3995266 - RNA, 22 nt, Staphylococcus aureus subsp. aureus Mu50
uagcgcucuggauuuuucuuau

SEQ ID NO: 3995267 - RNA, 15 nt, Staphylococcus aureus subsp. aureus Mu50
uagcggauuuauuuu

SEQ ID NO: 3995268 - RNA, 22 nt, Staphylococcus aureus subsp. aureus Mu50
uagcguaauuauuauaauaaau

SEQ ID NO: 3995269 - RNA, 19 nt, Staphylococcus aureus subsp. aureus Mu50
uagcguacgauauagugcu

SEQ ID NO: 3995270 - RNA, 14 nt, Staphylococcus aureus subsp. aureus Mu50
uagcguagcgaaag

SEQ ID NO: 3995271 - RNA, 19 nt, Staphylococcus aureus subsp. aureus Mu50
uagcgugauuuuucauauu

SEQ ID NO: 3995272 - RNA, 13 nt, Staphylococcus aureus subsp. aureus Mu50
uagcuaaagcuug

SEQ ID NO: 3995273 - RNA, 20 nt, Staphylococcus aureus subsp. aureus Mu50
uagcuaagauacuuuuaaau

SEQ ID NO: 3995274 - RNA, 12 nt, Staphylococcus aureus subsp. aureus Mu50
uagcuaaugcau

SEQ ID NO: 3995275 - RNA, 23 nt, Staphylococcus aureus subsp. aureus Mu50
uagcuauaacucuaaauauaaua

SEQ ID NO: 3995276 - RNA, 16 nt, Staphylococcus aureus subsp. aureus Mu50
uagcuauauuuuugua

SEQ ID NO: 3995277 - RNA, 18 nt, Staphylococcus aureus subsp. aureus Mu50
uagcuauauuuuuguauu

SEQ ID NO: 3995278 - RNA, 13 nt, Staphylococcus aureus subsp. aureus Mu50
uagcuauuaaaau

SEQ ID NO: 3995279 - RNA, 18 nt, Staphylococcus aureus subsp. aureus Mu50
uagcucaaaacaauuuaa

SEQ ID NO: 3995280 - RNA, 15 nt, Staphylococcus aureus subsp. aureus Mu50
uagcucauuacaaag

SEQ ID NO: 3995281 - RNA, 18 nt, Staphylococcus aureus subsp. aureus Mu50
uagcucauuacaaagucu

SEQ ID NO: 3995282 - RNA, 20 nt, Staphylococcus aureus subsp. aureus Mu50
uagcucuccuacaacuauuc

SEQ ID NO: 3995283 - RNA, 12 nt, Staphylococcus aureus subsp. aureus Mu50
uagcucuucuuu

SEQ ID NO: 3995284 - RNA, 15 nt, Staphylococcus aureus subsp. aureus Mu50
uagcucuuuuuugau

SEQ ID NO: 3995285 - RNA, 21 nt, Staphylococcus aureus subsp. aureus Mu50
uagcucuuuuuugauuuggaa

SEQ ID NO: 3995286 - RNA, 17 nt, Staphylococcus aureus subsp. aureus Mu50
uagcugcuucugcugua

SEQ ID NO: 3995287 - RNA, 16 nt, Staphylococcus aureus subsp. aureus Mu50
uagcuggcuuuuuaau

SEQ ID NO: 3995288 - RNA, 20 nt, Staphylococcus aureus subsp. aureus Mu50
uagcuggcuuuuuaauuguu

SEQ ID NO: 3995289 - RNA, 13 nt, Staphylococcus aureus subsp. aureus Mu50
uagcuuaauaauu

SEQ ID NO: 3995290 - RNA, 13 nt, Staphylococcus aureus subsp. aureus Mu50
uagcuuagucaau

SEQ ID NO: 3995291 - RNA, 20 nt, Staphylococcus aureus subsp. aureus Mu50
uagcuuagucaauguauauu

SEQ ID NO: 3995292 - RNA, 13 nt, Staphylococcus aureus subsp. aureus Mu50
uagcuugaauaau

SEQ ID NO: 3995293 - RNA, 14 nt, Staphylococcus aureus subsp. aureus Mu50
uagcuugaauaaua

SEQ ID NO: 3995294 - RNA, 15 nt, Staphylococcus aureus subsp. aureus Mu50
uagcuugaauaauau

SEQ ID NO: 3995295 - RNA, 17 nt, Staphylococcus aureus subsp. aureus Mu50
uagcuugaauaauauau

SEQ ID NO: 3995296 - RNA, 22 nt, Staphylococcus aureus subsp. aureus Mu50
uagugcucuugcaauagcaaca

SEQ ID NO: 3995297 - RNA, 12 nt, Staphylococcus aureus subsp. aureus Mu50
uagugcuuguuu

SEQ ID NO: 3995298 - RNA, 21 nt, Staphylococcus aureus subsp. aureus Mu50
uaguggaauacuugucaaaau

SEQ ID NO: 3995299 - RNA, 22 nt, Staphylococcus aureus subsp. aureus Mu50
uaguggaucacgauaauguaua

SEQ ID NO: 3995300 - RNA, 22 nt, Staphylococcus aureus subsp. aureus Mu50
uagugguagccaauaucauauu

SEQ ID NO: 3995301 - RNA, 18 nt, Staphylococcus aureus subsp. aureus Mu50
uagugucacaaagaaauu

SEQ ID NO: 3995302 - RNA, 14 nt, Staphylococcus aureus subsp. aureus Mu50
uaguguguuuaaaa

SEQ ID NO: 3995303 - RNA, 18 nt, Staphylococcus aureus subsp. aureus Mu50
uaguguucucauuauaau

SEQ ID NO: 3995304 - RNA, 14 nt, Staphylococcus aureus subsp. aureus Mu50
uaguguuuguaaug

SEQ ID NO: 3995305 - RNA, 12 nt, Staphylococcus aureus subsp. aureus Mu50
uaguuaaauaca

SEQ ID NO: 3995306 - RNA, 21 nt, Staphylococcus aureus subsp. aureus Mu50
uaguuaagauaccuuuuucua

SEQ ID NO: 3995307 - RNA, 16 nt, Staphylococcus aureus subsp. aureus Mu50
uaguuaaguauuuaaa

SEQ ID NO: 3995308 - RNA, 17 nt, Staphylococcus aureus subsp. aureus Mu50
uaguuaauuauuuagau

SEQ ID NO: 3995309 - RNA, 15 nt, Staphylococcus aureus subsp. aureus Mu50
uaguuaauucuccua

SEQ ID NO: 3995310 - RNA, 14 nt, Staphylococcus aureus subsp. aureus Mu50
uaguuagaaaguau

SEQ ID NO: 3995311 - RNA, 17 nt, Staphylococcus aureus subsp. aureus Mu50
uaguuagcccuauucaa

SEQ ID NO: 3995312 - RNA, 17 nt, Staphylococcus aureus subsp. aureus Mu50
uaguuagggaaauguag

SEQ ID NO: 3995313 - RNA, 22 nt, Staphylococcus aureus subsp. aureus Mu50
uaguuagggaaauguagauuac

SEQ ID NO: 3995314 - RNA, 19 nt, Staphylococcus aureus subsp. aureus Mu50
uaguucaaauugaacuucu

SEQ ID NO: 3995315 - RNA, 21 nt, Staphylococcus aureus subsp. aureus Mu50
uaguucacaugaauuuuaaua

SEQ ID NO: 3995316 - RNA, 18 nt, Staphylococcus aureus subsp. aureus Mu50
uaguucgauucaugaaua

SEQ ID NO: 3995317 - RNA, 23 nt, Staphylococcus aureus subsp. aureus Mu50
uaguucgcgacgacguccagcua

SEQ ID NO: 3995318 - RNA, 18 nt, Staphylococcus aureus subsp. aureus Mu50
uaguucuggcaaagaauc

SEQ ID NO: 3995319 - RNA, 23 nt, Staphylococcus aureus subsp. aureus Mu50
uaguucuggcaaagaauccuuaa

SEQ ID NO: 3995320 - RNA, 17 nt, Staphylococcus aureus subsp. aureus Mu50
uaguucuguugauauuu

SEQ ID NO: 3995321 - RNA, 19 nt, Staphylococcus aureus subsp. aureus Mu50
uaguugagcguuuaauuag

SEQ ID NO: 3995322 - RNA, 21 nt, Staphylococcus aureus subsp. aureus Mu50
uaguugagcguuuaauuagaa

SEQ ID NO: 3995323 - RNA, 23 nt, Staphylococcus aureus subsp. aureus Mu50
uaguugaucaaaaagacagcagu

SEQ ID NO: 3995324 - RNA, 14 nt, Staphylococcus aureus subsp. aureus Mu50
uaguuguacuucuu

SEQ ID NO: 3995325 - RNA, 15 nt, Staphylococcus aureus subsp. aureus Mu50
uaguuguacuucuuu

SEQ ID NO: 3995326 - RNA, 15 nt, Staphylococcus aureus subsp. aureus Mu50
uaguuguaucauuaa

SEQ ID NO: 3995327 - RNA, 20 nt, Staphylococcus aureus subsp. aureus Mu50
uaguuguuuuauagcauuuc

SEQ ID NO: 3995328 - RNA, 22 nt, Staphylococcus aureus subsp. aureus Mu50
uaguuuaacaauacuacuuaau

SEQ ID NO: 3995329 - RNA, 13 nt, Staphylococcus aureus subsp. aureus Mu50
uaguuuauaaauu

SEQ ID NO: 3995330 - RNA, 23 nt, Staphylococcus aureus subsp. aureus Mu50
uaguuuauugccgguuaaauuau

SEQ ID NO: 3995331 - RNA, 15 nt, Staphylococcus aureus subsp. aureus Mu50
uaguuugaauuggga

SEQ ID NO: 3995332 - RNA, 20 nt, Staphylococcus aureus subsp. aureus Mu50
uaguuugacaucuauuucuu

SEQ ID NO: 3995333 - RNA, 17 nt, Staphylococcus aureus subsp. aureus Mu50
uaguuuguaauaauuaa

SEQ ID NO: 3995334 - RNA, 13 nt, Staphylococcus aureus subsp. aureus Mu50
uaguuuucaugaa

SEQ ID NO: 3995335 - RNA, 12 nt, Staphylococcus aureus subsp. aureus Mu50
uaguuuucuuaa

SEQ ID NO: 3995336 - RNA, 16 nt, Staphylococcus aureus subsp. aureus Mu50
uaguuuucuuaaaaga

SEQ ID NO: 3995337 - RNA, 21 nt, Staphylococcus aureus subsp. aureus Mu50
uaguuuucuuaaaagagcaag

SEQ ID NO: 3995338 - RNA, 23 nt, Staphylococcus aureus subsp. aureus Mu50
uauaaaaaaauuaacuauacuuu

SEQ ID NO: 3995339 - RNA, 22 nt, Staphylococcus aureus subsp. aureus Mu50
uauaaaaaaccguaauuuuaau

SEQ ID NO: 3995340 - RNA, 19 nt, Staphylococcus aureus subsp. aureus Mu50
uauaaaaaauuauuaaaaa

SEQ ID NO: 3995341 - RNA, 15 nt, Staphylococcus aureus subsp. aureus Mu50
uauaaaaacuuauuu

SEQ ID NO: 3995342 - RNA, 20 nt, Staphylococcus aureus subsp. aureus Mu50
uauaaaaagaucauuaaaaa

SEQ ID NO: 3995343 - RNA, 23 nt, Staphylococcus aureus subsp. aureus Mu50
uauaaaaagucccgcuuaaaaug

SEQ ID NO: 3995344 - RNA, 20 nt, Staphylococcus aureus subsp. aureus Mu50
uauaaaaauuuauucaaaau

SEQ ID NO: 3995345 - RNA, 21 nt, Staphylococcus aureus subsp. aureus Mu50
uauaaaaauuuauucaaaauu

SEQ ID NO: 3995346 - RNA, 17 nt, Staphylococcus aureus subsp. aureus Mu50
uauaaaacgauaagaau

SEQ ID NO: 3995347 - RNA, 19 nt, Staphylococcus aureus subsp. aureus Mu50
uauaaaagauauaaacauu

SEQ ID NO: 3995348 - RNA, 13 nt, Staphylococcus aureus subsp. aureus Mu50
uauaaaaguacuu

SEQ ID NO: 3995349 - RNA, 14 nt, Staphylococcus aureus subsp. aureus Mu50
uauaaaauaaaaaa

SEQ ID NO: 3995350 - RNA, 13 nt, Staphylococcus aureus subsp. aureus Mu50
uauaaaauaaaau

SEQ ID NO: 3995351 - RNA, 14 nt, Staphylococcus aureus subsp. aureus Mu50
uauaaaauaaaaug

SEQ ID NO: 3995352 - RNA, 12 nt, Staphylococcus aureus subsp. aureus Mu50
uauaaaauaaau

SEQ ID NO: 3995353 - RNA, 13 nt, Staphylococcus aureus subsp. aureus Mu50
uauaaaauaaaua

SEQ ID NO: 3995354 - RNA, 21 nt, Staphylococcus aureus subsp. aureus Mu50
uauaaaauaugagauuaucug

SEQ ID NO: 3995355 - RNA, 22 nt, Staphylococcus aureus subsp. aureus Mu50
uauaaaaucaucguauuucaua

SEQ ID NO: 3995356 - RNA, 15 nt, Staphylococcus aureus subsp. aureus Mu50
uauaaaaucauuaau

SEQ ID NO: 3995357 - RNA, 23 nt, Staphylococcus aureus subsp. aureus Mu50
uauaaaauggugcgaauaauaau

SEQ ID NO: 3995358 - RNA, 14 nt, Staphylococcus aureus subsp. aureus Mu50
uauaaaauucacca

SEQ ID NO: 3995359 - RNA, 16 nt, Staphylococcus aureus subsp. aureus Mu50
uauaaacauaucuucu

SEQ ID NO: 3995360 - RNA, 20 nt, Staphylococcus aureus subsp. aureus Mu50
uauaaaccagcugauuccau

SEQ ID NO: 3995361 - RNA, 17 nt, Staphylococcus aureus subsp. aureus Mu50
uauaaaccgccaacuaa

SEQ ID NO: 3995362 - RNA, 17 nt, Staphylococcus aureus subsp. aureus Mu50
uauaaaccuaaugcuuu

SEQ ID NO: 3995363 - RNA, 22 nt, Staphylococcus aureus subsp. aureus Mu50
uauaaaccuaaugcuuuaauaa

SEQ ID NO: 3995364 - RNA, 22 nt, Staphylococcus aureus subsp. aureus Mu50
uauaaacguccaaacacaaaua

SEQ ID NO: 3995365 - RNA, 13 nt, Staphylococcus aureus subsp. aureus Mu50
uauaaagaaauaa

SEQ ID NO: 3995366 - RNA, 16 nt, Staphylococcus aureus subsp. aureus Mu50
uauaaagaaauaauuu

SEQ ID NO: 3995367 - RNA, 20 nt, Staphylococcus aureus subsp. aureus Mu50
uauaaagaaauaauuuaaag

SEQ ID NO: 3995368 - RNA, 21 nt, Staphylococcus aureus subsp. aureus Mu50
uauaaagaaauaauuuaaagg

SEQ ID NO: 3995369 - RNA, 10 nt, Staphylococcus aureus subsp. aureus Mu50
uauaaagaau

SEQ ID NO: 3995370 - RNA, 21 nt, Staphylococcus aureus subsp. aureus Mu50
uauaaagacgauuuauuaguu

SEQ ID NO: 3995371 - RNA, 21 nt, Staphylococcus aureus subsp. aureus Mu50
uauaaagauagaaugaauaau

SEQ ID NO: 3995372 - RNA, 22 nt, Staphylococcus aureus subsp. aureus Mu50
uauaaaggaauagcuacaauua

SEQ ID NO: 3995373 - RNA, 19 nt, Staphylococcus aureus subsp. aureus Mu50
uauaaagucguaucauaua

SEQ ID NO: 3995374 - RNA, 18 nt, Staphylococcus aureus subsp. aureus Mu50
uauaaaguugacaauaca

SEQ ID NO: 3995375 - RNA, 21 nt, Staphylococcus aureus subsp. aureus Mu50
uauaaaguugacaauacaaau

SEQ ID NO: 3995376 - RNA, 19 nt, Staphylococcus aureus subsp. aureus Mu50
uauaaaguuuguaauauug

SEQ ID NO: 3995377 - RNA, 14 nt, Staphylococcus aureus subsp. aureus Mu50
uauaaauaaaaaua

SEQ ID NO: 3995378 - RNA, 17 nt, Staphylococcus aureus subsp. aureus Mu50
uauaaauaaaaauacau

SEQ ID NO: 3995379 - RNA, 15 nt, Staphylococcus aureus subsp. aureus Mu50
uauaaauaauaaaug

SEQ ID NO: 3995380 - RNA, 23 nt, Staphylococcus aureus subsp. aureus Mu50
uauaaauaauaaaugcuauauuu

SEQ ID NO: 3995381 - RNA, 13 nt, Staphylococcus aureus subsp. aureus Mu50
uauaaauacaaau

SEQ ID NO: 3995382 - RNA, 14 nt, Staphylococcus aureus subsp. aureus Mu50
uauaaauacaaaua

SEQ ID NO: 3995383 - RNA, 15 nt, Staphylococcus aureus subsp. aureus Mu50
uauaaugauguauuu

SEQ ID NO: 3995384 - RNA, 17 nt, Staphylococcus aureus subsp. aureus Mu50
uauaaugccaaauauag

SEQ ID NO: 3995385 - RNA, 18 nt, Staphylococcus aureus subsp. aureus Mu50
uauaaugcugauaauuuu

SEQ ID NO: 3995386 - RNA, 15 nt, Staphylococcus aureus subsp. aureus Mu50
uauaauguauaaaac

SEQ ID NO: 3995387 - RNA, 13 nt, Staphylococcus aureus subsp. aureus Mu50
uauaauuaaacau

SEQ ID NO: 3995388 - RNA, 15 nt, Staphylococcus aureus subsp. aureus Mu50
uauaauuaaacuaau

SEQ ID NO: 3995389 - RNA, 15 nt, Staphylococcus aureus subsp. aureus Mu50
uauaauuauuaaacu

SEQ ID NO: 3995390 - RNA, 17 nt, Staphylococcus aureus subsp. aureus Mu50
uauaauuauuaaacuuu

SEQ ID NO: 3995391 - RNA, 13 nt, Staphylococcus aureus subsp. aureus Mu50
uauaauucacuuu

SEQ ID NO: 3995392 - RNA, 22 nt, Staphylococcus aureus subsp. aureus Mu50
uauaauucacuuuacccucuuu

SEQ ID NO: 3995393 - RNA, 17 nt, Staphylococcus aureus subsp. aureus Mu50
uauaauucuaagucucu

SEQ ID NO: 3995394 - RNA, 11 nt, Staphylococcus aureus subsp. aureus Mu50
uauaauucuuc

SEQ ID NO: 3995395 - RNA, 12 nt, Staphylococcus aureus subsp. aureus Mu50
uauaauugauug

SEQ ID NO: 3995396 - RNA, 16 nt, Staphylococcus aureus subsp. aureus Mu50
uauaauugauugucau

SEQ ID NO: 3995397 - RNA, 23 nt, Staphylococcus aureus subsp. aureus Mu50
uauaauugauugucauauaaaac

SEQ ID NO: 3995398 - RNA, 20 nt, Staphylococcus aureus subsp. aureus Mu50
uauaauuggcagauagaaug

SEQ ID NO: 3995399 - RNA, 10 nt, Staphylococcus aureus subsp. aureus Mu50
uauaauuuaa

SEQ ID NO: 3995400 - RNA, 16 nt, Staphylococcus aureus subsp. aureus Mu50
uauaauuuaucuuaau

SEQ ID NO: 3995401 - RNA, 12 nt, Staphylococcus aureus subsp. aureus Mu50
uauaauuuauuu

SEQ ID NO: 3995402 - RNA, 22 nt, Staphylococcus aureus subsp. aureus Mu50
uauaauuuauuuagcaucuuua

SEQ ID NO: 3995403 - RNA, 19 nt, Staphylococcus aureus subsp. aureus Mu50
uauaauuucaguaggacau

SEQ ID NO: 3995404 - RNA, 23 nt, Staphylococcus aureus subsp. aureus Mu50
uauaauuucaguaggacauauaa

SEQ ID NO: 3995405 - RNA, 20 nt, Staphylococcus aureus subsp. aureus Mu50
uauaauuucuguuuacgcca

SEQ ID NO: 3995406 - RNA, 18 nt, Staphylococcus aureus subsp. aureus Mu50
uauaauuucuuaauuagu

SEQ ID NO: 3995407 - RNA, 18 nt, Staphylococcus aureus subsp. aureus Mu50
uauaauuuuaauuauuuu

SEQ ID NO: 3995408 - RNA, 15 nt, Staphylococcus aureus subsp. aureus Mu50
uauaauuuuguuuca

SEQ ID NO: 3995409 - RNA, 18 nt, Staphylococcus aureus subsp. aureus Mu50
uauacaacaguaaucaug

SEQ ID NO: 3995410 - RNA, 17 nt, Staphylococcus aureus subsp. aureus Mu50
uauacaacauguguaug

SEQ ID NO: 3995411 - RNA, 20 nt, Staphylococcus aureus subsp. aureus Mu50
uauacaauuauggauaaaau

SEQ ID NO: 3995412 - RNA, 18 nt, Staphylococcus aureus subsp. aureus Mu50
uauacacuuuuugacaua

SEQ ID NO: 3995413 - RNA, 20 nt, Staphylococcus aureus subsp. aureus Mu50
uauacagguuuaauaaauuu

SEQ ID NO: 3995414 - RNA, 18 nt, Staphylococcus aureus subsp. aureus Mu50
uauacaguuuuacuauaa

SEQ ID NO: 3995415 - RNA, 19 nt, Staphylococcus aureus subsp. aureus Mu50
uauacauaacccuaaaaug

SEQ ID NO: 3995416 - RNA, 17 nt, Staphylococcus aureus subsp. aureus Mu50
uauacauugauaaauuu

SEQ ID NO: 3995417 - RNA, 14 nt, Staphylococcus aureus subsp. aureus Mu50
uauaccaaccaaaa

SEQ ID NO: 3995418 - RNA, 21 nt, Staphylococcus aureus subsp. aureus Mu50
uauaccucuuagcacuuggau

SEQ ID NO: 3995419 - RNA, 20 nt, Staphylococcus aureus subsp. aureus Mu50
uauacgugcuuuaaaguugu

SEQ ID NO: 3995420 - RNA, 15 nt, Staphylococcus aureus subsp. aureus Mu50
uauacguuacuaaac

SEQ ID NO: 3995421 - RNA, 22 nt, Staphylococcus aureus subsp. aureus Mu50
uauacguugauuaacacauucu

SEQ ID NO: 3995422 - RNA, 15 nt, Staphylococcus aureus subsp. aureus Mu50
uauacuaaacuuuuu

SEQ ID NO: 3995423 - RNA, 12 nt, Staphylococcus aureus subsp. aureus Mu50
uauacuaaauug

SEQ ID NO: 3995424 - RNA, 12 nt, Staphylococcus aureus subsp. aureus Mu50
uauacuaaucuu

SEQ ID NO: 3995425 - RNA, 17 nt, Staphylococcus aureus subsp. aureus Mu50
uauacuacuauugauau

SEQ ID NO: 3995426 - RNA, 14 nt, Staphylococcus aureus subsp. aureus Mu50
uauacucauuuucu

SEQ ID NO: 3995427 - RNA, 15 nt, Staphylococcus aureus subsp. aureus Mu50
uauacugaugaaaac

SEQ ID NO: 3995428 - RNA, 22 nt, Staphylococcus aureus subsp. aureus Mu50
uauacuuacugaaacuaaauua

SEQ ID NO: 3995429 - RNA, 16 nt, Staphylococcus aureus subsp. aureus Mu50
uauacuuuuauagaaa

SEQ ID NO: 3995430 - RNA, 20 nt, Staphylococcus aureus subsp. aureus Mu50
uauacuuuuggucuguugaa

SEQ ID NO: 3995431 - RNA, 18 nt, Staphylococcus aureus subsp. aureus Mu50
uauacuuuuuaaaugauu

SEQ ID NO: 3995432 - RNA, 16 nt, Staphylococcus aureus subsp. aureus Mu50
uauagaaaauuaacuc

SEQ ID NO: 3995433 - RNA, 22 nt, Staphylococcus aureus subsp. aureus Mu50
uauagagccaugaaaaggaaaa

SEQ ID NO: 3995434 - RNA, 16 nt, Staphylococcus aureus subsp. aureus Mu50
uauagaggauauuuau

SEQ ID NO: 3995435 - RNA, 16 nt, Staphylococcus aureus subsp. aureus Mu50
uauagauagacuuucu

SEQ ID NO: 3995436 - RNA, 17 nt, Staphylococcus aureus subsp. aureus Mu50
uauagauaggauauuuu

SEQ ID NO: 3995437 - RNA, 13 nt, Staphylococcus aureus subsp. aureus Mu50
uauagauauuagc

SEQ ID NO: 3995438 - RNA, 18 nt, Staphylococcus aureus subsp. aureus Mu50
uauagaugacuguagaaa

SEQ ID NO: 3995439 - RNA, 19 nt, Staphylococcus aureus subsp. aureus Mu50
uauagauggcguaagcagu

SEQ ID NO: 3995440 - RNA, 20 nt, Staphylococcus aureus subsp. aureus Mu50
uauagauucauguaaauagu

SEQ ID NO: 3995441 - RNA, 17 nt, Staphylococcus aureus subsp. aureus Mu50
uauagauuguauuuaau

SEQ ID NO: 3995442 - RNA, 22 nt, Staphylococcus aureus subsp. aureus Mu50
uauagauuuuguauuagcaucu

SEQ ID NO: 3995443 - RNA, 21 nt, Staphylococcus aureus subsp. aureus Mu50
uauagcaaauugauuaaauaa

SEQ ID NO: 3995444 - RNA, 13 nt, Staphylococcus aureus subsp. aureus Mu50
uauagcaccauua

SEQ ID NO: 3995445 - RNA, 18 nt, Staphylococcus aureus subsp. aureus Mu50
uauagcaucuaugauugu

SEQ ID NO: 3995446 - RNA, 21 nt, Staphylococcus aureus subsp. aureus Mu50
uauagccaaaggcaaaaugua

SEQ ID NO: 3995447 - RNA, 23 nt, Staphylococcus aureus subsp. aureus Mu50
uauagcugugauuugaucaaccu

SEQ ID NO: 3995448 - RNA, 16 nt, Staphylococcus aureus subsp. aureus Mu50
uauaguaaaauaaaua

SEQ ID NO: 3995449 - RNA, 14 nt, Staphylococcus aureus subsp. aureus Mu50
uauaguaagaaaag

SEQ ID NO: 3995450 - RNA, 15 nt, Staphylococcus aureus subsp. aureus Mu50
uauaguaauaaaagu

SEQ ID NO: 3995451 - RNA, 17 nt, Staphylococcus aureus subsp. aureus Mu50
uauaguaauagcuauau

SEQ ID NO: 3995452 - RNA, 13 nt, Staphylococcus aureus subsp. aureus Mu50
uauaguaauuguu

SEQ ID NO: 3995453 - RNA, 16 nt, Staphylococcus aureus subsp. aureus Mu50
uauaguaauuguuaua

SEQ ID NO: 3995454 - RNA, 23 nt, Staphylococcus aureus subsp. aureus Mu50
uauaguaggguauugaaauaaua

SEQ ID NO: 3995455 - RNA, 17 nt, Staphylococcus aureus subsp. aureus Mu50
uauagucauuacauuuu

SEQ ID NO: 3995456 - RNA, 13 nt, Staphylococcus aureus subsp. aureus Mu50
uauagucauucau

SEQ ID NO: 3995457 - RNA, 23 nt, Staphylococcus aureus subsp. aureus Mu50
uauaguccuucccacuuaucauc

SEQ ID NO: 3995458 - RNA, 18 nt, Staphylococcus aureus subsp. aureus Mu50
uauagucuaugaauaaug

SEQ ID NO: 3995459 - RNA, 15 nt, Staphylococcus aureus subsp. aureus Mu50
uauagucuuaaacau

SEQ ID NO: 3995460 - RNA, 16 nt, Staphylococcus aureus subsp. aureus Mu50
uauagucuuaaacaua

SEQ ID NO: 3995461 - RNA, 17 nt, Staphylococcus aureus subsp. aureus Mu50
uauagucuuaaacauaa

SEQ ID NO: 3995462 - RNA, 22 nt, Staphylococcus aureus subsp. aureus Mu50
uauagugcuuguuuauuacaua

SEQ ID NO: 3995463 - RNA, 18 nt, Staphylococcus aureus subsp. aureus Mu50
uauaguguuugacaaguu

SEQ ID NO: 3995464 - RNA, 19 nt, Staphylococcus aureus subsp. aureus Mu50
uauaguguuuuauucgaua

SEQ ID NO: 3995465 - RNA, 14 nt, Staphylococcus aureus subsp. aureus Mu50
uauaguucuauugc

SEQ ID NO: 3995466 - RNA, 16 nt, Staphylococcus aureus subsp. aureus Mu50
uauaguugagcguuua

SEQ ID NO: 3995467 - RNA, 20 nt, Staphylococcus aureus subsp. aureus Mu50
uauaguugagcguuuaauua

SEQ ID NO: 3995468 - RNA, 13 nt, Staphylococcus aureus subsp. aureus Mu50
uauaguuuagauu

SEQ ID NO: 3995469 - RNA, 19 nt, Staphylococcus aureus subsp. aureus Mu50
uauauaaaaucauuaauaa

SEQ ID NO: 3995470 - RNA, 18 nt, Staphylococcus aureus subsp. aureus Mu50
uauauaaacaaaaaucua

SEQ ID NO: 3995471 - RNA, 23 nt, Staphylococcus aureus subsp. aureus Mu50
uaucaaaaaauacguuuaaugua

SEQ ID NO: 3995472 - RNA, 20 nt, Staphylococcus aureus subsp. aureus Mu50
uaucaaaaccgcuauaaaau

SEQ ID NO: 3995473 - RNA, 17 nt, Staphylococcus aureus subsp. aureus Mu50
uaucaaaauauaaaauc

SEQ ID NO: 3995474 - RNA, 18 nt, Staphylococcus aureus subsp. aureus Mu50
uaucaaacggaauuaaag

SEQ ID NO: 3995475 - RNA, 14 nt, Staphylococcus aureus subsp. aureus Mu50
uaucaacaauggaa

SEQ ID NO: 3995476 - RNA, 14 nt, Staphylococcus aureus subsp. aureus Mu50
uaucaacauaaaau

SEQ ID NO: 3995477 - RNA, 16 nt, Staphylococcus aureus subsp. aureus Mu50
uaucaacauaauauuu

SEQ ID NO: 3995478 - RNA, 15 nt, Staphylococcus aureus subsp. aureus Mu50
uaucaacauuaauaa

SEQ ID NO: 3995479 - RNA, 20 nt, Staphylococcus aureus subsp. aureus Mu50
uaucaacauuaauaaauaau

SEQ ID NO: 3995480 - RNA, 13 nt, Staphylococcus aureus subsp. aureus Mu50
uaucaagaaaaag

SEQ ID NO: 3995481 - RNA, 16 nt, Staphylococcus aureus subsp. aureus Mu50
uaucaagaaaaaguuu

SEQ ID NO: 3995482 - RNA, 20 nt, Staphylococcus aureus subsp. aureus Mu50
uaucaagaaaaaguuuuucu

SEQ ID NO: 3995483 - RNA, 21 nt, Staphylococcus aureus subsp. aureus Mu50
uaucaagaaaaaguuuuucug

SEQ ID NO: 3995484 - RNA, 16 nt, Staphylococcus aureus subsp. aureus Mu50
uaucaagauguuugca

SEQ ID NO: 3995485 - RNA, 22 nt, Staphylococcus aureus subsp. aureus Mu50
uaucaagauguuugcaacauau

SEQ ID NO: 3995486 - RNA, 23 nt, Staphylococcus aureus subsp. aureus Mu50
uaucaagauguuugcaacauauu

SEQ ID NO: 3995487 - RNA, 12 nt, Staphylococcus aureus subsp. aureus Mu50
uaucaaguuuua

SEQ ID NO: 3995488 - RNA, 11 nt, Staphylococcus aureus subsp. aureus Mu50
uaucaauaaau

SEQ ID NO: 3995489 - RNA, 17 nt, Staphylococcus aureus subsp. aureus Mu50
uaucaauagaugaaaau

SEQ ID NO: 3995490 - RNA, 22 nt, Staphylococcus aureus subsp. aureus Mu50
uaucaauagaugaaaauuuaau

SEQ ID NO: 3995491 - RNA, 19 nt, Staphylococcus aureus subsp. aureus Mu50
uaucaauugaaugaaguaa

SEQ ID NO: 3995492 - RNA, 11 nt, Staphylococcus aureus subsp. aureus Mu50
uaucaauuuau

SEQ ID NO: 3995493 - RNA, 20 nt, Staphylococcus aureus subsp. aureus Mu50
uaucacaacacauaaauuaa

SEQ ID NO: 3995494 - RNA, 20 nt, Staphylococcus aureus subsp. aureus Mu50
uaucacauauuaugauacgc

SEQ ID NO: 3995495 - RNA, 16 nt, Staphylococcus aureus subsp. aureus Mu50
uaucaccuucaaacuu

SEQ ID NO: 3995496 - RNA, 20 nt, Staphylococcus aureus subsp. aureus Mu50
uaucacuauacaaucauaaa

SEQ ID NO: 3995497 - RNA, 15 nt, Staphylococcus aureus subsp. aureus Mu50
uaucacuaucagcuu

SEQ ID NO: 3995498 - RNA, 16 nt, Staphylococcus aureus subsp. aureus Mu50
uaucacugaaugcuaa

SEQ ID NO: 3995499 - RNA, 18 nt, Staphylococcus aureus subsp. aureus Mu50
uaucacuuauuauuuugu

SEQ ID NO: 3995500 - RNA, 17 nt, Staphylococcus aureus subsp. aureus Mu50
uaucacuuuucaugaug

SEQ ID NO: 3995501 - RNA, 18 nt, Staphylococcus aureus subsp. aureus Mu50
uaucagcgaaauuuguaa

SEQ ID NO: 3995502 - RNA, 17 nt, Staphylococcus aureus subsp. aureus Mu50
uaucagcuuuaauaaua

SEQ ID NO: 3995503 - RNA, 14 nt, Staphylococcus aureus subsp. aureus Mu50
uaucagcuuuuuca

SEQ ID NO: 3995504 - RNA, 16 nt, Staphylococcus aureus subsp. aureus Mu50
uaucagcuuuuucauu

SEQ ID NO: 3995505 - RNA, 14 nt, Staphylococcus aureus subsp. aureus Mu50
uaucaguaauaaua

SEQ ID NO: 3995506 - RNA, 15 nt, Staphylococcus aureus subsp. aureus Mu50
uaucaguaauaauac

SEQ ID NO: 3995507 - RNA, 18 nt, Staphylococcus aureus subsp. aureus Mu50
uaucagugugauuuugga

SEQ ID NO: 3995508 - RNA, 18 nt, Staphylococcus aureus subsp. aureus Mu50
uaucaguuauuuuaauaa

SEQ ID NO: 3995509 - RNA, 17 nt, Staphylococcus aureus subsp. aureus Mu50
uaucauaaagauaagau

SEQ ID NO: 3995510 - RNA, 12 nt, Staphylococcus aureus subsp. aureus Mu50
uaucauaaaugc

SEQ ID NO: 3995511 - RNA, 15 nt, Staphylococcus aureus subsp. aureus Mu50
uaucauaauauugau

SEQ ID NO: 3995512 - RNA, 22 nt, Staphylococcus aureus subsp. aureus Mu50
uaucauaauauugaugaauaaa

SEQ ID NO: 3995513 - RNA, 12 nt, Staphylococcus aureus subsp. aureus Mu50
uaucauaaucuu

SEQ ID NO: 3995514 - RNA, 22 nt, Staphylococcus aureus subsp. aureus Mu50
uaucauauaaugguugaauaac

SEQ ID NO: 3995515 - RNA, 16 nt, Staphylococcus aureus subsp. aureus Mu50
uaucauaugaacaaua

SEQ ID NO: 3995516 - RNA, 15 nt, Staphylococcus aureus subsp. aureus Mu50
uaucauauucaaaau

SEQ ID NO: 3995517 - RNA, 21 nt, Staphylococcus aureus subsp. aureus Mu50
uaucaucaacaaucuuuuuca

SEQ ID NO: 3995518 - RNA, 12 nt, Staphylococcus aureus subsp. aureus Mu50
uaucaucuauuc

SEQ ID NO: 3995519 - RNA, 21 nt, Staphylococcus aureus subsp. aureus Mu50
uaucaugauagccgcuucauu

SEQ ID NO: 3995520 - RNA, 23 nt, Staphylococcus aureus subsp. aureus Mu50
uaucaugcaaaacuaaucaaauu

SEQ ID NO: 3995521 - RNA, 15 nt, Staphylococcus aureus subsp. aureus Mu50
uaucaugcaaaauaa

SEQ ID NO: 3995522 - RNA, 20 nt, Staphylococcus aureus subsp. aureus Mu50
uaucaugcccucuauuagau

SEQ ID NO: 3995523 - RNA, 14 nt, Staphylococcus aureus subsp. aureus Mu50
uaucaugcuuuuaa

SEQ ID NO: 3995524 - RNA, 21 nt, Staphylococcus aureus subsp. aureus Mu50
uaucaugggcaguaauuuuca

SEQ ID NO: 3995525 - RNA, 15 nt, Staphylococcus aureus subsp. aureus Mu50
uaucauguucuuaua

SEQ ID NO: 3995526 - RNA, 17 nt, Staphylococcus aureus subsp. aureus Mu50
uaucauguucuuauaaa

SEQ ID NO: 3995527 - RNA, 19 nt, Staphylococcus aureus subsp. aureus Mu50
uaucauuaaauugcuugaa

SEQ ID NO: 3995528 - RNA, 17 nt, Staphylococcus aureus subsp. aureus Mu50
uaucauuauuugauaaa

SEQ ID NO: 3995529 - RNA, 23 nt, Staphylococcus aureus subsp. aureus Mu50
uaucauucuguguaaauauaaau

SEQ ID NO: 3995530 - RNA, 18 nt, Staphylococcus aureus subsp. aureus Mu50
uaucauuguucauacgcu

SEQ ID NO: 3995531 - RNA, 23 nt, Staphylococcus aureus subsp. aureus Mu50
uaucauuuggcguucaacauuac

SEQ ID NO: 3995532 - RNA, 21 nt, Staphylococcus aureus subsp. aureus Mu50
uauccaaaauccugaaauuaa

SEQ ID NO: 3995533 - RNA, 19 nt, Staphylococcus aureus subsp. aureus Mu50
uauccaaggauguuauaaa

SEQ ID NO: 3995534 - RNA, 20 nt, Staphylococcus aureus subsp. aureus Mu50
uauccaaggauguuauaaaa

SEQ ID NO: 3995535 - RNA, 16 nt, Staphylococcus aureus subsp. aureus Mu50
uauccaauguauaaaa

SEQ ID NO: 3995536 - RNA, 14 nt, Staphylococcus aureus subsp. aureus Mu50
uauccauaacugua

SEQ ID NO: 3995537 - RNA, 14 nt, Staphylococcus aureus subsp. aureus Mu50
uauccauuaugaug

SEQ ID NO: 3995538 - RNA, 20 nt, Staphylococcus aureus subsp. aureus Mu50
uauccauuaugauguagaug

SEQ ID NO: 3995539 - RNA, 21 nt, Staphylococcus aureus subsp. aureus Mu50
uauccgaaaauugcuaaaaaa

SEQ ID NO: 3995540 - RNA, 19 nt, Staphylococcus aureus subsp. aureus Mu50
uauccuaagcauaauucaa

SEQ ID NO: 3995541 - RNA, 18 nt, Staphylococcus aureus subsp. aureus Mu50
uauccucgguauuuaaug

SEQ ID NO: 3995542 - RNA, 17 nt, Staphylococcus aureus subsp. aureus Mu50
uauccugauuuaauguu

SEQ ID NO: 3995543 - RNA, 16 nt, Staphylococcus aureus subsp. aureus Mu50
uauccuguguaaaaua

SEQ ID NO: 3995544 - RNA, 20 nt, Staphylococcus aureus subsp. aureus Mu50
uauccuguuucauaugguga

SEQ ID NO: 3995545 - RNA, 13 nt, Staphylococcus aureus subsp. aureus Mu50
uauccuucaaaga

SEQ ID NO: 3995546 - RNA, 18 nt, Staphylococcus aureus subsp. aureus Mu50
uauccuucaaagauuuua

SEQ ID NO: 3995547 - RNA, 15 nt, Staphylococcus aureus subsp. aureus Mu50
uauccuuuuugacuc

SEQ ID NO: 3995548 - RNA, 16 nt, Staphylococcus aureus subsp. aureus Mu50
uaucgacuuugucauu

SEQ ID NO: 3995549 - RNA, 13 nt, Staphylococcus aureus subsp. aureus Mu50
uaucgauaaaugu

SEQ ID NO: 3995550 - RNA, 19 nt, Staphylococcus aureus subsp. aureus Mu50
uaucgauauagcauaaaau

SEQ ID NO: 3995551 - RNA, 14 nt, Staphylococcus aureus subsp. aureus Mu50
uaucgauuaucuga

SEQ ID NO: 3995552 - RNA, 17 nt, Staphylococcus aureus subsp. aureus Mu50
uaucgauucgauuauuu

SEQ ID NO: 3995553 - RNA, 20 nt, Staphylococcus aureus subsp. aureus Mu50
uaucgauuuaacauaaaaau

SEQ ID NO: 3995554 - RNA, 18 nt, Staphylococcus aureus subsp. aureus Mu50
uaucgauuuuaucgaaau

SEQ ID NO: 3995555 - RNA, 23 nt, Staphylococcus aureus subsp. aureus Mu50
uaucgauuuuggcacauaaauca

SEQ ID NO: 3995556 - RNA, 18 nt, Staphylococcus aureus subsp. aureus Mu50
uaucgccuaaaaauaaaa

SEQ ID NO: 3995557 - RNA, 19 nt, Staphylococcus aureus subsp. aureus Mu50
uaucgccuaaaaauaaaau

SEQ ID NO: 3995558 - RNA, 16 nt, Staphylococcus aureus subsp. aureus Mu50
uaugacguaauuaaua

SEQ ID NO: 3995559 - RNA, 22 nt, Staphylococcus aureus subsp. aureus Mu50
uaugacuaacgaaaaagauggu

SEQ ID NO: 3995560 - RNA, 18 nt, Staphylococcus aureus subsp. aureus Mu50
uaugacugcuuuuuauua

SEQ ID NO: 3995561 - RNA, 18 nt, Staphylococcus aureus subsp. aureus Mu50
uaugacuuauuuuucauc

SEQ ID NO: 3995562 - RNA, 15 nt, Staphylococcus aureus subsp. aureus Mu50
uaugacuuuuuauua

SEQ ID NO: 3995563 - RNA, 18 nt, Staphylococcus aureus subsp. aureus Mu50
uaugacuuuuuauuagua

SEQ ID NO: 3995564 - RNA, 17 nt, Staphylococcus aureus subsp. aureus Mu50
uaugagcuuaauaaauu

SEQ ID NO: 3995565 - RNA, 15 nt, Staphylococcus aureus subsp. aureus Mu50
uaugagugauagaaa

SEQ ID NO: 3995566 - RNA, 16 nt, Staphylococcus aureus subsp. aureus Mu50
uaugagugauagaaag

SEQ ID NO: 3995567 - RNA, 16 nt, Staphylococcus aureus subsp. aureus Mu50
uaugauaaccauuaug

SEQ ID NO: 3995568 - RNA, 22 nt, Staphylococcus aureus subsp. aureus Mu50
uaugauaaccauuaugauuaau

SEQ ID NO: 3995569 - RNA, 15 nt, Staphylococcus aureus subsp. aureus Mu50
uaugauaauaagaau

SEQ ID NO: 3995570 - RNA, 16 nt, Staphylococcus aureus subsp. aureus Mu50
uaugauaauuaauuaa

SEQ ID NO: 3995571 - RNA, 19 nt, Staphylococcus aureus subsp. aureus Mu50
uaugauaauuaauuaaaau

SEQ ID NO: 3995572 - RNA, 19 nt, Staphylococcus aureus subsp. aureus Mu50
uaugauacgcuuuuuaaaa

SEQ ID NO: 3995573 - RNA, 22 nt, Staphylococcus aureus subsp. aureus Mu50
uaugauacgcuuuuuaaaaaau

SEQ ID NO: 3995574 - RNA, 23 nt, Staphylococcus aureus subsp. aureus Mu50
uaugauacugauauuuagaauaa

SEQ ID NO: 3995575 - RNA, 18 nt, Staphylococcus aureus subsp. aureus Mu50
uaugauagaauacuaaaa

SEQ ID NO: 3995576 - RNA, 23 nt, Staphylococcus aureus subsp. aureus Mu50
uaugauagaauacuaaaaguguu

SEQ ID NO: 3995577 - RNA, 19 nt, Staphylococcus aureus subsp. aureus Mu50
uaugauauauguaacauaa

SEQ ID NO: 3995578 - RNA, 10 nt, Staphylococcus aureus subsp. aureus Mu50
uaugauauug

SEQ ID NO: 3995579 - RNA, 14 nt, Staphylococcus aureus subsp. aureus Mu50
uaugauauugauug

SEQ ID NO: 3995580 - RNA, 23 nt, Staphylococcus aureus subsp. aureus Mu50
uaugauccuuuaaugcuuuagca

SEQ ID NO: 3995581 - RNA, 22 nt, Staphylococcus aureus subsp. aureus Mu50
uaugaugaacuuaaugcuucaa

SEQ ID NO: 3995582 - RNA, 21 nt, Staphylococcus aureus subsp. aureus Mu50
uaugaugaauuguuguacaug

SEQ ID NO: 3995583 - RNA, 14 nt, Staphylococcus aureus subsp. aureus Mu50
uaugaugcuucuaa

SEQ ID NO: 3995584 - RNA, 16 nt, Staphylococcus aureus subsp. aureus Mu50
uaugaugggaaaaaau

SEQ ID NO: 3995585 - RNA, 17 nt, Staphylococcus aureus subsp. aureus Mu50
uaugaugucauguauug

SEQ ID NO: 3995586 - RNA, 22 nt, Staphylococcus aureus subsp. aureus Mu50
uaugaugucauguauuguccau

SEQ ID NO: 3995587 - RNA, 17 nt, Staphylococcus aureus subsp. aureus Mu50
uaugauguuaaaaaaua

SEQ ID NO: 3995588 - RNA, 12 nt, Staphylococcus aureus subsp. aureus Mu50
uaugauguucaa

SEQ ID NO: 3995589 - RNA, 23 nt, Staphylococcus aureus subsp. aureus Mu50
uaugauucuaacggcguuuguuu

SEQ ID NO: 3995590 - RNA, 22 nt, Staphylococcus aureus subsp. aureus Mu50
uaugauugcaaauuaucauuaa

SEQ ID NO: 3995591 - RNA, 19 nt, Staphylococcus aureus subsp. aureus Mu50
uaugauugcuuauuuauuu

SEQ ID NO: 3995592 - RNA, 18 nt, Staphylococcus aureus subsp. aureus Mu50
uaugauuguuuaagaaug

SEQ ID NO: 3995593 - RNA, 17 nt, Staphylococcus aureus subsp. aureus Mu50
uaugauuuaaaauauaa

SEQ ID NO: 3995594 - RNA, 23 nt, Staphylococcus aureus subsp. aureus Mu50
uaugauuugccccgccauucaua

SEQ ID NO: 3995595 - RNA, 21 nt, Staphylococcus aureus subsp. aureus Mu50
uaugauuuucuuuaauaacua

SEQ ID NO: 3995596 - RNA, 13 nt, Staphylococcus aureus subsp. aureus Mu50
uaugcaaaugaaa

SEQ ID NO: 3995597 - RNA, 16 nt, Staphylococcus aureus subsp. aureus Mu50
uaugcacaucauugau

SEQ ID NO: 3995598 - RNA, 22 nt, Staphylococcus aureus subsp. aureus Mu50
uaugcauacacuugauuaucau

SEQ ID NO: 3995599 - RNA, 16 nt, Staphylococcus aureus subsp. aureus Mu50
uaugcauagcucuugc

SEQ ID NO: 3995600 - RNA, 19 nt, Staphylococcus aureus subsp. aureus Mu50
uaugcaucaguuaauaauu

SEQ ID NO: 3995601 - RNA, 15 nt, Staphylococcus aureus subsp. aureus Mu50
uaugccauucauuaa

SEQ ID NO: 3995602 - RNA, 22 nt, Staphylococcus aureus subsp. aureus Mu50
uaugccgauugcucuaauccaa

SEQ ID NO: 3995603 - RNA, 17 nt, Staphylococcus aureus subsp. aureus Mu50
uaugccgccuaauaaua

SEQ ID NO: 3995604 - RNA, 17 nt, Staphylococcus aureus subsp. aureus Mu50
uaugcuaaacuugcauc

SEQ ID NO: 3995605 - RNA, 17 nt, Staphylococcus aureus subsp. aureus Mu50
uaugcuagaaaguaaug

SEQ ID NO: 3995606 - RNA, 16 nt, Staphylococcus aureus subsp. aureus Mu50
uaugcuauauuuaguu

SEQ ID NO: 3995607 - RNA, 21 nt, Staphylococcus aureus subsp. aureus Mu50
uaugcucuacaaaguuauaau

SEQ ID NO: 3995608 - RNA, 19 nt, Staphylococcus aureus subsp. aureus Mu50
uaugcugcaagucucauau

SEQ ID NO: 3995609 - RNA, 22 nt, Staphylococcus aureus subsp. aureus Mu50
uaugcugucaaacaacaaucaa

SEQ ID NO: 3995610 - RNA, 15 nt, Staphylococcus aureus subsp. aureus Mu50
uaugcuguguaucau

SEQ ID NO: 3995611 - RNA, 17 nt, Staphylococcus aureus subsp. aureus Mu50
uaugcuguguaucauca

SEQ ID NO: 3995612 - RNA, 21 nt, Staphylococcus aureus subsp. aureus Mu50
uaugcuguguaucaucauaau

SEQ ID NO: 3995613 - RNA, 19 nt, Staphylococcus aureus subsp. aureus Mu50
uaugcuguuggcaaaacaa

SEQ ID NO: 3995614 - RNA, 14 nt, Staphylococcus aureus subsp. aureus Mu50
uaugcuuuaaaucg

SEQ ID NO: 3995615 - RNA, 16 nt, Staphylococcus aureus subsp. aureus Mu50
uaugcuuuuaauagug

SEQ ID NO: 3995616 - RNA, 20 nt, Staphylococcus aureus subsp. aureus Mu50
uauggaaaauguauuauucu

SEQ ID NO: 3995617 - RNA, 21 nt, Staphylococcus aureus subsp. aureus Mu50
uauggaaaauguuaucaauau

SEQ ID NO: 3995618 - RNA, 14 nt, Staphylococcus aureus subsp. aureus Mu50
uauggaaauggugg

SEQ ID NO: 3995619 - RNA, 20 nt, Staphylococcus aureus subsp. aureus Mu50
uauggagcuacccuauuuua

SEQ ID NO: 3995620 - RNA, 13 nt, Staphylococcus aureus subsp. aureus Mu50
uauggauaaaauu

SEQ ID NO: 3995621 - RNA, 16 nt, Staphylococcus aureus subsp. aureus Mu50
uauggauguauuucug

SEQ ID NO: 3995622 - RNA, 21 nt, Staphylococcus aureus subsp. aureus Mu50
uauggcgcaauuuuuaacaaa

SEQ ID NO: 3995623 - RNA, 23 nt, Staphylococcus aureus subsp. aureus Mu50
uauggcgcaauuuuuaacaaaau

SEQ ID NO: 3995624 - RNA, 14 nt, Staphylococcus aureus subsp. aureus Mu50
uauggcgguuugaa

SEQ ID NO: 3995625 - RNA, 16 nt, Staphylococcus aureus subsp. aureus Mu50
uaugguaaaacccagu

SEQ ID NO: 3995626 - RNA, 19 nt, Staphylococcus aureus subsp. aureus Mu50
uaugguauuuauagauuua

SEQ ID NO: 3995627 - RNA, 16 nt, Staphylococcus aureus subsp. aureus Mu50
uaugguguggugugau

SEQ ID NO: 3995628 - RNA, 15 nt, Staphylococcus aureus subsp. aureus Mu50
uaugguucguccauu

SEQ ID NO: 3995629 - RNA, 16 nt, Staphylococcus aureus subsp. aureus Mu50
uaugguuguuuuccaa

SEQ ID NO: 3995630 - RNA, 19 nt, Staphylococcus aureus subsp. aureus Mu50
uaugguuuaccuaguuuua

SEQ ID NO: 3995631 - RNA, 21 nt, Staphylococcus aureus subsp. aureus Mu50
uaugguuuaccuaguuuuacu

SEQ ID NO: 3995632 - RNA, 13 nt, Staphylococcus aureus subsp. aureus Mu50
uauguaaauaaca

SEQ ID NO: 3995633 - RNA, 23 nt, Staphylococcus aureus subsp. aureus Mu50
uauguaacaauuuagcaaauauu

SEQ ID NO: 3995634 - RNA, 23 nt, Staphylococcus aureus subsp. aureus Mu50
uauguaacauaaagcuguuuauu

SEQ ID NO: 3995635 - RNA, 20 nt, Staphylococcus aureus subsp. aureus Mu50
uauguagcaggcaacuuuua

SEQ ID NO: 3995636 - RNA, 22 nt, Staphylococcus aureus subsp. aureus Mu50
uaugucaauagcgguuuaaaaa

SEQ ID NO: 3995637 - RNA, 17 nt, Staphylococcus aureus subsp. aureus Mu50
uaugucauauacuauau

SEQ ID NO: 3995638 - RNA, 18 nt, Staphylococcus aureus subsp. aureus Mu50
uaugucaucuucaauucu

SEQ ID NO: 3995639 - RNA, 22 nt, Staphylococcus aureus subsp. aureus Mu50
uaugucauucuaguagcuagaa

SEQ ID NO: 3995640 - RNA, 21 nt, Staphylococcus aureus subsp. aureus Mu50
uaugucccaaugcugaauaaa

SEQ ID NO: 3995641 - RNA, 22 nt, Staphylococcus aureus subsp. aureus Mu50
uaugucucggggcagaucauaa

SEQ ID NO: 3995642 - RNA, 14 nt, Staphylococcus aureus subsp. aureus Mu50
uaugugauuaauuu

SEQ ID NO: 3995643 - RNA, 17 nt, Staphylococcus aureus subsp. aureus Mu50
uaugugauuaauuucau

SEQ ID NO: 3995644 - RNA, 21 nt, Staphylococcus aureus subsp. aureus Mu50
uaugugcagcuugaucuaaau

SEQ ID NO: 3995645 - RNA, 22 nt, Staphylococcus aureus subsp. aureus Mu50
uauuauaacccucguaggcaua

SEQ ID NO: 3995646 - RNA, 23 nt, Staphylococcus aureus subsp. aureus Mu50
uauuauaaguugcauauaaaaac

SEQ ID NO: 3995647 - RNA, 18 nt, Staphylococcus aureus subsp. aureus Mu50
uauuauaauaaauagacu

SEQ ID NO: 3995648 - RNA, 14 nt, Staphylococcus aureus subsp. aureus Mu50
uauuauaauuuugu

SEQ ID NO: 3995649 - RNA, 18 nt, Staphylococcus aureus subsp. aureus Mu50
uauuauagggcuguuuuu

SEQ ID NO: 3995650 - RNA, 15 nt, Staphylococcus aureus subsp. aureus Mu50
uauuauaguuuagau

SEQ ID NO: 3995651 - RNA, 14 nt, Staphylococcus aureus subsp. aureus Mu50
uauuauauauauuc

SEQ ID NO: 3995652 - RNA, 17 nt, Staphylococcus aureus subsp. aureus Mu50
uauuauauugaauugaa

SEQ ID NO: 3995653 - RNA, 21 nt, Staphylococcus aureus subsp. aureus Mu50
uauuauauuuugaaucaguau

SEQ ID NO: 3995654 - RNA, 19 nt, Staphylococcus aureus subsp. aureus Mu50
uauuaucaaagaaauguau

SEQ ID NO: 3995655 - RNA, 12 nt, Staphylococcus aureus subsp. aureus Mu50
uauuaucauuaa

SEQ ID NO: 3995656 - RNA, 14 nt, Staphylococcus aureus subsp. aureus Mu50
uauuaucauugaua

SEQ ID NO: 3995657 - RNA, 18 nt, Staphylococcus aureus subsp. aureus Mu50
uauuauccucaaauauau

SEQ ID NO: 3995658 - RNA, 21 nt, Staphylococcus aureus subsp. aureus Mu50
uauuaucgaagaaacauuaua

SEQ ID NO: 3995659 - RNA, 20 nt, Staphylococcus aureus subsp. aureus Mu50
uauuaucuauccauuugguu

SEQ ID NO: 3995660 - RNA, 14 nt, Staphylococcus aureus subsp. aureus Mu50
uauuaucuuuaauu

SEQ ID NO: 3995661 - RNA, 21 nt, Staphylococcus aureus subsp. aureus Mu50
uauuaucuuuaauuuacaauu

SEQ ID NO: 3995662 - RNA, 17 nt, Staphylococcus aureus subsp. aureus Mu50
uauuaugaauuauuaau

SEQ ID NO: 3995663 - RNA, 18 nt, Staphylococcus aureus subsp. aureus Mu50
uauuaugauugcuuauuu

SEQ ID NO: 3995664 - RNA, 16 nt, Staphylococcus aureus subsp. aureus Mu50
uauuauguguauauua

SEQ ID NO: 3995665 - RNA, 14 nt, Staphylococcus aureus subsp. aureus Mu50
uauuauguuauaaa

SEQ ID NO: 3995666 - RNA, 15 nt, Staphylococcus aureus subsp. aureus Mu50
uauuauguuauaaau

SEQ ID NO: 3995667 - RNA, 23 nt, Staphylococcus aureus subsp. aureus Mu50
uauuauguuauaaauucuaucua

SEQ ID NO: 3995668 - RNA, 22 nt, Staphylococcus aureus subsp. aureus Mu50
uauuauuacaaugaaaaaacga

SEQ ID NO: 3995669 - RNA, 19 nt, Staphylococcus aureus subsp. aureus Mu50
uauuauuauaauuuuguuu

SEQ ID NO: 3995670 - RNA, 15 nt, Staphylococcus aureus subsp. aureus Mu50
uauuauuauugaaau

SEQ ID NO: 3995671 - RNA, 14 nt, Staphylococcus aureus subsp. aureus Mu50
uauuauucauaaua

SEQ ID NO: 3995672 - RNA, 18 nt, Staphylococcus aureus subsp. aureus Mu50
uauuauuccauugaugua

SEQ ID NO: 3995673 - RNA, 21 nt, Staphylococcus aureus subsp. aureus Mu50
uauuauugaaacuaauaauuu

SEQ ID NO: 3995674 - RNA, 12 nt, Staphylococcus aureus subsp. aureus Mu50
uauuauugaaau

SEQ ID NO: 3995675 - RNA, 22 nt, Staphylococcus aureus subsp. aureus Mu50
uauuauugaaaucgauacuaau

SEQ ID NO: 3995676 - RNA, 17 nt, Staphylococcus aureus subsp. aureus Mu50
uauuauuggauuugaag

SEQ ID NO: 3995677 - RNA, 13 nt, Staphylococcus aureus subsp. aureus Mu50
uauuauugucauc

SEQ ID NO: 3995678 - RNA, 19 nt, Staphylococcus aureus subsp. aureus Mu50
uauuauuuaaauuuucauc

SEQ ID NO: 3995679 - RNA, 14 nt, Staphylococcus aureus subsp. aureus Mu50
uauuauuucauuag

SEQ ID NO: 3995680 - RNA, 18 nt, Staphylococcus aureus subsp. aureus Mu50
uauuauuuuaauagcauu

SEQ ID NO: 3995681 - RNA, 18 nt, Staphylococcus aureus subsp. aureus Mu50
uauuauuuugcuuuaauu

SEQ ID NO: 3995682 - RNA, 20 nt, Staphylococcus aureus subsp. aureus Mu50
uauuauuuuguauuuuucaa

SEQ ID NO: 3995683 - RNA, 14 nt, Staphylococcus aureus subsp. aureus Mu50
uauuauuuuuuucu

SEQ ID NO: 3995684 - RNA, 15 nt, Staphylococcus aureus subsp. aureus Mu50
uauucaaaaagguau

SEQ ID NO: 3995685 - RNA, 12 nt, Staphylococcus aureus subsp. aureus Mu50
uauucaaaauaa

SEQ ID NO: 3995686 - RNA, 21 nt, Staphylococcus aureus subsp. aureus Mu50
uauucaaacaguccuuauuau

SEQ ID NO: 3995687 - RNA, 16 nt, Staphylococcus aureus subsp. aureus Mu50
uauucaaaguuuucau

SEQ ID NO: 3995688 - RNA, 17 nt, Staphylococcus aureus subsp. aureus Mu50
uauucaaaguuuucauu

SEQ ID NO: 3995689 - RNA, 18 nt, Staphylococcus aureus subsp. aureus Mu50
uauucaaauaaacacauc

SEQ ID NO: 3995690 - RNA, 14 nt, Staphylococcus aureus subsp. aureus Mu50
uauucaaaucauaa

SEQ ID NO: 3995691 - RNA, 21 nt, Staphylococcus aureus subsp. aureus Mu50
uauucaacagggguaaaacuu

SEQ ID NO: 3995692 - RNA, 23 nt, Staphylococcus aureus subsp. aureus Mu50
uauucaacuaauuuaaagcauca

SEQ ID NO: 3995693 - RNA, 14 nt, Staphylococcus aureus subsp. aureus Mu50
uauucaauaauuau

SEQ ID NO: 3995694 - RNA, 15 nt, Staphylococcus aureus subsp. aureus Mu50
uauucaauaauucau

SEQ ID NO: 3995695 - RNA, 10 nt, Staphylococcus aureus subsp. aureus Mu50
uauucaauug

SEQ ID NO: 3995696 - RNA, 14 nt, Staphylococcus aureus subsp. aureus Mu50
uauucaauuguaaa

SEQ ID NO: 3995697 - RNA, 15 nt, Staphylococcus aureus subsp. aureus Mu50
uauucaauuguaaau

SEQ ID NO: 3995698 - RNA, 20 nt, Staphylococcus aureus subsp. aureus Mu50
uauucacgauauaacauuaa

SEQ ID NO: 3995699 - RNA, 24 nt, Staphylococcus aureus subsp. aureus Mu50
uauucagcauugggacauaaaauu

SEQ ID NO: 3995700 - RNA, 17 nt, Staphylococcus aureus subsp. aureus Mu50
uauucauaauauauuaa

SEQ ID NO: 3995701 - RNA, 21 nt, Staphylococcus aureus subsp. aureus Mu50
uauucauaauaucgaugacuu

SEQ ID NO: 3995702 - RNA, 23 nt, Staphylococcus aureus subsp. aureus Mu50
uauucauagaccuaugaauuuag

SEQ ID NO: 3995703 - RNA, 15 nt, Staphylococcus aureus subsp. aureus Mu50
uauucauaucauuag

SEQ ID NO: 3995704 - RNA, 15 nt, Staphylococcus aureus subsp. aureus Mu50
uauucaucucuuaua

SEQ ID NO: 3995705 - RNA, 18 nt, Staphylococcus aureus subsp. aureus Mu50
uauucauuccuaagaaug

SEQ ID NO: 3995706 - RNA, 15 nt, Staphylococcus aureus subsp. aureus Mu50
uauucccaaaaugau

SEQ ID NO: 3995707 - RNA, 15 nt, Staphylococcus aureus subsp. aureus Mu50
uauuccuaauaaaua

SEQ ID NO: 3995708 - RNA, 17 nt, Staphylococcus aureus subsp. aureus Mu50
uauuccuaauaaauauc

SEQ ID NO: 3995709 - RNA, 14 nt, Staphylococcus aureus subsp. aureus Mu50
uauucgauaauaua

SEQ ID NO: 3995710 - RNA, 18 nt, Staphylococcus aureus subsp. aureus Mu50
uauucgcuuaaaaacgcu

SEQ ID NO: 3995711 - RNA, 18 nt, Staphylococcus aureus subsp. aureus Mu50
uauucgguuaauauucuu

SEQ ID NO: 3995712 - RNA, 21 nt, Staphylococcus aureus subsp. aureus Mu50
uauucguaucuaguguucuca

SEQ ID NO: 3995713 - RNA, 20 nt, Staphylococcus aureus subsp. aureus Mu50
uauucguuaacaaucaguaa

SEQ ID NO: 3995714 - RNA, 22 nt, Staphylococcus aureus subsp. aureus Mu50
uauucuaaaaaauuaaaaauuu

SEQ ID NO: 3995715 - RNA, 15 nt, Staphylococcus aureus subsp. aureus Mu50
uauucuaaauauauu

SEQ ID NO: 3995716 - RNA, 19 nt, Staphylococcus aureus subsp. aureus Mu50
uauucuaaauauauuuuau

SEQ ID NO: 3995717 - RNA, 14 nt, Staphylococcus aureus subsp. aureus Mu50
uauucuaaguuaaa

SEQ ID NO: 3995718 - RNA, 15 nt, Staphylococcus aureus subsp. aureus Mu50
uauucuaaucuaaau

SEQ ID NO: 3995719 - RNA, 16 nt, Staphylococcus aureus subsp. aureus Mu50
uauucuauuuuucaau

SEQ ID NO: 3995720 - RNA, 21 nt, Staphylococcus aureus subsp. aureus Mu50
uauucuauuuuucaauucgcu

SEQ ID NO: 3995721 - RNA, 16 nt, Staphylococcus aureus subsp. aureus Mu50
uauucucagucucuuu

SEQ ID NO: 3995722 - RNA, 21 nt, Staphylococcus aureus subsp. aureus Mu50
uauucugagauugagaauuca

SEQ ID NO: 3995723 - RNA, 10 nt, Staphylococcus aureus subsp. aureus Mu50
uauucuguaa

SEQ ID NO: 3995724 - RNA, 19 nt, Staphylococcus aureus subsp. aureus Mu50
uauucuuaucauucauuac

SEQ ID NO: 3995725 - RNA, 11 nt, Staphylococcus aureus subsp. aureus Mu50
uauucuuccca

SEQ ID NO: 3995726 - RNA, 17 nt, Staphylococcus aureus subsp. aureus Mu50
uauucuucccaaaaauu

SEQ ID NO: 3995727 - RNA, 20 nt, Staphylococcus aureus subsp. aureus Mu50
uauucuuggcguauuuuuug

SEQ ID NO: 3995728 - RNA, 19 nt, Staphylococcus aureus subsp. aureus Mu50
uauucuuucguuuucauca

SEQ ID NO: 3995729 - RNA, 13 nt, Staphylococcus aureus subsp. aureus Mu50
uauucuuucucua

SEQ ID NO: 3995730 - RNA, 15 nt, Staphylococcus aureus subsp. aureus Mu50
uauucuuucucuauu

SEQ ID NO: 3995731 - RNA, 12 nt, Staphylococcus aureus subsp. aureus Mu50
uauucuuugauu

SEQ ID NO: 3995732 - RNA, 15 nt, Staphylococcus aureus subsp. aureus Mu50
uauugaaaagauaaa

SEQ ID NO: 3995733 - RNA, 12 nt, Staphylococcus aureus subsp. aureus Mu50
uauuuauaauuu

SEQ ID NO: 3995734 - RNA, 20 nt, Staphylococcus aureus subsp. aureus Mu50
uauuuauacagugaaucuaa

SEQ ID NO: 3995735 - RNA, 12 nt, Staphylococcus aureus subsp. aureus Mu50
uauuuauauuaa

SEQ ID NO: 3995736 - RNA, 14 nt, Staphylococcus aureus subsp. aureus Mu50
uauuuauauuaaau

SEQ ID NO: 3995737 - RNA, 17 nt, Staphylococcus aureus subsp. aureus Mu50
uauuuauauuaaauacu

SEQ ID NO: 3995738 - RNA, 13 nt, Staphylococcus aureus subsp. aureus Mu50
uauuuaucaauaa

SEQ ID NO: 3995739 - RNA, 16 nt, Staphylococcus aureus subsp. aureus Mu50
uauuuaucaauaaauc

SEQ ID NO: 3995740 - RNA, 15 nt, Staphylococcus aureus subsp. aureus Mu50
uauuuaucauacuuc

SEQ ID NO: 3995741 - RNA, 21 nt, Staphylococcus aureus subsp. aureus Mu50
uauuuauguucgauuauucuu

SEQ ID NO: 3995742 - RNA, 15 nt, Staphylococcus aureus subsp. aureus Mu50
uauuuauguuuucua

SEQ ID NO: 3995743 - RNA, 11 nt, Staphylococcus aureus subsp. aureus Mu50
uauuuauucag

SEQ ID NO: 3995744 - RNA, 23 nt, Staphylococcus aureus subsp. aureus Mu50
uauuuauucauaacguguuugcu

SEQ ID NO: 3995745 - RNA, 14 nt, Staphylococcus aureus subsp. aureus Mu50
uauuuauucauuau

SEQ ID NO: 3995746 - RNA, 15 nt, Staphylococcus aureus subsp. aureus Mu50
uauuuauucauuaua

SEQ ID NO: 3995747 - RNA, 22 nt, Staphylococcus aureus subsp. aureus Mu50
uauuuauucgcuuguucaguaa

SEQ ID NO: 3995748 - RNA, 17 nt, Staphylococcus aureus subsp. aureus Mu50
uauuuauucuaaucuaa

SEQ ID NO: 3995749 - RNA, 19 nt, Staphylococcus aureus subsp. aureus Mu50
uauuuauucuaaucuaaau

SEQ ID NO: 3995750 - RNA, 18 nt, Staphylococcus aureus subsp. aureus Mu50
uauuuauugagauagaaa

SEQ ID NO: 3995751 - RNA, 19 nt, Staphylococcus aureus subsp. aureus Mu50
uauuuauugagauagaaau

SEQ ID NO: 3995752 - RNA, 14 nt, Staphylococcus aureus subsp. aureus Mu50
uauuuauuguuuuu

SEQ ID NO: 3995753 - RNA, 12 nt, Staphylococcus aureus subsp. aureus Mu50
uauuuauuuaau

SEQ ID NO: 3995754 - RNA, 15 nt, Staphylococcus aureus subsp. aureus Mu50
uauuuauuuguacau

SEQ ID NO: 3995755 - RNA, 13 nt, Staphylococcus aureus subsp. aureus Mu50
uauuuauuuuaau

SEQ ID NO: 3995756 - RNA, 17 nt, Staphylococcus aureus subsp. aureus Mu50
uauuuauuuuaauagug

SEQ ID NO: 3995757 - RNA, 18 nt, Staphylococcus aureus subsp. aureus Mu50
uauuuauuuuaauagugu

SEQ ID NO: 3995758 - RNA, 13 nt, Staphylococcus aureus subsp. aureus Mu50
uauuuauuuugau

SEQ ID NO: 3995759 - RNA, 16 nt, Staphylococcus aureus subsp. aureus Mu50
uauuuauuuugauuaa

SEQ ID NO: 3995760 - RNA, 15 nt, Staphylococcus aureus subsp. aureus Mu50
uauuucaacaaacau

SEQ ID NO: 3995761 - RNA, 17 nt, Staphylococcus aureus subsp. aureus Mu50
uauuucaacaaacauaa

SEQ ID NO: 3995762 - RNA, 21 nt, Staphylococcus aureus subsp. aureus Mu50
uauuucaacaaacauaaauaa

SEQ ID NO: 3995763 - RNA, 19 nt, Staphylococcus aureus subsp. aureus Mu50
uauuucaacuuuuuaauaa

SEQ ID NO: 3995764 - RNA, 21 nt, Staphylococcus aureus subsp. aureus Mu50
uauuucaacuuuuuaauaaua

SEQ ID NO: 3995765 - RNA, 14 nt, Staphylococcus aureus subsp. aureus Mu50
uauuucaauaauaa

SEQ ID NO: 3995766 - RNA, 20 nt, Staphylococcus aureus subsp. aureus Mu50
uauuucacacagcuucauua

SEQ ID NO: 3995767 - RNA, 17 nt, Staphylococcus aureus subsp. aureus Mu50
uauuucacucuacaauc

SEQ ID NO: 3995768 - RNA, 20 nt, Staphylococcus aureus subsp. aureus Mu50
uauuucagcuuauuaagcuu

SEQ ID NO: 3995769 - RNA, 15 nt, Staphylococcus aureus subsp. aureus Mu50
uauuucauuagaaaa

SEQ ID NO: 3995770 - RNA, 16 nt, Staphylococcus aureus subsp. aureus Mu50
uauuucccuaugaaau

SEQ ID NO: 3995771 - RNA, 19 nt, Staphylococcus aureus subsp. aureus Mu50
uauuucuauaucuauuuau

SEQ ID NO: 3995772 - RNA, 16 nt, Staphylococcus aureus subsp. aureus Mu50
uauuucugaaaugaua

SEQ ID NO: 3995773 - RNA, 22 nt, Staphylococcus aureus subsp. aureus Mu50
uauuucugacaacuuaauagaa

SEQ ID NO: 3995774 - RNA, 15 nt, Staphylococcus aureus subsp. aureus Mu50
uauuucuuaacaucc

SEQ ID NO: 3995775 - RNA, 18 nt, Staphylococcus aureus subsp. aureus Mu50
uauuucuugcuucauuga

SEQ ID NO: 3995776 - RNA, 21 nt, Staphylococcus aureus subsp. aureus Mu50
uauuucuuuucauuaucauua

SEQ ID NO: 3995777 - RNA, 22 nt, Staphylococcus aureus subsp. aureus Mu50
uauuugaaagacauuuaaauau

SEQ ID NO: 3995778 - RNA, 23 nt, Staphylococcus aureus subsp. aureus Mu50
uauuugaaagacauuuaaauaua

SEQ ID NO: 3995779 - RNA, 17 nt, Staphylococcus aureus subsp. aureus Mu50
uauuugaaagguaagua

SEQ ID NO: 3995780 - RNA, 14 nt, Staphylococcus aureus subsp. aureus Mu50
uauuugaaaugaua

SEQ ID NO: 3995781 - RNA, 14 nt, Staphylococcus aureus subsp. aureus Mu50
uauuugaauacuuu

SEQ ID NO: 3995782 - RNA, 22 nt, Staphylococcus aureus subsp. aureus Mu50
uauuugaaugcaaaucaaauac

SEQ ID NO: 3995783 - RNA, 22 nt, Staphylococcus aureus subsp. aureus Mu50
uauuugauaacaaaacgauuga

SEQ ID NO: 3995784 - RNA, 15 nt, Staphylococcus aureus subsp. aureus Mu50
uauuugauaaugaua

SEQ ID NO: 3995785 - RNA, 13 nt, Staphylococcus aureus subsp. aureus Mu50
uauuugauacaac

SEQ ID NO: 3995786 - RNA, 20 nt, Staphylococcus aureus subsp. aureus Mu50
uauuugauauaguuauaugu

SEQ ID NO: 3995787 - RNA, 15 nt, Staphylococcus aureus subsp. aureus Mu50
uauuugauauuucau

SEQ ID NO: 3995788 - RNA, 18 nt, Staphylococcus aureus subsp. aureus Mu50
uauuugaucguugaauac

SEQ ID NO: 3995789 - RNA, 17 nt, Staphylococcus aureus subsp. aureus Mu50
uauuugauuauucuuca

SEQ ID NO: 3995790 - RNA, 21 nt, Staphylococcus aureus subsp. aureus Mu50
uauuugauuauucuucauuua

SEQ ID NO: 3995791 - RNA, 14 nt, Staphylococcus aureus subsp. aureus Mu50
uauuugauucuuca

SEQ ID NO: 3995792 - RNA, 18 nt, Staphylococcus aureus subsp. aureus Mu50
uauuugccuuuugaauaa

SEQ ID NO: 3995793 - RNA, 19 nt, Staphylococcus aureus subsp. aureus Mu50
uauuugcuagucauaauuu

SEQ ID NO: 3995794 - RNA, 16 nt, Staphylococcus aureus subsp. aureus Mu50
uauuuggauauuuauu

SEQ ID NO: 3995795 - RNA, 18 nt, Staphylococcus aureus subsp. aureus Mu50
uauuuggauauuuauuuu

SEQ ID NO: 3995796 - RNA, 21 nt, Staphylococcus aureus subsp. aureus Mu50
uauuuggaugguaaguauaau

SEQ ID NO: 3995797 - RNA, 15 nt, Staphylococcus aureus subsp. aureus Mu50
uauuuguaauuucag

SEQ ID NO: 3995798 - RNA, 19 nt, Staphylococcus aureus subsp. aureus Mu50
uauuuguacaugaacaaau

SEQ ID NO: 3995799 - RNA, 15 nt, Staphylococcus aureus subsp. aureus Mu50
uauuuguauaugcaa

SEQ ID NO: 3995800 - RNA, 13 nt, Staphylococcus aureus subsp. aureus Mu50
uauuugucuuuga

SEQ ID NO: 3995801 - RNA, 19 nt, Staphylococcus aureus subsp. aureus Mu50
uauuuguuaugguauuuau

SEQ ID NO: 3995802 - RNA, 14 nt, Staphylococcus aureus subsp. aureus Mu50
uauuuguuuauuag

SEQ ID NO: 3995803 - RNA, 10 nt, Staphylococcus aureus subsp. aureus Mu50
uauuuuaaac

SEQ ID NO: 3995804 - RNA, 13 nt, Staphylococcus aureus subsp. aureus Mu50
uauuuuaaacaug

SEQ ID NO: 3995805 - RNA, 21 nt, Staphylococcus aureus subsp. aureus Mu50
uauuuuaaaccguuauauauu

SEQ ID NO: 3995806 - RNA, 20 nt, Staphylococcus aureus subsp. aureus Mu50
uauuuuaaacguaucauuua

SEQ ID NO: 3995807 - RNA, 23 nt, Staphylococcus aureus subsp. aureus Mu50
uauuuuaaacguaucauuuaaaa

SEQ ID NO: 3995808 - RNA, 14 nt, Staphylococcus aureus subsp. aureus Mu50
uauuuuaaauuaca

SEQ ID NO: 3995809 - RNA, 17 nt, Staphylococcus aureus subsp. aureus Mu50
uauuuuaacuuaauuaa

SEQ ID NO: 3995810 - RNA, 19 nt, Staphylococcus aureus subsp. aureus Mu50
uauuuuaacuuaauuaaaa

SEQ ID NO: 3995811 - RNA, 15 nt, Staphylococcus aureus subsp. aureus Mu50
uauuuuaauagcauu

SEQ ID NO: 3995812 - RNA, 18 nt, Staphylococcus aureus subsp. aureus Mu50
uauuuuaauauugaaaug

SEQ ID NO: 3995813 - RNA, 13 nt, Staphylococcus aureus subsp. aureus Mu50
uauuuuaauauuu

SEQ ID NO: 3995814 - RNA, 19 nt, Staphylococcus aureus subsp. aureus Mu50
uauuuuauaagaauuuaaa

SEQ ID NO: 3995815 - RNA, 14 nt, Staphylococcus aureus subsp. aureus Mu50
uauuuuauaauaaa

SEQ ID NO: 3995816 - RNA, 17 nt, Staphylococcus aureus subsp. aureus Mu50
uauuuuauaauaaauuu

SEQ ID NO: 3995817 - RNA, 16 nt, Staphylococcus aureus subsp. aureus Mu50
uauuuuauaauaaccu

SEQ ID NO: 3995818 - RNA, 13 nt, Staphylococcus aureus subsp. aureus Mu50
uauuuuauacaua

SEQ ID NO: 3995819 - RNA, 23 nt, Staphylococcus aureus subsp. aureus Mu50
uauuuuaucaagagguaaaucug

SEQ ID NO: 3995820 - RNA, 19 nt, Staphylococcus aureus subsp. aureus Mu50
uauuuuaucaucuauucaa

SEQ ID NO: 3995821 - RNA, 22 nt, Staphylococcus aureus subsp. aureus Mu50
ucaaaguuuaauugcuguaaau

SEQ ID NO: 3995822 - RNA, 15 nt, Staphylococcus aureus subsp. aureus Mu50
ucaaaguuuucauuu

SEQ ID NO: 3995823 - RNA, 21 nt, Staphylococcus aureus subsp. aureus Mu50
ucaaaguuuucauuuaacaug

SEQ ID NO: 3995824 - RNA, 22 nt, Staphylococcus aureus subsp. aureus Mu50
ucaaauaaaugacauuuaauac

SEQ ID NO: 3995825 - RNA, 13 nt, Staphylococcus aureus subsp. aureus Mu50
ucaaauaacugag

SEQ ID NO: 3995826 - RNA, 16 nt, Staphylococcus aureus subsp. aureus Mu50
ucaaauaauauaaaac

SEQ ID NO: 3995827 - RNA, 18 nt, Staphylococcus aureus subsp. aureus Mu50
ucaaauaauauaaaacga

SEQ ID NO: 3995828 - RNA, 18 nt, Staphylococcus aureus subsp. aureus Mu50
ucaaauaaugugaaaaau

SEQ ID NO: 3995829 - RNA, 14 nt, Staphylococcus aureus subsp. aureus Mu50
ucaaauacauuuca

SEQ ID NO: 3995830 - RNA, 21 nt, Staphylococcus aureus subsp. aureus Mu50
ucaaauacauuucaaaaaaag

SEQ ID NO: 3995831 - RNA, 21 nt, Staphylococcus aureus subsp. aureus Mu50
ucaaauacguaucaagaaaaa

SEQ ID NO: 3995832 - RNA, 20 nt, Staphylococcus aureus subsp. aureus Mu50
ucaaauagacaccaaaaaac

SEQ ID NO: 3995833 - RNA, 19 nt, Staphylococcus aureus subsp. aureus Mu50
ucaaauauacuuuuaccau

SEQ ID NO: 3995834 - RNA, 20 nt, Staphylococcus aureus subsp. aureus Mu50
ucaaauauaucuaauacuuu

SEQ ID NO: 3995835 - RNA, 17 nt, Staphylococcus aureus subsp. aureus Mu50
ucaaauccaaaaucuuu

SEQ ID NO: 3995836 - RNA, 17 nt, Staphylococcus aureus subsp. aureus Mu50
ucaaaucggcuauacau

SEQ ID NO: 3995837 - RNA, 17 nt, Staphylococcus aureus subsp. aureus Mu50
ucaaaugacauuuuaaa

SEQ ID NO: 3995838 - RNA, 21 nt, Staphylococcus aureus subsp. aureus Mu50
ucaaaugacauuuuaaaucua

SEQ ID NO: 3995839 - RNA, 20 nt, Staphylococcus aureus subsp. aureus Mu50
ucaaaugccgcuucuaauuu

SEQ ID NO: 3995840 - RNA, 23 nt, Staphylococcus aureus subsp. aureus Mu50
ucaaaugccgcuucuaauuuuuc

SEQ ID NO: 3995841 - RNA, 21 nt, Staphylococcus aureus subsp. aureus Mu50
ucaaauguaacauuaaaaaua

SEQ ID NO: 3995842 - RNA, 20 nt, Staphylococcus aureus subsp. aureus Mu50
ucaaauuaauuaaaccaaua

SEQ ID NO: 3995843 - RNA, 20 nt, Staphylococcus aureus subsp. aureus Mu50
ucaaauuacaaauuaucuag

SEQ ID NO: 3995844 - RNA, 20 nt, Staphylococcus aureus subsp. aureus Mu50
ucaaauuauaaccgcuacaa

SEQ ID NO: 3995845 - RNA, 20 nt, Staphylococcus aureus subsp. aureus Mu50
ucaaauucaacgucaucaaa

SEQ ID NO: 3995846 - RNA, 20 nt, Staphylococcus aureus subsp. aureus Mu50
ucaaauucaucaguaccaaa

SEQ ID NO: 3995847 - RNA, 22 nt, Staphylococcus aureus subsp. aureus Mu50
ucaaauucaucaguaccaaaga

SEQ ID NO: 3995848 - RNA, 16 nt, Staphylococcus aureus subsp. aureus Mu50
ucaaauugaacuucuu

SEQ ID NO: 3995849 - RNA, 19 nt, Staphylococcus aureus subsp. aureus Mu50
ucaaauuuaccaguuugau

SEQ ID NO: 3995850 - RNA, 13 nt, Staphylococcus aureus subsp. aureus Mu50
ucaaauuuuucga

SEQ ID NO: 3995851 - RNA, 11 nt, Staphylococcus aureus subsp. aureus Mu50
ucaacaaacau

SEQ ID NO: 3995852 - RNA, 13 nt, Staphylococcus aureus subsp. aureus Mu50
ucaacaaacauaa

SEQ ID NO: 3995853 - RNA, 13 nt, Staphylococcus aureus subsp. aureus Mu50
ucaacaaauuuaa

SEQ ID NO: 3995854 - RNA, 18 nt, Staphylococcus aureus subsp. aureus Mu50
ucaacaacaaguucuuga

SEQ ID NO: 3995855 - RNA, 18 nt, Staphylococcus aureus subsp. aureus Mu50
ucaacaacugcgacaugu

SEQ ID NO: 3995856 - RNA, 23 nt, Staphylococcus aureus subsp. aureus Mu50
ucaacaacuuuacgauaaauagu

SEQ ID NO: 3995857 - RNA, 18 nt, Staphylococcus aureus subsp. aureus Mu50
ucaacaaucuuuuucaug

SEQ ID NO: 3995858 - RNA, 22 nt, Staphylococcus aureus subsp. aureus Mu50
ucaacacacacaguuuauaaua

SEQ ID NO: 3995859 - RNA, 15 nt, Staphylococcus aureus subsp. aureus Mu50
ucaacacacuauuau

SEQ ID NO: 3995860 - RNA, 16 nt, Staphylococcus aureus subsp. aureus Mu50
ucaacacgauagucau

SEQ ID NO: 3995861 - RNA, 19 nt, Staphylococcus aureus subsp. aureus Mu50
ucaacagcuucaaaaucaa

SEQ ID NO: 3995862 - RNA, 19 nt, Staphylococcus aureus subsp. aureus Mu50
ucaacagggguuuuuauau

SEQ ID NO: 3995863 - RNA, 16 nt, Staphylococcus aureus subsp. aureus Mu50
ucaacauaaaauuuaa

SEQ ID NO: 3995864 - RNA, 19 nt, Staphylococcus aureus subsp. aureus Mu50
ucaacauaacucaaauauc

SEQ ID NO: 3995865 - RNA, 14 nt, Staphylococcus aureus subsp. aureus Mu50
ucaacauaauauuu

SEQ ID NO: 3995866 - RNA, 14 nt, Staphylococcus aureus subsp. aureus Mu50
ucaacauauuauau

SEQ ID NO: 3995867 - RNA, 22 nt, Staphylococcus aureus subsp. aureus Mu50
ucaacauauuauauauauucca

SEQ ID NO: 3995868 - RNA, 17 nt, Staphylococcus aureus subsp. aureus Mu50
ucaacaucaucuuuaau

SEQ ID NO: 3995869 - RNA, 19 nt, Staphylococcus aureus subsp. aureus Mu50
ucaacaucaucuuuaauuu

SEQ ID NO: 3995870 - RNA, 21 nt, Staphylococcus aureus subsp. aureus Mu50
ucaacaucaucuuuaauuuuc

SEQ ID NO: 3995871 - RNA, 20 nt, Staphylococcus aureus subsp. aureus Mu50
ucaacaucguauucuuuuaa

SEQ ID NO: 3995872 - RNA, 22 nt, Staphylococcus aureus subsp. aureus Mu50
ucaacauguuccgcuacaaaac

SEQ ID NO: 3995873 - RNA, 12 nt, Staphylococcus aureus subsp. aureus Mu50
ucaacauuaaaa

SEQ ID NO: 3995874 - RNA, 15 nt, Staphylococcus aureus subsp. aureus Mu50
ucaacauuaaaaugu

SEQ ID NO: 3995875 - RNA, 23 nt, Staphylococcus aureus subsp. aureus Mu50
ucaacauuaaaauguguuuucaa

SEQ ID NO: 3995876 - RNA, 12 nt, Staphylococcus aureus subsp. aureus Mu50
ucaacauuaaua

SEQ ID NO: 3995877 - RNA, 16 nt, Staphylococcus aureus subsp. aureus Mu50
ucaacauuaauaaaua

SEQ ID NO: 3995878 - RNA, 18 nt, Staphylococcus aureus subsp. aureus Mu50
ucaacauuaauaaauaau

SEQ ID NO: 3995879 - RNA, 19 nt, Staphylococcus aureus subsp. aureus Mu50
ucaacauuacaugcaccuu

SEQ ID NO: 3995880 - RNA, 18 nt, Staphylococcus aureus subsp. aureus Mu50
ucaacauuacuaauugau

SEQ ID NO: 3995881 - RNA, 11 nt, Staphylococcus aureus subsp. aureus Mu50
ucaacauuuug

SEQ ID NO: 3995882 - RNA, 20 nt, Staphylococcus aureus subsp. aureus Mu50
ucaaccauuuguucugcaga

SEQ ID NO: 3995883 - RNA, 17 nt, Staphylococcus aureus subsp. aureus Mu50
ucaacccaucauguaca

SEQ ID NO: 3995884 - RNA, 15 nt, Staphylococcus aureus subsp. aureus Mu50
ucaaccucuuguaau

SEQ ID NO: 3995885 - RNA, 17 nt, Staphylococcus aureus subsp. aureus Mu50
ucaaccuguucuuuauu

SEQ ID NO: 3995886 - RNA, 16 nt, Staphylococcus aureus subsp. aureus Mu50
ucaacgauugaauugu

SEQ ID NO: 3995887 - RNA, 17 nt, Staphylococcus aureus subsp. aureus Mu50
ucaacgauuuugucuuu

SEQ ID NO: 3995888 - RNA, 22 nt, Staphylococcus aureus subsp. aureus Mu50
ucaacgcauauucuauuguugu

SEQ ID NO: 3995889 - RNA, 17 nt, Staphylococcus aureus subsp. aureus Mu50
ucaacgccauauuuauu

SEQ ID NO: 3995890 - RNA, 19 nt, Staphylococcus aureus subsp. aureus Mu50
ucaacgccauauuuauuua

SEQ ID NO: 3995891 - RNA, 16 nt, Staphylococcus aureus subsp. aureus Mu50
ucaacgggaacaucau

SEQ ID NO: 3995892 - RNA, 19 nt, Staphylococcus aureus subsp. aureus Mu50
ucaacguauauaaguuaaa

SEQ ID NO: 3995893 - RNA, 21 nt, Staphylococcus aureus subsp. aureus Mu50
ucaacguauauaaguuaaaau

SEQ ID NO: 3995894 - RNA, 16 nt, Staphylococcus aureus subsp. aureus Mu50
ucaacgucaucugcuu

SEQ ID NO: 3995895 - RNA, 20 nt, Staphylococcus aureus subsp. aureus Mu50
ucaacgucgaauguuucuuc

SEQ ID NO: 3995896 - RNA, 19 nt, Staphylococcus aureus subsp. aureus Mu50
ucaacuaaucguguauuau

SEQ ID NO: 3995897 - RNA, 13 nt, Staphylococcus aureus subsp. aureus Mu50
ucaacuacuucau

SEQ ID NO: 3995898 - RNA, 22 nt, Staphylococcus aureus subsp. aureus Mu50
ucaacuauauauaguugaucaa

SEQ ID NO: 3995899 - RNA, 19 nt, Staphylococcus aureus subsp. aureus Mu50
ucaacugcugcuaaaauaa

SEQ ID NO: 3995900 - RNA, 14 nt, Staphylococcus aureus subsp. aureus Mu50
ucaacuuaaauauc

SEQ ID NO: 3995901 - RNA, 17 nt, Staphylococcus aureus subsp. aureus Mu50
ucaacuuagaauuuaca

SEQ ID NO: 3995902 - RNA, 17 nt, Staphylococcus aureus subsp. aureus Mu50
ucaacuuauuauuuauc

SEQ ID NO: 3995903 - RNA, 10 nt, Staphylococcus aureus subsp. aureus Mu50
ucaacuuuuc

SEQ ID NO: 3995904 - RNA, 11 nt, Staphylococcus aureus subsp. aureus Mu50
ucaacuuuuga

SEQ ID NO: 3995905 - RNA, 18 nt, Staphylococcus aureus subsp. aureus Mu50
ucaacuuuuuaauaauac

SEQ ID NO: 3995906 - RNA, 22 nt, Staphylococcus aureus subsp. aureus Mu50
ucaacuuuuuaauaauacuucu

SEQ ID NO: 3995907 - RNA, 15 nt, Staphylococcus aureus subsp. aureus Mu50
ucaagaaaaaguuuu

SEQ ID NO: 3995908 - RNA, 14 nt, Staphylococcus aureus subsp. aureus Mu50
ucaauuaauuuaaa

SEQ ID NO: 3995909 - RNA, 19 nt, Staphylococcus aureus subsp. aureus Mu50
ucaauuaauuuaaaugcuu

SEQ ID NO: 3995910 - RNA, 22 nt, Staphylococcus aureus subsp. aureus Mu50
ucaauuacucuuuuucuuucau

SEQ ID NO: 3995911 - RNA, 15 nt, Staphylococcus aureus subsp. aureus Mu50
ucaauuagaaaauuu

SEQ ID NO: 3995912 - RNA, 20 nt, Staphylococcus aureus subsp. aureus Mu50
ucaauuagccaauaccgaau

SEQ ID NO: 3995913 - RNA, 13 nt, Staphylococcus aureus subsp. aureus Mu50
ucaauuaguucug

SEQ ID NO: 3995914 - RNA, 14 nt, Staphylococcus aureus subsp. aureus Mu50
ucaauuauugaaaa

SEQ ID NO: 3995915 - RNA, 19 nt, Staphylococcus aureus subsp. aureus Mu50
ucaauucgcauuaaauaac

SEQ ID NO: 3995916 - RNA, 20 nt, Staphylococcus aureus subsp. aureus Mu50
ucaauucgcauuaaauaacc

SEQ ID NO: 3995917 - RNA, 15 nt, Staphylococcus aureus subsp. aureus Mu50
ucaauucgcucacau

SEQ ID NO: 3995918 - RNA, 21 nt, Staphylococcus aureus subsp. aureus Mu50
ucaauucgcucacaugugaaa

SEQ ID NO: 3995919 - RNA, 12 nt, Staphylococcus aureus subsp. aureus Mu50
ucaauucucuaa

SEQ ID NO: 3995920 - RNA, 14 nt, Staphylococcus aureus subsp. aureus Mu50
ucaauugaaucuuu

SEQ ID NO: 3995921 - RNA, 17 nt, Staphylococcus aureus subsp. aureus Mu50
ucaauugaaucuuuguu

SEQ ID NO: 3995922 - RNA, 16 nt, Staphylococcus aureus subsp. aureus Mu50
ucaauugcgauauacg

SEQ ID NO: 3995923 - RNA, 24 nt, Staphylococcus aureus subsp. aureus Mu50
ucaauuggcaacggcacauucaua

SEQ ID NO: 3995924 - RNA, 17 nt, Staphylococcus aureus subsp. aureus Mu50
ucaauugucucaauaau

SEQ ID NO: 3995925 - RNA, 18 nt, Staphylococcus aureus subsp. aureus Mu50
ucaauuguuacuuuaacu

SEQ ID NO: 3995926 - RNA, 16 nt, Staphylococcus aureus subsp. aureus Mu50
ucaauuguugauuuga

SEQ ID NO: 3995927 - RNA, 20 nt, Staphylococcus aureus subsp. aureus Mu50
ucaauuuaaauaaguuacuc

SEQ ID NO: 3995928 - RNA, 13 nt, Staphylococcus aureus subsp. aureus Mu50
ucaauuuaauuaa

SEQ ID NO: 3995929 - RNA, 18 nt, Staphylococcus aureus subsp. aureus Mu50
ucaauuuaguauaaauaa

SEQ ID NO: 3995930 - RNA, 21 nt, Staphylococcus aureus subsp. aureus Mu50
ucaauuuauaugguuguuuuc

SEQ ID NO: 3995931 - RNA, 14 nt, Staphylococcus aureus subsp. aureus Mu50
ucaauuucaccuug

SEQ ID NO: 3995932 - RNA, 14 nt, Staphylococcus aureus subsp. aureus Mu50
ucaauuucauuuuu

SEQ ID NO: 3995933 - RNA, 14 nt, Staphylococcus aureus subsp. aureus Mu50
ucaauuucuguaau

SEQ ID NO: 3995934 - RNA, 17 nt, Staphylococcus aureus subsp. aureus Mu50
ucaauuucuguaauaau

SEQ ID NO: 3995935 - RNA, 19 nt, Staphylococcus aureus subsp. aureus Mu50
ucaauuuuuacuaaaucau

SEQ ID NO: 3995936 - RNA, 12 nt, Staphylococcus aureus subsp. aureus Mu50
ucacaaagaaau

SEQ ID NO: 3995937 - RNA, 13 nt, Staphylococcus aureus subsp. aureus Mu50
ucacaaagaaauu

SEQ ID NO: 3995938 - RNA, 18 nt, Staphylococcus aureus subsp. aureus Mu50
ucacaaauuugaauauac

SEQ ID NO: 3995939 - RNA, 20 nt, Staphylococcus aureus subsp. aureus Mu50
ucacaaauuugaauauacuu

SEQ ID NO: 3995940 - RNA, 23 nt, Staphylococcus aureus subsp. aureus Mu50
ucacaaauuugaauauacuuaau

SEQ ID NO: 3995941 - RNA, 15 nt, Staphylococcus aureus subsp. aureus Mu50
ucacaaguucaggau

SEQ ID NO: 3995942 - RNA, 22 nt, Staphylococcus aureus subsp. aureus Mu50
ucacaauacgaaaucaaaaaua

SEQ ID NO: 3995943 - RNA, 15 nt, Staphylococcus aureus subsp. aureus Mu50
ucacaaucauagaua

SEQ ID NO: 3995944 - RNA, 20 nt, Staphylococcus aureus subsp. aureus Mu50
ucacaaucauagauauaaga

SEQ ID NO: 3995945 - RNA, 16 nt, Staphylococcus aureus subsp. aureus Mu50
ucacaaucuguucaua

SEQ ID NO: 3995946 - RNA, 13 nt, Staphylococcus aureus subsp. aureus Mu50
ucacaaugaccau

SEQ ID NO: 3995947 - RNA, 22 nt, Staphylococcus aureus subsp. aureus Mu50
ucacaaugaccauugucaugcc

SEQ ID NO: 3995948 - RNA, 23 nt, Staphylococcus aureus subsp. aureus Mu50
ucacacgacauguagguaauugc

SEQ ID NO: 3995949 - RNA, 14 nt, Staphylococcus aureus subsp. aureus Mu50
ucacagacuuuuua

SEQ ID NO: 3995950 - RNA, 19 nt, Staphylococcus aureus subsp. aureus Mu50
ucacagacuuuuuacuaac

SEQ ID NO: 3995951 - RNA, 22 nt, Staphylococcus aureus subsp. aureus Mu50
ucacagacuuuuuacuaacuga

SEQ ID NO: 3995952 - RNA, 14 nt, Staphylococcus aureus subsp. aureus Mu50
ucacagcaauaaua

SEQ ID NO: 3995953 - RNA, 20 nt, Staphylococcus aureus subsp. aureus Mu50
ucacaguaucuucaguuauu

SEQ ID NO: 3995954 - RNA, 22 nt, Staphylococcus aureus subsp. aureus Mu50
ucacaguaucuucaguuauuug

SEQ ID NO: 3995955 - RNA, 14 nt, Staphylococcus aureus subsp. aureus Mu50
ucacaguguaauca

SEQ ID NO: 3995956 - RNA, 18 nt, Staphylococcus aureus subsp. aureus Mu50
ucacaguguugaauuuca

SEQ ID NO: 3995957 - RNA, 20 nt, Staphylococcus aureus subsp. aureus Mu50
ucacauacauuuugaaacau

SEQ ID NO: 3995958 - RNA, 22 nt, Staphylococcus aureus subsp. aureus Mu50
ucacauacauuuugaaacaucu

SEQ ID NO: 3995959 - RNA, 16 nt, Staphylococcus aureus subsp. aureus Mu50
ucacauauaaauauuu

SEQ ID NO: 3995960 - RNA, 18 nt, Staphylococcus aureus subsp. aureus Mu50
ucacauaugacuuuauuu

SEQ ID NO: 3995961 - RNA, 14 nt, Staphylococcus aureus subsp. aureus Mu50
ucacauauuaugau

SEQ ID NO: 3995962 - RNA, 22 nt, Staphylococcus aureus subsp. aureus Mu50
ucacaucacguugugcaauacc

SEQ ID NO: 3995963 - RNA, 23 nt, Staphylococcus aureus subsp. aureus Mu50
ucacaucacguugugcaauaccu

SEQ ID NO: 3995964 - RNA, 18 nt, Staphylococcus aureus subsp. aureus Mu50
ucacaugaauuuuaauau

SEQ ID NO: 3995965 - RNA, 20 nt, Staphylococcus aureus subsp. aureus Mu50
ucacaugaggaucaacugaa

SEQ ID NO: 3995966 - RNA, 21 nt, Staphylococcus aureus subsp. aureus Mu50
ucacaugaggaucaacugaaa

SEQ ID NO: 3995967 - RNA, 18 nt, Staphylococcus aureus subsp. aureus Mu50
ucacaugccaucuuugua

SEQ ID NO: 3995968 - RNA, 18 nt, Staphylococcus aureus subsp. aureus Mu50
ucacauguaccacauuuu

SEQ ID NO: 3995969 - RNA, 16 nt, Staphylococcus aureus subsp. aureus Mu50
ucacaugugaaauaau

SEQ ID NO: 3995970 - RNA, 15 nt, Staphylococcus aureus subsp. aureus Mu50
ucacauuaaguuaaa

SEQ ID NO: 3995971 - RNA, 18 nt, Staphylococcus aureus subsp. aureus Mu50
ucacauucuugaauaaau

SEQ ID NO: 3995972 - RNA, 19 nt, Staphylococcus aureus subsp. aureus Mu50
ucacauucuugaauaaauu

SEQ ID NO: 3995973 - RNA, 20 nt, Staphylococcus aureus subsp. aureus Mu50
ucacauucuugaauaaauuu

SEQ ID NO: 3995974 - RNA, 20 nt, Staphylococcus aureus subsp. aureus Mu50
ucaccaacaacuuuguuuuc

SEQ ID NO: 3995975 - RNA, 18 nt, Staphylococcus aureus subsp. aureus Mu50
ucaccaauccgauucacu

SEQ ID NO: 3995976 - RNA, 14 nt, Staphylococcus aureus subsp. aureus Mu50
ucaccagauuuuaa

SEQ ID NO: 3995977 - RNA, 17 nt, Staphylococcus aureus subsp. aureus Mu50
ucaccagauuuuaagug

SEQ ID NO: 3995978 - RNA, 22 nt, Staphylococcus aureus subsp. aureus Mu50
ucaccagguuuuuuauuuucau

SEQ ID NO: 3995979 - RNA, 23 nt, Staphylococcus aureus subsp. aureus Mu50
ucaccaguuugugguaaugauuu

SEQ ID NO: 3995980 - RNA, 19 nt, Staphylococcus aureus subsp. aureus Mu50
ucaccauacuaaaacauga

SEQ ID NO: 3995981 - RNA, 18 nt, Staphylococcus aureus subsp. aureus Mu50
ucaccauauuuaacauuu

SEQ ID NO: 3995982 - RNA, 13 nt, Staphylococcus aureus subsp. aureus Mu50
ucaccaucuuuaa

SEQ ID NO: 3995983 - RNA, 16 nt, Staphylococcus aureus subsp. aureus Mu50
ucaccauuuacuucau

SEQ ID NO: 3995984 - RNA, 14 nt, Staphylococcus aureus subsp. aureus Mu50
ucaccgcuuucaau

SEQ ID NO: 3995985 - RNA, 14 nt, Staphylococcus aureus subsp. aureus Mu50
ucaccguaaucuuu

SEQ ID NO: 3995986 - RNA, 20 nt, Staphylococcus aureus subsp. aureus Mu50
ucaccguaaucuuuuaacuu

SEQ ID NO: 3995987 - RNA, 24 nt, Staphylococcus aureus subsp. aureus Mu50
ucaccuguagacaauuguaguaau

SEQ ID NO: 3995988 - RNA, 13 nt, Staphylococcus aureus subsp. aureus Mu50
ucaccuuguaaau

SEQ ID NO: 3995989 - RNA, 21 nt, Staphylococcus aureus subsp. aureus Mu50
ucaccuuuaggcaaauaaccu

SEQ ID NO: 3995990 - RNA, 14 nt, Staphylococcus aureus subsp. aureus Mu50
ucaccuuuuuuaac

SEQ ID NO: 3995991 - RNA, 19 nt, Staphylococcus aureus subsp. aureus Mu50
ucacgacuugauagcauuu

SEQ ID NO: 3995992 - RNA, 15 nt, Staphylococcus aureus subsp. aureus Mu50
ucacgauaauguaua

SEQ ID NO: 3995993 - RNA, 22 nt, Staphylococcus aureus subsp. aureus Mu50
ucacgauagauuuaucaccuuu

SEQ ID NO: 3995994 - RNA, 14 nt, Staphylococcus aureus subsp. aureus Mu50
ucacgauauaacau

SEQ ID NO: 3995995 - RNA, 19 nt, Staphylococcus aureus subsp. aureus Mu50
ucauaaaaaucauaaauaa

SEQ ID NO: 3995996 - RNA, 20 nt, Staphylococcus aureus subsp. aureus Mu50
ucauaaaaaucauaaauaac

SEQ ID NO: 3995997 - RNA, 15 nt, Staphylococcus aureus subsp. aureus Mu50
ucauaaaauuuaaaa

SEQ ID NO: 3995998 - RNA, 18 nt, Staphylococcus aureus subsp. aureus Mu50
ucauaaacugaaucgauu

SEQ ID NO: 3995999 - RNA, 20 nt, Staphylococcus aureus subsp. aureus Mu50
ucauaaagauaagaugguuu

SEQ ID NO: 3996000 - RNA, 15 nt, Staphylococcus aureus subsp. aureus Mu50
ucauaaagugcguuu

SEQ ID NO: 3996001 - RNA, 15 nt, Staphylococcus aureus subsp. aureus Mu50
ucauaaaguuuauuu

SEQ ID NO: 3996002 - RNA, 18 nt, Staphylococcus aureus subsp. aureus Mu50
ucauaaaguuuauuuaug

SEQ ID NO: 3996003 - RNA, 15 nt, Staphylococcus aureus subsp. aureus Mu50
ucauaaauauaaaau

SEQ ID NO: 3996004 - RNA, 12 nt, Staphylococcus aureus subsp. aureus Mu50
ucauaaauauuu

SEQ ID NO: 3996005 - RNA, 13 nt, Staphylococcus aureus subsp. aureus Mu50
ucauaaauauuuu

SEQ ID NO: 3996006 - RNA, 16 nt, Staphylococcus aureus subsp. aureus Mu50
ucauaaaugacgucuc

SEQ ID NO: 3996007 - RNA, 14 nt, Staphylococcus aureus subsp. aureus Mu50
ucauaaaugacuga

SEQ ID NO: 3996008 - RNA, 21 nt, Staphylococcus aureus subsp. aureus Mu50
ucauaaaugacugaauuaaua

SEQ ID NO: 3996009 - RNA, 13 nt, Staphylococcus aureus subsp. aureus Mu50
ucauaaauguuau

SEQ ID NO: 3996010 - RNA, 21 nt, Staphylococcus aureus subsp. aureus Mu50
ucauaaccgcuucuuuuaagu

SEQ ID NO: 3996011 - RNA, 22 nt, Staphylococcus aureus subsp. aureus Mu50
ucauaaccgcuucuuuuaaguu

SEQ ID NO: 3996012 - RNA, 19 nt, Staphylococcus aureus subsp. aureus Mu50
ucauaacgacaacuugaac

SEQ ID NO: 3996013 - RNA, 22 nt, Staphylococcus aureus subsp. aureus Mu50
ucauaacgauuguugcaaugau

SEQ ID NO: 3996014 - RNA, 22 nt, Staphylococcus aureus subsp. aureus Mu50
ucauaagucuuaacaaauuaaa

SEQ ID NO: 3996015 - RNA, 13 nt, Staphylococcus aureus subsp. aureus Mu50
ucauaauaauuca

SEQ ID NO: 3996016 - RNA, 14 nt, Staphylococcus aureus subsp. aureus Mu50
ucauaauagauaau

SEQ ID NO: 3996017 - RNA, 14 nt, Staphylococcus aureus subsp. aureus Mu50
ucauaauauaacau

SEQ ID NO: 3996018 - RNA, 17 nt, Staphylococcus aureus subsp. aureus Mu50
ucauaauauauuaacaa

SEQ ID NO: 3996019 - RNA, 21 nt, Staphylococcus aureus subsp. aureus Mu50
ucauaauauugaugaauaaau

SEQ ID NO: 3996020 - RNA, 15 nt, Staphylococcus aureus subsp. aureus Mu50
ucauaaucaagaaua

SEQ ID NO: 3996021 - RNA, 13 nt, Staphylococcus aureus subsp. aureus Mu50
ucauaaucaaguc

SEQ ID NO: 3996022 - RNA, 16 nt, Staphylococcus aureus subsp. aureus Mu50
ucauaaucaagucugc

SEQ ID NO: 3996023 - RNA, 18 nt, Staphylococcus aureus subsp. aureus Mu50
ucauaaucaagucugcau

SEQ ID NO: 3996024 - RNA, 16 nt, Staphylococcus aureus subsp. aureus Mu50
ucauaaucauaaaaau

SEQ ID NO: 3996025 - RNA, 18 nt, Staphylococcus aureus subsp. aureus Mu50
ucauaaugaacgauauuc

SEQ ID NO: 3996026 - RNA, 14 nt, Staphylococcus aureus subsp. aureus Mu50
ucauaaugaauaau

SEQ ID NO: 3996027 - RNA, 21 nt, Staphylococcus aureus subsp. aureus Mu50
ucauaauuaacacauucaaau

SEQ ID NO: 3996028 - RNA, 16 nt, Staphylococcus aureus subsp. aureus Mu50
ucauaauuaauaacau

SEQ ID NO: 3996029 - RNA, 23 nt, Staphylococcus aureus subsp. aureus Mu50
ucauaauuaucauauaaaucaaa

SEQ ID NO: 3996030 - RNA, 15 nt, Staphylococcus aureus subsp. aureus Mu50
ucauaauucaguguu

SEQ ID NO: 3996031 - RNA, 12 nt, Staphylococcus aureus subsp. aureus Mu50
ucauaauuuaaa

SEQ ID NO: 3996032 - RNA, 20 nt, Staphylococcus aureus subsp. aureus Mu50
ucauaauuuuguuuugcuuc

SEQ ID NO: 3996033 - RNA, 21 nt, Staphylococcus aureus subsp. aureus Mu50
ucauacacuaucauuaucaaa

SEQ ID NO: 3996034 - RNA, 13 nt, Staphylococcus aureus subsp. aureus Mu50
ucauaccaaaaac

SEQ ID NO: 3996035 - RNA, 17 nt, Staphylococcus aureus subsp. aureus Mu50
ucauaccaaaaacauua

SEQ ID NO: 3996036 - RNA, 18 nt, Staphylococcus aureus subsp. aureus Mu50
ucauaccaaaaacauuaa

SEQ ID NO: 3996037 - RNA, 18 nt, Staphylococcus aureus subsp. aureus Mu50
ucauaccgaagaaacuaa

SEQ ID NO: 3996038 - RNA, 17 nt, Staphylococcus aureus subsp. aureus Mu50
ucauaccgacaccuaua

SEQ ID NO: 3996039 - RNA, 13 nt, Staphylococcus aureus subsp. aureus Mu50
ucauaccuuuuaa

SEQ ID NO: 3996040 - RNA, 16 nt, Staphylococcus aureus subsp. aureus Mu50
ucauaccuuuuaauuu

SEQ ID NO: 3996041 - RNA, 14 nt, Staphylococcus aureus subsp. aureus Mu50
ucauacgagaaauu

SEQ ID NO: 3996042 - RNA, 22 nt, Staphylococcus aureus subsp. aureus Mu50
ucauacgcuaaugcuauauuag

SEQ ID NO: 3996043 - RNA, 14 nt, Staphylococcus aureus subsp. aureus Mu50
ucauacuaacuaua

SEQ ID NO: 3996044 - RNA, 11 nt, Staphylococcus aureus subsp. aureus Mu50
ucauagccuau

SEQ ID NO: 3996045 - RNA, 16 nt, Staphylococcus aureus subsp. aureus Mu50
ucauagccuauuuaaa

SEQ ID NO: 3996046 - RNA, 17 nt, Staphylococcus aureus subsp. aureus Mu50
ucauagccuauuuaaaa

SEQ ID NO: 3996047 - RNA, 16 nt, Staphylococcus aureus subsp. aureus Mu50
ucauagugaaauucga

SEQ ID NO: 3996048 - RNA, 17 nt, Staphylococcus aureus subsp. aureus Mu50
ucauagugguguuuaua

SEQ ID NO: 3996049 - RNA, 15 nt, Staphylococcus aureus subsp. aureus Mu50
ucauaguuaucgauu

SEQ ID NO: 3996050 - RNA, 15 nt, Staphylococcus aureus subsp. aureus Mu50
ucauaguuauuaaau

SEQ ID NO: 3996051 - RNA, 18 nt, Staphylococcus aureus subsp. aureus Mu50
ucauaguuauuaaaucuu

SEQ ID NO: 3996052 - RNA, 14 nt, Staphylococcus aureus subsp. aureus Mu50
ucauaguugucuuu

SEQ ID NO: 3996053 - RNA, 20 nt, Staphylococcus aureus subsp. aureus Mu50
ucauauaaaacaaaaacggu

SEQ ID NO: 3996054 - RNA, 13 nt, Staphylococcus aureus subsp. aureus Mu50
ucauauaaaucaa

SEQ ID NO: 3996055 - RNA, 16 nt, Staphylococcus aureus subsp. aureus Mu50
ucauauaugucucucu

SEQ ID NO: 3996056 - RNA, 21 nt, Staphylococcus aureus subsp. aureus Mu50
ucauauauugacucgaccuuu

SEQ ID NO: 3996057 - RNA, 22 nt, Staphylococcus aureus subsp. aureus Mu50
ucauaucauaccaaaaaguauu

SEQ ID NO: 3996058 - RNA, 16 nt, Staphylococcus aureus subsp. aureus Mu50
ucauaucgauuaauag

SEQ ID NO: 3996059 - RNA, 22 nt, Staphylococcus aureus subsp. aureus Mu50
ucauaucuuuauuugauucuuc

SEQ ID NO: 3996060 - RNA, 13 nt, Staphylococcus aureus subsp. aureus Mu50
ucauaucuuucaa

SEQ ID NO: 3996061 - RNA, 14 nt, Staphylococcus aureus subsp. aureus Mu50
ucauaucuuucaau

SEQ ID NO: 3996062 - RNA, 20 nt, Staphylococcus aureus subsp. aureus Mu50
ucauaucuuucaauuaauuu

SEQ ID NO: 3996063 - RNA, 15 nt, Staphylococcus aureus subsp. aureus Mu50
ucauaugcaucaaca

SEQ ID NO: 3996064 - RNA, 20 nt, Staphylococcus aureus subsp. aureus Mu50
ucauauggcaauguuaacug

SEQ ID NO: 3996065 - RNA, 17 nt, Staphylococcus aureus subsp. aureus Mu50
ucauaugugccauaugu

SEQ ID NO: 3996066 - RNA, 18 nt, Staphylococcus aureus subsp. aureus Mu50
ucauauguuuuauaauaa

SEQ ID NO: 3996067 - RNA, 20 nt, Staphylococcus aureus subsp. aureus Mu50
ucauauguuuuauaauaaau

SEQ ID NO: 3996068 - RNA, 22 nt, Staphylococcus aureus subsp. aureus Mu50
ucauauguuuuauaauaaaugu

SEQ ID NO: 3996069 - RNA, 21 nt, Staphylococcus aureus subsp. aureus Mu50
ucauauuacuuuggaaauuua

SEQ ID NO: 3996070 - RNA, 19 nt, Staphylococcus aureus subsp. aureus Mu50
ucauauucaaaauaacuua

SEQ ID NO: 3996071 - RNA, 15 nt, Staphylococcus aureus subsp. aureus Mu50
ucauauucacaucuu

SEQ ID NO: 3996072 - RNA, 20 nt, Staphylococcus aureus subsp. aureus Mu50
ucauauucacaucuuuagcu

SEQ ID NO: 3996073 - RNA, 11 nt, Staphylococcus aureus subsp. aureus Mu50
ucauauuuaua

SEQ ID NO: 3996074 - RNA, 20 nt, Staphylococcus aureus subsp. aureus Mu50
ucauauuugaauacuuuauu

SEQ ID NO: 3996075 - RNA, 22 nt, Staphylococcus aureus subsp. aureus Mu50
ucauauuuuuuacguauacuuu

SEQ ID NO: 3996076 - RNA, 14 nt, Staphylococcus aureus subsp. aureus Mu50
ucaucaaaaguuug

SEQ ID NO: 3996077 - RNA, 20 nt, Staphylococcus aureus subsp. aureus Mu50
ucaucaacaaucuuuuucau

SEQ ID NO: 3996078 - RNA, 12 nt, Staphylococcus aureus subsp. aureus Mu50
ucaucaauaauu

SEQ ID NO: 3996079 - RNA, 13 nt, Staphylococcus aureus subsp. aureus Mu50
ucaucaauuggca

SEQ ID NO: 3996080 - RNA, 19 nt, Staphylococcus aureus subsp. aureus Mu50
ucaucaccuuguuaaaaua

SEQ ID NO: 3996081 - RNA, 11 nt, Staphylococcus aureus subsp. aureus Mu50
ucaucacuaug

SEQ ID NO: 3996082 - RNA, 16 nt, Staphylococcus aureus subsp. aureus Mu50
ucaucacuuuuuaaac

SEQ ID NO: 3996083 - RNA, 17 nt, Staphylococcus aureus subsp. aureus Mu50
uccaagagaauuaauaa

SEQ ID NO: 3996084 - RNA, 18 nt, Staphylococcus aureus subsp. aureus Mu50
uccaagagaauuaauaau

SEQ ID NO: 3996085 - RNA, 20 nt, Staphylococcus aureus subsp. aureus Mu50
uccaagagaauuaauaauuu

SEQ ID NO: 3996086 - RNA, 16 nt, Staphylococcus aureus subsp. aureus Mu50
uccaagauuaugacaa

SEQ ID NO: 3996087 - RNA, 16 nt, Staphylococcus aureus subsp. aureus Mu50
uccaagcaucauugaa

SEQ ID NO: 3996088 - RNA, 23 nt, Staphylococcus aureus subsp. aureus Mu50
uccaagcaucauugaauguugga

SEQ ID NO: 3996089 - RNA, 18 nt, Staphylococcus aureus subsp. aureus Mu50
uccaaggauguuauaaaa

SEQ ID NO: 3996090 - RNA, 20 nt, Staphylococcus aureus subsp. aureus Mu50
uccaagugacaacauuauuu

SEQ ID NO: 3996091 - RNA, 15 nt, Staphylococcus aureus subsp. aureus Mu50
uccaaguuaaugcac

SEQ ID NO: 3996092 - RNA, 13 nt, Staphylococcus aureus subsp. aureus Mu50
uccaauaaauugu

SEQ ID NO: 3996093 - RNA, 17 nt, Staphylococcus aureus subsp. aureus Mu50
uccaauaauaaaccuaa

SEQ ID NO: 3996094 - RNA, 19 nt, Staphylococcus aureus subsp. aureus Mu50
uccaauacuacuguugaca

SEQ ID NO: 3996095 - RNA, 15 nt, Staphylococcus aureus subsp. aureus Mu50
uccaauaucuucuuu

SEQ ID NO: 3996096 - RNA, 21 nt, Staphylococcus aureus subsp. aureus Mu50
uccaauaucuucuuuuaauau

SEQ ID NO: 3996097 - RNA, 18 nt, Staphylococcus aureus subsp. aureus Mu50
uccaaucaacuucauaua

SEQ ID NO: 3996098 - RNA, 16 nt, Staphylococcus aureus subsp. aureus Mu50
uccaaucaucauuaaa

SEQ ID NO: 3996099 - RNA, 20 nt, Staphylococcus aureus subsp. aureus Mu50
uccaaucaucauuaaaucug

SEQ ID NO: 3996100 - RNA, 22 nt, Staphylococcus aureus subsp. aureus Mu50
uccaaucaucauuaaaucugau

SEQ ID NO: 3996101 - RNA, 22 nt, Staphylococcus aureus subsp. aureus Mu50
uccaaucuauuuuaaacucauc

SEQ ID NO: 3996102 - RNA, 11 nt, Staphylococcus aureus subsp. aureus Mu50
uccaaugaauc

SEQ ID NO: 3996103 - RNA, 20 nt, Staphylococcus aureus subsp. aureus Mu50
uccaaugaaucguucgaagu

SEQ ID NO: 3996104 - RNA, 13 nt, Staphylococcus aureus subsp. aureus Mu50
uccaaugcaauug

SEQ ID NO: 3996105 - RNA, 15 nt, Staphylococcus aureus subsp. aureus Mu50
uccaauguauaaaac

SEQ ID NO: 3996106 - RNA, 21 nt, Staphylococcus aureus subsp. aureus Mu50
uccaauuaccaaugaauaaau

SEQ ID NO: 3996107 - RNA, 19 nt, Staphylococcus aureus subsp. aureus Mu50
uccaauucauuuuauaaau

SEQ ID NO: 3996108 - RNA, 23 nt, Staphylococcus aureus subsp. aureus Mu50
uccaauucauuuuauaaaucaaa

SEQ ID NO: 3996109 - RNA, 15 nt, Staphylococcus aureus subsp. aureus Mu50
uccaauuccaauaaa

SEQ ID NO: 3996110 - RNA, 17 nt, Staphylococcus aureus subsp. aureus Mu50
uccaauuuaaaaugauu

SEQ ID NO: 3996111 - RNA, 15 nt, Staphylococcus aureus subsp. aureus Mu50
uccaauuuuauugag

SEQ ID NO: 3996112 - RNA, 13 nt, Staphylococcus aureus subsp. aureus Mu50
uccacacauuaag

SEQ ID NO: 3996113 - RNA, 20 nt, Staphylococcus aureus subsp. aureus Mu50
uccaccagucguaaugauga

SEQ ID NO: 3996114 - RNA, 16 nt, Staphylococcus aureus subsp. aureus Mu50
uccacgcucacauuaa

SEQ ID NO: 3996115 - RNA, 13 nt, Staphylococcus aureus subsp. aureus Mu50
uccacggcauuua

SEQ ID NO: 3996116 - RNA, 17 nt, Staphylococcus aureus subsp. aureus Mu50
uccacuucaucuaaaug

SEQ ID NO: 3996117 - RNA, 19 nt, Staphylococcus aureus subsp. aureus Mu50
uccacuuuuugccuggcaa

SEQ ID NO: 3996118 - RNA, 17 nt, Staphylococcus aureus subsp. aureus Mu50
uccagcgacauguccug

SEQ ID NO: 3996119 - RNA, 14 nt, Staphylococcus aureus subsp. aureus Mu50
uccaguauuaacug

SEQ ID NO: 3996120 - RNA, 23 nt, Staphylococcus aureus subsp. aureus Mu50
uccaguccuuuuuuuauguuuaa

SEQ ID NO: 3996121 - RNA, 16 nt, Staphylococcus aureus subsp. aureus Mu50
uccaguggaaaugaua

SEQ ID NO: 3996122 - RNA, 22 nt, Staphylococcus aureus subsp. aureus Mu50
uccaguggaaaugauaauuuaa

SEQ ID NO: 3996123 - RNA, 15 nt, Staphylococcus aureus subsp. aureus Mu50
uccaguuuucaauuu

SEQ ID NO: 3996124 - RNA, 16 nt, Staphylococcus aureus subsp. aureus Mu50
uccaguuuucaauuua

SEQ ID NO: 3996125 - RNA, 23 nt, Staphylococcus aureus subsp. aureus Mu50
uccaguuuucaauuuauuaacug

SEQ ID NO: 3996126 - RNA, 21 nt, Staphylococcus aureus subsp. aureus Mu50
uccaguuuuugguagcauuuu

SEQ ID NO: 3996127 - RNA, 18 nt, Staphylococcus aureus subsp. aureus Mu50
uccauaaauaaaaugcua

SEQ ID NO: 3996128 - RNA, 14 nt, Staphylococcus aureus subsp. aureus Mu50
uccauaaauauuua

SEQ ID NO: 3996129 - RNA, 20 nt, Staphylococcus aureus subsp. aureus Mu50
uccauaacuguaguuucuua

SEQ ID NO: 3996130 - RNA, 22 nt, Staphylococcus aureus subsp. aureus Mu50
uccauaacuguaguuucuuaau

SEQ ID NO: 3996131 - RNA, 17 nt, Staphylococcus aureus subsp. aureus Mu50
uccauacguaucaaaau

SEQ ID NO: 3996132 - RNA, 21 nt, Staphylococcus aureus subsp. aureus Mu50
uccauaguaaucgauugguaa

SEQ ID NO: 3996133 - RNA, 23 nt, Staphylococcus aureus subsp. aureus Mu50
uccauauuuuuuaguaauaacau

SEQ ID NO: 3996134 - RNA, 16 nt, Staphylococcus aureus subsp. aureus Mu50
uccaucaucucugcuu

SEQ ID NO: 3996135 - RNA, 21 nt, Staphylococcus aureus subsp. aureus Mu50
uccaucauuuguguaaaugaa

SEQ ID NO: 3996136 - RNA, 15 nt, Staphylococcus aureus subsp. aureus Mu50
uccaucgucaucacu

SEQ ID NO: 3996137 - RNA, 22 nt, Staphylococcus aureus subsp. aureus Mu50
uccaucgucaucacuuuuuaaa

SEQ ID NO: 3996138 - RNA, 22 nt, Staphylococcus aureus subsp. aureus Mu50
uccaugaguuuacuaaacuuuu

SEQ ID NO: 3996139 - RNA, 11 nt, Staphylococcus aureus subsp. aureus Mu50
uccauuauugg

SEQ ID NO: 3996140 - RNA, 21 nt, Staphylococcus aureus subsp. aureus Mu50
uccauugaucuuuuauaauga

SEQ ID NO: 3996141 - RNA, 13 nt, Staphylococcus aureus subsp. aureus Mu50
uccauugcacuau

SEQ ID NO: 3996142 - RNA, 20 nt, Staphylococcus aureus subsp. aureus Mu50
uccauugcacuaugcauaau

SEQ ID NO: 3996143 - RNA, 16 nt, Staphylococcus aureus subsp. aureus Mu50
uccauuuaauuuguua

SEQ ID NO: 3996144 - RNA, 13 nt, Staphylococcus aureus subsp. aureus Mu50
uccauuuuaugca

SEQ ID NO: 3996145 - RNA, 18 nt, Staphylococcus aureus subsp. aureus Mu50
ucccaaccccuuuauuuu

SEQ ID NO: 3996146 - RNA, 15 nt, Staphylococcus aureus subsp. aureus Mu50
ucccaacuuaauaac

SEQ ID NO: 3996147 - RNA, 17 nt, Staphylococcus aureus subsp. aureus Mu50
ucccaaugcuugaauuu

SEQ ID NO: 3996148 - RNA, 20 nt, Staphylococcus aureus subsp. aureus Mu50
ucccagauucauaucuuuca

SEQ ID NO: 3996149 - RNA, 18 nt, Staphylococcus aureus subsp. aureus Mu50
ucccauaacaaucauuuc

SEQ ID NO: 3996150 - RNA, 13 nt, Staphylococcus aureus subsp. aureus Mu50
ucccauaaugacu

SEQ ID NO: 3996151 - RNA, 20 nt, Staphylococcus aureus subsp. aureus Mu50
ucccauaaugacuauaacac

SEQ ID NO: 3996152 - RNA, 13 nt, Staphylococcus aureus subsp. aureus Mu50
ucccauacugauu

SEQ ID NO: 3996153 - RNA, 19 nt, Staphylococcus aureus subsp. aureus Mu50
ucccauacugauuaacaag

SEQ ID NO: 3996154 - RNA, 22 nt, Staphylococcus aureus subsp. aureus Mu50
ucccaucuuuuagguaauaauu

SEQ ID NO: 3996155 - RNA, 22 nt, Staphylococcus aureus subsp. aureus Mu50
ucccauguauucuuagauauua

SEQ ID NO: 3996156 - RNA, 21 nt, Staphylococcus aureus subsp. aureus Mu50
ucccauuaacacgaacugcau

SEQ ID NO: 3996157 - RNA, 23 nt, Staphylococcus aureus subsp. aureus Mu50
ucccauuaacacgaacugcauag

SEQ ID NO: 3996158 - RNA, 17 nt, Staphylococcus aureus subsp. aureus Mu50
ucccauucuuugaggug

SEQ ID NO: 3996159 - RNA, 14 nt, Staphylococcus aureus subsp. aureus Mu50
ucccauuuuaaagu

SEQ ID NO: 3996160 - RNA, 15 nt, Staphylococcus aureus subsp. aureus Mu50
ucccgcuuaaaauga

SEQ ID NO: 3996161 - RNA, 16 nt, Staphylococcus aureus subsp. aureus Mu50
ucccuacugcaccgau

SEQ ID NO: 3996162 - RNA, 13 nt, Staphylococcus aureus subsp. aureus Mu50
ucccuacugcuug

SEQ ID NO: 3996163 - RNA, 19 nt, Staphylococcus aureus subsp. aureus Mu50
ucccuaggaaauaaaaaau

SEQ ID NO: 3996164 - RNA, 17 nt, Staphylococcus aureus subsp. aureus Mu50
ucccuuaaauacaauuu

SEQ ID NO: 3996165 - RNA, 19 nt, Staphylococcus aureus subsp. aureus Mu50
ucccuuaaauacaauuucu

SEQ ID NO: 3996166 - RNA, 22 nt, Staphylococcus aureus subsp. aureus Mu50
ucccuuaaauacaauuucuuca

SEQ ID NO: 3996167 - RNA, 14 nt, Staphylococcus aureus subsp. aureus Mu50
ucccuuaauaauaa

SEQ ID NO: 3996168 - RNA, 17 nt, Staphylococcus aureus subsp. aureus Mu50
ucccuucaaaguagaca

SEQ ID NO: 3996169 - RNA, 19 nt, Staphylococcus aureus subsp. aureus Mu50
ucccuucaaaguagacauu

SEQ ID NO: 3996170 - RNA, 20 nt, Staphylococcus aureus subsp. aureus Mu50
ucgaacauaaauaaacuuua

SEQ ID NO: 3996171 - RNA, 23 nt, Staphylococcus aureus subsp. aureus Mu50
ucgaaccaaauuuuauacuauua

SEQ ID NO: 3996172 - RNA, 21 nt, Staphylococcus aureus subsp. aureus Mu50
ucgaacgauauuuuaaaaagu

SEQ ID NO: 3996173 - RNA, 21 nt, Staphylococcus aureus subsp. aureus Mu50
ucgaacuaguacgaaaugcaa

SEQ ID NO: 3996174 - RNA, 15 nt, Staphylococcus aureus subsp. aureus Mu50
ucgaaguagcuuguu

SEQ ID NO: 3996175 - RNA, 20 nt, Staphylococcus aureus subsp. aureus Mu50
ucgaaguagcuuguuuagaa

SEQ ID NO: 3996176 - RNA, 21 nt, Staphylococcus aureus subsp. aureus Mu50
ucgaauguauugcuauaagaa

SEQ ID NO: 3996177 - RNA, 15 nt, Staphylococcus aureus subsp. aureus Mu50
ucgaauuaagaaaag

SEQ ID NO: 3996178 - RNA, 15 nt, Staphylococcus aureus subsp. aureus Mu50
ucgaauucauuugca

SEQ ID NO: 3996179 - RNA, 17 nt, Staphylococcus aureus subsp. aureus Mu50
ucgaauugauggaaaag

SEQ ID NO: 3996180 - RNA, 16 nt, Staphylococcus aureus subsp. aureus Mu50
ucgaauugguaaaaau

SEQ ID NO: 3996181 - RNA, 20 nt, Staphylococcus aureus subsp. aureus Mu50
ucgacaaauuaaaaaacaau

SEQ ID NO: 3996182 - RNA, 20 nt, Staphylococcus aureus subsp. aureus Mu50
ucgacaacugauuuaauauc

SEQ ID NO: 3996183 - RNA, 14 nt, Staphylococcus aureus subsp. aureus Mu50
ucgacauugauguc

SEQ ID NO: 3996184 - RNA, 14 nt, Staphylococcus aureus subsp. aureus Mu50
ucgacuacaaguuu

SEQ ID NO: 3996185 - RNA, 19 nt, Staphylococcus aureus subsp. aureus Mu50
ucgacuacaaguuuauaau

SEQ ID NO: 3996186 - RNA, 15 nt, Staphylococcus aureus subsp. aureus Mu50
ucgagaggguacacu

SEQ ID NO: 3996187 - RNA, 19 nt, Staphylococcus aureus subsp. aureus Mu50
ucgagcucuucaaauuuac

SEQ ID NO: 3996188 - RNA, 15 nt, Staphylococcus aureus subsp. aureus Mu50
ucgagguaauuucac

SEQ ID NO: 3996189 - RNA, 12 nt, Staphylococcus aureus subsp. aureus Mu50
ucgauaaaaugu

SEQ ID NO: 3996190 - RNA, 23 nt, Staphylococcus aureus subsp. aureus Mu50
ucgauaacguugccauacccaua

SEQ ID NO: 3996191 - RNA, 19 nt, Staphylococcus aureus subsp. aureus Mu50
ucgauaacuuacuauuugu

SEQ ID NO: 3996192 - RNA, 18 nt, Staphylococcus aureus subsp. aureus Mu50
ucgauaguucuauauaau

SEQ ID NO: 3996193 - RNA, 21 nt, Staphylococcus aureus subsp. aureus Mu50
ucgauaguucuauauaauuua

SEQ ID NO: 3996194 - RNA, 21 nt, Staphylococcus aureus subsp. aureus Mu50
ucgauauagcauaaaauuucu

SEQ ID NO: 3996195 - RNA, 16 nt, Staphylococcus aureus subsp. aureus Mu50
ucgauaugaccauagu

SEQ ID NO: 3996196 - RNA, 20 nt, Staphylococcus aureus subsp. aureus Mu50
ucgauauuucuaguugcaau

SEQ ID NO: 3996197 - RNA, 17 nt, Staphylococcus aureus subsp. aureus Mu50
ucgauauuuguuucgua

SEQ ID NO: 3996198 - RNA, 16 nt, Staphylococcus aureus subsp. aureus Mu50
ucgaucgguauuuuca

SEQ ID NO: 3996199 - RNA, 17 nt, Staphylococcus aureus subsp. aureus Mu50
ucgaucgguauuuucau

SEQ ID NO: 3996200 - RNA, 21 nt, Staphylococcus aureus subsp. aureus Mu50
ucgaucgguauuuucauuuua

SEQ ID NO: 3996201 - RNA, 18 nt, Staphylococcus aureus subsp. aureus Mu50
ucgauuauucuuaauuua

SEQ ID NO: 3996202 - RNA, 20 nt, Staphylococcus aureus subsp. aureus Mu50
ucgauuauucuuaauuuaag

SEQ ID NO: 3996203 - RNA, 17 nt, Staphylococcus aureus subsp. aureus Mu50
ucgauucauaaaauuua

SEQ ID NO: 3996204 - RNA, 17 nt, Staphylococcus aureus subsp. aureus Mu50
ucgauucaugaauaauu

SEQ ID NO: 3996205 - RNA, 22 nt, Staphylococcus aureus subsp. aureus Mu50
ucgauuuagaagaacaauaauu

SEQ ID NO: 3996206 - RNA, 15 nt, Staphylococcus aureus subsp. aureus Mu50
ucgauuuuauaucuu

SEQ ID NO: 3996207 - RNA, 17 nt, Staphylococcus aureus subsp. aureus Mu50
ucgauuuuggcacauaa

SEQ ID NO: 3996208 - RNA, 14 nt, Staphylococcus aureus subsp. aureus Mu50
ucgauuuuuuaaug

SEQ ID NO: 3996209 - RNA, 22 nt, Staphylococcus aureus subsp. aureus Mu50
ucgauuuuuuaaugucuaaaaa

SEQ ID NO: 3996210 - RNA, 15 nt, Staphylococcus aureus subsp. aureus Mu50
ucgcaaauacauaau

SEQ ID NO: 3996211 - RNA, 22 nt, Staphylococcus aureus subsp. aureus Mu50
ucgcacaacugcauaaaagccu

SEQ ID NO: 3996212 - RNA, 21 nt, Staphylococcus aureus subsp. aureus Mu50
ucgcaccgucaaacuuaaaac

SEQ ID NO: 3996213 - RNA, 15 nt, Staphylococcus aureus subsp. aureus Mu50
ucgcacuauaaaauu

SEQ ID NO: 3996214 - RNA, 21 nt, Staphylococcus aureus subsp. aureus Mu50
ucgcauacugucaucuuucaa

SEQ ID NO: 3996215 - RNA, 16 nt, Staphylococcus aureus subsp. aureus Mu50
ucgcauacuuuuucag

SEQ ID NO: 3996216 - RNA, 18 nt, Staphylococcus aureus subsp. aureus Mu50
ucgcaucacugcauauaa

SEQ ID NO: 3996217 - RNA, 17 nt, Staphylococcus aureus subsp. aureus Mu50
ucgcaucuccaaaggcc

SEQ ID NO: 3996218 - RNA, 22 nt, Staphylococcus aureus subsp. aureus Mu50
ucgcauucuugguuuuuuagau

SEQ ID NO: 3996219 - RNA, 14 nt, Staphylococcus aureus subsp. aureus Mu50
ucgccaagccaucu

SEQ ID NO: 3996220 - RNA, 17 nt, Staphylococcus aureus subsp. aureus Mu50
ucgccaagccaucuuuc

SEQ ID NO: 3996221 - RNA, 21 nt, Staphylococcus aureus subsp. aureus Mu50
ucgccaucuuuuuuagcugaa

SEQ ID NO: 3996222 - RNA, 20 nt, Staphylococcus aureus subsp. aureus Mu50
ucgccauuguccaacugcuu

SEQ ID NO: 3996223 - RNA, 20 nt, Staphylococcus aureus subsp. aureus Mu50
ucgccuaaaaauaaaaucaa

SEQ ID NO: 3996224 - RNA, 16 nt, Staphylococcus aureus subsp. aureus Mu50
ucgcgcucuucuucag

SEQ ID NO: 3996225 - RNA, 18 nt, Staphylococcus aureus subsp. aureus Mu50
ucgcgucugauucucuaa

SEQ ID NO: 3996226 - RNA, 16 nt, Staphylococcus aureus subsp. aureus Mu50
ucgcucacaugugaaa

SEQ ID NO: 3996227 - RNA, 21 nt, Staphylococcus aureus subsp. aureus Mu50
ucgcucacaugugaaauaauc

SEQ ID NO: 3996228 - RNA, 17 nt, Staphylococcus aureus subsp. aureus Mu50
ucgcucauccucauuaa

SEQ ID NO: 3996229 - RNA, 21 nt, Staphylococcus aureus subsp. aureus Mu50
ucgcucuagacauuacauuua

SEQ ID NO: 3996230 - RNA, 21 nt, Staphylococcus aureus subsp. aureus Mu50
ucgcuucgguuaacuguucua

SEQ ID NO: 3996231 - RNA, 15 nt, Staphylococcus aureus subsp. aureus Mu50
ucgcuucuucuucag

SEQ ID NO: 3996232 - RNA, 21 nt, Staphylococcus aureus subsp. aureus Mu50
ucgcuucuucuucagaaauac

SEQ ID NO: 3996233 - RNA, 17 nt, Staphylococcus aureus subsp. aureus Mu50
ucgcuugauuaauuuua

SEQ ID NO: 3996234 - RNA, 19 nt, Staphylococcus aureus subsp. aureus Mu50
ucgcuugauuaauuuuauc

SEQ ID NO: 3996235 - RNA, 23 nt, Staphylococcus aureus subsp. aureus Mu50
ucgcuugcuucuuuccucuccuu

SEQ ID NO: 3996236 - RNA, 18 nt, Staphylococcus aureus subsp. aureus Mu50
ucgcuuguaacaagcuuu

SEQ ID NO: 3996237 - RNA, 18 nt, Staphylococcus aureus subsp. aureus Mu50
ucgcuuuuuuuauuuuuc

SEQ ID NO: 3996238 - RNA, 17 nt, Staphylococcus aureus subsp. aureus Mu50
ucggaaaaagaugaaaa

SEQ ID NO: 3996239 - RNA, 13 nt, Staphylococcus aureus subsp. aureus Mu50
ucggaauaaaaua

SEQ ID NO: 3996240 - RNA, 12 nt, Staphylococcus aureus subsp. aureus Mu50
ucggacagagga

SEQ ID NO: 3996241 - RNA, 17 nt, Staphylococcus aureus subsp. aureus Mu50
ucggauaaauaaguuaa

SEQ ID NO: 3996242 - RNA, 18 nt, Staphylococcus aureus subsp. aureus Mu50
ucggaugagaaauguuaa

SEQ ID NO: 3996243 - RNA, 20 nt, Staphylococcus aureus subsp. aureus Mu50
ucggauuauauuuagauuua

SEQ ID NO: 3996244 - RNA, 16 nt, Staphylococcus aureus subsp. aureus Mu50
ucggauuaucuguaau

SEQ ID NO: 3996245 - RNA, 20 nt, Staphylococcus aureus subsp. aureus Mu50
ucggcuuuggauuucuuuuu

SEQ ID NO: 3996246 - RNA, 14 nt, Staphylococcus aureus subsp. aureus Mu50
ucggcuuuguaaaa

SEQ ID NO: 3996247 - RNA, 18 nt, Staphylococcus aureus subsp. aureus Mu50
ucggggccccaacacaga

SEQ ID NO: 3996248 - RNA, 14 nt, Staphylococcus aureus subsp. aureus Mu50
ucgguaugauauuu

SEQ ID NO: 3996249 - RNA, 14 nt, Staphylococcus aureus subsp. aureus Mu50
ucgguauucaauuc

SEQ ID NO: 3996250 - RNA, 16 nt, Staphylococcus aureus subsp. aureus Mu50
ucgguauuuaauguuu

SEQ ID NO: 3996251 - RNA, 17 nt, Staphylococcus aureus subsp. aureus Mu50
ucgguauuuaauguuuu

SEQ ID NO: 3996252 - RNA, 13 nt, Staphylococcus aureus subsp. aureus Mu50
ucgguauuuuaaa

SEQ ID NO: 3996253 - RNA, 17 nt, Staphylococcus aureus subsp. aureus Mu50
ucgguauuuuaaauuua

SEQ ID NO: 3996254 - RNA, 16 nt, Staphylococcus aureus subsp. aureus Mu50
ucgguucaucuaaaau

SEQ ID NO: 3996255 - RNA, 18 nt, Staphylococcus aureus subsp. aureus Mu50
ucgguucaucuaaaauga

SEQ ID NO: 3996256 - RNA, 21 nt, Staphylococcus aureus subsp. aureus Mu50
ucgguuugauuaaaaucugcu

SEQ ID NO: 3996257 - RNA, 13 nt, Staphylococcus aureus subsp. aureus Mu50
ucuaaauucuuuu

SEQ ID NO: 3996258 - RNA, 20 nt, Staphylococcus aureus subsp. aureus Mu50
ucuaaauucuuuuuguucgg

SEQ ID NO: 3996259 - RNA, 15 nt, Staphylococcus aureus subsp. aureus Mu50
ucuaacaguuaauau

SEQ ID NO: 3996260 - RNA, 21 nt, Staphylococcus aureus subsp. aureus Mu50
ucuaaccacuucuucaccugc

SEQ ID NO: 3996261 - RNA, 12 nt, Staphylococcus aureus subsp. aureus Mu50
ucuaaccaucuc

SEQ ID NO: 3996262 - RNA, 19 nt, Staphylococcus aureus subsp. aureus Mu50
ucuaacggcguuuguuucu

SEQ ID NO: 3996263 - RNA, 15 nt, Staphylococcus aureus subsp. aureus Mu50
ucuaacgguaaauaa

SEQ ID NO: 3996264 - RNA, 16 nt, Staphylococcus aureus subsp. aureus Mu50
ucuaacgguaaauaac

SEQ ID NO: 3996265 - RNA, 17 nt, Staphylococcus aureus subsp. aureus Mu50
ucuaacguuaacaauau

SEQ ID NO: 3996266 - RNA, 14 nt, Staphylococcus aureus subsp. aureus Mu50
ucuaacugaauuaa

SEQ ID NO: 3996267 - RNA, 18 nt, Staphylococcus aureus subsp. aureus Mu50
ucuaacuuaccaugauga

SEQ ID NO: 3996268 - RNA, 17 nt, Staphylococcus aureus subsp. aureus Mu50
ucuaacuuuaccaauau

SEQ ID NO: 3996269 - RNA, 23 nt, Staphylococcus aureus subsp. aureus Mu50
ucuaacuuuaccaauaucaugca

SEQ ID NO: 3996270 - RNA, 16 nt, Staphylococcus aureus subsp. aureus Mu50
ucuaagauguguugaa

SEQ ID NO: 3996271 - RNA, 22 nt, Staphylococcus aureus subsp. aureus Mu50
ucuaaguguugaccauuaucaa

SEQ ID NO: 3996272 - RNA, 23 nt, Staphylococcus aureus subsp. aureus Mu50
ucuaaguuaaaaccuuuucaaau

SEQ ID NO: 3996273 - RNA, 15 nt, Staphylococcus aureus subsp. aureus Mu50
ucuaauacauacuga

SEQ ID NO: 3996274 - RNA, 17 nt, Staphylococcus aureus subsp. aureus Mu50
ucuaauacauacugauu

SEQ ID NO: 3996275 - RNA, 23 nt, Staphylococcus aureus subsp. aureus Mu50
ucuaauacuucaccacauaaaaa

SEQ ID NO: 3996276 - RNA, 18 nt, Staphylococcus aureus subsp. aureus Mu50
ucuaauacuuucaaacaa

SEQ ID NO: 3996277 - RNA, 18 nt, Staphylococcus aureus subsp. aureus Mu50
ucuaauacuuucacuuuu

SEQ ID NO: 3996278 - RNA, 22 nt, Staphylococcus aureus subsp. aureus Mu50
ucuaauacuuucacuuuuuaua

SEQ ID NO: 3996279 - RNA, 23 nt, Staphylococcus aureus subsp. aureus Mu50
ucuaauacuuucacuuuuuauau

SEQ ID NO: 3996280 - RNA, 13 nt, Staphylococcus aureus subsp. aureus Mu50
ucuaauauuuugg

SEQ ID NO: 3996281 - RNA, 17 nt, Staphylococcus aureus subsp. aureus Mu50
ucuaaucacuuggcgua

SEQ ID NO: 3996282 - RNA, 17 nt, Staphylococcus aureus subsp. aureus Mu50
ucuaaucuucacgcuua

SEQ ID NO: 3996283 - RNA, 23 nt, Staphylococcus aureus subsp. aureus Mu50
ucuaaugauauuugaucguugaa

SEQ ID NO: 3996284 - RNA, 17 nt, Staphylococcus aureus subsp. aureus Mu50
ucuaaugcuaauuuaac

SEQ ID NO: 3996285 - RNA, 20 nt, Staphylococcus aureus subsp. aureus Mu50
ucuaaugcuaauuuaacugc

SEQ ID NO: 3996286 - RNA, 19 nt, Staphylococcus aureus subsp. aureus Mu50
ucuaaugcucauuaauggu

SEQ ID NO: 3996287 - RNA, 17 nt, Staphylococcus aureus subsp. aureus Mu50
ucuaauucaaugauuuu

SEQ ID NO: 3996288 - RNA, 22 nt, Staphylococcus aureus subsp. aureus Mu50
ucuaauucaaugauuuuuaaaa

SEQ ID NO: 3996289 - RNA, 13 nt, Staphylococcus aureus subsp. aureus Mu50
ucuaauucguaau

SEQ ID NO: 3996290 - RNA, 19 nt, Staphylococcus aureus subsp. aureus Mu50
ucuaauuguuguaauucuu

SEQ ID NO: 3996291 - RNA, 20 nt, Staphylococcus aureus subsp. aureus Mu50
ucuaauuguuguaauucuuu

SEQ ID NO: 3996292 - RNA, 21 nt, Staphylococcus aureus subsp. aureus Mu50
ucuaauuguuguaauucuuuu

SEQ ID NO: 3996293 - RNA, 18 nt, Staphylococcus aureus subsp. aureus Mu50
ucuacaaacaaugcaagu

SEQ ID NO: 3996294 - RNA, 15 nt, Staphylococcus aureus subsp. aureus Mu50
ucuacaauaaccauu

SEQ ID NO: 3996295 - RNA, 21 nt, Staphylococcus aureus subsp. aureus Mu50
ucuacaauaaccauuucauca

SEQ ID NO: 3996296 - RNA, 19 nt, Staphylococcus aureus subsp. aureus Mu50
ucuacaauauucaauaauu

SEQ ID NO: 3996297 - RNA, 16 nt, Staphylococcus aureus subsp. aureus Mu50
ucuacaggcaaugcaa

SEQ ID NO: 3996298 - RNA, 18 nt, Staphylococcus aureus subsp. aureus Mu50
ucuacaggcaaugcaagu

SEQ ID NO: 3996299 - RNA, 22 nt, Staphylococcus aureus subsp. aureus Mu50
ucuacaggcaaugcaaguuggc

SEQ ID NO: 3996300 - RNA, 14 nt, Staphylococcus aureus subsp. aureus Mu50
ucuacagguaaugc

SEQ ID NO: 3996301 - RNA, 22 nt, Staphylococcus aureus subsp. aureus Mu50
ucuacagguaaugcaaguuggc

SEQ ID NO: 3996302 - RNA, 14 nt, Staphylococcus aureus subsp. aureus Mu50
ucuacaguuuuaug

SEQ ID NO: 3996303 - RNA, 15 nt, Staphylococcus aureus subsp. aureus Mu50
ucuacauaauuugaa

SEQ ID NO: 3996304 - RNA, 23 nt, Staphylococcus aureus subsp. aureus Mu50
ucuacauacaacucguuuuucca

SEQ ID NO: 3996305 - RNA, 23 nt, Staphylococcus aureus subsp. aureus Mu50
ucuacaugaaucaacaauuuaaa

SEQ ID NO: 3996306 - RNA, 23 nt, Staphylococcus aureus subsp. aureus Mu50
ucuacauuauauugagacaacau

SEQ ID NO: 3996307 - RNA, 22 nt, Staphylococcus aureus subsp. aureus Mu50
ucuaccaauaauucccuaggaa

SEQ ID NO: 3996308 - RNA, 13 nt, Staphylococcus aureus subsp. aureus Mu50
ucuacccuugcaa

SEQ ID NO: 3996309 - RNA, 15 nt, Staphylococcus aureus subsp. aureus Mu50
ucuacccuugcaaau

SEQ ID NO: 3996310 - RNA, 21 nt, Staphylococcus aureus subsp. aureus Mu50
ucuaccucuaggauuaaaagc

SEQ ID NO: 3996311 - RNA, 18 nt, Staphylococcus aureus subsp. aureus Mu50
ucuacgaucaaaaucaug

SEQ ID NO: 3996312 - RNA, 12 nt, Staphylococcus aureus subsp. aureus Mu50
ucuacuacuaau

SEQ ID NO: 3996313 - RNA, 16 nt, Staphylococcus aureus subsp. aureus Mu50
ucuacucaaauauaaa

SEQ ID NO: 3996314 - RNA, 22 nt, Staphylococcus aureus subsp. aureus Mu50
ucuacucgaaaccagcuuacug

SEQ ID NO: 3996315 - RNA, 17 nt, Staphylococcus aureus subsp. aureus Mu50
ucuacuuaguaauaaga

SEQ ID NO: 3996316 - RNA, 13 nt, Staphylococcus aureus subsp. aureus Mu50
ucuacuuuguucu

SEQ ID NO: 3996317 - RNA, 16 nt, Staphylococcus aureus subsp. aureus Mu50
ucuagacuuauuugaa

SEQ ID NO: 3996318 - RNA, 21 nt, Staphylococcus aureus subsp. aureus Mu50
ucuagacuuauuugaaugcaa

SEQ ID NO: 3996319 - RNA, 24 nt, Staphylococcus aureus subsp. aureus Mu50
ucuagacuuauuugaaugcaaauc

SEQ ID NO: 3996320 - RNA, 17 nt, Staphylococcus aureus subsp. aureus Mu50
ucuagagauaacuagaa

SEQ ID NO: 3996321 - RNA, 13 nt, Staphylococcus aureus subsp. aureus Mu50
ucuagaugaaauu

SEQ ID NO: 3996322 - RNA, 13 nt, Staphylococcus aureus subsp. aureus Mu50
ucuagauuauuua

SEQ ID NO: 3996323 - RNA, 18 nt, Staphylococcus aureus subsp. aureus Mu50
ucuagauuauuuaaaaau

SEQ ID NO: 3996324 - RNA, 15 nt, Staphylococcus aureus subsp. aureus Mu50
ucuagauucauauuu

SEQ ID NO: 3996325 - RNA, 18 nt, Staphylococcus aureus subsp. aureus Mu50
ucuagauuuuaaaucaau

SEQ ID NO: 3996326 - RNA, 21 nt, Staphylococcus aureus subsp. aureus Mu50
ucuagcguagcgaaaguaucu

SEQ ID NO: 3996327 - RNA, 16 nt, Staphylococcus aureus subsp. aureus Mu50
ucuagcucuccuacaa

SEQ ID NO: 3996328 - RNA, 19 nt, Staphylococcus aureus subsp. aureus Mu50
ucuagcuuuagucguuugu

SEQ ID NO: 3996329 - RNA, 14 nt, Staphylococcus aureus subsp. aureus Mu50
ucuagguuagaauu

SEQ ID NO: 3996330 - RNA, 19 nt, Staphylococcus aureus subsp. aureus Mu50
ucuagguuagaauuauuuu

SEQ ID NO: 3996331 - RNA, 22 nt, Staphylococcus aureus subsp. aureus Mu50
ucuaguacaccucuaaguucac

SEQ ID NO: 3996332 - RNA, 20 nt, Staphylococcus aureus subsp. aureus Mu50
ucuaguagcuagaacagaua

SEQ ID NO: 3996333 - RNA, 22 nt, Staphylococcus aureus subsp. aureus Mu50
ucuagugcuuugucuuggaugu

SEQ ID NO: 3996334 - RNA, 16 nt, Staphylococcus aureus subsp. aureus Mu50
ucuaguuauuucauag

SEQ ID NO: 3996335 - RNA, 13 nt, Staphylococcus aureus subsp. aureus Mu50
ucuaguuguuuua

SEQ ID NO: 3996336 - RNA, 20 nt, Staphylococcus aureus subsp. aureus Mu50
ucuaguuuaucuucaguaau

SEQ ID NO: 3996337 - RNA, 17 nt, Staphylococcus aureus subsp. aureus Mu50
ucuaguuuucaugaaaa

SEQ ID NO: 3996338 - RNA, 12 nt, Staphylococcus aureus subsp. aureus Mu50
ucuauaaauauc

SEQ ID NO: 3996339 - RNA, 14 nt, Staphylococcus aureus subsp. aureus Mu50
ucuauaauaccuaa

SEQ ID NO: 3996340 - RNA, 16 nt, Staphylococcus aureus subsp. aureus Mu50
ucuauaauuuuaauua

SEQ ID NO: 3996341 - RNA, 15 nt, Staphylococcus aureus subsp. aureus Mu50
ucuauacaacaguaa

SEQ ID NO: 3996342 - RNA, 20 nt, Staphylococcus aureus subsp. aureus Mu50
ucuauacaauuauggauaaa

SEQ ID NO: 3996343 - RNA, 23 nt, Staphylococcus aureus subsp. aureus Mu50
ucuauacauuccaaaguaccauc

SEQ ID NO: 3996344 - RNA, 18 nt, Staphylococcus aureus subsp. aureus Mu50
ucugaaacuuuaauacua

SEQ ID NO: 3996345 - RNA, 19 nt, Staphylococcus aureus subsp. aureus Mu50
ucugaaaugauacauuauu

SEQ ID NO: 3996346 - RNA, 16 nt, Staphylococcus aureus subsp. aureus Mu50
ucugaacauaaaaaau

SEQ ID NO: 3996347 - RNA, 19 nt, Staphylococcus aureus subsp. aureus Mu50
ucugaacauaaaaaauacu

SEQ ID NO: 3996348 - RNA, 23 nt, Staphylococcus aureus subsp. aureus Mu50
ucugaauacacgacgcuaaacaa

SEQ ID NO: 3996349 - RNA, 12 nt, Staphylococcus aureus subsp. aureus Mu50
ucugaaucugaa

SEQ ID NO: 3996350 - RNA, 12 nt, Staphylococcus aureus subsp. aureus Mu50
ucugaauuuagg

SEQ ID NO: 3996351 - RNA, 13 nt, Staphylococcus aureus subsp. aureus Mu50
ucugaauuuagga

SEQ ID NO: 3996352 - RNA, 14 nt, Staphylococcus aureus subsp. aureus Mu50
ucugaauuuuucaa

SEQ ID NO: 3996353 - RNA, 20 nt, Staphylococcus aureus subsp. aureus Mu50
ucugacauuguugcuaaucu

SEQ ID NO: 3996354 - RNA, 20 nt, Staphylococcus aureus subsp. aureus Mu50
ucugacauuucaucaauaau

SEQ ID NO: 3996355 - RNA, 22 nt, Staphylococcus aureus subsp. aureus Mu50
ucugacauuucaucaauaauuu

SEQ ID NO: 3996356 - RNA, 14 nt, Staphylococcus aureus subsp. aureus Mu50
ucugacuuuuaaaa

SEQ ID NO: 3996357 - RNA, 19 nt, Staphylococcus aureus subsp. aureus Mu50
ucugagaagaaauauauug

SEQ ID NO: 3996358 - RNA, 21 nt, Staphylococcus aureus subsp. aureus Mu50
ucugauacaucaucgccagca

SEQ ID NO: 3996359 - RNA, 15 nt, Staphylococcus aureus subsp. aureus Mu50
ucugaucgacuaauu

SEQ ID NO: 3996360 - RNA, 20 nt, Staphylococcus aureus subsp. aureus Mu50
ucugaugucgaaaauagcua

SEQ ID NO: 3996361 - RNA, 14 nt, Staphylococcus aureus subsp. aureus Mu50
ucugauguguuaug

SEQ ID NO: 3996362 - RNA, 17 nt, Staphylococcus aureus subsp. aureus Mu50
ucugauucuucacuaaa

SEQ ID NO: 3996363 - RNA, 22 nt, Staphylococcus aureus subsp. aureus Mu50
ucugauucuucacuaaaaauau

SEQ ID NO: 3996364 - RNA, 22 nt, Staphylococcus aureus subsp. aureus Mu50
ucugauuucacuucuaaaacua

SEQ ID NO: 3996365 - RNA, 23 nt, Staphylococcus aureus subsp. aureus Mu50
ucugauuucacuucuaaaacuaa

SEQ ID NO: 3996366 - RNA, 13 nt, Staphylococcus aureus subsp. aureus Mu50
ucugcaauuucau

SEQ ID NO: 3996367 - RNA, 15 nt, Staphylococcus aureus subsp. aureus Mu50
ucugcaauuucauag

SEQ ID NO: 3996368 - RNA, 19 nt, Staphylococcus aureus subsp. aureus Mu50
ucugcaugggcuucugcua

SEQ ID NO: 3996369 - RNA, 13 nt, Staphylococcus aureus subsp. aureus Mu50
ucugcuaauuuau

SEQ ID NO: 3996370 - RNA, 14 nt, Staphylococcus aureus subsp. aureus Mu50
ucugcuacuuguug

SEQ ID NO: 3996371 - RNA, 17 nt, Staphylococcus aureus subsp. aureus Mu50
ucugcucuuuuuguaug

SEQ ID NO: 3996372 - RNA, 13 nt, Staphylococcus aureus subsp. aureus Mu50
ucugcugcuguug

SEQ ID NO: 3996373 - RNA, 15 nt, Staphylococcus aureus subsp. aureus Mu50
ucugcugcuuucaua

SEQ ID NO: 3996374 - RNA, 14 nt, Staphylococcus aureus subsp. aureus Mu50
ucugcuucuaaaac

SEQ ID NO: 3996375 - RNA, 14 nt, Staphylococcus aureus subsp. aureus Mu50
ucugcuucuuuuaa

SEQ ID NO: 3996376 - RNA, 14 nt, Staphylococcus aureus subsp. aureus Mu50
ucugcuuuaauaua

SEQ ID NO: 3996377 - RNA, 13 nt, Staphylococcus aureus subsp. aureus Mu50
ucugcuuuauuuu

SEQ ID NO: 3996378 - RNA, 15 nt, Staphylococcus aureus subsp. aureus Mu50
ucugcuuuauuuuau

SEQ ID NO: 3996379 - RNA, 14 nt, Staphylococcus aureus subsp. aureus Mu50
ucugcuuuucuauu

SEQ ID NO: 3996380 - RNA, 15 nt, Staphylococcus aureus subsp. aureus Mu50
ucuggaacuuuaaua

SEQ ID NO: 3996381 - RNA, 22 nt, Staphylococcus aureus subsp. aureus Mu50
ucugguauuuuaugacguaauu

SEQ ID NO: 3996382 - RNA, 17 nt, Staphylococcus aureus subsp. aureus Mu50
ucuggucugugauauuc

SEQ ID NO: 3996383 - RNA, 21 nt, Staphylococcus aureus subsp. aureus Mu50
ucuggugaaaacccugaagau

SEQ ID NO: 3996384 - RNA, 20 nt, Staphylococcus aureus subsp. aureus Mu50
ucugguucuuuacuaaagau

SEQ ID NO: 3996385 - RNA, 21 nt, Staphylococcus aureus subsp. aureus Mu50
ucuguaaauuaucuaaagaaa

SEQ ID NO: 3996386 - RNA, 23 nt, Staphylococcus aureus subsp. aureus Mu50
ucuguaaccaaaagaaauucgcu

SEQ ID NO: 3996387 - RNA, 15 nt, Staphylococcus aureus subsp. aureus Mu50
ucuguaauaaagaau

SEQ ID NO: 3996388 - RNA, 22 nt, Staphylococcus aureus subsp. aureus Mu50
ucuguaauaugaaggcuuuuug

SEQ ID NO: 3996389 - RNA, 15 nt, Staphylococcus aureus subsp. aureus Mu50
ucuguaauuaaucca

SEQ ID NO: 3996390 - RNA, 19 nt, Staphylococcus aureus subsp. aureus Mu50
ucuguacguuuuaaauaaa

SEQ ID NO: 3996391 - RNA, 20 nt, Staphylococcus aureus subsp. aureus Mu50
ucuguacguuuuaaauaaau

SEQ ID NO: 3996392 - RNA, 19 nt, Staphylococcus aureus subsp. aureus Mu50
ucuguagcgauaccuuuaa

SEQ ID NO: 3996393 - RNA, 16 nt, Staphylococcus aureus subsp. aureus Mu50
ucuguauauggcgaua

SEQ ID NO: 3996394 - RNA, 20 nt, Staphylococcus aureus subsp. aureus Mu50
ucuguauauggcgauaacaa

SEQ ID NO: 3996395 - RNA, 13 nt, Staphylococcus aureus subsp. aureus Mu50
ucuguaucaauca

SEQ ID NO: 3996396 - RNA, 23 nt, Staphylococcus aureus subsp. aureus Mu50
ucuguaugcgguuauaucauucu

SEQ ID NO: 3996397 - RNA, 22 nt, Staphylococcus aureus subsp. aureus Mu50
ucuguauggaugcacuccuauu

SEQ ID NO: 3996398 - RNA, 13 nt, Staphylococcus aureus subsp. aureus Mu50
ucuguccaaaaag

SEQ ID NO: 3996399 - RNA, 20 nt, Staphylococcus aureus subsp. aureus Mu50
ucuguccgauaucuuuuaau

SEQ ID NO: 3996400 - RNA, 21 nt, Staphylococcus aureus subsp. aureus Mu50
ucuguccgauaucuuuuaauu

SEQ ID NO: 3996401 - RNA, 16 nt, Staphylococcus aureus subsp. aureus Mu50
ucuguccgauuuuuaa

SEQ ID NO: 3996402 - RNA, 18 nt, Staphylococcus aureus subsp. aureus Mu50
ucugucuaaaaacauaaa

SEQ ID NO: 3996403 - RNA, 20 nt, Staphylococcus aureus subsp. aureus Mu50
ucugucuaaaaacauaaaaa

SEQ ID NO: 3996404 - RNA, 23 nt, Staphylococcus aureus subsp. aureus Mu50
ucugucugaauuagauuuuguug

SEQ ID NO: 3996405 - RNA, 14 nt, Staphylococcus aureus subsp. aureus Mu50
ucuguguaaauaua

SEQ ID NO: 3996406 - RNA, 15 nt, Staphylococcus aureus subsp. aureus Mu50
ucuguguaaauauaa

SEQ ID NO: 3996407 - RNA, 18 nt, Staphylococcus aureus subsp. aureus Mu50
ucuguuaacugaauuucg

SEQ ID NO: 3996408 - RNA, 19 nt, Staphylococcus aureus subsp. aureus Mu50
ucuguuacagguuuuaaaa

SEQ ID NO: 3996409 - RNA, 23 nt, Staphylococcus aureus subsp. aureus Mu50
ucuguuacagguuuuaaaauuaa

SEQ ID NO: 3996410 - RNA, 15 nt, Staphylococcus aureus subsp. aureus Mu50
ucuguugcauuaagu

SEQ ID NO: 3996411 - RNA, 17 nt, Staphylococcus aureus subsp. aureus Mu50
ucuguugucaucauguu

SEQ ID NO: 3996412 - RNA, 16 nt, Staphylococcus aureus subsp. aureus Mu50
ucuguuguuucgaugg

SEQ ID NO: 3996413 - RNA, 13 nt, Staphylococcus aureus subsp. aureus Mu50
ucuguuuaaauuu

SEQ ID NO: 3996414 - RNA, 19 nt, Staphylococcus aureus subsp. aureus Mu50
ucuguuuaaauuuaaaaga

SEQ ID NO: 3996415 - RNA, 16 nt, Staphylococcus aureus subsp. aureus Mu50
ucuuaaaauaugauuu

SEQ ID NO: 3996416 - RNA, 15 nt, Staphylococcus aureus subsp. aureus Mu50
ucuuaaacauaacau

SEQ ID NO: 3996417 - RNA, 17 nt, Staphylococcus aureus subsp. aureus Mu50
ucuuaaagauuuuucag

SEQ ID NO: 3996418 - RNA, 13 nt, Staphylococcus aureus subsp. aureus Mu50
ucuuaaaucacua

SEQ ID NO: 3996419 - RNA, 14 nt, Staphylococcus aureus subsp. aureus Mu50
ucuuaacaacauga

SEQ ID NO: 3996420 - RNA, 16 nt, Staphylococcus aureus subsp. aureus Mu50
ucuuaacaacaugauu

SEQ ID NO: 3996421 - RNA, 16 nt, Staphylococcus aureus subsp. aureus Mu50
ucuuaacaacuuuaau

SEQ ID NO: 3996422 - RNA, 18 nt, Staphylococcus aureus subsp. aureus Mu50
ucuuaacaacuuuaauuu

SEQ ID NO: 3996423 - RNA, 16 nt, Staphylococcus aureus subsp. aureus Mu50
ucuuaaguacauaaau

SEQ ID NO: 3996424 - RNA, 17 nt, Staphylococcus aureus subsp. aureus Mu50
ucuuaaucuaaaaauag

SEQ ID NO: 3996425 - RNA, 12 nt, Staphylococcus aureus subsp. aureus Mu50
ucuuaauguacu

SEQ ID NO: 3996426 - RNA, 13 nt, Staphylococcus aureus subsp. aureus Mu50
ucuuaauuaucau

SEQ ID NO: 3996427 - RNA, 17 nt, Staphylococcus aureus subsp. aureus Mu50
ucuuaauuaucauuaca

SEQ ID NO: 3996428 - RNA, 14 nt, Staphylococcus aureus subsp. aureus Mu50
ucuuaauucuucug

SEQ ID NO: 3996429 - RNA, 16 nt, Staphylococcus aureus subsp. aureus Mu50
ucuuaauuuuucucca

SEQ ID NO: 3996430 - RNA, 15 nt, Staphylococcus aureus subsp. aureus Mu50
ucuuacuacuuaauu

SEQ ID NO: 3996431 - RNA, 17 nt, Staphylococcus aureus subsp. aureus Mu50
ucuuacuacuuaauuaa

SEQ ID NO: 3996432 - RNA, 21 nt, Staphylococcus aureus subsp. aureus Mu50
ucuuuaaagaaaauuucagua

SEQ ID NO: 3996433 - RNA, 18 nt, Staphylococcus aureus subsp. aureus Mu50
ucuuuaaagcuaaauguu

SEQ ID NO: 3996434 - RNA, 17 nt, Staphylococcus aureus subsp. aureus Mu50
ucuuuaacuuuaauuaa

SEQ ID NO: 3996435 - RNA, 19 nt, Staphylococcus aureus subsp. aureus Mu50
ucuuuaagcccuuccccua

SEQ ID NO: 3996436 - RNA, 12 nt, Staphylococcus aureus subsp. aureus Mu50
ucuuuaagugac

SEQ ID NO: 3996437 - RNA, 17 nt, Staphylococcus aureus subsp. aureus Mu50
ucuuuaauauaaauuuu

SEQ ID NO: 3996438 - RNA, 18 nt, Staphylococcus aureus subsp. aureus Mu50
ucuuuaauauaaauuuug

SEQ ID NO: 3996439 - RNA, 16 nt, Staphylococcus aureus subsp. aureus Mu50
ucuuuaaugauaagug

SEQ ID NO: 3996440 - RNA, 17 nt, Staphylococcus aureus subsp. aureus Mu50
ucuuuacgauaaacuaa

SEQ ID NO: 3996441 - RNA, 20 nt, Staphylococcus aureus subsp. aureus Mu50
ucuuuacgauaaacuaaaaa

SEQ ID NO: 3996442 - RNA, 16 nt, Staphylococcus aureus subsp. aureus Mu50
ucuuuacuaaagauag

SEQ ID NO: 3996443 - RNA, 23 nt, Staphylococcus aureus subsp. aureus Mu50
ucuuuacuaaagauagcugcuau

SEQ ID NO: 3996444 - RNA, 18 nt, Staphylococcus aureus subsp. aureus Mu50
ucuuuacuuguaauuaau

SEQ ID NO: 3996445 - RNA, 21 nt, Staphylococcus aureus subsp. aureus Mu50
ucuuuacuuguaauuaauaca

SEQ ID NO: 3996446 - RNA, 16 nt, Staphylococcus aureus subsp. aureus Mu50
ucuuuagaugagauuu

SEQ ID NO: 3996447 - RNA, 22 nt, Staphylococcus aureus subsp. aureus Mu50
ucuuuagcuauguaaaauuauu

SEQ ID NO: 3996448 - RNA, 16 nt, Staphylococcus aureus subsp. aureus Mu50
ucuuuauaaaaaaauc

SEQ ID NO: 3996449 - RNA, 18 nt, Staphylococcus aureus subsp. aureus Mu50
ucuuuauauauaaaauca

SEQ ID NO: 3996450 - RNA, 13 nt, Staphylococcus aureus subsp. aureus Mu50
ucuuuauauuuau

SEQ ID NO: 3996451 - RNA, 14 nt, Staphylococcus aureus subsp. aureus Mu50
ucuuuauauuuauc

SEQ ID NO: 3996452 - RNA, 21 nt, Staphylococcus aureus subsp. aureus Mu50
ucuuuaucaacauaaaauuua

SEQ ID NO: 3996453 - RNA, 13 nt, Staphylococcus aureus subsp. aureus Mu50
ucuuuaucauuau

SEQ ID NO: 3996454 - RNA, 22 nt, Staphylococcus aureus subsp. aureus Mu50
ucuuuaucuauaugcauauauu

SEQ ID NO: 3996455 - RNA, 14 nt, Staphylococcus aureus subsp. aureus Mu50
ucuuuaugauaauu

SEQ ID NO: 3996456 - RNA, 16 nt, Staphylococcus aureus subsp. aureus Mu50
ucuuuaugauaauuaa

SEQ ID NO: 3996457 - RNA, 17 nt, Staphylococcus aureus subsp. aureus Mu50
ucuuuaugauaauuaau

SEQ ID NO: 3996458 - RNA, 22 nt, Staphylococcus aureus subsp. aureus Mu50
ucuuuaugauaauuaauuaaaa

SEQ ID NO: 3996459 - RNA, 14 nt, Staphylococcus aureus subsp. aureus Mu50
ucuuuauguuugau

SEQ ID NO: 3996460 - RNA, 13 nt, Staphylococcus aureus subsp. aureus Mu50
ucuuuauuaauaa

SEQ ID NO: 3996461 - RNA, 16 nt, Staphylococcus aureus subsp. aureus Mu50
ucuuuauuaauaaauu

SEQ ID NO: 3996462 - RNA, 17 nt, Staphylococcus aureus subsp. aureus Mu50
ucuuuauuaauaaauuc

SEQ ID NO: 3996463 - RNA, 23 nt, Staphylococcus aureus subsp. aureus Mu50
ucuuuauuagaaugaaaccguau

SEQ ID NO: 3996464 - RNA, 13 nt, Staphylococcus aureus subsp. aureus Mu50
ucuuuauuuaaag

SEQ ID NO: 3996465 - RNA, 13 nt, Staphylococcus aureus subsp. aureus Mu50
ucuuuauuuacaa

SEQ ID NO: 3996466 - RNA, 21 nt, Staphylococcus aureus subsp. aureus Mu50
ucuuuauuugauucuucacca

SEQ ID NO: 3996467 - RNA, 16 nt, Staphylococcus aureus subsp. aureus Mu50
ucuuuauuuuaaacau

SEQ ID NO: 3996468 - RNA, 18 nt, Staphylococcus aureus subsp. aureus Mu50
ucuuuauuuuuuaucauu

SEQ ID NO: 3996469 - RNA, 23 nt, Staphylococcus aureus subsp. aureus Mu50
ucuuucaagaccuucuucucuaa

SEQ ID NO: 3996470 - RNA, 22 nt, Staphylococcus aureus subsp. aureus Mu50
ucuuucaauuaauuuaaaugcu

SEQ ID NO: 3996471 - RNA, 23 nt, Staphylococcus aureus subsp. aureus Mu50
ucuuucaauuaauuuaaaugcuu

SEQ ID NO: 3996472 - RNA, 14 nt, Staphylococcus aureus subsp. aureus Mu50
ucuuucagcuaauu

SEQ ID NO: 3996473 - RNA, 19 nt, Staphylococcus aureus subsp. aureus Mu50
ucuuucagcuaauucgucu

SEQ ID NO: 3996474 - RNA, 19 nt, Staphylococcus aureus subsp. aureus Mu50
ucuuucauaguuauuaaau

SEQ ID NO: 3996475 - RNA, 14 nt, Staphylococcus aureus subsp. aureus Mu50
ucuuuccauaauaa

SEQ ID NO: 3996476 - RNA, 15 nt, Staphylococcus aureus subsp. aureus Mu50
ucuuuccucacuaga

SEQ ID NO: 3996477 - RNA, 21 nt, Staphylococcus aureus subsp. aureus Mu50
ucuuucgucuuguaaacuucu

SEQ ID NO: 3996478 - RNA, 15 nt, Staphylococcus aureus subsp. aureus Mu50
ucuuucucuauuaau

SEQ ID NO: 3996479 - RNA, 13 nt, Staphylococcus aureus subsp. aureus Mu50
ucuuucugaagaa

SEQ ID NO: 3996480 - RNA, 17 nt, Staphylococcus aureus subsp. aureus Mu50
ucuuucugaagaacgau

SEQ ID NO: 3996481 - RNA, 22 nt, Staphylococcus aureus subsp. aureus Mu50
ucuuucuuagugaaucuucuaa

SEQ ID NO: 3996482 - RNA, 20 nt, Staphylococcus aureus subsp. aureus Mu50
ucuuucuucagaaccuugaa

SEQ ID NO: 3996483 - RNA, 19 nt, Staphylococcus aureus subsp. aureus Mu50
ucuuucuuguucuaaaaua

SEQ ID NO: 3996484 - RNA, 20 nt, Staphylococcus aureus subsp. aureus Mu50
ucuuucuuguucuaaaauaa

SEQ ID NO: 3996485 - RNA, 13 nt, Staphylococcus aureus subsp. aureus Mu50
ucuuucuuuucug

SEQ ID NO: 3996486 - RNA, 19 nt, Staphylococcus aureus subsp. aureus Mu50
ucuuugaacauauuauaaa

SEQ ID NO: 3996487 - RNA, 21 nt, Staphylococcus aureus subsp. aureus Mu50
ucuuugaacauauuauaaaag

SEQ ID NO: 3996488 - RNA, 22 nt, Staphylococcus aureus subsp. aureus Mu50
ucuuugacauguguuaaaccaa

SEQ ID NO: 3996489 - RNA, 20 nt, Staphylococcus aureus subsp. aureus Mu50
ucuuugauaacaauuuuaaa

SEQ ID NO: 3996490 - RNA, 16 nt, Staphylococcus aureus subsp. aureus Mu50
ucuuugauuaaaucuu

SEQ ID NO: 3996491 - RNA, 13 nt, Staphylococcus aureus subsp. aureus Mu50
ucuuuguaaauuu

SEQ ID NO: 3996492 - RNA, 14 nt, Staphylococcus aureus subsp. aureus Mu50
ucuuuguaaauuuu

SEQ ID NO: 3996493 - RNA, 19 nt, Staphylococcus aureus subsp. aureus Mu50
ucuuuguaaccuaaaaaca

SEQ ID NO: 3996494 - RNA, 22 nt, Staphylococcus aureus subsp. aureus Mu50
ucuuuguauaccuauuccuauu

SEQ ID NO: 3996495 - RNA, 15 nt, Staphylococcus aureus subsp. aureus Mu50
ucuuugucaucuuuu

SEQ ID NO: 3996496 - RNA, 18 nt, Staphylococcus aureus subsp. aureus Mu50
ucuuuguguuugcuuuua

SEQ ID NO: 3996497 - RNA, 18 nt, Staphylococcus aureus subsp. aureus Mu50
ucuuuguguuugcuuuuu

SEQ ID NO: 3996498 - RNA, 21 nt, Staphylococcus aureus subsp. aureus Mu50
ucuuuguuggggcccacaccc

SEQ ID NO: 3996499 - RNA, 23 nt, Staphylococcus aureus subsp. aureus Mu50
ucuuuguuggggcccacacccca

SEQ ID NO: 3996500 - RNA, 16 nt, Staphylococcus aureus subsp. aureus Mu50
ucuuuguuuuuaauuu

SEQ ID NO: 3996501 - RNA, 20 nt, Staphylococcus aureus subsp. aureus Mu50
ucuuuuaaauucuuauaaaa

SEQ ID NO: 3996502 - RNA, 22 nt, Staphylococcus aureus subsp. aureus Mu50
ucuuuuaaauucuuauaaaaua

SEQ ID NO: 3996503 - RNA, 13 nt, Staphylococcus aureus subsp. aureus Mu50
ucuuuuaaauuua

SEQ ID NO: 3996504 - RNA, 18 nt, Staphylococcus aureus subsp. aureus Mu50
ucuuuuaacccacauuaa

SEQ ID NO: 3996505 - RNA, 20 nt, Staphylococcus aureus subsp. aureus Mu50
ucuuuuaauagaucuuugua

SEQ ID NO: 3996506 - RNA, 12 nt, Staphylococcus aureus subsp. aureus Mu50
ucuuuuaauuaa

SEQ ID NO: 3996507 - RNA, 23 nt, Staphylococcus aureus subsp. aureus Mu50
ucuuuuaccucugauaaaugaau

SEQ ID NO: 3996508 - RNA, 15 nt, Staphylococcus aureus subsp. aureus Mu50
ucuuuuauacaugua

SEQ ID NO: 3996509 - RNA, 13 nt, Staphylococcus aureus subsp. aureus Mu50
ucuuuuauauuuu

SEQ ID NO: 3996510 - RNA, 21 nt, Staphylococcus aureus subsp. aureus Mu50
ucuuuuauuaugauauacgag

SEQ ID NO: 3996511 - RNA, 17 nt, Staphylococcus aureus subsp. aureus Mu50
ucuuuucaaaaauaguc

SEQ ID NO: 3996512 - RNA, 18 nt, Staphylococcus aureus subsp. aureus Mu50
ucuuuugaaucuuguuga

SEQ ID NO: 3996513 - RNA, 12 nt, Staphylococcus aureus subsp. aureus Mu50
ucuuuuguaaga

SEQ ID NO: 3996514 - RNA, 15 nt, Staphylococcus aureus subsp. aureus Mu50
ucuuuuguuguuuuu

SEQ ID NO: 3996515 - RNA, 12 nt, Staphylococcus aureus subsp. aureus Mu50
ucuuuuguuuua

SEQ ID NO: 3996516 - RNA, 21 nt, Staphylococcus aureus subsp. aureus Mu50
ucuuuuguuuucacuguuuua

SEQ ID NO: 3996517 - RNA, 15 nt, Staphylococcus aureus subsp. aureus Mu50
ucuuuuguuuuuaua

SEQ ID NO: 3996518 - RNA, 13 nt, Staphylococcus aureus subsp. aureus Mu50
ucuuuuuaaaagg

SEQ ID NO: 3996519 - RNA, 17 nt, Staphylococcus aureus subsp. aureus Mu50
ugaaauuuauuauaauu

SEQ ID NO: 3996520 - RNA, 13 nt, Staphylococcus aureus subsp. aureus Mu50
ugaaauuucauaa

SEQ ID NO: 3996521 - RNA, 14 nt, Staphylococcus aureus subsp. aureus Mu50
ugaaauuucauaaa

SEQ ID NO: 3996522 - RNA, 17 nt, Staphylococcus aureus subsp. aureus Mu50
ugaaauuucgacaucua

SEQ ID NO: 3996523 - RNA, 15 nt, Staphylococcus aureus subsp. aureus Mu50
ugaaauuuuuaauau

SEQ ID NO: 3996524 - RNA, 20 nt, Staphylococcus aureus subsp. aureus Mu50
ugaaauuuuuaauauacccc

SEQ ID NO: 3996525 - RNA, 13 nt, Staphylococcus aureus subsp. aureus Mu50
ugaaauuuuuccg

SEQ ID NO: 3996526 - RNA, 19 nt, Staphylococcus aureus subsp. aureus Mu50
ugaaauuuuuuagugaaaa

SEQ ID NO: 3996527 - RNA, 20 nt, Staphylococcus aureus subsp. aureus Mu50
ugaaauuuuuuagugaaaaa

SEQ ID NO: 3996528 - RNA, 21 nt, Staphylococcus aureus subsp. aureus Mu50
ugaaauuuuuuagugaaaaag

SEQ ID NO: 3996529 - RNA, 16 nt, Staphylococcus aureus subsp. aureus Mu50
ugaacaaauaauuuac

SEQ ID NO: 3996530 - RNA, 22 nt, Staphylococcus aureus subsp. aureus Mu50
ugaacaacaaauugugauuuac

SEQ ID NO: 3996531 - RNA, 22 nt, Staphylococcus aureus subsp. aureus Mu50
ugaacaacaucuuuuguuguuu

SEQ ID NO: 3996532 - RNA, 19 nt, Staphylococcus aureus subsp. aureus Mu50
ugaacaaucagauaaguua

SEQ ID NO: 3996533 - RNA, 13 nt, Staphylococcus aureus subsp. aureus Mu50
ugaacaauucuuc

SEQ ID NO: 3996534 - RNA, 19 nt, Staphylococcus aureus subsp. aureus Mu50
ugaacaauucuucaucaug

SEQ ID NO: 3996535 - RNA, 17 nt, Staphylococcus aureus subsp. aureus Mu50
ugaacaguuagugcuug

SEQ ID NO: 3996536 - RNA, 15 nt, Staphylococcus aureus subsp. aureus Mu50
ugaacauaaaaaaua

SEQ ID NO: 3996537 - RNA, 21 nt, Staphylococcus aureus subsp. aureus Mu50
ugaacauaccugcauaugugu

SEQ ID NO: 3996538 - RNA, 20 nt, Staphylococcus aureus subsp. aureus Mu50
ugaacauauuauaaaagugu

SEQ ID NO: 3996539 - RNA, 18 nt, Staphylococcus aureus subsp. aureus Mu50
ugaacaucauuuaauuga

SEQ ID NO: 3996540 - RNA, 22 nt, Staphylococcus aureus subsp. aureus Mu50
ugaaccaagaaugugaugauua

SEQ ID NO: 3996541 - RNA, 19 nt, Staphylococcus aureus subsp. aureus Mu50
ugaaccagcuaaccaaaua

SEQ ID NO: 3996542 - RNA, 20 nt, Staphylococcus aureus subsp. aureus Mu50
ugaaccagcuaaccaaauaa

SEQ ID NO: 3996543 - RNA, 17 nt, Staphylococcus aureus subsp. aureus Mu50
ugaaccccauucacuac

SEQ ID NO: 3996544 - RNA, 22 nt, Staphylococcus aureus subsp. aureus Mu50
ugaaccccauucacuacuuuuu

SEQ ID NO: 3996545 - RNA, 15 nt, Staphylococcus aureus subsp. aureus Mu50
ugaaccggaaauuaa

SEQ ID NO: 3996546 - RNA, 18 nt, Staphylococcus aureus subsp. aureus Mu50
ugaacgauaacaauuuau

SEQ ID NO: 3996547 - RNA, 21 nt, Staphylococcus aureus subsp. aureus Mu50
ugaacgguuguauuucaucau

SEQ ID NO: 3996548 - RNA, 11 nt, Staphylococcus aureus subsp. aureus Mu50
ugaacuaaaac

SEQ ID NO: 3996549 - RNA, 13 nt, Staphylococcus aureus subsp. aureus Mu50
ugaacuaaaacga

SEQ ID NO: 3996550 - RNA, 13 nt, Staphylococcus aureus subsp. aureus Mu50
ugaacuaaauuga

SEQ ID NO: 3996551 - RNA, 13 nt, Staphylococcus aureus subsp. aureus Mu50
ugaacuuaaugcu

SEQ ID NO: 3996552 - RNA, 15 nt, Staphylococcus aureus subsp. aureus Mu50
ugaacuuauaagucc

SEQ ID NO: 3996553 - RNA, 15 nt, Staphylococcus aureus subsp. aureus Mu50
ugaacuucucuuagu

SEQ ID NO: 3996554 - RNA, 14 nt, Staphylococcus aureus subsp. aureus Mu50
ugaacuucuuuuuu

SEQ ID NO: 3996555 - RNA, 15 nt, Staphylococcus aureus subsp. aureus Mu50
ugaacuuuguaucuu

SEQ ID NO: 3996556 - RNA, 12 nt, Staphylococcus aureus subsp. aureus Mu50
ugaacuuuuauu

SEQ ID NO: 3996557 - RNA, 15 nt, Staphylococcus aureus subsp. aureus Mu50
ugaagaaauuugaug

SEQ ID NO: 3996558 - RNA, 20 nt, Staphylococcus aureus subsp. aureus Mu50
ugaagaacgaucuguccauu

SEQ ID NO: 3996559 - RNA, 19 nt, Staphylococcus aureus subsp. aureus Mu50
ugaagaaggaugaguuuaa

SEQ ID NO: 3996560 - RNA, 19 nt, Staphylococcus aureus subsp. aureus Mu50
ugaagaugcuuuaauuaaa

SEQ ID NO: 3996561 - RNA, 23 nt, Staphylococcus aureus subsp. aureus Mu50
ugaagcgcuuggauuuuuugguu

SEQ ID NO: 3996562 - RNA, 22 nt, Staphylococcus aureus subsp. aureus Mu50
ugaagcguucgugauagaaguu

SEQ ID NO: 3996563 - RNA, 18 nt, Staphylococcus aureus subsp. aureus Mu50
ugaaggagauauuuucuu

SEQ ID NO: 3996564 - RNA, 17 nt, Staphylococcus aureus subsp. aureus Mu50
ugaaggccauuuuuauu

SEQ ID NO: 3996565 - RNA, 19 nt, Staphylococcus aureus subsp. aureus Mu50
ugaaggccauuuuuauuua

SEQ ID NO: 3996566 - RNA, 24 nt, Staphylococcus aureus subsp. aureus Mu50
ugaaggccauuuuuauuuaacacu

SEQ ID NO: 3996567 - RNA, 17 nt, Staphylococcus aureus subsp. aureus Mu50
ugaagggagcauuucau

SEQ ID NO: 3996568 - RNA, 18 nt, Staphylococcus aureus subsp. aureus Mu50
ugaagggagcauuucauu

SEQ ID NO: 3996569 - RNA, 19 nt, Staphylococcus aureus subsp. aureus Mu50
ugaagggagcauuucauua

SEQ ID NO: 3996570 - RNA, 17 nt, Staphylococcus aureus subsp. aureus Mu50
ugaagggguuuuuucuu

SEQ ID NO: 3996571 - RNA, 15 nt, Staphylococcus aureus subsp. aureus Mu50
ugaaguaagucauau

SEQ ID NO: 3996572 - RNA, 18 nt, Staphylococcus aureus subsp. aureus Mu50
ugaaguacauuaaaacaa

SEQ ID NO: 3996573 - RNA, 20 nt, Staphylococcus aureus subsp. aureus Mu50
ugaaguaugcacaucauuga

SEQ ID NO: 3996574 - RNA, 19 nt, Staphylococcus aureus subsp. aureus Mu50
ugaaguauugccaaauuuc

SEQ ID NO: 3996575 - RNA, 21 nt, Staphylococcus aureus subsp. aureus Mu50
ugaagucuugugauaauucuu

SEQ ID NO: 3996576 - RNA, 20 nt, Staphylococcus aureus subsp. aureus Mu50
ugaaguuugaacaacaucuu

SEQ ID NO: 3996577 - RNA, 18 nt, Staphylococcus aureus subsp. aureus Mu50
ugaauaaagcuaacauac

SEQ ID NO: 3996578 - RNA, 21 nt, Staphylococcus aureus subsp. aureus Mu50
ugaauaaagcuaacauaccua

SEQ ID NO: 3996579 - RNA, 20 nt, Staphylococcus aureus subsp. aureus Mu50
ugaauaaauagauaauauau

SEQ ID NO: 3996580 - RNA, 13 nt, Staphylococcus aureus subsp. aureus Mu50
ugaauaacaagaa

SEQ ID NO: 3996581 - RNA, 14 nt, Staphylococcus aureus subsp. aureus Mu50
ugaauaauauauuu

SEQ ID NO: 3996582 - RNA, 22 nt, Staphylococcus aureus subsp. aureus Mu50
ugaauaaucauccauauaugcc

SEQ ID NO: 3996583 - RNA, 14 nt, Staphylococcus aureus subsp. aureus Mu50
ugaauaauggaugu

SEQ ID NO: 3996584 - RNA, 16 nt, Staphylococcus aureus subsp. aureus Mu50
ugaauaauguuuccau

SEQ ID NO: 3996585 - RNA, 15 nt, Staphylococcus aureus subsp. aureus Mu50
ugaauaauguuuuca

SEQ ID NO: 3996586 - RNA, 14 nt, Staphylococcus aureus subsp. aureus Mu50
ugaauaauuaaaaa

SEQ ID NO: 3996587 - RNA, 11 nt, Staphylococcus aureus subsp. aureus Mu50
ugaauaauucc

SEQ ID NO: 3996588 - RNA, 22 nt, Staphylococcus aureus subsp. aureus Mu50
ugaauaauugcuaaaauaucaa

SEQ ID NO: 3996589 - RNA, 14 nt, Staphylococcus aureus subsp. aureus Mu50
ugaauaauuucagu

SEQ ID NO: 3996590 - RNA, 22 nt, Staphylococcus aureus subsp. aureus Mu50
ugaauaauuucaguucuuagau

SEQ ID NO: 3996591 - RNA, 21 nt, Staphylococcus aureus subsp. aureus Mu50
ugaauacacgacgcuaaacaa

SEQ ID NO: 3996592 - RNA, 17 nt, Staphylococcus aureus subsp. aureus Mu50
ugaauacuuuauuugau

SEQ ID NO: 3996593 - RNA, 20 nt, Staphylococcus aureus subsp. aureus Mu50
ugaauaguagugauaucgcu

SEQ ID NO: 3996594 - RNA, 22 nt, Staphylococcus aureus subsp. aureus Mu50
ugaauagugagcguauuauuau

SEQ ID NO: 3996595 - RNA, 13 nt, Staphylococcus aureus subsp. aureus Mu50
ugaauauaaaaaa

SEQ ID NO: 3996596 - RNA, 18 nt, Staphylococcus aureus subsp. aureus Mu50
ugaauauacuuaauuuaa

SEQ ID NO: 3996597 - RNA, 22 nt, Staphylococcus aureus subsp. aureus Mu50
ugaauauacuuaauuuaaaucu

SEQ ID NO: 3996598 - RNA, 16 nt, Staphylococcus aureus subsp. aureus Mu50
ugaauaugauauuaag

SEQ ID NO: 3996599 - RNA, 17 nt, Staphylococcus aureus subsp. aureus Mu50
ugaauauggaaaaugua

SEQ ID NO: 3996600 - RNA, 16 nt, Staphylococcus aureus subsp. aureus Mu50
ugaauauuauucauaa

SEQ ID NO: 3996601 - RNA, 15 nt, Staphylococcus aureus subsp. aureus Mu50
ugaaucauuuuagca

SEQ ID NO: 3996602 - RNA, 20 nt, Staphylococcus aureus subsp. aureus Mu50
ugaaucgauauaaugaaguu

SEQ ID NO: 3996603 - RNA, 17 nt, Staphylococcus aureus subsp. aureus Mu50
ugaaucggugucuuuau

SEQ ID NO: 3996604 - RNA, 14 nt, Staphylococcus aureus subsp. aureus Mu50
ugaaucuaaacuau

SEQ ID NO: 3996605 - RNA, 18 nt, Staphylococcus aureus subsp. aureus Mu50
ugaaucuaaacuauaaua

SEQ ID NO: 3996606 - RNA, 16 nt, Staphylococcus aureus subsp. aureus Mu50
ugacgcugguaauauu

SEQ ID NO: 3996607 - RNA, 15 nt, Staphylococcus aureus subsp. aureus Mu50
ugacguaauuaauag

SEQ ID NO: 3996608 - RNA, 20 nt, Staphylococcus aureus subsp. aureus Mu50
ugacgugcuuuuaaauguau

SEQ ID NO: 3996609 - RNA, 19 nt, Staphylococcus aureus subsp. aureus Mu50
ugacguucugaucggcuuu

SEQ ID NO: 3996610 - RNA, 18 nt, Staphylococcus aureus subsp. aureus Mu50
ugacguuuugguuguucu

SEQ ID NO: 3996611 - RNA, 15 nt, Staphylococcus aureus subsp. aureus Mu50
ugacuaauaaaacuu

SEQ ID NO: 3996612 - RNA, 22 nt, Staphylococcus aureus subsp. aureus Mu50
ugacuacucaauccuaaauuau

SEQ ID NO: 3996613 - RNA, 18 nt, Staphylococcus aureus subsp. aureus Mu50
ugacuagccuucaauauu

SEQ ID NO: 3996614 - RNA, 13 nt, Staphylococcus aureus subsp. aureus Mu50
ugacuagggguuu

SEQ ID NO: 3996615 - RNA, 18 nt, Staphylococcus aureus subsp. aureus Mu50
ugacuagggguuuuuaau

SEQ ID NO: 3996616 - RNA, 19 nt, Staphylococcus aureus subsp. aureus Mu50
ugacuagggguuuuuaaua

SEQ ID NO: 3996617 - RNA, 23 nt, Staphylococcus aureus subsp. aureus Mu50
ugacuauuucgcuuuuuuuauuu

SEQ ID NO: 3996618 - RNA, 17 nt, Staphylococcus aureus subsp. aureus Mu50
ugacucaguuauauuaa

SEQ ID NO: 3996619 - RNA, 21 nt, Staphylococcus aureus subsp. aureus Mu50
ugacucggggaauuuuuaugc

SEQ ID NO: 3996620 - RNA, 12 nt, Staphylococcus aureus subsp. aureus Mu50
ugacugaaugag

SEQ ID NO: 3996621 - RNA, 17 nt, Staphylococcus aureus subsp. aureus Mu50
ugacugagaaaaauauu

SEQ ID NO: 3996622 - RNA, 21 nt, Staphylococcus aureus subsp. aureus Mu50
ugacugagaaaaauauuucua

SEQ ID NO: 3996623 - RNA, 20 nt, Staphylococcus aureus subsp. aureus Mu50
ugacugauuuuuuuuaugca

SEQ ID NO: 3996624 - RNA, 21 nt, Staphylococcus aureus subsp. aureus Mu50
ugacugauuuuuuuuaugcac

SEQ ID NO: 3996625 - RNA, 16 nt, Staphylococcus aureus subsp. aureus Mu50
ugacugcaaauacgag

SEQ ID NO: 3996626 - RNA, 18 nt, Staphylococcus aureus subsp. aureus Mu50
ugacuuauuuuucaucau

SEQ ID NO: 3996627 - RNA, 21 nt, Staphylococcus aureus subsp. aureus Mu50
ugacuuuaucaauugaaugaa

SEQ ID NO: 3996628 - RNA, 14 nt, Staphylococcus aureus subsp. aureus Mu50
ugacuuuauuucua

SEQ ID NO: 3996629 - RNA, 19 nt, Staphylococcus aureus subsp. aureus Mu50
ugacuuuauuucuauaucu

SEQ ID NO: 3996630 - RNA, 17 nt, Staphylococcus aureus subsp. aureus Mu50
ugacuuugucuuuaaug

SEQ ID NO: 3996631 - RNA, 14 nt, Staphylococcus aureus subsp. aureus Mu50
ugacuuuuaaaaaa

SEQ ID NO: 3996632 - RNA, 16 nt, Staphylococcus aureus subsp. aureus Mu50
ugacuuuuaaaaaaca

SEQ ID NO: 3996633 - RNA, 23 nt, Staphylococcus aureus subsp. aureus Mu50
ugacuuuuaaaaaacauaccugc

SEQ ID NO: 3996634 - RNA, 13 nt, Staphylococcus aureus subsp. aureus Mu50
ugacuuuuuaaua

SEQ ID NO: 3996635 - RNA, 18 nt, Staphylococcus aureus subsp. aureus Mu50
ugagaaaaauauuucuaa

SEQ ID NO: 3996636 - RNA, 14 nt, Staphylococcus aureus subsp. aureus Mu50
ugagaaaguaaaag

SEQ ID NO: 3996637 - RNA, 14 nt, Staphylococcus aureus subsp. aureus Mu50
ugagaauauuaaga

SEQ ID NO: 3996638 - RNA, 17 nt, Staphylococcus aureus subsp. aureus Mu50
ugagaauugcaacgcau

SEQ ID NO: 3996639 - RNA, 13 nt, Staphylococcus aureus subsp. aureus Mu50
ugagaauuucuaa

SEQ ID NO: 3996640 - RNA, 15 nt, Staphylococcus aureus subsp. aureus Mu50
ugagaauuucuaauu

SEQ ID NO: 3996641 - RNA, 16 nt, Staphylococcus aureus subsp. aureus Mu50
ugagaauuucuaauua

SEQ ID NO: 3996642 - RNA, 13 nt, Staphylococcus aureus subsp. aureus Mu50
ugagacgcauugc

SEQ ID NO: 3996643 - RNA, 16 nt, Staphylococcus aureus subsp. aureus Mu50
ugagagauuauuuaaa

SEQ ID NO: 3996644 - RNA, 12 nt, Staphylococcus aureus subsp. aureus Mu50
ugagauaaaauc

SEQ ID NO: 3996645 - RNA, 15 nt, Staphylococcus aureus subsp. aureus Mu50
ugagauaaaaucaua

SEQ ID NO: 3996646 - RNA, 22 nt, Staphylococcus aureus subsp. aureus Mu50
ugagauacguuauuucaauaau

SEQ ID NO: 3996647 - RNA, 17 nt, Staphylococcus aureus subsp. aureus Mu50
ugagauaucuuauaaca

SEQ ID NO: 3996648 - RNA, 13 nt, Staphylococcus aureus subsp. aureus Mu50
ugagauggucuuu

SEQ ID NO: 3996649 - RNA, 16 nt, Staphylococcus aureus subsp. aureus Mu50
ugagauggucuuuuaa

SEQ ID NO: 3996650 - RNA, 16 nt, Staphylococcus aureus subsp. aureus Mu50
ugagauuaucuuuaga

SEQ ID NO: 3996651 - RNA, 22 nt, Staphylococcus aureus subsp. aureus Mu50
ugagauuauuuuuuuaaaucua

SEQ ID NO: 3996652 - RNA, 14 nt, Staphylococcus aureus subsp. aureus Mu50
ugagcaacaaaaga

SEQ ID NO: 3996653 - RNA, 14 nt, Staphylococcus aureus subsp. aureus Mu50
ugagcaucuugucu

SEQ ID NO: 3996654 - RNA, 13 nt, Staphylococcus aureus subsp. aureus Mu50
ugagcaucuuuua

SEQ ID NO: 3996655 - RNA, 15 nt, Staphylococcus aureus subsp. aureus Mu50
ugagcguauuauuau

SEQ ID NO: 3996656 - RNA, 14 nt, Staphylococcus aureus subsp. aureus Mu50
ugagcuauucauag

SEQ ID NO: 3996657 - RNA, 19 nt, Staphylococcus aureus subsp. aureus Mu50
ugagcucugaaggagacau

SEQ ID NO: 3996658 - RNA, 20 nt, Staphylococcus aureus subsp. aureus Mu50
ugagcuguuacacuuuucuu

SEQ ID NO: 3996659 - RNA, 17 nt, Staphylococcus aureus subsp. aureus Mu50
ugagcuuaauaaauugu

SEQ ID NO: 3996660 - RNA, 16 nt, Staphylococcus aureus subsp. aureus Mu50
ugagcuucuuuaaaua

SEQ ID NO: 3996661 - RNA, 17 nt, Staphylococcus aureus subsp. aureus Mu50
ugagcuuuguuagcauc

SEQ ID NO: 3996662 - RNA, 19 nt, Staphylococcus aureus subsp. aureus Mu50
ugagcuuuguuugaaacaa

SEQ ID NO: 3996663 - RNA, 18 nt, Staphylococcus aureus subsp. aureus Mu50
ugagcuuuucuaaugcua

SEQ ID NO: 3996664 - RNA, 23 nt, Staphylococcus aureus subsp. aureus Mu50
ugaggagauaguaucuuauauuc

SEQ ID NO: 3996665 - RNA, 21 nt, Staphylococcus aureus subsp. aureus Mu50
ugaggccauaagccauaugcu

SEQ ID NO: 3996666 - RNA, 18 nt, Staphylococcus aureus subsp. aureus Mu50
ugaggcccauaaauuacu

SEQ ID NO: 3996667 - RNA, 19 nt, Staphylococcus aureus subsp. aureus Mu50
ugaggcccauaaauuacuu

SEQ ID NO: 3996668 - RNA, 19 nt, Staphylococcus aureus subsp. aureus Mu50
ugaggcguuucagaaguug

SEQ ID NO: 3996669 - RNA, 12 nt, Staphylococcus aureus subsp. aureus Mu50
ugagggccccaa

SEQ ID NO: 3996670 - RNA, 14 nt, Staphylococcus aureus subsp. aureus Mu50
ugagggccccaaca

SEQ ID NO: 3996671 - RNA, 17 nt, Staphylococcus aureus subsp. aureus Mu50
ugagggccccaacacag

SEQ ID NO: 3996672 - RNA, 14 nt, Staphylococcus aureus subsp. aureus Mu50
ugaguaaauuaaua

SEQ ID NO: 3996673 - RNA, 16 nt, Staphylococcus aureus subsp. aureus Mu50
ugaguaaauuaauaga

SEQ ID NO: 3996674 - RNA, 20 nt, Staphylococcus aureus subsp. aureus Mu50
ugaguaaauuaauagagaaa

SEQ ID NO: 3996675 - RNA, 13 nt, Staphylococcus aureus subsp. aureus Mu50
ugaguacaacaua

SEQ ID NO: 3996676 - RNA, 14 nt, Staphylococcus aureus subsp. aureus Mu50
ugaguacaacauag

SEQ ID NO: 3996677 - RNA, 19 nt, Staphylococcus aureus subsp. aureus Mu50
ugaguacaacauagaauaa

SEQ ID NO: 3996678 - RNA, 16 nt, Staphylococcus aureus subsp. aureus Mu50
ugaguaggcucuuaau

SEQ ID NO: 3996679 - RNA, 15 nt, Staphylococcus aureus subsp. aureus Mu50
ugaguauauucaaaa

SEQ ID NO: 3996680 - RNA, 18 nt, Staphylococcus aureus subsp. aureus Mu50
ugaguauauucaaaagga

SEQ ID NO: 3996681 - RNA, 16 nt, Staphylococcus aureus subsp. aureus Mu50
ugaguaucaugcuuuu

SEQ ID NO: 3996682 - RNA, 18 nt, Staphylococcus aureus subsp. aureus Mu50
ugaguaucaugcuuuuaa

SEQ ID NO: 3996683 - RNA, 19 nt, Staphylococcus aureus subsp. aureus Mu50
ugaguaucaugcuuuuaau

SEQ ID NO: 3996684 - RNA, 20 nt, Staphylococcus aureus subsp. aureus Mu50
ugaguaucaugcuuuuaaua

SEQ ID NO: 3996685 - RNA, 15 nt, Staphylococcus aureus subsp. aureus Mu50
ugaguauccaauacu

SEQ ID NO: 3996686 - RNA, 14 nt, Staphylococcus aureus subsp. aureus Mu50
ugaguauuaaauuu

SEQ ID NO: 3996687 - RNA, 15 nt, Staphylococcus aureus subsp. aureus Mu50
ugaguauuaaauuug

SEQ ID NO: 3996688 - RNA, 23 nt, Staphylococcus aureus subsp. aureus Mu50
ugagucuuagacauuguaaaaug

SEQ ID NO: 3996689 - RNA, 20 nt, Staphylococcus aureus subsp. aureus Mu50
ugagugcuuauuuguuuauu

SEQ ID NO: 3996690 - RNA, 23 nt, Staphylococcus aureus subsp. aureus Mu50
ugagugguuuucuuuauuuuaaa

SEQ ID NO: 3996691 - RNA, 21 nt, Staphylococcus aureus subsp. aureus Mu50
ugagugucaugcuuaauuuau

SEQ ID NO: 3996692 - RNA, 17 nt, Staphylococcus aureus subsp. aureus Mu50
ugaguguuuaugaaagu

SEQ ID NO: 3996693 - RNA, 14 nt, Staphylococcus aureus subsp. aureus Mu50
ugaguguuucauaa

SEQ ID NO: 3996694 - RNA, 21 nt, Staphylococcus aureus subsp. aureus Mu50
ugauauugaaaguguaugcau

SEQ ID NO: 3996695 - RNA, 21 nt, Staphylococcus aureus subsp. aureus Mu50
ugauauuuagaauaagaaaua

SEQ ID NO: 3996696 - RNA, 16 nt, Staphylococcus aureus subsp. aureus Mu50
ugauauuucaacuuuu

SEQ ID NO: 3996697 - RNA, 23 nt, Staphylococcus aureus subsp. aureus Mu50
ugauauuucgguuagucuuaauc

SEQ ID NO: 3996698 - RNA, 19 nt, Staphylococcus aureus subsp. aureus Mu50
ugauauuuuucgaauuuaa

SEQ ID NO: 3996699 - RNA, 20 nt, Staphylococcus aureus subsp. aureus Mu50
ugauauuuuucgaauuuaac

SEQ ID NO: 3996700 - RNA, 15 nt, Staphylococcus aureus subsp. aureus Mu50
ugaucaaaaagacag

SEQ ID NO: 3996701 - RNA, 14 nt, Staphylococcus aureus subsp. aureus Mu50
ugaucaaaaauguu

SEQ ID NO: 3996702 - RNA, 14 nt, Staphylococcus aureus subsp. aureus Mu50
ugaucauaauucag

SEQ ID NO: 3996703 - RNA, 16 nt, Staphylococcus aureus subsp. aureus Mu50
ugaucauuauaaaaug

SEQ ID NO: 3996704 - RNA, 20 nt, Staphylococcus aureus subsp. aureus Mu50
ugauccuggaaucgaaaaua

SEQ ID NO: 3996705 - RNA, 19 nt, Staphylococcus aureus subsp. aureus Mu50
ugaucgcauguuuguaaau

SEQ ID NO: 3996706 - RNA, 13 nt, Staphylococcus aureus subsp. aureus Mu50
ugaucuuuuauaa

SEQ ID NO: 3996707 - RNA, 24 nt, Staphylococcus aureus subsp. aureus Mu50
ugaucuuuuuuauauucaacuuau

SEQ ID NO: 3996708 - RNA, 21 nt, Staphylococcus aureus subsp. aureus Mu50
ugaugaaaacuuaaaaaugaa

SEQ ID NO: 3996709 - RNA, 17 nt, Staphylococcus aureus subsp. aureus Mu50
ugaugaacuuaaugcuu

SEQ ID NO: 3996710 - RNA, 13 nt, Staphylococcus aureus subsp. aureus Mu50
ugaugaacuucua

SEQ ID NO: 3996711 - RNA, 13 nt, Staphylococcus aureus subsp. aureus Mu50
ugaugaaugauug

SEQ ID NO: 3996712 - RNA, 20 nt, Staphylococcus aureus subsp. aureus Mu50
ugaugaauuguuguacaugu

SEQ ID NO: 3996713 - RNA, 19 nt, Staphylococcus aureus subsp. aureus Mu50
ugaugagauaaaaucauau

SEQ ID NO: 3996714 - RNA, 17 nt, Staphylococcus aureus subsp. aureus Mu50
ugaugaggcaauauuaa

SEQ ID NO: 3996715 - RNA, 21 nt, Staphylococcus aureus subsp. aureus Mu50
ugaugauaaaaauaaaaccga

SEQ ID NO: 3996716 - RNA, 19 nt, Staphylococcus aureus subsp. aureus Mu50
ugaugauacccgcgauacu

SEQ ID NO: 3996717 - RNA, 21 nt, Staphylococcus aureus subsp. aureus Mu50
ugaugauuuauaaaaacuuau

SEQ ID NO: 3996718 - RNA, 19 nt, Staphylococcus aureus subsp. aureus Mu50
ugaugcuugaauguuugaa

SEQ ID NO: 3996719 - RNA, 15 nt, Staphylococcus aureus subsp. aureus Mu50
ugauguaauucuguu

SEQ ID NO: 3996720 - RNA, 22 nt, Staphylococcus aureus subsp. aureus Mu50
ugauguaugugaguaaugaccg

SEQ ID NO: 3996721 - RNA, 16 nt, Staphylococcus aureus subsp. aureus Mu50
ugaugucuguacuuuu

SEQ ID NO: 3996722 - RNA, 13 nt, Staphylococcus aureus subsp. aureus Mu50
ugaugugaaaauu

SEQ ID NO: 3996723 - RNA, 11 nt, Staphylococcus aureus subsp. aureus Mu50
ugaugugaugu

SEQ ID NO: 3996724 - RNA, 13 nt, Staphylococcus aureus subsp. aureus Mu50
ugaugugcuaccu

SEQ ID NO: 3996725 - RNA, 16 nt, Staphylococcus aureus subsp. aureus Mu50
ugauguguugcauuac

SEQ ID NO: 3996726 - RNA, 16 nt, Staphylococcus aureus subsp. aureus Mu50
ugauguguuguuuuaa

SEQ ID NO: 3996727 - RNA, 13 nt, Staphylococcus aureus subsp. aureus Mu50
ugauguuacaauc

SEQ ID NO: 3996728 - RNA, 20 nt, Staphylococcus aureus subsp. aureus Mu50
ugauguucaauauuuucaug

SEQ ID NO: 3996729 - RNA, 14 nt, Staphylococcus aureus subsp. aureus Mu50
ugauuaaaaaucaa

SEQ ID NO: 3996730 - RNA, 20 nt, Staphylococcus aureus subsp. aureus Mu50
ugauuaaaaaucaaagaggc

SEQ ID NO: 3996731 - RNA, 19 nt, Staphylococcus aureus subsp. aureus Mu50
ugauuaaaauguuagguga

SEQ ID NO: 3996732 - RNA, 16 nt, Staphylococcus aureus subsp. aureus Mu50
ugauuaaagcgauaau

SEQ ID NO: 3996733 - RNA, 17 nt, Staphylococcus aureus subsp. aureus Mu50
ugauuaaaguguuucaa

SEQ ID NO: 3996734 - RNA, 20 nt, Staphylococcus aureus subsp. aureus Mu50
ugauuaaaucuucaagugcc

SEQ ID NO: 3996735 - RNA, 14 nt, Staphylococcus aureus subsp. aureus Mu50
ugauuaacaaggaa

SEQ ID NO: 3996736 - RNA, 11 nt, Staphylococcus aureus subsp. aureus Mu50
ugauuaagugu

SEQ ID NO: 3996737 - RNA, 16 nt, Staphylococcus aureus subsp. aureus Mu50
ugauuaauaaaguaau

SEQ ID NO: 3996738 - RNA, 16 nt, Staphylococcus aureus subsp. aureus Mu50
ugauuaauuaaagauu

SEQ ID NO: 3996739 - RNA, 21 nt, Staphylococcus aureus subsp. aureus Mu50
ugauuacaacuuauucuucac

SEQ ID NO: 3996740 - RNA, 16 nt, Staphylococcus aureus subsp. aureus Mu50
ugauuaccaacaaggu

SEQ ID NO: 3996741 - RNA, 22 nt, Staphylococcus aureus subsp. aureus Mu50
ugauuacguugguuuaaaaauu

SEQ ID NO: 3996742 - RNA, 21 nt, Staphylococcus aureus subsp. aureus Mu50
ugauuacuuuaagauuauuug

SEQ ID NO: 3996743 - RNA, 22 nt, Staphylococcus aureus subsp. aureus Mu50
ugauuagcauaccuuuauuauu

SEQ ID NO: 3996744 - RNA, 22 nt, Staphylococcus aureus subsp. aureus Mu50
ugauuagcgcaccaauuaucaa

SEQ ID NO: 3996745 - RNA, 14 nt, Staphylococcus aureus subsp. aureus Mu50
ugauuaguaaauau

SEQ ID NO: 3996746 - RNA, 15 nt, Staphylococcus aureus subsp. aureus Mu50
ugauuaguaaauaua

SEQ ID NO: 3996747 - RNA, 17 nt, Staphylococcus aureus subsp. aureus Mu50
ugauuaguaauuuuuaa

SEQ ID NO: 3996748 - RNA, 22 nt, Staphylococcus aureus subsp. aureus Mu50
ugauuaguaauuuuuaaaucua

SEQ ID NO: 3996749 - RNA, 17 nt, Staphylococcus aureus subsp. aureus Mu50
ugauuauaaugauuguc

SEQ ID NO: 3996750 - RNA, 14 nt, Staphylococcus aureus subsp. aureus Mu50
ugauuauauauauu

SEQ ID NO: 3996751 - RNA, 18 nt, Staphylococcus aureus subsp. aureus Mu50
ugauuauauuucucauac

SEQ ID NO: 3996752 - RNA, 15 nt, Staphylococcus aureus subsp. aureus Mu50
ugauuauauuuuucu

SEQ ID NO: 3996753 - RNA, 16 nt, Staphylococcus aureus subsp. aureus Mu50
ugauuauauuuuucuu

SEQ ID NO: 3996754 - RNA, 13 nt, Staphylococcus aureus subsp. aureus Mu50
ugauuaucauaug

SEQ ID NO: 3996755 - RNA, 16 nt, Staphylococcus aureus subsp. aureus Mu50
ugauuaucauuguuca

SEQ ID NO: 3996756 - RNA, 11 nt, Staphylococcus aureus subsp. aureus Mu50
ugauuauuaca

SEQ ID NO: 3996757 - RNA, 14 nt, Staphylococcus aureus subsp. aureus Mu50
ugauuauucuucau

SEQ ID NO: 3996758 - RNA, 18 nt, Staphylococcus aureus subsp. aureus Mu50
ugauuauucuucauuuau

SEQ ID NO: 3996759 - RNA, 23 nt, Staphylococcus aureus subsp. aureus Mu50
ugauuauucuuugauuaaaucuu

SEQ ID NO: 3996760 - RNA, 12 nt, Staphylococcus aureus subsp. aureus Mu50
ugauucaaauaa

SEQ ID NO: 3996761 - RNA, 17 nt, Staphylococcus aureus subsp. aureus Mu50
ugauucaaauaaaucaa

SEQ ID NO: 3996762 - RNA, 14 nt, Staphylococcus aureus subsp. aureus Mu50
ugauucaauauagu

SEQ ID NO: 3996763 - RNA, 20 nt, Staphylococcus aureus subsp. aureus Mu50
ugauucaccagguuuuuuau

SEQ ID NO: 3996764 - RNA, 22 nt, Staphylococcus aureus subsp. aureus Mu50
ugauucaccagguuuuuuauuu

SEQ ID NO: 3996765 - RNA, 18 nt, Staphylococcus aureus subsp. aureus Mu50
ugauucauuacaaccauu

SEQ ID NO: 3996766 - RNA, 19 nt, Staphylococcus aureus subsp. aureus Mu50
ugauucauucguacuucca

SEQ ID NO: 3996767 - RNA, 22 nt, Staphylococcus aureus subsp. aureus Mu50
ugauucauuucgauuaauuuaa

SEQ ID NO: 3996768 - RNA, 14 nt, Staphylococcus aureus subsp. aureus Mu50
ugauuccacuacaa

SEQ ID NO: 3996769 - RNA, 11 nt, Staphylococcus aureus subsp. aureus Mu50
ugauucccaaa

SEQ ID NO: 3996770 - RNA, 15 nt, Staphylococcus aureus subsp. aureus Mu50
ugauucguauucaaa

SEQ ID NO: 3996771 - RNA, 16 nt, Staphylococcus aureus subsp. aureus Mu50
ugauucguauucaaag

SEQ ID NO: 3996772 - RNA, 14 nt, Staphylococcus aureus subsp. aureus Mu50
ugauucuaaauaau

SEQ ID NO: 3996773 - RNA, 16 nt, Staphylococcus aureus subsp. aureus Mu50
ugauucuacagcacug

SEQ ID NO: 3996774 - RNA, 19 nt, Staphylococcus aureus subsp. aureus Mu50
ugauucuacagcacugaaa

SEQ ID NO: 3996775 - RNA, 21 nt, Staphylococcus aureus subsp. aureus Mu50
ugauucuacagcacugaaauc

SEQ ID NO: 3996776 - RNA, 16 nt, Staphylococcus aureus subsp. aureus Mu50
ugauucucuguagaua

SEQ ID NO: 3996777 - RNA, 11 nt, Staphylococcus aureus subsp. aureus Mu50
ugauucuucac

SEQ ID NO: 3996778 - RNA, 18 nt, Staphylococcus aureus subsp. aureus Mu50
ugauugaacaauaauaug

SEQ ID NO: 3996779 - RNA, 17 nt, Staphylococcus aureus subsp. aureus Mu50
ugauugauaugguuaga

SEQ ID NO: 3996780 - RNA, 21 nt, Staphylococcus aureus subsp. aureus Mu50
ugauuggcagugaucuuuuuu

SEQ ID NO: 3996781 - RNA, 12 nt, Staphylococcus aureus subsp. aureus Mu50
ugauuuaaaaaa

SEQ ID NO: 3996782 - RNA, 12 nt, Staphylococcus aureus subsp. aureus Mu50
ugcacaacaguc

SEQ ID NO: 3996783 - RNA, 21 nt, Staphylococcus aureus subsp. aureus Mu50
ugcacauaaaaaaugugaccu

SEQ ID NO: 3996784 - RNA, 11 nt, Staphylococcus aureus subsp. aureus Mu50
ugcacaucaua

SEQ ID NO: 3996785 - RNA, 16 nt, Staphylococcus aureus subsp. aureus Mu50
ugcacaucauaauaaa

SEQ ID NO: 3996786 - RNA, 23 nt, Staphylococcus aureus subsp. aureus Mu50
ugcacaucauaauaaaucuaucu

SEQ ID NO: 3996787 - RNA, 23 nt, Staphylococcus aureus subsp. aureus Mu50
ugcaccuaaacgaucaacugcuu

SEQ ID NO: 3996788 - RNA, 18 nt, Staphylococcus aureus subsp. aureus Mu50
ugcaccuaaggcuaauga

SEQ ID NO: 3996789 - RNA, 16 nt, Staphylococcus aureus subsp. aureus Mu50
ugcaccuauaauagcg

SEQ ID NO: 3996790 - RNA, 17 nt, Staphylococcus aureus subsp. aureus Mu50
ugcaccuuuacaacaua

SEQ ID NO: 3996791 - RNA, 19 nt, Staphylococcus aureus subsp. aureus Mu50
ugcaccuuuacaacauaca

SEQ ID NO: 3996792 - RNA, 14 nt, Staphylococcus aureus subsp. aureus Mu50
ugcacgagcaacau

SEQ ID NO: 3996793 - RNA, 15 nt, Staphylococcus aureus subsp. aureus Mu50
ugcacgagcaacauc

SEQ ID NO: 3996794 - RNA, 19 nt, Staphylococcus aureus subsp. aureus Mu50
ugcacgucuuguaucaaca

SEQ ID NO: 3996795 - RNA, 20 nt, Staphylococcus aureus subsp. aureus Mu50
ugcacuaauggcacuuaaua

SEQ ID NO: 3996796 - RNA, 23 nt, Staphylococcus aureus subsp. aureus Mu50
ugcacuaauggcacuuaauauaa

SEQ ID NO: 3996797 - RNA, 19 nt, Staphylococcus aureus subsp. aureus Mu50
ugcacuaugcauaauacca

SEQ ID NO: 3996798 - RNA, 23 nt, Staphylococcus aureus subsp. aureus Mu50
ugcacucuuuucucguuucguca

SEQ ID NO: 3996799 - RNA, 16 nt, Staphylococcus aureus subsp. aureus Mu50
ugcacugagcaacaaa

SEQ ID NO: 3996800 - RNA, 17 nt, Staphylococcus aureus subsp. aureus Mu50
ugcacugcuaauauuag

SEQ ID NO: 3996801 - RNA, 17 nt, Staphylococcus aureus subsp. aureus Mu50
ugcacuugguucauaau

SEQ ID NO: 3996802 - RNA, 15 nt, Staphylococcus aureus subsp. aureus Mu50
ugcacuuuaacauaa

SEQ ID NO: 3996803 - RNA, 17 nt, Staphylococcus aureus subsp. aureus Mu50
ugcacuuuaacauaacu

SEQ ID NO: 3996804 - RNA, 13 nt, Staphylococcus aureus subsp. aureus Mu50
ugcacuuuauuaa

SEQ ID NO: 3996805 - RNA, 19 nt, Staphylococcus aureus subsp. aureus Mu50
ugcacuuuuuuuaaaucuu

SEQ ID NO: 3996806 - RNA, 14 nt, Staphylococcus aureus subsp. aureus Mu50
ugcagagaauauag

SEQ ID NO: 3996807 - RNA, 20 nt, Staphylococcus aureus subsp. aureus Mu50
ugcagauucuucaccaacuu

SEQ ID NO: 3996808 - RNA, 20 nt, Staphylococcus aureus subsp. aureus Mu50
ugcagauugauauaaauuau

SEQ ID NO: 3996809 - RNA, 19 nt, Staphylococcus aureus subsp. aureus Mu50
ugcaggauaacguucacuu

SEQ ID NO: 3996810 - RNA, 19 nt, Staphylococcus aureus subsp. aureus Mu50
ugcaggcaucauaucauac

SEQ ID NO: 3996811 - RNA, 21 nt, Staphylococcus aureus subsp. aureus Mu50
ugcaggcaucauaucauacca

SEQ ID NO: 3996812 - RNA, 15 nt, Staphylococcus aureus subsp. aureus Mu50
ugcaguuaaauuaaa

SEQ ID NO: 3996813 - RNA, 15 nt, Staphylococcus aureus subsp. aureus Mu50
ugcauaaaaaaagaa

SEQ ID NO: 3996814 - RNA, 22 nt, Staphylococcus aureus subsp. aureus Mu50
ugcauaagauuuugaauuuuau

SEQ ID NO: 3996815 - RNA, 22 nt, Staphylococcus aureus subsp. aureus Mu50
ugcauaauuaggauuaacauaa

SEQ ID NO: 3996816 - RNA, 13 nt, Staphylococcus aureus subsp. aureus Mu50
ugcauacauaucu

SEQ ID NO: 3996817 - RNA, 17 nt, Staphylococcus aureus subsp. aureus Mu50
ugcauacgaauuaaaau

SEQ ID NO: 3996818 - RNA, 23 nt, Staphylococcus aureus subsp. aureus Mu50
ugcauagcgcucuggauuuuucu

SEQ ID NO: 3996819 - RNA, 15 nt, Staphylococcus aureus subsp. aureus Mu50
ugcauagcuaaauaa

SEQ ID NO: 3996820 - RNA, 17 nt, Staphylococcus aureus subsp. aureus Mu50
ugcauagcuaaauaaau

SEQ ID NO: 3996821 - RNA, 18 nt, Staphylococcus aureus subsp. aureus Mu50
ugcauagcucuucuuuuu

SEQ ID NO: 3996822 - RNA, 23 nt, Staphylococcus aureus subsp. aureus Mu50
ugcauagguaaccuuaaauauag

SEQ ID NO: 3996823 - RNA, 15 nt, Staphylococcus aureus subsp. aureus Mu50
ugcauauauauauag

SEQ ID NO: 3996824 - RNA, 16 nt, Staphylococcus aureus subsp. aureus Mu50
ugcauauauugaggau

SEQ ID NO: 3996825 - RNA, 23 nt, Staphylococcus aureus subsp. aureus Mu50
ugcauauugugccgcuucuacaa

SEQ ID NO: 3996826 - RNA, 17 nt, Staphylococcus aureus subsp. aureus Mu50
ugcauauuuaauacauu

SEQ ID NO: 3996827 - RNA, 13 nt, Staphylococcus aureus subsp. aureus Mu50
ugcaugacagcaa

SEQ ID NO: 3996828 - RNA, 20 nt, Staphylococcus aureus subsp. aureus Mu50
ugcaugacagcaaauuuucu

SEQ ID NO: 3996829 - RNA, 16 nt, Staphylococcus aureus subsp. aureus Mu50
ugcaugacgauaauga

SEQ ID NO: 3996830 - RNA, 17 nt, Staphylococcus aureus subsp. aureus Mu50
ugcaugacgauaaugaa

SEQ ID NO: 3996831 - RNA, 19 nt, Staphylococcus aureus subsp. aureus Mu50
ugcaugagacuuauucaac

SEQ ID NO: 3996832 - RNA, 15 nt, Staphylococcus aureus subsp. aureus Mu50
ugcauguacaucuuu

SEQ ID NO: 3996833 - RNA, 18 nt, Staphylococcus aureus subsp. aureus Mu50
ugcauguuuaaauaucau

SEQ ID NO: 3996834 - RNA, 12 nt, Staphylococcus aureus subsp. aureus Mu50
ugcauuaagugc

SEQ ID NO: 3996835 - RNA, 17 nt, Staphylococcus aureus subsp. aureus Mu50
ugcauuaagugcaauaa

SEQ ID NO: 3996836 - RNA, 12 nt, Staphylococcus aureus subsp. aureus Mu50
ugcauuaauuuc

SEQ ID NO: 3996837 - RNA, 14 nt, Staphylococcus aureus subsp. aureus Mu50
ugcauuaauuucau

SEQ ID NO: 3996838 - RNA, 14 nt, Staphylococcus aureus subsp. aureus Mu50
ugcauuacgcuguc

SEQ ID NO: 3996839 - RNA, 18 nt, Staphylococcus aureus subsp. aureus Mu50
ugcauuacuacuuuauaa

SEQ ID NO: 3996840 - RNA, 22 nt, Staphylococcus aureus subsp. aureus Mu50
ugcauuacuacuuuauaaauau

SEQ ID NO: 3996841 - RNA, 23 nt, Staphylococcus aureus subsp. aureus Mu50
ugcauuacuacuuuauaaauauc

SEQ ID NO: 3996842 - RNA, 20 nt, Staphylococcus aureus subsp. aureus Mu50
ugcauuauuauaauagcuuu

SEQ ID NO: 3996843 - RNA, 14 nt, Staphylococcus aureus subsp. aureus Mu50
ugcauuuaauuuaa

SEQ ID NO: 3996844 - RNA, 19 nt, Staphylococcus aureus subsp. aureus Mu50
ugcauuuagaugauucuua

SEQ ID NO: 3996845 - RNA, 16 nt, Staphylococcus aureus subsp. aureus Mu50
ugccaaaaaguauuca

SEQ ID NO: 3996846 - RNA, 18 nt, Staphylococcus aureus subsp. aureus Mu50
ugccaaaaaguauucauu

SEQ ID NO: 3996847 - RNA, 17 nt, Staphylococcus aureus subsp. aureus Mu50
ugccaaauauaguaauu

SEQ ID NO: 3996848 - RNA, 22 nt, Staphylococcus aureus subsp. aureus Mu50
ugccaaauuucucuuucaagac

SEQ ID NO: 3996849 - RNA, 15 nt, Staphylococcus aureus subsp. aureus Mu50
ugccacauucgagcu

SEQ ID NO: 3996850 - RNA, 18 nt, Staphylococcus aureus subsp. aureus Mu50
ugccaccguggaauuuac

SEQ ID NO: 3996851 - RNA, 11 nt, Staphylococcus aureus subsp. aureus Mu50
ugccauaccug

SEQ ID NO: 3996852 - RNA, 13 nt, Staphylococcus aureus subsp. aureus Mu50
ugccauauguuuu

SEQ ID NO: 3996853 - RNA, 16 nt, Staphylococcus aureus subsp. aureus Mu50
ugccauauguuuuaga

SEQ ID NO: 3996854 - RNA, 14 nt, Staphylococcus aureus subsp. aureus Mu50
ugccaucuuuguaa

SEQ ID NO: 3996855 - RNA, 20 nt, Staphylococcus aureus subsp. aureus Mu50
ugccauguuggcaauuguuu

SEQ ID NO: 3996856 - RNA, 14 nt, Staphylococcus aureus subsp. aureus Mu50
ugccauuaaacgaa

SEQ ID NO: 3996857 - RNA, 13 nt, Staphylococcus aureus subsp. aureus Mu50
ugccauucauuaa

SEQ ID NO: 3996858 - RNA, 21 nt, Staphylococcus aureus subsp. aureus Mu50
ugccauuuuuaaauuacuaua

SEQ ID NO: 3996859 - RNA, 17 nt, Staphylococcus aureus subsp. aureus Mu50
ugcccaccauguacauu

SEQ ID NO: 3996860 - RNA, 16 nt, Staphylococcus aureus subsp. aureus Mu50
ugcccugcuguuuuau

SEQ ID NO: 3996861 - RNA, 15 nt, Staphylococcus aureus subsp. aureus Mu50
ugccgagauuauuau

SEQ ID NO: 3996862 - RNA, 18 nt, Staphylococcus aureus subsp. aureus Mu50
ugccggcuuuuucuuuug

SEQ ID NO: 3996863 - RNA, 20 nt, Staphylococcus aureus subsp. aureus Mu50
ugccguaucuauaaaaagaa

SEQ ID NO: 3996864 - RNA, 22 nt, Staphylococcus aureus subsp. aureus Mu50
ugccguaucuauaaaaagaaua

SEQ ID NO: 3996865 - RNA, 23 nt, Staphylococcus aureus subsp. aureus Mu50
ugccguaucuauaaaaagaauau

SEQ ID NO: 3996866 - RNA, 21 nt, Staphylococcus aureus subsp. aureus Mu50
ugccguauuucaaauguaauu

SEQ ID NO: 3996867 - RNA, 16 nt, Staphylococcus aureus subsp. aureus Mu50
ugccguccauuuccau

SEQ ID NO: 3996868 - RNA, 16 nt, Staphylococcus aureus subsp. aureus Mu50
ugccuagcauuacgcc

SEQ ID NO: 3996869 - RNA, 14 nt, Staphylococcus aureus subsp. aureus Mu50
ugcuuaguacacgu

SEQ ID NO: 3996870 - RNA, 15 nt, Staphylococcus aureus subsp. aureus Mu50
ugcuuaucaacagcu

SEQ ID NO: 3996871 - RNA, 16 nt, Staphylococcus aureus subsp. aureus Mu50
ugcuuauguuuuuaac

SEQ ID NO: 3996872 - RNA, 19 nt, Staphylococcus aureus subsp. aureus Mu50
ugcuuauuuuuguauucuu

SEQ ID NO: 3996873 - RNA, 18 nt, Staphylococcus aureus subsp. aureus Mu50
ugcuucaaauguaacauu

SEQ ID NO: 3996874 - RNA, 22 nt, Staphylococcus aureus subsp. aureus Mu50
ugcuucaaauguaacauuaaaa

SEQ ID NO: 3996875 - RNA, 12 nt, Staphylococcus aureus subsp. aureus Mu50
ugcuucaacuac

SEQ ID NO: 3996876 - RNA, 17 nt, Staphylococcus aureus subsp. aureus Mu50
ugcuucauuauauaauu

SEQ ID NO: 3996877 - RNA, 20 nt, Staphylococcus aureus subsp. aureus Mu50
ugcuucauuauauaauucuu

SEQ ID NO: 3996878 - RNA, 22 nt, Staphylococcus aureus subsp. aureus Mu50
ugcuucauugauaccuuuugcu

SEQ ID NO: 3996879 - RNA, 23 nt, Staphylococcus aureus subsp. aureus Mu50
ugcuuccacuucaucuaaaugau

SEQ ID NO: 3996880 - RNA, 15 nt, Staphylococcus aureus subsp. aureus Mu50
ugcuucgaauuuaac

SEQ ID NO: 3996881 - RNA, 20 nt, Staphylococcus aureus subsp. aureus Mu50
ugcuucgcacaacugcauaa

SEQ ID NO: 3996882 - RNA, 15 nt, Staphylococcus aureus subsp. aureus Mu50
ugcuucgucauuagg

SEQ ID NO: 3996883 - RNA, 18 nt, Staphylococcus aureus subsp. aureus Mu50
ugcuucguuuuuaguguu

SEQ ID NO: 3996884 - RNA, 21 nt, Staphylococcus aureus subsp. aureus Mu50
ugcuucguuuuuaguguuaau

SEQ ID NO: 3996885 - RNA, 17 nt, Staphylococcus aureus subsp. aureus Mu50
ugcuucucacaacugca

SEQ ID NO: 3996886 - RNA, 13 nt, Staphylococcus aureus subsp. aureus Mu50
ugcuucugcugua

SEQ ID NO: 3996887 - RNA, 18 nt, Staphylococcus aureus subsp. aureus Mu50
ugcuucugguucuucaau

SEQ ID NO: 3996888 - RNA, 20 nt, Staphylococcus aureus subsp. aureus Mu50
ugcuucuguaaacgauacug

SEQ ID NO: 3996889 - RNA, 15 nt, Staphylococcus aureus subsp. aureus Mu50
ugcuucuuaucaaca

SEQ ID NO: 3996890 - RNA, 21 nt, Staphylococcus aureus subsp. aureus Mu50
ugcuucuucagguguuuuacc

SEQ ID NO: 3996891 - RNA, 15 nt, Staphylococcus aureus subsp. aureus Mu50
ugcuucuuuuaagua

SEQ ID NO: 3996892 - RNA, 21 nt, Staphylococcus aureus subsp. aureus Mu50
ugcuugaaauuauuauuuaaa

SEQ ID NO: 3996893 - RNA, 17 nt, Staphylococcus aureus subsp. aureus Mu50
ugcuugaccuucaguuu

SEQ ID NO: 3996894 - RNA, 19 nt, Staphylococcus aureus subsp. aureus Mu50
ugcuuggacauauacucua

SEQ ID NO: 3996895 - RNA, 16 nt, Staphylococcus aureus subsp. aureus Mu50
ugcuuggauaauugca

SEQ ID NO: 3996896 - RNA, 14 nt, Staphylococcus aureus subsp. aureus Mu50
ugcuugguuugauu

SEQ ID NO: 3996897 - RNA, 12 nt, Staphylococcus aureus subsp. aureus Mu50
ugcuuguuacac

SEQ ID NO: 3996898 - RNA, 23 nt, Staphylococcus aureus subsp. aureus Mu50
ugcuuguuuauuacauaauuuau

SEQ ID NO: 3996899 - RNA, 12 nt, Staphylococcus aureus subsp. aureus Mu50
ugcuuuaaaucg

SEQ ID NO: 3996900 - RNA, 23 nt, Staphylococcus aureus subsp. aureus Mu50
ugcuuuaaggaaucguaaagcug

SEQ ID NO: 3996901 - RNA, 14 nt, Staphylococcus aureus subsp. aureus Mu50
ugcuuuaauaaauc

SEQ ID NO: 3996902 - RNA, 13 nt, Staphylococcus aureus subsp. aureus Mu50
ugcuuuaauauaa

SEQ ID NO: 3996903 - RNA, 14 nt, Staphylococcus aureus subsp. aureus Mu50
ugcuuuaauauaau

SEQ ID NO: 3996904 - RNA, 20 nt, Staphylococcus aureus subsp. aureus Mu50
ugcuuuaauauaauuauuaa

SEQ ID NO: 3996905 - RNA, 16 nt, Staphylococcus aureus subsp. aureus Mu50
ugcuuuaauuaaaguu

SEQ ID NO: 3996906 - RNA, 17 nt, Staphylococcus aureus subsp. aureus Mu50
ugcuuuacguccaaaau

SEQ ID NO: 3996907 - RNA, 22 nt, Staphylococcus aureus subsp. aureus Mu50
ugcuuuagagauuguaagaauu

SEQ ID NO: 3996908 - RNA, 17 nt, Staphylococcus aureus subsp. aureus Mu50
ugcuuuagcucuuuuuu

SEQ ID NO: 3996909 - RNA, 15 nt, Staphylococcus aureus subsp. aureus Mu50
ugcuuuaucaauaau

SEQ ID NO: 3996910 - RNA, 19 nt, Staphylococcus aureus subsp. aureus Mu50
ugcuuugcauacauaucuu

SEQ ID NO: 3996911 - RNA, 20 nt, Staphylococcus aureus subsp. aureus Mu50
ugcuuuguuaggaucaagga

SEQ ID NO: 3996912 - RNA, 15 nt, Staphylococcus aureus subsp. aureus Mu50
ugcuuuguuuaucaa

SEQ ID NO: 3996913 - RNA, 13 nt, Staphylococcus aureus subsp. aureus Mu50
ugcuuuuaaaugu

SEQ ID NO: 3996914 - RNA, 20 nt, Staphylococcus aureus subsp. aureus Mu50
ugcuuuuaaauguauuuuua

SEQ ID NO: 3996915 - RNA, 13 nt, Staphylococcus aureus subsp. aureus Mu50
ugcuuuuaauauu

SEQ ID NO: 3996916 - RNA, 20 nt, Staphylococcus aureus subsp. aureus Mu50
ugcuuuuaauauuauaaacc

SEQ ID NO: 3996917 - RNA, 15 nt, Staphylococcus aureus subsp. aureus Mu50
ugcuuuuauaauaau

SEQ ID NO: 3996918 - RNA, 18 nt, Staphylococcus aureus subsp. aureus Mu50
ugcuuuuuauuaugcuuc

SEQ ID NO: 3996919 - RNA, 16 nt, Staphylococcus aureus subsp. aureus Mu50
ugcuuuuuauuauuau

SEQ ID NO: 3996920 - RNA, 17 nt, Staphylococcus aureus subsp. aureus Mu50
ugcuuuuucaaaaucuu

SEQ ID NO: 3996921 - RNA, 20 nt, Staphylococcus aureus subsp. aureus Mu50
uggaaagaugggauuucacu

SEQ ID NO: 3996922 - RNA, 22 nt, Staphylococcus aureus subsp. aureus Mu50
uggaaaguaauaaguaauaauu

SEQ ID NO: 3996923 - RNA, 15 nt, Staphylococcus aureus subsp. aureus Mu50
uggaaagucagcuua

SEQ ID NO: 3996924 - RNA, 13 nt, Staphylococcus aureus subsp. aureus Mu50
uggaaauuuauua

SEQ ID NO: 3996925 - RNA, 14 nt, Staphylococcus aureus subsp. aureus Mu50
uggaaauuuauuau

SEQ ID NO: 3996926 - RNA, 16 nt, Staphylococcus aureus subsp. aureus Mu50
uggaaauuuauuauaa

SEQ ID NO: 3996927 - RNA, 18 nt, Staphylococcus aureus subsp. aureus Mu50
uggaaauuuauuauaaaa

SEQ ID NO: 3996928 - RNA, 23 nt, Staphylococcus aureus subsp. aureus Mu50
uggaaauuuauuauaaaauagaa

SEQ ID NO: 3996929 - RNA, 13 nt, Staphylococcus aureus subsp. aureus Mu50
uggaacgugcuuu

SEQ ID NO: 3996930 - RNA, 20 nt, Staphylococcus aureus subsp. aureus Mu50
uggaagaaugccuuuuauuu

SEQ ID NO: 3996931 - RNA, 17 nt, Staphylococcus aureus subsp. aureus Mu50
uggaaguguuuuaaguu

SEQ ID NO: 3996932 - RNA, 18 nt, Staphylococcus aureus subsp. aureus Mu50
uggaaguucuuuuguaaa

SEQ ID NO: 3996933 - RNA, 22 nt, Staphylococcus aureus subsp. aureus Mu50
uggaauaccuaauucaauaccu

SEQ ID NO: 3996934 - RNA, 14 nt, Staphylococcus aureus subsp. aureus Mu50
uggaauaccuuuuu

SEQ ID NO: 3996935 - RNA, 11 nt, Staphylococcus aureus subsp. aureus Mu50
uggaaugacua

SEQ ID NO: 3996936 - RNA, 22 nt, Staphylococcus aureus subsp. aureus Mu50
uggaaugauacgccuaaauauu

SEQ ID NO: 3996937 - RNA, 14 nt, Staphylococcus aureus subsp. aureus Mu50
uggaauuucauaua

SEQ ID NO: 3996938 - RNA, 22 nt, Staphylococcus aureus subsp. aureus Mu50
uggacaaucuuaucauaaucuu

SEQ ID NO: 3996939 - RNA, 15 nt, Staphylococcus aureus subsp. aureus Mu50
uggacagcuacaauu

SEQ ID NO: 3996940 - RNA, 20 nt, Staphylococcus aureus subsp. aureus Mu50
uggaccucuugaaaaaguuu

SEQ ID NO: 3996941 - RNA, 19 nt, Staphylococcus aureus subsp. aureus Mu50
uggacgcggguucaaaucc

SEQ ID NO: 3996942 - RNA, 17 nt, Staphylococcus aureus subsp. aureus Mu50
uggacuaacgucauuau

SEQ ID NO: 3996943 - RNA, 22 nt, Staphylococcus aureus subsp. aureus Mu50
uggacuaauaauuguccaugcc

SEQ ID NO: 3996944 - RNA, 20 nt, Staphylococcus aureus subsp. aureus Mu50
uggacuaauuuauuaauuuu

SEQ ID NO: 3996945 - RNA, 16 nt, Staphylococcus aureus subsp. aureus Mu50
uggacugaugcauuca

SEQ ID NO: 3996946 - RNA, 20 nt, Staphylococcus aureus subsp. aureus Mu50
uggacuuauggguucaauau

SEQ ID NO: 3996947 - RNA, 14 nt, Staphylococcus aureus subsp. aureus Mu50
uggacuucuaucuu

SEQ ID NO: 3996948 - RNA, 17 nt, Staphylococcus aureus subsp. aureus Mu50
uggacuucuaucuucac

SEQ ID NO: 3996949 - RNA, 18 nt, Staphylococcus aureus subsp. aureus Mu50
uggagaaccuuuaaaagu

SEQ ID NO: 3996950 - RNA, 17 nt, Staphylococcus aureus subsp. aureus Mu50
uggagaucuaacaauau

SEQ ID NO: 3996951 - RNA, 22 nt, Staphylococcus aureus subsp. aureus Mu50
uggagauucucgguuuuuucgg

SEQ ID NO: 3996952 - RNA, 16 nt, Staphylococcus aureus subsp. aureus Mu50
uggagcguaaaguuuu

SEQ ID NO: 3996953 - RNA, 21 nt, Staphylococcus aureus subsp. aureus Mu50
uggaguaaagaucacacgaca

SEQ ID NO: 3996954 - RNA, 17 nt, Staphylococcus aureus subsp. aureus Mu50
uggaguauaucagcuug

SEQ ID NO: 3996955 - RNA, 14 nt, Staphylococcus aureus subsp. aureus Mu50
uggauaaaaauuua

SEQ ID NO: 3996956 - RNA, 21 nt, Staphylococcus aureus subsp. aureus Mu50
ugguuauuaaaauuaaauaau

SEQ ID NO: 3996957 - RNA, 14 nt, Staphylococcus aureus subsp. aureus Mu50
ugguucaaaaauca

SEQ ID NO: 3996958 - RNA, 21 nt, Staphylococcus aureus subsp. aureus Mu50
ugguucagaaaugacaucauc

SEQ ID NO: 3996959 - RNA, 14 nt, Staphylococcus aureus subsp. aureus Mu50
ugguucauaaugau

SEQ ID NO: 3996960 - RNA, 16 nt, Staphylococcus aureus subsp. aureus Mu50
ugguucaucaaacaac

SEQ ID NO: 3996961 - RNA, 19 nt, Staphylococcus aureus subsp. aureus Mu50
ugguucaucaaacaacauc

SEQ ID NO: 3996962 - RNA, 19 nt, Staphylococcus aureus subsp. aureus Mu50
ugguucugacauuucugac

SEQ ID NO: 3996963 - RNA, 13 nt, Staphylococcus aureus subsp. aureus Mu50
ugguucuucuuuc

SEQ ID NO: 3996964 - RNA, 14 nt, Staphylococcus aureus subsp. aureus Mu50
ugguugaaauuaau

SEQ ID NO: 3996965 - RNA, 22 nt, Staphylococcus aureus subsp. aureus Mu50
ugguugugauuuguuacuucua

SEQ ID NO: 3996966 - RNA, 16 nt, Staphylococcus aureus subsp. aureus Mu50
ugguuguuaauguauu

SEQ ID NO: 3996967 - RNA, 19 nt, Staphylococcus aureus subsp. aureus Mu50
ugguuguuuuccaauaaua

SEQ ID NO: 3996968 - RNA, 17 nt, Staphylococcus aureus subsp. aureus Mu50
ugguuuaacuuuaucua

SEQ ID NO: 3996969 - RNA, 15 nt, Staphylococcus aureus subsp. aureus Mu50
ugguuuaaugagcuu

SEQ ID NO: 3996970 - RNA, 19 nt, Staphylococcus aureus subsp. aureus Mu50
ugguuuaccuaguuuuacu

SEQ ID NO: 3996971 - RNA, 18 nt, Staphylococcus aureus subsp. aureus Mu50
ugguuucauaaacugaau

SEQ ID NO: 3996972 - RNA, 14 nt, Staphylococcus aureus subsp. aureus Mu50
ugguuucaucauau

SEQ ID NO: 3996973 - RNA, 21 nt, Staphylococcus aureus subsp. aureus Mu50
ugguuucaucauaucgauuaa

SEQ ID NO: 3996974 - RNA, 20 nt, Staphylococcus aureus subsp. aureus Mu50
ugguuucuuaacauaaaaug

SEQ ID NO: 3996975 - RNA, 21 nt, Staphylococcus aureus subsp. aureus Mu50
ugguuucuuaacauaaaauga

SEQ ID NO: 3996976 - RNA, 14 nt, Staphylococcus aureus subsp. aureus Mu50
ugguuucuuauuaa

SEQ ID NO: 3996977 - RNA, 22 nt, Staphylococcus aureus subsp. aureus Mu50
ugguuugcuuuaaaauucucua

SEQ ID NO: 3996978 - RNA, 20 nt, Staphylococcus aureus subsp. aureus Mu50
ugguuugugauuuuuugaua

SEQ ID NO: 3996979 - RNA, 23 nt, Staphylococcus aureus subsp. aureus Mu50
ugguuuuauuugauuauucuuca

SEQ ID NO: 3996980 - RNA, 13 nt, Staphylococcus aureus subsp. aureus Mu50
ugguuuugaugua

SEQ ID NO: 3996981 - RNA, 16 nt, Staphylococcus aureus subsp. aureus Mu50
ugguuuuuagugaaaa

SEQ ID NO: 3996982 - RNA, 13 nt, Staphylococcus aureus subsp. aureus Mu50
uguaaaaaauauc

SEQ ID NO: 3996983 - RNA, 22 nt, Staphylococcus aureus subsp. aureus Mu50
uguaaaacauucccuuaauaau

SEQ ID NO: 3996984 - RNA, 15 nt, Staphylococcus aureus subsp. aureus Mu50
uguaaaaccauagau

SEQ ID NO: 3996985 - RNA, 18 nt, Staphylococcus aureus subsp. aureus Mu50
uguaaaaccauagauaau

SEQ ID NO: 3996986 - RNA, 19 nt, Staphylococcus aureus subsp. aureus Mu50
uguaaaacuaaguuauuua

SEQ ID NO: 3996987 - RNA, 15 nt, Staphylococcus aureus subsp. aureus Mu50
uguaaaauaaaucau

SEQ ID NO: 3996988 - RNA, 12 nt, Staphylococcus aureus subsp. aureus Mu50
uguaaaaugcuc

SEQ ID NO: 3996989 - RNA, 20 nt, Staphylococcus aureus subsp. aureus Mu50
uguaaaaugcucccuucaaa

SEQ ID NO: 3996990 - RNA, 19 nt, Staphylococcus aureus subsp. aureus Mu50
uguaaacaugguuuucuuu

SEQ ID NO: 3996991 - RNA, 18 nt, Staphylococcus aureus subsp. aureus Mu50
uguaaacuucuuuucuuu

SEQ ID NO: 3996992 - RNA, 11 nt, Staphylococcus aureus subsp. aureus Mu50
uguaaagacac

SEQ ID NO: 3996993 - RNA, 23 nt, Staphylococcus aureus subsp. aureus Mu50
uguaaagcaugaauagcuuguug

SEQ ID NO: 3996994 - RNA, 17 nt, Staphylococcus aureus subsp. aureus Mu50
uguaaagccaccuaaau

SEQ ID NO: 3996995 - RNA, 21 nt, Staphylococcus aureus subsp. aureus Mu50
uguaaauaaaaauuauauaaa

SEQ ID NO: 3996996 - RNA, 23 nt, Staphylococcus aureus subsp. aureus Mu50
uguaaauaaaaauuauauaaauu

SEQ ID NO: 3996997 - RNA, 19 nt, Staphylococcus aureus subsp. aureus Mu50
uguaaauaacaguuaauua

SEQ ID NO: 3996998 - RNA, 16 nt, Staphylococcus aureus subsp. aureus Mu50
uguaaauaguuaguuu

SEQ ID NO: 3996999 - RNA, 14 nt, Staphylococcus aureus subsp. aureus Mu50
uguaaauauaaaua

SEQ ID NO: 3997000 - RNA, 16 nt, Staphylococcus aureus subsp. aureus Mu50
uguaaauauaaauaug

SEQ ID NO: 3997001 - RNA, 19 nt, Staphylococcus aureus subsp. aureus Mu50
uguaaauauaguaauaaaa

SEQ ID NO: 3997002 - RNA, 16 nt, Staphylococcus aureus subsp. aureus Mu50
uguaaaucgugcuguu

SEQ ID NO: 3997003 - RNA, 23 nt, Staphylococcus aureus subsp. aureus Mu50
uguaaaugaaaguaccuaaaaua

SEQ ID NO: 3997004 - RNA, 13 nt, Staphylococcus aureus subsp. aureus Mu50
uguaaaugaaaua

SEQ ID NO: 3997005 - RNA, 21 nt, Staphylococcus aureus subsp. aureus Mu50
uguaaaugaaauaggcgcuug

SEQ ID NO: 3997006 - RNA, 21 nt, Staphylococcus aureus subsp. aureus Mu50
uguaaauuacaaaaguaugau

SEQ ID NO: 3997007 - RNA, 20 nt, Staphylococcus aureus subsp. aureus Mu50
uguaacaaaauacccugcuu

SEQ ID NO: 3997008 - RNA, 13 nt, Staphylococcus aureus subsp. aureus Mu50
uguaacaaagucu

SEQ ID NO: 3997009 - RNA, 20 nt, Staphylococcus aureus subsp. aureus Mu50
uguaacacgcucuuuucaaa

SEQ ID NO: 3997010 - RNA, 15 nt, Staphylococcus aureus subsp. aureus Mu50
uguaacauaaacaau

SEQ ID NO: 3997011 - RNA, 14 nt, Staphylococcus aureus subsp. aureus Mu50
uguaaccuaaaaac

SEQ ID NO: 3997012 - RNA, 16 nt, Staphylococcus aureus subsp. aureus Mu50
uguaaccuaaaaacaa

SEQ ID NO: 3997013 - RNA, 21 nt, Staphylococcus aureus subsp. aureus Mu50
uguaacgugaggcccauaaau

SEQ ID NO: 3997014 - RNA, 18 nt, Staphylococcus aureus subsp. aureus Mu50
uguaacucaauaugaaac

SEQ ID NO: 3997015 - RNA, 21 nt, Staphylococcus aureus subsp. aureus Mu50
uguaacuuuagacauaaaaaa

SEQ ID NO: 3997016 - RNA, 22 nt, Staphylococcus aureus subsp. aureus Mu50
uguaagaacgaaacuuuaauua

SEQ ID NO: 3997017 - RNA, 23 nt, Staphylococcus aureus subsp. aureus Mu50
uguaagaacgaaacuuuaauuaa

SEQ ID NO: 3997018 - RNA, 15 nt, Staphylococcus aureus subsp. aureus Mu50
uguaagacaacaaau

SEQ ID NO: 3997019 - RNA, 16 nt, Staphylococcus aureus subsp. aureus Mu50
uguaagacaacaaauc

SEQ ID NO: 3997020 - RNA, 22 nt, Staphylococcus aureus subsp. aureus Mu50
uguaagcuaucguaaacaacau

SEQ ID NO: 3997021 - RNA, 22 nt, Staphylococcus aureus subsp. aureus Mu50
uguaaguuauuuggauauuuau

SEQ ID NO: 3997022 - RNA, 18 nt, Staphylococcus aureus subsp. aureus Mu50
uguaaguuugguuucuua

SEQ ID NO: 3997023 - RNA, 18 nt, Staphylococcus aureus subsp. aureus Mu50
uguaauaaagaauaaaca

SEQ ID NO: 3997024 - RNA, 16 nt, Staphylococcus aureus subsp. aureus Mu50
uguaauaauaaucuuu

SEQ ID NO: 3997025 - RNA, 18 nt, Staphylococcus aureus subsp. aureus Mu50
uguaauaauaaucuuuaa

SEQ ID NO: 3997026 - RNA, 14 nt, Staphylococcus aureus subsp. aureus Mu50
uguaauacaagcaa

SEQ ID NO: 3997027 - RNA, 21 nt, Staphylococcus aureus subsp. aureus Mu50
uguaauacaucuaauaaauau

SEQ ID NO: 3997028 - RNA, 19 nt, Staphylococcus aureus subsp. aureus Mu50
uguaauacaugacauucau

SEQ ID NO: 3997029 - RNA, 21 nt, Staphylococcus aureus subsp. aureus Mu50
uguaauaccaauuuuuagcau

SEQ ID NO: 3997030 - RNA, 17 nt, Staphylococcus aureus subsp. aureus Mu50
uguaauaccuuuacuuu

SEQ ID NO: 3997031 - RNA, 21 nt, Staphylococcus aureus subsp. aureus Mu50
uguaauaccuuuacuuucauu

SEQ ID NO: 3997032 - RNA, 16 nt, Staphylococcus aureus subsp. aureus Mu50
uguaauauaacaagua

SEQ ID NO: 3997033 - RNA, 19 nt, Staphylococcus aureus subsp. aureus Mu50
uguaauauaacaaguauaa

SEQ ID NO: 3997034 - RNA, 22 nt, Staphylococcus aureus subsp. aureus Mu50
uguaaucauugguuucaucaua

SEQ ID NO: 3997035 - RNA, 16 nt, Staphylococcus aureus subsp. aureus Mu50
uguaauccuugagcuc

SEQ ID NO: 3997036 - RNA, 13 nt, Staphylococcus aureus subsp. aureus Mu50
uguaauccuuguu

SEQ ID NO: 3997037 - RNA, 22 nt, Staphylococcus aureus subsp. aureus Mu50
uguaaugaguaggcucuuaaug

SEQ ID NO: 3997038 - RNA, 15 nt, Staphylococcus aureus subsp. aureus Mu50
uguaaugcuuaaaaa

SEQ ID NO: 3997039 - RNA, 16 nt, Staphylococcus aureus subsp. aureus Mu50
uguaaugcuuaaaaac

SEQ ID NO: 3997040 - RNA, 18 nt, Staphylococcus aureus subsp. aureus Mu50
uguaaugcuuaaaaacaa

SEQ ID NO: 3997041 - RNA, 21 nt, Staphylococcus aureus subsp. aureus Mu50
uguaauguuccccugaaaaga

SEQ ID NO: 3997042 - RNA, 15 nt, Staphylococcus aureus subsp. aureus Mu50
uguaauguuggcaaa

SEQ ID NO: 3997043 - RNA, 13 nt, Staphylococcus aureus subsp. aureus Mu50
uguauuuuuauuu

SEQ ID NO: 3997044 - RNA, 14 nt, Staphylococcus aureus subsp. aureus Mu50
uguauuuuucaaau

SEQ ID NO: 3997045 - RNA, 13 nt, Staphylococcus aureus subsp. aureus Mu50
uguauuuuucuua

SEQ ID NO: 3997046 - RNA, 22 nt, Staphylococcus aureus subsp. aureus Mu50
ugucaaauacguaucaagaaaa

SEQ ID NO: 3997047 - RNA, 16 nt, Staphylococcus aureus subsp. aureus Mu50
ugucaauaaauuguuu

SEQ ID NO: 3997048 - RNA, 22 nt, Staphylococcus aureus subsp. aureus Mu50
ugucaauaaauuguuuacuaua

SEQ ID NO: 3997049 - RNA, 20 nt, Staphylococcus aureus subsp. aureus Mu50
ugucaauagcgguuuaaaaa

SEQ ID NO: 3997050 - RNA, 20 nt, Staphylococcus aureus subsp. aureus Mu50
ugucacuaauggauaugaua

SEQ ID NO: 3997051 - RNA, 16 nt, Staphylococcus aureus subsp. aureus Mu50
ugucaguaacuuuguc

SEQ ID NO: 3997052 - RNA, 21 nt, Staphylococcus aureus subsp. aureus Mu50
ugucaguuuugaagaauaaaa

SEQ ID NO: 3997053 - RNA, 13 nt, Staphylococcus aureus subsp. aureus Mu50
ugucauaauccau

SEQ ID NO: 3997054 - RNA, 14 nt, Staphylococcus aureus subsp. aureus Mu50
ugucauaccaaaua

SEQ ID NO: 3997055 - RNA, 14 nt, Staphylococcus aureus subsp. aureus Mu50
ugucauaccuuuua

SEQ ID NO: 3997056 - RNA, 18 nt, Staphylococcus aureus subsp. aureus Mu50
ugucaucauguucuaaug

SEQ ID NO: 3997057 - RNA, 15 nt, Staphylococcus aureus subsp. aureus Mu50
ugucaugccuucauu

SEQ ID NO: 3997058 - RNA, 17 nt, Staphylococcus aureus subsp. aureus Mu50
ugucauuugaauccaag

SEQ ID NO: 3997059 - RNA, 15 nt, Staphylococcus aureus subsp. aureus Mu50
ugucauuuugauuaa

SEQ ID NO: 3997060 - RNA, 17 nt, Staphylococcus aureus subsp. aureus Mu50
uguccaauaaauugugg

SEQ ID NO: 3997061 - RNA, 19 nt, Staphylococcus aureus subsp. aureus Mu50
uguccaucuuuuauuaaag

SEQ ID NO: 3997062 - RNA, 13 nt, Staphylococcus aureus subsp. aureus Mu50
uguccauuuaucu

SEQ ID NO: 3997063 - RNA, 14 nt, Staphylococcus aureus subsp. aureus Mu50
ugucccaaugcuga

SEQ ID NO: 3997064 - RNA, 19 nt, Staphylococcus aureus subsp. aureus Mu50
uguccgacuugauaaaaaa

SEQ ID NO: 3997065 - RNA, 21 nt, Staphylococcus aureus subsp. aureus Mu50
uguccuaacgcuaauuuuacu

SEQ ID NO: 3997066 - RNA, 17 nt, Staphylococcus aureus subsp. aureus Mu50
uguccuaauaaguuacc

SEQ ID NO: 3997067 - RNA, 13 nt, Staphylococcus aureus subsp. aureus Mu50
uguccucuaaaac

SEQ ID NO: 3997068 - RNA, 22 nt, Staphylococcus aureus subsp. aureus Mu50
uguccucuaaaacauguugaua

SEQ ID NO: 3997069 - RNA, 23 nt, Staphylococcus aureus subsp. aureus Mu50
ugucgaaaauagcuauuaaaaua

SEQ ID NO: 3997070 - RNA, 14 nt, Staphylococcus aureus subsp. aureus Mu50
ugucgcuucuucuu

SEQ ID NO: 3997071 - RNA, 16 nt, Staphylococcus aureus subsp. aureus Mu50
ugucgcuucuucuuca

SEQ ID NO: 3997072 - RNA, 16 nt, Staphylococcus aureus subsp. aureus Mu50
ugucgcuuucauaccu

SEQ ID NO: 3997073 - RNA, 15 nt, Staphylococcus aureus subsp. aureus Mu50
ugucguauucuucaa

SEQ ID NO: 3997074 - RNA, 19 nt, Staphylococcus aureus subsp. aureus Mu50
ugucguuguacaucauuaa

SEQ ID NO: 3997075 - RNA, 20 nt, Staphylococcus aureus subsp. aureus Mu50
ugucguuguacaucauuaaa

SEQ ID NO: 3997076 - RNA, 18 nt, Staphylococcus aureus subsp. aureus Mu50
ugucuaaaaacauaaaaa

SEQ ID NO: 3997077 - RNA, 19 nt, Staphylococcus aureus subsp. aureus Mu50
ugucuaaaaacauaaaaau

SEQ ID NO: 3997078 - RNA, 16 nt, Staphylococcus aureus subsp. aureus Mu50
ugucuagacuuauuug

SEQ ID NO: 3997079 - RNA, 23 nt, Staphylococcus aureus subsp. aureus Mu50
ugucuagacuuauuugaaugcaa

SEQ ID NO: 3997080 - RNA, 19 nt, Staphylococcus aureus subsp. aureus Mu50
ugucuagguuagaauuauu

SEQ ID NO: 3997081 - RNA, 23 nt, Staphylococcus aureus subsp. aureus Mu50
ugucucaauaauguuacgcugug

SEQ ID NO: 3997082 - RNA, 17 nt, Staphylococcus aureus subsp. aureus Mu50
ugucucucuuucuuauu

SEQ ID NO: 3997083 - RNA, 17 nt, Staphylococcus aureus subsp. aureus Mu50
ugucucuuuucacgaau

SEQ ID NO: 3997084 - RNA, 14 nt, Staphylococcus aureus subsp. aureus Mu50
ugucuguacuuuua

SEQ ID NO: 3997085 - RNA, 13 nt, Staphylococcus aureus subsp. aureus Mu50
ugucuuacuaauu

SEQ ID NO: 3997086 - RNA, 13 nt, Staphylococcus aureus subsp. aureus Mu50
ugucuuacuuuua

SEQ ID NO: 3997087 - RNA, 15 nt, Staphylococcus aureus subsp. aureus Mu50
ugucuuacuuuuaaa

SEQ ID NO: 3997088 - RNA, 16 nt, Staphylococcus aureus subsp. aureus Mu50
ugucuuacuuuuaaau

SEQ ID NO: 3997089 - RNA, 13 nt, Staphylococcus aureus subsp. aureus Mu50
ugucuucuuuuuu

SEQ ID NO: 3997090 - RNA, 16 nt, Staphylococcus aureus subsp. aureus Mu50
ugucuucuuuuuuucu

SEQ ID NO: 3997091 - RNA, 12 nt, Staphylococcus aureus subsp. aureus Mu50
ugucuuuccaua

SEQ ID NO: 3997092 - RNA, 20 nt, Staphylococcus aureus subsp. aureus Mu50
ugucuuuccauaauaaugcc

SEQ ID NO: 3997093 - RNA, 14 nt, Staphylococcus aureus subsp. aureus Mu50
ugucuuugaacaua

SEQ ID NO: 3997094 - RNA, 17 nt, Staphylococcus aureus subsp. aureus Mu50
ugucuuuuauauuuuua

SEQ ID NO: 3997095 - RNA, 13 nt, Staphylococcus aureus subsp. aureus Mu50
ugugaaaucuauu

SEQ ID NO: 3997096 - RNA, 15 nt, Staphylococcus aureus subsp. aureus Mu50
ugugaauaaaauugu

SEQ ID NO: 3997097 - RNA, 18 nt, Staphylococcus aureus subsp. aureus Mu50
ugugaauguuuucuaaau

SEQ ID NO: 3997098 - RNA, 22 nt, Staphylococcus aureus subsp. aureus Mu50
ugugaauguuuucuaaaucuaa

SEQ ID NO: 3997099 - RNA, 14 nt, Staphylococcus aureus subsp. aureus Mu50
ugugaauguuuugu

SEQ ID NO: 3997100 - RNA, 22 nt, Staphylococcus aureus subsp. aureus Mu50
ugugacaaaugccuuaucuaua

SEQ ID NO: 3997101 - RNA, 19 nt, Staphylococcus aureus subsp. aureus Mu50
ugugacgcugguaauauuu

SEQ ID NO: 3997102 - RNA, 15 nt, Staphylococcus aureus subsp. aureus Mu50
ugugauaacuuguaa

SEQ ID NO: 3997103 - RNA, 14 nt, Staphylococcus aureus subsp. aureus Mu50
ugugauaauucuuc

SEQ ID NO: 3997104 - RNA, 15 nt, Staphylococcus aureus subsp. aureus Mu50
ugugauacuuucuaa

SEQ ID NO: 3997105 - RNA, 17 nt, Staphylococcus aureus subsp. aureus Mu50
ugugauacuuucuaaga

SEQ ID NO: 3997106 - RNA, 15 nt, Staphylococcus aureus subsp. aureus Mu50
ugugauauauaacca

SEQ ID NO: 3997107 - RNA, 15 nt, Staphylococcus aureus subsp. aureus Mu50
ugugaugauuaaucg

SEQ ID NO: 3997108 - RNA, 21 nt, Staphylococcus aureus subsp. aureus Mu50
ugugauguguuguuuuaauug

SEQ ID NO: 3997109 - RNA, 15 nt, Staphylococcus aureus subsp. aureus Mu50
ugugauuuguuacuu

SEQ ID NO: 3997110 - RNA, 23 nt, Staphylococcus aureus subsp. aureus Mu50
ugugauuuuuaauaauuugaaua

SEQ ID NO: 3997111 - RNA, 15 nt, Staphylococcus aureus subsp. aureus Mu50
ugugauuuuuugaua

SEQ ID NO: 3997112 - RNA, 19 nt, Staphylococcus aureus subsp. aureus Mu50
ugugcaacgguuugaaaaa

SEQ ID NO: 3997113 - RNA, 15 nt, Staphylococcus aureus subsp. aureus Mu50
ugugcaauaccuguu

SEQ ID NO: 3997114 - RNA, 19 nt, Staphylococcus aureus subsp. aureus Mu50
ugugcaauuagaauauaug

SEQ ID NO: 3997115 - RNA, 22 nt, Staphylococcus aureus subsp. aureus Mu50
ugugcaauuagaauauauguau

SEQ ID NO: 3997116 - RNA, 23 nt, Staphylococcus aureus subsp. aureus Mu50
ugugcaauuagaauauauguaua

SEQ ID NO: 3997117 - RNA, 23 nt, Staphylococcus aureus subsp. aureus Mu50
ugugcaucauuuauaugauguuc

SEQ ID NO: 3997118 - RNA, 18 nt, Staphylococcus aureus subsp. aureus Mu50
ugugccggcuuuuucuuu

SEQ ID NO: 3997119 - RNA, 20 nt, Staphylococcus aureus subsp. aureus Mu50
ugugccggcuuuuucuuuug

SEQ ID NO: 3997120 - RNA, 15 nt, Staphylococcus aureus subsp. aureus Mu50
ugugccuuucuaaua

SEQ ID NO: 3997121 - RNA, 20 nt, Staphylococcus aureus subsp. aureus Mu50
ugugccuuugcuuuuuauuu

SEQ ID NO: 3997122 - RNA, 22 nt, Staphylococcus aureus subsp. aureus Mu50
ugugcgguaaccauuuuuuuau

SEQ ID NO: 3997123 - RNA, 18 nt, Staphylococcus aureus subsp. aureus Mu50
ugugcuguucuauuccac

SEQ ID NO: 3997124 - RNA, 13 nt, Staphylococcus aureus subsp. aureus Mu50
ugugcuuguaaca

SEQ ID NO: 3997125 - RNA, 16 nt, Staphylococcus aureus subsp. aureus Mu50
ugugcuuuaucaacaa

SEQ ID NO: 3997126 - RNA, 22 nt, Staphylococcus aureus subsp. aureus Mu50
ugugcuuuguuuaucaauuucu

SEQ ID NO: 3997127 - RNA, 19 nt, Staphylococcus aureus subsp. aureus Mu50
ugugcuuuuccauaaauau

SEQ ID NO: 3997128 - RNA, 21 nt, Staphylococcus aureus subsp. aureus Mu50
ugugcuuuuccauaaauauuu

SEQ ID NO: 3997129 - RNA, 14 nt, Staphylococcus aureus subsp. aureus Mu50
uguggauacaaacc

SEQ ID NO: 3997130 - RNA, 17 nt, Staphylococcus aureus subsp. aureus Mu50
uguggauuuaauuuuua

SEQ ID NO: 3997131 - RNA, 21 nt, Staphylococcus aureus subsp. aureus Mu50
uguucaaaucacaaguuuaca

SEQ ID NO: 3997132 - RNA, 22 nt, Staphylococcus aureus subsp. aureus Mu50
uguucaacuaaauuuucuaaau

SEQ ID NO: 3997133 - RNA, 18 nt, Staphylococcus aureus subsp. aureus Mu50
uguucaauacuucuuguu

SEQ ID NO: 3997134 - RNA, 22 nt, Staphylococcus aureus subsp. aureus Mu50
uguucacauucuugaauaaauu

SEQ ID NO: 3997135 - RNA, 14 nt, Staphylococcus aureus subsp. aureus Mu50
uguucacuaaaugu

SEQ ID NO: 3997136 - RNA, 21 nt, Staphylococcus aureus subsp. aureus Mu50
uguucaguuguuuuuuuguca

SEQ ID NO: 3997137 - RNA, 14 nt, Staphylococcus aureus subsp. aureus Mu50
uguucauaauauaa

SEQ ID NO: 3997138 - RNA, 15 nt, Staphylococcus aureus subsp. aureus Mu50
uguucauaaucauaa

SEQ ID NO: 3997139 - RNA, 23 nt, Staphylococcus aureus subsp. aureus Mu50
uguucauaaucauaauaagauuu

SEQ ID NO: 3997140 - RNA, 16 nt, Staphylococcus aureus subsp. aureus Mu50
uguucauuggcaauau

SEQ ID NO: 3997141 - RNA, 18 nt, Staphylococcus aureus subsp. aureus Mu50
uguuccaaucuuuuuaau

SEQ ID NO: 3997142 - RNA, 19 nt, Staphylococcus aureus subsp. aureus Mu50
uguuccaaucuuuuuaauu

SEQ ID NO: 3997143 - RNA, 20 nt, Staphylococcus aureus subsp. aureus Mu50
uguucccuucaaaguagaca

SEQ ID NO: 3997144 - RNA, 17 nt, Staphylococcus aureus subsp. aureus Mu50
uguuccgcuacaaaaca

SEQ ID NO: 3997145 - RNA, 22 nt, Staphylococcus aureus subsp. aureus Mu50
uguuccugcuacaacuucuucu

SEQ ID NO: 3997146 - RNA, 23 nt, Staphylococcus aureus subsp. aureus Mu50
uguuccugcuacaacuucuucuc

SEQ ID NO: 3997147 - RNA, 18 nt, Staphylococcus aureus subsp. aureus Mu50
uguucuaaaauaaaacgu

SEQ ID NO: 3997148 - RNA, 19 nt, Staphylococcus aureus subsp. aureus Mu50
uguucuaaugauauuugau

SEQ ID NO: 3997149 - RNA, 17 nt, Staphylococcus aureus subsp. aureus Mu50
uguucuauagaaaaagc

SEQ ID NO: 3997150 - RNA, 13 nt, Staphylococcus aureus subsp. aureus Mu50
uguucuauuugau

SEQ ID NO: 3997151 - RNA, 15 nt, Staphylococcus aureus subsp. aureus Mu50
uguucucauuauaau

SEQ ID NO: 3997152 - RNA, 18 nt, Staphylococcus aureus subsp. aureus Mu50
uguucucauuauaaugau

SEQ ID NO: 3997153 - RNA, 23 nt, Staphylococcus aureus subsp. aureus Mu50
uguucucuauuuauaacacuucg

SEQ ID NO: 3997154 - RNA, 16 nt, Staphylococcus aureus subsp. aureus Mu50
uguucucucaaugcau

SEQ ID NO: 3997155 - RNA, 15 nt, Staphylococcus aureus subsp. aureus Mu50
uguucugcuuuuucu

SEQ ID NO: 3997156 - RNA, 18 nt, Staphylococcus aureus subsp. aureus Mu50
uguucugcuuuuucuuua

SEQ ID NO: 3997157 - RNA, 14 nt, Staphylococcus aureus subsp. aureus Mu50
uguucuuauaaaaa

SEQ ID NO: 3997158 - RNA, 13 nt, Staphylococcus aureus subsp. aureus Mu50
uguucuucagaaa

SEQ ID NO: 3997159 - RNA, 14 nt, Staphylococcus aureus subsp. aureus Mu50
uguucuucagaaac

SEQ ID NO: 3997160 - RNA, 21 nt, Staphylococcus aureus subsp. aureus Mu50
uguucuucccacauacuuuua

SEQ ID NO: 3997161 - RNA, 18 nt, Staphylococcus aureus subsp. aureus Mu50
uguucuucgucaaauuca

SEQ ID NO: 3997162 - RNA, 19 nt, Staphylococcus aureus subsp. aureus Mu50
uguucuugaaaacaauaaa

SEQ ID NO: 3997163 - RNA, 22 nt, Staphylococcus aureus subsp. aureus Mu50
uguucuugaaaacaauaaauuu

SEQ ID NO: 3997164 - RNA, 15 nt, Staphylococcus aureus subsp. aureus Mu50
uguucuuuuuauuua

SEQ ID NO: 3997165 - RNA, 17 nt, Staphylococcus aureus subsp. aureus Mu50
uguucuuuuuguuguuu

SEQ ID NO: 3997166 - RNA, 22 nt, Staphylococcus aureus subsp. aureus Mu50
uguugaaaaguaauuaaauacu

SEQ ID NO: 3997167 - RNA, 20 nt, Staphylococcus aureus subsp. aureus Mu50
uguugaaacgguaucaacau

SEQ ID NO: 3997168 - RNA, 22 nt, Staphylococcus aureus subsp. aureus Mu50
uguugaaacgguaucaacauau

SEQ ID NO: 3997169 - RNA, 23 nt, Staphylococcus aureus subsp. aureus Mu50
uguugaaacgguaucaacauauu

SEQ ID NO: 3997170 - RNA, 20 nt, Staphylococcus aureus subsp. aureus Mu50
uguugaaauuaaauucaaau

SEQ ID NO: 3997171 - RNA, 17 nt, Staphylococcus aureus subsp. aureus Mu50
uguugaagucaauaauu

SEQ ID NO: 3997172 - RNA, 13 nt, Staphylococcus aureus subsp. aureus Mu50
uguugaauauacu

SEQ ID NO: 3997173 - RNA, 12 nt, Staphylococcus aureus subsp. aureus Mu50
uguugaaucaac

SEQ ID NO: 3997174 - RNA, 16 nt, Staphylococcus aureus subsp. aureus Mu50
uguugaauuucaaaau

SEQ ID NO: 3997175 - RNA, 19 nt, Staphylococcus aureus subsp. aureus Mu50
uguugacauuugaccaagu

SEQ ID NO: 3997176 - RNA, 22 nt, Staphylococcus aureus subsp. aureus Mu50
uguugacauuugaccaaguaug

SEQ ID NO: 3997177 - RNA, 22 nt, Staphylococcus aureus subsp. aureus Mu50
uguugaggcguuucagaaguug

SEQ ID NO: 3997178 - RNA, 23 nt, Staphylococcus aureus subsp. aureus Mu50
uguugauaaugcuacuauuaaau

SEQ ID NO: 3997179 - RNA, 22 nt, Staphylococcus aureus subsp. aureus Mu50
uguugauccuggaaucgaaaau

SEQ ID NO: 3997180 - RNA, 11 nt, Staphylococcus aureus subsp. aureus Mu50
uguugaugaag

SEQ ID NO: 3997181 - RNA, 19 nt, Staphylococcus aureus subsp. aureus Mu50
uguugauuugauaagugau

SEQ ID NO: 3997182 - RNA, 15 nt, Staphylococcus aureus subsp. aureus Mu50
uguugcaaaauacga

SEQ ID NO: 3997183 - RNA, 16 nt, Staphylococcus aureus subsp. aureus Mu50
uguugcaauaaaauca

SEQ ID NO: 3997184 - RNA, 20 nt, Staphylococcus aureus subsp. aureus Mu50
uguugcauuaagugcaauaa

SEQ ID NO: 3997185 - RNA, 18 nt, Staphylococcus aureus subsp. aureus Mu50
uguuggaauaccuuuuuc

SEQ ID NO: 3997186 - RNA, 20 nt, Staphylococcus aureus subsp. aureus Mu50
uguuggaucggcauuguaaa

SEQ ID NO: 3997187 - RNA, 18 nt, Staphylococcus aureus subsp. aureus Mu50
uguuggauucaucucagc

SEQ ID NO: 3997188 - RNA, 16 nt, Staphylococcus aureus subsp. aureus Mu50
uguugguauuuuuuua

SEQ ID NO: 3997189 - RNA, 22 nt, Staphylococcus aureus subsp. aureus Mu50
uguuggucuaucgccuaaaaau

SEQ ID NO: 3997190 - RNA, 22 nt, Staphylococcus aureus subsp. aureus Mu50
uguuguaaaccagcuaaaccau

SEQ ID NO: 3997191 - RNA, 17 nt, Staphylococcus aureus subsp. aureus Mu50
uguuguacauguauugg

SEQ ID NO: 3997192 - RNA, 20 nt, Staphylococcus aureus subsp. aureus Mu50
uguugucaucauguuuaucu

SEQ ID NO: 3997193 - RNA, 12 nt, Staphylococcus aureus subsp. aureus Mu50
uguugugaauaa

SEQ ID NO: 3997194 - RNA, 16 nt, Staphylococcus aureus subsp. aureus Mu50
uguuguuauuuauuug

SEQ ID NO: 3997195 - RNA, 19 nt, Staphylococcus aureus subsp. aureus Mu50
uguuguucuguaaugauau

SEQ ID NO: 3997196 - RNA, 12 nt, Staphylococcus aureus subsp. aureus Mu50
uguuguuuuaau

SEQ ID NO: 3997197 - RNA, 13 nt, Staphylococcus aureus subsp. aureus Mu50
uguuguuuuugau

SEQ ID NO: 3997198 - RNA, 16 nt, Staphylococcus aureus subsp. aureus Mu50
uguuuaaacauguaca

SEQ ID NO: 3997199 - RNA, 13 nt, Staphylococcus aureus subsp. aureus Mu50
uguuuaaauuuaa

SEQ ID NO: 3997200 - RNA, 17 nt, Staphylococcus aureus subsp. aureus Mu50
uguuuaaauuuaaaaga

SEQ ID NO: 3997201 - RNA, 17 nt, Staphylococcus aureus subsp. aureus Mu50
uguuuaauaacaaaauu

SEQ ID NO: 3997202 - RNA, 11 nt, Staphylococcus aureus subsp. aureus Mu50
uguuuaauuug

SEQ ID NO: 3997203 - RNA, 21 nt, Staphylococcus aureus subsp. aureus Mu50
uguuuaauuugauuaaauuca

SEQ ID NO: 3997204 - RNA, 21 nt, Staphylococcus aureus subsp. aureus Mu50
uguuuaauuuucuaaauauau

SEQ ID NO: 3997205 - RNA, 21 nt, Staphylococcus aureus subsp. aureus Mu50
uguuuaccuaaaucuuuaaau

SEQ ID NO: 3997206 - RNA, 22 nt, Staphylococcus aureus subsp. aureus Mu50
uguuuacgccauaagaaaauac

SEQ ID NO: 3997207 - RNA, 20 nt, Staphylococcus aureus subsp. aureus Mu50
uguuuagcgcaauuugguga

SEQ ID NO: 3997208 - RNA, 16 nt, Staphylococcus aureus subsp. aureus Mu50
uguuuaggcuuauuaa

SEQ ID NO: 3997209 - RNA, 20 nt, Staphylococcus aureus subsp. aureus Mu50
uguuuaguauggaauaaaug

SEQ ID NO: 3997210 - RNA, 15 nt, Staphylococcus aureus subsp. aureus Mu50
uguuuauaucuuugu

SEQ ID NO: 3997211 - RNA, 16 nt, Staphylococcus aureus subsp. aureus Mu50
uguuuauauugcaaaa

SEQ ID NO: 3997212 - RNA, 18 nt, Staphylococcus aureus subsp. aureus Mu50
uguuuaucaauuucucuu

SEQ ID NO: 3997213 - RNA, 22 nt, Staphylococcus aureus subsp. aureus Mu50
uguuuaucaugaugauaaauug

SEQ ID NO: 3997214 - RNA, 18 nt, Staphylococcus aureus subsp. aureus Mu50
uguuuaucuguaucaaaa

SEQ ID NO: 3997215 - RNA, 19 nt, Staphylococcus aureus subsp. aureus Mu50
uguuuaucuguaucaaaau

SEQ ID NO: 3997216 - RNA, 21 nt, Staphylococcus aureus subsp. aureus Mu50
uguuuaugagcuuaauaaauu

SEQ ID NO: 3997217 - RNA, 22 nt, Staphylococcus aureus subsp. aureus Mu50
uguuuaugagcuuaauaaauug

SEQ ID NO: 3997218 - RNA, 21 nt, Staphylococcus aureus subsp. aureus Mu50
uuaaaaucucauaauaauuca

SEQ ID NO: 3997219 - RNA, 21 nt, Staphylococcus aureus subsp. aureus Mu50
uuaaaaucugcuuuauuuuau

SEQ ID NO: 3997220 - RNA, 22 nt, Staphylococcus aureus subsp. aureus Mu50
uuaaaaugauagcuaaacauuu

SEQ ID NO: 3997221 - RNA, 19 nt, Staphylococcus aureus subsp. aureus Mu50
uuaaaaugauaucugacau

SEQ ID NO: 3997222 - RNA, 21 nt, Staphylococcus aureus subsp. aureus Mu50
uuaaaaugauuguuuuaagug

SEQ ID NO: 3997223 - RNA, 18 nt, Staphylococcus aureus subsp. aureus Mu50
uuaaaaugcuuuuuugaa

SEQ ID NO: 3997224 - RNA, 16 nt, Staphylococcus aureus subsp. aureus Mu50
uuaaaauguuaauaau

SEQ ID NO: 3997225 - RNA, 16 nt, Staphylococcus aureus subsp. aureus Mu50
uuaaaauuaugauuau

SEQ ID NO: 3997226 - RNA, 19 nt, Staphylococcus aureus subsp. aureus Mu50
uuaaaauucaguaucuaaa

SEQ ID NO: 3997227 - RNA, 22 nt, Staphylococcus aureus subsp. aureus Mu50
uuaaaauucaguaucuaaauau

SEQ ID NO: 3997228 - RNA, 22 nt, Staphylococcus aureus subsp. aureus Mu50
uuaaaauugguuuggauaaaau

SEQ ID NO: 3997229 - RNA, 22 nt, Staphylococcus aureus subsp. aureus Mu50
uuaaaauuguauagaaugugua

SEQ ID NO: 3997230 - RNA, 15 nt, Staphylococcus aureus subsp. aureus Mu50
uuaaaauuuaaauau

SEQ ID NO: 3997231 - RNA, 16 nt, Staphylococcus aureus subsp. aureus Mu50
uuaaaauuuuaauuaa

SEQ ID NO: 3997232 - RNA, 17 nt, Staphylococcus aureus subsp. aureus Mu50
uuaaacaaauaaauguc

SEQ ID NO: 3997233 - RNA, 19 nt, Staphylococcus aureus subsp. aureus Mu50
uuaaacaagcaucaugaaa

SEQ ID NO: 3997234 - RNA, 15 nt, Staphylococcus aureus subsp. aureus Mu50
uuaaacaguuuaauu

SEQ ID NO: 3997235 - RNA, 20 nt, Staphylococcus aureus subsp. aureus Mu50
uuaaacauccaauuauguuu

SEQ ID NO: 3997236 - RNA, 21 nt, Staphylococcus aureus subsp. aureus Mu50
uuaaacauccaauuauguuua

SEQ ID NO: 3997237 - RNA, 19 nt, Staphylococcus aureus subsp. aureus Mu50
uuaaacaugaacaaucaga

SEQ ID NO: 3997238 - RNA, 22 nt, Staphylococcus aureus subsp. aureus Mu50
uuaaacauuuuuagaaucaaaa

SEQ ID NO: 3997239 - RNA, 18 nt, Staphylococcus aureus subsp. aureus Mu50
uuaaacccucauuuuuau

SEQ ID NO: 3997240 - RNA, 23 nt, Staphylococcus aureus subsp. aureus Mu50
uuaaacccucauuuuuauaaauu

SEQ ID NO: 3997241 - RNA, 23 nt, Staphylococcus aureus subsp. aureus Mu50
uuaaaccgcacuucuauauuaau

SEQ ID NO: 3997242 - RNA, 20 nt, Staphylococcus aureus subsp. aureus Mu50
uuaaaccgccaccaccuaau

SEQ ID NO: 3997243 - RNA, 20 nt, Staphylococcus aureus subsp. aureus Mu50
uuaaacucaaaaagccaaca

SEQ ID NO: 3997244 - RNA, 23 nt, Staphylococcus aureus subsp. aureus Mu50
uuaaacucauaccaaaaacauua

SEQ ID NO: 3997245 - RNA, 16 nt, Staphylococcus aureus subsp. aureus Mu50
uuaaacucucuaaaaa

SEQ ID NO: 3997246 - RNA, 14 nt, Staphylococcus aureus subsp. aureus Mu50
uuaaacuuauuaau

SEQ ID NO: 3997247 - RNA, 18 nt, Staphylococcus aureus subsp. aureus Mu50
uuaaacuuauuaauuaau

SEQ ID NO: 3997248 - RNA, 20 nt, Staphylococcus aureus subsp. aureus Mu50
uuaaagaaaauaucugaaaa

SEQ ID NO: 3997249 - RNA, 21 nt, Staphylococcus aureus subsp. aureus Mu50
uuaaagaaaauaucugaaaaa

SEQ ID NO: 3997250 - RNA, 21 nt, Staphylococcus aureus subsp. aureus Mu50
uuaaagaaaauuucaguacca

SEQ ID NO: 3997251 - RNA, 18 nt, Staphylococcus aureus subsp. aureus Mu50
uuaaagaacuaacauaau

SEQ ID NO: 3997252 - RNA, 14 nt, Staphylococcus aureus subsp. aureus Mu50
uuaaagaacuauuu

SEQ ID NO: 3997253 - RNA, 21 nt, Staphylococcus aureus subsp. aureus Mu50
uuaaagaacuauuuuaaauua

SEQ ID NO: 3997254 - RNA, 16 nt, Staphylococcus aureus subsp. aureus Mu50
uuaaagacuagccaua

SEQ ID NO: 3997255 - RNA, 20 nt, Staphylococcus aureus subsp. aureus Mu50
uuaaagacugaaccguauaa

SEQ ID NO: 3997256 - RNA, 14 nt, Staphylococcus aureus subsp. aureus Mu50
uuaaagauuaaaau

SEQ ID NO: 3997257 - RNA, 13 nt, Staphylococcus aureus subsp. aureus Mu50
uuaaagauuauua

SEQ ID NO: 3997258 - RNA, 18 nt, Staphylococcus aureus subsp. aureus Mu50
uuaaagauuuacccauua

SEQ ID NO: 3997259 - RNA, 15 nt, Staphylococcus aureus subsp. aureus Mu50
uuaaagcaucuucaa

SEQ ID NO: 3997260 - RNA, 17 nt, Staphylococcus aureus subsp. aureus Mu50
uuaaagcuaucuucaga

SEQ ID NO: 3997261 - RNA, 14 nt, Staphylococcus aureus subsp. aureus Mu50
uuaaaggaaaucaa

SEQ ID NO: 3997262 - RNA, 22 nt, Staphylococcus aureus subsp. aureus Mu50
uuaaaggauggauacuuaaaga

SEQ ID NO: 3997263 - RNA, 14 nt, Staphylococcus aureus subsp. aureus Mu50
uuaaagguuaaaua

SEQ ID NO: 3997264 - RNA, 16 nt, Staphylococcus aureus subsp. aureus Mu50
uuaaagguuaaauauu

SEQ ID NO: 3997265 - RNA, 17 nt, Staphylococcus aureus subsp. aureus Mu50
uuaaaguagaaccuaua

SEQ ID NO: 3997266 - RNA, 22 nt, Staphylococcus aureus subsp. aureus Mu50
uuaaaguagaaccuauauuaag

SEQ ID NO: 3997267 - RNA, 14 nt, Staphylococcus aureus subsp. aureus Mu50
uuaaagucaguaua

SEQ ID NO: 3997268 - RNA, 22 nt, Staphylococcus aureus subsp. aureus Mu50
uuaaagucuguugguuuaucag

SEQ ID NO: 3997269 - RNA, 14 nt, Staphylococcus aureus subsp. aureus Mu50
uuaaagucuucauc

SEQ ID NO: 3997270 - RNA, 14 nt, Staphylococcus aureus subsp. aureus Mu50
uuaaaguguuucaa

SEQ ID NO: 3997271 - RNA, 22 nt, Staphylococcus aureus subsp. aureus Mu50
uuaaaguguuucaacauauuau

SEQ ID NO: 3997272 - RNA, 17 nt, Staphylococcus aureus subsp. aureus Mu50
uuaaaguuguugaaauu

SEQ ID NO: 3997273 - RNA, 14 nt, Staphylococcus aureus subsp. aureus Mu50
uuaaaguuuaaaua

SEQ ID NO: 3997274 - RNA, 15 nt, Staphylococcus aureus subsp. aureus Mu50
uuaaaguuuaaauau

SEQ ID NO: 3997275 - RNA, 17 nt, Staphylococcus aureus subsp. aureus Mu50
uuaaaguuuaaauauuc

SEQ ID NO: 3997276 - RNA, 18 nt, Staphylococcus aureus subsp. aureus Mu50
uuaaaguuuaaauauuca

SEQ ID NO: 3997277 - RNA, 17 nt, Staphylococcus aureus subsp. aureus Mu50
uuaaauaagaugaaaua

SEQ ID NO: 3997278 - RNA, 19 nt, Staphylococcus aureus subsp. aureus Mu50
uuaaauaagaugaaauauu

SEQ ID NO: 3997279 - RNA, 15 nt, Staphylococcus aureus subsp. aureus Mu50
uuaaauaagcuacua

SEQ ID NO: 3997280 - RNA, 17 nt, Staphylococcus aureus subsp. aureus Mu50
uuaaauaauaauucaua

SEQ ID NO: 3997281 - RNA, 15 nt, Staphylococcus aureus subsp. aureus Mu50
uuaaauaaugauaaa

SEQ ID NO: 3997282 - RNA, 15 nt, Staphylococcus aureus subsp. aureus Mu50
uuaaauacaauuucu

SEQ ID NO: 3997283 - RNA, 21 nt, Staphylococcus aureus subsp. aureus Mu50
uuaaauacaauuucuucauuu

SEQ ID NO: 3997284 - RNA, 16 nt, Staphylococcus aureus subsp. aureus Mu50
uuaaauacgccaaaua

SEQ ID NO: 3997285 - RNA, 17 nt, Staphylococcus aureus subsp. aureus Mu50
uuaaauacuugcucuaa

SEQ ID NO: 3997286 - RNA, 21 nt, Staphylococcus aureus subsp. aureus Mu50
uuaaauaggugauuauauaua

SEQ ID NO: 3997287 - RNA, 23 nt, Staphylococcus aureus subsp. aureus Mu50
uuaaauauaaagacgauuuauua

SEQ ID NO: 3997288 - RNA, 15 nt, Staphylococcus aureus subsp. aureus Mu50
uuaaauauucuuauc

SEQ ID NO: 3997289 - RNA, 17 nt, Staphylococcus aureus subsp. aureus Mu50
uuaaauauuuaaccuuu

SEQ ID NO: 3997290 - RNA, 14 nt, Staphylococcus aureus subsp. aureus Mu50
uuaaauauuuaauu

SEQ ID NO: 3997291 - RNA, 20 nt, Staphylococcus aureus subsp. aureus Mu50
uuaaaucaacaucaucuuua

SEQ ID NO: 3997292 - RNA, 13 nt, Staphylococcus aureus subsp. aureus Mu50
uuaaaucaaguau

SEQ ID NO: 3997293 - RNA, 19 nt, Staphylococcus aureus subsp. aureus Mu50
uuaaaucaccaacaacuuu

SEQ ID NO: 3997294 - RNA, 18 nt, Staphylococcus aureus subsp. aureus Mu50
uuaaauccgcuuguucaa

SEQ ID NO: 3997295 - RNA, 19 nt, Staphylococcus aureus subsp. aureus Mu50
uuaaaucugauucauuaaa

SEQ ID NO: 3997296 - RNA, 20 nt, Staphylococcus aureus subsp. aureus Mu50
uuaaaucuucaagugccauu

SEQ ID NO: 3997297 - RNA, 13 nt, Staphylococcus aureus subsp. aureus Mu50
uuaaaucuucuag

SEQ ID NO: 3997298 - RNA, 21 nt, Staphylococcus aureus subsp. aureus Mu50
uuaaaucuucuaguaauucuu

SEQ ID NO: 3997299 - RNA, 20 nt, Staphylococcus aureus subsp. aureus Mu50
uuaaaugauggguauuuugu

SEQ ID NO: 3997300 - RNA, 16 nt, Staphylococcus aureus subsp. aureus Mu50
uuaaaugauuuaauaa

SEQ ID NO: 3997301 - RNA, 14 nt, Staphylococcus aureus subsp. aureus Mu50
uuaaaugcaauaca

SEQ ID NO: 3997302 - RNA, 20 nt, Staphylococcus aureus subsp. aureus Mu50
uuaaaugcccaccauguaca

SEQ ID NO: 3997303 - RNA, 21 nt, Staphylococcus aureus subsp. aureus Mu50
uuaaauguacauuguaaauau

SEQ ID NO: 3997304 - RNA, 19 nt, Staphylococcus aureus subsp. aureus Mu50
uuaaauguauuuuuacuuu

SEQ ID NO: 3997305 - RNA, 18 nt, Staphylococcus aureus subsp. aureus Mu50
uuaagugcaauaacacca

SEQ ID NO: 3997306 - RNA, 22 nt, Staphylococcus aureus subsp. aureus Mu50
uuaagugcaauaacaccaauug

SEQ ID NO: 3997307 - RNA, 23 nt, Staphylococcus aureus subsp. aureus Mu50
uuaagugccuugccaugauuuaa

SEQ ID NO: 3997308 - RNA, 18 nt, Staphylococcus aureus subsp. aureus Mu50
uuaagugucuauguugaa

SEQ ID NO: 3997309 - RNA, 13 nt, Staphylococcus aureus subsp. aureus Mu50
uuaaguuaaaaua

SEQ ID NO: 3997310 - RNA, 14 nt, Staphylococcus aureus subsp. aureus Mu50
uuaaguuaaaauaa

SEQ ID NO: 3997311 - RNA, 21 nt, Staphylococcus aureus subsp. aureus Mu50
uuaaguuaaaauaaaaugguu

SEQ ID NO: 3997312 - RNA, 19 nt, Staphylococcus aureus subsp. aureus Mu50
uuaaguugaaaaccucuuu

SEQ ID NO: 3997313 - RNA, 21 nt, Staphylococcus aureus subsp. aureus Mu50
uuaaguuugucuuugaacaua

SEQ ID NO: 3997314 - RNA, 13 nt, Staphylococcus aureus subsp. aureus Mu50
uuaaguuuuucag

SEQ ID NO: 3997315 - RNA, 16 nt, Staphylococcus aureus subsp. aureus Mu50
uuaauaaaaucaucuu

SEQ ID NO: 3997316 - RNA, 18 nt, Staphylococcus aureus subsp. aureus Mu50
uuaauaaaauucuauaau

SEQ ID NO: 3997317 - RNA, 20 nt, Staphylococcus aureus subsp. aureus Mu50
uuaauaaauuguaugaauaa

SEQ ID NO: 3997318 - RNA, 21 nt, Staphylococcus aureus subsp. aureus Mu50
uuaauaaauuguaugaauaau

SEQ ID NO: 3997319 - RNA, 13 nt, Staphylococcus aureus subsp. aureus Mu50
uuaauaaauuuaa

SEQ ID NO: 3997320 - RNA, 22 nt, Staphylococcus aureus subsp. aureus Mu50
uuaauaaauuuaacguuauuca

SEQ ID NO: 3997321 - RNA, 14 nt, Staphylococcus aureus subsp. aureus Mu50
uuaauaacaaaauu

SEQ ID NO: 3997322 - RNA, 20 nt, Staphylococcus aureus subsp. aureus Mu50
uuaauaacaaaauuaaauau

SEQ ID NO: 3997323 - RNA, 21 nt, Staphylococcus aureus subsp. aureus Mu50
uuaauaacauccccaaaaaua

SEQ ID NO: 3997324 - RNA, 22 nt, Staphylococcus aureus subsp. aureus Mu50
uuaauaacauccccaaaaauag

SEQ ID NO: 3997325 - RNA, 19 nt, Staphylococcus aureus subsp. aureus Mu50
uuaauaacccauuuucaaa

SEQ ID NO: 3997326 - RNA, 16 nt, Staphylococcus aureus subsp. aureus Mu50
uuaauaaccuuuaaaa

SEQ ID NO: 3997327 - RNA, 19 nt, Staphylococcus aureus subsp. aureus Mu50
uuaauaaccuuuaaaacau

SEQ ID NO: 3997328 - RNA, 16 nt, Staphylococcus aureus subsp. aureus Mu50
uuaauaacguacauuu

SEQ ID NO: 3997329 - RNA, 16 nt, Staphylococcus aureus subsp. aureus Mu50
uuaauaagcugaaaua

SEQ ID NO: 3997330 - RNA, 13 nt, Staphylococcus aureus subsp. aureus Mu50
uuaauaauaagua

SEQ ID NO: 3997331 - RNA, 16 nt, Staphylococcus aureus subsp. aureus Mu50
uuaauaaucaaaccac

SEQ ID NO: 3997332 - RNA, 17 nt, Staphylococcus aureus subsp. aureus Mu50
uuaauaaugaauucuau

SEQ ID NO: 3997333 - RNA, 13 nt, Staphylococcus aureus subsp. aureus Mu50
uuaauaauguaca

SEQ ID NO: 3997334 - RNA, 15 nt, Staphylococcus aureus subsp. aureus Mu50
uuaauaauuaaacaa

SEQ ID NO: 3997335 - RNA, 12 nt, Staphylococcus aureus subsp. aureus Mu50
uuaauaauuaau

SEQ ID NO: 3997336 - RNA, 19 nt, Staphylococcus aureus subsp. aureus Mu50
uuaauaauuuguuuuauuu

SEQ ID NO: 3997337 - RNA, 20 nt, Staphylococcus aureus subsp. aureus Mu50
uuaauaauuuuuuuccuuuc

SEQ ID NO: 3997338 - RNA, 16 nt, Staphylococcus aureus subsp. aureus Mu50
uuaauacaagucuuua

SEQ ID NO: 3997339 - RNA, 19 nt, Staphylococcus aureus subsp. aureus Mu50
uuaauacaagucuuuacuc

SEQ ID NO: 3997340 - RNA, 14 nt, Staphylococcus aureus subsp. aureus Mu50
uuaauacauaucgg

SEQ ID NO: 3997341 - RNA, 20 nt, Staphylococcus aureus subsp. aureus Mu50
uuaauacaucaauaucuucu

SEQ ID NO: 3997342 - RNA, 22 nt, Staphylococcus aureus subsp. aureus Mu50
uuaauaccuaucccuguaaaac

SEQ ID NO: 3997343 - RNA, 13 nt, Staphylococcus aureus subsp. aureus Mu50
uuaauaccuauga

SEQ ID NO: 3997344 - RNA, 15 nt, Staphylococcus aureus subsp. aureus Mu50
uuaauacgaauuuca

SEQ ID NO: 3997345 - RNA, 16 nt, Staphylococcus aureus subsp. aureus Mu50
uuaauacgauaauaac

SEQ ID NO: 3997346 - RNA, 16 nt, Staphylococcus aureus subsp. aureus Mu50
uuaauacguuuaauaa

SEQ ID NO: 3997347 - RNA, 22 nt, Staphylococcus aureus subsp. aureus Mu50
uuaauagagaaagaauaaaugu

SEQ ID NO: 3997348 - RNA, 20 nt, Staphylococcus aureus subsp. aureus Mu50
uuaauagagacauuuuaucu

SEQ ID NO: 3997349 - RNA, 22 nt, Staphylococcus aureus subsp. aureus Mu50
uuaauagagacauuuuaucuga

SEQ ID NO: 3997350 - RNA, 19 nt, Staphylococcus aureus subsp. aureus Mu50
uuaauaggauuauuaucaa

SEQ ID NO: 3997351 - RNA, 19 nt, Staphylococcus aureus subsp. aureus Mu50
uuaauaguacuuaauuuaa

SEQ ID NO: 3997352 - RNA, 16 nt, Staphylococcus aureus subsp. aureus Mu50
uuaauaguguuauauu

SEQ ID NO: 3997353 - RNA, 17 nt, Staphylococcus aureus subsp. aureus Mu50
uuaauaguguuauauug

SEQ ID NO: 3997354 - RNA, 13 nt, Staphylococcus aureus subsp. aureus Mu50
uuaauauaaauau

SEQ ID NO: 3997355 - RNA, 15 nt, Staphylococcus aureus subsp. aureus Mu50
uuaauauaaauauca

SEQ ID NO: 3997356 - RNA, 22 nt, Staphylococcus aureus subsp. aureus Mu50
uuaauauaaauuuugaauuaca

SEQ ID NO: 3997357 - RNA, 18 nt, Staphylococcus aureus subsp. aureus Mu50
uuaauauaacuucuauua

SEQ ID NO: 3997358 - RNA, 14 nt, Staphylococcus aureus subsp. aureus Mu50
uuaauauaauaccu

SEQ ID NO: 3997359 - RNA, 14 nt, Staphylococcus aureus subsp. aureus Mu50
uuaauauaauuauu

SEQ ID NO: 3997360 - RNA, 19 nt, Staphylococcus aureus subsp. aureus Mu50
uuaauaucacgaucuuuaa

SEQ ID NO: 3997361 - RNA, 23 nt, Staphylococcus aureus subsp. aureus Mu50
uuaauaucacgaucuuuaaaguc

SEQ ID NO: 3997362 - RNA, 14 nt, Staphylococcus aureus subsp. aureus Mu50
uuaauaugaacaaa

SEQ ID NO: 3997363 - RNA, 16 nt, Staphylococcus aureus subsp. aureus Mu50
uuaauaugaacaaaaa

SEQ ID NO: 3997364 - RNA, 20 nt, Staphylococcus aureus subsp. aureus Mu50
uuaauaugaacaaaaaauaa

SEQ ID NO: 3997365 - RNA, 22 nt, Staphylococcus aureus subsp. aureus Mu50
uuaauaugcaaugcaccuauaa

SEQ ID NO: 3997366 - RNA, 16 nt, Staphylococcus aureus subsp. aureus Mu50
uuaauauucuuucguu

SEQ ID NO: 3997367 - RNA, 21 nt, Staphylococcus aureus subsp. aureus Mu50
uuaauauuuagauacugaauu

SEQ ID NO: 3997368 - RNA, 18 nt, Staphylococcus aureus subsp. aureus Mu50
uuaauauuugauaacaaa

SEQ ID NO: 3997369 - RNA, 12 nt, Staphylococcus aureus subsp. aureus Mu50
uuaauauuuucu

SEQ ID NO: 3997370 - RNA, 15 nt, Staphylococcus aureus subsp. aureus Mu50
uuaaucaaauuaucu

SEQ ID NO: 3997371 - RNA, 23 nt, Staphylococcus aureus subsp. aureus Mu50
uuaaucaacguauauaaguuaaa

SEQ ID NO: 3997372 - RNA, 17 nt, Staphylococcus aureus subsp. aureus Mu50
uuaaucaauuuaauuaa

SEQ ID NO: 3997373 - RNA, 19 nt, Staphylococcus aureus subsp. aureus Mu50
uuaaucagcuauaaaagua

SEQ ID NO: 3997374 - RNA, 16 nt, Staphylococcus aureus subsp. aureus Mu50
uuaaucauagcauuaa

SEQ ID NO: 3997375 - RNA, 14 nt, Staphylococcus aureus subsp. aureus Mu50
uuaauccaauuuaa

SEQ ID NO: 3997376 - RNA, 17 nt, Staphylococcus aureus subsp. aureus Mu50
uuaauccaguaaucaaa

SEQ ID NO: 3997377 - RNA, 23 nt, Staphylococcus aureus subsp. aureus Mu50
uuaauccgauuuugauauaaaaa

SEQ ID NO: 3997378 - RNA, 21 nt, Staphylococcus aureus subsp. aureus Mu50
uuaauccuucuccaaaaauaa

SEQ ID NO: 3997379 - RNA, 18 nt, Staphylococcus aureus subsp. aureus Mu50
uuaaucggaucauuauuu

SEQ ID NO: 3997380 - RNA, 19 nt, Staphylococcus aureus subsp. aureus Mu50
uuaaucggaucauuauuua

SEQ ID NO: 3997381 - RNA, 15 nt, Staphylococcus aureus subsp. aureus Mu50
uuaaucgggcuauau

SEQ ID NO: 3997382 - RNA, 22 nt, Staphylococcus aureus subsp. aureus Mu50
uuaaucguauuagccaauaaaa

SEQ ID NO: 3997383 - RNA, 13 nt, Staphylococcus aureus subsp. aureus Mu50
uuaaucuaaaaau

SEQ ID NO: 3997384 - RNA, 19 nt, Staphylococcus aureus subsp. aureus Mu50
uuaaucucuuuuugauuau

SEQ ID NO: 3997385 - RNA, 23 nt, Staphylococcus aureus subsp. aureus Mu50
uuaaucucuuuuugauuauauuu

SEQ ID NO: 3997386 - RNA, 21 nt, Staphylococcus aureus subsp. aureus Mu50
uuaaugauaaguggauuuucu

SEQ ID NO: 3997387 - RNA, 19 nt, Staphylococcus aureus subsp. aureus Mu50
uuaaugauucuacagcacu

SEQ ID NO: 3997388 - RNA, 19 nt, Staphylococcus aureus subsp. aureus Mu50
uuaaugauuuuucaucaau

SEQ ID NO: 3997389 - RNA, 21 nt, Staphylococcus aureus subsp. aureus Mu50
uuaaugccauuguuauccaaa

SEQ ID NO: 3997390 - RNA, 22 nt, Staphylococcus aureus subsp. aureus Mu50
uuaaugccggucauaacaccau

SEQ ID NO: 3997391 - RNA, 20 nt, Staphylococcus aureus subsp. aureus Mu50
uuaaugccugcccuuuaguc

SEQ ID NO: 3997392 - RNA, 21 nt, Staphylococcus aureus subsp. aureus Mu50
uuacaaaucaugacauaaaac

SEQ ID NO: 3997393 - RNA, 22 nt, Staphylococcus aureus subsp. aureus Mu50
uuacaaaugaagguguugaaaa

SEQ ID NO: 3997394 - RNA, 19 nt, Staphylococcus aureus subsp. aureus Mu50
uuacaaccuuugguuguua

SEQ ID NO: 3997395 - RNA, 14 nt, Staphylococcus aureus subsp. aureus Mu50
uuacaacuuauucu

SEQ ID NO: 3997396 - RNA, 12 nt, Staphylococcus aureus subsp. aureus Mu50
uuacaacuuuua

SEQ ID NO: 3997397 - RNA, 21 nt, Staphylococcus aureus subsp. aureus Mu50
uuacaacuuuuagaguuuuua

SEQ ID NO: 3997398 - RNA, 12 nt, Staphylococcus aureus subsp. aureus Mu50
uuacaaguuguu

SEQ ID NO: 3997399 - RNA, 17 nt, Staphylococcus aureus subsp. aureus Mu50
uuacaaguuguucaauu

SEQ ID NO: 3997400 - RNA, 17 nt, Staphylococcus aureus subsp. aureus Mu50
uuacaauaaagacauau

SEQ ID NO: 3997401 - RNA, 23 nt, Staphylococcus aureus subsp. aureus Mu50
uuacaauaagcgcaauuaaaagu

SEQ ID NO: 3997402 - RNA, 15 nt, Staphylococcus aureus subsp. aureus Mu50
uuacaauaugauuaa

SEQ ID NO: 3997403 - RNA, 13 nt, Staphylococcus aureus subsp. aureus Mu50
uuacaaugaaaaa

SEQ ID NO: 3997404 - RNA, 20 nt, Staphylococcus aureus subsp. aureus Mu50
uuacaaugcgcaaugaaaac

SEQ ID NO: 3997405 - RNA, 21 nt, Staphylococcus aureus subsp. aureus Mu50
uuacaaugcgguauugcaugu

SEQ ID NO: 3997406 - RNA, 14 nt, Staphylococcus aureus subsp. aureus Mu50
uuacaauuguucuc

SEQ ID NO: 3997407 - RNA, 16 nt, Staphylococcus aureus subsp. aureus Mu50
uuacacaaauuaaaac

SEQ ID NO: 3997408 - RNA, 15 nt, Staphylococcus aureus subsp. aureus Mu50
uuacaccuauaccuc

SEQ ID NO: 3997409 - RNA, 20 nt, Staphylococcus aureus subsp. aureus Mu50
uuacaccuuuggcaccagua

SEQ ID NO: 3997410 - RNA, 16 nt, Staphylococcus aureus subsp. aureus Mu50
uuacagacaaacauua

SEQ ID NO: 3997411 - RNA, 13 nt, Staphylococcus aureus subsp. aureus Mu50
uuacagaugaugc

SEQ ID NO: 3997412 - RNA, 21 nt, Staphylococcus aureus subsp. aureus Mu50
uuacaggagcgagccauuauu

SEQ ID NO: 3997413 - RNA, 15 nt, Staphylococcus aureus subsp. aureus Mu50
uuacagucaacugcu

SEQ ID NO: 3997414 - RNA, 17 nt, Staphylococcus aureus subsp. aureus Mu50
uuacauauacgacauuu

SEQ ID NO: 3997415 - RNA, 18 nt, Staphylococcus aureus subsp. aureus Mu50
uuacauauacgacauuuu

SEQ ID NO: 3997416 - RNA, 20 nt, Staphylococcus aureus subsp. aureus Mu50
uuacaucuauauuuguuugu

SEQ ID NO: 3997417 - RNA, 22 nt, Staphylococcus aureus subsp. aureus Mu50
uuacaugcaccuuuacaacaua

SEQ ID NO: 3997418 - RNA, 20 nt, Staphylococcus aureus subsp. aureus Mu50
uuacauguuacugaugaaca

SEQ ID NO: 3997419 - RNA, 15 nt, Staphylococcus aureus subsp. aureus Mu50
uuacauuaauuuguc

SEQ ID NO: 3997420 - RNA, 20 nt, Staphylococcus aureus subsp. aureus Mu50
uuacauuuggcguaaugaua

SEQ ID NO: 3997421 - RNA, 14 nt, Staphylococcus aureus subsp. aureus Mu50
uuacauuuuauguc

SEQ ID NO: 3997422 - RNA, 16 nt, Staphylococcus aureus subsp. aureus Mu50
uuacauuuuaugucca

SEQ ID NO: 3997423 - RNA, 11 nt, Staphylococcus aureus subsp. aureus Mu50
uuaccaaaauu

SEQ ID NO: 3997424 - RNA, 12 nt, Staphylococcus aureus subsp. aureus Mu50
uuaccaaaauuu

SEQ ID NO: 3997425 - RNA, 17 nt, Staphylococcus aureus subsp. aureus Mu50
uuaccaaugaauaaauu

SEQ ID NO: 3997426 - RNA, 23 nt, Staphylococcus aureus subsp. aureus Mu50
uuaccacaaccagucagaaagaa

SEQ ID NO: 3997427 - RNA, 12 nt, Staphylococcus aureus subsp. aureus Mu50
uuaccaucuuua

SEQ ID NO: 3997428 - RNA, 17 nt, Staphylococcus aureus subsp. aureus Mu50
uuaccauugugaauaau

SEQ ID NO: 3997429 - RNA, 20 nt, Staphylococcus aureus subsp. aureus Mu50
uuacccacaucuuuuuaaaa

SEQ ID NO: 3997430 - RNA, 19 nt, Staphylococcus aureus subsp. aureus Mu50
uuaccuaauaggauuuccu

SEQ ID NO: 3997431 - RNA, 14 nt, Staphylococcus aureus subsp. aureus Mu50
uuaccucugauaaa

SEQ ID NO: 3997432 - RNA, 17 nt, Staphylococcus aureus subsp. aureus Mu50
uuaccucugauaaauga

SEQ ID NO: 3997433 - RNA, 14 nt, Staphylococcus aureus subsp. aureus Mu50
uuaccuuuccauuc

SEQ ID NO: 3997434 - RNA, 22 nt, Staphylococcus aureus subsp. aureus Mu50
uuaccuuugucuuuuuuaucau

SEQ ID NO: 3997435 - RNA, 15 nt, Staphylococcus aureus subsp. aureus Mu50
uuaccuuuuaaggca

SEQ ID NO: 3997436 - RNA, 21 nt, Staphylococcus aureus subsp. aureus Mu50
uuacgaaaguagaauuauuua

SEQ ID NO: 3997437 - RNA, 15 nt, Staphylococcus aureus subsp. aureus Mu50
uuacgaucauaaaua

SEQ ID NO: 3997438 - RNA, 21 nt, Staphylococcus aureus subsp. aureus Mu50
uuacgaucauaaauauuuucu

SEQ ID NO: 3997439 - RNA, 21 nt, Staphylococcus aureus subsp. aureus Mu50
uuacgccaacaagguuucaag

SEQ ID NO: 3997440 - RNA, 21 nt, Staphylococcus aureus subsp. aureus Mu50
uuacgccaccaguuucaagug

SEQ ID NO: 3997441 - RNA, 20 nt, Staphylococcus aureus subsp. aureus Mu50
uuacgcugucucauuaaugu

SEQ ID NO: 3997442 - RNA, 21 nt, Staphylococcus aureus subsp. aureus Mu50
uuacgcuguguacguuucaau

SEQ ID NO: 3997443 - RNA, 15 nt, Staphylococcus aureus subsp. aureus Mu50
uuacuaaaaucacuu

SEQ ID NO: 3997444 - RNA, 17 nt, Staphylococcus aureus subsp. aureus Mu50
uuacuaaaugaauugcu

SEQ ID NO: 3997445 - RNA, 22 nt, Staphylococcus aureus subsp. aureus Mu50
uuacuaacaaccguuuuaagua

SEQ ID NO: 3997446 - RNA, 23 nt, Staphylococcus aureus subsp. aureus Mu50
uuacuaaccuauuaaaaaaaacc

SEQ ID NO: 3997447 - RNA, 16 nt, Staphylococcus aureus subsp. aureus Mu50
uuacuaaguaaccaag

SEQ ID NO: 3997448 - RNA, 15 nt, Staphylococcus aureus subsp. aureus Mu50
uuacuaccuauuaau

SEQ ID NO: 3997449 - RNA, 18 nt, Staphylococcus aureus subsp. aureus Mu50
uuacuaggaauauaaaac

SEQ ID NO: 3997450 - RNA, 16 nt, Staphylococcus aureus subsp. aureus Mu50
uuacuaguuuguaaua

SEQ ID NO: 3997451 - RNA, 18 nt, Staphylococcus aureus subsp. aureus Mu50
uuacuaguuuguaauaau

SEQ ID NO: 3997452 - RNA, 13 nt, Staphylococcus aureus subsp. aureus Mu50
uuacuauaaaaaa

SEQ ID NO: 3997453 - RNA, 13 nt, Staphylococcus aureus subsp. aureus Mu50
uuacuauaaugau

SEQ ID NO: 3997454 - RNA, 19 nt, Staphylococcus aureus subsp. aureus Mu50
uuacuaucuucaucauauu

SEQ ID NO: 3997455 - RNA, 18 nt, Staphylococcus aureus subsp. aureus Mu50
uuacuauggcauuauugc

SEQ ID NO: 3997456 - RNA, 20 nt, Staphylococcus aureus subsp. aureus Mu50
uuacuauggcauuauugccu

SEQ ID NO: 3997457 - RNA, 17 nt, Staphylococcus aureus subsp. aureus Mu50
uuacucaaaccaucuua

SEQ ID NO: 3997458 - RNA, 22 nt, Staphylococcus aureus subsp. aureus Mu50
uuacucacagacuuuuuacuaa

SEQ ID NO: 3997459 - RNA, 23 nt, Staphylococcus aureus subsp. aureus Mu50
uuacuccaaaguaacaugugcaa

SEQ ID NO: 3997460 - RNA, 19 nt, Staphylococcus aureus subsp. aureus Mu50
uuacucuacacucaaacaa

SEQ ID NO: 3997461 - RNA, 16 nt, Staphylococcus aureus subsp. aureus Mu50
uuacugcaauuauuuu

SEQ ID NO: 3997462 - RNA, 16 nt, Staphylococcus aureus subsp. aureus Mu50
uuacuguaguacuaua

SEQ ID NO: 3997463 - RNA, 19 nt, Staphylococcus aureus subsp. aureus Mu50
uuacugucuuuccauaaua

SEQ ID NO: 3997464 - RNA, 16 nt, Staphylococcus aureus subsp. aureus Mu50
uuacuguuaggauaaa

SEQ ID NO: 3997465 - RNA, 13 nt, Staphylococcus aureus subsp. aureus Mu50
uuacuucaguuug

SEQ ID NO: 3997466 - RNA, 15 nt, Staphylococcus aureus subsp. aureus Mu50
uuacuucauaaguca

SEQ ID NO: 3997467 - RNA, 20 nt, Staphylococcus aureus subsp. aureus Mu50
uuacuucuaauaguaaugau

SEQ ID NO: 3997468 - RNA, 12 nt, Staphylococcus aureus subsp. aureus Mu50
uuacuugcacac

SEQ ID NO: 3997469 - RNA, 17 nt, Staphylococcus aureus subsp. aureus Mu50
uuacuugcacaccagug

SEQ ID NO: 3997470 - RNA, 17 nt, Staphylococcus aureus subsp. aureus Mu50
uuacuugcuuuuucaaa

SEQ ID NO: 3997471 - RNA, 21 nt, Staphylococcus aureus subsp. aureus Mu50
uuacuugcuuuuucaaauaau

SEQ ID NO: 3997472 - RNA, 14 nt, Staphylococcus aureus subsp. aureus Mu50
uuacuuuaagauua

SEQ ID NO: 3997473 - RNA, 13 nt, Staphylococcus aureus subsp. aureus Mu50
uuacuuuaauuua

SEQ ID NO: 3997474 - RNA, 14 nt, Staphylococcus aureus subsp. aureus Mu50
uuagaaaaauauga

SEQ ID NO: 3997475 - RNA, 19 nt, Staphylococcus aureus subsp. aureus Mu50
uuagaaaaguaaguaaaau

SEQ ID NO: 3997476 - RNA, 19 nt, Staphylococcus aureus subsp. aureus Mu50
uuagaaaguauuuauuucu

SEQ ID NO: 3997477 - RNA, 12 nt, Staphylococcus aureus subsp. aureus Mu50
uuagaaccauca

SEQ ID NO: 3997478 - RNA, 23 nt, Staphylococcus aureus subsp. aureus Mu50
uuagaaccaucauucauauggaa

SEQ ID NO: 3997479 - RNA, 13 nt, Staphylococcus aureus subsp. aureus Mu50
uuagaagaaacuu

SEQ ID NO: 3997480 - RNA, 16 nt, Staphylococcus aureus subsp. aureus Mu50
uuaguguguuuaaaag

SEQ ID NO: 3997481 - RNA, 15 nt, Staphylococcus aureus subsp. aureus Mu50
uuaguuaaaauucag

SEQ ID NO: 3997482 - RNA, 15 nt, Staphylococcus aureus subsp. aureus Mu50
uuaguuaauuauuua

SEQ ID NO: 3997483 - RNA, 15 nt, Staphylococcus aureus subsp. aureus Mu50
uuaguuauacuacua

SEQ ID NO: 3997484 - RNA, 19 nt, Staphylococcus aureus subsp. aureus Mu50
uuaguucguguuugaaugu

SEQ ID NO: 3997485 - RNA, 19 nt, Staphylococcus aureus subsp. aureus Mu50
uuaguugcauaaucaauuu

SEQ ID NO: 3997486 - RNA, 12 nt, Staphylococcus aureus subsp. aureus Mu50
uuaguuuauguc

SEQ ID NO: 3997487 - RNA, 13 nt, Staphylococcus aureus subsp. aureus Mu50
uuaguuuuuaaaa

SEQ ID NO: 3997488 - RNA, 14 nt, Staphylococcus aureus subsp. aureus Mu50
uuauaaaaaacggu

SEQ ID NO: 3997489 - RNA, 21 nt, Staphylococcus aureus subsp. aureus Mu50
uuauaaaaaaucaguuuuuaa

SEQ ID NO: 3997490 - RNA, 23 nt, Staphylococcus aureus subsp. aureus Mu50
uuauaaaaaaucaguuuuuaaau

SEQ ID NO: 3997491 - RNA, 20 nt, Staphylococcus aureus subsp. aureus Mu50
uuauaaaaacagcagugaag

SEQ ID NO: 3997492 - RNA, 14 nt, Staphylococcus aureus subsp. aureus Mu50
uuauaaaaagagau

SEQ ID NO: 3997493 - RNA, 21 nt, Staphylococcus aureus subsp. aureus Mu50
uuauaaaaaggccucuugaaa

SEQ ID NO: 3997494 - RNA, 17 nt, Staphylococcus aureus subsp. aureus Mu50
uuauaaaaguguaaugu

SEQ ID NO: 3997495 - RNA, 22 nt, Staphylococcus aureus subsp. aureus Mu50
uuauaaaauaaauauaaaacgg

SEQ ID NO: 3997496 - RNA, 20 nt, Staphylococcus aureus subsp. aureus Mu50
uuauaaaaugaauaauugcu

SEQ ID NO: 3997497 - RNA, 23 nt, Staphylococcus aureus subsp. aureus Mu50
uuauaaaccuaaugcuuuaauaa

SEQ ID NO: 3997498 - RNA, 23 nt, Staphylococcus aureus subsp. aureus Mu50
uuauaaagauagaaugaauaauu

SEQ ID NO: 3997499 - RNA, 13 nt, Staphylococcus aureus subsp. aureus Mu50
uuauaaagcugcg

SEQ ID NO: 3997500 - RNA, 21 nt, Staphylococcus aureus subsp. aureus Mu50
uuauaaagcugcgaaacuugu

SEQ ID NO: 3997501 - RNA, 20 nt, Staphylococcus aureus subsp. aureus Mu50
uuauaaauagagaacagcag

SEQ ID NO: 3997502 - RNA, 13 nt, Staphylococcus aureus subsp. aureus Mu50
uuauaaaucaaag

SEQ ID NO: 3997503 - RNA, 15 nt, Staphylococcus aureus subsp. aureus Mu50
uuauaaaucauagag

SEQ ID NO: 3997504 - RNA, 18 nt, Staphylococcus aureus subsp. aureus Mu50
uuauaaaugauuaaagug

SEQ ID NO: 3997505 - RNA, 17 nt, Staphylococcus aureus subsp. aureus Mu50
uuauaaauuauauuuau

SEQ ID NO: 3997506 - RNA, 12 nt, Staphylococcus aureus subsp. aureus Mu50
uuauaaauuucg

SEQ ID NO: 3997507 - RNA, 11 nt, Staphylococcus aureus subsp. aureus Mu50
uuauaaauuug

SEQ ID NO: 3997508 - RNA, 18 nt, Staphylococcus aureus subsp. aureus Mu50
uuauaaauuugguacaua

SEQ ID NO: 3997509 - RNA, 20 nt, Staphylococcus aureus subsp. aureus Mu50
uuauaaauuugguacauaau

SEQ ID NO: 3997510 - RNA, 17 nt, Staphylococcus aureus subsp. aureus Mu50
uuauaacauccccuucu

SEQ ID NO: 3997511 - RNA, 16 nt, Staphylococcus aureus subsp. aureus Mu50
uuauaacauucuucaa

SEQ ID NO: 3997512 - RNA, 12 nt, Staphylococcus aureus subsp. aureus Mu50
uuauaacauuua

SEQ ID NO: 3997513 - RNA, 23 nt, Staphylococcus aureus subsp. aureus Mu50
uuauaacucuauccaaagacaua

SEQ ID NO: 3997514 - RNA, 21 nt, Staphylococcus aureus subsp. aureus Mu50
uuauaagaauuuaaaagagaa

SEQ ID NO: 3997515 - RNA, 15 nt, Staphylococcus aureus subsp. aureus Mu50
uuauaaguaaauaau

SEQ ID NO: 3997516 - RNA, 17 nt, Staphylococcus aureus subsp. aureus Mu50
uuauaaguaaauaauag

SEQ ID NO: 3997517 - RNA, 12 nt, Staphylococcus aureus subsp. aureus Mu50
uuauaaguacaa

SEQ ID NO: 3997518 - RNA, 22 nt, Staphylococcus aureus subsp. aureus Mu50
uuauaaguaucgccaucauuca

SEQ ID NO: 3997519 - RNA, 13 nt, Staphylococcus aureus subsp. aureus Mu50
uuauaaguauuca

SEQ ID NO: 3997520 - RNA, 15 nt, Staphylococcus aureus subsp. aureus Mu50
uuauaaguuaaaaau

SEQ ID NO: 3997521 - RNA, 19 nt, Staphylococcus aureus subsp. aureus Mu50
uuauaaguuaaaaauguaa

SEQ ID NO: 3997522 - RNA, 22 nt, Staphylococcus aureus subsp. aureus Mu50
uuauaaguuaaaaauguaaaua

SEQ ID NO: 3997523 - RNA, 15 nt, Staphylococcus aureus subsp. aureus Mu50
uuauaauagagaaac

SEQ ID NO: 3997524 - RNA, 17 nt, Staphylococcus aureus subsp. aureus Mu50
uuauaauauuaaauugc

SEQ ID NO: 3997525 - RNA, 16 nt, Staphylococcus aureus subsp. aureus Mu50
uuauaaucuuuuaguc

SEQ ID NO: 3997526 - RNA, 17 nt, Staphylococcus aureus subsp. aureus Mu50
uuauaaugaacaacaaa

SEQ ID NO: 3997527 - RNA, 13 nt, Staphylococcus aureus subsp. aureus Mu50
uuauaauuguuca

SEQ ID NO: 3997528 - RNA, 23 nt, Staphylococcus aureus subsp. aureus Mu50
uuauaauuucaguaggacauaua

SEQ ID NO: 3997529 - RNA, 14 nt, Staphylococcus aureus subsp. aureus Mu50
uuauacacuuuuug

SEQ ID NO: 3997530 - RNA, 17 nt, Staphylococcus aureus subsp. aureus Mu50
uuauacagugaaucuaa

SEQ ID NO: 3997531 - RNA, 19 nt, Staphylococcus aureus subsp. aureus Mu50
uuauacagugaaucuaaac

SEQ ID NO: 3997532 - RNA, 15 nt, Staphylococcus aureus subsp. aureus Mu50
uuauacauaaauauu

SEQ ID NO: 3997533 - RNA, 12 nt, Staphylococcus aureus subsp. aureus Mu50
uuauacauguac

SEQ ID NO: 3997534 - RNA, 19 nt, Staphylococcus aureus subsp. aureus Mu50
uuauacauguacauuauca

SEQ ID NO: 3997535 - RNA, 16 nt, Staphylococcus aureus subsp. aureus Mu50
uuauacauuagccaca

SEQ ID NO: 3997536 - RNA, 22 nt, Staphylococcus aureus subsp. aureus Mu50
uuauacgaaucacaguuauaua

SEQ ID NO: 3997537 - RNA, 23 nt, Staphylococcus aureus subsp. aureus Mu50
uuauacgugcuuuaaaguuguug

SEQ ID NO: 3997538 - RNA, 19 nt, Staphylococcus aureus subsp. aureus Mu50
uuauacuaaauugagaagu

SEQ ID NO: 3997539 - RNA, 13 nt, Staphylococcus aureus subsp. aureus Mu50
uuauacuacuauu

SEQ ID NO: 3997540 - RNA, 10 nt, Staphylococcus aureus subsp. aureus Mu50
uuauacugug

SEQ ID NO: 3997541 - RNA, 23 nt, Staphylococcus aureus subsp. aureus Mu50
uuauacuuaauauaguuaaugua

SEQ ID NO: 3997542 - RNA, 21 nt, Staphylococcus aureus subsp. aureus Mu50
uuauagaugacuguagaaaac

SEQ ID NO: 3997543 - RNA, 21 nt, Staphylococcus aureus subsp. aureus Mu50
uuauagauucauguaaauagu

SEQ ID NO: 3997544 - RNA, 18 nt, Staphylococcus aureus subsp. aureus Mu50
uuauagcaaauugauuaa

SEQ ID NO: 3997545 - RNA, 17 nt, Staphylococcus aureus subsp. aureus Mu50
uuauagcauuucuuuau

SEQ ID NO: 3997546 - RNA, 19 nt, Staphylococcus aureus subsp. aureus Mu50
uuauagcauuucuuuauua

SEQ ID NO: 3997547 - RNA, 16 nt, Staphylococcus aureus subsp. aureus Mu50
uuauagguauaagaau

SEQ ID NO: 3997548 - RNA, 17 nt, Staphylococcus aureus subsp. aureus Mu50
uuauagucuuaaacaua

SEQ ID NO: 3997549 - RNA, 17 nt, Staphylococcus aureus subsp. aureus Mu50
uuauagugguaaaaagu

SEQ ID NO: 3997550 - RNA, 22 nt, Staphylococcus aureus subsp. aureus Mu50
uuauagugguaaaaaguuuaaa

SEQ ID NO: 3997551 - RNA, 19 nt, Staphylococcus aureus subsp. aureus Mu50
uuauauaaacaaaaaucua

SEQ ID NO: 3997552 - RNA, 15 nt, Staphylococcus aureus subsp. aureus Mu50
uuauauaaauaggca

SEQ ID NO: 3997553 - RNA, 19 nt, Staphylococcus aureus subsp. aureus Mu50
uuauauaaauuuguaccaa

SEQ ID NO: 3997554 - RNA, 22 nt, Staphylococcus aureus subsp. aureus Mu50
uuauauaacacgauaauuauac

SEQ ID NO: 3997555 - RNA, 23 nt, Staphylococcus aureus subsp. aureus Mu50
uuauauaagucauacgcaaugau

SEQ ID NO: 3997556 - RNA, 13 nt, Staphylococcus aureus subsp. aureus Mu50
uuauauaauucuu

SEQ ID NO: 3997557 - RNA, 19 nt, Staphylococcus aureus subsp. aureus Mu50
uuauauacccaccacauuu

SEQ ID NO: 3997558 - RNA, 19 nt, Staphylococcus aureus subsp. aureus Mu50
uuauauacuaguucaacuc

SEQ ID NO: 3997559 - RNA, 13 nt, Staphylococcus aureus subsp. aureus Mu50
uuauauagaaaac

SEQ ID NO: 3997560 - RNA, 17 nt, Staphylococcus aureus subsp. aureus Mu50
uuauauagacaguaguu

SEQ ID NO: 3997561 - RNA, 21 nt, Staphylococcus aureus subsp. aureus Mu50
uuauauagauugccauucaua

SEQ ID NO: 3997562 - RNA, 14 nt, Staphylococcus aureus subsp. aureus Mu50
uuauauauaaaauc

SEQ ID NO: 3997563 - RNA, 19 nt, Staphylococcus aureus subsp. aureus Mu50
uuauauauaaagaaauaau

SEQ ID NO: 3997564 - RNA, 17 nt, Staphylococcus aureus subsp. aureus Mu50
uuauauauauuaaagua

SEQ ID NO: 3997565 - RNA, 14 nt, Staphylococcus aureus subsp. aureus Mu50
uuauauaucacaua

SEQ ID NO: 3997566 - RNA, 17 nt, Staphylococcus aureus subsp. aureus Mu50
uuauauaucacauauua

SEQ ID NO: 3997567 - RNA, 18 nt, Staphylococcus aureus subsp. aureus Mu50
uuauuaacuuuaauauaa

SEQ ID NO: 3997568 - RNA, 22 nt, Staphylococcus aureus subsp. aureus Mu50
uuauuaaggggguaauacuaua

SEQ ID NO: 3997569 - RNA, 21 nt, Staphylococcus aureus subsp. aureus Mu50
uuauuacaaugaaaaaacgag

SEQ ID NO: 3997570 - RNA, 18 nt, Staphylococcus aureus subsp. aureus Mu50
uuauuacauaauuuaucu

SEQ ID NO: 3997571 - RNA, 17 nt, Staphylococcus aureus subsp. aureus Mu50
uuauuagaauauucaga

SEQ ID NO: 3997572 - RNA, 17 nt, Staphylococcus aureus subsp. aureus Mu50
uuauuagauacuucuuu

SEQ ID NO: 3997573 - RNA, 17 nt, Staphylococcus aureus subsp. aureus Mu50
uuauuaggauucaauaa

SEQ ID NO: 3997574 - RNA, 18 nt, Staphylococcus aureus subsp. aureus Mu50
uuauuaggauucaauaau

SEQ ID NO: 3997575 - RNA, 12 nt, Staphylococcus aureus subsp. aureus Mu50
uuauuauaaaau

SEQ ID NO: 3997576 - RNA, 18 nt, Staphylococcus aureus subsp. aureus Mu50
uuauuauaaaauaaauau

SEQ ID NO: 3997577 - RNA, 20 nt, Staphylococcus aureus subsp. aureus Mu50
uuauuauguuauaaauucua

SEQ ID NO: 3997578 - RNA, 12 nt, Staphylococcus aureus subsp. aureus Mu50
uuauuauuaaau

SEQ ID NO: 3997579 - RNA, 14 nt, Staphylococcus aureus subsp. aureus Mu50
uuauuauuaaauua

SEQ ID NO: 3997580 - RNA, 13 nt, Staphylococcus aureus subsp. aureus Mu50
uuauuauugaaau

SEQ ID NO: 3997581 - RNA, 12 nt, Staphylococcus aureus subsp. aureus Mu50
uuauuauuuauc

SEQ ID NO: 3997582 - RNA, 20 nt, Staphylococcus aureus subsp. aureus Mu50
uuauuauuuuguauuuuuca

SEQ ID NO: 3997583 - RNA, 19 nt, Staphylococcus aureus subsp. aureus Mu50
uuauucaaaauucaauauu

SEQ ID NO: 3997584 - RNA, 14 nt, Staphylococcus aureus subsp. aureus Mu50
uuauucaaaucaua

SEQ ID NO: 3997585 - RNA, 20 nt, Staphylococcus aureus subsp. aureus Mu50
uuauucaacguauaagugau

SEQ ID NO: 3997586 - RNA, 13 nt, Staphylococcus aureus subsp. aureus Mu50
uuauucaauauuu

SEQ ID NO: 3997587 - RNA, 13 nt, Staphylococcus aureus subsp. aureus Mu50
uuauucuaaauau

SEQ ID NO: 3997588 - RNA, 14 nt, Staphylococcus aureus subsp. aureus Mu50
uuauucucuuuauu

SEQ ID NO: 3997589 - RNA, 14 nt, Staphylococcus aureus subsp. aureus Mu50
uuauucuucacuuu

SEQ ID NO: 3997590 - RNA, 12 nt, Staphylococcus aureus subsp. aureus Mu50
uuauucuuucuc

SEQ ID NO: 3997591 - RNA, 15 nt, Staphylococcus aureus subsp. aureus Mu50
uuauugaaaagauaa

SEQ ID NO: 3997592 - RNA, 17 nt, Staphylococcus aureus subsp. aureus Mu50
uuauugaaacuaauaau

SEQ ID NO: 3997593 - RNA, 21 nt, Staphylococcus aureus subsp. aureus Mu50
uuauugaaauuuuuaauauac

SEQ ID NO: 3997594 - RNA, 15 nt, Staphylococcus aureus subsp. aureus Mu50
uuauugcaauaaaau

SEQ ID NO: 3997595 - RNA, 18 nt, Staphylococcus aureus subsp. aureus Mu50
uuauugcacuuuuuucau

SEQ ID NO: 3997596 - RNA, 13 nt, Staphylococcus aureus subsp. aureus Mu50
uuauugccauaaa

SEQ ID NO: 3997597 - RNA, 18 nt, Staphylococcus aureus subsp. aureus Mu50
uuauugccgguuaaauua

SEQ ID NO: 3997598 - RNA, 20 nt, Staphylococcus aureus subsp. aureus Mu50
uuauugccgguuaaauuauu

SEQ ID NO: 3997599 - RNA, 21 nt, Staphylococcus aureus subsp. aureus Mu50
uuauugccgguuaaauuauuu

SEQ ID NO: 3997600 - RNA, 16 nt, Staphylococcus aureus subsp. aureus Mu50
uuauugguugaaauua

SEQ ID NO: 3997601 - RNA, 14 nt, Staphylococcus aureus subsp. aureus Mu50
uuauugucaucaug

SEQ ID NO: 3997602 - RNA, 17 nt, Staphylococcus aureus subsp. aureus Mu50
uuauuguuccaaucuuu

SEQ ID NO: 3997603 - RNA, 17 nt, Staphylococcus aureus subsp. aureus Mu50
uuauuguuuuuaaaauc

SEQ ID NO: 3997604 - RNA, 13 nt, Staphylococcus aureus subsp. aureus Mu50
uuauuuaaaacuu

SEQ ID NO: 3997605 - RNA, 16 nt, Staphylococcus aureus subsp. aureus Mu50
uuauuuaaaacuugua

SEQ ID NO: 3997606 - RNA, 22 nt, Staphylococcus aureus subsp. aureus Mu50
uuauuuaaaacuuguaaauuua

SEQ ID NO: 3997607 - RNA, 13 nt, Staphylococcus aureus subsp. aureus Mu50
uuauuuaacacuu

SEQ ID NO: 3997608 - RNA, 15 nt, Staphylococcus aureus subsp. aureus Mu50
uuauuuaauaacgaa

SEQ ID NO: 3997609 - RNA, 16 nt, Staphylococcus aureus subsp. aureus Mu50
uuauuuagauaaaaau

SEQ ID NO: 3997610 - RNA, 17 nt, Staphylococcus aureus subsp. aureus Mu50
uuauuuauaaacaauaa

SEQ ID NO: 3997611 - RNA, 18 nt, Staphylococcus aureus subsp. aureus Mu50
uuauuuauacuaaauuga

SEQ ID NO: 3997612 - RNA, 16 nt, Staphylococcus aureus subsp. aureus Mu50
uuauuuauucagcauu

SEQ ID NO: 3997613 - RNA, 12 nt, Staphylococcus aureus subsp. aureus Mu50
uuauuucagcuu

SEQ ID NO: 3997614 - RNA, 19 nt, Staphylococcus aureus subsp. aureus Mu50
uuauuucauuagaaaaggc

SEQ ID NO: 3997615 - RNA, 17 nt, Staphylococcus aureus subsp. aureus Mu50
uuauuugaaugcaaauc

SEQ ID NO: 3997616 - RNA, 19 nt, Staphylococcus aureus subsp. aureus Mu50
uuauuugauaaauaaaauu

SEQ ID NO: 3997617 - RNA, 18 nt, Staphylococcus aureus subsp. aureus Mu50
uuauuugauaaugauagu

SEQ ID NO: 3997618 - RNA, 21 nt, Staphylococcus aureus subsp. aureus Mu50
uuauuugauaaugauagugua

SEQ ID NO: 3997619 - RNA, 15 nt, Staphylococcus aureus subsp. aureus Mu50
uuauuugauuauucu

SEQ ID NO: 3997620 - RNA, 20 nt, Staphylococcus aureus subsp. aureus Mu50
uuauuuggcucuauaucaaa

SEQ ID NO: 3997621 - RNA, 15 nt, Staphylococcus aureus subsp. aureus Mu50
uuauuuguaauuuca

SEQ ID NO: 3997622 - RNA, 21 nt, Staphylococcus aureus subsp. aureus Mu50
uuauuuuaucaucuauucaac

SEQ ID NO: 3997623 - RNA, 13 nt, Staphylococcus aureus subsp. aureus Mu50
uuauuuucaauaa

SEQ ID NO: 3997624 - RNA, 17 nt, Staphylococcus aureus subsp. aureus Mu50
uuauuuucaauaaauaa

SEQ ID NO: 3997625 - RNA, 20 nt, Staphylococcus aureus subsp. aureus Mu50
uuauuuucaauaaauaaaca

SEQ ID NO: 3997626 - RNA, 17 nt, Staphylococcus aureus subsp. aureus Mu50
uuauuuucaauaaauuu

SEQ ID NO: 3997627 - RNA, 23 nt, Staphylococcus aureus subsp. aureus Mu50
uuauuuucauauaaauagcuucu

SEQ ID NO: 3997628 - RNA, 17 nt, Staphylococcus aureus subsp. aureus Mu50
uuauuuugauagacuaa

SEQ ID NO: 3997629 - RNA, 13 nt, Staphylococcus aureus subsp. aureus Mu50
uuauuuugauuaa

SEQ ID NO: 3997630 - RNA, 19 nt, Staphylococcus aureus subsp. aureus Mu50
uuauuuugcaauugcaaug

SEQ ID NO: 3997631 - RNA, 11 nt, Staphylococcus aureus subsp. aureus Mu50
uuauuuuuaag

SEQ ID NO: 3997632 - RNA, 13 nt, Staphylococcus aureus subsp. aureus Mu50
uuauuuuuuuaaa

SEQ ID NO: 3997633 - RNA, 21 nt, Staphylococcus aureus subsp. aureus Mu50
uuauuuuuuuaaaucuauaua

SEQ ID NO: 3997634 - RNA, 17 nt, Staphylococcus aureus subsp. aureus Mu50
uuauuuuuuucuuucuu

SEQ ID NO: 3997635 - RNA, 12 nt, Staphylococcus aureus subsp. aureus Mu50
uucaaaaaauau

SEQ ID NO: 3997636 - RNA, 13 nt, Staphylococcus aureus subsp. aureus Mu50
uucaaaaaauauu

SEQ ID NO: 3997637 - RNA, 14 nt, Staphylococcus aureus subsp. aureus Mu50
uucaaaaaauauuu

SEQ ID NO: 3997638 - RNA, 18 nt, Staphylococcus aureus subsp. aureus Mu50
uucaaaaaauauuuacau

SEQ ID NO: 3997639 - RNA, 16 nt, Staphylococcus aureus subsp. aureus Mu50
uucaaaaaucauacca

SEQ ID NO: 3997640 - RNA, 19 nt, Staphylococcus aureus subsp. aureus Mu50
uucaaaaugccaagaagac

SEQ ID NO: 3997641 - RNA, 19 nt, Staphylococcus aureus subsp. aureus Mu50
uucaaaauucaauauuaau

SEQ ID NO: 3997642 - RNA, 15 nt, Staphylococcus aureus subsp. aureus Mu50
uucaaaauuuugacu

SEQ ID NO: 3997643 - RNA, 13 nt, Staphylococcus aureus subsp. aureus Mu50
uucaaacagaaau

SEQ ID NO: 3997644 - RNA, 12 nt, Staphylococcus aureus subsp. aureus Mu50
uucaaacauauu

SEQ ID NO: 3997645 - RNA, 12 nt, Staphylococcus aureus subsp. aureus Mu50
uucaaagcgaua

SEQ ID NO: 3997646 - RNA, 17 nt, Staphylococcus aureus subsp. aureus Mu50
uucaaagcugucaacuu

SEQ ID NO: 3997647 - RNA, 18 nt, Staphylococcus aureus subsp. aureus Mu50
uucaaaguagauauugaa

SEQ ID NO: 3997648 - RNA, 13 nt, Staphylococcus aureus subsp. aureus Mu50
uucaaauaaauca

SEQ ID NO: 3997649 - RNA, 21 nt, Staphylococcus aureus subsp. aureus Mu50
uucaaauaaugugaaaaaucu

SEQ ID NO: 3997650 - RNA, 19 nt, Staphylococcus aureus subsp. aureus Mu50
uucaaauauaucuaauacu

SEQ ID NO: 3997651 - RNA, 21 nt, Staphylococcus aureus subsp. aureus Mu50
uucaaaucuggcacuuaagcu

SEQ ID NO: 3997652 - RNA, 21 nt, Staphylococcus aureus subsp. aureus Mu50
uucaaaugcuuaauaaaauca

SEQ ID NO: 3997653 - RNA, 19 nt, Staphylococcus aureus subsp. aureus Mu50
uucaaauggacuaacguca

SEQ ID NO: 3997654 - RNA, 19 nt, Staphylococcus aureus subsp. aureus Mu50
uucaaauguaguuaagaua

SEQ ID NO: 3997655 - RNA, 13 nt, Staphylococcus aureus subsp. aureus Mu50
uucacuuuaacuu

SEQ ID NO: 3997656 - RNA, 16 nt, Staphylococcus aureus subsp. aureus Mu50
uucacuuuuuauauca

SEQ ID NO: 3997657 - RNA, 19 nt, Staphylococcus aureus subsp. aureus Mu50
uucacuuuuuuuaauuuga

SEQ ID NO: 3997658 - RNA, 22 nt, Staphylococcus aureus subsp. aureus Mu50
uucacuuuuuuuaauuugauua

SEQ ID NO: 3997659 - RNA, 11 nt, Staphylococcus aureus subsp. aureus Mu50
uucagaaauga

SEQ ID NO: 3997660 - RNA, 23 nt, Staphylococcus aureus subsp. aureus Mu50
uucagaugaauaauguuuccauu

SEQ ID NO: 3997661 - RNA, 16 nt, Staphylococcus aureus subsp. aureus Mu50
uucagauuuguauuuu

SEQ ID NO: 3997662 - RNA, 22 nt, Staphylococcus aureus subsp. aureus Mu50
uucagcaccagaacaauucaau

SEQ ID NO: 3997663 - RNA, 22 nt, Staphylococcus aureus subsp. aureus Mu50
uucagcgauaacguacaaugua

SEQ ID NO: 3997664 - RNA, 23 nt, Staphylococcus aureus subsp. aureus Mu50
uucagcgauaacguacaauguau

SEQ ID NO: 3997665 - RNA, 22 nt, Staphylococcus aureus subsp. aureus Mu50
uucagcuaauucgucuacauau

SEQ ID NO: 3997666 - RNA, 21 nt, Staphylococcus aureus subsp. aureus Mu50
uucaggaauaucuuucaaauu

SEQ ID NO: 3997667 - RNA, 14 nt, Staphylococcus aureus subsp. aureus Mu50
uucagggucaacau

SEQ ID NO: 3997668 - RNA, 20 nt, Staphylococcus aureus subsp. aureus Mu50
uucaggguuuaagauuuuau

SEQ ID NO: 3997669 - RNA, 16 nt, Staphylococcus aureus subsp. aureus Mu50
uucaguaacugauuuu

SEQ ID NO: 3997670 - RNA, 15 nt, Staphylococcus aureus subsp. aureus Mu50
uucaguaauuucucc

SEQ ID NO: 3997671 - RNA, 21 nt, Staphylococcus aureus subsp. aureus Mu50
uucaguacgguuauuuaauaa

SEQ ID NO: 3997672 - RNA, 22 nt, Staphylococcus aureus subsp. aureus Mu50
uucaguacgguuauuuaauaau

SEQ ID NO: 3997673 - RNA, 17 nt, Staphylococcus aureus subsp. aureus Mu50
uucaguuuguuggucuu

SEQ ID NO: 3997674 - RNA, 16 nt, Staphylococcus aureus subsp. aureus Mu50
uucauaaaauuuaaaa

SEQ ID NO: 3997675 - RNA, 19 nt, Staphylococcus aureus subsp. aureus Mu50
uucauaaaauuuaaaacaa

SEQ ID NO: 3997676 - RNA, 14 nt, Staphylococcus aureus subsp. aureus Mu50
uucauaaaguuuau

SEQ ID NO: 3997677 - RNA, 20 nt, Staphylococcus aureus subsp. aureus Mu50
uucauaaaguuuauuuaugu

SEQ ID NO: 3997678 - RNA, 13 nt, Staphylococcus aureus subsp. aureus Mu50
uucauaaaugcuu

SEQ ID NO: 3997679 - RNA, 15 nt, Staphylococcus aureus subsp. aureus Mu50
uucauaaucauaaua

SEQ ID NO: 3997680 - RNA, 14 nt, Staphylococcus aureus subsp. aureus Mu50
uucauaaugaucaa

SEQ ID NO: 3997681 - RNA, 16 nt, Staphylococcus aureus subsp. aureus Mu50
uucauaaugaucaagu

SEQ ID NO: 3997682 - RNA, 20 nt, Staphylococcus aureus subsp. aureus Mu50
uucauaauuaacacauucaa

SEQ ID NO: 3997683 - RNA, 14 nt, Staphylococcus aureus subsp. aureus Mu50
uucauaauuuguug

SEQ ID NO: 3997684 - RNA, 16 nt, Staphylococcus aureus subsp. aureus Mu50
uucauacacuaucauu

SEQ ID NO: 3997685 - RNA, 22 nt, Staphylococcus aureus subsp. aureus Mu50
uucauacacugcacaucauaau

SEQ ID NO: 3997686 - RNA, 15 nt, Staphylococcus aureus subsp. aureus Mu50
uucauacauaacaca

SEQ ID NO: 3997687 - RNA, 22 nt, Staphylococcus aureus subsp. aureus Mu50
uucauacgcuaaugcuauauua

SEQ ID NO: 3997688 - RNA, 19 nt, Staphylococcus aureus subsp. aureus Mu50
uucauagaugcauaaaaac

SEQ ID NO: 3997689 - RNA, 16 nt, Staphylococcus aureus subsp. aureus Mu50
uucauagucacuuuua

SEQ ID NO: 3997690 - RNA, 14 nt, Staphylococcus aureus subsp. aureus Mu50
uucauaguuauuaa

SEQ ID NO: 3997691 - RNA, 14 nt, Staphylococcus aureus subsp. aureus Mu50
uucauaucuuucaa

SEQ ID NO: 3997692 - RNA, 13 nt, Staphylococcus aureus subsp. aureus Mu50
uucauauuaacug

SEQ ID NO: 3997693 - RNA, 14 nt, Staphylococcus aureus subsp. aureus Mu50
uucauauuaacugu

SEQ ID NO: 3997694 - RNA, 16 nt, Staphylococcus aureus subsp. aureus Mu50
uucauauucacaucuu

SEQ ID NO: 3997695 - RNA, 17 nt, Staphylococcus aureus subsp. aureus Mu50
uucaucaaacaacauca

SEQ ID NO: 3997696 - RNA, 19 nt, Staphylococcus aureus subsp. aureus Mu50
uucaucaaacaacaucacu

SEQ ID NO: 3997697 - RNA, 20 nt, Staphylococcus aureus subsp. aureus Mu50
uucaucaaauccaaaaucuu

SEQ ID NO: 3997698 - RNA, 21 nt, Staphylococcus aureus subsp. aureus Mu50
uucaucaaguauaaauguuau

SEQ ID NO: 3997699 - RNA, 17 nt, Staphylococcus aureus subsp. aureus Mu50
uucaucaaguugauaau

SEQ ID NO: 3997700 - RNA, 15 nt, Staphylococcus aureus subsp. aureus Mu50
uucaucaauaacuau

SEQ ID NO: 3997701 - RNA, 13 nt, Staphylococcus aureus subsp. aureus Mu50
uucaucaauaauu

SEQ ID NO: 3997702 - RNA, 17 nt, Staphylococcus aureus subsp. aureus Mu50
uucaucauaucgauuaa

SEQ ID NO: 3997703 - RNA, 16 nt, Staphylococcus aureus subsp. aureus Mu50
uucaucauuaaaauca

SEQ ID NO: 3997704 - RNA, 21 nt, Staphylococcus aureus subsp. aureus Mu50
uucaucauuuacgauacauca

SEQ ID NO: 3997705 - RNA, 20 nt, Staphylococcus aureus subsp. aureus Mu50
uucaucgucucacuuaauaa

SEQ ID NO: 3997706 - RNA, 21 nt, Staphylococcus aureus subsp. aureus Mu50
uucaucguucauauauuuugu

SEQ ID NO: 3997707 - RNA, 14 nt, Staphylococcus aureus subsp. aureus Mu50
uucaucuaaaauga

SEQ ID NO: 3997708 - RNA, 12 nt, Staphylococcus aureus subsp. aureus Mu50
uucaucuaaaug

SEQ ID NO: 3997709 - RNA, 15 nt, Staphylococcus aureus subsp. aureus Mu50
uucaucuaaaugaug

SEQ ID NO: 3997710 - RNA, 21 nt, Staphylococcus aureus subsp. aureus Mu50
uucaucuaacgacccaaauua

SEQ ID NO: 3997711 - RNA, 15 nt, Staphylococcus aureus subsp. aureus Mu50
uucaucucagcaaua

SEQ ID NO: 3997712 - RNA, 19 nt, Staphylococcus aureus subsp. aureus Mu50
uucaucucuuauaaguuca

SEQ ID NO: 3997713 - RNA, 22 nt, Staphylococcus aureus subsp. aureus Mu50
uucaucugguauuuuaugacgu

SEQ ID NO: 3997714 - RNA, 13 nt, Staphylococcus aureus subsp. aureus Mu50
uucaucuuaucaa

SEQ ID NO: 3997715 - RNA, 20 nt, Staphylococcus aureus subsp. aureus Mu50
uucaucuucaaacagacuua

SEQ ID NO: 3997716 - RNA, 12 nt, Staphylococcus aureus subsp. aureus Mu50
uucaucuucaac

SEQ ID NO: 3997717 - RNA, 12 nt, Staphylococcus aureus subsp. aureus Mu50
uucaucuugcaa

SEQ ID NO: 3997718 - RNA, 21 nt, Staphylococcus aureus subsp. aureus Mu50
uucaucuugcaaguauuuucu

SEQ ID NO: 3997719 - RNA, 12 nt, Staphylococcus aureus subsp. aureus Mu50
uucaugaacagc

SEQ ID NO: 3997720 - RNA, 15 nt, Staphylococcus aureus subsp. aureus Mu50
uucaugaacagcauc

SEQ ID NO: 3997721 - RNA, 14 nt, Staphylococcus aureus subsp. aureus Mu50
uucaugauuuacua

SEQ ID NO: 3997722 - RNA, 18 nt, Staphylococcus aureus subsp. aureus Mu50
uucaugcacuuuaacaua

SEQ ID NO: 3997723 - RNA, 21 nt, Staphylococcus aureus subsp. aureus Mu50
uucaugcacuuuaacauaacu

SEQ ID NO: 3997724 - RNA, 21 nt, Staphylococcus aureus subsp. aureus Mu50
uucauggccaaauguugauaa

SEQ ID NO: 3997725 - RNA, 22 nt, Staphylococcus aureus subsp. aureus Mu50
uucauguaaauaguuaguuuau

SEQ ID NO: 3997726 - RNA, 18 nt, Staphylococcus aureus subsp. aureus Mu50
uucaugugcaagcuuuuu

SEQ ID NO: 3997727 - RNA, 19 nt, Staphylococcus aureus subsp. aureus Mu50
uucaugugcaagcuuuuua

SEQ ID NO: 3997728 - RNA, 19 nt, Staphylococcus aureus subsp. aureus Mu50
uucaugugucauaauccau

SEQ ID NO: 3997729 - RNA, 22 nt, Staphylococcus aureus subsp. aureus Mu50
uucauguucuaaugauauuuga

SEQ ID NO: 3997730 - RNA, 17 nt, Staphylococcus aureus subsp. aureus Mu50
uucauguuugauucuaa

SEQ ID NO: 3997731 - RNA, 21 nt, Staphylococcus aureus subsp. aureus Mu50
uucauguuugauucuaaauaa

SEQ ID NO: 3997732 - RNA, 14 nt, Staphylococcus aureus subsp. aureus Mu50
uucauuaauacaag

SEQ ID NO: 3997733 - RNA, 16 nt, Staphylococcus aureus subsp. aureus Mu50
uucauuaauuuuucaa

SEQ ID NO: 3997734 - RNA, 23 nt, Staphylococcus aureus subsp. aureus Mu50
uucauuacuuggaaauguauaug

SEQ ID NO: 3997735 - RNA, 19 nt, Staphylococcus aureus subsp. aureus Mu50
uucauuaguugcauaauca

SEQ ID NO: 3997736 - RNA, 22 nt, Staphylococcus aureus subsp. aureus Mu50
uucauuauagucuuaaacauaa

SEQ ID NO: 3997737 - RNA, 21 nt, Staphylococcus aureus subsp. aureus Mu50
uucauuauagugugucauaau

SEQ ID NO: 3997738 - RNA, 13 nt, Staphylococcus aureus subsp. aureus Mu50
uucauugaugaug

SEQ ID NO: 3997739 - RNA, 17 nt, Staphylococcus aureus subsp. aureus Mu50
uucauugcguaagguau

SEQ ID NO: 3997740 - RNA, 17 nt, Staphylococcus aureus subsp. aureus Mu50
uucauuguaauaauaau

SEQ ID NO: 3997741 - RNA, 16 nt, Staphylococcus aureus subsp. aureus Mu50
uucauuguuaaacauu

SEQ ID NO: 3997742 - RNA, 19 nt, Staphylococcus aureus subsp. aureus Mu50
uucuaaaacggaaauaacc

SEQ ID NO: 3997743 - RNA, 22 nt, Staphylococcus aureus subsp. aureus Mu50
uucuaaaagaauuauucaagua

SEQ ID NO: 3997744 - RNA, 14 nt, Staphylococcus aureus subsp. aureus Mu50
uucuaaaauaaaac

SEQ ID NO: 3997745 - RNA, 18 nt, Staphylococcus aureus subsp. aureus Mu50
uucuaaacaacuucugaa

SEQ ID NO: 3997746 - RNA, 23 nt, Staphylococcus aureus subsp. aureus Mu50
uucuaaagcgauuuccaucauuu

SEQ ID NO: 3997747 - RNA, 12 nt, Staphylococcus aureus subsp. aureus Mu50
uucuaaauaaac

SEQ ID NO: 3997748 - RNA, 22 nt, Staphylococcus aureus subsp. aureus Mu50
uucuaaauaaacgauugauuau

SEQ ID NO: 3997749 - RNA, 15 nt, Staphylococcus aureus subsp. aureus Mu50
uucuaaaugauuuau

SEQ ID NO: 3997750 - RNA, 22 nt, Staphylococcus aureus subsp. aureus Mu50
uucuaaauuauuuauucauuau

SEQ ID NO: 3997751 - RNA, 20 nt, Staphylococcus aureus subsp. aureus Mu50
uucuaacaccugauugacaa

SEQ ID NO: 3997752 - RNA, 13 nt, Staphylococcus aureus subsp. aureus Mu50
uucuaaccacuuc

SEQ ID NO: 3997753 - RNA, 17 nt, Staphylococcus aureus subsp. aureus Mu50
uucuaaccauucguaau

SEQ ID NO: 3997754 - RNA, 21 nt, Staphylococcus aureus subsp. aureus Mu50
uucuaacgguaaauaaccacu

SEQ ID NO: 3997755 - RNA, 19 nt, Staphylococcus aureus subsp. aureus Mu50
uucuaagucucuugucauu

SEQ ID NO: 3997756 - RNA, 17 nt, Staphylococcus aureus subsp. aureus Mu50
uucuaaguguugaccau

SEQ ID NO: 3997757 - RNA, 15 nt, Staphylococcus aureus subsp. aureus Mu50
uucuaaguguuuuau

SEQ ID NO: 3997758 - RNA, 13 nt, Staphylococcus aureus subsp. aureus Mu50
uucuaauacaaac

SEQ ID NO: 3997759 - RNA, 13 nt, Staphylococcus aureus subsp. aureus Mu50
uucuaaucuaaau

SEQ ID NO: 3997760 - RNA, 16 nt, Staphylococcus aureus subsp. aureus Mu50
uucuaaugcuaauuua

SEQ ID NO: 3997761 - RNA, 17 nt, Staphylococcus aureus subsp. aureus Mu50
uucuaaugcuaauuuaa

SEQ ID NO: 3997762 - RNA, 19 nt, Staphylococcus aureus subsp. aureus Mu50
uucuaaugcugcuucuuca

SEQ ID NO: 3997763 - RNA, 14 nt, Staphylococcus aureus subsp. aureus Mu50
uucuaauucugaaa

SEQ ID NO: 3997764 - RNA, 20 nt, Staphylococcus aureus subsp. aureus Mu50
uucuaauugaaaucaucuua

SEQ ID NO: 3997765 - RNA, 14 nt, Staphylococcus aureus subsp. aureus Mu50
uucuaauuuuucac

SEQ ID NO: 3997766 - RNA, 22 nt, Staphylococcus aureus subsp. aureus Mu50
uucuacaacuucauuaguugcc

SEQ ID NO: 3997767 - RNA, 18 nt, Staphylococcus aureus subsp. aureus Mu50
uucuacaggcaaugcaag

SEQ ID NO: 3997768 - RNA, 20 nt, Staphylococcus aureus subsp. aureus Mu50
uucuacaggcaaugcaaguu

SEQ ID NO: 3997769 - RNA, 21 nt, Staphylococcus aureus subsp. aureus Mu50
uucuacaggcaaugcaaguug

SEQ ID NO: 3997770 - RNA, 21 nt, Staphylococcus aureus subsp. aureus Mu50
uucuacagguaaugcaaguug

SEQ ID NO: 3997771 - RNA, 18 nt, Staphylococcus aureus subsp. aureus Mu50
uucuacuuaguaauaaga

SEQ ID NO: 3997772 - RNA, 14 nt, Staphylococcus aureus subsp. aureus Mu50
uucuagauucauau

SEQ ID NO: 3997773 - RNA, 18 nt, Staphylococcus aureus subsp. aureus Mu50
uucuagauucauauuuau

SEQ ID NO: 3997774 - RNA, 19 nt, Staphylococcus aureus subsp. aureus Mu50
uucuagauucauauuuaua

SEQ ID NO: 3997775 - RNA, 13 nt, Staphylococcus aureus subsp. aureus Mu50
uucuagcuuuagu

SEQ ID NO: 3997776 - RNA, 21 nt, Staphylococcus aureus subsp. aureus Mu50
uucuagucaggggccccaaca

SEQ ID NO: 3997777 - RNA, 14 nt, Staphylococcus aureus subsp. aureus Mu50
uucuagugaaauac

SEQ ID NO: 3997778 - RNA, 13 nt, Staphylococcus aureus subsp. aureus Mu50
uucuaguuuucau

SEQ ID NO: 3997779 - RNA, 20 nt, Staphylococcus aureus subsp. aureus Mu50
uucuauaaagaaugauuuau

SEQ ID NO: 3997780 - RNA, 16 nt, Staphylococcus aureus subsp. aureus Mu50
uucuauaauaaaucga

SEQ ID NO: 3997781 - RNA, 14 nt, Staphylococcus aureus subsp. aureus Mu50
uucuauaauucacu

SEQ ID NO: 3997782 - RNA, 17 nt, Staphylococcus aureus subsp. aureus Mu50
uucuauaauucacuuua

SEQ ID NO: 3997783 - RNA, 14 nt, Staphylococcus aureus subsp. aureus Mu50
uucuauaauuuuaa

SEQ ID NO: 3997784 - RNA, 20 nt, Staphylococcus aureus subsp. aureus Mu50
uucuauacauuccaaaguac

SEQ ID NO: 3997785 - RNA, 17 nt, Staphylococcus aureus subsp. aureus Mu50
uucuauauaauuuauuu

SEQ ID NO: 3997786 - RNA, 18 nt, Staphylococcus aureus subsp. aureus Mu50
uucuauauaauuuauuua

SEQ ID NO: 3997787 - RNA, 18 nt, Staphylococcus aureus subsp. aureus Mu50
uucuauauaguaaaauaa

SEQ ID NO: 3997788 - RNA, 23 nt, Staphylococcus aureus subsp. aureus Mu50
uucuauaucuauuuaucauacuu

SEQ ID NO: 3997789 - RNA, 13 nt, Staphylococcus aureus subsp. aureus Mu50
uucuaucaaauaa

SEQ ID NO: 3997790 - RNA, 13 nt, Staphylococcus aureus subsp. aureus Mu50
uucuaucuucaca

SEQ ID NO: 3997791 - RNA, 18 nt, Staphylococcus aureus subsp. aureus Mu50
uucuaugcucuacgaagu

SEQ ID NO: 3997792 - RNA, 17 nt, Staphylococcus aureus subsp. aureus Mu50
uucuauggcacaaauga

SEQ ID NO: 3997793 - RNA, 19 nt, Staphylococcus aureus subsp. aureus Mu50
uucuauuaaacauuuuuga

SEQ ID NO: 3997794 - RNA, 20 nt, Staphylococcus aureus subsp. aureus Mu50
uucuauuaaacuuccuuuuu

SEQ ID NO: 3997795 - RNA, 13 nt, Staphylococcus aureus subsp. aureus Mu50
uucuauuaagaaa

SEQ ID NO: 3997796 - RNA, 19 nt, Staphylococcus aureus subsp. aureus Mu50
uucuauuaagaaauacuca

SEQ ID NO: 3997797 - RNA, 13 nt, Staphylococcus aureus subsp. aureus Mu50
uucuauuaauaau

SEQ ID NO: 3997798 - RNA, 21 nt, Staphylococcus aureus subsp. aureus Mu50
uucuauuaauaauuugguuaa

SEQ ID NO: 3997799 - RNA, 15 nt, Staphylococcus aureus subsp. aureus Mu50
uucuauucaaaaagg

SEQ ID NO: 3997800 - RNA, 14 nt, Staphylococcus aureus subsp. aureus Mu50
uucuauuuuauaau

SEQ ID NO: 3997801 - RNA, 18 nt, Staphylococcus aureus subsp. aureus Mu50
uucuauuuuauaauaaau

SEQ ID NO: 3997802 - RNA, 17 nt, Staphylococcus aureus subsp. aureus Mu50
uucuauuuucauagaug

SEQ ID NO: 3997803 - RNA, 15 nt, Staphylococcus aureus subsp. aureus Mu50
uucuauuuuucaauu

SEQ ID NO: 3997804 - RNA, 20 nt, Staphylococcus aureus subsp. aureus Mu50
uucuauuuuugauuuaauaa

SEQ ID NO: 3997805 - RNA, 21 nt, Staphylococcus aureus subsp. aureus Mu50
uucuauuuuugauuuaauaau

SEQ ID NO: 3997806 - RNA, 23 nt, Staphylococcus aureus subsp. aureus Mu50
uucucaacaaaucuauaaauauc

SEQ ID NO: 3997807 - RNA, 17 nt, Staphylococcus aureus subsp. aureus Mu50
uucucacaacugcauau

SEQ ID NO: 3997808 - RNA, 18 nt, Staphylococcus aureus subsp. aureus Mu50
uucucauacuauaagcaa

SEQ ID NO: 3997809 - RNA, 17 nt, Staphylococcus aureus subsp. aureus Mu50
uucucauuaaccuuaca

SEQ ID NO: 3997810 - RNA, 13 nt, Staphylococcus aureus subsp. aureus Mu50
uucucauuauaau

SEQ ID NO: 3997811 - RNA, 23 nt, Staphylococcus aureus subsp. aureus Mu50
uucucccauacugauuaacaagg

SEQ ID NO: 3997812 - RNA, 15 nt, Staphylococcus aureus subsp. aureus Mu50
uucucccuuaaauac

SEQ ID NO: 3997813 - RNA, 15 nt, Staphylococcus aureus subsp. aureus Mu50
uucuccguuaauuua

SEQ ID NO: 3997814 - RNA, 18 nt, Staphylococcus aureus subsp. aureus Mu50
uucuccuaauaauuuggu

SEQ ID NO: 3997815 - RNA, 21 nt, Staphylococcus aureus subsp. aureus Mu50
uucuccuucaauguucaauuc

SEQ ID NO: 3997816 - RNA, 21 nt, Staphylococcus aureus subsp. aureus Mu50
uucucgauacaaaggauuauu

SEQ ID NO: 3997817 - RNA, 22 nt, Staphylococcus aureus subsp. aureus Mu50
uucucgccaacccgcuuuauga

SEQ ID NO: 3997818 - RNA, 17 nt, Staphylococcus aureus subsp. aureus Mu50
uucucuaacuuuaccaa

SEQ ID NO: 3997819 - RNA, 19 nt, Staphylococcus aureus subsp. aureus Mu50
uucucuaacuuuaccaaua

SEQ ID NO: 3997820 - RNA, 13 nt, Staphylococcus aureus subsp. aureus Mu50
uucucuaaucacu

SEQ ID NO: 3997821 - RNA, 20 nt, Staphylococcus aureus subsp. aureus Mu50
uucucuaucaguaugaaguu

SEQ ID NO: 3997822 - RNA, 14 nt, Staphylococcus aureus subsp. aureus Mu50
uucucucuuauuaa

SEQ ID NO: 3997823 - RNA, 13 nt, Staphylococcus aureus subsp. aureus Mu50
uucucuuaaauau

SEQ ID NO: 3997824 - RNA, 20 nt, Staphylococcus aureus subsp. aureus Mu50
uucugaaacuuuaauacuac

SEQ ID NO: 3997825 - RNA, 21 nt, Staphylococcus aureus subsp. aureus Mu50
uucugaaaugauacauuauua

SEQ ID NO: 3997826 - RNA, 16 nt, Staphylococcus aureus subsp. aureus Mu50
uucugauucuucacua

SEQ ID NO: 3997827 - RNA, 21 nt, Staphylococcus aureus subsp. aureus Mu50
uucugccauaaacauggucaa

SEQ ID NO: 3997828 - RNA, 20 nt, Staphylococcus aureus subsp. aureus Mu50
uucugcgugcuuaauuacaa

SEQ ID NO: 3997829 - RNA, 18 nt, Staphylococcus aureus subsp. aureus Mu50
uugaacguuuauuuuuau

SEQ ID NO: 3997830 - RNA, 12 nt, Staphylococcus aureus subsp. aureus Mu50
uugaacuuuuau

SEQ ID NO: 3997831 - RNA, 18 nt, Staphylococcus aureus subsp. aureus Mu50
uugaagaagguaauaaag

SEQ ID NO: 3997832 - RNA, 19 nt, Staphylococcus aureus subsp. aureus Mu50
uugaagaauaaaaaaguug

SEQ ID NO: 3997833 - RNA, 18 nt, Staphylococcus aureus subsp. aureus Mu50
uugaagaauguuucauau

SEQ ID NO: 3997834 - RNA, 22 nt, Staphylococcus aureus subsp. aureus Mu50
uugaagaauguuucauaugcau

SEQ ID NO: 3997835 - RNA, 15 nt, Staphylococcus aureus subsp. aureus Mu50
uugaaggaaaauaaa

SEQ ID NO: 3997836 - RNA, 18 nt, Staphylococcus aureus subsp. aureus Mu50
uugaaguacauuaaaaca

SEQ ID NO: 3997837 - RNA, 15 nt, Staphylococcus aureus subsp. aureus Mu50
uugaagugaguuuau

SEQ ID NO: 3997838 - RNA, 17 nt, Staphylococcus aureus subsp. aureus Mu50
uugaagugauuugccaa

SEQ ID NO: 3997839 - RNA, 21 nt, Staphylococcus aureus subsp. aureus Mu50
uugaaguuacuauauuuauua

SEQ ID NO: 3997840 - RNA, 17 nt, Staphylococcus aureus subsp. aureus Mu50
uugaauaaauuuuauuc

SEQ ID NO: 3997841 - RNA, 22 nt, Staphylococcus aureus subsp. aureus Mu50
uugaauaacacuagaaaguugu

SEQ ID NO: 3997842 - RNA, 19 nt, Staphylococcus aureus subsp. aureus Mu50
uugaauaauauauuuagga

SEQ ID NO: 3997843 - RNA, 19 nt, Staphylococcus aureus subsp. aureus Mu50
uugaauaauuaauguuucu

SEQ ID NO: 3997844 - RNA, 22 nt, Staphylococcus aureus subsp. aureus Mu50
uugaauacuuuuuaacugguug

SEQ ID NO: 3997845 - RNA, 23 nt, Staphylococcus aureus subsp. aureus Mu50
uugaauauggaaaauguauuauu

SEQ ID NO: 3997846 - RNA, 19 nt, Staphylococcus aureus subsp. aureus Mu50
uugaauauuguuguaaaug

SEQ ID NO: 3997847 - RNA, 16 nt, Staphylococcus aureus subsp. aureus Mu50
uugaauauuugcuuuu

SEQ ID NO: 3997848 - RNA, 11 nt, Staphylococcus aureus subsp. aureus Mu50
uugaauauuuu

SEQ ID NO: 3997849 - RNA, 22 nt, Staphylococcus aureus subsp. aureus Mu50
uugaaucggugucuuuauguuu

SEQ ID NO: 3997850 - RNA, 15 nt, Staphylococcus aureus subsp. aureus Mu50
uugaaucuuguugaa

SEQ ID NO: 3997851 - RNA, 23 nt, Staphylococcus aureus subsp. aureus Mu50
uugaaugauauuaacuguaccau

SEQ ID NO: 3997852 - RNA, 18 nt, Staphylococcus aureus subsp. aureus Mu50
uugaaugguauaauuccu

SEQ ID NO: 3997853 - RNA, 14 nt, Staphylococcus aureus subsp. aureus Mu50
uugaauguuucucc

SEQ ID NO: 3997854 - RNA, 17 nt, Staphylococcus aureus subsp. aureus Mu50
uugaauugaaaaauuaa

SEQ ID NO: 3997855 - RNA, 23 nt, Staphylococcus aureus subsp. aureus Mu50
uugaauugacuuacauuuuaaua

SEQ ID NO: 3997856 - RNA, 16 nt, Staphylococcus aureus subsp. aureus Mu50
uugaauuuuauuaggu

SEQ ID NO: 3997857 - RNA, 19 nt, Staphylococcus aureus subsp. aureus Mu50
uugacacacccaaauuuag

SEQ ID NO: 3997858 - RNA, 21 nt, Staphylococcus aureus subsp. aureus Mu50
uugacaguuuccauaaauaaa

SEQ ID NO: 3997859 - RNA, 15 nt, Staphylococcus aureus subsp. aureus Mu50
uugacauauuuuuua

SEQ ID NO: 3997860 - RNA, 18 nt, Staphylococcus aureus subsp. aureus Mu50
uugacauguguuaaacca

SEQ ID NO: 3997861 - RNA, 23 nt, Staphylococcus aureus subsp. aureus Mu50
uugaccaccacuuucaguaauug

SEQ ID NO: 3997862 - RNA, 19 nt, Staphylococcus aureus subsp. aureus Mu50
uugaccaccugauaaugca

SEQ ID NO: 3997863 - RNA, 20 nt, Staphylococcus aureus subsp. aureus Mu50
uugacgaguagauucguacc

SEQ ID NO: 3997864 - RNA, 19 nt, Staphylococcus aureus subsp. aureus Mu50
uugacgccagaauaaaucc

SEQ ID NO: 3997865 - RNA, 14 nt, Staphylococcus aureus subsp. aureus Mu50
uugacguucugauc

SEQ ID NO: 3997866 - RNA, 14 nt, Staphylococcus aureus subsp. aureus Mu50
uugacuaaguuugu

SEQ ID NO: 3997867 - RNA, 23 nt, Staphylococcus aureus subsp. aureus Mu50
uugacuacucaauccuaaauuau

SEQ ID NO: 3997868 - RNA, 19 nt, Staphylococcus aureus subsp. aureus Mu50
uugacucaaagauauacuu

SEQ ID NO: 3997869 - RNA, 20 nt, Staphylococcus aureus subsp. aureus Mu50
uugacucaaagauauacuua

SEQ ID NO: 3997870 - RNA, 15 nt, Staphylococcus aureus subsp. aureus Mu50
uugacuuuaucaauu

SEQ ID NO: 3997871 - RNA, 16 nt, Staphylococcus aureus subsp. aureus Mu50
uugacuuuaucaauug

SEQ ID NO: 3997872 - RNA, 22 nt, Staphylococcus aureus subsp. aureus Mu50
uugagaaccacuauaauuucuu

SEQ ID NO: 3997873 - RNA, 14 nt, Staphylococcus aureus subsp. aureus Mu50
uugagaauauuuau

SEQ ID NO: 3997874 - RNA, 14 nt, Staphylococcus aureus subsp. aureus Mu50
uugagacaacauug

SEQ ID NO: 3997875 - RNA, 18 nt, Staphylococcus aureus subsp. aureus Mu50
uugagacaauucguaaau

SEQ ID NO: 3997876 - RNA, 18 nt, Staphylococcus aureus subsp. aureus Mu50
uugagagauuauuuaaaa

SEQ ID NO: 3997877 - RNA, 15 nt, Staphylococcus aureus subsp. aureus Mu50
uugagcguuuaauua

SEQ ID NO: 3997878 - RNA, 23 nt, Staphylococcus aureus subsp. aureus Mu50
uugaggaccacggucuugauauu

SEQ ID NO: 3997879 - RNA, 16 nt, Staphylococcus aureus subsp. aureus Mu50
uugagguguggaguaa

SEQ ID NO: 3997880 - RNA, 22 nt, Staphylococcus aureus subsp. aureus Mu50
uugaguaucaugcuuuuaauau

SEQ ID NO: 3997881 - RNA, 15 nt, Staphylococcus aureus subsp. aureus Mu50
uugaguauuaaauuu

SEQ ID NO: 3997882 - RNA, 17 nt, Staphylococcus aureus subsp. aureus Mu50
uugagucuuagacauug

SEQ ID NO: 3997883 - RNA, 21 nt, Staphylococcus aureus subsp. aureus Mu50
uugaguguguccaucauuugu

SEQ ID NO: 3997884 - RNA, 15 nt, Staphylococcus aureus subsp. aureus Mu50
uugauaaaauaaaua

SEQ ID NO: 3997885 - RNA, 16 nt, Staphylococcus aureus subsp. aureus Mu50
uugauaaaauaaauaa

SEQ ID NO: 3997886 - RNA, 17 nt, Staphylococcus aureus subsp. aureus Mu50
uugauaaaauaaauaag

SEQ ID NO: 3997887 - RNA, 13 nt, Staphylococcus aureus subsp. aureus Mu50
uugauaaaauaau

SEQ ID NO: 3997888 - RNA, 17 nt, Staphylococcus aureus subsp. aureus Mu50
uugauaaauauugaaca

SEQ ID NO: 3997889 - RNA, 21 nt, Staphylococcus aureus subsp. aureus Mu50
uugauaaaugcgguugauggu

SEQ ID NO: 3997890 - RNA, 16 nt, Staphylococcus aureus subsp. aureus Mu50
uugauaacaauuuuaa

SEQ ID NO: 3997891 - RNA, 21 nt, Staphylococcus aureus subsp. aureus Mu50
uugauaagaaaaaguuauauc

SEQ ID NO: 3997892 - RNA, 13 nt, Staphylococcus aureus subsp. aureus Mu50
uugauaagucuug

SEQ ID NO: 3997893 - RNA, 22 nt, Staphylococcus aureus subsp. aureus Mu50
uugauaaguucuagauuauuua

SEQ ID NO: 3997894 - RNA, 15 nt, Staphylococcus aureus subsp. aureus Mu50
uugauagacuaauua

SEQ ID NO: 3997895 - RNA, 19 nt, Staphylococcus aureus subsp. aureus Mu50
uugauagcaccguaacaua

SEQ ID NO: 3997896 - RNA, 15 nt, Staphylococcus aureus subsp. aureus Mu50
uugauagcuaaugca

SEQ ID NO: 3997897 - RNA, 17 nt, Staphylococcus aureus subsp. aureus Mu50
uugauaguaauaguuaa

SEQ ID NO: 3997898 - RNA, 11 nt, Staphylococcus aureus subsp. aureus Mu50
uugauagucac

SEQ ID NO: 3997899 - RNA, 20 nt, Staphylococcus aureus subsp. aureus Mu50
uugauaguuguaucauuaau

SEQ ID NO: 3997900 - RNA, 23 nt, Staphylococcus aureus subsp. aureus Mu50
uugauauagucaaugaauaauga

SEQ ID NO: 3997901 - RNA, 21 nt, Staphylococcus aureus subsp. aureus Mu50
uugauauaguuauaugugcuu

SEQ ID NO: 3997902 - RNA, 21 nt, Staphylococcus aureus subsp. aureus Mu50
uugauaucgaaacgcuuugca

SEQ ID NO: 3997903 - RNA, 19 nt, Staphylococcus aureus subsp. aureus Mu50
uugauauggcguauucacc

SEQ ID NO: 3997904 - RNA, 18 nt, Staphylococcus aureus subsp. aureus Mu50
uugauaugguuagagaaa

SEQ ID NO: 3997905 - RNA, 22 nt, Staphylococcus aureus subsp. aureus Mu50
uugauaugguuagagaaaaauc

SEQ ID NO: 3997906 - RNA, 16 nt, Staphylococcus aureus subsp. aureus Mu50
uugauauucuaaaaaa

SEQ ID NO: 3997907 - RNA, 13 nt, Staphylococcus aureus subsp. aureus Mu50
uugauauuucauc

SEQ ID NO: 3997908 - RNA, 17 nt, Staphylococcus aureus subsp. aureus Mu50
uugaucaaaaauguuau

SEQ ID NO: 3997909 - RNA, 14 nt, Staphylococcus aureus subsp. aureus Mu50
uugaucauaauuca

SEQ ID NO: 3997910 - RNA, 18 nt, Staphylococcus aureus subsp. aureus Mu50
uugaucgauuguuuauua

SEQ ID NO: 3997911 - RNA, 15 nt, Staphylococcus aureus subsp. aureus Mu50
uugaucuacuaaaga

SEQ ID NO: 3997912 - RNA, 16 nt, Staphylococcus aureus subsp. aureus Mu50
uugaucugauuucacu

SEQ ID NO: 3997913 - RNA, 16 nt, Staphylococcus aureus subsp. aureus Mu50
uugaucuuugacaugu

SEQ ID NO: 3997914 - RNA, 15 nt, Staphylococcus aureus subsp. aureus Mu50
uugaugaauaaauag

SEQ ID NO: 3997915 - RNA, 19 nt, Staphylococcus aureus subsp. aureus Mu50
uugaugaugaugugcuuua

SEQ ID NO: 3997916 - RNA, 16 nt, Staphylococcus aureus subsp. aureus Mu50
uugcuuuaucaauaau

SEQ ID NO: 3997917 - RNA, 21 nt, Staphylococcus aureus subsp. aureus Mu50
uugcuuuuucaaauaauauaa

SEQ ID NO: 3997918 - RNA, 23 nt, Staphylococcus aureus subsp. aureus Mu50
uugcuuuuucucugcuguaacca

SEQ ID NO: 3997919 - RNA, 14 nt, Staphylococcus aureus subsp. aureus Mu50
uuggaaaaauugug

SEQ ID NO: 3997920 - RNA, 18 nt, Staphylococcus aureus subsp. aureus Mu50
uuggaaauuuauuauaaa

SEQ ID NO: 3997921 - RNA, 18 nt, Staphylococcus aureus subsp. aureus Mu50
uuggaacauauucauaau

SEQ ID NO: 3997922 - RNA, 12 nt, Staphylococcus aureus subsp. aureus Mu50
uuggaagucugc

SEQ ID NO: 3997923 - RNA, 13 nt, Staphylococcus aureus subsp. aureus Mu50
uuggaauacucuu

SEQ ID NO: 3997924 - RNA, 14 nt, Staphylococcus aureus subsp. aureus Mu50
uuggaauagauguu

SEQ ID NO: 3997925 - RNA, 14 nt, Staphylococcus aureus subsp. aureus Mu50
uuggaaucaucuuu

SEQ ID NO: 3997926 - RNA, 23 nt, Staphylococcus aureus subsp. aureus Mu50
uuggaaucaucuuuuugaaauuu

SEQ ID NO: 3997927 - RNA, 14 nt, Staphylococcus aureus subsp. aureus Mu50
uuggacuaauaauu

SEQ ID NO: 3997928 - RNA, 18 nt, Staphylococcus aureus subsp. aureus Mu50
uuggauaauuucuucuuc

SEQ ID NO: 3997929 - RNA, 14 nt, Staphylococcus aureus subsp. aureus Mu50
uuggaucuuucaaa

SEQ ID NO: 3997930 - RNA, 23 nt, Staphylococcus aureus subsp. aureus Mu50
uuggaugaacaaaauaacauguu

SEQ ID NO: 3997931 - RNA, 17 nt, Staphylococcus aureus subsp. aureus Mu50
uuggauuuuaacaagau

SEQ ID NO: 3997932 - RNA, 20 nt, Staphylococcus aureus subsp. aureus Mu50
uuggauuuuuugguuucuau

SEQ ID NO: 3997933 - RNA, 23 nt, Staphylococcus aureus subsp. aureus Mu50
uuggcaauuguuuaucuccuaaa

SEQ ID NO: 3997934 - RNA, 17 nt, Staphylococcus aureus subsp. aureus Mu50
uuggcacauaaaucaau

SEQ ID NO: 3997935 - RNA, 19 nt, Staphylococcus aureus subsp. aureus Mu50
uuggcacauaaaucaaugu

SEQ ID NO: 3997936 - RNA, 21 nt, Staphylococcus aureus subsp. aureus Mu50
uuggcggggccccaacacaga

SEQ ID NO: 3997937 - RNA, 18 nt, Staphylococcus aureus subsp. aureus Mu50
uuggcguauuuuuuguuc

SEQ ID NO: 3997938 - RNA, 17 nt, Staphylococcus aureus subsp. aureus Mu50
uuggcuggcccccaaca

SEQ ID NO: 3997939 - RNA, 17 nt, Staphylococcus aureus subsp. aureus Mu50
uuggcuucgucaucaac

SEQ ID NO: 3997940 - RNA, 16 nt, Staphylococcus aureus subsp. aureus Mu50
uuggcuugaaguuguu

SEQ ID NO: 3997941 - RNA, 15 nt, Staphylococcus aureus subsp. aureus Mu50
uugggaauugaccac

SEQ ID NO: 3997942 - RNA, 14 nt, Staphylococcus aureus subsp. aureus Mu50
uugggauauagaaa

SEQ ID NO: 3997943 - RNA, 17 nt, Staphylococcus aureus subsp. aureus Mu50
uuggggaugggccccaa

SEQ ID NO: 3997944 - RNA, 23 nt, Staphylococcus aureus subsp. aureus Mu50
uuggggaugggccccaacaaaga

SEQ ID NO: 3997945 - RNA, 20 nt, Staphylococcus aureus subsp. aureus Mu50
uuggggcccacaccccaacu

SEQ ID NO: 3997946 - RNA, 19 nt, Staphylococcus aureus subsp. aureus Mu50
uuggggccccgacuauuuu

SEQ ID NO: 3997947 - RNA, 18 nt, Staphylococcus aureus subsp. aureus Mu50
uuggggugagggccccaa

SEQ ID NO: 3997948 - RNA, 20 nt, Staphylococcus aureus subsp. aureus Mu50
uuggggugagggccccaaca

SEQ ID NO: 3997949 - RNA, 16 nt, Staphylococcus aureus subsp. aureus Mu50
uuggguaauguuuuua

SEQ ID NO: 3997950 - RNA, 17 nt, Staphylococcus aureus subsp. aureus Mu50
uuggguggucguaauuu

SEQ ID NO: 3997951 - RNA, 20 nt, Staphylococcus aureus subsp. aureus Mu50
uugguaaaaaucucaaaauu

SEQ ID NO: 3997952 - RNA, 18 nt, Staphylococcus aureus subsp. aureus Mu50
uugguagcauuuuagauu

SEQ ID NO: 3997953 - RNA, 21 nt, Staphylococcus aureus subsp. aureus Mu50
uugguauaagaggauuucuag

SEQ ID NO: 3997954 - RNA, 20 nt, Staphylococcus aureus subsp. aureus Mu50
uugguauacaguuuuacuau

SEQ ID NO: 3997955 - RNA, 23 nt, Staphylococcus aureus subsp. aureus Mu50
uugguauacaguuuuacuauaau

SEQ ID NO: 3997956 - RNA, 16 nt, Staphylococcus aureus subsp. aureus Mu50
uuggucaaguaaaugu

SEQ ID NO: 3997957 - RNA, 19 nt, Staphylococcus aureus subsp. aureus Mu50
uuggucaccuacagauaaa

SEQ ID NO: 3997958 - RNA, 21 nt, Staphylococcus aureus subsp. aureus Mu50
uuggucaccuacagauaaagc

SEQ ID NO: 3997959 - RNA, 18 nt, Staphylococcus aureus subsp. aureus Mu50
uuggucauagaaauuuua

SEQ ID NO: 3997960 - RNA, 19 nt, Staphylococcus aureus subsp. aureus Mu50
uuggugaguguuucauaau

SEQ ID NO: 3997961 - RNA, 23 nt, Staphylococcus aureus subsp. aureus Mu50
uugguggaugucaugucuagauu

SEQ ID NO: 3997962 - RNA, 16 nt, Staphylococcus aureus subsp. aureus Mu50
uuggugugguaaaagc

SEQ ID NO: 3997963 - RNA, 21 nt, Staphylococcus aureus subsp. aureus Mu50
uugguuaauacguuuaauaau

SEQ ID NO: 3997964 - RNA, 14 nt, Staphylococcus aureus subsp. aureus Mu50
uugguuacuuagua

SEQ ID NO: 3997965 - RNA, 15 nt, Staphylococcus aureus subsp. aureus Mu50
uugguugaacuguuu

SEQ ID NO: 3997966 - RNA, 17 nt, Staphylococcus aureus subsp. aureus Mu50
uugguuuagacaaccag

SEQ ID NO: 3997967 - RNA, 18 nt, Staphylococcus aureus subsp. aureus Mu50
uugguuucuauaaagaau

SEQ ID NO: 3997968 - RNA, 12 nt, Staphylococcus aureus subsp. aureus Mu50
uuguaaauuuaa

SEQ ID NO: 3997969 - RNA, 15 nt, Staphylococcus aureus subsp. aureus Mu50
uuguaaauuuauuuu

SEQ ID NO: 3997970 - RNA, 14 nt, Staphylococcus aureus subsp. aureus Mu50
uuguaaauuuuuaa

SEQ ID NO: 3997971 - RNA, 20 nt, Staphylococcus aureus subsp. aureus Mu50
uuguaacaagcuuuuuucaa

SEQ ID NO: 3997972 - RNA, 15 nt, Staphylococcus aureus subsp. aureus Mu50
uuguaacuauugaaa

SEQ ID NO: 3997973 - RNA, 22 nt, Staphylococcus aureus subsp. aureus Mu50
uuguaagucgcucuagacauua

SEQ ID NO: 3997974 - RNA, 18 nt, Staphylococcus aureus subsp. aureus Mu50
uuguaaucccauuuuaaa

SEQ ID NO: 3997975 - RNA, 16 nt, Staphylococcus aureus subsp. aureus Mu50
uuguaauccuuguucu

SEQ ID NO: 3997976 - RNA, 16 nt, Staphylococcus aureus subsp. aureus Mu50
uuguaauugaaaugau

SEQ ID NO: 3997977 - RNA, 17 nt, Staphylococcus aureus subsp. aureus Mu50
uuguaauuguaaucuau

SEQ ID NO: 3997978 - RNA, 11 nt, Staphylococcus aureus subsp. aureus Mu50
uuguaauuuaa

SEQ ID NO: 3997979 - RNA, 15 nt, Staphylococcus aureus subsp. aureus Mu50
uuguaauuuaaaaua

SEQ ID NO: 3997980 - RNA, 16 nt, Staphylococcus aureus subsp. aureus Mu50
uuguacauauguguau

SEQ ID NO: 3997981 - RNA, 18 nt, Staphylococcus aureus subsp. aureus Mu50
uuguacaucauuaaauau

SEQ ID NO: 3997982 - RNA, 19 nt, Staphylococcus aureus subsp. aureus Mu50
uuguacaucauuaaauauu

SEQ ID NO: 3997983 - RNA, 22 nt, Staphylococcus aureus subsp. aureus Mu50
uuguaccaaauaaauuaaauuu

SEQ ID NO: 3997984 - RNA, 21 nt, Staphylococcus aureus subsp. aureus Mu50
uuguacgcuucaauuauuuca

SEQ ID NO: 3997985 - RNA, 16 nt, Staphylococcus aureus subsp. aureus Mu50
uuguacuucuuugguc

SEQ ID NO: 3997986 - RNA, 18 nt, Staphylococcus aureus subsp. aureus Mu50
uuguagcuugaauaauau

SEQ ID NO: 3997987 - RNA, 23 nt, Staphylococcus aureus subsp. aureus Mu50
uuguagggaguauuguuuuauau

SEQ ID NO: 3997988 - RNA, 17 nt, Staphylococcus aureus subsp. aureus Mu50
uuguauagaauguguau

SEQ ID NO: 3997989 - RNA, 20 nt, Staphylococcus aureus subsp. aureus Mu50
uuguauagauuguauuuaau

SEQ ID NO: 3997990 - RNA, 22 nt, Staphylococcus aureus subsp. aureus Mu50
uuguauagauuguauuuaauaa

SEQ ID NO: 3997991 - RNA, 23 nt, Staphylococcus aureus subsp. aureus Mu50
uuguaucaacauuaauaaauaau

SEQ ID NO: 3997992 - RNA, 23 nt, Staphylococcus aureus subsp. aureus Mu50
uuguaucuucucggcaagugcuu

SEQ ID NO: 3997993 - RNA, 13 nt, Staphylococcus aureus subsp. aureus Mu50
uuguaugaauaau

SEQ ID NO: 3997994 - RNA, 21 nt, Staphylococcus aureus subsp. aureus Mu50
uuguaugcaucaguuaauaau

SEQ ID NO: 3997995 - RNA, 19 nt, Staphylococcus aureus subsp. aureus Mu50
uuguauucugaaacuuuaa

SEQ ID NO: 3997996 - RNA, 14 nt, Staphylococcus aureus subsp. aureus Mu50
uuguauuuaauaag

SEQ ID NO: 3997997 - RNA, 21 nt, Staphylococcus aureus subsp. aureus Mu50
uugucaaaauugaacuuugua

SEQ ID NO: 3997998 - RNA, 11 nt, Staphylococcus aureus subsp. aureus Mu50
uugucacaauc

SEQ ID NO: 3997999 - RNA, 19 nt, Staphylococcus aureus subsp. aureus Mu50
uugucacgauagauuuauc

SEQ ID NO: 3998000 - RNA, 20 nt, Staphylococcus aureus subsp. aureus Mu50
uugucaguuuuuuuauaagc

SEQ ID NO: 3998001 - RNA, 18 nt, Staphylococcus aureus subsp. aureus Mu50
uugucauaauagauaaug

SEQ ID NO: 3998002 - RNA, 21 nt, Staphylococcus aureus subsp. aureus Mu50
uugucauaccaaauaaauaag

SEQ ID NO: 3998003 - RNA, 22 nt, Staphylococcus aureus subsp. aureus Mu50
uuuaaaaauaaaaaaccaauaa

SEQ ID NO: 3998004 - RNA, 15 nt, Staphylococcus aureus subsp. aureus Mu50
uuuaaaaaucaaaga

SEQ ID NO: 3998005 - RNA, 21 nt, Staphylococcus aureus subsp. aureus Mu50
uuuaaaaaugcuguuuuaugg

SEQ ID NO: 3998006 - RNA, 16 nt, Staphylococcus aureus subsp. aureus Mu50
uuuaaaaauucauaau

SEQ ID NO: 3998007 - RNA, 22 nt, Staphylococcus aureus subsp. aureus Mu50
uuuaaaacaaugauuaaaauua

SEQ ID NO: 3998008 - RNA, 19 nt, Staphylococcus aureus subsp. aureus Mu50
uuuaaaacuuguaaauuua

SEQ ID NO: 3998009 - RNA, 13 nt, Staphylococcus aureus subsp. aureus Mu50
uuuaaaagagaau

SEQ ID NO: 3998010 - RNA, 21 nt, Staphylococcus aureus subsp. aureus Mu50
uuuaaaauacgacaccaacau

SEQ ID NO: 3998011 - RNA, 17 nt, Staphylococcus aureus subsp. aureus Mu50
uuuaaaauauaaauuuc

SEQ ID NO: 3998012 - RNA, 19 nt, Staphylococcus aureus subsp. aureus Mu50
uuuaaaauauaaauuucuu

SEQ ID NO: 3998013 - RNA, 16 nt, Staphylococcus aureus subsp. aureus Mu50
uuuaaaaucucauaau

SEQ ID NO: 3998014 - RNA, 18 nt, Staphylococcus aureus subsp. aureus Mu50
uuuaaaaucucauaauaa

SEQ ID NO: 3998015 - RNA, 20 nt, Staphylococcus aureus subsp. aureus Mu50
uuuaaaaucucauaauaauu

SEQ ID NO: 3998016 - RNA, 11 nt, Staphylococcus aureus subsp. aureus Mu50
uuuaaaaugcu

SEQ ID NO: 3998017 - RNA, 22 nt, Staphylococcus aureus subsp. aureus Mu50
uuuaaaauuauuuggcucuaua

SEQ ID NO: 3998018 - RNA, 18 nt, Staphylococcus aureus subsp. aureus Mu50
uuuaaacauccaauuaug

SEQ ID NO: 3998019 - RNA, 21 nt, Staphylococcus aureus subsp. aureus Mu50
uuuaaacguacauuuuuauga

SEQ ID NO: 3998020 - RNA, 15 nt, Staphylococcus aureus subsp. aureus Mu50
uuuaaagaaaaguuu

SEQ ID NO: 3998021 - RNA, 16 nt, Staphylococcus aureus subsp. aureus Mu50
uuuaaagaaaaguuua

SEQ ID NO: 3998022 - RNA, 15 nt, Staphylococcus aureus subsp. aureus Mu50
uuuaaagaaaauuuc

SEQ ID NO: 3998023 - RNA, 20 nt, Staphylococcus aureus subsp. aureus Mu50
uuuaaagaacuauuuuaaau

SEQ ID NO: 3998024 - RNA, 21 nt, Staphylococcus aureus subsp. aureus Mu50
uuuaaagaacuauuuuaaauu

SEQ ID NO: 3998025 - RNA, 16 nt, Staphylococcus aureus subsp. aureus Mu50
uuuaaagcuaaauguu

SEQ ID NO: 3998026 - RNA, 16 nt, Staphylococcus aureus subsp. aureus Mu50
uuuaaaggcauaauaa

SEQ ID NO: 3998027 - RNA, 20 nt, Staphylococcus aureus subsp. aureus Mu50
uuuaaaguuguugaaauuuc

SEQ ID NO: 3998028 - RNA, 21 nt, Staphylococcus aureus subsp. aureus Mu50
uuuaaaguuguugaaauuucu

SEQ ID NO: 3998029 - RNA, 22 nt, Staphylococcus aureus subsp. aureus Mu50
uuuaaauaaaugacuucacauu

SEQ ID NO: 3998030 - RNA, 19 nt, Staphylococcus aureus subsp. aureus Mu50
uuuaaaucuuguucuaauu

SEQ ID NO: 3998031 - RNA, 19 nt, Staphylococcus aureus subsp. aureus Mu50
uuuaaaugauuucacuuca

SEQ ID NO: 3998032 - RNA, 18 nt, Staphylococcus aureus subsp. aureus Mu50
uuuaaaugucuuucaaau

SEQ ID NO: 3998033 - RNA, 19 nt, Staphylococcus aureus subsp. aureus Mu50
uuuaaauuaugacuuauuu

SEQ ID NO: 3998034 - RNA, 20 nt, Staphylococcus aureus subsp. aureus Mu50
uuuaaauucuuauaaaauaa

SEQ ID NO: 3998035 - RNA, 23 nt, Staphylococcus aureus subsp. aureus Mu50
uuuaaauugacuuuaauugcucu

SEQ ID NO: 3998036 - RNA, 22 nt, Staphylococcus aureus subsp. aureus Mu50
uuuaaauuggaaucccaaugcu

SEQ ID NO: 3998037 - RNA, 23 nt, Staphylococcus aureus subsp. aureus Mu50
uuuaaauuuaacucaacuuaaau

SEQ ID NO: 3998038 - RNA, 14 nt, Staphylococcus aureus subsp. aureus Mu50
uuuaaauuuaagaa

SEQ ID NO: 3998039 - RNA, 15 nt, Staphylococcus aureus subsp. aureus Mu50
uuuaaauuuucauca

SEQ ID NO: 3998040 - RNA, 20 nt, Staphylococcus aureus subsp. aureus Mu50
uuuaaauuuucaucauaauc

SEQ ID NO: 3998041 - RNA, 14 nt, Staphylococcus aureus subsp. aureus Mu50
uuuaacaaaauaua

SEQ ID NO: 3998042 - RNA, 15 nt, Staphylococcus aureus subsp. aureus Mu50
uuuaacaaaauauac

SEQ ID NO: 3998043 - RNA, 13 nt, Staphylococcus aureus subsp. aureus Mu50
uuuaacaaaauua

SEQ ID NO: 3998044 - RNA, 14 nt, Staphylococcus aureus subsp. aureus Mu50
uuuaacaacacuac

SEQ ID NO: 3998045 - RNA, 24 nt, Staphylococcus aureus subsp. aureus Mu50
uuuaacaagauaacuagcaaaugc

SEQ ID NO: 3998046 - RNA, 23 nt, Staphylococcus aureus subsp. aureus Mu50
uuuaacaauacuacuuaaugacu

SEQ ID NO: 3998047 - RNA, 20 nt, Staphylococcus aureus subsp. aureus Mu50
uuuaacaaugcgauuaaacu

SEQ ID NO: 3998048 - RNA, 16 nt, Staphylococcus aureus subsp. aureus Mu50
uuuaacacuucaguua

SEQ ID NO: 3998049 - RNA, 19 nt, Staphylococcus aureus subsp. aureus Mu50
uuuaacagcgugaauauaa

SEQ ID NO: 3998050 - RNA, 15 nt, Staphylococcus aureus subsp. aureus Mu50
uuuaacauaaaaaug

SEQ ID NO: 3998051 - RNA, 22 nt, Staphylococcus aureus subsp. aureus Mu50
uuuaacauuuguccgauuuauu

SEQ ID NO: 3998052 - RNA, 21 nt, Staphylococcus aureus subsp. aureus Mu50
uuuaaccacuccuuaaacaaa

SEQ ID NO: 3998053 - RNA, 20 nt, Staphylococcus aureus subsp. aureus Mu50
uuuaacccaaauugaugacu

SEQ ID NO: 3998054 - RNA, 16 nt, Staphylococcus aureus subsp. aureus Mu50
uuuaacccacauuaaa

SEQ ID NO: 3998055 - RNA, 21 nt, Staphylococcus aureus subsp. aureus Mu50
uuuaacccacauuaaauauua

SEQ ID NO: 3998056 - RNA, 15 nt, Staphylococcus aureus subsp. aureus Mu50
uuuaacggaaauaca

SEQ ID NO: 3998057 - RNA, 16 nt, Staphylococcus aureus subsp. aureus Mu50
uuuaacguuauucauu

SEQ ID NO: 3998058 - RNA, 18 nt, Staphylococcus aureus subsp. aureus Mu50
uuuaacguuauucauuug

SEQ ID NO: 3998059 - RNA, 13 nt, Staphylococcus aureus subsp. aureus Mu50
uuuaacuaaacca

SEQ ID NO: 3998060 - RNA, 20 nt, Staphylococcus aureus subsp. aureus Mu50
uuuaacuauguuacuuauau

SEQ ID NO: 3998061 - RNA, 18 nt, Staphylococcus aureus subsp. aureus Mu50
uuuaacugguugauaaau

SEQ ID NO: 3998062 - RNA, 17 nt, Staphylococcus aureus subsp. aureus Mu50
uuuaacuuuaucuaguu

SEQ ID NO: 3998063 - RNA, 13 nt, Staphylococcus aureus subsp. aureus Mu50
uuuaagaaugcga

SEQ ID NO: 3998064 - RNA, 18 nt, Staphylococcus aureus subsp. aureus Mu50
uuuaagauagguuuauuu

SEQ ID NO: 3998065 - RNA, 13 nt, Staphylococcus aureus subsp. aureus Mu50
uuuaagcugcucg

SEQ ID NO: 3998066 - RNA, 23 nt, Staphylococcus aureus subsp. aureus Mu50
uuuaagcugcucgauauaugucu

SEQ ID NO: 3998067 - RNA, 18 nt, Staphylococcus aureus subsp. aureus Mu50
uuuaagcuuaucaacgau

SEQ ID NO: 3998068 - RNA, 19 nt, Staphylococcus aureus subsp. aureus Mu50
uuuaaguuaucaaauugac

SEQ ID NO: 3998069 - RNA, 17 nt, Staphylococcus aureus subsp. aureus Mu50
uuuaaguuuauaaucag

SEQ ID NO: 3998070 - RNA, 18 nt, Staphylococcus aureus subsp. aureus Mu50
uuuaauaaaaaccaauau

SEQ ID NO: 3998071 - RNA, 21 nt, Staphylococcus aureus subsp. aureus Mu50
uuuaauaaaaaccaauauuuc

SEQ ID NO: 3998072 - RNA, 23 nt, Staphylococcus aureus subsp. aureus Mu50
uuuaauaaaaaccaauauuucug

SEQ ID NO: 3998073 - RNA, 17 nt, Staphylococcus aureus subsp. aureus Mu50
uuuaauaaaaucaucuu

SEQ ID NO: 3998074 - RNA, 17 nt, Staphylococcus aureus subsp. aureus Mu50
uuuaauaaaccagugcg

SEQ ID NO: 3998075 - RNA, 14 nt, Staphylococcus aureus subsp. aureus Mu50
uuuaauaacaaaau

SEQ ID NO: 3998076 - RNA, 17 nt, Staphylococcus aureus subsp. aureus Mu50
uuuaauaacaaaauuaa

SEQ ID NO: 3998077 - RNA, 19 nt, Staphylococcus aureus subsp. aureus Mu50
uuuaauaaccuuuaaaaca

SEQ ID NO: 3998078 - RNA, 20 nt, Staphylococcus aureus subsp. aureus Mu50
uuuaauaacguacauuuaug

SEQ ID NO: 3998079 - RNA, 16 nt, Staphylococcus aureus subsp. aureus Mu50
uuuaauaaguuaaugu

SEQ ID NO: 3998080 - RNA, 21 nt, Staphylococcus aureus subsp. aureus Mu50
uuuaauaauguaucauuucag

SEQ ID NO: 3998081 - RNA, 14 nt, Staphylococcus aureus subsp. aureus Mu50
uuuaauaauuaaau

SEQ ID NO: 3998082 - RNA, 18 nt, Staphylococcus aureus subsp. aureus Mu50
uuuaauaauuaaauauaa

SEQ ID NO: 3998083 - RNA, 13 nt, Staphylococcus aureus subsp. aureus Mu50
uuuaauaauugua

SEQ ID NO: 3998084 - RNA, 17 nt, Staphylococcus aureus subsp. aureus Mu50
uuuaauaccuaugauau

SEQ ID NO: 3998085 - RNA, 21 nt, Staphylococcus aureus subsp. aureus Mu50
uuuaauacuauaguaagaaaa

SEQ ID NO: 3998086 - RNA, 13 nt, Staphylococcus aureus subsp. aureus Mu50
uuuaauauaaauu

SEQ ID NO: 3998087 - RNA, 14 nt, Staphylococcus aureus subsp. aureus Mu50
uuuaauauaaauuu

SEQ ID NO: 3998088 - RNA, 21 nt, Staphylococcus aureus subsp. aureus Mu50
uuuaauauagauuugaauuaa

SEQ ID NO: 3998089 - RNA, 11 nt, Staphylococcus aureus subsp. aureus Mu50
uuuaauauuua

SEQ ID NO: 3998090 - RNA, 15 nt, Staphylococcus aureus subsp. aureus Mu50
uuuaguauaaauaaa

SEQ ID NO: 3998091 - RNA, 17 nt, Staphylococcus aureus subsp. aureus Mu50
uuuaguaucucauuuuu

SEQ ID NO: 3998092 - RNA, 18 nt, Staphylococcus aureus subsp. aureus Mu50
uuuaguaucucauuuuuu

SEQ ID NO: 3998093 - RNA, 19 nt, Staphylococcus aureus subsp. aureus Mu50
uuuagucauuacaaaucau

SEQ ID NO: 3998094 - RNA, 23 nt, Staphylococcus aureus subsp. aureus Mu50
uuuagugaaaaaguuucggaaaa

SEQ ID NO: 3998095 - RNA, 17 nt, Staphylococcus aureus subsp. aureus Mu50
uuuagugaaaagaacac

SEQ ID NO: 3998096 - RNA, 14 nt, Staphylococcus aureus subsp. aureus Mu50
uuuagugacaaaca

SEQ ID NO: 3998097 - RNA, 16 nt, Staphylococcus aureus subsp. aureus Mu50
uuuaguuaaauaguaa

SEQ ID NO: 3998098 - RNA, 15 nt, Staphylococcus aureus subsp. aureus Mu50
uuuaguuaauucucc

SEQ ID NO: 3998099 - RNA, 18 nt, Staphylococcus aureus subsp. aureus Mu50
uuuaguuauacuacuauu

SEQ ID NO: 3998100 - RNA, 21 nt, Staphylococcus aureus subsp. aureus Mu50
uuuaguucaaagcgauaaagu

SEQ ID NO: 3998101 - RNA, 21 nt, Staphylococcus aureus subsp. aureus Mu50
uuuaguucacaugaauuuuaa

SEQ ID NO: 3998102 - RNA, 21 nt, Staphylococcus aureus subsp. aureus Mu50
uuuaguucaccauuucguguu

SEQ ID NO: 3998103 - RNA, 14 nt, Staphylococcus aureus subsp. aureus Mu50
uuuauaaaaacuua

SEQ ID NO: 3998104 - RNA, 18 nt, Staphylococcus aureus subsp. aureus Mu50
uuuauaaacaauaaaaaa

SEQ ID NO: 3998105 - RNA, 23 nt, Staphylococcus aureus subsp. aureus Mu50
uuuauaaagauagaaugaauaau

SEQ ID NO: 3998106 - RNA, 15 nt, Staphylococcus aureus subsp. aureus Mu50
uuuauaaaucaaaga

SEQ ID NO: 3998107 - RNA, 12 nt, Staphylococcus aureus subsp. aureus Mu50
uuuauaaauuaa

SEQ ID NO: 3998108 - RNA, 21 nt, Staphylococcus aureus subsp. aureus Mu50
uuuauaaauuaaaugcaauac

SEQ ID NO: 3998109 - RNA, 12 nt, Staphylococcus aureus subsp. aureus Mu50
uuuauaaauuuu

SEQ ID NO: 3998110 - RNA, 18 nt, Staphylococcus aureus subsp. aureus Mu50
uuuauaacauuuaagaaa

SEQ ID NO: 3998111 - RNA, 10 nt, Staphylococcus aureus subsp. aureus Mu50
uuuauaagcu

SEQ ID NO: 3998112 - RNA, 21 nt, Staphylococcus aureus subsp. aureus Mu50
uuuauaaguaucgccaucauu

SEQ ID NO: 3998113 - RNA, 12 nt, Staphylococcus aureus subsp. aureus Mu50
uuuauaaguauu

SEQ ID NO: 3998114 - RNA, 15 nt, Staphylococcus aureus subsp. aureus Mu50
uuuauaauaaauguc

SEQ ID NO: 3998115 - RNA, 14 nt, Staphylococcus aureus subsp. aureus Mu50
uuuauaauaaauuu

SEQ ID NO: 3998116 - RNA, 15 nt, Staphylococcus aureus subsp. aureus Mu50
uuuauaauaaauuuc

SEQ ID NO: 3998117 - RNA, 12 nt, Staphylococcus aureus subsp. aureus Mu50
uuuauaauaauc

SEQ ID NO: 3998118 - RNA, 13 nt, Staphylococcus aureus subsp. aureus Mu50
uuuauaauucuaa

SEQ ID NO: 3998119 - RNA, 14 nt, Staphylococcus aureus subsp. aureus Mu50
uuuauaauuuuuga

SEQ ID NO: 3998120 - RNA, 15 nt, Staphylococcus aureus subsp. aureus Mu50
uuuauacauaaauau

SEQ ID NO: 3998121 - RNA, 13 nt, Staphylococcus aureus subsp. aureus Mu50
uuuauacuuaaua

SEQ ID NO: 3998122 - RNA, 14 nt, Staphylococcus aureus subsp. aureus Mu50
uuuauagaaaauua

SEQ ID NO: 3998123 - RNA, 16 nt, Staphylococcus aureus subsp. aureus Mu50
uuuauagaaaauuaac

SEQ ID NO: 3998124 - RNA, 22 nt, Staphylococcus aureus subsp. aureus Mu50
uuuauagauucauguaaauagu

SEQ ID NO: 3998125 - RNA, 15 nt, Staphylococcus aureus subsp. aureus Mu50
uuuauagcauuucuu

SEQ ID NO: 3998126 - RNA, 17 nt, Staphylococcus aureus subsp. aureus Mu50
uuuauaggucaacugua

SEQ ID NO: 3998127 - RNA, 15 nt, Staphylococcus aureus subsp. aureus Mu50
uuuauaguaauagcu

SEQ ID NO: 3998128 - RNA, 14 nt, Staphylococcus aureus subsp. aureus Mu50
uuuauaguucuauu

SEQ ID NO: 3998129 - RNA, 21 nt, Staphylococcus aureus subsp. aureus Mu50
uuuauauauaaaaucauuaau

SEQ ID NO: 3998130 - RNA, 19 nt, Staphylococcus aureus subsp. aureus Mu50
uuuauauauaaagaaauaa

SEQ ID NO: 3998131 - RNA, 13 nt, Staphylococcus aureus subsp. aureus Mu50
uuuauaucaaaaa

SEQ ID NO: 3998132 - RNA, 14 nt, Staphylococcus aureus subsp. aureus Mu50
uuuauaucaaaaaa

SEQ ID NO: 3998133 - RNA, 16 nt, Staphylococcus aureus subsp. aureus Mu50
uuuauaucaaaaaaua

SEQ ID NO: 3998134 - RNA, 22 nt, Staphylococcus aureus subsp. aureus Mu50
uuuauaucuuaaguacauaaau

SEQ ID NO: 3998135 - RNA, 21 nt, Staphylococcus aureus subsp. aureus Mu50
uuuauauuaaauacuauauau

SEQ ID NO: 3998136 - RNA, 16 nt, Staphylococcus aureus subsp. aureus Mu50
uuuauauuauuucaau

SEQ ID NO: 3998137 - RNA, 18 nt, Staphylococcus aureus subsp. aureus Mu50
uuuauauuuaaacucucu

SEQ ID NO: 3998138 - RNA, 14 nt, Staphylococcus aureus subsp. aureus Mu50
uuuauauuuaucag

SEQ ID NO: 3998139 - RNA, 13 nt, Staphylococcus aureus subsp. aureus Mu50
uuuauauuuauuu

SEQ ID NO: 3998140 - RNA, 16 nt, Staphylococcus aureus subsp. aureus Mu50
uuuauauuuauuuuau

SEQ ID NO: 3998141 - RNA, 23 nt, Staphylococcus aureus subsp. aureus Mu50
uuuauauuuuaguucacaugaau

SEQ ID NO: 3998142 - RNA, 12 nt, Staphylococcus aureus subsp. aureus Mu50
uuuauauuuuau

SEQ ID NO: 3998143 - RNA, 13 nt, Staphylococcus aureus subsp. aureus Mu50
uuuauauuuuuau

SEQ ID NO: 3998144 - RNA, 15 nt, Staphylococcus aureus subsp. aureus Mu50
uuuauauuuuuauca

SEQ ID NO: 3998145 - RNA, 19 nt, Staphylococcus aureus subsp. aureus Mu50
uuuaucaaauucaucagua

SEQ ID NO: 3998146 - RNA, 19 nt, Staphylococcus aureus subsp. aureus Mu50
uuuaucaacauaaaauuua

SEQ ID NO: 3998147 - RNA, 13 nt, Staphylococcus aureus subsp. aureus Mu50
uuuaucaauuucu

SEQ ID NO: 3998148 - RNA, 21 nt, Staphylococcus aureus subsp. aureus Mu50
uuuaucaauuucuauuucacu

SEQ ID NO: 3998149 - RNA, 19 nt, Staphylococcus aureus subsp. aureus Mu50
uuuaucagcgaaauuugua

SEQ ID NO: 3998150 - RNA, 21 nt, Staphylococcus aureus subsp. aureus Mu50
uuuaucagcgaaauuuguaaa

SEQ ID NO: 3998151 - RNA, 13 nt, Staphylococcus aureus subsp. aureus Mu50
uuuaucauuauuu

SEQ ID NO: 3998152 - RNA, 20 nt, Staphylococcus aureus subsp. aureus Mu50
uuuaucauuauuugauaaau

SEQ ID NO: 3998153 - RNA, 16 nt, Staphylococcus aureus subsp. aureus Mu50
uuuaucgaaauauuua

SEQ ID NO: 3998154 - RNA, 18 nt, Staphylococcus aureus subsp. aureus Mu50
uuuaucgaucgguauuuu

SEQ ID NO: 3998155 - RNA, 19 nt, Staphylococcus aureus subsp. aureus Mu50
uuuaucuacauuaaagaaa

SEQ ID NO: 3998156 - RNA, 16 nt, Staphylococcus aureus subsp. aureus Mu50
uuuaucuauaugcaua

SEQ ID NO: 3998157 - RNA, 19 nt, Staphylococcus aureus subsp. aureus Mu50
uuuaucuccuaaagguaac

SEQ ID NO: 3998158 - RNA, 20 nt, Staphylococcus aureus subsp. aureus Mu50
uuuaugaauugaguauuaaa

SEQ ID NO: 3998159 - RNA, 22 nt, Staphylococcus aureus subsp. aureus Mu50
uuuaugagcuuaauaaauugua

SEQ ID NO: 3998160 - RNA, 22 nt, Staphylococcus aureus subsp. aureus Mu50
uuuaugagcuucuuuaaauaca

SEQ ID NO: 3998161 - RNA, 17 nt, Staphylococcus aureus subsp. aureus Mu50
uuuaugauaauaagaau

SEQ ID NO: 3998162 - RNA, 21 nt, Staphylococcus aureus subsp. aureus Mu50
uuuaugauucuaacggcguuu

SEQ ID NO: 3998163 - RNA, 16 nt, Staphylococcus aureus subsp. aureus Mu50
uuuauggagugauaua

SEQ ID NO: 3998164 - RNA, 14 nt, Staphylococcus aureus subsp. aureus Mu50
uuuauggauuucuu

SEQ ID NO: 3998165 - RNA, 17 nt, Staphylococcus aureus subsp. aureus Mu50
uuuauggcgguuugaaa

SEQ ID NO: 3998166 - RNA, 23 nt, Staphylococcus aureus subsp. aureus Mu50
uuuaugguguagcugaggauuuu

SEQ ID NO: 3998167 - RNA, 14 nt, Staphylococcus aureus subsp. aureus Mu50
uuuauguauuuauu

SEQ ID NO: 3998168 - RNA, 13 nt, Staphylococcus aureus subsp. aureus Mu50
uuuaugucccaau

SEQ ID NO: 3998169 - RNA, 14 nt, Staphylococcus aureus subsp. aureus Mu50
uuuauguuauuguu

SEQ ID NO: 3998170 - RNA, 17 nt, Staphylococcus aureus subsp. aureus Mu50
uuuauguuugauuuuau

SEQ ID NO: 3998171 - RNA, 17 nt, Staphylococcus aureus subsp. aureus Mu50
uuuauguuuuaauuucu

SEQ ID NO: 3998172 - RNA, 14 nt, Staphylococcus aureus subsp. aureus Mu50
uuuauuaaagaaac

SEQ ID NO: 3998173 - RNA, 21 nt, Staphylococcus aureus subsp. aureus Mu50
uuuauuaauggcaacuaagau

SEQ ID NO: 3998174 - RNA, 14 nt, Staphylococcus aureus subsp. aureus Mu50
uuuauuacuuuaau

SEQ ID NO: 3998175 - RNA, 19 nt, Staphylococcus aureus subsp. aureus Mu50
uuuauuaguauucaaaaaa

SEQ ID NO: 3998176 - RNA, 23 nt, Staphylococcus aureus subsp. aureus Mu50
uuuauuaguuauguuagucuuuu

SEQ ID NO: 3998177 - RNA, 15 nt, Staphylococcus aureus subsp. aureus Mu50
uuuauuaguuuuuac

SEQ ID NO: 3998178 - RNA, 11 nt, Staphylococcus aureus subsp. aureus Mu50
uuuccucuuua

SEQ ID NO: 3998179 - RNA, 23 nt, Staphylococcus aureus subsp. aureus Mu50
uuuccuuggacucagugcuaugu

SEQ ID NO: 3998180 - RNA, 22 nt, Staphylococcus aureus subsp. aureus Mu50
uuucgaaaagaaauucuacagg

SEQ ID NO: 3998181 - RNA, 18 nt, Staphylococcus aureus subsp. aureus Mu50
uuucgaacgcuugaaaaa

SEQ ID NO: 3998182 - RNA, 22 nt, Staphylococcus aureus subsp. aureus Mu50
uuucgacguaccaauuagcaug

SEQ ID NO: 3998183 - RNA, 18 nt, Staphylococcus aureus subsp. aureus Mu50
uuucgauaccuaaaauac

SEQ ID NO: 3998184 - RNA, 14 nt, Staphylococcus aureus subsp. aureus Mu50
uuucgauuaauuua

SEQ ID NO: 3998185 - RNA, 18 nt, Staphylococcus aureus subsp. aureus Mu50
uuucgcuuuuuuuauuuu

SEQ ID NO: 3998186 - RNA, 19 nt, Staphylococcus aureus subsp. aureus Mu50
uuucgcuuuuuuuauuuuu

SEQ ID NO: 3998187 - RNA, 18 nt, Staphylococcus aureus subsp. aureus Mu50
uuucggacgauugaacau

SEQ ID NO: 3998188 - RNA, 21 nt, Staphylococcus aureus subsp. aureus Mu50
uuucggauugaaccggaaauu

SEQ ID NO: 3998189 - RNA, 19 nt, Staphylococcus aureus subsp. aureus Mu50
uuucggcuagauuuuaaac

SEQ ID NO: 3998190 - RNA, 19 nt, Staphylococcus aureus subsp. aureus Mu50
uuucguaacauuuaaaaaa

SEQ ID NO: 3998191 - RNA, 20 nt, Staphylococcus aureus subsp. aureus Mu50
uuucguaauguguuaauacu

SEQ ID NO: 3998192 - RNA, 16 nt, Staphylococcus aureus subsp. aureus Mu50
uuucguauaauuuuaa

SEQ ID NO: 3998193 - RNA, 17 nt, Staphylococcus aureus subsp. aureus Mu50
uuucguauguuucuuua

SEQ ID NO: 3998194 - RNA, 21 nt, Staphylococcus aureus subsp. aureus Mu50
uuucgucuuguaaacuucuuu

SEQ ID NO: 3998195 - RNA, 22 nt, Staphylococcus aureus subsp. aureus Mu50
uuucguguuccaauuuuauuga

SEQ ID NO: 3998196 - RNA, 16 nt, Staphylococcus aureus subsp. aureus Mu50
uuucguuuucaucaac

SEQ ID NO: 3998197 - RNA, 20 nt, Staphylococcus aureus subsp. aureus Mu50
uuucuaaaucuaacuggaaa

SEQ ID NO: 3998198 - RNA, 23 nt, Staphylococcus aureus subsp. aureus Mu50
uuucuaaaugauuuauucuaaau

SEQ ID NO: 3998199 - RNA, 20 nt, Staphylococcus aureus subsp. aureus Mu50
uuucuaaguuugaaucauuu

SEQ ID NO: 3998200 - RNA, 16 nt, Staphylococcus aureus subsp. aureus Mu50
uuucuaauuaaacgcu

SEQ ID NO: 3998201 - RNA, 14 nt, Staphylococcus aureus subsp. aureus Mu50
uuucuacccguuuu

SEQ ID NO: 3998202 - RNA, 16 nt, Staphylococcus aureus subsp. aureus Mu50
uuucuacccguuuuuu

SEQ ID NO: 3998203 - RNA, 18 nt, Staphylococcus aureus subsp. aureus Mu50
uuucuacccguuuuuugg

SEQ ID NO: 3998204 - RNA, 21 nt, Staphylococcus aureus subsp. aureus Mu50
uuucuacucugauuacauaua

SEQ ID NO: 3998205 - RNA, 17 nt, Staphylococcus aureus subsp. aureus Mu50
uuucuacuguauaagug

SEQ ID NO: 3998206 - RNA, 19 nt, Staphylococcus aureus subsp. aureus Mu50
uuucuacuguauaagugcu

SEQ ID NO: 3998207 - RNA, 20 nt, Staphylococcus aureus subsp. aureus Mu50
uuucuagcaacugaucauuu

SEQ ID NO: 3998208 - RNA, 12 nt, Staphylococcus aureus subsp. aureus Mu50
uuucuagcaugu

SEQ ID NO: 3998209 - RNA, 21 nt, Staphylococcus aureus subsp. aureus Mu50
uuucuagcuauauccaguaaa

SEQ ID NO: 3998210 - RNA, 18 nt, Staphylococcus aureus subsp. aureus Mu50
uuucuaguuuucaugaaa

SEQ ID NO: 3998211 - RNA, 14 nt, Staphylococcus aureus subsp. aureus Mu50
uuucuauaauauuu

SEQ ID NO: 3998212 - RNA, 23 nt, Staphylococcus aureus subsp. aureus Mu50
uuucuauagaaaaaguauuacuu

SEQ ID NO: 3998213 - RNA, 14 nt, Staphylococcus aureus subsp. aureus Mu50
uuucuauaucuauu

SEQ ID NO: 3998214 - RNA, 20 nt, Staphylococcus aureus subsp. aureus Mu50
uuucucaaguaacucaagug

SEQ ID NO: 3998215 - RNA, 16 nt, Staphylococcus aureus subsp. aureus Mu50
uuucucaaugugagau

SEQ ID NO: 3998216 - RNA, 13 nt, Staphylococcus aureus subsp. aureus Mu50
uuucucauaguca

SEQ ID NO: 3998217 - RNA, 17 nt, Staphylococcus aureus subsp. aureus Mu50
uuucuccuuuguauaag

SEQ ID NO: 3998218 - RNA, 15 nt, Staphylococcus aureus subsp. aureus Mu50
uuucucgauuaauuu

SEQ ID NO: 3998219 - RNA, 19 nt, Staphylococcus aureus subsp. aureus Mu50
uuucucgauuaauuuucuu

SEQ ID NO: 3998220 - RNA, 17 nt, Staphylococcus aureus subsp. aureus Mu50
uuucucggcgauaaaau

SEQ ID NO: 3998221 - RNA, 23 nt, Staphylococcus aureus subsp. aureus Mu50
uuucucuuucaagaccuucuucu

SEQ ID NO: 3998222 - RNA, 15 nt, Staphylococcus aureus subsp. aureus Mu50
uuucugaaaugauac

SEQ ID NO: 3998223 - RNA, 21 nt, Staphylococcus aureus subsp. aureus Mu50
uuucugacaacuuaauagaaa

SEQ ID NO: 3998224 - RNA, 22 nt, Staphylococcus aureus subsp. aureus Mu50
uuucugacuuuuaaaaaacaua

SEQ ID NO: 3998225 - RNA, 21 nt, Staphylococcus aureus subsp. aureus Mu50
uuucugagaagaaauauauug

SEQ ID NO: 3998226 - RNA, 22 nt, Staphylococcus aureus subsp. aureus Mu50
uuucugaucgacuaauuuuucu

SEQ ID NO: 3998227 - RNA, 13 nt, Staphylococcus aureus subsp. aureus Mu50
uuucuggcucuuc

SEQ ID NO: 3998228 - RNA, 18 nt, Staphylococcus aureus subsp. aureus Mu50
uuucuggcucuucuuauc

SEQ ID NO: 3998229 - RNA, 14 nt, Staphylococcus aureus subsp. aureus Mu50
uuucuguaccaaau

SEQ ID NO: 3998230 - RNA, 19 nt, Staphylococcus aureus subsp. aureus Mu50
uuucugugaccaauagaau

SEQ ID NO: 3998231 - RNA, 19 nt, Staphylococcus aureus subsp. aureus Mu50
uuucuguuuaauuaaaaua

SEQ ID NO: 3998232 - RNA, 12 nt, Staphylococcus aureus subsp. aureus Mu50
uuucuuaauuag

SEQ ID NO: 3998233 - RNA, 12 nt, Staphylococcus aureus subsp. aureus Mu50
uuucuuaauuau

SEQ ID NO: 3998234 - RNA, 14 nt, Staphylococcus aureus subsp. aureus Mu50
uuucuuagauacuc

SEQ ID NO: 3998235 - RNA, 14 nt, Staphylococcus aureus subsp. aureus Mu50
uuucuuaucaguuu

SEQ ID NO: 3998236 - RNA, 13 nt, Staphylococcus aureus subsp. aureus Mu50
uuucuuauuuauu

SEQ ID NO: 3998237 - RNA, 15 nt, Staphylococcus aureus subsp. aureus Mu50
uuucuucaauugucu

SEQ ID NO: 3998238 - RNA, 20 nt, Staphylococcus aureus subsp. aureus Mu50
uuucuucagaaccuugaaug

SEQ ID NO: 3998239 - RNA, 22 nt, Staphylococcus aureus subsp. aureus Mu50
uuucuucagaaccuugaaugau

SEQ ID NO: 3998240 - RNA, 15 nt, Staphylococcus aureus subsp. aureus Mu50
uuucuucauuaucaa

SEQ ID NO: 3998241 - RNA, 15 nt, Staphylococcus aureus subsp. aureus Mu50
uuucuugaucuaaug

SEQ ID NO: 3998242 - RNA, 23 nt, Staphylococcus aureus subsp. aureus Mu50
uuucuugaugaauuaaacugauc

SEQ ID NO: 3998243 - RNA, 22 nt, Staphylococcus aureus subsp. aureus Mu50
uuucuugcauacgaauuaaaau

SEQ ID NO: 3998244 - RNA, 17 nt, Staphylococcus aureus subsp. aureus Mu50
uuucuuguguauuuuua

SEQ ID NO: 3998245 - RNA, 18 nt, Staphylococcus aureus subsp. aureus Mu50
uuucuuguucuaaaauaa

SEQ ID NO: 3998246 - RNA, 14 nt, Staphylococcus aureus subsp. aureus Mu50
uuucuuuaagugac

SEQ ID NO: 3998247 - RNA, 15 nt, Staphylococcus aureus subsp. aureus Mu50
uuucuuuauuuuaaa

SEQ ID NO: 3998248 - RNA, 14 nt, Staphylococcus aureus subsp. aureus Mu50
uuucuuucauaauu

SEQ ID NO: 3998249 - RNA, 13 nt, Staphylococcus aureus subsp. aureus Mu50
uuucuuuggugaa

SEQ ID NO: 3998250 - RNA, 17 nt, Staphylococcus aureus subsp. aureus Mu50
uuucuuuguguuugcuu

SEQ ID NO: 3998251 - RNA, 20 nt, Staphylococcus aureus subsp. aureus Mu50
uuucuuuuguuuuuauauua

SEQ ID NO: 3998252 - RNA, 18 nt, Staphylococcus aureus subsp. aureus Mu50
uuucuuuuuuaauucuau

SEQ ID NO: 3998253 - RNA, 22 nt, Staphylococcus aureus subsp. aureus Mu50
uuucuuuuuuuauggauuucuu

SEQ ID NO: 3998254 - RNA, 14 nt, Staphylococcus aureus subsp. aureus Mu50
uuugaaagacauuu

SEQ ID NO: 3998255 - RNA, 13 nt, Staphylococcus aureus subsp. aureus Mu50
uuugaaauauacc

SEQ ID NO: 3998256 - RNA, 15 nt, Staphylococcus aureus subsp. aureus Mu50
uuugaaauuuauuau

SEQ ID NO: 3998257 - RNA, 16 nt, Staphylococcus aureus subsp. aureus Mu50
uuugaaccuaaauucc

SEQ ID NO: 3998258 - RNA, 17 nt, Staphylococcus aureus subsp. aureus Mu50
uuugaagaauaaaaaag

SEQ ID NO: 3998259 - RNA, 20 nt, Staphylococcus aureus subsp. aureus Mu50
uuugaagggagcauuucacu

SEQ ID NO: 3998260 - RNA, 13 nt, Staphylococcus aureus subsp. aureus Mu50
uuugaauaaaaaa

SEQ ID NO: 3998261 - RNA, 16 nt, Staphylococcus aureus subsp. aureus Mu50
uuugaauacuuuauuu

SEQ ID NO: 3998262 - RNA, 16 nt, Staphylococcus aureus subsp. aureus Mu50
uuugaauauacuuaau

SEQ ID NO: 3998263 - RNA, 16 nt, Staphylococcus aureus subsp. aureus Mu50
uuugaauaugauauua

SEQ ID NO: 3998264 - RNA, 18 nt, Staphylococcus aureus subsp. aureus Mu50
uuugaaucauuugaugcu

SEQ ID NO: 3998265 - RNA, 17 nt, Staphylococcus aureus subsp. aureus Mu50
uuuguucaguuaaaucu

SEQ ID NO: 3998266 - RNA, 20 nt, Staphylococcus aureus subsp. aureus Mu50
uuuguucaguuaaaucugua

SEQ ID NO: 3998267 - RNA, 15 nt, Staphylococcus aureus subsp. aureus Mu50
uuuguugguguuuag

SEQ ID NO: 3998268 - RNA, 21 nt, Staphylococcus aureus subsp. aureus Mu50
uuuguugguguuuagucuuuu

SEQ ID NO: 3998269 - RNA, 19 nt, Staphylococcus aureus subsp. aureus Mu50
uuuguuguuuuaauuucac

SEQ ID NO: 3998270 - RNA, 20 nt, Staphylococcus aureus subsp. aureus Mu50
uuuguuguuuuaauuucacu

SEQ ID NO: 3998271 - RNA, 13 nt, Staphylococcus aureus subsp. aureus Mu50
uuuguuucuaaau

SEQ ID NO: 3998272 - RNA, 12 nt, Staphylococcus aureus subsp. aureus Mu50
uuuguuuguaag

SEQ ID NO: 3998273 - RNA, 14 nt, Staphylococcus aureus subsp. aureus Mu50
uuuguuuuaaaaaa

SEQ ID NO: 3998274 - RNA, 16 nt, Staphylococcus aureus subsp. aureus Mu50
uuuguuuuaaauacuu

SEQ ID NO: 3998275 - RNA, 15 nt, Staphylococcus aureus subsp. aureus Mu50
uuuguuuuaccauca

SEQ ID NO: 3998276 - RNA, 13 nt, Staphylococcus aureus subsp. aureus Mu50
uuuguuuucagua

SEQ ID NO: 3998277 - RNA, 13 nt, Staphylococcus aureus subsp. aureus Mu50
uuuguuuugaaug

SEQ ID NO: 3998278 - RNA, 16 nt, Staphylococcus aureus subsp. aureus Mu50
uuuguuuugcuucuuu

SEQ ID NO: 3998279 - RNA, 13 nt, Staphylococcus aureus subsp. aureus Mu50
uuuguuuuuauau

SEQ ID NO: 3998280 - RNA, 15 nt, Staphylococcus aureus subsp. aureus Mu50
uuuuaaaaaaugaug

SEQ ID NO: 3998281 - RNA, 17 nt, Staphylococcus aureus subsp. aureus Mu50
uuuuaaaaaauuuaaau

SEQ ID NO: 3998282 - RNA, 17 nt, Staphylococcus aureus subsp. aureus Mu50
uuuuaaaagauaaauaa

SEQ ID NO: 3998283 - RNA, 21 nt, Staphylococcus aureus subsp. aureus Mu50
uuuuaaaaucucauaauaauu

SEQ ID NO: 3998284 - RNA, 16 nt, Staphylococcus aureus subsp. aureus Mu50
uuuuaaaauuaaaccu

SEQ ID NO: 3998285 - RNA, 19 nt, Staphylococcus aureus subsp. aureus Mu50
uuuuaaacguacauuuuua

SEQ ID NO: 3998286 - RNA, 16 nt, Staphylococcus aureus subsp. aureus Mu50
uuuuaaagguuaaaua

SEQ ID NO: 3998287 - RNA, 18 nt, Staphylococcus aureus subsp. aureus Mu50
uuuuaaagguuaaauauu

SEQ ID NO: 3998288 - RNA, 12 nt, Staphylococcus aureus subsp. aureus Mu50
uuuuaaaguaac

SEQ ID NO: 3998289 - RNA, 16 nt, Staphylococcus aureus subsp. aureus Mu50
uuuuaaaguuuaaaua

SEQ ID NO: 3998290 - RNA, 11 nt, Staphylococcus aureus subsp. aureus Mu50
uuuuaaauaaa

SEQ ID NO: 3998291 - RNA, 23 nt, Staphylococcus aureus subsp. aureus Mu50
uuuuaaauaaucgaaaauuucag

SEQ ID NO: 3998292 - RNA, 17 nt, Staphylococcus aureus subsp. aureus Mu50
uuuuaaaucuauauaaa

SEQ ID NO: 3998293 - RNA, 13 nt, Staphylococcus aureus subsp. aureus Mu50
uuuuaaaucuuuu

SEQ ID NO: 3998294 - RNA, 22 nt, Staphylococcus aureus subsp. aureus Mu50
uuuuaaaugauuuaauaaaaac

SEQ ID NO: 3998295 - RNA, 13 nt, Staphylococcus aureus subsp. aureus Mu50
uuuuaaauguauu

SEQ ID NO: 3998296 - RNA, 17 nt, Staphylococcus aureus subsp. aureus Mu50
uuuuaaauguauuuuua

SEQ ID NO: 3998297 - RNA, 13 nt, Staphylococcus aureus subsp. aureus Mu50
uuuuaaauuacua

SEQ ID NO: 3998298 - RNA, 17 nt, Staphylococcus aureus subsp. aureus Mu50
uuuuaaauuacuauauu

SEQ ID NO: 3998299 - RNA, 22 nt, Staphylococcus aureus subsp. aureus Mu50
uuuuaaauuacuauauuuaaau

SEQ ID NO: 3998300 - RNA, 20 nt, Staphylococcus aureus subsp. aureus Mu50
uuuuaaauuaugacuuauuu

SEQ ID NO: 3998301 - RNA, 21 nt, Staphylococcus aureus subsp. aureus Mu50
uuuuaaauucuuauaaaauaa

SEQ ID NO: 3998302 - RNA, 12 nt, Staphylococcus aureus subsp. aureus Mu50
uuuuaaauuuag

SEQ ID NO: 3998303 - RNA, 15 nt, Staphylococcus aureus subsp. aureus Mu50
uuuuaacaaaauaua

SEQ ID NO: 3998304 - RNA, 17 nt, Staphylococcus aureus subsp. aureus Mu50
uuuuaacaaaauauacu

SEQ ID NO: 3998305 - RNA, 21 nt, Staphylococcus aureus subsp. aureus Mu50
uuuuaacaaaauauacuaaau

SEQ ID NO: 3998306 - RNA, 20 nt, Staphylococcus aureus subsp. aureus Mu50
uuuuaacugguugauaaaua

SEQ ID NO: 3998307 - RNA, 21 nt, Staphylococcus aureus subsp. aureus Mu50
uuuuaacuuccuaaaauuuac

SEQ ID NO: 3998308 - RNA, 23 nt, Staphylococcus aureus subsp. aureus Mu50
uuuuaacuuuaacaucugaaucu

SEQ ID NO: 3998309 - RNA, 17 nt, Staphylococcus aureus subsp. aureus Mu50
uuuuaagaucaauauca

SEQ ID NO: 3998310 - RNA, 24 nt, Staphylococcus aureus subsp. aureus Mu50
uuuuaaggcagcuaaaaaguauac

SEQ ID NO: 3998311 - RNA, 19 nt, Staphylococcus aureus subsp. aureus Mu50
uuuuaagguucuuuuuuua

SEQ ID NO: 3998312 - RNA, 12 nt, Staphylococcus aureus subsp. aureus Mu50
uuuuaagugaug

SEQ ID NO: 3998313 - RNA, 23 nt, Staphylococcus aureus subsp. aureus Mu50
uuuuaagugaugaccaauauucu

SEQ ID NO: 3998314 - RNA, 22 nt, Staphylococcus aureus subsp. aureus Mu50
uuuuaagugguuaucacgugcu

SEQ ID NO: 3998315 - RNA, 13 nt, Staphylococcus aureus subsp. aureus Mu50
uuuuaaguuaauu

SEQ ID NO: 3998316 - RNA, 15 nt, Staphylococcus aureus subsp. aureus Mu50
uuuuaauaaucaaac

SEQ ID NO: 3998317 - RNA, 12 nt, Staphylococcus aureus subsp. aureus Mu50
uuuuaauauauu

SEQ ID NO: 3998318 - RNA, 17 nt, Staphylococcus aureus subsp. aureus Mu50
uuuuaauauauuuauuu

SEQ ID NO: 3998319 - RNA, 12 nt, Staphylococcus aureus subsp. aureus Mu50
uuuuaaugauuu

SEQ ID NO: 3998320 - RNA, 20 nt, Staphylococcus aureus subsp. aureus Mu50
uuuuaauguauucuucuaau

SEQ ID NO: 3998321 - RNA, 12 nt, Staphylococcus aureus subsp. aureus Mu50
uuuuaauuaagu

SEQ ID NO: 3998322 - RNA, 16 nt, Staphylococcus aureus subsp. aureus Mu50
uuuuaauuaauuauca

SEQ ID NO: 3998323 - RNA, 15 nt, Staphylococcus aureus subsp. aureus Mu50
uuuuaauuaauuauu

SEQ ID NO: 3998324 - RNA, 11 nt, Staphylococcus aureus subsp. aureus Mu50
uuuuaauuauu

SEQ ID NO: 3998325 - RNA, 18 nt, Staphylococcus aureus subsp. aureus Mu50
uuuuaauuauuuuaaaaa

SEQ ID NO: 3998326 - RNA, 16 nt, Staphylococcus aureus subsp. aureus Mu50
uuuuaauugaaugaaa

SEQ ID NO: 3998327 - RNA, 14 nt, Staphylococcus aureus subsp. aureus Mu50
uuuuaauuguucau

SEQ ID NO: 3998328 - RNA, 13 nt, Staphylococcus aureus subsp. aureus Mu50
uuuuaauuuucag

SEQ ID NO: 3998329 - RNA, 23 nt, Staphylococcus aureus subsp. aureus Mu50
uuuuacaaagugauuuaaaaaau

SEQ ID NO: 3998330 - RNA, 16 nt, Staphylococcus aureus subsp. aureus Mu50
uuuuacaaguuguuca

SEQ ID NO: 3998331 - RNA, 20 nt, Staphylococcus aureus subsp. aureus Mu50
uuuuacagucaacugcugcu

SEQ ID NO: 3998332 - RNA, 20 nt, Staphylococcus aureus subsp. aureus Mu50
uuuuaccauugugaauaauu

SEQ ID NO: 3998333 - RNA, 21 nt, Staphylococcus aureus subsp. aureus Mu50
uuuuaccucugauaaaugaau

SEQ ID NO: 3998334 - RNA, 14 nt, Staphylococcus aureus subsp. aureus Mu50
uuuuaccuuuaauu

SEQ ID NO: 3998335 - RNA, 17 nt, Staphylococcus aureus subsp. aureus Mu50
uuuuaccuuuaauuaca

SEQ ID NO: 3998336 - RNA, 18 nt, Staphylococcus aureus subsp. aureus Mu50
uuuuacgaaaauaucauu

SEQ ID NO: 3998337 - RNA, 16 nt, Staphylococcus aureus subsp. aureus Mu50
uuuuacuaaaucauuu

SEQ ID NO: 3998338 - RNA, 15 nt, Staphylococcus aureus subsp. aureus Mu50
uuuuacuaaaugaau

SEQ ID NO: 3998339 - RNA, 19 nt, Staphylococcus aureus subsp. aureus Mu50
uuuuacuaggaauauaaaa

SEQ ID NO: 3998340 - RNA, 16 nt, Staphylococcus aureus subsp. aureus Mu50
uuuuacuauaauaauu

SEQ ID NO: 3998341 - RNA, 16 nt, Staphylococcus aureus subsp. aureus Mu50
uuuuacugcacuuuua

SEQ ID NO: 3998342 - RNA, 20 nt, Staphylococcus aureus subsp. aureus Mu50
uuuuagacauaaaaaaagag

SEQ ID NO: 3998343 - RNA, 17 nt, Staphylococcus aureus subsp. aureus Mu50
uuuuagauuaucuuuca

SEQ ID NO: 3998344 - RNA, 23 nt, Staphylococcus aureus subsp. aureus Mu50
uuuuagauuuaguuuuuuuaaag

SEQ ID NO: 3998345 - RNA, 15 nt, Staphylococcus aureus subsp. aureus Mu50
uuuuagauuugaaau

SEQ ID NO: 3998346 - RNA, 21 nt, Staphylococcus aureus subsp. aureus Mu50
uuuuagccccagcaaauacuu

SEQ ID NO: 3998347 - RNA, 15 nt, Staphylococcus aureus subsp. aureus Mu50
uuuuagcuauagaaa

SEQ ID NO: 3998348 - RNA, 15 nt, Staphylococcus aureus subsp. aureus Mu50
uuuuagcuuguuguu

SEQ ID NO: 3998349 - RNA, 14 nt, Staphylococcus aureus subsp. aureus Mu50
uuuuagcuuuugua

SEQ ID NO: 3998350 - RNA, 15 nt, Staphylococcus aureus subsp. aureus Mu50
uuuuagguaauaauu

SEQ ID NO: 3998351 - RNA, 22 nt, Staphylococcus aureus subsp. aureus Mu50
uuuuaguaguuuauaucaaaaa

SEQ ID NO: 3998352 - RNA, 16 nt, Staphylococcus aureus subsp. aureus Mu50
uuuuagugacaaacau

SEQ ID NO: 3998353 - RNA, 14 nt, Staphylococcus aureus subsp. aureus Mu50
uuuucuauucaaaa

SEQ ID NO: 3998354 - RNA, 13 nt, Staphylococcus aureus subsp. aureus Mu50
uuuucucaacagu

SEQ ID NO: 3998355 - RNA, 19 nt, Staphylococcus aureus subsp. aureus Mu50
uuuucuccaacgucauaac

SEQ ID NO: 3998356 - RNA, 19 nt, Staphylococcus aureus subsp. aureus Mu50
uuuucucgauuaauuuucu

SEQ ID NO: 3998357 - RNA, 17 nt, Staphylococcus aureus subsp. aureus Mu50
uuuucugccauaaacau

SEQ ID NO: 3998358 - RNA, 19 nt, Staphylococcus aureus subsp. aureus Mu50
uuuucuguccaaaaagguu

SEQ ID NO: 3998359 - RNA, 13 nt, Staphylococcus aureus subsp. aureus Mu50
uuuucuuaaaaga

SEQ ID NO: 3998360 - RNA, 11 nt, Staphylococcus aureus subsp. aureus Mu50
uuuucuuaauu

SEQ ID NO: 3998361 - RNA, 13 nt, Staphylococcus aureus subsp. aureus Mu50
uuuucuuauuuau

SEQ ID NO: 3998362 - RNA, 22 nt, Staphylococcus aureus subsp. aureus Mu50
uuuucuucaguuaaaucuuuaa

SEQ ID NO: 3998363 - RNA, 20 nt, Staphylococcus aureus subsp. aureus Mu50
uuuucuuuaucuauaugcau

SEQ ID NO: 3998364 - RNA, 22 nt, Staphylococcus aureus subsp. aureus Mu50
uuuucuuuauuuuaaacaugaa

SEQ ID NO: 3998365 - RNA, 14 nt, Staphylococcus aureus subsp. aureus Mu50
uuuucuuuucaaaa

SEQ ID NO: 3998366 - RNA, 12 nt, Staphylococcus aureus subsp. aureus Mu50
uuuucuuuuguu

SEQ ID NO: 3998367 - RNA, 14 nt, Staphylococcus aureus subsp. aureus Mu50
uuuucuuuuuuaau

SEQ ID NO: 3998368 - RNA, 12 nt, Staphylococcus aureus subsp. aureus Mu50
uuuugaauauuu

SEQ ID NO: 3998369 - RNA, 18 nt, Staphylococcus aureus subsp. aureus Mu50
uuuugaauguuucuccua

SEQ ID NO: 3998370 - RNA, 19 nt, Staphylococcus aureus subsp. aureus Mu50
uuuugacaaauccuaauuu

SEQ ID NO: 3998371 - RNA, 17 nt, Staphylococcus aureus subsp. aureus Mu50
uuuugagagauuauuua

SEQ ID NO: 3998372 - RNA, 19 nt, Staphylococcus aureus subsp. aureus Mu50
uuuugagagauuauuuaaa

SEQ ID NO: 3998373 - RNA, 12 nt, Staphylococcus aureus subsp. aureus Mu50
uuuugagauauu

SEQ ID NO: 3998374 - RNA, 15 nt, Staphylococcus aureus subsp. aureus Mu50
uuuugagcaauaaug

SEQ ID NO: 3998375 - RNA, 18 nt, Staphylococcus aureus subsp. aureus Mu50
uuuugauacguaaacacu

SEQ ID NO: 3998376 - RNA, 13 nt, Staphylococcus aureus subsp. aureus Mu50
uuuugauauaaaa

SEQ ID NO: 3998377 - RNA, 16 nt, Staphylococcus aureus subsp. aureus Mu50
uuuugaugaucauuag

SEQ ID NO: 3998378 - RNA, 23 nt, Staphylococcus aureus subsp. aureus Mu50
uuuugaugugaaaauuuauucaa

SEQ ID NO: 3998379 - RNA, 13 nt, Staphylococcus aureus subsp. aureus Mu50
uuuugauuauauu

SEQ ID NO: 3998380 - RNA, 9 nt, Staphylococcus aureus subsp. aureus Mu50
uuuugauug

SEQ ID NO: 3998381 - RNA, 15 nt, Staphylococcus aureus subsp. aureus Mu50
uuuugauuuaauaau

SEQ ID NO: 3998382 - RNA, 20 nt, Staphylococcus aureus subsp. aureus Mu50
uuuugcaacauuaaauuauu

SEQ ID NO: 3998383 - RNA, 14 nt, Staphylococcus aureus subsp. aureus Mu50
uuuugcacuaaugg

SEQ ID NO: 3998384 - RNA, 16 nt, Staphylococcus aureus subsp. aureus Mu50
uuuugcguuaauaauu

SEQ ID NO: 3998385 - RNA, 18 nt, Staphylococcus aureus subsp. aureus Mu50
uuuugcguuuuuaaauaa

SEQ ID NO: 3998386 - RNA, 19 nt, Staphylococcus aureus subsp. aureus Mu50
uuuugcucuuuaaacucgu

SEQ ID NO: 3998387 - RNA, 14 nt, Staphylococcus aureus subsp. aureus Mu50
uuuugcuguauaua

SEQ ID NO: 3998388 - RNA, 16 nt, Staphylococcus aureus subsp. aureus Mu50
uuuugcuguuuaguua

SEQ ID NO: 3998389 - RNA, 13 nt, Staphylococcus aureus subsp. aureus Mu50
uuuugcuuuauuu

SEQ ID NO: 3998390 - RNA, 14 nt, Staphylococcus aureus subsp. aureus Mu50
uuuugcuuuauuuu

SEQ ID NO: 3998391 - RNA, 21 nt, Staphylococcus aureus subsp. aureus Mu50
uuuugcuuuauuuucuugugu

SEQ ID NO: 3998392 - RNA, 19 nt, Staphylococcus aureus subsp. aureus Mu50
uuuugcuuuguuugcuucu

SEQ ID NO: 3998393 - RNA, 18 nt, Staphylococcus aureus subsp. aureus Mu50
uuuuggaacauauucaua

SEQ ID NO: 3998394 - RNA, 22 nt, Staphylococcus aureus subsp. aureus Mu50
uuuuggcuuaucaagcaccuua

SEQ ID NO: 3998395 - RNA, 20 nt, Staphylococcus aureus subsp. aureus Mu50
uuuuggucaaguaaauguuu

SEQ ID NO: 3998396 - RNA, 21 nt, Staphylococcus aureus subsp. aureus Mu50
uuuugguucuauaauucacuu

SEQ ID NO: 3998397 - RNA, 13 nt, Staphylococcus aureus subsp. aureus Mu50
uuuugguuguucu

SEQ ID NO: 3998398 - RNA, 23 nt, Staphylococcus aureus subsp. aureus Mu50
uuuuguaauugaaaugauagaug

SEQ ID NO: 3998399 - RNA, 17 nt, Staphylococcus aureus subsp. aureus Mu50
uuuuguaucucugaaaa

SEQ ID NO: 3998400 - RNA, 18 nt, Staphylococcus aureus subsp. aureus Mu50
uuuuguaucucugaaaaa

SEQ ID NO: 3998401 - RNA, 13 nt, Staphylococcus aureus subsp. aureus Mu50
uuuugugauuuuu

SEQ ID NO: 3998402 - RNA, 16 nt, Staphylococcus aureus subsp. aureus Mu50
uuuugugauuuuuaau

SEQ ID NO: 3998403 - RNA, 23 nt, Staphylococcus aureus subsp. aureus Mu50
uuuugugccucuuguguuucagc

SEQ ID NO: 3998404 - RNA, 17 nt, Staphylococcus aureus subsp. aureus Mu50
uuuuguguucggaauuu

SEQ ID NO: 3998405 - RNA, 14 nt, Staphylococcus aureus subsp. aureus Mu50
uuuuguuaauuuuu

SEQ ID NO: 3998406 - RNA, 16 nt, Staphylococcus aureus subsp. aureus Mu50
uuuuguuaauuuuuua

SEQ ID NO: 3998407 - RNA, 16 nt, Staphylococcus aureus subsp. aureus Mu50
uuuuguucuaaguguu

SEQ ID NO: 3998408 - RNA, 20 nt, Staphylococcus aureus subsp. aureus Mu50
uuuuguucuaaguguuuuau

SEQ ID NO: 3998409 - RNA, 18 nt, Staphylococcus aureus subsp. aureus Mu50
uuuuguugcucagugcau

SEQ ID NO: 3998410 - RNA, 14 nt, Staphylococcus aureus subsp. aureus Mu50
uuuuguuguacuuc

SEQ ID NO: 3998411 - RNA, 12 nt, Staphylococcus aureus subsp. aureus Mu50
uuuuguuuugcu

SEQ ID NO: 3998412 - RNA, 21 nt, Staphylococcus aureus subsp. aureus Mu50
uuuuuaaaaaauuuaaauaau

SEQ ID NO: 3998413 - RNA, 22 nt, Staphylococcus aureus subsp. aureus Mu50
uuuuuaaaaaauuuaaauaaua

SEQ ID NO: 3998414 - RNA, 14 nt, Staphylococcus aureus subsp. aureus Mu50
uuuuuaaaaauaca

SEQ ID NO: 3998415 - RNA, 21 nt, Staphylococcus aureus subsp. aureus Mu50
uuuuuaaaaggugugggcuuu

SEQ ID NO: 3998416 - RNA, 21 nt, Staphylococcus aureus subsp. aureus Mu50
uuuuuaaaaucucauaauaau

SEQ ID NO: 3998417 - RNA, 19 nt, Staphylococcus aureus subsp. aureus Mu50
uuuuuaaaauuaucaauug

SEQ ID NO: 3998418 - RNA, 17 nt, Staphylococcus aureus subsp. aureus Mu50
uuuuuaaagcuggggaa

SEQ ID NO: 3998419 - RNA, 18 nt, Staphylococcus aureus subsp. aureus Mu50
uuuuuaaaguuuaaauau

SEQ ID NO: 3998420 - RNA, 11 nt, Staphylococcus aureus subsp. aureus Mu50
uuuuuaaauac

SEQ ID NO: 3998421 - RNA, 17 nt, Staphylococcus aureus subsp. aureus Mu50
uuuuuaaauuacuauau

SEQ ID NO: 3998422 - RNA, 23 nt, Staphylococcus aureus subsp. aureus Mu50
uuuuuaacauagcuuaauaauua

SEQ ID NO: 3998423 - RNA, 16 nt, Staphylococcus aureus subsp. aureus Mu50
uuuuuaacugccauau

SEQ ID NO: 3998424 - RNA, 12 nt, Staphylococcus aureus subsp. aureus Mu50
uuuuuaauaauu

SEQ ID NO: 3998425 - RNA, 21 nt, Staphylococcus aureus subsp. aureus Mu50
uuuuuaauuauuuuaaaaaau

SEQ ID NO: 3998426 - RNA, 19 nt, Staphylococcus aureus subsp. aureus Mu50
uuuuuacuaggaauauaaa

SEQ ID NO: 3998427 - RNA, 16 nt, Staphylococcus aureus subsp. aureus Mu50
uuuuuacuauaauaau

SEQ ID NO: 3998428 - RNA, 20 nt, Staphylococcus aureus subsp. aureus Mu50
uuuuuagacauuaaaaaauc

SEQ ID NO: 3998429 - RNA, 19 nt, Staphylococcus aureus subsp. aureus Mu50
uuuuuagguuauauuuaaa

SEQ ID NO: 3998430 - RNA, 15 nt, Staphylococcus aureus subsp. aureus Mu50
uuuuuaguaauaaca

SEQ ID NO: 3998431 - RNA, 15 nt, Staphylococcus aureus subsp. aureus Mu50
uuuuuaguuaaagua

SEQ ID NO: 3998432 - RNA, 14 nt, Staphylococcus aureus subsp. aureus Mu50
uuuuuauaaaucau

SEQ ID NO: 3998433 - RNA, 18 nt, Staphylococcus aureus subsp. aureus Mu50
uuuuuauaaguauucaua

SEQ ID NO: 3998434 - RNA, 18 nt, Staphylococcus aureus subsp. aureus Mu50
uuuuuauaaguuaaaaau

SEQ ID NO: 3998435 - RNA, 23 nt, Staphylococcus aureus subsp. aureus Mu50
uuuuuauauuauuucaauacccu

SEQ ID NO: 3998436 - RNA, 11 nt, Staphylococcus aureus subsp. aureus Mu50
uuuuuauauug

SEQ ID NO: 3998437 - RNA, 22 nt, Staphylococcus aureus subsp. aureus Mu50
uuuuuauauugcgaaaaauaau

SEQ ID NO: 3998438 - RNA, 15 nt, Staphylococcus aureus subsp. aureus Mu50
uuuuuaucaucuucu

SEQ ID NO: 3998439 - RNA, 13 nt, Staphylococcus aureus subsp. aureus Mu50
uuuuuaucaugau

SEQ ID NO: 3998440 - RNA, 12 nt, Staphylococcus aureus subsp. aureus Mu50
uuuuuaucaugu

SEQ ID NO: 3998441 - RNA, 19 nt, Staphylococcus aureus subsp. aureus MW2
aaaaaggaagaacagcaca

SEQ ID NO: 3998442 - RNA, 22 nt, Staphylococcus aureus subsp. aureus MW2
aaaaaggaugaugugaauguuu

SEQ ID NO: 3998443 - RNA, 21 nt, Staphylococcus aureus subsp. aureus MW2
aaaaagguuguuuuucaucau

SEQ ID NO: 3998444 - RNA, 20 nt, Staphylococcus aureus subsp. aureus MW2
aaaaaguaaaaucuuuaaca

SEQ ID NO: 3998445 - RNA, 15 nt, Staphylococcus aureus subsp. aureus MW2
aaaaagucaaagagg

SEQ ID NO: 3998446 - RNA, 20 nt, Staphylococcus aureus subsp. aureus MW2
aaaaagucucauuaucacca

SEQ ID NO: 3998447 - RNA, 18 nt, Staphylococcus aureus subsp. aureus MW2
aaaaagucuuuaauagcu

SEQ ID NO: 3998448 - RNA, 20 nt, Staphylococcus aureus subsp. aureus MW2
aaaaagugaaaguauuagau

SEQ ID NO: 3998449 - RNA, 18 nt, Staphylococcus aureus subsp. aureus MW2
aaaaagugauaauuaaaa

SEQ ID NO: 3998450 - RNA, 13 nt, Staphylococcus aureus subsp. aureus MW2
aaaaaguuuaaag

SEQ ID NO: 3998451 - RNA, 20 nt, Staphylococcus aureus subsp. aureus MW2
aaaaauaaagucauaugguu

SEQ ID NO: 3998452 - RNA, 16 nt, Staphylococcus aureus subsp. aureus MW2
aaaaauaaauguuaaa

SEQ ID NO: 3998453 - RNA, 20 nt, Staphylococcus aureus subsp. aureus MW2
aaaaauaacuguaaaacauu

SEQ ID NO: 3998454 - RNA, 15 nt, Staphylococcus aureus subsp. aureus MW2
aaaaauaauagcaaa

SEQ ID NO: 3998455 - RNA, 17 nt, Staphylococcus aureus subsp. aureus MW2
aaaaauaauagcaaaau

SEQ ID NO: 3998456 - RNA, 14 nt, Staphylococcus aureus subsp. aureus MW2
aaaaauaauuaaau

SEQ ID NO: 3998457 - RNA, 13 nt, Staphylococcus aureus subsp. aureus MW2
aaaaauacauaau

SEQ ID NO: 3998458 - RNA, 19 nt, Staphylococcus aureus subsp. aureus MW2
aaaaauaguucuuuaaauu

SEQ ID NO: 3998459 - RNA, 17 nt, Staphylococcus aureus subsp. aureus MW2
aaaaauauucaaacgaa

SEQ ID NO: 3998460 - RNA, 13 nt, Staphylococcus aureus subsp. aureus MW2
aaaaauauuuaaa

SEQ ID NO: 3998461 - RNA, 17 nt, Staphylococcus aureus subsp. aureus MW2
aaaaauauuuaaauaga

SEQ ID NO: 3998462 - RNA, 14 nt, Staphylococcus aureus subsp. aureus MW2
aaaaaucaaagagg

SEQ ID NO: 3998463 - RNA, 20 nt, Staphylococcus aureus subsp. aureus MW2
aaaaauccggaacauuaaaa

SEQ ID NO: 3998464 - RNA, 22 nt, Staphylococcus aureus subsp. aureus MW2
aaaaauccggaacauuaaaagg

SEQ ID NO: 3998465 - RNA, 14 nt, Staphylococcus aureus subsp. aureus MW2
aaaaauccuaugaa

SEQ ID NO: 3998466 - RNA, 19 nt, Staphylococcus aureus subsp. aureus MW2
aaaaauccuaugaauaaau

SEQ ID NO: 3998467 - RNA, 20 nt, Staphylococcus aureus subsp. aureus MW2
aaaaauccucacaaauuuga

SEQ ID NO: 3998468 - RNA, 17 nt, Staphylococcus aureus subsp. aureus MW2
aaaaaucggcuuucuaa

SEQ ID NO: 3998469 - RNA, 23 nt, Staphylococcus aureus subsp. aureus MW2
aaaaaucuacauaugaaaaaugu

SEQ ID NO: 3998470 - RNA, 18 nt, Staphylococcus aureus subsp. aureus MW2
aaaaaucuucuccaauca

SEQ ID NO: 3998471 - RNA, 22 nt, Staphylococcus aureus subsp. aureus MW2
aaaaaucuucuccaaucaucau

SEQ ID NO: 3998472 - RNA, 10 nt, Staphylococcus aureus subsp. aureus MW2
aaaaaugaaa

SEQ ID NO: 3998473 - RNA, 19 nt, Staphylococcus aureus subsp. aureus MW2
aaaaaugaagaauacaaau

SEQ ID NO: 3998474 - RNA, 22 nt, Staphylococcus aureus subsp. aureus MW2
aaaaaugaagucuuucaacaaa

SEQ ID NO: 3998475 - RNA, 12 nt, Staphylococcus aureus subsp. aureus MW2
aaaaaugaugua

SEQ ID NO: 3998476 - RNA, 18 nt, Staphylococcus aureus subsp. aureus MW2
aaaaaugcgcuuccaauu

SEQ ID NO: 3998477 - RNA, 23 nt, Staphylococcus aureus subsp. aureus MW2
aaaaauggggacauguucacuua

SEQ ID NO: 3998478 - RNA, 21 nt, Staphylococcus aureus subsp. aureus MW2
aaaaauggugauccgccuuga

SEQ ID NO: 3998479 - RNA, 12 nt, Staphylococcus aureus subsp. aureus MW2
aaaaauguaaau

SEQ ID NO: 3998480 - RNA, 17 nt, Staphylococcus aureus subsp. aureus MW2
aaaaauguaaauaaaaa

SEQ ID NO: 3998481 - RNA, 18 nt, Staphylococcus aureus subsp. aureus MW2
aaaaauguaaauaaaaau

SEQ ID NO: 3998482 - RNA, 18 nt, Staphylococcus aureus subsp. aureus MW2
aaaaaugucuaaaaaaau

SEQ ID NO: 3998483 - RNA, 18 nt, Staphylococcus aureus subsp. aureus MW2
aaaaauguguuaaaauau

SEQ ID NO: 3998484 - RNA, 21 nt, Staphylococcus aureus subsp. aureus MW2
aaaaauguguuaaaauauauu

SEQ ID NO: 3998485 - RNA, 15 nt, Staphylococcus aureus subsp. aureus MW2
aaaaauuaaaaaaca

SEQ ID NO: 3998486 - RNA, 16 nt, Staphylococcus aureus subsp. aureus MW2
aaaaauuaaaaaacaa

SEQ ID NO: 3998487 - RNA, 14 nt, Staphylococcus aureus subsp. aureus MW2
aaaaauuaaaaauu

SEQ ID NO: 3998488 - RNA, 13 nt, Staphylococcus aureus subsp. aureus MW2
aaaaauuaucuca

SEQ ID NO: 3998489 - RNA, 19 nt, Staphylococcus aureus subsp. aureus MW2
aaaaauugcaaugcuauca

SEQ ID NO: 3998490 - RNA, 21 nt, Staphylococcus aureus subsp. aureus MW2
aaaaauugcaaugcuaucaug

SEQ ID NO: 3998491 - RNA, 16 nt, Staphylococcus aureus subsp. aureus MW2
aaaaauuguuaauccc

SEQ ID NO: 3998492 - RNA, 16 nt, Staphylococcus aureus subsp. aureus MW2
aaaaauuuaaauaaua

SEQ ID NO: 3998493 - RNA, 16 nt, Staphylococcus aureus subsp. aureus MW2
aaaaauuucaaaaaua

SEQ ID NO: 3998494 - RNA, 18 nt, Staphylococcus aureus subsp. aureus MW2
aaaaauuucaaaaauagc

SEQ ID NO: 3998495 - RNA, 22 nt, Staphylococcus aureus subsp. aureus MW2
aaaaauuucgccucaucuaauu

SEQ ID NO: 3998496 - RNA, 22 nt, Staphylococcus aureus subsp. aureus MW2
aaaaauuucucccauccccuuu

SEQ ID NO: 3998497 - RNA, 18 nt, Staphylococcus aureus subsp. aureus MW2
aaaaauuugcaugaaaau

SEQ ID NO: 3998498 - RNA, 14 nt, Staphylococcus aureus subsp. aureus MW2
aaaacaaaaaaccg

SEQ ID NO: 3998499 - RNA, 15 nt, Staphylococcus aureus subsp. aureus MW2
aaaacaaaaaaccga

SEQ ID NO: 3998500 - RNA, 15 nt, Staphylococcus aureus subsp. aureus MW2
aaaacaaaaaauauc

SEQ ID NO: 3998501 - RNA, 13 nt, Staphylococcus aureus subsp. aureus MW2
aaaacaaaaccaa

SEQ ID NO: 3998502 - RNA, 17 nt, Staphylococcus aureus subsp. aureus MW2
aaaacaaagguuuguaa

SEQ ID NO: 3998503 - RNA, 12 nt, Staphylococcus aureus subsp. aureus MW2
aaaacaauaaua

SEQ ID NO: 3998504 - RNA, 13 nt, Staphylococcus aureus subsp. aureus MW2
aaaacaauauuga

SEQ ID NO: 3998505 - RNA, 13 nt, Staphylococcus aureus subsp. aureus MW2
aaaacaaugauua

SEQ ID NO: 3998506 - RNA, 17 nt, Staphylococcus aureus subsp. aureus MW2
aaaacaauuuaaaaagc

SEQ ID NO: 3998507 - RNA, 19 nt, Staphylococcus aureus subsp. aureus MW2
aaaacagaauuucaucaaa

SEQ ID NO: 3998508 - RNA, 19 nt, Staphylococcus aureus subsp. aureus MW2
aaaacagcaguaagauauu

SEQ ID NO: 3998509 - RNA, 20 nt, Staphylococcus aureus subsp. aureus MW2
aaaacagcaguaagauuauu

SEQ ID NO: 3998510 - RNA, 16 nt, Staphylococcus aureus subsp. aureus MW2
aaaacauaaucauugu

SEQ ID NO: 3998511 - RNA, 12 nt, Staphylococcus aureus subsp. aureus MW2
aaaacauaccug

SEQ ID NO: 3998512 - RNA, 19 nt, Staphylococcus aureus subsp. aureus MW2
aaaacauguugauaaaaag

SEQ ID NO: 3998513 - RNA, 16 nt, Staphylococcus aureus subsp. aureus MW2
aaaacauuauuaagug

SEQ ID NO: 3998514 - RNA, 22 nt, Staphylococcus aureus subsp. aureus MW2
aaaacauuggcgaggccccaac

SEQ ID NO: 3998515 - RNA, 12 nt, Staphylococcus aureus subsp. aureus MW2
aaaaccaaauga

SEQ ID NO: 3998516 - RNA, 16 nt, Staphylococcus aureus subsp. aureus MW2
aaaaccaguuugauua

SEQ ID NO: 3998517 - RNA, 18 nt, Staphylococcus aureus subsp. aureus MW2
aaaaccgaggaaauccuu

SEQ ID NO: 3998518 - RNA, 22 nt, Staphylococcus aureus subsp. aureus MW2
aaaaccgcuauaaaauuuugaa

SEQ ID NO: 3998519 - RNA, 21 nt, Staphylococcus aureus subsp. aureus MW2
aaaaccuauuccuaauaaaua

SEQ ID NO: 3998520 - RNA, 19 nt, Staphylococcus aureus subsp. aureus MW2
aaaaccuuacccaaaaaau

SEQ ID NO: 3998521 - RNA, 14 nt, Staphylococcus aureus subsp. aureus MW2
aaaaccuucaguaa

SEQ ID NO: 3998522 - RNA, 14 nt, Staphylococcus aureus subsp. aureus MW2
aaaacgaagucagu

SEQ ID NO: 3998523 - RNA, 14 nt, Staphylococcus aureus subsp. aureus MW2
aaaacgagauuaca

SEQ ID NO: 3998524 - RNA, 16 nt, Staphylococcus aureus subsp. aureus MW2
aaaacgauaagaauua

SEQ ID NO: 3998525 - RNA, 17 nt, Staphylococcus aureus subsp. aureus MW2
aaaacgauaguguacac

SEQ ID NO: 3998526 - RNA, 16 nt, Staphylococcus aureus subsp. aureus MW2
aaaacgugacauuuuc

SEQ ID NO: 3998527 - RNA, 18 nt, Staphylococcus aureus subsp. aureus MW2
aaaacguugaguauuacu

SEQ ID NO: 3998528 - RNA, 12 nt, Staphylococcus aureus subsp. aureus MW2
aaaacguuuaau

SEQ ID NO: 3998529 - RNA, 19 nt, Staphylococcus aureus subsp. aureus MW2
aaaacuaaagguauucuau

SEQ ID NO: 3998530 - RNA, 20 nt, Staphylococcus aureus subsp. aureus MW2
aaaauaguaaagugaaauaa

SEQ ID NO: 3998531 - RNA, 16 nt, Staphylococcus aureus subsp. aureus MW2
aaaauaguucuuuaaa

SEQ ID NO: 3998532 - RNA, 21 nt, Staphylococcus aureus subsp. aureus MW2
aaaauaguucuuuaaauuaua

SEQ ID NO: 3998533 - RNA, 24 nt, Staphylococcus aureus subsp. aureus MW2
aaaauaguucuuuaaauuauauac

SEQ ID NO: 3998534 - RNA, 15 nt, Staphylococcus aureus subsp. aureus MW2
aaaauauagcuauua

SEQ ID NO: 3998535 - RNA, 14 nt, Staphylococcus aureus subsp. aureus MW2
aaaauauaugaaua

SEQ ID NO: 3998536 - RNA, 15 nt, Staphylococcus aureus subsp. aureus MW2
aaaauauaugaauaa

SEQ ID NO: 3998537 - RNA, 14 nt, Staphylococcus aureus subsp. aureus MW2
aaaauauauuauaa

SEQ ID NO: 3998538 - RNA, 16 nt, Staphylococcus aureus subsp. aureus MW2
aaaauauauuauaaaa

SEQ ID NO: 3998539 - RNA, 17 nt, Staphylococcus aureus subsp. aureus MW2
aaaauauauuauaaaaa

SEQ ID NO: 3998540 - RNA, 19 nt, Staphylococcus aureus subsp. aureus MW2
aaaauauauuauaaaaaua

SEQ ID NO: 3998541 - RNA, 20 nt, Staphylococcus aureus subsp. aureus MW2
aaaauauauuauaaaaauag

SEQ ID NO: 3998542 - RNA, 13 nt, Staphylococcus aureus subsp. aureus MW2
aaaauaucacuaa

SEQ ID NO: 3998543 - RNA, 23 nt, Staphylococcus aureus subsp. aureus MW2
aaaauaucacuaauauauuuaga

SEQ ID NO: 3998544 - RNA, 22 nt, Staphylococcus aureus subsp. aureus MW2
aaaauaugauugcaaauuauca

SEQ ID NO: 3998545 - RNA, 20 nt, Staphylococcus aureus subsp. aureus MW2
aaaauauguguuaacugaua

SEQ ID NO: 3998546 - RNA, 21 nt, Staphylococcus aureus subsp. aureus MW2
aaaauauuuaaacuaguaaua

SEQ ID NO: 3998547 - RNA, 14 nt, Staphylococcus aureus subsp. aureus MW2
aaaauauuuaaaua

SEQ ID NO: 3998548 - RNA, 14 nt, Staphylococcus aureus subsp. aureus MW2
aaaauauuuacauu

SEQ ID NO: 3998549 - RNA, 17 nt, Staphylococcus aureus subsp. aureus MW2
aaaauauuuuauuauaa

SEQ ID NO: 3998550 - RNA, 21 nt, Staphylococcus aureus subsp. aureus MW2
aaaaucaaauugacgcauuaa

SEQ ID NO: 3998551 - RNA, 13 nt, Staphylococcus aureus subsp. aureus MW2
aaaaucaccuuuu

SEQ ID NO: 3998552 - RNA, 23 nt, Staphylococcus aureus subsp. aureus MW2
aaaaucaguugcuucauaaaugu

SEQ ID NO: 3998553 - RNA, 19 nt, Staphylococcus aureus subsp. aureus MW2
aaaauccgcuuuauuuuau

SEQ ID NO: 3998554 - RNA, 21 nt, Staphylococcus aureus subsp. aureus MW2
aaaauccucacaaauuugaau

SEQ ID NO: 3998555 - RNA, 15 nt, Staphylococcus aureus subsp. aureus MW2
aaaauccugaaauua

SEQ ID NO: 3998556 - RNA, 22 nt, Staphylococcus aureus subsp. aureus MW2
aaaaucgaacaaaugaaaaagu

SEQ ID NO: 3998557 - RNA, 20 nt, Staphylococcus aureus subsp. aureus MW2
aaaaucggacagcugaaaaa

SEQ ID NO: 3998558 - RNA, 12 nt, Staphylococcus aureus subsp. aureus MW2
aaaaucuauaua

SEQ ID NO: 3998559 - RNA, 19 nt, Staphylococcus aureus subsp. aureus MW2
aaaaucucauaauaauuca

SEQ ID NO: 3998560 - RNA, 23 nt, Staphylococcus aureus subsp. aureus MW2
aaaaucucauaauaauucaguaa

SEQ ID NO: 3998561 - RNA, 19 nt, Staphylococcus aureus subsp. aureus MW2
aaaaucugaguauuguuau

SEQ ID NO: 3998562 - RNA, 23 nt, Staphylococcus aureus subsp. aureus MW2
aaaaucuguuucuuguucuaaaa

SEQ ID NO: 3998563 - RNA, 15 nt, Staphylococcus aureus subsp. aureus MW2
aaaaucuuuaacucu

SEQ ID NO: 3998564 - RNA, 13 nt, Staphylococcus aureus subsp. aureus MW2
aaaaugaaaugaa

SEQ ID NO: 3998565 - RNA, 17 nt, Staphylococcus aureus subsp. aureus MW2
aaaaugaagaauacaaa

SEQ ID NO: 3998566 - RNA, 23 nt, Staphylococcus aureus subsp. aureus MW2
aaaaugaagucuuucaacaaaau

SEQ ID NO: 3998567 - RNA, 18 nt, Staphylococcus aureus subsp. aureus MW2
aaaaugaauaauuacuaa

SEQ ID NO: 3998568 - RNA, 12 nt, Staphylococcus aureus subsp. aureus MW2
aaaaugaaugaa

SEQ ID NO: 3998569 - RNA, 16 nt, Staphylococcus aureus subsp. aureus MW2
aaaaugacgauacgua

SEQ ID NO: 3998570 - RNA, 15 nt, Staphylococcus aureus subsp. aureus MW2
aaaaugauagauuca

SEQ ID NO: 3998571 - RNA, 23 nt, Staphylococcus aureus subsp. aureus MW2
aaaaugauguaacguuucuuugu

SEQ ID NO: 3998572 - RNA, 23 nt, Staphylococcus aureus subsp. aureus MW2
aaaaugcaauuuuucacuuauaa

SEQ ID NO: 3998573 - RNA, 13 nt, Staphylococcus aureus subsp. aureus MW2
aaaaugcacugag

SEQ ID NO: 3998574 - RNA, 21 nt, Staphylococcus aureus subsp. aureus MW2
aaaauggauuuuauuuucaaa

SEQ ID NO: 3998575 - RNA, 23 nt, Staphylococcus aureus subsp. aureus MW2
aaaauggugauccgccuugauuu

SEQ ID NO: 3998576 - RNA, 15 nt, Staphylococcus aureus subsp. aureus MW2
aaaaugguuaaaauc

SEQ ID NO: 3998577 - RNA, 22 nt, Staphylococcus aureus subsp. aureus MW2
aaaauguauuaaauaugcacuu

SEQ ID NO: 3998578 - RNA, 15 nt, Staphylococcus aureus subsp. aureus MW2
aaaaugucauuugaa

SEQ ID NO: 3998579 - RNA, 14 nt, Staphylococcus aureus subsp. aureus MW2
aaaaugucuaaaaa

SEQ ID NO: 3998580 - RNA, 15 nt, Staphylococcus aureus subsp. aureus MW2
aaaaugucuaaaaaa

SEQ ID NO: 3998581 - RNA, 15 nt, Staphylococcus aureus subsp. aureus MW2
aaaauguguuaaaau

SEQ ID NO: 3998582 - RNA, 16 nt, Staphylococcus aureus subsp. aureus MW2
aaaauguuaauaauga

SEQ ID NO: 3998583 - RNA, 17 nt, Staphylococcus aureus subsp. aureus MW2
aaaauguuacacaaauu

SEQ ID NO: 3998584 - RNA, 19 nt, Staphylococcus aureus subsp. aureus MW2
aaaauguuacacaaauuaa

SEQ ID NO: 3998585 - RNA, 14 nt, Staphylococcus aureus subsp. aureus MW2
aaaauguuuaacaa

SEQ ID NO: 3998586 - RNA, 17 nt, Staphylococcus aureus subsp. aureus MW2
aaaauguuuaacaauaa

SEQ ID NO: 3998587 - RNA, 13 nt, Staphylococcus aureus subsp. aureus MW2
aaaauuaaaaaac

SEQ ID NO: 3998588 - RNA, 17 nt, Staphylococcus aureus subsp. aureus MW2
aaaauuaaaaaacaaaa

SEQ ID NO: 3998589 - RNA, 13 nt, Staphylococcus aureus subsp. aureus MW2
aaaauuaaaaaau

SEQ ID NO: 3998590 - RNA, 14 nt, Staphylococcus aureus subsp. aureus MW2
aaaauuaaaacagc

SEQ ID NO: 3998591 - RNA, 22 nt, Staphylococcus aureus subsp. aureus MW2
aaaauuaaaacagcaaauaaaa

SEQ ID NO: 3998592 - RNA, 22 nt, Staphylococcus aureus subsp. aureus MW2
aaaauuaaauaaugauaaauua

SEQ ID NO: 3998593 - RNA, 18 nt, Staphylococcus aureus subsp. aureus MW2
aaaauuacgcaaagaaaa

SEQ ID NO: 3998594 - RNA, 21 nt, Staphylococcus aureus subsp. aureus MW2
aaaauuacgcaaagaaaaaca

SEQ ID NO: 3998595 - RNA, 16 nt, Staphylococcus aureus subsp. aureus MW2
aaaauuagcgauacuu

SEQ ID NO: 3998596 - RNA, 18 nt, Staphylococcus aureus subsp. aureus MW2
aaaauuauauaaauuacc

SEQ ID NO: 3998597 - RNA, 13 nt, Staphylococcus aureus subsp. aureus MW2
aaaauuauaugga

SEQ ID NO: 3998598 - RNA, 15 nt, Staphylococcus aureus subsp. aureus MW2
aaaauuauguaaaaa

SEQ ID NO: 3998599 - RNA, 21 nt, Staphylococcus aureus subsp. aureus MW2
aaaauuccuagcuuuuauguc

SEQ ID NO: 3998600 - RNA, 19 nt, Staphylococcus aureus subsp. aureus MW2
aaaauucuaacugcaaaac

SEQ ID NO: 3998601 - RNA, 23 nt, Staphylococcus aureus subsp. aureus MW2
aaaauugaaggaaaauaaaaacc

SEQ ID NO: 3998602 - RNA, 15 nt, Staphylococcus aureus subsp. aureus MW2
aaaauugcuaaaaaa

SEQ ID NO: 3998603 - RNA, 16 nt, Staphylococcus aureus subsp. aureus MW2
aaaauugcuaaaaaaa

SEQ ID NO: 3998604 - RNA, 19 nt, Staphylococcus aureus subsp. aureus MW2
aaaauugcuaaaaaaauua

SEQ ID NO: 3998605 - RNA, 17 nt, Staphylococcus aureus subsp. aureus MW2
aaaauugcuauauuagu

SEQ ID NO: 3998606 - RNA, 18 nt, Staphylococcus aureus subsp. aureus MW2
aaaauugcuauauuagua

SEQ ID NO: 3998607 - RNA, 21 nt, Staphylococcus aureus subsp. aureus MW2
aaaauugguuuggauaaaaug

SEQ ID NO: 3998608 - RNA, 22 nt, Staphylococcus aureus subsp. aureus MW2
aaaauugguuuggauaaaauga

SEQ ID NO: 3998609 - RNA, 23 nt, Staphylococcus aureus subsp. aureus MW2
aaaauugguuuggauaaaaugau

SEQ ID NO: 3998610 - RNA, 17 nt, Staphylococcus aureus subsp. aureus MW2
aaaauuguaagucgaaa

SEQ ID NO: 3998611 - RNA, 14 nt, Staphylococcus aureus subsp. aureus MW2
aaaauuguuaauac

SEQ ID NO: 3998612 - RNA, 15 nt, Staphylococcus aureus subsp. aureus MW2
aaaauuguuaauaca

SEQ ID NO: 3998613 - RNA, 23 nt, Staphylococcus aureus subsp. aureus MW2
aaaauuuaaauaauaauucauaa

SEQ ID NO: 3998614 - RNA, 23 nt, Staphylococcus aureus subsp. aureus MW2
aaaauuuaauugcuguaaauauu

SEQ ID NO: 3998615 - RNA, 13 nt, Staphylococcus aureus subsp. aureus MW2
aaaauuucaguac

SEQ ID NO: 3998616 - RNA, 24 nt, Staphylococcus aureus subsp. aureus MW2
aaaauuuccacuuugaucuuuaaa

SEQ ID NO: 3998617 - RNA, 12 nt, Staphylococcus aureus subsp. aureus MW2
aaaauuucugcu

SEQ ID NO: 3998618 - RNA, 15 nt, Staphylococcus aureus subsp. aureus MW2
aaaccaauuuuaaua

SEQ ID NO: 3998619 - RNA, 18 nt, Staphylococcus aureus subsp. aureus MW2
aaaccaguuuaguauuaa

SEQ ID NO: 3998620 - RNA, 16 nt, Staphylococcus aureus subsp. aureus MW2
aaaccauuaauaaaac

SEQ ID NO: 3998621 - RNA, 15 nt, Staphylococcus aureus subsp. aureus MW2
aaaccgaaaauaccu

SEQ ID NO: 3998622 - RNA, 18 nt, Staphylococcus aureus subsp. aureus MW2
aaaccgagaaucuccauu

SEQ ID NO: 3998623 - RNA, 17 nt, Staphylococcus aureus subsp. aureus MW2
aaaccgaggaaauccuu

SEQ ID NO: 3998624 - RNA, 12 nt, Staphylococcus aureus subsp. aureus MW2
aaaccgauuaau

SEQ ID NO: 3998625 - RNA, 22 nt, Staphylococcus aureus subsp. aureus MW2
aaaccgccaacuaauguuaaaa

SEQ ID NO: 3998626 - RNA, 16 nt, Staphylococcus aureus subsp. aureus MW2
aaaccguaauuuuaau

SEQ ID NO: 3998627 - RNA, 23 nt, Staphylococcus aureus subsp. aureus MW2
aaaccgugagggacgucaucaug

SEQ ID NO: 3998628 - RNA, 16 nt, Staphylococcus aureus subsp. aureus MW2
aaaccguuauauauua

SEQ ID NO: 3998629 - RNA, 12 nt, Staphylococcus aureus subsp. aureus MW2
aaaccuaacaua

SEQ ID NO: 3998630 - RNA, 15 nt, Staphylococcus aureus subsp. aureus MW2
aaaccuaaugauaau

SEQ ID NO: 3998631 - RNA, 18 nt, Staphylococcus aureus subsp. aureus MW2
aaaccuacuaauauauua

SEQ ID NO: 3998632 - RNA, 12 nt, Staphylococcus aureus subsp. aureus MW2
aaaccucuaaau

SEQ ID NO: 3998633 - RNA, 20 nt, Staphylococcus aureus subsp. aureus MW2
aaaccucuaaauaaaauuaa

SEQ ID NO: 3998634 - RNA, 17 nt, Staphylococcus aureus subsp. aureus MW2
aaaccuuacccaaaaaa

SEQ ID NO: 3998635 - RNA, 16 nt, Staphylococcus aureus subsp. aureus MW2
aaaccuuuucaaacua

SEQ ID NO: 3998636 - RNA, 13 nt, Staphylococcus aureus subsp. aureus MW2
aaacgaaauuaua

SEQ ID NO: 3998637 - RNA, 20 nt, Staphylococcus aureus subsp. aureus MW2
aaacgagcuggugagaaauu

SEQ ID NO: 3998638 - RNA, 21 nt, Staphylococcus aureus subsp. aureus MW2
aaacgauaagaauuaacaaca

SEQ ID NO: 3998639 - RNA, 13 nt, Staphylococcus aureus subsp. aureus MW2
aaacgauacugcu

SEQ ID NO: 3998640 - RNA, 22 nt, Staphylococcus aureus subsp. aureus MW2
aaacgauauagaccguugaaau

SEQ ID NO: 3998641 - RNA, 21 nt, Staphylococcus aureus subsp. aureus MW2
aaacgcaauacgaauaucugu

SEQ ID NO: 3998642 - RNA, 17 nt, Staphylococcus aureus subsp. aureus MW2
aaacgccucaacacuuu

SEQ ID NO: 3998643 - RNA, 14 nt, Staphylococcus aureus subsp. aureus MW2
aaacgccuuuccau

SEQ ID NO: 3998644 - RNA, 13 nt, Staphylococcus aureus subsp. aureus MW2
aaacgcucuucuu

SEQ ID NO: 3998645 - RNA, 21 nt, Staphylococcus aureus subsp. aureus MW2
aaacgcucuucuucuucagga

SEQ ID NO: 3998646 - RNA, 21 nt, Staphylococcus aureus subsp. aureus MW2
aaacggcacuaauauuuaaaa

SEQ ID NO: 3998647 - RNA, 20 nt, Staphylococcus aureus subsp. aureus MW2
aaacgguaacaaagauuauu

SEQ ID NO: 3998648 - RNA, 23 nt, Staphylococcus aureus subsp. aureus MW2
aaacgguaacaaagauuauugaa

SEQ ID NO: 3998649 - RNA, 20 nt, Staphylococcus aureus subsp. aureus MW2
aaacgguacagauaagaaua

SEQ ID NO: 3998650 - RNA, 22 nt, Staphylococcus aureus subsp. aureus MW2
aaacguaucauuuaaaauauuu

SEQ ID NO: 3998651 - RNA, 17 nt, Staphylococcus aureus subsp. aureus MW2
aaacgugacauuuucaa

SEQ ID NO: 3998652 - RNA, 21 nt, Staphylococcus aureus subsp. aureus MW2
aaacguguacuucaauugucg

SEQ ID NO: 3998653 - RNA, 14 nt, Staphylococcus aureus subsp. aureus MW2
aaacguuauguaca

SEQ ID NO: 3998654 - RNA, 18 nt, Staphylococcus aureus subsp. aureus MW2
aaacguugaguauuacuu

SEQ ID NO: 3998655 - RNA, 22 nt, Staphylococcus aureus subsp. aureus MW2
aaacguugaguauuacuugaaa

SEQ ID NO: 3998656 - RNA, 13 nt, Staphylococcus aureus subsp. aureus MW2
aaacuaaucaaau

SEQ ID NO: 3998657 - RNA, 12 nt, Staphylococcus aureus subsp. aureus MW2
aaacuagacaaa

SEQ ID NO: 3998658 - RNA, 13 nt, Staphylococcus aureus subsp. aureus MW2
aaacuagcaguaa

SEQ ID NO: 3998659 - RNA, 16 nt, Staphylococcus aureus subsp. aureus MW2
aaacuauaauaaagau

SEQ ID NO: 3998660 - RNA, 17 nt, Staphylococcus aureus subsp. aureus MW2
aaacuauaauaaagauu

SEQ ID NO: 3998661 - RNA, 23 nt, Staphylococcus aureus subsp. aureus MW2
aaacuauaauaaagauuauaucu

SEQ ID NO: 3998662 - RNA, 14 nt, Staphylococcus aureus subsp. aureus MW2
aaacuaucuacacc

SEQ ID NO: 3998663 - RNA, 18 nt, Staphylococcus aureus subsp. aureus MW2
aaacuaucuacaccauua

SEQ ID NO: 3998664 - RNA, 22 nt, Staphylococcus aureus subsp. aureus MW2
aaacucguaaauuuuaucuaaa

SEQ ID NO: 3998665 - RNA, 11 nt, Staphylococcus aureus subsp. aureus MW2
aaacucuuaua

SEQ ID NO: 3998666 - RNA, 17 nt, Staphylococcus aureus subsp. aureus MW2
aaacuuacauuacauau

SEQ ID NO: 3998667 - RNA, 16 nt, Staphylococcus aureus subsp. aureus MW2
aaacuuagugucacau

SEQ ID NO: 3998668 - RNA, 18 nt, Staphylococcus aureus subsp. aureus MW2
aaacuuagugucacauua

SEQ ID NO: 3998669 - RNA, 22 nt, Staphylococcus aureus subsp. aureus MW2
aaacuuccugcuuuuuuuauaa

SEQ ID NO: 3998670 - RNA, 12 nt, Staphylococcus aureus subsp. aureus MW2
aaacuucuuuuc

SEQ ID NO: 3998671 - RNA, 14 nt, Staphylococcus aureus subsp. aureus MW2
aaacuucuuuucuu

SEQ ID NO: 3998672 - RNA, 22 nt, Staphylococcus aureus subsp. aureus MW2
aaacuuguaaauuuauuuuuaa

SEQ ID NO: 3998673 - RNA, 22 nt, Staphylococcus aureus subsp. aureus MW2
aaacuugugaauuuucagcauc

SEQ ID NO: 3998674 - RNA, 20 nt, Staphylococcus aureus subsp. aureus MW2
aaacuuuauggguauccuuc

SEQ ID NO: 3998675 - RNA, 19 nt, Staphylococcus aureus subsp. aureus MW2
aaacuuuugcaauuuuuga

SEQ ID NO: 3998676 - RNA, 20 nt, Staphylococcus aureus subsp. aureus MW2
aaacuuuuucgauuaauucu

SEQ ID NO: 3998677 - RNA, 12 nt, Staphylococcus aureus subsp. aureus MW2
aaagaaaaguuu

SEQ ID NO: 3998678 - RNA, 21 nt, Staphylococcus aureus subsp. aureus MW2
aaagaaccacgcaucauguau

SEQ ID NO: 3998679 - RNA, 22 nt, Staphylococcus aureus subsp. aureus MW2
aaagaagggaagaguuaauccu

SEQ ID NO: 3998680 - RNA, 12 nt, Staphylococcus aureus subsp. aureus MW2
aaagaauaugau

SEQ ID NO: 3998681 - RNA, 16 nt, Staphylococcus aureus subsp. aureus MW2
aaagaaugauuuauaa

SEQ ID NO: 3998682 - RNA, 13 nt, Staphylococcus aureus subsp. aureus MW2
aaagacaaaagca

SEQ ID NO: 3998683 - RNA, 14 nt, Staphylococcus aureus subsp. aureus MW2
aaagacaauuucua

SEQ ID NO: 3998684 - RNA, 19 nt, Staphylococcus aureus subsp. aureus MW2
aaagacauccacagaauua

SEQ ID NO: 3998685 - RNA, 16 nt, Staphylococcus aureus subsp. aureus MW2
aaagacaugagauuau

SEQ ID NO: 3998686 - RNA, 16 nt, Staphylococcus aureus subsp. aureus MW2
aaagaccguauuuuuu

SEQ ID NO: 3998687 - RNA, 21 nt, Staphylococcus aureus subsp. aureus MW2
aaagaccguauuuuuuuauaa

SEQ ID NO: 3998688 - RNA, 22 nt, Staphylococcus aureus subsp. aureus MW2
aaagacgauuuauuaguuuuua

SEQ ID NO: 3998689 - RNA, 18 nt, Staphylococcus aureus subsp. aureus MW2
aaagacggauaauuaauc

SEQ ID NO: 3998690 - RNA, 23 nt, Staphylococcus aureus subsp. aureus MW2
aaagacggugaccuuauauuuua

SEQ ID NO: 3998691 - RNA, 18 nt, Staphylococcus aureus subsp. aureus MW2
aaagacguuuuuuuauaa

SEQ ID NO: 3998692 - RNA, 21 nt, Staphylococcus aureus subsp. aureus MW2
aaagacuauauaacacaauac

SEQ ID NO: 3998693 - RNA, 20 nt, Staphylococcus aureus subsp. aureus MW2
aaagacucaauuucauuuga

SEQ ID NO: 3998694 - RNA, 21 nt, Staphylococcus aureus subsp. aureus MW2
aaagacucuccaccauaugug

SEQ ID NO: 3998695 - RNA, 13 nt, Staphylococcus aureus subsp. aureus MW2
aaagagaaaagcu

SEQ ID NO: 3998696 - RNA, 19 nt, Staphylococcus aureus subsp. aureus MW2
aaagagaauauaaaauaau

SEQ ID NO: 3998697 - RNA, 22 nt, Staphylococcus aureus subsp. aureus MW2
aaagagaauuucgaaaagaaau

SEQ ID NO: 3998698 - RNA, 22 nt, Staphylococcus aureus subsp. aureus MW2
aaagagauacugguuaguaaaa

SEQ ID NO: 3998699 - RNA, 13 nt, Staphylococcus aureus subsp. aureus MW2
aaagagauuuuuu

SEQ ID NO: 3998700 - RNA, 18 nt, Staphylococcus aureus subsp. aureus MW2
aaagagauuuuuuugaaa

SEQ ID NO: 3998701 - RNA, 20 nt, Staphylococcus aureus subsp. aureus MW2
aaagagauuuuuuugaaaag

SEQ ID NO: 3998702 - RNA, 13 nt, Staphylococcus aureus subsp. aureus MW2
aaagagcguguua

SEQ ID NO: 3998703 - RNA, 17 nt, Staphylococcus aureus subsp. aureus MW2
aaagaggcuuuaaaauu

SEQ ID NO: 3998704 - RNA, 21 nt, Staphylococcus aureus subsp. aureus MW2
aaagaggcuuuaaaauuuuuu

SEQ ID NO: 3998705 - RNA, 19 nt, Staphylococcus aureus subsp. aureus MW2
aaagagguacuagaauuaa

SEQ ID NO: 3998706 - RNA, 12 nt, Staphylococcus aureus subsp. aureus MW2
aaaguacucaag

SEQ ID NO: 3998707 - RNA, 13 nt, Staphylococcus aureus subsp. aureus MW2
aaaguacuuacaa

SEQ ID NO: 3998708 - RNA, 19 nt, Staphylococcus aureus subsp. aureus MW2
aaaguacuuacaaauauac

SEQ ID NO: 3998709 - RNA, 14 nt, Staphylococcus aureus subsp. aureus MW2
aaaguacuuuaaaa

SEQ ID NO: 3998710 - RNA, 19 nt, Staphylococcus aureus subsp. aureus MW2
aaaguacuuuaaaauugua

SEQ ID NO: 3998711 - RNA, 16 nt, Staphylococcus aureus subsp. aureus MW2
aaaguagacauugaaa

SEQ ID NO: 3998712 - RNA, 17 nt, Staphylococcus aureus subsp. aureus MW2
aaaguaguugaaauguu

SEQ ID NO: 3998713 - RNA, 24 nt, Staphylococcus aureus subsp. aureus MW2
aaaguaguugaaauguuuauaaua

SEQ ID NO: 3998714 - RNA, 16 nt, Staphylococcus aureus subsp. aureus MW2
aaaguauaaaccaaau

SEQ ID NO: 3998715 - RNA, 13 nt, Staphylococcus aureus subsp. aureus MW2
aaaguauauugcu

SEQ ID NO: 3998716 - RNA, 15 nt, Staphylococcus aureus subsp. aureus MW2
aaaguauauugcuua

SEQ ID NO: 3998717 - RNA, 15 nt, Staphylococcus aureus subsp. aureus MW2
aaaguaucagucauu

SEQ ID NO: 3998718 - RNA, 13 nt, Staphylococcus aureus subsp. aureus MW2
aaagucaaaaaau

SEQ ID NO: 3998719 - RNA, 12 nt, Staphylococcus aureus subsp. aureus MW2
aaagucaaagag

SEQ ID NO: 3998720 - RNA, 18 nt, Staphylococcus aureus subsp. aureus MW2
aaagucacaguguaauca

SEQ ID NO: 3998721 - RNA, 21 nt, Staphylococcus aureus subsp. aureus MW2
aaagucagcauacaauaaugu

SEQ ID NO: 3998722 - RNA, 14 nt, Staphylococcus aureus subsp. aureus MW2
aaagucagcuuaca

SEQ ID NO: 3998723 - RNA, 18 nt, Staphylococcus aureus subsp. aureus MW2
aaagucagcuuacaauaa

SEQ ID NO: 3998724 - RNA, 21 nt, Staphylococcus aureus subsp. aureus MW2
aaagucagcuuacaauaaugu

SEQ ID NO: 3998725 - RNA, 15 nt, Staphylococcus aureus subsp. aureus MW2
aaagucauuaaaugu

SEQ ID NO: 3998726 - RNA, 17 nt, Staphylococcus aureus subsp. aureus MW2
aaagucauuaaauguac

SEQ ID NO: 3998727 - RNA, 16 nt, Staphylococcus aureus subsp. aureus MW2
aaaguccaauacaauu

SEQ ID NO: 3998728 - RNA, 13 nt, Staphylococcus aureus subsp. aureus MW2
aaagucgaaggcu

SEQ ID NO: 3998729 - RNA, 17 nt, Staphylococcus aureus subsp. aureus MW2
aaagucguuguugaaau

SEQ ID NO: 3998730 - RNA, 22 nt, Staphylococcus aureus subsp. aureus MW2
aaagucguuguugaaauuaaau

SEQ ID NO: 3998731 - RNA, 21 nt, Staphylococcus aureus subsp. aureus MW2
aaagucuguugguuuaucagc

SEQ ID NO: 3998732 - RNA, 19 nt, Staphylococcus aureus subsp. aureus MW2
aaagucuucuucaacaauu

SEQ ID NO: 3998733 - RNA, 13 nt, Staphylococcus aureus subsp. aureus MW2
aaagucuuuaaua

SEQ ID NO: 3998734 - RNA, 19 nt, Staphylococcus aureus subsp. aureus MW2
aaagugaaaacuucucuau

SEQ ID NO: 3998735 - RNA, 13 nt, Staphylococcus aureus subsp. aureus MW2
aaagugaauugua

SEQ ID NO: 3998736 - RNA, 16 nt, Staphylococcus aureus subsp. aureus MW2
aaagugauaauuaaaa

SEQ ID NO: 3998737 - RNA, 22 nt, Staphylococcus aureus subsp. aureus MW2
aaagugauaauuaaaauaagau

SEQ ID NO: 3998738 - RNA, 14 nt, Staphylococcus aureus subsp. aureus MW2
aaagugauuuaaaa

SEQ ID NO: 3998739 - RNA, 18 nt, Staphylococcus aureus subsp. aureus MW2
aaagugauuuaaaaaaau

SEQ ID NO: 3998740 - RNA, 22 nt, Staphylococcus aureus subsp. aureus MW2
aaagugauuuauuucauauuua

SEQ ID NO: 3998741 - RNA, 16 nt, Staphylococcus aureus subsp. aureus MW2
aaagugcgauuaucag

SEQ ID NO: 3998742 - RNA, 18 nt, Staphylococcus aureus subsp. aureus MW2
aaagugcgguuauuuaua

SEQ ID NO: 3998743 - RNA, 19 nt, Staphylococcus aureus subsp. aureus MW2
aaagugcgguuauuuauac

SEQ ID NO: 3998744 - RNA, 18 nt, Staphylococcus aureus subsp. aureus MW2
aaaguggccuuuuaaaca

SEQ ID NO: 3998745 - RNA, 19 nt, Staphylococcus aureus subsp. aureus MW2
aaaguggccuuuuaaacaa

SEQ ID NO: 3998746 - RNA, 14 nt, Staphylococcus aureus subsp. aureus MW2
aaagugguuuuacu

SEQ ID NO: 3998747 - RNA, 18 nt, Staphylococcus aureus subsp. aureus MW2
aaaguguagccaaauaaa

SEQ ID NO: 3998748 - RNA, 21 nt, Staphylococcus aureus subsp. aureus MW2
aaagugucuaacgcuguuuca

SEQ ID NO: 3998749 - RNA, 16 nt, Staphylococcus aureus subsp. aureus MW2
aaaguguuaugaauua

SEQ ID NO: 3998750 - RNA, 21 nt, Staphylococcus aureus subsp. aureus MW2
aaaguuagacuaaaaaacuaa

SEQ ID NO: 3998751 - RNA, 15 nt, Staphylococcus aureus subsp. aureus MW2
aaaguugacaauaca

SEQ ID NO: 3998752 - RNA, 18 nt, Staphylococcus aureus subsp. aureus MW2
aaaguugacaauacaaau

SEQ ID NO: 3998753 - RNA, 13 nt, Staphylococcus aureus subsp. aureus MW2
aaaguugauuuug

SEQ ID NO: 3998754 - RNA, 21 nt, Staphylococcus aureus subsp. aureus MW2
aaaguugcacucgguucauaa

SEQ ID NO: 3998755 - RNA, 14 nt, Staphylococcus aureus subsp. aureus MW2
aaaguuuauacuua

SEQ ID NO: 3998756 - RNA, 11 nt, Staphylococcus aureus subsp. aureus MW2
aaaguuucucc

SEQ ID NO: 3998757 - RNA, 11 nt, Staphylococcus aureus subsp. aureus MW2
aaaguuuucau

SEQ ID NO: 3998758 - RNA, 20 nt, Staphylococcus aureus subsp. aureus MW2
aaaguuuucauuuaacaugu

SEQ ID NO: 3998759 - RNA, 13 nt, Staphylococcus aureus subsp. aureus MW2
aaauaaaaaauaa

SEQ ID NO: 3998760 - RNA, 13 nt, Staphylococcus aureus subsp. aureus MW2
aaauaaaaaaugc

SEQ ID NO: 3998761 - RNA, 13 nt, Staphylococcus aureus subsp. aureus MW2
aaauaaaaauaca

SEQ ID NO: 3998762 - RNA, 14 nt, Staphylococcus aureus subsp. aureus MW2
aaauaaaaauauau

SEQ ID NO: 3998763 - RNA, 19 nt, Staphylococcus aureus subsp. aureus MW2
aaauaaaacgcuucauaua

SEQ ID NO: 3998764 - RNA, 12 nt, Staphylococcus aureus subsp. aureus MW2
aaauaaaaugcu

SEQ ID NO: 3998765 - RNA, 22 nt, Staphylococcus aureus subsp. aureus MW2
aaauaaaauuuuuuucauaauu

SEQ ID NO: 3998766 - RNA, 15 nt, Staphylococcus aureus subsp. aureus MW2
aaauaaacauaaaaa

SEQ ID NO: 3998767 - RNA, 12 nt, Staphylococcus aureus subsp. aureus MW2
aaauaaacauau

SEQ ID NO: 3998768 - RNA, 13 nt, Staphylococcus aureus subsp. aureus MW2
aaauaaacauauc

SEQ ID NO: 3998769 - RNA, 19 nt, Staphylococcus aureus subsp. aureus MW2
aaauaaacauaucaucaua

SEQ ID NO: 3998770 - RNA, 16 nt, Staphylococcus aureus subsp. aureus MW2
aaauaaauacaauaga

SEQ ID NO: 3998771 - RNA, 13 nt, Staphylococcus aureus subsp. aureus MW2
aaauaaauuuuga

SEQ ID NO: 3998772 - RNA, 19 nt, Staphylococcus aureus subsp. aureus MW2
aaauaaauuuugagaaaau

SEQ ID NO: 3998773 - RNA, 17 nt, Staphylococcus aureus subsp. aureus MW2
aaauaacgauaccuuua

SEQ ID NO: 3998774 - RNA, 19 nt, Staphylococcus aureus subsp. aureus MW2
aaauaacguuaauauaauu

SEQ ID NO: 3998775 - RNA, 21 nt, Staphylococcus aureus subsp. aureus MW2
aaauaacguuaauauaauuaa

SEQ ID NO: 3998776 - RNA, 21 nt, Staphylococcus aureus subsp. aureus MW2
aaauaacuagauguucacauu

SEQ ID NO: 3998777 - RNA, 20 nt, Staphylococcus aureus subsp. aureus MW2
aaauaacuucguuuuaauaa

SEQ ID NO: 3998778 - RNA, 18 nt, Staphylococcus aureus subsp. aureus MW2
aaauaagcaaucauaaua

SEQ ID NO: 3998779 - RNA, 14 nt, Staphylococcus aureus subsp. aureus MW2
aaauaauauaaaaa

SEQ ID NO: 3998780 - RNA, 16 nt, Staphylococcus aureus subsp. aureus MW2
aaauaauauaaaacga

SEQ ID NO: 3998781 - RNA, 11 nt, Staphylococcus aureus subsp. aureus MW2
aaauaaugaau

SEQ ID NO: 3998782 - RNA, 18 nt, Staphylococcus aureus subsp. aureus MW2
aaauaaugauacuaauaa

SEQ ID NO: 3998783 - RNA, 23 nt, Staphylococcus aureus subsp. aureus MW2
aaauaaugauauauuacaucauu

SEQ ID NO: 3998784 - RNA, 18 nt, Staphylococcus aureus subsp. aureus MW2
aaauaaugcuuauuaaaa

SEQ ID NO: 3998785 - RNA, 20 nt, Staphylococcus aureus subsp. aureus MW2
aaauaaugcuuauuaaaauu

SEQ ID NO: 3998786 - RNA, 15 nt, Staphylococcus aureus subsp. aureus MW2
aaauaauuaaacuuu

SEQ ID NO: 3998787 - RNA, 16 nt, Staphylococcus aureus subsp. aureus MW2
aaauaauuaaacuuua

SEQ ID NO: 3998788 - RNA, 13 nt, Staphylococcus aureus subsp. aureus MW2
aaauaauuaugaa

SEQ ID NO: 3998789 - RNA, 13 nt, Staphylococcus aureus subsp. aureus MW2
aaauaauuuaaag

SEQ ID NO: 3998790 - RNA, 22 nt, Staphylococcus aureus subsp. aureus MW2
aaauaauuuaaaggcauaauaa

SEQ ID NO: 3998791 - RNA, 13 nt, Staphylococcus aureus subsp. aureus MW2
aaauaauuuaaau

SEQ ID NO: 3998792 - RNA, 19 nt, Staphylococcus aureus subsp. aureus MW2
aaauaauuuaaauuaaaau

SEQ ID NO: 3998793 - RNA, 21 nt, Staphylococcus aureus subsp. aureus MW2
aaauaauuuaaauuaaaauaa

SEQ ID NO: 3998794 - RNA, 22 nt, Staphylococcus aureus subsp. aureus MW2
aaauaauuuaaauuaaaauaau

SEQ ID NO: 3998795 - RNA, 16 nt, Staphylococcus aureus subsp. aureus MW2
aaauauuacuaacaac

SEQ ID NO: 3998796 - RNA, 19 nt, Staphylococcus aureus subsp. aureus MW2
aaauauuauaaaaagauau

SEQ ID NO: 3998797 - RNA, 15 nt, Staphylococcus aureus subsp. aureus MW2
aaauauuauuaaauc

SEQ ID NO: 3998798 - RNA, 18 nt, Staphylococcus aureus subsp. aureus MW2
aaauauuauuaaaucaaa

SEQ ID NO: 3998799 - RNA, 11 nt, Staphylococcus aureus subsp. aureus MW2
aaauauuauuu

SEQ ID NO: 3998800 - RNA, 12 nt, Staphylococcus aureus subsp. aureus MW2
aaauauuccuua

SEQ ID NO: 3998801 - RNA, 12 nt, Staphylococcus aureus subsp. aureus MW2
aaauauucuuau

SEQ ID NO: 3998802 - RNA, 19 nt, Staphylococcus aureus subsp. aureus MW2
aaauauugaagaugcuuua

SEQ ID NO: 3998803 - RNA, 17 nt, Staphylococcus aureus subsp. aureus MW2
aaauauugauauaaaaa

SEQ ID NO: 3998804 - RNA, 17 nt, Staphylococcus aureus subsp. aureus MW2
aaauauuguaaucacua

SEQ ID NO: 3998805 - RNA, 13 nt, Staphylococcus aureus subsp. aureus MW2
aaauauuuaaccu

SEQ ID NO: 3998806 - RNA, 17 nt, Staphylococcus aureus subsp. aureus MW2
aaauauuuaaccuuuaa

SEQ ID NO: 3998807 - RNA, 21 nt, Staphylococcus aureus subsp. aureus MW2
aaauauuuacauugccacuuu

SEQ ID NO: 3998808 - RNA, 22 nt, Staphylococcus aureus subsp. aureus MW2
aaauauuucuaaaccauuuuca

SEQ ID NO: 3998809 - RNA, 15 nt, Staphylococcus aureus subsp. aureus MW2
aaauauuuuuuaaaa

SEQ ID NO: 3998810 - RNA, 18 nt, Staphylococcus aureus subsp. aureus MW2
aaauauuuuuuaaaauga

SEQ ID NO: 3998811 - RNA, 14 nt, Staphylococcus aureus subsp. aureus MW2
aaauauuuuuucug

SEQ ID NO: 3998812 - RNA, 17 nt, Staphylococcus aureus subsp. aureus MW2
aaaucaaaauaaugcaa

SEQ ID NO: 3998813 - RNA, 17 nt, Staphylococcus aureus subsp. aureus MW2
aaaucaaauacaucaau

SEQ ID NO: 3998814 - RNA, 20 nt, Staphylococcus aureus subsp. aureus MW2
aaaucaaaugguacaguuaa

SEQ ID NO: 3998815 - RNA, 20 nt, Staphylococcus aureus subsp. aureus MW2
aaaucaacuuuaaucaaaaa

SEQ ID NO: 3998816 - RNA, 15 nt, Staphylococcus aureus subsp. aureus MW2
aaaucaacuuuucua

SEQ ID NO: 3998817 - RNA, 22 nt, Staphylococcus aureus subsp. aureus MW2
aaaucaagacucccuuuuuaaa

SEQ ID NO: 3998818 - RNA, 23 nt, Staphylococcus aureus subsp. aureus MW2
aaaucaagacucccuuuuuaaaa

SEQ ID NO: 3998819 - RNA, 14 nt, Staphylococcus aureus subsp. aureus MW2
aaaucaaguguugu

SEQ ID NO: 3998820 - RNA, 15 nt, Staphylococcus aureus subsp. aureus MW2
aaaucaauccaucaa

SEQ ID NO: 3998821 - RNA, 16 nt, Staphylococcus aureus subsp. aureus MW2
aaaucaauccaucaau

SEQ ID NO: 3998822 - RNA, 13 nt, Staphylococcus aureus subsp. aureus MW2
aaaucaauguacu

SEQ ID NO: 3998823 - RNA, 14 nt, Staphylococcus aureus subsp. aureus MW2
aaaucaauugaaaa

SEQ ID NO: 3998824 - RNA, 20 nt, Staphylococcus aureus subsp. aureus MW2
aaaucacauaugauaauuaa

SEQ ID NO: 3998825 - RNA, 17 nt, Staphylococcus aureus subsp. aureus MW2
aaaucaccuuuuuuaac

SEQ ID NO: 3998826 - RNA, 18 nt, Staphylococcus aureus subsp. aureus MW2
aaaucaccuuuuuuaacu

SEQ ID NO: 3998827 - RNA, 20 nt, Staphylococcus aureus subsp. aureus MW2
aaaucaccuuuuuuaacuuu

SEQ ID NO: 3998828 - RNA, 23 nt, Staphylococcus aureus subsp. aureus MW2
aaaucacgauuuucaaguaauga

SEQ ID NO: 3998829 - RNA, 14 nt, Staphylococcus aureus subsp. aureus MW2
aaaucacgccauaa

SEQ ID NO: 3998830 - RNA, 17 nt, Staphylococcus aureus subsp. aureus MW2
aaaucagcuuuuuuaca

SEQ ID NO: 3998831 - RNA, 15 nt, Staphylococcus aureus subsp. aureus MW2
aaaucaguaauauca

SEQ ID NO: 3998832 - RNA, 19 nt, Staphylococcus aureus subsp. aureus MW2
aaaucaguuaggaugaaaa

SEQ ID NO: 3998833 - RNA, 13 nt, Staphylococcus aureus subsp. aureus MW2
aaaucauaaauaa

SEQ ID NO: 3998834 - RNA, 21 nt, Staphylococcus aureus subsp. aureus MW2
aaaucauacgagaaauuagaa

SEQ ID NO: 3998835 - RNA, 23 nt, Staphylococcus aureus subsp. aureus MW2
aaaucauagucgguuauuacaaa

SEQ ID NO: 3998836 - RNA, 11 nt, Staphylococcus aureus subsp. aureus MW2
aaaucaucuua

SEQ ID NO: 3998837 - RNA, 22 nt, Staphylococcus aureus subsp. aureus MW2
aaaucaucuuaacaauuuuaau

SEQ ID NO: 3998838 - RNA, 17 nt, Staphylococcus aureus subsp. aureus MW2
aaaucaugaaauuaaaa

SEQ ID NO: 3998839 - RNA, 20 nt, Staphylococcus aureus subsp. aureus MW2
aaaucaugacauaaaacuua

SEQ ID NO: 3998840 - RNA, 15 nt, Staphylococcus aureus subsp. aureus MW2
aaaucauuaauaauu

SEQ ID NO: 3998841 - RNA, 18 nt, Staphylococcus aureus subsp. aureus MW2
aaaucauuaguuguauca

SEQ ID NO: 3998842 - RNA, 14 nt, Staphylococcus aureus subsp. aureus MW2
aaaucauucuuuau

SEQ ID NO: 3998843 - RNA, 19 nt, Staphylococcus aureus subsp. aureus MW2
aaaucauucuuuauagaaa

SEQ ID NO: 3998844 - RNA, 11 nt, Staphylococcus aureus subsp. aureus MW2
aaaucauugcg

SEQ ID NO: 3998845 - RNA, 16 nt, Staphylococcus aureus subsp. aureus MW2
aaauccaaaaucuuua

SEQ ID NO: 3998846 - RNA, 13 nt, Staphylococcus aureus subsp. aureus MW2
aaauccaaugaug

SEQ ID NO: 3998847 - RNA, 15 nt, Staphylococcus aureus subsp. aureus MW2
aaauccaaugaugaa

SEQ ID NO: 3998848 - RNA, 15 nt, Staphylococcus aureus subsp. aureus MW2
aaauccacacauuaa

SEQ ID NO: 3998849 - RNA, 21 nt, Staphylococcus aureus subsp. aureus MW2
aaauccgcuuuauuuuaucau

SEQ ID NO: 3998850 - RNA, 24 nt, Staphylococcus aureus subsp. aureus MW2
aaauccuuaaauggagauucucgg

SEQ ID NO: 3998851 - RNA, 14 nt, Staphylococcus aureus subsp. aureus MW2
aaaucgauuaagaa

SEQ ID NO: 3998852 - RNA, 16 nt, Staphylococcus aureus subsp. aureus MW2
aaaucgccuuguuuau

SEQ ID NO: 3998853 - RNA, 16 nt, Staphylococcus aureus subsp. aureus MW2
aaaucggauuaacauu

SEQ ID NO: 3998854 - RNA, 18 nt, Staphylococcus aureus subsp. aureus MW2
aaaucgugcuguuaucau

SEQ ID NO: 3998855 - RNA, 15 nt, Staphylococcus aureus subsp. aureus MW2
aaaucguuaaggaaa

SEQ ID NO: 3998856 - RNA, 19 nt, Staphylococcus aureus subsp. aureus MW2
aaaucguuaaggaaagcuu

SEQ ID NO: 3998857 - RNA, 13 nt, Staphylococcus aureus subsp. aureus MW2
aaaucguuucaua

SEQ ID NO: 3998858 - RNA, 23 nt, Staphylococcus aureus subsp. aureus MW2
aaaucuaauccugguauaaugga

SEQ ID NO: 3998859 - RNA, 16 nt, Staphylococcus aureus subsp. aureus MW2
aaaucuaauuauucau

SEQ ID NO: 3998860 - RNA, 15 nt, Staphylococcus aureus subsp. aureus MW2
aaaucuacaauauua

SEQ ID NO: 3998861 - RNA, 22 nt, Staphylococcus aureus subsp. aureus MW2
aaaucuacaauauuaaaauuaa

SEQ ID NO: 3998862 - RNA, 17 nt, Staphylococcus aureus subsp. aureus MW2
aaaucuacauaugaaaa

SEQ ID NO: 3998863 - RNA, 12 nt, Staphylococcus aureus subsp. aureus MW2
aaaucuauaaau

SEQ ID NO: 3998864 - RNA, 17 nt, Staphylococcus aureus subsp. aureus MW2
aaaucuauacuuuaucu

SEQ ID NO: 3998865 - RNA, 23 nt, Staphylococcus aureus subsp. aureus MW2
aaaucuauauaacgcuuuaaauc

SEQ ID NO: 3998866 - RNA, 16 nt, Staphylococcus aureus subsp. aureus MW2
aaaucucauaauaauu

SEQ ID NO: 3998867 - RNA, 22 nt, Staphylococcus aureus subsp. aureus MW2
aaaucucauaauaauucaguaa

SEQ ID NO: 3998868 - RNA, 23 nt, Staphylococcus aureus subsp. aureus MW2
aaaucuggcacuuaagcuuuaau

SEQ ID NO: 3998869 - RNA, 15 nt, Staphylococcus aureus subsp. aureus MW2
aaaucuguuuaaauu

SEQ ID NO: 3998870 - RNA, 23 nt, Staphylococcus aureus subsp. aureus MW2
aaaucuguuuaaauuuaaaagaa

SEQ ID NO: 3998871 - RNA, 17 nt, Staphylococcus aureus subsp. aureus MW2
aaaucuucaagugccau

SEQ ID NO: 3998872 - RNA, 21 nt, Staphylococcus aureus subsp. aureus MW2
aaaucuuguuggauuuuaaca

SEQ ID NO: 3998873 - RNA, 22 nt, Staphylococcus aureus subsp. aureus MW2
aaaucuuguuggauuuuaacaa

SEQ ID NO: 3998874 - RNA, 23 nt, Staphylococcus aureus subsp. aureus MW2
aaaucuuguuggauuuuaacaag

SEQ ID NO: 3998875 - RNA, 13 nt, Staphylococcus aureus subsp. aureus MW2
aaaucuuuaaaug

SEQ ID NO: 3998876 - RNA, 19 nt, Staphylococcus aureus subsp. aureus MW2
aaaucuuuaacauuugucc

SEQ ID NO: 3998877 - RNA, 16 nt, Staphylococcus aureus subsp. aureus MW2
aaaucuuuacuuguaa

SEQ ID NO: 3998878 - RNA, 23 nt, Staphylococcus aureus subsp. aureus MW2
aaaucuuuacuuguaauuaauac

SEQ ID NO: 3998879 - RNA, 19 nt, Staphylococcus aureus subsp. aureus MW2
aaaucuuugauuaugaacu

SEQ ID NO: 3998880 - RNA, 15 nt, Staphylococcus aureus subsp. aureus MW2
aaaucuuuuacuaaa

SEQ ID NO: 3998881 - RNA, 21 nt, Staphylococcus aureus subsp. aureus MW2
aaaucuuuuacuaaaugaauu

SEQ ID NO: 3998882 - RNA, 22 nt, Staphylococcus aureus subsp. aureus MW2
aaaucuuuuagcuuuuguaaag

SEQ ID NO: 3998883 - RNA, 12 nt, Staphylococcus aureus subsp. aureus MW2
aaauuaaugaac

SEQ ID NO: 3998884 - RNA, 22 nt, Staphylococcus aureus subsp. aureus MW2
aaauuaauguagguuauuauaa

SEQ ID NO: 3998885 - RNA, 24 nt, Staphylococcus aureus subsp. aureus MW2
aaauuaauguagguuauuauaaaa

SEQ ID NO: 3998886 - RNA, 15 nt, Staphylococcus aureus subsp. aureus MW2
aaauuaauguuuuca

SEQ ID NO: 3998887 - RNA, 17 nt, Staphylococcus aureus subsp. aureus MW2
aaauuacaaauuaucua

SEQ ID NO: 3998888 - RNA, 12 nt, Staphylococcus aureus subsp. aureus MW2
aaauuacaauua

SEQ ID NO: 3998889 - RNA, 16 nt, Staphylococcus aureus subsp. aureus MW2
aaauuacacccuuuaa

SEQ ID NO: 3998890 - RNA, 19 nt, Staphylococcus aureus subsp. aureus MW2
aaauuacacccuuuaaauu

SEQ ID NO: 3998891 - RNA, 21 nt, Staphylococcus aureus subsp. aureus MW2
aaauuacgcaaagaaaaacau

SEQ ID NO: 3998892 - RNA, 13 nt, Staphylococcus aureus subsp. aureus MW2
aaauuacuugaau

SEQ ID NO: 3998893 - RNA, 22 nt, Staphylococcus aureus subsp. aureus MW2
aaauuacuugaauauuauucau

SEQ ID NO: 3998894 - RNA, 15 nt, Staphylococcus aureus subsp. aureus MW2
aaauuagauaaaaca

SEQ ID NO: 3998895 - RNA, 22 nt, Staphylococcus aureus subsp. aureus MW2
aaauuagauaaaacaaaaccaa

SEQ ID NO: 3998896 - RNA, 14 nt, Staphylococcus aureus subsp. aureus MW2
aaauuagaugaaau

SEQ ID NO: 3998897 - RNA, 20 nt, Staphylococcus aureus subsp. aureus MW2
aaauuagauuuuaugcuuua

SEQ ID NO: 3998898 - RNA, 22 nt, Staphylococcus aureus subsp. aureus MW2
aaauuagcaagugaguaacauu

SEQ ID NO: 3998899 - RNA, 16 nt, Staphylococcus aureus subsp. aureus MW2
aaauuagccauuucaa

SEQ ID NO: 3998900 - RNA, 18 nt, Staphylococcus aureus subsp. aureus MW2
aaauuaggcauucaucua

SEQ ID NO: 3998901 - RNA, 22 nt, Staphylococcus aureus subsp. aureus MW2
aaauuagggguggaaauaugaa

SEQ ID NO: 3998902 - RNA, 15 nt, Staphylococcus aureus subsp. aureus MW2
aaauuagucauccaa

SEQ ID NO: 3998903 - RNA, 23 nt, Staphylococcus aureus subsp. aureus MW2
aaauuagugguuagcuauauuuu

SEQ ID NO: 3998904 - RNA, 14 nt, Staphylococcus aureus subsp. aureus MW2
aaauuaguuauacu

SEQ ID NO: 3998905 - RNA, 13 nt, Staphylococcus aureus subsp. aureus MW2
aaauuauaauugu

SEQ ID NO: 3998906 - RNA, 12 nt, Staphylococcus aureus subsp. aureus MW2
aaauuauauaaa

SEQ ID NO: 3998907 - RNA, 14 nt, Staphylococcus aureus subsp. aureus MW2
aaauuaucagaauc

SEQ ID NO: 3998908 - RNA, 13 nt, Staphylococcus aureus subsp. aureus MW2
aaauuaugauuau

SEQ ID NO: 3998909 - RNA, 20 nt, Staphylococcus aureus subsp. aureus MW2
aaauuaugcuugcuuaguau

SEQ ID NO: 3998910 - RNA, 16 nt, Staphylococcus aureus subsp. aureus MW2
aaauuauguaaaaaau

SEQ ID NO: 3998911 - RNA, 17 nt, Staphylococcus aureus subsp. aureus MW2
aaauuauuauuuaaauu

SEQ ID NO: 3998912 - RNA, 19 nt, Staphylococcus aureus subsp. aureus MW2
aaauuauugacauugcaaa

SEQ ID NO: 3998913 - RNA, 13 nt, Staphylococcus aureus subsp. aureus MW2
aaauuauuuuuga

SEQ ID NO: 3998914 - RNA, 15 nt, Staphylococcus aureus subsp. aureus MW2
aaauucaaauuauaa

SEQ ID NO: 3998915 - RNA, 16 nt, Staphylococcus aureus subsp. aureus MW2
aaauucaacgucauca

SEQ ID NO: 3998916 - RNA, 13 nt, Staphylococcus aureus subsp. aureus MW2
aaauucauuugua

SEQ ID NO: 3998917 - RNA, 17 nt, Staphylococcus aureus subsp. aureus MW2
aaauucgaacuaucaau

SEQ ID NO: 3998918 - RNA, 16 nt, Staphylococcus aureus subsp. aureus MW2
aaauucuacaaacaau

SEQ ID NO: 3998919 - RNA, 18 nt, Staphylococcus aureus subsp. aureus MW2
aaauucuacaaacaaugc

SEQ ID NO: 3998920 - RNA, 22 nt, Staphylococcus aureus subsp. aureus MW2
aaauucuacagacaaugcaagu

SEQ ID NO: 3998921 - RNA, 17 nt, Staphylococcus aureus subsp. aureus MW2
aaauucuauaaccuuaa

SEQ ID NO: 3998922 - RNA, 16 nt, Staphylococcus aureus subsp. aureus MW2
aaauucuaugagaaua

SEQ ID NO: 3998923 - RNA, 13 nt, Staphylococcus aureus subsp. aureus MW2
aaauucucuaauu

SEQ ID NO: 3998924 - RNA, 17 nt, Staphylococcus aureus subsp. aureus MW2
aaauucucuguguuggg

SEQ ID NO: 3998925 - RNA, 12 nt, Staphylococcus aureus subsp. aureus MW2
aaauucuuauaa

SEQ ID NO: 3998926 - RNA, 18 nt, Staphylococcus aureus subsp. aureus MW2
aaauucuuauaaaauaaa

SEQ ID NO: 3998927 - RNA, 18 nt, Staphylococcus aureus subsp. aureus MW2
aaauucuuuucaagaaau

SEQ ID NO: 3998928 - RNA, 11 nt, Staphylococcus aureus subsp. aureus MW2
aaauucuuuuu

SEQ ID NO: 3998929 - RNA, 16 nt, Staphylococcus aureus subsp. aureus MW2
aaauugaaauguuuau

SEQ ID NO: 3998930 - RNA, 22 nt, Staphylococcus aureus subsp. aureus MW2
aaauugaaauguuuaucaauuc

SEQ ID NO: 3998931 - RNA, 14 nt, Staphylococcus aureus subsp. aureus MW2
aaauugaaauuauc

SEQ ID NO: 3998932 - RNA, 15 nt, Staphylococcus aureus subsp. aureus MW2
aaauugaaauuaucc

SEQ ID NO: 3998933 - RNA, 15 nt, Staphylococcus aureus subsp. aureus MW2
aaauugaauuaugau

SEQ ID NO: 3998934 - RNA, 15 nt, Staphylococcus aureus subsp. aureus MW2
aaauugacgcauuaa

SEQ ID NO: 3998935 - RNA, 17 nt, Staphylococcus aureus subsp. aureus MW2
aaauugauauugcaaaa

SEQ ID NO: 3998936 - RNA, 21 nt, Staphylococcus aureus subsp. aureus MW2
aaauugauauugcaaaacuug

SEQ ID NO: 3998937 - RNA, 12 nt, Staphylococcus aureus subsp. aureus MW2
aaauugauuaaa

SEQ ID NO: 3998938 - RNA, 17 nt, Staphylococcus aureus subsp. aureus MW2
aaauugccuuucauuuu

SEQ ID NO: 3998939 - RNA, 19 nt, Staphylococcus aureus subsp. aureus MW2
aaauugcguuguuucauua

SEQ ID NO: 3998940 - RNA, 19 nt, Staphylococcus aureus subsp. aureus MW2
aaauugcuaaaaaaauuaa

SEQ ID NO: 3998941 - RNA, 21 nt, Staphylococcus aureus subsp. aureus MW2
aaauugcucauugugcuugau

SEQ ID NO: 3998942 - RNA, 17 nt, Staphylococcus aureus subsp. aureus MW2
aaauugcuugaaauuau

SEQ ID NO: 3998943 - RNA, 20 nt, Staphylococcus aureus subsp. aureus MW2
aaauuggacuuauggguuca

SEQ ID NO: 3998944 - RNA, 19 nt, Staphylococcus aureus subsp. aureus MW2
aaauuggauaauuucuucu

SEQ ID NO: 3998945 - RNA, 15 nt, Staphylococcus aureus subsp. aureus MW2
aaauugguuuggaua

SEQ ID NO: 3998946 - RNA, 23 nt, Staphylococcus aureus subsp. aureus MW2
aaauugguuuggauaaaaugaua

SEQ ID NO: 3998947 - RNA, 12 nt, Staphylococcus aureus subsp. aureus MW2
aaauuguaaaac

SEQ ID NO: 3998948 - RNA, 13 nt, Staphylococcus aureus subsp. aureus MW2
aaauuguauagaa

SEQ ID NO: 3998949 - RNA, 14 nt, Staphylococcus aureus subsp. aureus MW2
aaauuguauagaau

SEQ ID NO: 3998950 - RNA, 18 nt, Staphylococcus aureus subsp. aureus MW2
aaauugucuuuucauuuu

SEQ ID NO: 3998951 - RNA, 21 nt, Staphylococcus aureus subsp. aureus MW2
aaauugucuuuucauuuuuua

SEQ ID NO: 3998952 - RNA, 17 nt, Staphylococcus aureus subsp. aureus MW2
aaauugugcuuuuucau

SEQ ID NO: 3998953 - RNA, 16 nt, Staphylococcus aureus subsp. aureus MW2
aaauuguguugaauca

SEQ ID NO: 3998954 - RNA, 14 nt, Staphylococcus aureus subsp. aureus MW2
aaauuguguuucuu

SEQ ID NO: 3998955 - RNA, 18 nt, Staphylococcus aureus subsp. aureus MW2
aaauuguguuucuuuuau

SEQ ID NO: 3998956 - RNA, 19 nt, Staphylococcus aureus subsp. aureus MW2
aaauuguguuucuuuuauu

SEQ ID NO: 3998957 - RNA, 17 nt, Staphylococcus aureus subsp. aureus MW2
aaauuguucuaauacac

SEQ ID NO: 3998958 - RNA, 20 nt, Staphylococcus aureus subsp. aureus MW2
aaauuguuuacuauacuuug

SEQ ID NO: 3998959 - RNA, 16 nt, Staphylococcus aureus subsp. aureus MW2
aaauuuaaaacaauga

SEQ ID NO: 3998960 - RNA, 11 nt, Staphylococcus aureus subsp. aureus MW2
aaauuuaaaua

SEQ ID NO: 3998961 - RNA, 16 nt, Staphylococcus aureus subsp. aureus MW2
aaauuuaaauauugaa

SEQ ID NO: 3998962 - RNA, 14 nt, Staphylococcus aureus subsp. aureus MW2
aaauuuaacuauga

SEQ ID NO: 3998963 - RNA, 20 nt, Staphylococcus aureus subsp. aureus MW2
aaauuuaacucaacuuaaau

SEQ ID NO: 3998964 - RNA, 17 nt, Staphylococcus aureus subsp. aureus MW2
aaauuuaagaaugcgaa

SEQ ID NO: 3998965 - RNA, 15 nt, Staphylococcus aureus subsp. aureus MW2
aaauuuaauauuguu

SEQ ID NO: 3998966 - RNA, 13 nt, Staphylococcus aureus subsp. aureus MW2
aaauuuacaaaaa

SEQ ID NO: 3998967 - RNA, 15 nt, Staphylococcus aureus subsp. aureus MW2
aaauuuacaaaaacu

SEQ ID NO: 3998968 - RNA, 21 nt, Staphylococcus aureus subsp. aureus MW2
aaauuuagguggagauuuaac

SEQ ID NO: 3998969 - RNA, 16 nt, Staphylococcus aureus subsp. aureus MW2
aaauuuaguaucucau

SEQ ID NO: 3998970 - RNA, 16 nt, Staphylococcus aureus subsp. aureus MW2
aaauuuauaauuugua

SEQ ID NO: 3998971 - RNA, 19 nt, Staphylococcus aureus subsp. aureus MW2
aaauuuauaauuuguauaa

SEQ ID NO: 3998972 - RNA, 12 nt, Staphylococcus aureus subsp. aureus MW2
aacacagagaaa

SEQ ID NO: 3998973 - RNA, 12 nt, Staphylococcus aureus subsp. aureus MW2
aacacagagaau

SEQ ID NO: 3998974 - RNA, 19 nt, Staphylococcus aureus subsp. aureus MW2
aacacaguacaaauaacaa

SEQ ID NO: 3998975 - RNA, 23 nt, Staphylococcus aureus subsp. aureus MW2
aacacauauuccgagaauuauua

SEQ ID NO: 3998976 - RNA, 21 nt, Staphylococcus aureus subsp. aureus MW2
aacacaucuauguggcuacuu

SEQ ID NO: 3998977 - RNA, 18 nt, Staphylococcus aureus subsp. aureus MW2
aacacauguauucaacug

SEQ ID NO: 3998978 - RNA, 18 nt, Staphylococcus aureus subsp. aureus MW2
aacacauucuuauuugaa

SEQ ID NO: 3998979 - RNA, 21 nt, Staphylococcus aureus subsp. aureus MW2
aacaccacacagcauuuucaa

SEQ ID NO: 3998980 - RNA, 22 nt, Staphylococcus aureus subsp. aureus MW2
aacaccagauaucauaauauug

SEQ ID NO: 3998981 - RNA, 13 nt, Staphylococcus aureus subsp. aureus MW2
aacacccaauaau

SEQ ID NO: 3998982 - RNA, 22 nt, Staphylococcus aureus subsp. aureus MW2
aacaccgcaaugccacaucaua

SEQ ID NO: 3998983 - RNA, 16 nt, Staphylococcus aureus subsp. aureus MW2
aacaccuaauauuuua

SEQ ID NO: 3998984 - RNA, 21 nt, Staphylococcus aureus subsp. aureus MW2
aacaccuucguuuaaauucau

SEQ ID NO: 3998985 - RNA, 21 nt, Staphylococcus aureus subsp. aureus MW2
aacaccuuucgcgacuucauu

SEQ ID NO: 3998986 - RNA, 14 nt, Staphylococcus aureus subsp. aureus MW2
aacacgaacugcau

SEQ ID NO: 3998987 - RNA, 21 nt, Staphylococcus aureus subsp. aureus MW2
aacacuagguacauaaauacc

SEQ ID NO: 3998988 - RNA, 22 nt, Staphylococcus aureus subsp. aureus MW2
aacacuagguacauaaauaccu

SEQ ID NO: 3998989 - RNA, 21 nt, Staphylococcus aureus subsp. aureus MW2
aacacucaaaauguuuaacaa

SEQ ID NO: 3998990 - RNA, 22 nt, Staphylococcus aureus subsp. aureus MW2
aacacucaaaauguuuaacaau

SEQ ID NO: 3998991 - RNA, 16 nt, Staphylococcus aureus subsp. aureus MW2
aacacucggaaacaug

SEQ ID NO: 3998992 - RNA, 19 nt, Staphylococcus aureus subsp. aureus MW2
aacacuggcguuaaagcuu

SEQ ID NO: 3998993 - RNA, 17 nt, Staphylococcus aureus subsp. aureus MW2
aacacuucguauugaau

SEQ ID NO: 3998994 - RNA, 23 nt, Staphylococcus aureus subsp. aureus MW2
aacagaauuauuugauuauguaa

SEQ ID NO: 3998995 - RNA, 22 nt, Staphylococcus aureus subsp. aureus MW2
aacagacuuuguuaaaaaauua

SEQ ID NO: 3998996 - RNA, 14 nt, Staphylococcus aureus subsp. aureus MW2
aacagaguugucau

SEQ ID NO: 3998997 - RNA, 17 nt, Staphylococcus aureus subsp. aureus MW2
aacagauacuucaguac

SEQ ID NO: 3998998 - RNA, 18 nt, Staphylococcus aureus subsp. aureus MW2
aacagcaguaagauauuu

SEQ ID NO: 3998999 - RNA, 13 nt, Staphylococcus aureus subsp. aureus MW2
aacagcauaaaua

SEQ ID NO: 3999000 - RNA, 15 nt, Staphylococcus aureus subsp. aureus MW2
aacagcgcaucauaa

SEQ ID NO: 3999001 - RNA, 18 nt, Staphylococcus aureus subsp. aureus MW2
aacagcgugaauauaagu

SEQ ID NO: 3999002 - RNA, 13 nt, Staphylococcus aureus subsp. aureus MW2
aacagcuacaaau

SEQ ID NO: 3999003 - RNA, 15 nt, Staphylococcus aureus subsp. aureus MW2
aacagcuacaaauaa

SEQ ID NO: 3999004 - RNA, 18 nt, Staphylococcus aureus subsp. aureus MW2
aacagcugcuucucuuug

SEQ ID NO: 3999005 - RNA, 15 nt, Staphylococcus aureus subsp. aureus MW2
aacagcuuuuucuac

SEQ ID NO: 3999006 - RNA, 20 nt, Staphylococcus aureus subsp. aureus MW2
aacagggaacccaggugcau

SEQ ID NO: 3999007 - RNA, 14 nt, Staphylococcus aureus subsp. aureus MW2
aacaguaauuuuua

SEQ ID NO: 3999008 - RNA, 16 nt, Staphylococcus aureus subsp. aureus MW2
aacaguaauuuuuaaa

SEQ ID NO: 3999009 - RNA, 16 nt, Staphylococcus aureus subsp. aureus MW2
aacaguauuaauuaca

SEQ ID NO: 3999010 - RNA, 19 nt, Staphylococcus aureus subsp. aureus MW2
aacagucuuuggauaugcg

SEQ ID NO: 3999011 - RNA, 12 nt, Staphylococcus aureus subsp. aureus MW2
aacaguuuuaaa

SEQ ID NO: 3999012 - RNA, 13 nt, Staphylococcus aureus subsp. aureus MW2
aacaguuuuaaag

SEQ ID NO: 3999013 - RNA, 14 nt, Staphylococcus aureus subsp. aureus MW2
aacauaaagaauuu

SEQ ID NO: 3999014 - RNA, 22 nt, Staphylococcus aureus subsp. aureus MW2
aacauaacaaagucgaaggcua

SEQ ID NO: 3999015 - RNA, 24 nt, Staphylococcus aureus subsp. aureus MW2
aacauaacaugaccuaauauauua

SEQ ID NO: 3999016 - RNA, 16 nt, Staphylococcus aureus subsp. aureus MW2
aacauaaccuugcuuu

SEQ ID NO: 3999017 - RNA, 15 nt, Staphylococcus aureus subsp. aureus MW2
aacauaacucaaaua

SEQ ID NO: 3999018 - RNA, 20 nt, Staphylococcus aureus subsp. aureus MW2
aacauaauaauaauacaauu

SEQ ID NO: 3999019 - RNA, 14 nt, Staphylococcus aureus subsp. aureus MW2
aacauaaucauaau

SEQ ID NO: 3999020 - RNA, 17 nt, Staphylococcus aureus subsp. aureus MW2
aacauaaucauugugua

SEQ ID NO: 3999021 - RNA, 20 nt, Staphylococcus aureus subsp. aureus MW2
aacauaccuaauaacgcaua

SEQ ID NO: 3999022 - RNA, 18 nt, Staphylococcus aureus subsp. aureus MW2
aacauagacacuuaacuu

SEQ ID NO: 3999023 - RNA, 16 nt, Staphylococcus aureus subsp. aureus MW2
aacauagagaaauuug

SEQ ID NO: 3999024 - RNA, 17 nt, Staphylococcus aureus subsp. aureus MW2
aacauagcuuaauaauu

SEQ ID NO: 3999025 - RNA, 18 nt, Staphylococcus aureus subsp. aureus MW2
aacauagcuuaauaauua

SEQ ID NO: 3999026 - RNA, 19 nt, Staphylococcus aureus subsp. aureus MW2
aacauagucggcaugaugc

SEQ ID NO: 3999027 - RNA, 11 nt, Staphylococcus aureus subsp. aureus MW2
aacauaucauc

SEQ ID NO: 3999028 - RNA, 13 nt, Staphylococcus aureus subsp. aureus MW2
aacauaugcaagu

SEQ ID NO: 3999029 - RNA, 16 nt, Staphylococcus aureus subsp. aureus MW2
aacauauuauauauau

SEQ ID NO: 3999030 - RNA, 19 nt, Staphylococcus aureus subsp. aureus MW2
aacauauuauauauauucc

SEQ ID NO: 3999031 - RNA, 22 nt, Staphylococcus aureus subsp. aureus MW2
aacaucacagaaaauacauuuc

SEQ ID NO: 3999032 - RNA, 14 nt, Staphylococcus aureus subsp. aureus MW2
aacaucacuugcug

SEQ ID NO: 3999033 - RNA, 15 nt, Staphylococcus aureus subsp. aureus MW2
aacaucaucauguuu

SEQ ID NO: 3999034 - RNA, 18 nt, Staphylococcus aureus subsp. aureus MW2
aacaucaucauguuuauu

SEQ ID NO: 3999035 - RNA, 12 nt, Staphylococcus aureus subsp. aureus MW2
aacaucaucguc

SEQ ID NO: 3999036 - RNA, 13 nt, Staphylococcus aureus subsp. aureus MW2
aacaucaucuuua

SEQ ID NO: 3999037 - RNA, 22 nt, Staphylococcus aureus subsp. aureus MW2
aacaucaugucgaaucaaagua

SEQ ID NO: 3999038 - RNA, 20 nt, Staphylococcus aureus subsp. aureus MW2
aacaucauuaacuuucucaa

SEQ ID NO: 3999039 - RNA, 21 nt, Staphylococcus aureus subsp. aureus MW2
aacaucauuaacuuucucaaa

SEQ ID NO: 3999040 - RNA, 16 nt, Staphylococcus aureus subsp. aureus MW2
aacauccccaaaaaua

SEQ ID NO: 3999041 - RNA, 22 nt, Staphylococcus aureus subsp. aureus MW2
aacauccugcuuauuaauuguu

SEQ ID NO: 3999042 - RNA, 22 nt, Staphylococcus aureus subsp. aureus MW2
aacaucgaauuaaccccuucaa

SEQ ID NO: 3999043 - RNA, 20 nt, Staphylococcus aureus subsp. aureus MW2
aacaucgauuuaucauuauu

SEQ ID NO: 3999044 - RNA, 19 nt, Staphylococcus aureus subsp. aureus MW2
aacaucuaaauaguuuuuc

SEQ ID NO: 3999045 - RNA, 14 nt, Staphylococcus aureus subsp. aureus MW2
aacaucugaaaaaa

SEQ ID NO: 3999046 - RNA, 15 nt, Staphylococcus aureus subsp. aureus MW2
aacaucugaaaaaau

SEQ ID NO: 3999047 - RNA, 11 nt, Staphylococcus aureus subsp. aureus MW2
aacaucugaau

SEQ ID NO: 3999048 - RNA, 15 nt, Staphylococcus aureus subsp. aureus MW2
aacaucugaaucuga

SEQ ID NO: 3999049 - RNA, 22 nt, Staphylococcus aureus subsp. aureus MW2
aacaucuucauguaugaaguaa

SEQ ID NO: 3999050 - RNA, 17 nt, Staphylococcus aureus subsp. aureus MW2
aacaucuucuucaucau

SEQ ID NO: 3999051 - RNA, 20 nt, Staphylococcus aureus subsp. aureus MW2
aacaugaaugauauugauuu

SEQ ID NO: 3999052 - RNA, 19 nt, Staphylococcus aureus subsp. aureus MW2
aacaugauacugaaauuuc

SEQ ID NO: 3999053 - RNA, 21 nt, Staphylococcus aureus subsp. aureus MW2
aacaugauucaugauauguuc

SEQ ID NO: 3999054 - RNA, 20 nt, Staphylococcus aureus subsp. aureus MW2
aacaugcuuggacauauacu

SEQ ID NO: 3999055 - RNA, 21 nt, Staphylococcus aureus subsp. aureus MW2
aacaugggguuuuauuuuugg

SEQ ID NO: 3999056 - RNA, 23 nt, Staphylococcus aureus subsp. aureus MW2
aacaugguuuucuuuuuaucaug

SEQ ID NO: 3999057 - RNA, 13 nt, Staphylococcus aureus subsp. aureus MW2
aacauguacaauu

SEQ ID NO: 3999058 - RNA, 18 nt, Staphylococcus aureus subsp. aureus MW2
aacauguacaauuuuuaa

SEQ ID NO: 3999059 - RNA, 23 nt, Staphylococcus aureus subsp. aureus MW2
aacauguacaauuuuuaaaaacc

SEQ ID NO: 3999060 - RNA, 21 nt, Staphylococcus aureus subsp. aureus MW2
aacgaaucgccuacuauaaau

SEQ ID NO: 3999061 - RNA, 22 nt, Staphylococcus aureus subsp. aureus MW2
aacgaaucgccuacuauaaaua

SEQ ID NO: 3999062 - RNA, 23 nt, Staphylococcus aureus subsp. aureus MW2
aacgaaucuauaacgauagauuu

SEQ ID NO: 3999063 - RNA, 14 nt, Staphylococcus aureus subsp. aureus MW2
aacgagagagaaaa

SEQ ID NO: 3999064 - RNA, 13 nt, Staphylococcus aureus subsp. aureus MW2
aacgagauuacac

SEQ ID NO: 3999065 - RNA, 18 nt, Staphylococcus aureus subsp. aureus MW2
aacgagucauaaauauaa

SEQ ID NO: 3999066 - RNA, 13 nt, Staphylococcus aureus subsp. aureus MW2
aacgaguuuucag

SEQ ID NO: 3999067 - RNA, 14 nt, Staphylococcus aureus subsp. aureus MW2
aacgauaagaauua

SEQ ID NO: 3999068 - RNA, 18 nt, Staphylococcus aureus subsp. aureus MW2
aacgauaagaauuaacaa

SEQ ID NO: 3999069 - RNA, 18 nt, Staphylococcus aureus subsp. aureus MW2
aacgauaccaaauauauu

SEQ ID NO: 3999070 - RNA, 19 nt, Staphylococcus aureus subsp. aureus MW2
aacgauaguguacacgaau

SEQ ID NO: 3999071 - RNA, 13 nt, Staphylococcus aureus subsp. aureus MW2
aacgauauagacc

SEQ ID NO: 3999072 - RNA, 12 nt, Staphylococcus aureus subsp. aureus MW2
aacgauauugcu

SEQ ID NO: 3999073 - RNA, 16 nt, Staphylococcus aureus subsp. aureus MW2
aacgauuguugcaaug

SEQ ID NO: 3999074 - RNA, 13 nt, Staphylococcus aureus subsp. aureus MW2
aacgcaaauuaaa

SEQ ID NO: 3999075 - RNA, 18 nt, Staphylococcus aureus subsp. aureus MW2
aacgcaauuaaccuugau

SEQ ID NO: 3999076 - RNA, 16 nt, Staphylococcus aureus subsp. aureus MW2
aacgccucaacacuuu

SEQ ID NO: 3999077 - RNA, 16 nt, Staphylococcus aureus subsp. aureus MW2
aacgcuaauuuuacuc

SEQ ID NO: 3999078 - RNA, 22 nt, Staphylococcus aureus subsp. aureus MW2
aacgcuguuuuuaaaugcuuua

SEQ ID NO: 3999079 - RNA, 22 nt, Staphylococcus aureus subsp. aureus MW2
aacgcuuugcagauugauauaa

SEQ ID NO: 3999080 - RNA, 18 nt, Staphylococcus aureus subsp. aureus MW2
aacggcauaauacacauu

SEQ ID NO: 3999081 - RNA, 18 nt, Staphylococcus aureus subsp. aureus MW2
aacgguaaauaaccacuu

SEQ ID NO: 3999082 - RNA, 19 nt, Staphylococcus aureus subsp. aureus MW2
aacguacaauguauuaccu

SEQ ID NO: 3999083 - RNA, 15 nt, Staphylococcus aureus subsp. aureus MW2
aacguacauuuuuau

SEQ ID NO: 3999084 - RNA, 15 nt, Staphylococcus aureus subsp. aureus MW2
aacguaucauuuaaa

SEQ ID NO: 3999085 - RNA, 15 nt, Staphylococcus aureus subsp. aureus MW2
aacgucaacagcaua

SEQ ID NO: 3999086 - RNA, 17 nt, Staphylococcus aureus subsp. aureus MW2
aacgucacaacggcaua

SEQ ID NO: 3999087 - RNA, 22 nt, Staphylococcus aureus subsp. aureus MW2
aacgucacaugccaucuuugua

SEQ ID NO: 3999088 - RNA, 22 nt, Staphylococcus aureus subsp. aureus MW2
aacgucauauguuuuauaauaa

SEQ ID NO: 3999089 - RNA, 13 nt, Staphylococcus aureus subsp. aureus MW2
aacguccaaacac

SEQ ID NO: 3999090 - RNA, 17 nt, Staphylococcus aureus subsp. aureus MW2
aacgucccaacaacaua

SEQ ID NO: 3999091 - RNA, 14 nt, Staphylococcus aureus subsp. aureus MW2
aacguucacuuggu

SEQ ID NO: 3999092 - RNA, 17 nt, Staphylococcus aureus subsp. aureus MW2
aacguucauauaugaua

SEQ ID NO: 3999093 - RNA, 18 nt, Staphylococcus aureus subsp. aureus MW2
aacguucauauaugauaa

SEQ ID NO: 3999094 - RNA, 15 nt, Staphylococcus aureus subsp. aureus MW2
aacguuugaagaaug

SEQ ID NO: 3999095 - RNA, 12 nt, Staphylococcus aureus subsp. aureus MW2
aacguuuucacu

SEQ ID NO: 3999096 - RNA, 17 nt, Staphylococcus aureus subsp. aureus MW2
aacguuuugaccaaucg

SEQ ID NO: 3999097 - RNA, 23 nt, Staphylococcus aureus subsp. aureus MW2
aacuaaaaagcgugguucccaau

SEQ ID NO: 3999098 - RNA, 16 nt, Staphylococcus aureus subsp. aureus MW2
aacuaaaacaauaaua

SEQ ID NO: 3999099 - RNA, 17 nt, Staphylococcus aureus subsp. aureus MW2
aacuaaaacaauaauaa

SEQ ID NO: 3999100 - RNA, 19 nt, Staphylococcus aureus subsp. aureus MW2
aacuaaaacaauaauaaua

SEQ ID NO: 3999101 - RNA, 11 nt, Staphylococcus aureus subsp. aureus MW2
aacuaaaaugu

SEQ ID NO: 3999102 - RNA, 17 nt, Staphylococcus aureus subsp. aureus MW2
aacuaaaaugucuuuga

SEQ ID NO: 3999103 - RNA, 22 nt, Staphylococcus aureus subsp. aureus MW2
aacuaaaaugucuuugaaaaau

SEQ ID NO: 3999104 - RNA, 23 nt, Staphylococcus aureus subsp. aureus MW2
aacuaaaaugucuuugaaaaauu

SEQ ID NO: 3999105 - RNA, 21 nt, Staphylococcus aureus subsp. aureus MW2
aacuaaaauuuguaauuuaaa

SEQ ID NO: 3999106 - RNA, 15 nt, Staphylococcus aureus subsp. aureus MW2
aacuaaaccauugaa

SEQ ID NO: 3999107 - RNA, 22 nt, Staphylococcus aureus subsp. aureus MW2
aacuaaauacgaguguugguaa

SEQ ID NO: 3999108 - RNA, 14 nt, Staphylococcus aureus subsp. aureus MW2
aacuaaaucaccau

SEQ ID NO: 3999109 - RNA, 18 nt, Staphylococcus aureus subsp. aureus MW2
aacuaacacgucacaugg

SEQ ID NO: 3999110 - RNA, 16 nt, Staphylococcus aureus subsp. aureus MW2
aacuaacuaauaacuc

SEQ ID NO: 3999111 - RNA, 12 nt, Staphylococcus aureus subsp. aureus MW2
aacuaagauaua

SEQ ID NO: 3999112 - RNA, 17 nt, Staphylococcus aureus subsp. aureus MW2
aacuaagauauuuagua

SEQ ID NO: 3999113 - RNA, 23 nt, Staphylococcus aureus subsp. aureus MW2
aacuaagucacgauauaguguuu

SEQ ID NO: 3999114 - RNA, 18 nt, Staphylococcus aureus subsp. aureus MW2
aacuaagugaauuaucua

SEQ ID NO: 3999115 - RNA, 19 nt, Staphylococcus aureus subsp. aureus MW2
aacuaaguugacuauauaa

SEQ ID NO: 3999116 - RNA, 16 nt, Staphylococcus aureus subsp. aureus MW2
aacuaauaacaaauag

SEQ ID NO: 3999117 - RNA, 14 nt, Staphylococcus aureus subsp. aureus MW2
aacuaauaauuugu

SEQ ID NO: 3999118 - RNA, 20 nt, Staphylococcus aureus subsp. aureus MW2
aacuaauaauuuguaauucc

SEQ ID NO: 3999119 - RNA, 16 nt, Staphylococcus aureus subsp. aureus MW2
aacuaauaugauuggu

SEQ ID NO: 3999120 - RNA, 20 nt, Staphylococcus aureus subsp. aureus MW2
aacuaaucguguauuauuga

SEQ ID NO: 3999121 - RNA, 14 nt, Staphylococcus aureus subsp. aureus MW2
aacuaaugucgcac

SEQ ID NO: 3999122 - RNA, 16 nt, Staphylococcus aureus subsp. aureus MW2
aacuaauguuaaaaua

SEQ ID NO: 3999123 - RNA, 21 nt, Staphylococcus aureus subsp. aureus MW2
aacuaauuuaaagcaucauau

SEQ ID NO: 3999124 - RNA, 22 nt, Staphylococcus aureus subsp. aureus MW2
aacuaauuuaaagcaucauaua

SEQ ID NO: 3999125 - RNA, 22 nt, Staphylococcus aureus subsp. aureus MW2
aacuacggaagugguauuaacu

SEQ ID NO: 3999126 - RNA, 13 nt, Staphylococcus aureus subsp. aureus MW2
aacuacuucauca

SEQ ID NO: 3999127 - RNA, 15 nt, Staphylococcus aureus subsp. aureus MW2
aacuagaaugauuaa

SEQ ID NO: 3999128 - RNA, 15 nt, Staphylococcus aureus subsp. aureus MW2
aacuaguauccuuua

SEQ ID NO: 3999129 - RNA, 22 nt, Staphylococcus aureus subsp. aureus MW2
aacuaguauccuuuauaaauaa

SEQ ID NO: 3999130 - RNA, 14 nt, Staphylococcus aureus subsp. aureus MW2
aacuauaacaauag

SEQ ID NO: 3999131 - RNA, 21 nt, Staphylococcus aureus subsp. aureus MW2
aacuauaaccgcuacaauuau

SEQ ID NO: 3999132 - RNA, 19 nt, Staphylococcus aureus subsp. aureus MW2
aacuauaauaaagauuaua

SEQ ID NO: 3999133 - RNA, 17 nt, Staphylococcus aureus subsp. aureus MW2
aacuauaauaauuggaa

SEQ ID NO: 3999134 - RNA, 14 nt, Staphylococcus aureus subsp. aureus MW2
aacuauaaucauua

SEQ ID NO: 3999135 - RNA, 17 nt, Staphylococcus aureus subsp. aureus MW2
aacuauaugaaauguuc

SEQ ID NO: 3999136 - RNA, 15 nt, Staphylococcus aureus subsp. aureus MW2
aacuauccauaaagu

SEQ ID NO: 3999137 - RNA, 21 nt, Staphylococcus aureus subsp. aureus MW2
aacuaucuacaccauuaucgc

SEQ ID NO: 3999138 - RNA, 22 nt, Staphylococcus aureus subsp. aureus MW2
aacuauuaaaucauuauuuuac

SEQ ID NO: 3999139 - RNA, 19 nt, Staphylococcus aureus subsp. aureus MW2
aacuauuaauagcaccaua

SEQ ID NO: 3999140 - RNA, 17 nt, Staphylococcus aureus subsp. aureus MW2
aacucaaaaagccaaca

SEQ ID NO: 3999141 - RNA, 18 nt, Staphylococcus aureus subsp. aureus MW2
aacucaaaaagccaacac

SEQ ID NO: 3999142 - RNA, 15 nt, Staphylococcus aureus subsp. aureus MW2
aacucaacuuaaaua

SEQ ID NO: 3999143 - RNA, 19 nt, Staphylococcus aureus subsp. aureus MW2
aacucacaacagugcucua

SEQ ID NO: 3999144 - RNA, 22 nt, Staphylococcus aureus subsp. aureus MW2
aacucaguaaauuuauuauucg

SEQ ID NO: 3999145 - RNA, 14 nt, Staphylococcus aureus subsp. aureus MW2
aacucauaauuuuc

SEQ ID NO: 3999146 - RNA, 16 nt, Staphylococcus aureus subsp. aureus MW2
aacucauaauuuucua

SEQ ID NO: 3999147 - RNA, 17 nt, Staphylococcus aureus subsp. aureus MW2
aacucauaauuuucuau

SEQ ID NO: 3999148 - RNA, 16 nt, Staphylococcus aureus subsp. aureus MW2
aacucauacaaauuuu

SEQ ID NO: 3999149 - RNA, 15 nt, Staphylococcus aureus subsp. aureus MW2
aagaaaauacuaaca

SEQ ID NO: 3999150 - RNA, 18 nt, Staphylococcus aureus subsp. aureus MW2
aagaaaauacuaacaauu

SEQ ID NO: 3999151 - RNA, 14 nt, Staphylococcus aureus subsp. aureus MW2
aagaaaauuucagu

SEQ ID NO: 3999152 - RNA, 14 nt, Staphylococcus aureus subsp. aureus MW2
aagaaaucaacaac

SEQ ID NO: 3999153 - RNA, 13 nt, Staphylococcus aureus subsp. aureus MW2
aagaaauguuaaa

SEQ ID NO: 3999154 - RNA, 15 nt, Staphylococcus aureus subsp. aureus MW2
aagaaauguuaaauu

SEQ ID NO: 3999155 - RNA, 18 nt, Staphylococcus aureus subsp. aureus MW2
aagaaauguuaaauuaaa

SEQ ID NO: 3999156 - RNA, 17 nt, Staphylococcus aureus subsp. aureus MW2
aagaaauucgcaagccu

SEQ ID NO: 3999157 - RNA, 13 nt, Staphylococcus aureus subsp. aureus MW2
aagaaauuguguu

SEQ ID NO: 3999158 - RNA, 14 nt, Staphylococcus aureus subsp. aureus MW2
aagaaauuuuuucu

SEQ ID NO: 3999159 - RNA, 14 nt, Staphylococcus aureus subsp. aureus MW2
aagaacauaaccua

SEQ ID NO: 3999160 - RNA, 17 nt, Staphylococcus aureus subsp. aureus MW2
aagaacaugauacugaa

SEQ ID NO: 3999161 - RNA, 15 nt, Staphylococcus aureus subsp. aureus MW2
aagaacauucuaacu

SEQ ID NO: 3999162 - RNA, 17 nt, Staphylococcus aureus subsp. aureus MW2
aagaacguguuugaaug

SEQ ID NO: 3999163 - RNA, 15 nt, Staphylococcus aureus subsp. aureus MW2
aagaacuuaauguuc

SEQ ID NO: 3999164 - RNA, 22 nt, Staphylococcus aureus subsp. aureus MW2
aagaagacauuggauuacuucc

SEQ ID NO: 3999165 - RNA, 16 nt, Staphylococcus aureus subsp. aureus MW2
aagaaguaauguuaaa

SEQ ID NO: 3999166 - RNA, 17 nt, Staphylococcus aureus subsp. aureus MW2
aagaagugacaucguug

SEQ ID NO: 3999167 - RNA, 19 nt, Staphylococcus aureus subsp. aureus MW2
aagaagugccguauucuuu

SEQ ID NO: 3999168 - RNA, 22 nt, Staphylococcus aureus subsp. aureus MW2
aagaagugcuuaugaaugaaau

SEQ ID NO: 3999169 - RNA, 15 nt, Staphylococcus aureus subsp. aureus MW2
aagaaguuuccaacg

SEQ ID NO: 3999170 - RNA, 16 nt, Staphylococcus aureus subsp. aureus MW2
aagaauaaaaaaguug

SEQ ID NO: 3999171 - RNA, 14 nt, Staphylococcus aureus subsp. aureus MW2
aagaauaaacaaca

SEQ ID NO: 3999172 - RNA, 15 nt, Staphylococcus aureus subsp. aureus MW2
aagaauaaacaacau

SEQ ID NO: 3999173 - RNA, 17 nt, Staphylococcus aureus subsp. aureus MW2
aagaauacaaauauuaa

SEQ ID NO: 3999174 - RNA, 17 nt, Staphylococcus aureus subsp. aureus MW2
aagaauacaugacucca

SEQ ID NO: 3999175 - RNA, 14 nt, Staphylococcus aureus subsp. aureus MW2
aagaauauaaauga

SEQ ID NO: 3999176 - RNA, 22 nt, Staphylococcus aureus subsp. aureus MW2
aagaaucagcuaaauauuuuac

SEQ ID NO: 3999177 - RNA, 17 nt, Staphylococcus aureus subsp. aureus MW2
aagaaugauuuauaaaa

SEQ ID NO: 3999178 - RNA, 20 nt, Staphylococcus aureus subsp. aureus MW2
aagaaugccuuuuauuuauc

SEQ ID NO: 3999179 - RNA, 20 nt, Staphylococcus aureus subsp. aureus MW2
aagaaugugaacaucuaguu

SEQ ID NO: 3999180 - RNA, 18 nt, Staphylococcus aureus subsp. aureus MW2
aagaauguguuaaucaac

SEQ ID NO: 3999181 - RNA, 14 nt, Staphylococcus aureus subsp. aureus MW2
aagaauuaaguagu

SEQ ID NO: 3999182 - RNA, 23 nt, Staphylococcus aureus subsp. aureus MW2
aagaauuaauucgccuaaauggu

SEQ ID NO: 3999183 - RNA, 16 nt, Staphylococcus aureus subsp. aureus MW2
aagaauuauucaagua

SEQ ID NO: 3999184 - RNA, 12 nt, Staphylococcus aureus subsp. aureus MW2
aagaauuuaaaa

SEQ ID NO: 3999185 - RNA, 19 nt, Staphylococcus aureus subsp. aureus MW2
aagaauuucgaaaagaaau

SEQ ID NO: 3999186 - RNA, 13 nt, Staphylococcus aureus subsp. aureus MW2
aagacaccuucaa

SEQ ID NO: 3999187 - RNA, 22 nt, Staphylococcus aureus subsp. aureus MW2
aagacagcuucucauugaaauc

SEQ ID NO: 3999188 - RNA, 19 nt, Staphylococcus aureus subsp. aureus MW2
aagacauacagucaauaca

SEQ ID NO: 3999189 - RNA, 15 nt, Staphylococcus aureus subsp. aureus MW2
aagacaugagauuau

SEQ ID NO: 3999190 - RNA, 12 nt, Staphylococcus aureus subsp. aureus MW2
aagacauuuuaa

SEQ ID NO: 3999191 - RNA, 14 nt, Staphylococcus aureus subsp. aureus MW2
aagacauuuuaaca

SEQ ID NO: 3999192 - RNA, 21 nt, Staphylococcus aureus subsp. aureus MW2
aagaccauuuuauauuuuagu

SEQ ID NO: 3999193 - RNA, 21 nt, Staphylococcus aureus subsp. aureus MW2
aagaccguauccuguguaaaa

SEQ ID NO: 3999194 - RNA, 16 nt, Staphylococcus aureus subsp. aureus MW2
aagacgccgaaaagag

SEQ ID NO: 3999195 - RNA, 17 nt, Staphylococcus aureus subsp. aureus MW2
aagacgccgaaaagagg

SEQ ID NO: 3999196 - RNA, 21 nt, Staphylococcus aureus subsp. aureus MW2
aagacggugaccuuauauuuu

SEQ ID NO: 3999197 - RNA, 15 nt, Staphylococcus aureus subsp. aureus MW2
aagacuauaaugaau

SEQ ID NO: 3999198 - RNA, 17 nt, Staphylococcus aureus subsp. aureus MW2
aagacuauaaugaauaa

SEQ ID NO: 3999199 - RNA, 22 nt, Staphylococcus aureus subsp. aureus MW2
aagacucccuuuuuaaaauacg

SEQ ID NO: 3999200 - RNA, 21 nt, Staphylococcus aureus subsp. aureus MW2
aagacuucccuauauguaggg

SEQ ID NO: 3999201 - RNA, 16 nt, Staphylococcus aureus subsp. aureus MW2
aagagaaaagcuagaa

SEQ ID NO: 3999202 - RNA, 17 nt, Staphylococcus aureus subsp. aureus MW2
aagagaaaagcuagaag

SEQ ID NO: 3999203 - RNA, 15 nt, Staphylococcus aureus subsp. aureus MW2
aagagaaaauuugua

SEQ ID NO: 3999204 - RNA, 22 nt, Staphylococcus aureus subsp. aureus MW2
aagagauuuucuuaauugaaaa

SEQ ID NO: 3999205 - RNA, 17 nt, Staphylococcus aureus subsp. aureus MW2
aagagcaauuaaaguca

SEQ ID NO: 3999206 - RNA, 22 nt, Staphylococcus aureus subsp. aureus MW2
aagaggacaacuaauaacaaau

SEQ ID NO: 3999207 - RNA, 21 nt, Staphylococcus aureus subsp. aureus MW2
aagaggcgccacaacauguuu

SEQ ID NO: 3999208 - RNA, 18 nt, Staphylococcus aureus subsp. aureus MW2
aagaggcuuuaaaauuuu

SEQ ID NO: 3999209 - RNA, 22 nt, Staphylococcus aureus subsp. aureus MW2
aagagggaccuuacuacucauu

SEQ ID NO: 3999210 - RNA, 23 nt, Staphylococcus aureus subsp. aureus MW2
aagaguacagcgguuuguaugau

SEQ ID NO: 3999211 - RNA, 17 nt, Staphylococcus aureus subsp. aureus MW2
aagaguuaauccucauu

SEQ ID NO: 3999212 - RNA, 20 nt, Staphylococcus aureus subsp. aureus MW2
aagauaaacaagccaagaua

SEQ ID NO: 3999213 - RNA, 13 nt, Staphylococcus aureus subsp. aureus MW2
aagauaaauaaaa

SEQ ID NO: 3999214 - RNA, 21 nt, Staphylococcus aureus subsp. aureus MW2
aagauaacuagcaaaugcacu

SEQ ID NO: 3999215 - RNA, 15 nt, Staphylococcus aureus subsp. aureus MW2
aagauaccuuuuucu

SEQ ID NO: 3999216 - RNA, 19 nt, Staphylococcus aureus subsp. aureus MW2
aagauagaaugaauaauuc

SEQ ID NO: 3999217 - RNA, 17 nt, Staphylococcus aureus subsp. aureus MW2
aagauagguuuauuucu

SEQ ID NO: 3999218 - RNA, 20 nt, Staphylococcus aureus subsp. aureus MW2
aagauagguuuauuucugaa

SEQ ID NO: 3999219 - RNA, 20 nt, Staphylococcus aureus subsp. aureus MW2
aagauaguuugagaaaauua

SEQ ID NO: 3999220 - RNA, 20 nt, Staphylococcus aureus subsp. aureus MW2
aagauauauaacuaugguca

SEQ ID NO: 3999221 - RNA, 15 nt, Staphylococcus aureus subsp. aureus MW2
aagauauauuguaag

SEQ ID NO: 3999222 - RNA, 13 nt, Staphylococcus aureus subsp. aureus MW2
aagauauccauua

SEQ ID NO: 3999223 - RNA, 15 nt, Staphylococcus aureus subsp. aureus MW2
aagauaucuggauua

SEQ ID NO: 3999224 - RNA, 13 nt, Staphylococcus aureus subsp. aureus MW2
aagaugauuccaa

SEQ ID NO: 3999225 - RNA, 14 nt, Staphylococcus aureus subsp. aureus MW2
aagaugauuucaaa

SEQ ID NO: 3999226 - RNA, 18 nt, Staphylococcus aureus subsp. aureus MW2
aagaugccucaguuagaa

SEQ ID NO: 3999227 - RNA, 15 nt, Staphylococcus aureus subsp. aureus MW2
aagaugcuuuaauua

SEQ ID NO: 3999228 - RNA, 18 nt, Staphylococcus aureus subsp. aureus MW2
aagaugcuuuaauuaaag

SEQ ID NO: 3999229 - RNA, 20 nt, Staphylococcus aureus subsp. aureus MW2
aagaugcuuuaauuaaaguu

SEQ ID NO: 3999230 - RNA, 21 nt, Staphylococcus aureus subsp. aureus MW2
aagauguauaugaauuuuaua

SEQ ID NO: 3999231 - RNA, 22 nt, Staphylococcus aureus subsp. aureus MW2
aagaugugcaucccgaaaguua

SEQ ID NO: 3999232 - RNA, 22 nt, Staphylococcus aureus subsp. aureus MW2
aagauguugaaaaguauaugaa

SEQ ID NO: 3999233 - RNA, 15 nt, Staphylococcus aureus subsp. aureus MW2
aagauuaugaaaaca

SEQ ID NO: 3999234 - RNA, 15 nt, Staphylococcus aureus subsp. aureus MW2
aagauuauuuucaau

SEQ ID NO: 3999235 - RNA, 17 nt, Staphylococcus aureus subsp. aureus MW2
aagauuuaauaaagugu

SEQ ID NO: 3999236 - RNA, 14 nt, Staphylococcus aureus subsp. aureus MW2
aagcaaaagaugaa

SEQ ID NO: 3999237 - RNA, 14 nt, Staphylococcus aureus subsp. aureus MW2
aagcaaagaugaua

SEQ ID NO: 3999238 - RNA, 16 nt, Staphylococcus aureus subsp. aureus MW2
aaggccauuuguagac

SEQ ID NO: 3999239 - RNA, 14 nt, Staphylococcus aureus subsp. aureus MW2
aaggccugcaucac

SEQ ID NO: 3999240 - RNA, 18 nt, Staphylococcus aureus subsp. aureus MW2
aaggcgcucucuuuuuag

SEQ ID NO: 3999241 - RNA, 18 nt, Staphylococcus aureus subsp. aureus MW2
aagggaauggauuacagc

SEQ ID NO: 3999242 - RNA, 20 nt, Staphylococcus aureus subsp. aureus MW2
aagggaucggucuugaaaac

SEQ ID NO: 3999243 - RNA, 20 nt, Staphylococcus aureus subsp. aureus MW2
aagggaucguucuuugauua

SEQ ID NO: 3999244 - RNA, 15 nt, Staphylococcus aureus subsp. aureus MW2
aaggggguaauacua

SEQ ID NO: 3999245 - RNA, 13 nt, Staphylococcus aureus subsp. aureus MW2
aagguacauaaau

SEQ ID NO: 3999246 - RNA, 16 nt, Staphylococcus aureus subsp. aureus MW2
aaggucaaaaaauuaa

SEQ ID NO: 3999247 - RNA, 19 nt, Staphylococcus aureus subsp. aureus MW2
aaggucuacuaaauaacua

SEQ ID NO: 3999248 - RNA, 18 nt, Staphylococcus aureus subsp. aureus MW2
aaggucuauauauauuua

SEQ ID NO: 3999249 - RNA, 15 nt, Staphylococcus aureus subsp. aureus MW2
aaggugauugaacaa

SEQ ID NO: 3999250 - RNA, 15 nt, Staphylococcus aureus subsp. aureus MW2
aagguuaauauuaaa

SEQ ID NO: 3999251 - RNA, 20 nt, Staphylococcus aureus subsp. aureus MW2
aagguuaauauuaaauuuug

SEQ ID NO: 3999252 - RNA, 17 nt, Staphylococcus aureus subsp. aureus MW2
aagguuguucuauacau

SEQ ID NO: 3999253 - RNA, 17 nt, Staphylococcus aureus subsp. aureus MW2
aagguuuuacaauuuuu

SEQ ID NO: 3999254 - RNA, 20 nt, Staphylococcus aureus subsp. aureus MW2
aaguaaagggaggaauuaau

SEQ ID NO: 3999255 - RNA, 13 nt, Staphylococcus aureus subsp. aureus MW2
aaguaacucaagu

SEQ ID NO: 3999256 - RNA, 16 nt, Staphylococcus aureus subsp. aureus MW2
aaguaacucaagugau

SEQ ID NO: 3999257 - RNA, 20 nt, Staphylococcus aureus subsp. aureus MW2
aaguaagcguaauauuuaag

SEQ ID NO: 3999258 - RNA, 12 nt, Staphylococcus aureus subsp. aureus MW2
aaguaaguaaaa

SEQ ID NO: 3999259 - RNA, 13 nt, Staphylococcus aureus subsp. aureus MW2
aaguaaguaaaau

SEQ ID NO: 3999260 - RNA, 14 nt, Staphylococcus aureus subsp. aureus MW2
aaguaaguaaaaua

SEQ ID NO: 3999261 - RNA, 18 nt, Staphylococcus aureus subsp. aureus MW2
aaguaauaaguaauaauu

SEQ ID NO: 3999262 - RNA, 15 nt, Staphylococcus aureus subsp. aureus MW2
aaguaauaauauaaa

SEQ ID NO: 3999263 - RNA, 21 nt, Staphylococcus aureus subsp. aureus MW2
aaguaauaauggcaauuaaaa

SEQ ID NO: 3999264 - RNA, 15 nt, Staphylococcus aureus subsp. aureus MW2
aaguaauauauaaaa

SEQ ID NO: 3999265 - RNA, 21 nt, Staphylococcus aureus subsp. aureus MW2
aaguaauaugagugaaaguuu

SEQ ID NO: 3999266 - RNA, 16 nt, Staphylococcus aureus subsp. aureus MW2
aaguaaucauuuuucg

SEQ ID NO: 3999267 - RNA, 13 nt, Staphylococcus aureus subsp. aureus MW2
aaguaauguuaaa

SEQ ID NO: 3999268 - RNA, 19 nt, Staphylococcus aureus subsp. aureus MW2
aaguaauguuaaacacuca

SEQ ID NO: 3999269 - RNA, 14 nt, Staphylococcus aureus subsp. aureus MW2
aaguaauuaaauac

SEQ ID NO: 3999270 - RNA, 13 nt, Staphylococcus aureus subsp. aureus MW2
aaguacaaauaau

SEQ ID NO: 3999271 - RNA, 17 nt, Staphylococcus aureus subsp. aureus MW2
aaguacaaauaauacag

SEQ ID NO: 3999272 - RNA, 21 nt, Staphylococcus aureus subsp. aureus MW2
aaguacauaaaugcuaaaagu

SEQ ID NO: 3999273 - RNA, 14 nt, Staphylococcus aureus subsp. aureus MW2
aaguacuuacaaau

SEQ ID NO: 3999274 - RNA, 16 nt, Staphylococcus aureus subsp. aureus MW2
aaguacuuacaaauau

SEQ ID NO: 3999275 - RNA, 17 nt, Staphylococcus aureus subsp. aureus MW2
aaguacuucggugcuug

SEQ ID NO: 3999276 - RNA, 20 nt, Staphylococcus aureus subsp. aureus MW2
aaguacuuuaaaauuguaua

SEQ ID NO: 3999277 - RNA, 14 nt, Staphylococcus aureus subsp. aureus MW2
aaguagaagcaaaa

SEQ ID NO: 3999278 - RNA, 23 nt, Staphylococcus aureus subsp. aureus MW2
aaguagcucaaaacaauuuaaaa

SEQ ID NO: 3999279 - RNA, 22 nt, Staphylococcus aureus subsp. aureus MW2
aaguaguucaauaaauuuuuaa

SEQ ID NO: 3999280 - RNA, 13 nt, Staphylococcus aureus subsp. aureus MW2
aaguaguuucauu

SEQ ID NO: 3999281 - RNA, 19 nt, Staphylococcus aureus subsp. aureus MW2
aaguauaaguagcucaaaa

SEQ ID NO: 3999282 - RNA, 17 nt, Staphylococcus aureus subsp. aureus MW2
aaguauacuaaacuuuu

SEQ ID NO: 3999283 - RNA, 17 nt, Staphylococcus aureus subsp. aureus MW2
aaguauauaagcaaaga

SEQ ID NO: 3999284 - RNA, 14 nt, Staphylococcus aureus subsp. aureus MW2
aaguauaucuuuga

SEQ ID NO: 3999285 - RNA, 19 nt, Staphylococcus aureus subsp. aureus MW2
aaguaucgccaaucuauug

SEQ ID NO: 3999286 - RNA, 18 nt, Staphylococcus aureus subsp. aureus MW2
aaguaucuaugaaauuuu

SEQ ID NO: 3999287 - RNA, 12 nt, Staphylococcus aureus subsp. aureus MW2
aaguaucuguga

SEQ ID NO: 3999288 - RNA, 19 nt, Staphylococcus aureus subsp. aureus MW2
aaguaucugugaauaugcu

SEQ ID NO: 3999289 - RNA, 20 nt, Staphylococcus aureus subsp. aureus MW2
aaguaucugugaauaugcuu

SEQ ID NO: 3999290 - RNA, 21 nt, Staphylococcus aureus subsp. aureus MW2
aaguaucugugaauaugcuuu

SEQ ID NO: 3999291 - RNA, 21 nt, Staphylococcus aureus subsp. aureus MW2
aaguaucuuuugcaccuucaa

SEQ ID NO: 3999292 - RNA, 16 nt, Staphylococcus aureus subsp. aureus MW2
aaguauggaaguuguu

SEQ ID NO: 3999293 - RNA, 19 nt, Staphylococcus aureus subsp. aureus MW2
aaguauggcgaaauguuuu

SEQ ID NO: 3999294 - RNA, 14 nt, Staphylococcus aureus subsp. aureus MW2
aaguauuagauaua

SEQ ID NO: 3999295 - RNA, 17 nt, Staphylococcus aureus subsp. aureus MW2
aaguauuagauauauuu

SEQ ID NO: 3999296 - RNA, 18 nt, Staphylococcus aureus subsp. aureus MW2
aaguauuaucuaauucuu

SEQ ID NO: 3999297 - RNA, 17 nt, Staphylococcus aureus subsp. aureus MW2
aaguauuaugauugcuu

SEQ ID NO: 3999298 - RNA, 23 nt, Staphylococcus aureus subsp. aureus MW2
aaguauuaugauugcuuauuuau

SEQ ID NO: 3999299 - RNA, 11 nt, Staphylococcus aureus subsp. aureus MW2
aaguauuuaaa

SEQ ID NO: 3999300 - RNA, 12 nt, Staphylococcus aureus subsp. aureus MW2
aaguauuuaaac

SEQ ID NO: 3999301 - RNA, 12 nt, Staphylococcus aureus subsp. aureus MW2
aaguauuuuaau

SEQ ID NO: 3999302 - RNA, 23 nt, Staphylococcus aureus subsp. aureus MW2
aaguauuuucuuaguuugacauc

SEQ ID NO: 3999303 - RNA, 15 nt, Staphylococcus aureus subsp. aureus MW2
aagucacaguguaau

SEQ ID NO: 3999304 - RNA, 16 nt, Staphylococcus aureus subsp. aureus MW2
aagucagcuuacaaua

SEQ ID NO: 3999305 - RNA, 22 nt, Staphylococcus aureus subsp. aureus MW2
aagucaggaucacguuuuucuu

SEQ ID NO: 3999306 - RNA, 13 nt, Staphylococcus aureus subsp. aureus MW2
aagucauuaaaug

SEQ ID NO: 3999307 - RNA, 22 nt, Staphylococcus aureus subsp. aureus MW2
aagucauuaaauguacauugua

SEQ ID NO: 3999308 - RNA, 15 nt, Staphylococcus aureus subsp. aureus MW2
aagucgcucuagaca

SEQ ID NO: 3999309 - RNA, 19 nt, Staphylococcus aureus subsp. aureus MW2
aagucgugccgaacuggaa

SEQ ID NO: 3999310 - RNA, 19 nt, Staphylococcus aureus subsp. aureus MW2
aagucuaguucgaacacac

SEQ ID NO: 3999311 - RNA, 21 nt, Staphylococcus aureus subsp. aureus MW2
aagucucauuaucaccaccuu

SEQ ID NO: 3999312 - RNA, 15 nt, Staphylococcus aureus subsp. aureus MW2
aagucucuugucauu

SEQ ID NO: 3999313 - RNA, 16 nt, Staphylococcus aureus subsp. aureus MW2
aagucucuugucauuu

SEQ ID NO: 3999314 - RNA, 15 nt, Staphylococcus aureus subsp. aureus MW2
aagucucuuuccuca

SEQ ID NO: 3999315 - RNA, 17 nt, Staphylococcus aureus subsp. aureus MW2
aagucugaugucgaaaa

SEQ ID NO: 3999316 - RNA, 19 nt, Staphylococcus aureus subsp. aureus MW2
aagucugaugucgaaaaua

SEQ ID NO: 3999317 - RNA, 18 nt, Staphylococcus aureus subsp. aureus MW2
aagucugcugguaacucu

SEQ ID NO: 3999318 - RNA, 21 nt, Staphylococcus aureus subsp. aureus MW2
aagucuguugguuuaucagcu

SEQ ID NO: 3999319 - RNA, 23 nt, Staphylococcus aureus subsp. aureus MW2
aagucuguugguuuaucagcuuu

SEQ ID NO: 3999320 - RNA, 19 nt, Staphylococcus aureus subsp. aureus MW2
aagucuugugauaauucuu

SEQ ID NO: 3999321 - RNA, 23 nt, Staphylococcus aureus subsp. aureus MW2
aagucuuuaauagcgucaaguuu

SEQ ID NO: 3999322 - RNA, 12 nt, Staphylococcus aureus subsp. aureus MW2
aagugaaaaauu

SEQ ID NO: 3999323 - RNA, 13 nt, Staphylococcus aureus subsp. aureus MW2
aagugacacugua

SEQ ID NO: 3999324 - RNA, 23 nt, Staphylococcus aureus subsp. aureus MW2
aagugacuuaauaucauauucaa

SEQ ID NO: 3999325 - RNA, 12 nt, Staphylococcus aureus subsp. aureus MW2
aagugaugaaaa

SEQ ID NO: 3999326 - RNA, 13 nt, Staphylococcus aureus subsp. aureus MW2
aagugaugaaaaa

SEQ ID NO: 3999327 - RNA, 13 nt, Staphylococcus aureus subsp. aureus MW2
aauaaacuuaaaa

SEQ ID NO: 3999328 - RNA, 15 nt, Staphylococcus aureus subsp. aureus MW2
aauaaacuuaaaaga

SEQ ID NO: 3999329 - RNA, 18 nt, Staphylococcus aureus subsp. aureus MW2
aauaaacuuaaaagagaa

SEQ ID NO: 3999330 - RNA, 15 nt, Staphylococcus aureus subsp. aureus MW2
aauaaagauucaauu

SEQ ID NO: 3999331 - RNA, 18 nt, Staphylococcus aureus subsp. aureus MW2
aauaaagcaguguugcau

SEQ ID NO: 3999332 - RNA, 22 nt, Staphylococcus aureus subsp. aureus MW2
aauaaagcugauuuuucauuga

SEQ ID NO: 3999333 - RNA, 20 nt, Staphylococcus aureus subsp. aureus MW2
aauaaauaagcaaucauaau

SEQ ID NO: 3999334 - RNA, 22 nt, Staphylococcus aureus subsp. aureus MW2
aauaaauagacugccaauaaaa

SEQ ID NO: 3999335 - RNA, 17 nt, Staphylococcus aureus subsp. aureus MW2
aauaaauagauaauaua

SEQ ID NO: 3999336 - RNA, 21 nt, Staphylococcus aureus subsp. aureus MW2
aauaaaucauuaguuguauca

SEQ ID NO: 3999337 - RNA, 14 nt, Staphylococcus aureus subsp. aureus MW2
aauaaaucuaucua

SEQ ID NO: 3999338 - RNA, 21 nt, Staphylococcus aureus subsp. aureus MW2
aauaaaucuaucuauucaaau

SEQ ID NO: 3999339 - RNA, 13 nt, Staphylococcus aureus subsp. aureus MW2
aauaaauguuaaa

SEQ ID NO: 3999340 - RNA, 21 nt, Staphylococcus aureus subsp. aureus MW2
aauaaauuaugaaagugaauu

SEQ ID NO: 3999341 - RNA, 23 nt, Staphylococcus aureus subsp. aureus MW2
aauaaauugcacgucuuguauca

SEQ ID NO: 3999342 - RNA, 22 nt, Staphylococcus aureus subsp. aureus MW2
aauaaauuguacugauauauac

SEQ ID NO: 3999343 - RNA, 19 nt, Staphylococcus aureus subsp. aureus MW2
aauaaauuguaugaauaau

SEQ ID NO: 3999344 - RNA, 22 nt, Staphylococcus aureus subsp. aureus MW2
aauaaauuuagauauaauaaaa

SEQ ID NO: 3999345 - RNA, 13 nt, Staphylococcus aureus subsp. aureus MW2
aauaaauuuuaua

SEQ ID NO: 3999346 - RNA, 15 nt, Staphylococcus aureus subsp. aureus MW2
aauaaauuuuauaua

SEQ ID NO: 3999347 - RNA, 17 nt, Staphylococcus aureus subsp. aureus MW2
aauaacaaaauuaaaua

SEQ ID NO: 3999348 - RNA, 22 nt, Staphylococcus aureus subsp. aureus MW2
aauaacaccaauugaauauuuu

SEQ ID NO: 3999349 - RNA, 23 nt, Staphylococcus aureus subsp. aureus MW2
aauaacaccuuucauuuggaaac

SEQ ID NO: 3999350 - RNA, 22 nt, Staphylococcus aureus subsp. aureus MW2
aauaacacgauuugguugaacu

SEQ ID NO: 3999351 - RNA, 16 nt, Staphylococcus aureus subsp. aureus MW2
aauaacagcuacaaau

SEQ ID NO: 3999352 - RNA, 14 nt, Staphylococcus aureus subsp. aureus MW2
aauaaccauguaaa

SEQ ID NO: 3999353 - RNA, 23 nt, Staphylococcus aureus subsp. aureus MW2
aauaaccauguaaaauuagcaag

SEQ ID NO: 3999354 - RNA, 14 nt, Staphylococcus aureus subsp. aureus MW2
aauaaccauucacu

SEQ ID NO: 3999355 - RNA, 22 nt, Staphylococcus aureus subsp. aureus MW2
aauaaccauucacuuauagaau

SEQ ID NO: 3999356 - RNA, 17 nt, Staphylococcus aureus subsp. aureus MW2
aauaaccgcuuaauucu

SEQ ID NO: 3999357 - RNA, 18 nt, Staphylococcus aureus subsp. aureus MW2
aauaaccgcuuaauucuu

SEQ ID NO: 3999358 - RNA, 17 nt, Staphylococcus aureus subsp. aureus MW2
aauaaccuacauuaauu

SEQ ID NO: 3999359 - RNA, 19 nt, Staphylococcus aureus subsp. aureus MW2
aauaaccuacauuaauuua

SEQ ID NO: 3999360 - RNA, 17 nt, Staphylococcus aureus subsp. aureus MW2
aauaaccuuuaaaacau

SEQ ID NO: 3999361 - RNA, 15 nt, Staphylococcus aureus subsp. aureus MW2
aauaacguuaauaua

SEQ ID NO: 3999362 - RNA, 24 nt, Staphylococcus aureus subsp. aureus MW2
aauaacuaguauccuuuauaaaua

SEQ ID NO: 3999363 - RNA, 17 nt, Staphylococcus aureus subsp. aureus MW2
aauaacucuuaggguuu

SEQ ID NO: 3999364 - RNA, 19 nt, Staphylococcus aureus subsp. aureus MW2
aauaacuggcaaaucaaac

SEQ ID NO: 3999365 - RNA, 15 nt, Staphylococcus aureus subsp. aureus MW2
aauaacuguucuuuc

SEQ ID NO: 3999366 - RNA, 15 nt, Staphylococcus aureus subsp. aureus MW2
aauaacuguuuauca

SEQ ID NO: 3999367 - RNA, 16 nt, Staphylococcus aureus subsp. aureus MW2
aauaacuguuuaucau

SEQ ID NO: 3999368 - RNA, 18 nt, Staphylococcus aureus subsp. aureus MW2
aauaacuguuuaucauga

SEQ ID NO: 3999369 - RNA, 22 nt, Staphylococcus aureus subsp. aureus MW2
aauaacuucguuuuaauaaauu

SEQ ID NO: 3999370 - RNA, 17 nt, Staphylococcus aureus subsp. aureus MW2
aauaacuugauauuaua

SEQ ID NO: 3999371 - RNA, 23 nt, Staphylococcus aureus subsp. aureus MW2
aauaagaacuugcuuuucauuua

SEQ ID NO: 3999372 - RNA, 11 nt, Staphylococcus aureus subsp. aureus MW2
aauaagauuau

SEQ ID NO: 3999373 - RNA, 12 nt, Staphylococcus aureus subsp. aureus MW2
aauaagauuauu

SEQ ID NO: 3999374 - RNA, 16 nt, Staphylococcus aureus subsp. aureus MW2
aauaagauuuugcuuu

SEQ ID NO: 3999375 - RNA, 12 nt, Staphylococcus aureus subsp. aureus MW2
aauaagcuaaua

SEQ ID NO: 3999376 - RNA, 20 nt, Staphylococcus aureus subsp. aureus MW2
aauaaggaagcguaugaugu

SEQ ID NO: 3999377 - RNA, 21 nt, Staphylococcus aureus subsp. aureus MW2
aauaagguauggcuagucuuu

SEQ ID NO: 3999378 - RNA, 15 nt, Staphylococcus aureus subsp. aureus MW2
aauaaguaauaauuu

SEQ ID NO: 3999379 - RNA, 17 nt, Staphylococcus aureus subsp. aureus MW2
aauaaguaauaauuuau

SEQ ID NO: 3999380 - RNA, 23 nt, Staphylococcus aureus subsp. aureus MW2
aauaagucucuuuacggauugcu

SEQ ID NO: 3999381 - RNA, 13 nt, Staphylococcus aureus subsp. aureus MW2
aauaagugauaaa

SEQ ID NO: 3999382 - RNA, 13 nt, Staphylococcus aureus subsp. aureus MW2
aauaaguugucau

SEQ ID NO: 3999383 - RNA, 14 nt, Staphylococcus aureus subsp. aureus MW2
aauaaguugucauc

SEQ ID NO: 3999384 - RNA, 13 nt, Staphylococcus aureus subsp. aureus MW2
aauaauaaaauag

SEQ ID NO: 3999385 - RNA, 14 nt, Staphylococcus aureus subsp. aureus MW2
aauaauaacgucac

SEQ ID NO: 3999386 - RNA, 14 nt, Staphylococcus aureus subsp. aureus MW2
aauaauaaugggaa

SEQ ID NO: 3999387 - RNA, 17 nt, Staphylococcus aureus subsp. aureus MW2
aauaauacgcaauugau

SEQ ID NO: 3999388 - RNA, 15 nt, Staphylococcus aureus subsp. aureus MW2
aauaauagcaaaauu

SEQ ID NO: 3999389 - RNA, 22 nt, Staphylococcus aureus subsp. aureus MW2
aauaauaggauaccacaucgca

SEQ ID NO: 3999390 - RNA, 22 nt, Staphylococcus aureus subsp. aureus MW2
aauaauaggcuagauaauaauc

SEQ ID NO: 3999391 - RNA, 16 nt, Staphylococcus aureus subsp. aureus MW2
aauaauauaaaacgau

SEQ ID NO: 3999392 - RNA, 12 nt, Staphylococcus aureus subsp. aureus MW2
aauaauauauuu

SEQ ID NO: 3999393 - RNA, 14 nt, Staphylococcus aureus subsp. aureus MW2
aauaauauauuuag

SEQ ID NO: 3999394 - RNA, 23 nt, Staphylococcus aureus subsp. aureus MW2
aauaauaucaccuuuuuuaagau

SEQ ID NO: 3999395 - RNA, 11 nt, Staphylococcus aureus subsp. aureus MW2
aauaauauuug

SEQ ID NO: 3999396 - RNA, 20 nt, Staphylococcus aureus subsp. aureus MW2
aauaauccagucacaaacaa

SEQ ID NO: 3999397 - RNA, 15 nt, Staphylococcus aureus subsp. aureus MW2
aauaaucgaacagaa

SEQ ID NO: 3999398 - RNA, 16 nt, Staphylococcus aureus subsp. aureus MW2
aauaaucggacugaug

SEQ ID NO: 3999399 - RNA, 19 nt, Staphylococcus aureus subsp. aureus MW2
aauaaucggacugauggaa

SEQ ID NO: 3999400 - RNA, 21 nt, Staphylococcus aureus subsp. aureus MW2
aauaaucgguaauuacuugug

SEQ ID NO: 3999401 - RNA, 21 nt, Staphylococcus aureus subsp. aureus MW2
aauaaucguaaacacuauaaa

SEQ ID NO: 3999402 - RNA, 14 nt, Staphylococcus aureus subsp. aureus MW2
aauaaugacaaauu

SEQ ID NO: 3999403 - RNA, 19 nt, Staphylococcus aureus subsp. aureus MW2
aauaaugacgagaauuaaa

SEQ ID NO: 3999404 - RNA, 20 nt, Staphylococcus aureus subsp. aureus MW2
aauaaugacgagaauuaaag

SEQ ID NO: 3999405 - RNA, 14 nt, Staphylococcus aureus subsp. aureus MW2
aauaaugacugaca

SEQ ID NO: 3999406 - RNA, 14 nt, Staphylococcus aureus subsp. aureus MW2
aauaaugauacuaa

SEQ ID NO: 3999407 - RNA, 18 nt, Staphylococcus aureus subsp. aureus MW2
aauaaugcuuauuaaaau

SEQ ID NO: 3999408 - RNA, 23 nt, Staphylococcus aureus subsp. aureus MW2
aauaaugggaauuguauuagcaa

SEQ ID NO: 3999409 - RNA, 14 nt, Staphylococcus aureus subsp. aureus MW2
aauaauguaucauu

SEQ ID NO: 3999410 - RNA, 18 nt, Staphylococcus aureus subsp. aureus MW2
aauaaugugaaaaaucuu

SEQ ID NO: 3999411 - RNA, 18 nt, Staphylococcus aureus subsp. aureus MW2
aauaaugugcaaguuggc

SEQ ID NO: 3999412 - RNA, 16 nt, Staphylococcus aureus subsp. aureus MW2
aauaaugugucaaaca

SEQ ID NO: 3999413 - RNA, 11 nt, Staphylococcus aureus subsp. aureus MW2
aauaauguuuc

SEQ ID NO: 3999414 - RNA, 16 nt, Staphylococcus aureus subsp. aureus MW2
aauaauuaaacaaaac

SEQ ID NO: 3999415 - RNA, 16 nt, Staphylococcus aureus subsp. aureus MW2
aauagacauuguuaaa

SEQ ID NO: 3999416 - RNA, 19 nt, Staphylococcus aureus subsp. aureus MW2
aauagacugccaauaaaau

SEQ ID NO: 3999417 - RNA, 20 nt, Staphylococcus aureus subsp. aureus MW2
aauagacugccaauaaaaug

SEQ ID NO: 3999418 - RNA, 22 nt, Staphylococcus aureus subsp. aureus MW2
aauagacugccaauaaaaugca

SEQ ID NO: 3999419 - RNA, 16 nt, Staphylococcus aureus subsp. aureus MW2
aauagagaaaaaauaa

SEQ ID NO: 3999420 - RNA, 15 nt, Staphylococcus aureus subsp. aureus MW2
aauagauaauauaua

SEQ ID NO: 3999421 - RNA, 16 nt, Staphylococcus aureus subsp. aureus MW2
aauagauaaugcaccu

SEQ ID NO: 3999422 - RNA, 18 nt, Staphylococcus aureus subsp. aureus MW2
aauagaugaaaauuuaau

SEQ ID NO: 3999423 - RNA, 19 nt, Staphylococcus aureus subsp. aureus MW2
aauagaugagaaaguaaaa

SEQ ID NO: 3999424 - RNA, 21 nt, Staphylococcus aureus subsp. aureus MW2
aauagaugucacuguuaaaga

SEQ ID NO: 3999425 - RNA, 15 nt, Staphylococcus aureus subsp. aureus MW2
aauagcgauuuuaaa

SEQ ID NO: 3999426 - RNA, 20 nt, Staphylococcus aureus subsp. aureus MW2
aauagcgauuuuaaagaaaa

SEQ ID NO: 3999427 - RNA, 21 nt, Staphylococcus aureus subsp. aureus MW2
aauagcuacaauuaaagugaa

SEQ ID NO: 3999428 - RNA, 18 nt, Staphylococcus aureus subsp. aureus MW2
aauagcuauaacucuaaa

SEQ ID NO: 3999429 - RNA, 21 nt, Staphylococcus aureus subsp. aureus MW2
aauagcuauaacucuaaauau

SEQ ID NO: 3999430 - RNA, 17 nt, Staphylococcus aureus subsp. aureus MW2
aauagcuauauuuaaaa

SEQ ID NO: 3999431 - RNA, 15 nt, Staphylococcus aureus subsp. aureus MW2
aauagcuauuaaaau

SEQ ID NO: 3999432 - RNA, 12 nt, Staphylococcus aureus subsp. aureus MW2
aauagcugcaau

SEQ ID NO: 3999433 - RNA, 14 nt, Staphylococcus aureus subsp. aureus MW2
aauagcuuguuuau

SEQ ID NO: 3999434 - RNA, 20 nt, Staphylococcus aureus subsp. aureus MW2
aauagcuuucguuucuuuua

SEQ ID NO: 3999435 - RNA, 21 nt, Staphylococcus aureus subsp. aureus MW2
aauagcuuucguuucuuuuau

SEQ ID NO: 3999436 - RNA, 13 nt, Staphylococcus aureus subsp. aureus MW2
aauaggaauacca

SEQ ID NO: 3999437 - RNA, 13 nt, Staphylococcus aureus subsp. aureus MW2
aauaggauuuccu

SEQ ID NO: 3999438 - RNA, 19 nt, Staphylococcus aureus subsp. aureus MW2
aauagguacaacuaaauau

SEQ ID NO: 3999439 - RNA, 16 nt, Staphylococcus aureus subsp. aureus MW2
aauagguuaguaauau

SEQ ID NO: 3999440 - RNA, 16 nt, Staphylococcus aureus subsp. aureus MW2
aauagguuauuugaua

SEQ ID NO: 3999441 - RNA, 20 nt, Staphylococcus aureus subsp. aureus MW2
aauagguuauuugauaauga

SEQ ID NO: 3999442 - RNA, 20 nt, Staphylococcus aureus subsp. aureus MW2
aauagguucauuauuuaaau

SEQ ID NO: 3999443 - RNA, 14 nt, Staphylococcus aureus subsp. aureus MW2
aauaguaaagugaa

SEQ ID NO: 3999444 - RNA, 17 nt, Staphylococcus aureus subsp. aureus MW2
aauaguaaagugaaaua

SEQ ID NO: 3999445 - RNA, 18 nt, Staphylococcus aureus subsp. aureus MW2
aauaguaaagugaaauaa

SEQ ID NO: 3999446 - RNA, 13 nt, Staphylococcus aureus subsp. aureus MW2
aauaguaacgucu

SEQ ID NO: 3999447 - RNA, 18 nt, Staphylococcus aureus subsp. aureus MW2
aauagucaauuaaugaua

SEQ ID NO: 3999448 - RNA, 18 nt, Staphylococcus aureus subsp. aureus MW2
aauagucggggccccaac

SEQ ID NO: 3999449 - RNA, 15 nt, Staphylococcus aureus subsp. aureus MW2
aauaguuaagauuuu

SEQ ID NO: 3999450 - RNA, 14 nt, Staphylococcus aureus subsp. aureus MW2
aauaguucaaaaua

SEQ ID NO: 3999451 - RNA, 12 nt, Staphylococcus aureus subsp. aureus MW2
aauaguucaaau

SEQ ID NO: 3999452 - RNA, 13 nt, Staphylococcus aureus subsp. aureus MW2
aauaguucuuuaa

SEQ ID NO: 3999453 - RNA, 15 nt, Staphylococcus aureus subsp. aureus MW2
aauaguuucaaugcc

SEQ ID NO: 3999454 - RNA, 19 nt, Staphylococcus aureus subsp. aureus MW2
aauaguuuucuucacugcu

SEQ ID NO: 3999455 - RNA, 12 nt, Staphylococcus aureus subsp. aureus MW2
aauauaaaaaag

SEQ ID NO: 3999456 - RNA, 19 nt, Staphylococcus aureus subsp. aureus MW2
aauauaaaacgauaagaau

SEQ ID NO: 3999457 - RNA, 12 nt, Staphylococcus aureus subsp. aureus MW2
aauauaaaauaa

SEQ ID NO: 3999458 - RNA, 13 nt, Staphylococcus aureus subsp. aureus MW2
aauauaaacuauu

SEQ ID NO: 3999459 - RNA, 16 nt, Staphylococcus aureus subsp. aureus MW2
aauauaaacuauuaaa

SEQ ID NO: 3999460 - RNA, 17 nt, Staphylococcus aureus subsp. aureus MW2
aauauaacaucaaauag

SEQ ID NO: 3999461 - RNA, 14 nt, Staphylococcus aureus subsp. aureus MW2
aauauaaguauaau

SEQ ID NO: 3999462 - RNA, 18 nt, Staphylococcus aureus subsp. aureus MW2
aauauaauagaaauaauc

SEQ ID NO: 3999463 - RNA, 16 nt, Staphylococcus aureus subsp. aureus MW2
aauauaauauauacaa

SEQ ID NO: 3999464 - RNA, 18 nt, Staphylococcus aureus subsp. aureus MW2
aauauaauuaauuuugua

SEQ ID NO: 3999465 - RNA, 13 nt, Staphylococcus aureus subsp. aureus MW2
aauauaauuauua

SEQ ID NO: 3999466 - RNA, 15 nt, Staphylococcus aureus subsp. aureus MW2
aauauaauuauuaaa

SEQ ID NO: 3999467 - RNA, 17 nt, Staphylococcus aureus subsp. aureus MW2
aauauaauuauuaaacu

SEQ ID NO: 3999468 - RNA, 13 nt, Staphylococcus aureus subsp. aureus MW2
aauauaauuuuaa

SEQ ID NO: 3999469 - RNA, 18 nt, Staphylococcus aureus subsp. aureus MW2
aauauacuaaauuugaaa

SEQ ID NO: 3999470 - RNA, 15 nt, Staphylococcus aureus subsp. aureus MW2
aauauacuucuauua

SEQ ID NO: 3999471 - RNA, 22 nt, Staphylococcus aureus subsp. aureus MW2
aauauacuucuauuaaaugaca

SEQ ID NO: 3999472 - RNA, 22 nt, Staphylococcus aureus subsp. aureus MW2
aauauacuugaagcaucgauuu

SEQ ID NO: 3999473 - RNA, 19 nt, Staphylococcus aureus subsp. aureus MW2
aauauacuugccuucaaau

SEQ ID NO: 3999474 - RNA, 11 nt, Staphylococcus aureus subsp. aureus MW2
aauauacuuuu

SEQ ID NO: 3999475 - RNA, 18 nt, Staphylococcus aureus subsp. aureus MW2
aauauacuuuuauagaaa

SEQ ID NO: 3999476 - RNA, 23 nt, Staphylococcus aureus subsp. aureus MW2
aauauacuuuuuaaaugauuuaa

SEQ ID NO: 3999477 - RNA, 17 nt, Staphylococcus aureus subsp. aureus MW2
aauauagaaaaugagua

SEQ ID NO: 3999478 - RNA, 16 nt, Staphylococcus aureus subsp. aureus MW2
aauauagaagauauaa

SEQ ID NO: 3999479 - RNA, 22 nt, Staphylococcus aureus subsp. aureus MW2
aauauagcuauuacuauaaaaa

SEQ ID NO: 3999480 - RNA, 15 nt, Staphylococcus aureus subsp. aureus MW2
aauauagcuauuaga

SEQ ID NO: 3999481 - RNA, 16 nt, Staphylococcus aureus subsp. aureus MW2
aauauagcugugauuu

SEQ ID NO: 3999482 - RNA, 22 nt, Staphylococcus aureus subsp. aureus MW2
aauauagcugugauuugaucaa

SEQ ID NO: 3999483 - RNA, 15 nt, Staphylococcus aureus subsp. aureus MW2
aauauaguaauaaaa

SEQ ID NO: 3999484 - RNA, 15 nt, Staphylococcus aureus subsp. aureus MW2
aauauaguuaaaguu

SEQ ID NO: 3999485 - RNA, 16 nt, Staphylococcus aureus subsp. aureus MW2
aauauaguuaaaguua

SEQ ID NO: 3999486 - RNA, 16 nt, Staphylococcus aureus subsp. aureus MW2
aauauaucaucucuau

SEQ ID NO: 3999487 - RNA, 16 nt, Staphylococcus aureus subsp. aureus MW2
aauauauccugccaau

SEQ ID NO: 3999488 - RNA, 18 nt, Staphylococcus aureus subsp. aureus MW2
aauauaucuaauacuuuc

SEQ ID NO: 3999489 - RNA, 13 nt, Staphylococcus aureus subsp. aureus MW2
aauauauguauaa

SEQ ID NO: 3999490 - RNA, 12 nt, Staphylococcus aureus subsp. aureus MW2
aauauauuauaa

SEQ ID NO: 3999491 - RNA, 15 nt, Staphylococcus aureus subsp. aureus MW2
aauauauuauaaaaa

SEQ ID NO: 3999492 - RNA, 16 nt, Staphylococcus aureus subsp. aureus MW2
aauauauuuaaacuca

SEQ ID NO: 3999493 - RNA, 13 nt, Staphylococcus aureus subsp. aureus MW2
aauauauuuauuu

SEQ ID NO: 3999494 - RNA, 14 nt, Staphylococcus aureus subsp. aureus MW2
aauaucaaaauaua

SEQ ID NO: 3999495 - RNA, 18 nt, Staphylococcus aureus subsp. aureus MW2
aauaucaaaauauaaaau

SEQ ID NO: 3999496 - RNA, 19 nt, Staphylococcus aureus subsp. aureus MW2
aauaucaauaauucguuga

SEQ ID NO: 3999497 - RNA, 18 nt, Staphylococcus aureus subsp. aureus MW2
aauaucacuaauauauuu

SEQ ID NO: 3999498 - RNA, 16 nt, Staphylococcus aureus subsp. aureus MW2
aauaucauaaaugcau

SEQ ID NO: 3999499 - RNA, 16 nt, Staphylococcus aureus subsp. aureus MW2
aauaucauauucaaaa

SEQ ID NO: 3999500 - RNA, 13 nt, Staphylococcus aureus subsp. aureus MW2
aauaucauauuug

SEQ ID NO: 3999501 - RNA, 20 nt, Staphylococcus aureus subsp. aureus MW2
aauaucaucauuuaaauauu

SEQ ID NO: 3999502 - RNA, 12 nt, Staphylococcus aureus subsp. aureus MW2
aauaucauucau

SEQ ID NO: 3999503 - RNA, 15 nt, Staphylococcus aureus subsp. aureus MW2
aauauccaaaauccu

SEQ ID NO: 3999504 - RNA, 13 nt, Staphylococcus aureus subsp. aureus MW2
aaucaauuauuga

SEQ ID NO: 3999505 - RNA, 18 nt, Staphylococcus aureus subsp. aureus MW2
aaucaauugcauacguaa

SEQ ID NO: 3999506 - RNA, 20 nt, Staphylococcus aureus subsp. aureus MW2
aaucaauuuaucgagaacau

SEQ ID NO: 3999507 - RNA, 23 nt, Staphylococcus aureus subsp. aureus MW2
aaucaauuuaucgagaacaucau

SEQ ID NO: 3999508 - RNA, 20 nt, Staphylococcus aureus subsp. aureus MW2
aaucaauuucaccuuguaaa

SEQ ID NO: 3999509 - RNA, 14 nt, Staphylococcus aureus subsp. aureus MW2
aaucacaauacgaa

SEQ ID NO: 3999510 - RNA, 14 nt, Staphylococcus aureus subsp. aureus MW2
aaucacaguuauau

SEQ ID NO: 3999511 - RNA, 15 nt, Staphylococcus aureus subsp. aureus MW2
aaucacaguuauaua

SEQ ID NO: 3999512 - RNA, 18 nt, Staphylococcus aureus subsp. aureus MW2
aaucacaguuauauauua

SEQ ID NO: 3999513 - RNA, 20 nt, Staphylococcus aureus subsp. aureus MW2
aaucacaguuauauauuacu

SEQ ID NO: 3999514 - RNA, 20 nt, Staphylococcus aureus subsp. aureus MW2
aaucacauaacaaacauacc

SEQ ID NO: 3999515 - RNA, 12 nt, Staphylococcus aureus subsp. aureus MW2
aaucacaucuuu

SEQ ID NO: 3999516 - RNA, 18 nt, Staphylococcus aureus subsp. aureus MW2
aaucaccucaauaugagu

SEQ ID NO: 3999517 - RNA, 17 nt, Staphylococcus aureus subsp. aureus MW2
aaucaccuuuuuuaacu

SEQ ID NO: 3999518 - RNA, 20 nt, Staphylococcus aureus subsp. aureus MW2
aaucacgauuaaugucacau

SEQ ID NO: 3999519 - RNA, 14 nt, Staphylococcus aureus subsp. aureus MW2
aaucacgcuaacau

SEQ ID NO: 3999520 - RNA, 15 nt, Staphylococcus aureus subsp. aureus MW2
aaucacgcuaacauu

SEQ ID NO: 3999521 - RNA, 23 nt, Staphylococcus aureus subsp. aureus MW2
aaucacuauuuguuguuauauaa

SEQ ID NO: 3999522 - RNA, 22 nt, Staphylococcus aureus subsp. aureus MW2
aaucacuccucuauuuuaugau

SEQ ID NO: 3999523 - RNA, 23 nt, Staphylococcus aureus subsp. aureus MW2
aaucacuuggcgacauuuguaaa

SEQ ID NO: 3999524 - RNA, 16 nt, Staphylococcus aureus subsp. aureus MW2
aaucagaugauuuaau

SEQ ID NO: 3999525 - RNA, 18 nt, Staphylococcus aureus subsp. aureus MW2
aaucagaugauuuaauuc

SEQ ID NO: 3999526 - RNA, 15 nt, Staphylococcus aureus subsp. aureus MW2
aaucagcuuuucuuc

SEQ ID NO: 3999527 - RNA, 17 nt, Staphylococcus aureus subsp. aureus MW2
aaucagcuuuuucacau

SEQ ID NO: 3999528 - RNA, 24 nt, Staphylococcus aureus subsp. aureus MW2
aaucagcuuuuucacauugccuaa

SEQ ID NO: 3999529 - RNA, 15 nt, Staphylococcus aureus subsp. aureus MW2
aaucaggaauguuug

SEQ ID NO: 3999530 - RNA, 20 nt, Staphylococcus aureus subsp. aureus MW2
aaucagggacaaaaauucuu

SEQ ID NO: 3999531 - RNA, 22 nt, Staphylococcus aureus subsp. aureus MW2
aaucagguuuaaacaguuuaau

SEQ ID NO: 3999532 - RNA, 17 nt, Staphylococcus aureus subsp. aureus MW2
aaucaguaauaucaagg

SEQ ID NO: 3999533 - RNA, 21 nt, Staphylococcus aureus subsp. aureus MW2
aaucaguauaaucagcaaugu

SEQ ID NO: 3999534 - RNA, 21 nt, Staphylococcus aureus subsp. aureus MW2
aaucagucauucacauacauu

SEQ ID NO: 3999535 - RNA, 16 nt, Staphylococcus aureus subsp. aureus MW2
aaucagugaaauauca

SEQ ID NO: 3999536 - RNA, 20 nt, Staphylococcus aureus subsp. aureus MW2
aaucagugaaauaucaagau

SEQ ID NO: 3999537 - RNA, 21 nt, Staphylococcus aureus subsp. aureus MW2
aaucaguuucaucaaguauaa

SEQ ID NO: 3999538 - RNA, 18 nt, Staphylococcus aureus subsp. aureus MW2
aaucauaccggcaaauaa

SEQ ID NO: 3999539 - RNA, 23 nt, Staphylococcus aureus subsp. aureus MW2
aaucauaccggcaaauaacaaug

SEQ ID NO: 3999540 - RNA, 20 nt, Staphylococcus aureus subsp. aureus MW2
aaucauacgagaaauuagaa

SEQ ID NO: 3999541 - RNA, 17 nt, Staphylococcus aureus subsp. aureus MW2
aaucauagcauuaagau

SEQ ID NO: 3999542 - RNA, 19 nt, Staphylococcus aureus subsp. aureus MW2
aaucaucaagacauuuuaa

SEQ ID NO: 3999543 - RNA, 12 nt, Staphylococcus aureus subsp. aureus MW2
aaucaucacaca

SEQ ID NO: 3999544 - RNA, 16 nt, Staphylococcus aureus subsp. aureus MW2
aaucaucgaacaugaa

SEQ ID NO: 3999545 - RNA, 19 nt, Staphylococcus aureus subsp. aureus MW2
aaucaucgaacaugaauga

SEQ ID NO: 3999546 - RNA, 17 nt, Staphylococcus aureus subsp. aureus MW2
aaucaucgcaaaaacau

SEQ ID NO: 3999547 - RNA, 18 nt, Staphylococcus aureus subsp. aureus MW2
aaucaucguauuucauau

SEQ ID NO: 3999548 - RNA, 15 nt, Staphylococcus aureus subsp. aureus MW2
aaucaucuuuuugaa

SEQ ID NO: 3999549 - RNA, 17 nt, Staphylococcus aureus subsp. aureus MW2
aaucaucuuuuugaaau

SEQ ID NO: 3999550 - RNA, 15 nt, Staphylococcus aureus subsp. aureus MW2
aaucaugacauaaaa

SEQ ID NO: 3999551 - RNA, 13 nt, Staphylococcus aureus subsp. aureus MW2
aaucaugacauag

SEQ ID NO: 3999552 - RNA, 15 nt, Staphylococcus aureus subsp. aureus MW2
aaucaugcauucuau

SEQ ID NO: 3999553 - RNA, 21 nt, Staphylococcus aureus subsp. aureus MW2
aaucaugcucguuuuuauuca

SEQ ID NO: 3999554 - RNA, 18 nt, Staphylococcus aureus subsp. aureus MW2
aaucauguaaugcuuaaa

SEQ ID NO: 3999555 - RNA, 18 nt, Staphylococcus aureus subsp. aureus MW2
aaucauuaauaauuaaac

SEQ ID NO: 3999556 - RNA, 23 nt, Staphylococcus aureus subsp. aureus MW2
aaucauuagucaucaaccucauu

SEQ ID NO: 3999557 - RNA, 19 nt, Staphylococcus aureus subsp. aureus MW2
aaucauucacuucaaguug

SEQ ID NO: 3999558 - RNA, 22 nt, Staphylococcus aureus subsp. aureus MW2
aaucauuguaaaugaucaucgu

SEQ ID NO: 3999559 - RNA, 15 nt, Staphylococcus aureus subsp. aureus MW2
aaucauuguggcuuu

SEQ ID NO: 3999560 - RNA, 21 nt, Staphylococcus aureus subsp. aureus MW2
aaucauuguggcuuuuuuuau

SEQ ID NO: 3999561 - RNA, 14 nt, Staphylococcus aureus subsp. aureus MW2
aaucauuuguguau

SEQ ID NO: 3999562 - RNA, 23 nt, Staphylococcus aureus subsp. aureus MW2
aaucauuuguguauaaaugucau

SEQ ID NO: 3999563 - RNA, 19 nt, Staphylococcus aureus subsp. aureus MW2
aaucauuuucuugauuuua

SEQ ID NO: 3999564 - RNA, 21 nt, Staphylococcus aureus subsp. aureus MW2
aaucauuuuucgccaaaaacu

SEQ ID NO: 3999565 - RNA, 17 nt, Staphylococcus aureus subsp. aureus MW2
aauccaagugacaacau

SEQ ID NO: 3999566 - RNA, 13 nt, Staphylococcus aureus subsp. aureus MW2
aauccaaugauga

SEQ ID NO: 3999567 - RNA, 14 nt, Staphylococcus aureus subsp. aureus MW2
aauccaauuaaaua

SEQ ID NO: 3999568 - RNA, 22 nt, Staphylococcus aureus subsp. aureus MW2
aauccacaucccaauuuaaacu

SEQ ID NO: 3999569 - RNA, 19 nt, Staphylococcus aureus subsp. aureus MW2
aauccaguaaucaaagauu

SEQ ID NO: 3999570 - RNA, 23 nt, Staphylococcus aureus subsp. aureus MW2
aauccaucaauaccauaauuaaa

SEQ ID NO: 3999571 - RNA, 22 nt, Staphylococcus aureus subsp. aureus MW2
aaucccaaguuacgauaucaua

SEQ ID NO: 3999572 - RNA, 17 nt, Staphylococcus aureus subsp. aureus MW2
aaucccuucaacaguaa

SEQ ID NO: 3999573 - RNA, 23 nt, Staphylococcus aureus subsp. aureus MW2
aauccguaacgaugguugcuuca

SEQ ID NO: 3999574 - RNA, 22 nt, Staphylococcus aureus subsp. aureus MW2
aauccuaugaauaaauuguaau

SEQ ID NO: 3999575 - RNA, 21 nt, Staphylococcus aureus subsp. aureus MW2
aauccuauggcgcaauuuuua

SEQ ID NO: 3999576 - RNA, 22 nt, Staphylococcus aureus subsp. aureus MW2
aauccucacaaauuugaauaua

SEQ ID NO: 3999577 - RNA, 23 nt, Staphylococcus aureus subsp. aureus MW2
aauccucaguuauaccauauuua

SEQ ID NO: 3999578 - RNA, 13 nt, Staphylococcus aureus subsp. aureus MW2
aauccugauucca

SEQ ID NO: 3999579 - RNA, 14 nt, Staphylococcus aureus subsp. aureus MW2
aauccuucaucaau

SEQ ID NO: 3999580 - RNA, 20 nt, Staphylococcus aureus subsp. aureus MW2
aauccuuuauauuuaguuag

SEQ ID NO: 3999581 - RNA, 22 nt, Staphylococcus aureus subsp. aureus MW2
aauccuuuggacuccaucgcaa

SEQ ID NO: 3999582 - RNA, 13 nt, Staphylococcus aureus subsp. aureus MW2
aaucgaaauuucc

SEQ ID NO: 3999583 - RNA, 15 nt, Staphylococcus aureus subsp. aureus MW2
aaucgaguuugaaau

SEQ ID NO: 3999584 - RNA, 14 nt, Staphylococcus aureus subsp. aureus MW2
aaucgauaaaaugu

SEQ ID NO: 3999585 - RNA, 14 nt, Staphylococcus aureus subsp. aureus MW2
aaucgauaacaguu

SEQ ID NO: 3999586 - RNA, 19 nt, Staphylococcus aureus subsp. aureus MW2
aaucgauacuaauaucuuc

SEQ ID NO: 3999587 - RNA, 19 nt, Staphylococcus aureus subsp. aureus MW2
aaucggacagaugagcuca

SEQ ID NO: 3999588 - RNA, 23 nt, Staphylococcus aureus subsp. aureus MW2
aaucggacugauagaaaaaguuu

SEQ ID NO: 3999589 - RNA, 18 nt, Staphylococcus aureus subsp. aureus MW2
aaucggcuauacauugau

SEQ ID NO: 3999590 - RNA, 12 nt, Staphylococcus aureus subsp. aureus MW2
aaucguauugaa

SEQ ID NO: 3999591 - RNA, 14 nt, Staphylococcus aureus subsp. aureus MW2
aaucguuaaggaaa

SEQ ID NO: 3999592 - RNA, 20 nt, Staphylococcus aureus subsp. aureus MW2
aaugauagcuaaacauuuua

SEQ ID NO: 3999593 - RNA, 17 nt, Staphylococcus aureus subsp. aureus MW2
aaugauagugaauaaug

SEQ ID NO: 3999594 - RNA, 18 nt, Staphylococcus aureus subsp. aureus MW2
aaugauauauuacaucau

SEQ ID NO: 3999595 - RNA, 16 nt, Staphylococcus aureus subsp. aureus MW2
aaugaucagugaagcu

SEQ ID NO: 3999596 - RNA, 21 nt, Staphylococcus aureus subsp. aureus MW2
aaugaugacaucaauaucuuc

SEQ ID NO: 3999597 - RNA, 14 nt, Staphylococcus aureus subsp. aureus MW2
aaugaugauuuaaa

SEQ ID NO: 3999598 - RNA, 17 nt, Staphylococcus aureus subsp. aureus MW2
aaugauggguaguuaau

SEQ ID NO: 3999599 - RNA, 20 nt, Staphylococcus aureus subsp. aureus MW2
aaugauuaaaaaucaaagag

SEQ ID NO: 3999600 - RNA, 21 nt, Staphylococcus aureus subsp. aureus MW2
aaugauuacuuuaagauuauu

SEQ ID NO: 3999601 - RNA, 12 nt, Staphylococcus aureus subsp. aureus MW2
aaugauuauaaa

SEQ ID NO: 3999602 - RNA, 14 nt, Staphylococcus aureus subsp. aureus MW2
aaugauuauaaaua

SEQ ID NO: 3999603 - RNA, 15 nt, Staphylococcus aureus subsp. aureus MW2
aaugauugcauugau

SEQ ID NO: 3999604 - RNA, 17 nt, Staphylococcus aureus subsp. aureus MW2
aaugauugcauugauuu

SEQ ID NO: 3999605 - RNA, 22 nt, Staphylococcus aureus subsp. aureus MW2
aaugauugucuuauaagauaua

SEQ ID NO: 3999606 - RNA, 22 nt, Staphylococcus aureus subsp. aureus MW2
aaugauuuaauuuguuauacca

SEQ ID NO: 3999607 - RNA, 19 nt, Staphylococcus aureus subsp. aureus MW2
aaugauuugugguaaucau

SEQ ID NO: 3999608 - RNA, 13 nt, Staphylococcus aureus subsp. aureus MW2
aaugauuuugcuu

SEQ ID NO: 3999609 - RNA, 16 nt, Staphylococcus aureus subsp. aureus MW2
aaugcaacuaaaacua

SEQ ID NO: 3999610 - RNA, 16 nt, Staphylococcus aureus subsp. aureus MW2
aaugcaacuugaucau

SEQ ID NO: 3999611 - RNA, 21 nt, Staphylococcus aureus subsp. aureus MW2
aaugcaaguuggcggggcccc

SEQ ID NO: 3999612 - RNA, 17 nt, Staphylococcus aureus subsp. aureus MW2
aaugcaauauguaacaa

SEQ ID NO: 3999613 - RNA, 16 nt, Staphylococcus aureus subsp. aureus MW2
aaugcaccugugauaa

SEQ ID NO: 3999614 - RNA, 23 nt, Staphylococcus aureus subsp. aureus MW2
aaugcacgcgugccaacaucuuc

SEQ ID NO: 3999615 - RNA, 19 nt, Staphylococcus aureus subsp. aureus MW2
aaugcacuagcaacaucuu

SEQ ID NO: 3999616 - RNA, 23 nt, Staphylococcus aureus subsp. aureus MW2
aaugcagauucuucaccaacuuu

SEQ ID NO: 3999617 - RNA, 20 nt, Staphylococcus aureus subsp. aureus MW2
aaugcagcuguauaaccaua

SEQ ID NO: 3999618 - RNA, 21 nt, Staphylococcus aureus subsp. aureus MW2
aaugcaucaguauuaggauuu

SEQ ID NO: 3999619 - RNA, 16 nt, Staphylococcus aureus subsp. aureus MW2
aaugcaugugaaauua

SEQ ID NO: 3999620 - RNA, 21 nt, Staphylococcus aureus subsp. aureus MW2
aaugcauguggacguugaucu

SEQ ID NO: 3999621 - RNA, 16 nt, Staphylococcus aureus subsp. aureus MW2
aaugcauugcacuugu

SEQ ID NO: 3999622 - RNA, 13 nt, Staphylococcus aureus subsp. aureus MW2
aaugccauaccug

SEQ ID NO: 3999623 - RNA, 21 nt, Staphylococcus aureus subsp. aureus MW2
aaugccauuguuauccaaaac

SEQ ID NO: 3999624 - RNA, 23 nt, Staphylococcus aureus subsp. aureus MW2
aaugccauuguuauccaaaacau

SEQ ID NO: 3999625 - RNA, 15 nt, Staphylococcus aureus subsp. aureus MW2
aaugccuaauuuugu

SEQ ID NO: 3999626 - RNA, 18 nt, Staphylococcus aureus subsp. aureus MW2
aaugcgaagauuuuuaac

SEQ ID NO: 3999627 - RNA, 16 nt, Staphylococcus aureus subsp. aureus MW2
aaugcgaguuggggug

SEQ ID NO: 3999628 - RNA, 13 nt, Staphylococcus aureus subsp. aureus MW2
aaugcgcaaugaa

SEQ ID NO: 3999629 - RNA, 19 nt, Staphylococcus aureus subsp. aureus MW2
aaugcuaauacuaaucaaa

SEQ ID NO: 3999630 - RNA, 19 nt, Staphylococcus aureus subsp. aureus MW2
aaugcuacaucaauauugu

SEQ ID NO: 3999631 - RNA, 19 nt, Staphylococcus aureus subsp. aureus MW2
aaugcuaguaacuuaucug

SEQ ID NO: 3999632 - RNA, 13 nt, Staphylococcus aureus subsp. aureus MW2
aaugcuaucaugc

SEQ ID NO: 3999633 - RNA, 15 nt, Staphylococcus aureus subsp. aureus MW2
aaugcucuauauauc

SEQ ID NO: 3999634 - RNA, 20 nt, Staphylococcus aureus subsp. aureus MW2
aaugcucuauauauccauuc

SEQ ID NO: 3999635 - RNA, 18 nt, Staphylococcus aureus subsp. aureus MW2
aaugcuucuucuacagau

SEQ ID NO: 3999636 - RNA, 18 nt, Staphylococcus aureus subsp. aureus MW2
aaugcuugaauuuuauua

SEQ ID NO: 3999637 - RNA, 22 nt, Staphylococcus aureus subsp. aureus MW2
aaugcuuucgcauuauuugcug

SEQ ID NO: 3999638 - RNA, 16 nt, Staphylococcus aureus subsp. aureus MW2
aauggaugaauauauu

SEQ ID NO: 3999639 - RNA, 19 nt, Staphylococcus aureus subsp. aureus MW2
aauggauuauuaugccuuu

SEQ ID NO: 3999640 - RNA, 19 nt, Staphylococcus aureus subsp. aureus MW2
aauggcaaucuauauaaau

SEQ ID NO: 3999641 - RNA, 19 nt, Staphylococcus aureus subsp. aureus MW2
aauggcgugcuuuucaaac

SEQ ID NO: 3999642 - RNA, 15 nt, Staphylococcus aureus subsp. aureus MW2
aaugggcgugccauu

SEQ ID NO: 3999643 - RNA, 20 nt, Staphylococcus aureus subsp. aureus MW2
aaugggcgugccauuaaaau

SEQ ID NO: 3999644 - RNA, 15 nt, Staphylococcus aureus subsp. aureus MW2
aauggggacauguuc

SEQ ID NO: 3999645 - RNA, 14 nt, Staphylococcus aureus subsp. aureus MW2
aaugggucauuaaa

SEQ ID NO: 3999646 - RNA, 21 nt, Staphylococcus aureus subsp. aureus MW2
aaugguaguuagguaaaaauu

SEQ ID NO: 3999647 - RNA, 22 nt, Staphylococcus aureus subsp. aureus MW2
aaugguaucuaaaugugaaaga

SEQ ID NO: 3999648 - RNA, 16 nt, Staphylococcus aureus subsp. aureus MW2
aauggucgugcuugcg

SEQ ID NO: 3999649 - RNA, 14 nt, Staphylococcus aureus subsp. aureus MW2
aaugguucuaaaau

SEQ ID NO: 3999650 - RNA, 19 nt, Staphylococcus aureus subsp. aureus MW2
aaugguugauuugauuuaa

SEQ ID NO: 3999651 - RNA, 13 nt, Staphylococcus aureus subsp. aureus MW2
aaugguuucaaaa

SEQ ID NO: 3999652 - RNA, 15 nt, Staphylococcus aureus subsp. aureus MW2
aaugguuucaaaauc

SEQ ID NO: 3999653 - RNA, 19 nt, Staphylococcus aureus subsp. aureus MW2
aaugguuucauaaacugaa

SEQ ID NO: 3999654 - RNA, 14 nt, Staphylococcus aureus subsp. aureus MW2
aauguaaaaugaug

SEQ ID NO: 3999655 - RNA, 22 nt, Staphylococcus aureus subsp. aureus MW2
aauguaaucacuucugaaaaua

SEQ ID NO: 3999656 - RNA, 19 nt, Staphylococcus aureus subsp. aureus MW2
aauguaauuauugcaucau

SEQ ID NO: 3999657 - RNA, 18 nt, Staphylococcus aureus subsp. aureus MW2
aauguacauuguaaauau

SEQ ID NO: 3999658 - RNA, 21 nt, Staphylococcus aureus subsp. aureus MW2
aauguaccgaauccuucauca

SEQ ID NO: 3999659 - RNA, 22 nt, Staphylococcus aureus subsp. aureus MW2
aauguacuuuucugucuguaaa

SEQ ID NO: 3999660 - RNA, 21 nt, Staphylococcus aureus subsp. aureus MW2
aauguaggcgccauaaucauu

SEQ ID NO: 3999661 - RNA, 14 nt, Staphylococcus aureus subsp. aureus MW2
aauguaugacauaa

SEQ ID NO: 3999662 - RNA, 22 nt, Staphylococcus aureus subsp. aureus MW2
aauguauucagucaguaaaaau

SEQ ID NO: 3999663 - RNA, 23 nt, Staphylococcus aureus subsp. aureus MW2
aaugucauagccuauuuaaaaga

SEQ ID NO: 3999664 - RNA, 20 nt, Staphylococcus aureus subsp. aureus MW2
aauguccgauuugauaaaaa

SEQ ID NO: 3999665 - RNA, 18 nt, Staphylococcus aureus subsp. aureus MW2
aaugucgaucuaacaauu

SEQ ID NO: 3999666 - RNA, 22 nt, Staphylococcus aureus subsp. aureus MW2
aaugucgcacuauaaaauucac

SEQ ID NO: 3999667 - RNA, 15 nt, Staphylococcus aureus subsp. aureus MW2
aaugucguauaugua

SEQ ID NO: 3999668 - RNA, 15 nt, Staphylococcus aureus subsp. aureus MW2
aaugucuaaaaaaau

SEQ ID NO: 3999669 - RNA, 18 nt, Staphylococcus aureus subsp. aureus MW2
aaugucuaaaaaaauguu

SEQ ID NO: 3999670 - RNA, 15 nt, Staphylococcus aureus subsp. aureus MW2
aaugucuaaaaaugu

SEQ ID NO: 3999671 - RNA, 19 nt, Staphylococcus aureus subsp. aureus MW2
aaugucucuuuucacgaau

SEQ ID NO: 3999672 - RNA, 22 nt, Staphylococcus aureus subsp. aureus MW2
aaugugagauacguuauuucaa

SEQ ID NO: 3999673 - RNA, 17 nt, Staphylococcus aureus subsp. aureus MW2
aaugugagauauaaagg

SEQ ID NO: 3999674 - RNA, 14 nt, Staphylococcus aureus subsp. aureus MW2
aaugugaugauuaa

SEQ ID NO: 3999675 - RNA, 18 nt, Staphylococcus aureus subsp. aureus MW2
aaugugaugguucaaaua

SEQ ID NO: 3999676 - RNA, 16 nt, Staphylococcus aureus subsp. aureus MW2
aaugugauuuucuuuc

SEQ ID NO: 3999677 - RNA, 18 nt, Staphylococcus aureus subsp. aureus MW2
aaugugauuuucuuucau

SEQ ID NO: 3999678 - RNA, 15 nt, Staphylococcus aureus subsp. aureus MW2
aaugugcauugcuuu

SEQ ID NO: 3999679 - RNA, 19 nt, Staphylococcus aureus subsp. aureus MW2
aaugugcauugcuuuuguu

SEQ ID NO: 3999680 - RNA, 13 nt, Staphylococcus aureus subsp. aureus MW2
aauuacuuauuca

SEQ ID NO: 3999681 - RNA, 19 nt, Staphylococcus aureus subsp. aureus MW2
aauuacuuauucaaauguu

SEQ ID NO: 3999682 - RNA, 20 nt, Staphylococcus aureus subsp. aureus MW2
aauuacuugaauauuauuca

SEQ ID NO: 3999683 - RNA, 21 nt, Staphylococcus aureus subsp. aureus MW2
aauuacuugcacaccagugcc

SEQ ID NO: 3999684 - RNA, 19 nt, Staphylococcus aureus subsp. aureus MW2
aauuagaaaaauaugauug

SEQ ID NO: 3999685 - RNA, 13 nt, Staphylococcus aureus subsp. aureus MW2
aauuagaaccauc

SEQ ID NO: 3999686 - RNA, 23 nt, Staphylococcus aureus subsp. aureus MW2
aauuagaauauauguauaacaau

SEQ ID NO: 3999687 - RNA, 12 nt, Staphylococcus aureus subsp. aureus MW2
aauuagauaaaa

SEQ ID NO: 3999688 - RNA, 16 nt, Staphylococcus aureus subsp. aureus MW2
aauuagauaaaacaaa

SEQ ID NO: 3999689 - RNA, 17 nt, Staphylococcus aureus subsp. aureus MW2
aauuagaucuaugguua

SEQ ID NO: 3999690 - RNA, 21 nt, Staphylococcus aureus subsp. aureus MW2
aauuagauuuuaugcuuuacu

SEQ ID NO: 3999691 - RNA, 16 nt, Staphylococcus aureus subsp. aureus MW2
aauuagccauuucaau

SEQ ID NO: 3999692 - RNA, 22 nt, Staphylococcus aureus subsp. aureus MW2
aauuagcgauacuuuuaaaauc

SEQ ID NO: 3999693 - RNA, 17 nt, Staphylococcus aureus subsp. aureus MW2
aauuaggauuaacauaa

SEQ ID NO: 3999694 - RNA, 22 nt, Staphylococcus aureus subsp. aureus MW2
aauuagggguggaaauaugaaa

SEQ ID NO: 3999695 - RNA, 15 nt, Staphylococcus aureus subsp. aureus MW2
aauuaguacuugaaa

SEQ ID NO: 3999696 - RNA, 22 nt, Staphylococcus aureus subsp. aureus MW2
aauuaguacuugaaacaucuug

SEQ ID NO: 3999697 - RNA, 20 nt, Staphylococcus aureus subsp. aureus MW2
aauuagucauccaaagaaac

SEQ ID NO: 3999698 - RNA, 14 nt, Staphylococcus aureus subsp. aureus MW2
aauuagucauugaa

SEQ ID NO: 3999699 - RNA, 14 nt, Staphylococcus aureus subsp. aureus MW2
aauuagucccauua

SEQ ID NO: 3999700 - RNA, 18 nt, Staphylococcus aureus subsp. aureus MW2
aauuagucccauuaacac

SEQ ID NO: 3999701 - RNA, 16 nt, Staphylococcus aureus subsp. aureus MW2
aauuauaaaugauuaa

SEQ ID NO: 3999702 - RNA, 17 nt, Staphylococcus aureus subsp. aureus MW2
aauuauaaaugauuaaa

SEQ ID NO: 3999703 - RNA, 12 nt, Staphylococcus aureus subsp. aureus MW2
aauuauaauaaa

SEQ ID NO: 3999704 - RNA, 22 nt, Staphylococcus aureus subsp. aureus MW2
aauuauaauaaaacuugugaua

SEQ ID NO: 3999705 - RNA, 20 nt, Staphylococcus aureus subsp. aureus MW2
aauuaucagaaucaaguaau

SEQ ID NO: 3999706 - RNA, 18 nt, Staphylococcus aureus subsp. aureus MW2
aauuauccuacugcuguc

SEQ ID NO: 3999707 - RNA, 15 nt, Staphylococcus aureus subsp. aureus MW2
aauuaucuucaucau

SEQ ID NO: 3999708 - RNA, 20 nt, Staphylococcus aureus subsp. aureus MW2
aauuaugaucaauaagauuu

SEQ ID NO: 3999709 - RNA, 15 nt, Staphylococcus aureus subsp. aureus MW2
aauuauguaaaaaau

SEQ ID NO: 3999710 - RNA, 20 nt, Staphylococcus aureus subsp. aureus MW2
aauuauguauuuuuauuuau

SEQ ID NO: 3999711 - RNA, 13 nt, Staphylococcus aureus subsp. aureus MW2
aauuauuauaaua

SEQ ID NO: 3999712 - RNA, 15 nt, Staphylococcus aureus subsp. aureus MW2
aauuauuauaauaaa

SEQ ID NO: 3999713 - RNA, 19 nt, Staphylococcus aureus subsp. aureus MW2
aauuauuauaauaaauaga

SEQ ID NO: 3999714 - RNA, 18 nt, Staphylococcus aureus subsp. aureus MW2
aauuauuauaguuuagau

SEQ ID NO: 3999715 - RNA, 20 nt, Staphylococcus aureus subsp. aureus MW2
aauuauuauuuaaauuuuca

SEQ ID NO: 3999716 - RNA, 19 nt, Staphylococcus aureus subsp. aureus MW2
aauuauucaaguaaaacau

SEQ ID NO: 3999717 - RNA, 21 nt, Staphylococcus aureus subsp. aureus MW2
aauuauucaugaaucgaacua

SEQ ID NO: 3999718 - RNA, 21 nt, Staphylococcus aureus subsp. aureus MW2
aauuauuccuucauugaagaa

SEQ ID NO: 3999719 - RNA, 18 nt, Staphylococcus aureus subsp. aureus MW2
aauuauugagaauauuua

SEQ ID NO: 3999720 - RNA, 16 nt, Staphylococcus aureus subsp. aureus MW2
aauuauuuauuguucu

SEQ ID NO: 3999721 - RNA, 14 nt, Staphylococcus aureus subsp. aureus MW2
aauuauuucccugg

SEQ ID NO: 3999722 - RNA, 22 nt, Staphylococcus aureus subsp. aureus MW2
aauuauuucccuggaaaaugau

SEQ ID NO: 3999723 - RNA, 23 nt, Staphylococcus aureus subsp. aureus MW2
aauuauuucccuggaaaaugauu

SEQ ID NO: 3999724 - RNA, 22 nt, Staphylococcus aureus subsp. aureus MW2
aauuauuucuagcauguaagcu

SEQ ID NO: 3999725 - RNA, 17 nt, Staphylococcus aureus subsp. aureus MW2
aauuauuugauagaaau

SEQ ID NO: 3999726 - RNA, 18 nt, Staphylococcus aureus subsp. aureus MW2
aauucaaaaugccaagaa

SEQ ID NO: 3999727 - RNA, 15 nt, Staphylococcus aureus subsp. aureus MW2
aauucaaauuauaau

SEQ ID NO: 3999728 - RNA, 19 nt, Staphylococcus aureus subsp. aureus MW2
aauucaacgucaucaaaac

SEQ ID NO: 3999729 - RNA, 18 nt, Staphylococcus aureus subsp. aureus MW2
aauucaauugcuaaauca

SEQ ID NO: 3999730 - RNA, 16 nt, Staphylococcus aureus subsp. aureus MW2
aauucacuuuuaacug

SEQ ID NO: 3999731 - RNA, 15 nt, Staphylococcus aureus subsp. aureus MW2
aauucagaugaauaa

SEQ ID NO: 3999732 - RNA, 19 nt, Staphylococcus aureus subsp. aureus MW2
aauucaggauggaaugaua

SEQ ID NO: 3999733 - RNA, 17 nt, Staphylococcus aureus subsp. aureus MW2
aauucauuccaaacaca

SEQ ID NO: 3999734 - RNA, 21 nt, Staphylococcus aureus subsp. aureus MW2
aauuccccaaagccuucuauc

SEQ ID NO: 3999735 - RNA, 18 nt, Staphylococcus aureus subsp. aureus MW2
aauuccucccuuuacuuu

SEQ ID NO: 3999736 - RNA, 21 nt, Staphylococcus aureus subsp. aureus MW2
aauuccucccuuuacuuuaua

SEQ ID NO: 3999737 - RNA, 21 nt, Staphylococcus aureus subsp. aureus MW2
aauucgcaagccuucuauaua

SEQ ID NO: 3999738 - RNA, 22 nt, Staphylococcus aureus subsp. aureus MW2
aauucgcucacaugugaaauaa

SEQ ID NO: 3999739 - RNA, 20 nt, Staphylococcus aureus subsp. aureus MW2
aauucgucuguuucauauau

SEQ ID NO: 3999740 - RNA, 13 nt, Staphylococcus aureus subsp. aureus MW2
aauucguugauuu

SEQ ID NO: 3999741 - RNA, 19 nt, Staphylococcus aureus subsp. aureus MW2
aauucguuuugcuaaccau

SEQ ID NO: 3999742 - RNA, 22 nt, Staphylococcus aureus subsp. aureus MW2
aauucguuuugcuaaccaucau

SEQ ID NO: 3999743 - RNA, 14 nt, Staphylococcus aureus subsp. aureus MW2
aauucuaacuugaa

SEQ ID NO: 3999744 - RNA, 12 nt, Staphylococcus aureus subsp. aureus MW2
aauucuacagaa

SEQ ID NO: 3999745 - RNA, 13 nt, Staphylococcus aureus subsp. aureus MW2
aauucuacaggca

SEQ ID NO: 3999746 - RNA, 19 nt, Staphylococcus aureus subsp. aureus MW2
aauucuacaggcaaugcaa

SEQ ID NO: 3999747 - RNA, 19 nt, Staphylococcus aureus subsp. aureus MW2
aauucuagucaggggcccc

SEQ ID NO: 3999748 - RNA, 20 nt, Staphylococcus aureus subsp. aureus MW2
aauucucuguguuggggccc

SEQ ID NO: 3999749 - RNA, 14 nt, Staphylococcus aureus subsp. aureus MW2
aauucugguuuaau

SEQ ID NO: 3999750 - RNA, 17 nt, Staphylococcus aureus subsp. aureus MW2
aauucugugagguaaaa

SEQ ID NO: 3999751 - RNA, 21 nt, Staphylococcus aureus subsp. aureus MW2
aauucuucaaccauuuguucu

SEQ ID NO: 3999752 - RNA, 12 nt, Staphylococcus aureus subsp. aureus MW2
aauucuucauca

SEQ ID NO: 3999753 - RNA, 21 nt, Staphylococcus aureus subsp. aureus MW2
aauucuucaucuucuucaaaa

SEQ ID NO: 3999754 - RNA, 21 nt, Staphylococcus aureus subsp. aureus MW2
aauucuucuuuagauugucca

SEQ ID NO: 3999755 - RNA, 13 nt, Staphylococcus aureus subsp. aureus MW2
aauucuuguaaau

SEQ ID NO: 3999756 - RNA, 17 nt, Staphylococcus aureus subsp. aureus MW2
aauucuuguaaaucaua

SEQ ID NO: 3999757 - RNA, 16 nt, Staphylococcus aureus subsp. aureus MW2
aauucuuguuugauuu

SEQ ID NO: 3999758 - RNA, 24 nt, Staphylococcus aureus subsp. aureus MW2
aauucuuuuagaauucuaaauaau

SEQ ID NO: 3999759 - RNA, 18 nt, Staphylococcus aureus subsp. aureus MW2
aauucuuuucaagaaauu

SEQ ID NO: 3999760 - RNA, 18 nt, Staphylococcus aureus subsp. aureus MW2
aauucuuuuucagcuaau

SEQ ID NO: 3999761 - RNA, 11 nt, Staphylococcus aureus subsp. aureus MW2
aauugaaaauc

SEQ ID NO: 3999762 - RNA, 15 nt, Staphylococcus aureus subsp. aureus MW2
aauugaaaugauaaa

SEQ ID NO: 3999763 - RNA, 15 nt, Staphylococcus aureus subsp. aureus MW2
aauugaaauuaacug

SEQ ID NO: 3999764 - RNA, 18 nt, Staphylococcus aureus subsp. aureus MW2
aauugaaauuaacuguau

SEQ ID NO: 3999765 - RNA, 16 nt, Staphylococcus aureus subsp. aureus MW2
aauugaagugaaauug

SEQ ID NO: 3999766 - RNA, 14 nt, Staphylococcus aureus subsp. aureus MW2
aauugaauuaugau

SEQ ID NO: 3999767 - RNA, 21 nt, Staphylococcus aureus subsp. aureus MW2
aauugaauuucgcacaauguu

SEQ ID NO: 3999768 - RNA, 15 nt, Staphylococcus aureus subsp. aureus MW2
aauuuagucauuaca

SEQ ID NO: 3999769 - RNA, 18 nt, Staphylococcus aureus subsp. aureus MW2
aauuuagucauuacaaau

SEQ ID NO: 3999770 - RNA, 17 nt, Staphylococcus aureus subsp. aureus MW2
aauuuauaaugauuaaa

SEQ ID NO: 3999771 - RNA, 15 nt, Staphylococcus aureus subsp. aureus MW2
aauuuauaauuugua

SEQ ID NO: 3999772 - RNA, 12 nt, Staphylococcus aureus subsp. aureus MW2
aauuuauauaua

SEQ ID NO: 3999773 - RNA, 18 nt, Staphylococcus aureus subsp. aureus MW2
aauuuaucaauuucuauu

SEQ ID NO: 3999774 - RNA, 13 nt, Staphylococcus aureus subsp. aureus MW2
aauuuaucauuau

SEQ ID NO: 3999775 - RNA, 14 nt, Staphylococcus aureus subsp. aureus MW2
aauuuaucuuaauc

SEQ ID NO: 3999776 - RNA, 22 nt, Staphylococcus aureus subsp. aureus MW2
aauuuaugauuguuuauucguu

SEQ ID NO: 3999777 - RNA, 22 nt, Staphylococcus aureus subsp. aureus MW2
aauuuauuaaaacgaaguuauu

SEQ ID NO: 3999778 - RNA, 13 nt, Staphylococcus aureus subsp. aureus MW2
aauuuauuauaaa

SEQ ID NO: 3999779 - RNA, 16 nt, Staphylococcus aureus subsp. aureus MW2
aauuuauuauaaaaua

SEQ ID NO: 3999780 - RNA, 22 nt, Staphylococcus aureus subsp. aureus MW2
aauuuauuauaaaauagaagua

SEQ ID NO: 3999781 - RNA, 12 nt, Staphylococcus aureus subsp. aureus MW2
aauuuauuauua

SEQ ID NO: 3999782 - RNA, 19 nt, Staphylococcus aureus subsp. aureus MW2
aauuuauuuauuuugauuu

SEQ ID NO: 3999783 - RNA, 23 nt, Staphylococcus aureus subsp. aureus MW2
aauuuauuuuuaauuucugguaa

SEQ ID NO: 3999784 - RNA, 22 nt, Staphylococcus aureus subsp. aureus MW2
aauuucaaacgcaccuggcaca

SEQ ID NO: 3999785 - RNA, 21 nt, Staphylococcus aureus subsp. aureus MW2
aauuucaagguauacacaaau

SEQ ID NO: 3999786 - RNA, 15 nt, Staphylococcus aureus subsp. aureus MW2
aauuucaaugucugc

SEQ ID NO: 3999787 - RNA, 17 nt, Staphylococcus aureus subsp. aureus MW2
aauuucaccuuguaaau

SEQ ID NO: 3999788 - RNA, 19 nt, Staphylococcus aureus subsp. aureus MW2
aauuucaguaccauguuuu

SEQ ID NO: 3999789 - RNA, 20 nt, Staphylococcus aureus subsp. aureus MW2
aauuucauaaaguuuauuua

SEQ ID NO: 3999790 - RNA, 16 nt, Staphylococcus aureus subsp. aureus MW2
aauuucaucaaaucca

SEQ ID NO: 3999791 - RNA, 22 nt, Staphylococcus aureus subsp. aureus MW2
aauuuccugcagucauuugauu

SEQ ID NO: 3999792 - RNA, 14 nt, Staphylococcus aureus subsp. aureus MW2
aauuucgaaaagaa

SEQ ID NO: 3999793 - RNA, 21 nt, Staphylococcus aureus subsp. aureus MW2
aauuucgacaucuagaugaaa

SEQ ID NO: 3999794 - RNA, 23 nt, Staphylococcus aureus subsp. aureus MW2
aauuucgacaucuagaugaaauu

SEQ ID NO: 3999795 - RNA, 19 nt, Staphylococcus aureus subsp. aureus MW2
aauuucgacuccauuagcu

SEQ ID NO: 3999796 - RNA, 13 nt, Staphylococcus aureus subsp. aureus MW2
aauuucgcacaau

SEQ ID NO: 3999797 - RNA, 14 nt, Staphylococcus aureus subsp. aureus MW2
aauuucgcaguagc

SEQ ID NO: 3999798 - RNA, 20 nt, Staphylococcus aureus subsp. aureus MW2
aauuucguuuuauuaaugaa

SEQ ID NO: 3999799 - RNA, 21 nt, Staphylococcus aureus subsp. aureus MW2
aauuucguuuuauuaaugaag

SEQ ID NO: 3999800 - RNA, 14 nt, Staphylococcus aureus subsp. aureus MW2
aauuucuacagaca

SEQ ID NO: 3999801 - RNA, 14 nt, Staphylococcus aureus subsp. aureus MW2
aauuucuacugaca

SEQ ID NO: 3999802 - RNA, 14 nt, Staphylococcus aureus subsp. aureus MW2
aauuucuaugaaaa

SEQ ID NO: 3999803 - RNA, 19 nt, Staphylococcus aureus subsp. aureus MW2
aauuucucccguuugauuu

SEQ ID NO: 3999804 - RNA, 13 nt, Staphylococcus aureus subsp. aureus MW2
aauuucucugugu

SEQ ID NO: 3999805 - RNA, 17 nt, Staphylococcus aureus subsp. aureus MW2
aauuucucuguguuggg

SEQ ID NO: 3999806 - RNA, 11 nt, Staphylococcus aureus subsp. aureus MW2
aauuucuuuuc

SEQ ID NO: 3999807 - RNA, 13 nt, Staphylococcus aureus subsp. aureus MW2
aauuugaaauaua

SEQ ID NO: 3999808 - RNA, 17 nt, Staphylococcus aureus subsp. aureus MW2
aauuugaaauauaccaa

SEQ ID NO: 3999809 - RNA, 12 nt, Staphylococcus aureus subsp. aureus MW2
aauuugaaauug

SEQ ID NO: 3999810 - RNA, 12 nt, Staphylococcus aureus subsp. aureus MW2
aauuugauuaaa

SEQ ID NO: 3999811 - RNA, 17 nt, Staphylococcus aureus subsp. aureus MW2
aauuugauuaaauucau

SEQ ID NO: 3999812 - RNA, 16 nt, Staphylococcus aureus subsp. aureus MW2
aauuugcaaaaucaac

SEQ ID NO: 3999813 - RNA, 16 nt, Staphylococcus aureus subsp. aureus MW2
aauuugcauaacauug

SEQ ID NO: 3999814 - RNA, 18 nt, Staphylococcus aureus subsp. aureus MW2
aauuugguaggcauuuua

SEQ ID NO: 3999815 - RNA, 17 nt, Staphylococcus aureus subsp. aureus MW2
aauuugguuaacauccu

SEQ ID NO: 3999816 - RNA, 14 nt, Staphylococcus aureus subsp. aureus MW2
aauuuguaauacaa

SEQ ID NO: 3999817 - RNA, 14 nt, Staphylococcus aureus subsp. aureus MW2
aauuuguauuuaaa

SEQ ID NO: 3999818 - RNA, 15 nt, Staphylococcus aureus subsp. aureus MW2
aauuuguauuuaaaa

SEQ ID NO: 3999819 - RNA, 18 nt, Staphylococcus aureus subsp. aureus MW2
aauuugugauuaugcaua

SEQ ID NO: 3999820 - RNA, 15 nt, Staphylococcus aureus subsp. aureus MW2
aauuuguuuuaaaua

SEQ ID NO: 3999821 - RNA, 16 nt, Staphylococcus aureus subsp. aureus MW2
aauuuguuuuaaauac

SEQ ID NO: 3999822 - RNA, 21 nt, Staphylococcus aureus subsp. aureus MW2
aauuuuaaauauugauauaaa

SEQ ID NO: 3999823 - RNA, 11 nt, Staphylococcus aureus subsp. aureus MW2
aauuuuaaauc

SEQ ID NO: 3999824 - RNA, 16 nt, Staphylococcus aureus subsp. aureus MW2
aauuuuaacuuauaua

SEQ ID NO: 3999825 - RNA, 22 nt, Staphylococcus aureus subsp. aureus MW2
aauuuuaucuaaagcuauaaaa

SEQ ID NO: 3999826 - RNA, 17 nt, Staphylococcus aureus subsp. aureus MW2
aauuuuaucugaaucug

SEQ ID NO: 3999827 - RNA, 15 nt, Staphylococcus aureus subsp. aureus MW2
aauuuuaugaaucga

SEQ ID NO: 3999828 - RNA, 22 nt, Staphylococcus aureus subsp. aureus MW2
aauuuuaugucccaaugcugaa

SEQ ID NO: 3999829 - RNA, 20 nt, Staphylococcus aureus subsp. aureus MW2
aauuuucagcaucuacuaaa

SEQ ID NO: 3999830 - RNA, 12 nt, Staphylococcus aureus subsp. aureus MW2
aauuuucuauua

SEQ ID NO: 3999831 - RNA, 15 nt, Staphylococcus aureus subsp. aureus MW2
aauuuucucaaacua

SEQ ID NO: 3999832 - RNA, 20 nt, Staphylococcus aureus subsp. aureus MW2
aauuuucucaaacuaucuua

SEQ ID NO: 3999833 - RNA, 16 nt, Staphylococcus aureus subsp. aureus MW2
aauuuucuguccaaaa

SEQ ID NO: 3999834 - RNA, 15 nt, Staphylococcus aureus subsp. aureus MW2
aauuuucuugccauc

SEQ ID NO: 3999835 - RNA, 12 nt, Staphylococcus aureus subsp. aureus MW2
aauuuugaagaa

SEQ ID NO: 3999836 - RNA, 20 nt, Staphylococcus aureus subsp. aureus MW2
aauuuugacgcucagguaua

SEQ ID NO: 3999837 - RNA, 13 nt, Staphylococcus aureus subsp. aureus MW2
aauuuugagaaaa

SEQ ID NO: 3999838 - RNA, 13 nt, Staphylococcus aureus subsp. aureus MW2
aauuuugauauag

SEQ ID NO: 3999839 - RNA, 16 nt, Staphylococcus aureus subsp. aureus MW2
aauuuuguaaccugau

SEQ ID NO: 3999840 - RNA, 19 nt, Staphylococcus aureus subsp. aureus MW2
aauuuuguacauaaaaaua

SEQ ID NO: 3999841 - RNA, 14 nt, Staphylococcus aureus subsp. aureus MW2
aauuuuuaaacaaa

SEQ ID NO: 3999842 - RNA, 13 nt, Staphylococcus aureus subsp. aureus MW2
aauuuuuaacaaa

SEQ ID NO: 3999843 - RNA, 17 nt, Staphylococcus aureus subsp. aureus MW2
aauuuuuaacaaaauau

SEQ ID NO: 3999844 - RNA, 18 nt, Staphylococcus aureus subsp. aureus MW2
aauuuuuauccaagucua

SEQ ID NO: 3999845 - RNA, 19 nt, Staphylococcus aureus subsp. aureus MW2
aauuuuuccaacuucuuuu

SEQ ID NO: 3999846 - RNA, 12 nt, Staphylococcus aureus subsp. aureus MW2
aauuuuucuuua

SEQ ID NO: 3999847 - RNA, 15 nt, Staphylococcus aureus subsp. aureus MW2
aauuuuuuauuaaga

SEQ ID NO: 3999848 - RNA, 21 nt, Staphylococcus aureus subsp. aureus MW2
aauuuuuucaucauucaaacu

SEQ ID NO: 3999849 - RNA, 16 nt, Staphylococcus aureus subsp. aureus MW2
aauuuuuuggaaacau

SEQ ID NO: 3999850 - RNA, 14 nt, Staphylococcus aureus subsp. aureus MW2
acaaaaaauuaucu

SEQ ID NO: 3999851 - RNA, 14 nt, Staphylococcus aureus subsp. aureus MW2
acaaaaaauuguaa

SEQ ID NO: 3999852 - RNA, 16 nt, Staphylococcus aureus subsp. aureus MW2
acaaaaauauagcuau

SEQ ID NO: 3999853 - RNA, 13 nt, Staphylococcus aureus subsp. aureus MW2
acaaaacuuaaaa

SEQ ID NO: 3999854 - RNA, 15 nt, Staphylococcus aureus subsp. aureus MW2
acaaaagaggcgcca

SEQ ID NO: 3999855 - RNA, 23 nt, Staphylococcus aureus subsp. aureus MW2
acaaaagaggcgccacaacaugu

SEQ ID NO: 3999856 - RNA, 22 nt, Staphylococcus aureus subsp. aureus MW2
acaaaagauguugcuagugcau

SEQ ID NO: 3999857 - RNA, 19 nt, Staphylococcus aureus subsp. aureus MW2
acaauaguauaaauaucau

SEQ ID NO: 3999858 - RNA, 13 nt, Staphylococcus aureus subsp. aureus MW2
acaauauaaaagc

SEQ ID NO: 3999859 - RNA, 17 nt, Staphylococcus aureus subsp. aureus MW2
acaauauaaaagcacua

SEQ ID NO: 3999860 - RNA, 14 nt, Staphylococcus aureus subsp. aureus MW2
acaauauaauauau

SEQ ID NO: 3999861 - RNA, 13 nt, Staphylococcus aureus subsp. aureus MW2
acaauaugauuaa

SEQ ID NO: 3999862 - RNA, 18 nt, Staphylococcus aureus subsp. aureus MW2
acaauauuaaaauuaaaa

SEQ ID NO: 3999863 - RNA, 19 nt, Staphylococcus aureus subsp. aureus MW2
acaauauuaaaauuaaaac

SEQ ID NO: 3999864 - RNA, 14 nt, Staphylococcus aureus subsp. aureus MW2
acaauauugacuuu

SEQ ID NO: 3999865 - RNA, 16 nt, Staphylococcus aureus subsp. aureus MW2
acaauauuuuuacaua

SEQ ID NO: 3999866 - RNA, 21 nt, Staphylococcus aureus subsp. aureus MW2
acaauauuuuuacauauuuau

SEQ ID NO: 3999867 - RNA, 14 nt, Staphylococcus aureus subsp. aureus MW2
acaaucaaaggcuu

SEQ ID NO: 3999868 - RNA, 24 nt, Staphylococcus aureus subsp. aureus MW2
acaaucaaauuacaaauuaucuag

SEQ ID NO: 3999869 - RNA, 14 nt, Staphylococcus aureus subsp. aureus MW2
acaaucacagcaau

SEQ ID NO: 3999870 - RNA, 18 nt, Staphylococcus aureus subsp. aureus MW2
acaaucacagcaauaaua

SEQ ID NO: 3999871 - RNA, 19 nt, Staphylococcus aureus subsp. aureus MW2
acaaucacagcaauaauaa

SEQ ID NO: 3999872 - RNA, 14 nt, Staphylococcus aureus subsp. aureus MW2
acaaucacgauuaa

SEQ ID NO: 3999873 - RNA, 19 nt, Staphylococcus aureus subsp. aureus MW2
acaaucagauaaguuacua

SEQ ID NO: 3999874 - RNA, 21 nt, Staphylococcus aureus subsp. aureus MW2
acaaucauagauauaagaaau

SEQ ID NO: 3999875 - RNA, 12 nt, Staphylococcus aureus subsp. aureus MW2
acaaucaucuua

SEQ ID NO: 3999876 - RNA, 15 nt, Staphylococcus aureus subsp. aureus MW2
acaaucauuagucau

SEQ ID NO: 3999877 - RNA, 14 nt, Staphylococcus aureus subsp. aureus MW2
acaauccugaagag

SEQ ID NO: 3999878 - RNA, 15 nt, Staphylococcus aureus subsp. aureus MW2
acaauccugaagaga

SEQ ID NO: 3999879 - RNA, 21 nt, Staphylococcus aureus subsp. aureus MW2
acaauccugaagagaaaauuu

SEQ ID NO: 3999880 - RNA, 22 nt, Staphylococcus aureus subsp. aureus MW2
acaauccugaagagaaaauuug

SEQ ID NO: 3999881 - RNA, 17 nt, Staphylococcus aureus subsp. aureus MW2
acaaucggaagcauauu

SEQ ID NO: 3999882 - RNA, 20 nt, Staphylococcus aureus subsp. aureus MW2
acaaucggaagcauauuucu

SEQ ID NO: 3999883 - RNA, 19 nt, Staphylococcus aureus subsp. aureus MW2
acaaucguuuuaaugccug

SEQ ID NO: 3999884 - RNA, 18 nt, Staphylococcus aureus subsp. aureus MW2
acaaucuaaauguaaaau

SEQ ID NO: 3999885 - RNA, 19 nt, Staphylococcus aureus subsp. aureus MW2
acaaucuccauuagaacua

SEQ ID NO: 3999886 - RNA, 20 nt, Staphylococcus aureus subsp. aureus MW2
acaaucuuaucguaaucuuc

SEQ ID NO: 3999887 - RNA, 24 nt, Staphylococcus aureus subsp. aureus MW2
acaaugaagcuaaguauauaagca

SEQ ID NO: 3999888 - RNA, 23 nt, Staphylococcus aureus subsp. aureus MW2
acaaugaauuucuaauuuaguau

SEQ ID NO: 3999889 - RNA, 16 nt, Staphylococcus aureus subsp. aureus MW2
acaaugauuaaaauua

SEQ ID NO: 3999890 - RNA, 16 nt, Staphylococcus aureus subsp. aureus MW2
acaaugauucaucagu

SEQ ID NO: 3999891 - RNA, 13 nt, Staphylococcus aureus subsp. aureus MW2
acaaugcagcugu

SEQ ID NO: 3999892 - RNA, 12 nt, Staphylococcus aureus subsp. aureus MW2
acaaugccuuua

SEQ ID NO: 3999893 - RNA, 13 nt, Staphylococcus aureus subsp. aureus MW2
acaaugcgcaaug

SEQ ID NO: 3999894 - RNA, 17 nt, Staphylococcus aureus subsp. aureus MW2
acaaugcgcaaugaaaa

SEQ ID NO: 3999895 - RNA, 19 nt, Staphylococcus aureus subsp. aureus MW2
acaauguuauuagauacuu

SEQ ID NO: 3999896 - RNA, 17 nt, Staphylococcus aureus subsp. aureus MW2
acaauuauaauaaaacu

SEQ ID NO: 3999897 - RNA, 20 nt, Staphylococcus aureus subsp. aureus MW2
acaauucauaagaaaaaugu

SEQ ID NO: 3999898 - RNA, 18 nt, Staphylococcus aureus subsp. aureus MW2
acaauuccccaaagccuu

SEQ ID NO: 3999899 - RNA, 23 nt, Staphylococcus aureus subsp. aureus MW2
acaauugguuguuucaauucaau

SEQ ID NO: 3999900 - RNA, 14 nt, Staphylococcus aureus subsp. aureus MW2
acaauuguaguaau

SEQ ID NO: 3999901 - RNA, 23 nt, Staphylococcus aureus subsp. aureus MW2
acaauuguggguguuuuuuuuau

SEQ ID NO: 3999902 - RNA, 18 nt, Staphylococcus aureus subsp. aureus MW2
acaauuuagguuaauuaa

SEQ ID NO: 3999903 - RNA, 20 nt, Staphylococcus aureus subsp. aureus MW2
acaauuuagguuaauuaaac

SEQ ID NO: 3999904 - RNA, 20 nt, Staphylococcus aureus subsp. aureus MW2
acaauuuuaauuuuucauua

SEQ ID NO: 3999905 - RNA, 16 nt, Staphylococcus aureus subsp. aureus MW2
acaauuuuaucugaau

SEQ ID NO: 3999906 - RNA, 22 nt, Staphylococcus aureus subsp. aureus MW2
acaauuuucgaugcauauucau

SEQ ID NO: 3999907 - RNA, 13 nt, Staphylococcus aureus subsp. aureus MW2
acaauuuuuaaaa

SEQ ID NO: 3999908 - RNA, 15 nt, Staphylococcus aureus subsp. aureus MW2
acaauuuuuaaaaac

SEQ ID NO: 3999909 - RNA, 16 nt, Staphylococcus aureus subsp. aureus MW2
acaauuuuuaaaaacc

SEQ ID NO: 3999910 - RNA, 11 nt, Staphylococcus aureus subsp. aureus MW2
acaauuuuugg

SEQ ID NO: 3999911 - RNA, 19 nt, Staphylococcus aureus subsp. aureus MW2
acacaaauaaaagcaacaa

SEQ ID NO: 3999912 - RNA, 17 nt, Staphylococcus aureus subsp. aureus MW2
acacaaauuaaaacucg

SEQ ID NO: 3999913 - RNA, 14 nt, Staphylococcus aureus subsp. aureus MW2
acacaacgauagau

SEQ ID NO: 3999914 - RNA, 18 nt, Staphylococcus aureus subsp. aureus MW2
acacaaugauuauaaaua

SEQ ID NO: 3999915 - RNA, 22 nt, Staphylococcus aureus subsp. aureus MW2
acacaaugauucaucaguguag

SEQ ID NO: 3999916 - RNA, 15 nt, Staphylococcus aureus subsp. aureus MW2
acacacccaaauuua

SEQ ID NO: 3999917 - RNA, 22 nt, Staphylococcus aureus subsp. aureus MW2
acacacugcuaaaauuguauua

SEQ ID NO: 3999918 - RNA, 21 nt, Staphylococcus aureus subsp. aureus MW2
acacacuguugaaaaugacua

SEQ ID NO: 3999919 - RNA, 14 nt, Staphylococcus aureus subsp. aureus MW2
acacacuuauaauc

SEQ ID NO: 3999920 - RNA, 13 nt, Staphylococcus aureus subsp. aureus MW2
acacagaagcuga

SEQ ID NO: 3999921 - RNA, 23 nt, Staphylococcus aureus subsp. aureus MW2
acacagaagcugacgaaaaguca

SEQ ID NO: 3999922 - RNA, 23 nt, Staphylococcus aureus subsp. aureus MW2
acacagaagcuggcggaaaguca

SEQ ID NO: 3999923 - RNA, 22 nt, Staphylococcus aureus subsp. aureus MW2
acacagagaauuucgaaaagaa

SEQ ID NO: 3999924 - RNA, 23 nt, Staphylococcus aureus subsp. aureus MW2
acacagagaauuucgaaaagaaa

SEQ ID NO: 3999925 - RNA, 21 nt, Staphylococcus aureus subsp. aureus MW2
acacagcuaaacgcaauacga

SEQ ID NO: 3999926 - RNA, 14 nt, Staphylococcus aureus subsp. aureus MW2
acacagguaaauuu

SEQ ID NO: 3999927 - RNA, 16 nt, Staphylococcus aureus subsp. aureus MW2
acacagguaaauuuaa

SEQ ID NO: 3999928 - RNA, 20 nt, Staphylococcus aureus subsp. aureus MW2
acacagguaaauuuaaaaua

SEQ ID NO: 3999929 - RNA, 22 nt, Staphylococcus aureus subsp. aureus MW2
acacaguaauucuuaaaaagca

SEQ ID NO: 3999930 - RNA, 13 nt, Staphylococcus aureus subsp. aureus MW2
acacaguacaaau

SEQ ID NO: 3999931 - RNA, 22 nt, Staphylococcus aureus subsp. aureus MW2
acacauauaguuguaucaaaua

SEQ ID NO: 3999932 - RNA, 13 nt, Staphylococcus aureus subsp. aureus MW2
acacaucaacaua

SEQ ID NO: 3999933 - RNA, 13 nt, Staphylococcus aureus subsp. aureus MW2
acacaucacuaua

SEQ ID NO: 3999934 - RNA, 15 nt, Staphylococcus aureus subsp. aureus MW2
acacaugcaucaacu

SEQ ID NO: 3999935 - RNA, 15 nt, Staphylococcus aureus subsp. aureus MW2
acacauuauugaagu

SEQ ID NO: 3999936 - RNA, 18 nt, Staphylococcus aureus subsp. aureus MW2
acacauuauugaaguuuu

SEQ ID NO: 3999937 - RNA, 22 nt, Staphylococcus aureus subsp. aureus MW2
acacauucuuauuugaaaugau

SEQ ID NO: 3999938 - RNA, 22 nt, Staphylococcus aureus subsp. aureus MW2
acaccaauugaauauuuuucaa

SEQ ID NO: 3999939 - RNA, 23 nt, Staphylococcus aureus subsp. aureus MW2
acaccauuauagacauaagcaaa

SEQ ID NO: 3999940 - RNA, 12 nt, Staphylococcus aureus subsp. aureus MW2
acacccaaauuu

SEQ ID NO: 3999941 - RNA, 13 nt, Staphylococcus aureus subsp. aureus MW2
acaccugcaaugu

SEQ ID NO: 3999942 - RNA, 22 nt, Staphylococcus aureus subsp. aureus MW2
acaccuuucgcgacuucauuac

SEQ ID NO: 3999943 - RNA, 20 nt, Staphylococcus aureus subsp. aureus MW2
acacgcggugggcgaaauca

SEQ ID NO: 3999944 - RNA, 17 nt, Staphylococcus aureus subsp. aureus MW2
acacgucuaauuuuaau

SEQ ID NO: 3999945 - RNA, 20 nt, Staphylococcus aureus subsp. aureus MW2
acauagagaaauuugauuuu

SEQ ID NO: 3999946 - RNA, 16 nt, Staphylococcus aureus subsp. aureus MW2
acauagagaauuucaa

SEQ ID NO: 3999947 - RNA, 18 nt, Staphylococcus aureus subsp. aureus MW2
acauagagaauuucaaaa

SEQ ID NO: 3999948 - RNA, 18 nt, Staphylococcus aureus subsp. aureus MW2
acauagccucuuaaaaua

SEQ ID NO: 3999949 - RNA, 17 nt, Staphylococcus aureus subsp. aureus MW2
acauagcguaauuuuac

SEQ ID NO: 3999950 - RNA, 20 nt, Staphylococcus aureus subsp. aureus MW2
acauagcguaauuuuaccug

SEQ ID NO: 3999951 - RNA, 20 nt, Staphylococcus aureus subsp. aureus MW2
acauagcuuaauaauuaaua

SEQ ID NO: 3999952 - RNA, 19 nt, Staphylococcus aureus subsp. aureus MW2
acauagguauaaucauuua

SEQ ID NO: 3999953 - RNA, 14 nt, Staphylococcus aureus subsp. aureus MW2
acauauaaaucauu

SEQ ID NO: 3999954 - RNA, 16 nt, Staphylococcus aureus subsp. aureus MW2
acauauacaaauuuau

SEQ ID NO: 3999955 - RNA, 16 nt, Staphylococcus aureus subsp. aureus MW2
acauauaguuguauca

SEQ ID NO: 3999956 - RNA, 20 nt, Staphylococcus aureus subsp. aureus MW2
acauaugcaaguauagacca

SEQ ID NO: 3999957 - RNA, 20 nt, Staphylococcus aureus subsp. aureus MW2
acauauguguaugauagaau

SEQ ID NO: 3999958 - RNA, 15 nt, Staphylococcus aureus subsp. aureus MW2
acauauuauaaaagu

SEQ ID NO: 3999959 - RNA, 18 nt, Staphylococcus aureus subsp. aureus MW2
acauauucaguauaugua

SEQ ID NO: 3999960 - RNA, 14 nt, Staphylococcus aureus subsp. aureus MW2
acauauucauaaua

SEQ ID NO: 3999961 - RNA, 20 nt, Staphylococcus aureus subsp. aureus MW2
acauauuccgagaauuauua

SEQ ID NO: 3999962 - RNA, 15 nt, Staphylococcus aureus subsp. aureus MW2
acauauuuauacuga

SEQ ID NO: 3999963 - RNA, 19 nt, Staphylococcus aureus subsp. aureus MW2
acauauuuauacugaucaa

SEQ ID NO: 3999964 - RNA, 15 nt, Staphylococcus aureus subsp. aureus MW2
acauauuuauauuuu

SEQ ID NO: 3999965 - RNA, 15 nt, Staphylococcus aureus subsp. aureus MW2
acauauuuucacaau

SEQ ID NO: 3999966 - RNA, 19 nt, Staphylococcus aureus subsp. aureus MW2
acaucaagucgcaucguag

SEQ ID NO: 3999967 - RNA, 13 nt, Staphylococcus aureus subsp. aureus MW2
acaucaauaucuu

SEQ ID NO: 3999968 - RNA, 15 nt, Staphylococcus aureus subsp. aureus MW2
acaucaauaucuucu

SEQ ID NO: 3999969 - RNA, 17 nt, Staphylococcus aureus subsp. aureus MW2
acaucaauaucuucuuc

SEQ ID NO: 3999970 - RNA, 21 nt, Staphylococcus aureus subsp. aureus MW2
acaucaauauugucuucauua

SEQ ID NO: 3999971 - RNA, 21 nt, Staphylococcus aureus subsp. aureus MW2
acaucacuauacgcaaucauu

SEQ ID NO: 3999972 - RNA, 14 nt, Staphylococcus aureus subsp. aureus MW2
acaucacuugcugu

SEQ ID NO: 3999973 - RNA, 15 nt, Staphylococcus aureus subsp. aureus MW2
acaucauaauaaauc

SEQ ID NO: 3999974 - RNA, 14 nt, Staphylococcus aureus subsp. aureus MW2
acaucaucauguuu

SEQ ID NO: 3999975 - RNA, 17 nt, Staphylococcus aureus subsp. aureus MW2
acaucaucgccagcauu

SEQ ID NO: 3999976 - RNA, 13 nt, Staphylococcus aureus subsp. aureus MW2
acaucauuaaaua

SEQ ID NO: 3999977 - RNA, 15 nt, Staphylococcus aureus subsp. aureus MW2
acaucauuaaauauu

SEQ ID NO: 3999978 - RNA, 17 nt, Staphylococcus aureus subsp. aureus MW2
acaucauuaaauauuua

SEQ ID NO: 3999979 - RNA, 13 nt, Staphylococcus aureus subsp. aureus MW2
acaucauuaacuu

SEQ ID NO: 3999980 - RNA, 15 nt, Staphylococcus aureus subsp. aureus MW2
acaucauucacaagu

SEQ ID NO: 3999981 - RNA, 23 nt, Staphylococcus aureus subsp. aureus MW2
acaucauucacaaguucaggauc

SEQ ID NO: 3999982 - RNA, 22 nt, Staphylococcus aureus subsp. aureus MW2
acaucauugauagauagaaauu

SEQ ID NO: 3999983 - RNA, 17 nt, Staphylococcus aureus subsp. aureus MW2
acaucauuuuuggauga

SEQ ID NO: 3999984 - RNA, 23 nt, Staphylococcus aureus subsp. aureus MW2
acauccaauuauguuuaucuacu

SEQ ID NO: 3999985 - RNA, 15 nt, Staphylococcus aureus subsp. aureus MW2
acaucgccaauuuga

SEQ ID NO: 3999986 - RNA, 22 nt, Staphylococcus aureus subsp. aureus MW2
acaucgccaauuugauuaguaa

SEQ ID NO: 3999987 - RNA, 22 nt, Staphylococcus aureus subsp. aureus MW2
acaucuaaauaguuuuucauau

SEQ ID NO: 3999988 - RNA, 14 nt, Staphylococcus aureus subsp. aureus MW2
acaucuaauaaaua

SEQ ID NO: 3999989 - RNA, 16 nt, Staphylococcus aureus subsp. aureus MW2
acaucuaauaaauaua

SEQ ID NO: 3999990 - RNA, 18 nt, Staphylococcus aureus subsp. aureus MW2
acaucuacaucaaauuuu

SEQ ID NO: 3999991 - RNA, 21 nt, Staphylococcus aureus subsp. aureus MW2
acaucuauguggcuacuugaa

SEQ ID NO: 3999992 - RNA, 14 nt, Staphylococcus aureus subsp. aureus MW2
acaucuauuucuug

SEQ ID NO: 3999993 - RNA, 13 nt, Staphylococcus aureus subsp. aureus MW2
acaucugaaaaaa

SEQ ID NO: 3999994 - RNA, 17 nt, Staphylococcus aureus subsp. aureus MW2
acaucuucauguaugaa

SEQ ID NO: 3999995 - RNA, 14 nt, Staphylococcus aureus subsp. aureus MW2
acaucuucuucauc

SEQ ID NO: 3999996 - RNA, 16 nt, Staphylococcus aureus subsp. aureus MW2
acaucuucuucaucau

SEQ ID NO: 3999997 - RNA, 12 nt, Staphylococcus aureus subsp. aureus MW2
acaucuuuuguu

SEQ ID NO: 3999998 - RNA, 13 nt, Staphylococcus aureus subsp. aureus MW2
acaucuuuuuaaa

SEQ ID NO: 3999999 - RNA, 13 nt, Staphylococcus aureus subsp. aureus MW2
acaucuuuuugau

SEQ ID NO: 4000000 - RNA, 14 nt, Staphylococcus aureus subsp. aureus MW2
acaugaaaguuguu

SEQ ID NO: 4000001 - RNA, 14 nt, Staphylococcus aureus subsp. aureus MW2
acaugaacaaucag

SEQ ID NO: 4000002 - RNA, 20 nt, Staphylococcus aureus subsp. aureus MW2
acaugaacaaucagauaagu

SEQ ID NO: 4000003 - RNA, 21 nt, Staphylococcus aureus subsp. aureus MW2
acaugaacaaucagauaaguu

SEQ ID NO: 4000004 - RNA, 17 nt, Staphylococcus aureus subsp. aureus MW2
acaugaaucaacaauau

SEQ ID NO: 4000005 - RNA, 16 nt, Staphylococcus aureus subsp. aureus MW2
acaugaauuuuaauau

SEQ ID NO: 4000006 - RNA, 19 nt, Staphylococcus aureus subsp. aureus MW2
acaugaauuuuaauauauu

SEQ ID NO: 4000007 - RNA, 22 nt, Staphylococcus aureus subsp. aureus MW2
acaugacauucauuuaguuaaa

SEQ ID NO: 4000008 - RNA, 22 nt, Staphylococcus aureus subsp. aureus MW2
acaugagauuauuuuuuuaaau

SEQ ID NO: 4000009 - RNA, 19 nt, Staphylococcus aureus subsp. aureus MW2
acaugauucaugauauguu

SEQ ID NO: 4000010 - RNA, 14 nt, Staphylococcus aureus subsp. aureus MW2
acaugccaauggaa

SEQ ID NO: 4000011 - RNA, 17 nt, Staphylococcus aureus subsp. aureus MW2
acauggaaaauauauua

SEQ ID NO: 4000012 - RNA, 23 nt, Staphylococcus aureus subsp. aureus MW2
acauggcuuagguuuaauuuuaa

SEQ ID NO: 4000013 - RNA, 22 nt, Staphylococcus aureus subsp. aureus MW2
acaugguuuucuuuuuaucaug

SEQ ID NO: 4000014 - RNA, 13 nt, Staphylococcus aureus subsp. aureus MW2
acauguacaauuu

SEQ ID NO: 4000015 - RNA, 18 nt, Staphylococcus aureus subsp. aureus MW2
acauguacaauuuuuaaa

SEQ ID NO: 4000016 - RNA, 20 nt, Staphylococcus aureus subsp. aureus MW2
acauguacguuuuuuuaaau

SEQ ID NO: 4000017 - RNA, 18 nt, Staphylococcus aureus subsp. aureus MW2
acauguauuggccaaaca

SEQ ID NO: 4000018 - RNA, 15 nt, Staphylococcus aureus subsp. aureus MW2
acaugugggauaucu

SEQ ID NO: 4000019 - RNA, 20 nt, Staphylococcus aureus subsp. aureus MW2
acauguuacugaugaacaua

SEQ ID NO: 4000020 - RNA, 16 nt, Staphylococcus aureus subsp. aureus MW2
acauguuccgcuacaa

SEQ ID NO: 4000021 - RNA, 20 nt, Staphylococcus aureus subsp. aureus MW2
acauguugauaaaaaggauc

SEQ ID NO: 4000022 - RNA, 19 nt, Staphylococcus aureus subsp. aureus MW2
acauguuuggaugaacaaa

SEQ ID NO: 4000023 - RNA, 19 nt, Staphylococcus aureus subsp. aureus MW2
acauuaaaaugauaucuga

SEQ ID NO: 4000024 - RNA, 21 nt, Staphylococcus aureus subsp. aureus MW2
acauuaaaauguguuuucaac

SEQ ID NO: 4000025 - RNA, 20 nt, Staphylococcus aureus subsp. aureus MW2
acauuaaagaaaauaucuga

SEQ ID NO: 4000026 - RNA, 23 nt, Staphylococcus aureus subsp. aureus MW2
acauuaaagaaaauaucugaaaa

SEQ ID NO: 4000027 - RNA, 16 nt, Staphylococcus aureus subsp. aureus MW2
acauuaacgauuaaua

SEQ ID NO: 4000028 - RNA, 19 nt, Staphylococcus aureus subsp. aureus MW2
acauuaaucaugcguuuua

SEQ ID NO: 4000029 - RNA, 21 nt, Staphylococcus aureus subsp. aureus MW2
acauuaaucaugcguuuuaag

SEQ ID NO: 4000030 - RNA, 15 nt, Staphylococcus aureus subsp. aureus MW2
acauuaaucuauaua

SEQ ID NO: 4000031 - RNA, 14 nt, Staphylococcus aureus subsp. aureus MW2
acauuacaucuuua

SEQ ID NO: 4000032 - RNA, 18 nt, Staphylococcus aureus subsp. aureus MW2
acauuacauuuaguacau

SEQ ID NO: 4000033 - RNA, 21 nt, Staphylococcus aureus subsp. aureus MW2
accaucuucuugauuguaaau

SEQ ID NO: 4000034 - RNA, 19 nt, Staphylococcus aureus subsp. aureus MW2
accaucuuuaauacgaauu

SEQ ID NO: 4000035 - RNA, 22 nt, Staphylococcus aureus subsp. aureus MW2
accaucuuuaauacgaauuuca

SEQ ID NO: 4000036 - RNA, 17 nt, Staphylococcus aureus subsp. aureus MW2
accaugagaaaccgcuu

SEQ ID NO: 4000037 - RNA, 15 nt, Staphylococcus aureus subsp. aureus MW2
accaugauuggcuug

SEQ ID NO: 4000038 - RNA, 15 nt, Staphylococcus aureus subsp. aureus MW2
accauguuuuuuaag

SEQ ID NO: 4000039 - RNA, 14 nt, Staphylococcus aureus subsp. aureus MW2
accauuaugauuaa

SEQ ID NO: 4000040 - RNA, 18 nt, Staphylococcus aureus subsp. aureus MW2
accauuccaaaaauugua

SEQ ID NO: 4000041 - RNA, 20 nt, Staphylococcus aureus subsp. aureus MW2
accauucuaccaguugauuu

SEQ ID NO: 4000042 - RNA, 21 nt, Staphylococcus aureus subsp. aureus MW2
accauugcacaguuucaucuu

SEQ ID NO: 4000043 - RNA, 17 nt, Staphylococcus aureus subsp. aureus MW2
accauuucauuucagua

SEQ ID NO: 4000044 - RNA, 23 nt, Staphylococcus aureus subsp. aureus MW2
accauuucuuuuuucaauguuug

SEQ ID NO: 4000045 - RNA, 16 nt, Staphylococcus aureus subsp. aureus MW2
accauuuuauauuuua

SEQ ID NO: 4000046 - RNA, 13 nt, Staphylococcus aureus subsp. aureus MW2
accauuuuuuuau

SEQ ID NO: 4000047 - RNA, 14 nt, Staphylococcus aureus subsp. aureus MW2
acccaaaaaauugu

SEQ ID NO: 4000048 - RNA, 13 nt, Staphylococcus aureus subsp. aureus MW2
acccaaucuuguu

SEQ ID NO: 4000049 - RNA, 18 nt, Staphylococcus aureus subsp. aureus MW2
acccacaucuuuuuaaaa

SEQ ID NO: 4000050 - RNA, 17 nt, Staphylococcus aureus subsp. aureus MW2
acccaccuuucuuuauc

SEQ ID NO: 4000051 - RNA, 18 nt, Staphylococcus aureus subsp. aureus MW2
acccauaauuuaaaugau

SEQ ID NO: 4000052 - RNA, 16 nt, Staphylococcus aureus subsp. aureus MW2
acccauauuaaauuuu

SEQ ID NO: 4000053 - RNA, 23 nt, Staphylococcus aureus subsp. aureus MW2
acccauuuuuuuccaagcaucau

SEQ ID NO: 4000054 - RNA, 20 nt, Staphylococcus aureus subsp. aureus MW2
accccaacuugcacauuauu

SEQ ID NO: 4000055 - RNA, 14 nt, Staphylococcus aureus subsp. aureus MW2
accccauuuuaaag

SEQ ID NO: 4000056 - RNA, 14 nt, Staphylococcus aureus subsp. aureus MW2
accccuucaaaauu

SEQ ID NO: 4000057 - RNA, 13 nt, Staphylococcus aureus subsp. aureus MW2
accccuucucuaa

SEQ ID NO: 4000058 - RNA, 21 nt, Staphylococcus aureus subsp. aureus MW2
acccguuuuaccgacaacacg

SEQ ID NO: 4000059 - RNA, 23 nt, Staphylococcus aureus subsp. aureus MW2
acccuaaaaguugaauauaauuu

SEQ ID NO: 4000060 - RNA, 21 nt, Staphylococcus aureus subsp. aureus MW2
acccuaaugagcccguuaaaa

SEQ ID NO: 4000061 - RNA, 22 nt, Staphylococcus aureus subsp. aureus MW2
acccuucccuaucauacauauu

SEQ ID NO: 4000062 - RNA, 20 nt, Staphylococcus aureus subsp. aureus MW2
acccuugucaguuuuuuuau

SEQ ID NO: 4000063 - RNA, 18 nt, Staphylococcus aureus subsp. aureus MW2
acccuuuaaauuuaacuc

SEQ ID NO: 4000064 - RNA, 20 nt, Staphylococcus aureus subsp. aureus MW2
accgauuaauauaauaccua

SEQ ID NO: 4000065 - RNA, 22 nt, Staphylococcus aureus subsp. aureus MW2
accgauuguuucaccagcuugu

SEQ ID NO: 4000066 - RNA, 21 nt, Staphylococcus aureus subsp. aureus MW2
accgcacuuucuauuaauaua

SEQ ID NO: 4000067 - RNA, 19 nt, Staphylococcus aureus subsp. aureus MW2
accgcauaagauugcuuuu

SEQ ID NO: 4000068 - RNA, 16 nt, Staphylococcus aureus subsp. aureus MW2
accgcugcucuucucu

SEQ ID NO: 4000069 - RNA, 20 nt, Staphylococcus aureus subsp. aureus MW2
accgcugcucuucucuuuac

SEQ ID NO: 4000070 - RNA, 19 nt, Staphylococcus aureus subsp. aureus MW2
accguaacuauaugaaaug

SEQ ID NO: 4000071 - RNA, 14 nt, Staphylococcus aureus subsp. aureus MW2
accguaaucuuuua

SEQ ID NO: 4000072 - RNA, 15 nt, Staphylococcus aureus subsp. aureus MW2
accguaaucuuuuaa

SEQ ID NO: 4000073 - RNA, 22 nt, Staphylococcus aureus subsp. aureus MW2
accguauuauuaguuuugaagu

SEQ ID NO: 4000074 - RNA, 21 nt, Staphylococcus aureus subsp. aureus MW2
accguuaguacggcugcuuua

SEQ ID NO: 4000075 - RNA, 20 nt, Staphylococcus aureus subsp. aureus MW2
accguuuuuuauaaaucauu

SEQ ID NO: 4000076 - RNA, 13 nt, Staphylococcus aureus subsp. aureus MW2
accuaaaaacaaa

SEQ ID NO: 4000077 - RNA, 12 nt, Staphylococcus aureus subsp. aureus MW2
accuaaaauacc

SEQ ID NO: 4000078 - RNA, 18 nt, Staphylococcus aureus subsp. aureus MW2
accuaagcaagauaauag

SEQ ID NO: 4000079 - RNA, 19 nt, Staphylococcus aureus subsp. aureus MW2
accuaagcugauuaaaaua

SEQ ID NO: 4000080 - RNA, 12 nt, Staphylococcus aureus subsp. aureus MW2
accuacaaauau

SEQ ID NO: 4000081 - RNA, 14 nt, Staphylococcus aureus subsp. aureus MW2
accuacaaauauuu

SEQ ID NO: 4000082 - RNA, 14 nt, Staphylococcus aureus subsp. aureus MW2
accuacaacaccaa

SEQ ID NO: 4000083 - RNA, 20 nt, Staphylococcus aureus subsp. aureus MW2
accuacaacgaagaauccua

SEQ ID NO: 4000084 - RNA, 16 nt, Staphylococcus aureus subsp. aureus MW2
accuacacggucccaa

SEQ ID NO: 4000085 - RNA, 15 nt, Staphylococcus aureus subsp. aureus MW2
accuacagauaaagc

SEQ ID NO: 4000086 - RNA, 23 nt, Staphylococcus aureus subsp. aureus MW2
accuacagauuuuaaaaauucau

SEQ ID NO: 4000087 - RNA, 22 nt, Staphylococcus aureus subsp. aureus MW2
accuacauuaauuuaucguuua

SEQ ID NO: 4000088 - RNA, 17 nt, Staphylococcus aureus subsp. aureus MW2
accuacuacaaauuuua

SEQ ID NO: 4000089 - RNA, 22 nt, Staphylococcus aureus subsp. aureus MW2
accuacuuugauauguuuccuc

SEQ ID NO: 4000090 - RNA, 16 nt, Staphylococcus aureus subsp. aureus MW2
accuauaagucucuuu

SEQ ID NO: 4000091 - RNA, 21 nt, Staphylococcus aureus subsp. aureus MW2
accuaucccuguaaaaccaua

SEQ ID NO: 4000092 - RNA, 18 nt, Staphylococcus aureus subsp. aureus MW2
accuauuaaaauaaacca

SEQ ID NO: 4000093 - RNA, 17 nt, Staphylococcus aureus subsp. aureus MW2
accuauuugauuaaauu

SEQ ID NO: 4000094 - RNA, 15 nt, Staphylococcus aureus subsp. aureus MW2
accucauuugacaua

SEQ ID NO: 4000095 - RNA, 20 nt, Staphylococcus aureus subsp. aureus MW2
accucggauaccaaaacuca

SEQ ID NO: 4000096 - RNA, 15 nt, Staphylococcus aureus subsp. aureus MW2
accucguuacauuua

SEQ ID NO: 4000097 - RNA, 23 nt, Staphylococcus aureus subsp. aureus MW2
accucuaaauaaaauuaaaacag

SEQ ID NO: 4000098 - RNA, 22 nt, Staphylococcus aureus subsp. aureus MW2
accucuguuuuguugguguuua

SEQ ID NO: 4000099 - RNA, 16 nt, Staphylococcus aureus subsp. aureus MW2
accucuugauaaaaua

SEQ ID NO: 4000100 - RNA, 18 nt, Staphylococcus aureus subsp. aureus MW2
accucuuguaauguuggc

SEQ ID NO: 4000101 - RNA, 12 nt, Staphylococcus aureus subsp. aureus MW2
accucuuuuguu

SEQ ID NO: 4000102 - RNA, 19 nt, Staphylococcus aureus subsp. aureus MW2
accucuuuuguuuaguaug

SEQ ID NO: 4000103 - RNA, 16 nt, Staphylococcus aureus subsp. aureus MW2
accugcauauguguuu

SEQ ID NO: 4000104 - RNA, 18 nt, Staphylococcus aureus subsp. aureus MW2
accugcugaaguuugaac

SEQ ID NO: 4000105 - RNA, 14 nt, Staphylococcus aureus subsp. aureus MW2
accugcuucuguaa

SEQ ID NO: 4000106 - RNA, 17 nt, Staphylococcus aureus subsp. aureus MW2
accugcuuuuuauuauu

SEQ ID NO: 4000107 - RNA, 13 nt, Staphylococcus aureus subsp. aureus MW2
accugucuuaauu

SEQ ID NO: 4000108 - RNA, 14 nt, Staphylococcus aureus subsp. aureus MW2
accugugauaaaaa

SEQ ID NO: 4000109 - RNA, 18 nt, Staphylococcus aureus subsp. aureus MW2
accuguuuuuauuuguuu

SEQ ID NO: 4000110 - RNA, 22 nt, Staphylococcus aureus subsp. aureus MW2
accuuaaauauaguugccaugu

SEQ ID NO: 4000111 - RNA, 19 nt, Staphylococcus aureus subsp. aureus MW2
accuuaauaggauaugcua

SEQ ID NO: 4000112 - RNA, 18 nt, Staphylococcus aureus subsp. aureus MW2
accuuacauaggauaucu

SEQ ID NO: 4000113 - RNA, 20 nt, Staphylococcus aureus subsp. aureus MW2
accuuacauaggauaucuac

SEQ ID NO: 4000114 - RNA, 19 nt, Staphylococcus aureus subsp. aureus MW2
accuuacuacucauuauua

SEQ ID NO: 4000115 - RNA, 21 nt, Staphylococcus aureus subsp. aureus MW2
accuuacuacucauuauuaag

SEQ ID NO: 4000116 - RNA, 12 nt, Staphylococcus aureus subsp. aureus MW2
accuuauauuuu

SEQ ID NO: 4000117 - RNA, 13 nt, Staphylococcus aureus subsp. aureus MW2
accuuauauuuua

SEQ ID NO: 4000118 - RNA, 15 nt, Staphylococcus aureus subsp. aureus MW2
accuuauauuuuauu

SEQ ID NO: 4000119 - RNA, 23 nt, Staphylococcus aureus subsp. aureus MW2
accuuauauuuuauuuaaaaaua

SEQ ID NO: 4000120 - RNA, 19 nt, Staphylococcus aureus subsp. aureus MW2
accuuaucaguguaaguuu

SEQ ID NO: 4000121 - RNA, 16 nt, Staphylococcus aureus subsp. aureus MW2
acgcucuucuucuuca

SEQ ID NO: 4000122 - RNA, 13 nt, Staphylococcus aureus subsp. aureus MW2
acgcuguaaucca

SEQ ID NO: 4000123 - RNA, 14 nt, Staphylococcus aureus subsp. aureus MW2
acgcuguuuuuaaa

SEQ ID NO: 4000124 - RNA, 17 nt, Staphylococcus aureus subsp. aureus MW2
acgcuuacuuauauuuu

SEQ ID NO: 4000125 - RNA, 18 nt, Staphylococcus aureus subsp. aureus MW2
acgcuuacuuauauuuua

SEQ ID NO: 4000126 - RNA, 19 nt, Staphylococcus aureus subsp. aureus MW2
acgcuuauacuauauaaua

SEQ ID NO: 4000127 - RNA, 21 nt, Staphylococcus aureus subsp. aureus MW2
acgcuuauugaaaagauaaac

SEQ ID NO: 4000128 - RNA, 15 nt, Staphylococcus aureus subsp. aureus MW2
acgcuucaauuauuu

SEQ ID NO: 4000129 - RNA, 17 nt, Staphylococcus aureus subsp. aureus MW2
acgcuucaauuauuuca

SEQ ID NO: 4000130 - RNA, 15 nt, Staphylococcus aureus subsp. aureus MW2
acgcuuuaaaucauu

SEQ ID NO: 4000131 - RNA, 18 nt, Staphylococcus aureus subsp. aureus MW2
acgcuuuaaaucauugcg

SEQ ID NO: 4000132 - RNA, 16 nt, Staphylococcus aureus subsp. aureus MW2
acgcuuuguuuuuagu

SEQ ID NO: 4000133 - RNA, 23 nt, Staphylococcus aureus subsp. aureus MW2
acgcuuuuucuucuacauauaca

SEQ ID NO: 4000134 - RNA, 14 nt, Staphylococcus aureus subsp. aureus MW2
acggaauaacuuuu

SEQ ID NO: 4000135 - RNA, 16 nt, Staphylococcus aureus subsp. aureus MW2
acggcugcuuuaacug

SEQ ID NO: 4000136 - RNA, 18 nt, Staphylococcus aureus subsp. aureus MW2
acgguaggaccucuuauu

SEQ ID NO: 4000137 - RNA, 13 nt, Staphylococcus aureus subsp. aureus MW2
acgguuugaaaaa

SEQ ID NO: 4000138 - RNA, 14 nt, Staphylococcus aureus subsp. aureus MW2
acguaaguuugcua

SEQ ID NO: 4000139 - RNA, 14 nt, Staphylococcus aureus subsp. aureus MW2
acguacaaaauaau

SEQ ID NO: 4000140 - RNA, 15 nt, Staphylococcus aureus subsp. aureus MW2
acguacguugaugug

SEQ ID NO: 4000141 - RNA, 16 nt, Staphylococcus aureus subsp. aureus MW2
acguauacaaauugau

SEQ ID NO: 4000142 - RNA, 17 nt, Staphylococcus aureus subsp. aureus MW2
acguauauaaguuaaaa

SEQ ID NO: 4000143 - RNA, 19 nt, Staphylococcus aureus subsp. aureus MW2
acguauauaaguuaaaauu

SEQ ID NO: 4000144 - RNA, 16 nt, Staphylococcus aureus subsp. aureus MW2
acguaucaucaaaauu

SEQ ID NO: 4000145 - RNA, 18 nt, Staphylococcus aureus subsp. aureus MW2
acguaucaucccauugca

SEQ ID NO: 4000146 - RNA, 16 nt, Staphylococcus aureus subsp. aureus MW2
acguaucauuuaaaau

SEQ ID NO: 4000147 - RNA, 21 nt, Staphylococcus aureus subsp. aureus MW2
acguaugcccucauaaaucau

SEQ ID NO: 4000148 - RNA, 19 nt, Staphylococcus aureus subsp. aureus MW2
acgucaagcuuugcugcuu

SEQ ID NO: 4000149 - RNA, 15 nt, Staphylococcus aureus subsp. aureus MW2
acgucacuuuauuaa

SEQ ID NO: 4000150 - RNA, 21 nt, Staphylococcus aureus subsp. aureus MW2
acgucacuuuauuaaauaacu

SEQ ID NO: 4000151 - RNA, 19 nt, Staphylococcus aureus subsp. aureus MW2
acgucauauguuuuauaau

SEQ ID NO: 4000152 - RNA, 16 nt, Staphylococcus aureus subsp. aureus MW2
acguccaaacacaaau

SEQ ID NO: 4000153 - RNA, 23 nt, Staphylococcus aureus subsp. aureus MW2
acguccgacaucauaaaugacgu

SEQ ID NO: 4000154 - RNA, 22 nt, Staphylococcus aureus subsp. aureus MW2
acgucgcaacaggaccacucaa

SEQ ID NO: 4000155 - RNA, 16 nt, Staphylococcus aureus subsp. aureus MW2
acgucuuguaucaaca

SEQ ID NO: 4000156 - RNA, 21 nt, Staphylococcus aureus subsp. aureus MW2
acgucuuuccauuuaucaaca

SEQ ID NO: 4000157 - RNA, 22 nt, Staphylococcus aureus subsp. aureus MW2
acgugacauuuucaaguuuaaa

SEQ ID NO: 4000158 - RNA, 22 nt, Staphylococcus aureus subsp. aureus MW2
acgugaggcccauaaauuacuu

SEQ ID NO: 4000159 - RNA, 18 nt, Staphylococcus aureus subsp. aureus MW2
acgugcauuguaauacca

SEQ ID NO: 4000160 - RNA, 19 nt, Staphylococcus aureus subsp. aureus MW2
acguggcucuaaaaacaaa

SEQ ID NO: 4000161 - RNA, 15 nt, Staphylococcus aureus subsp. aureus MW2
acguguuugagauau

SEQ ID NO: 4000162 - RNA, 18 nt, Staphylococcus aureus subsp. aureus MW2
acguuauucguuaacaau

SEQ ID NO: 4000163 - RNA, 17 nt, Staphylococcus aureus subsp. aureus MW2
acguucaaucguuucuu

SEQ ID NO: 4000164 - RNA, 14 nt, Staphylococcus aureus subsp. aureus MW2
acguucauggauuc

SEQ ID NO: 4000165 - RNA, 22 nt, Staphylococcus aureus subsp. aureus MW2
acguucgccaacuaaaucacca

SEQ ID NO: 4000166 - RNA, 16 nt, Staphylococcus aureus subsp. aureus MW2
acguucuaauaauuua

SEQ ID NO: 4000167 - RNA, 22 nt, Staphylococcus aureus subsp. aureus MW2
acguucuugguauuuuuuaaau

SEQ ID NO: 4000168 - RNA, 15 nt, Staphylococcus aureus subsp. aureus MW2
acguugauguaauuc

SEQ ID NO: 4000169 - RNA, 20 nt, Staphylococcus aureus subsp. aureus MW2
acguugguuuaaaaauugau

SEQ ID NO: 4000170 - RNA, 16 nt, Staphylococcus aureus subsp. aureus MW2
acguuuacguucuuca

SEQ ID NO: 4000171 - RNA, 17 nt, Staphylococcus aureus subsp. aureus MW2
acguuuagugaaaauac

SEQ ID NO: 4000172 - RNA, 17 nt, Staphylococcus aureus subsp. aureus MW2
acguuuauccuuuaaau

SEQ ID NO: 4000173 - RNA, 18 nt, Staphylococcus aureus subsp. aureus MW2
acguuuauccuuuaaauc

SEQ ID NO: 4000174 - RNA, 20 nt, Staphylococcus aureus subsp. aureus MW2
acguuuauccuuuaaaucau

SEQ ID NO: 4000175 - RNA, 14 nt, Staphylococcus aureus subsp. aureus MW2
acguuuccaaucca

SEQ ID NO: 4000176 - RNA, 16 nt, Staphylococcus aureus subsp. aureus MW2
acguuuccaauccauu

SEQ ID NO: 4000177 - RNA, 16 nt, Staphylococcus aureus subsp. aureus MW2
acguuugcauauccuu

SEQ ID NO: 4000178 - RNA, 19 nt, Staphylococcus aureus subsp. aureus MW2
acguuuuaaauaaaugacu

SEQ ID NO: 4000179 - RNA, 20 nt, Staphylococcus aureus subsp. aureus MW2
acguuuuaaauaaaugacuu

SEQ ID NO: 4000180 - RNA, 11 nt, Staphylococcus aureus subsp. aureus MW2
acguuuucuag

SEQ ID NO: 4000181 - RNA, 16 nt, Staphylococcus aureus subsp. aureus MW2
acguuuucuagguaau

SEQ ID NO: 4000182 - RNA, 20 nt, Staphylococcus aureus subsp. aureus MW2
acguuuucuagguaauacga

SEQ ID NO: 4000183 - RNA, 20 nt, Staphylococcus aureus subsp. aureus MW2
acguuuugguuguucuuuuu

SEQ ID NO: 4000184 - RNA, 16 nt, Staphylococcus aureus subsp. aureus MW2
acguuuuucuuuaaac

SEQ ID NO: 4000185 - RNA, 15 nt, Staphylococcus aureus subsp. aureus MW2
acguuuuugaaucag

SEQ ID NO: 4000186 - RNA, 15 nt, Staphylococcus aureus subsp. aureus MW2
acguuuuuuuaaaua

SEQ ID NO: 4000187 - RNA, 23 nt, Staphylococcus aureus subsp. aureus MW2
acguuuuuuuauaaauuauagua

SEQ ID NO: 4000188 - RNA, 22 nt, Staphylococcus aureus subsp. aureus MW2
acuaaaaagaagcucccauuaa

SEQ ID NO: 4000189 - RNA, 11 nt, Staphylococcus aureus subsp. aureus MW2
acuaaaaauau

SEQ ID NO: 4000190 - RNA, 16 nt, Staphylococcus aureus subsp. aureus MW2
acuaaaacaauaauaa

SEQ ID NO: 4000191 - RNA, 21 nt, Staphylococcus aureus subsp. aureus MW2
acuaaaacaauaauaauaaga

SEQ ID NO: 4000192 - RNA, 20 nt, Staphylococcus aureus subsp. aureus MW2
acuaaaacaugauacguggu

SEQ ID NO: 4000193 - RNA, 19 nt, Staphylococcus aureus subsp. aureus MW2
acuaaaaggucaucugaug

SEQ ID NO: 4000194 - RNA, 20 nt, Staphylococcus aureus subsp. aureus MW2
acuaaaaguggccuuuuaaa

SEQ ID NO: 4000195 - RNA, 19 nt, Staphylococcus aureus subsp. aureus MW2
acuaaaaguguuaugaauu

SEQ ID NO: 4000196 - RNA, 22 nt, Staphylococcus aureus subsp. aureus MW2
acuaaaaugucuuugaaaaauu

SEQ ID NO: 4000197 - RNA, 19 nt, Staphylococcus aureus subsp. aureus MW2
acuaaaauuuguaauuuaa

SEQ ID NO: 4000198 - RNA, 20 nt, Staphylococcus aureus subsp. aureus MW2
acuaaaauuuguaauuuaaa

SEQ ID NO: 4000199 - RNA, 15 nt, Staphylococcus aureus subsp. aureus MW2
acuaaaccaaugauu

SEQ ID NO: 4000200 - RNA, 13 nt, Staphylococcus aureus subsp. aureus MW2
acuaaacgauaaa

SEQ ID NO: 4000201 - RNA, 14 nt, Staphylococcus aureus subsp. aureus MW2
acuaaaggaauuuc

SEQ ID NO: 4000202 - RNA, 16 nt, Staphylococcus aureus subsp. aureus MW2
acuaaaggaauuucaa

SEQ ID NO: 4000203 - RNA, 18 nt, Staphylococcus aureus subsp. aureus MW2
acuaaagguauucuauuu

SEQ ID NO: 4000204 - RNA, 17 nt, Staphylococcus aureus subsp. aureus MW2
acuaaaguaaauaacac

SEQ ID NO: 4000205 - RNA, 15 nt, Staphylococcus aureus subsp. aureus MW2
acuaaaguugcaaac

SEQ ID NO: 4000206 - RNA, 17 nt, Staphylococcus aureus subsp. aureus MW2
acuaaaucaccauuuuu

SEQ ID NO: 4000207 - RNA, 16 nt, Staphylococcus aureus subsp. aureus MW2
acuaaaugaauugcuu

SEQ ID NO: 4000208 - RNA, 16 nt, Staphylococcus aureus subsp. aureus MW2
acuaaauucaauaauc

SEQ ID NO: 4000209 - RNA, 21 nt, Staphylococcus aureus subsp. aureus MW2
acucauacaaauuuuuuuuau

SEQ ID NO: 4000210 - RNA, 13 nt, Staphylococcus aureus subsp. aureus MW2
acucaucgaguuu

SEQ ID NO: 4000211 - RNA, 18 nt, Staphylococcus aureus subsp. aureus MW2
acuccauagaaauuguag

SEQ ID NO: 4000212 - RNA, 13 nt, Staphylococcus aureus subsp. aureus MW2
acucccauuggca

SEQ ID NO: 4000213 - RNA, 14 nt, Staphylococcus aureus subsp. aureus MW2
acucccuuuuuaaa

SEQ ID NO: 4000214 - RNA, 15 nt, Staphylococcus aureus subsp. aureus MW2
acuccucuauuuuau

SEQ ID NO: 4000215 - RNA, 15 nt, Staphylococcus aureus subsp. aureus MW2
acuccuuaaacaaau

SEQ ID NO: 4000216 - RNA, 17 nt, Staphylococcus aureus subsp. aureus MW2
acuccuuaaacaaauaa

SEQ ID NO: 4000217 - RNA, 15 nt, Staphylococcus aureus subsp. aureus MW2
acuccuuacaauaaa

SEQ ID NO: 4000218 - RNA, 14 nt, Staphylococcus aureus subsp. aureus MW2
acucgacuugguau

SEQ ID NO: 4000219 - RNA, 16 nt, Staphylococcus aureus subsp. aureus MW2
acucgcaaucgagaug

SEQ ID NO: 4000220 - RNA, 19 nt, Staphylococcus aureus subsp. aureus MW2
acucgcccccguaauaauu

SEQ ID NO: 4000221 - RNA, 15 nt, Staphylococcus aureus subsp. aureus MW2
acucguaaauuuuau

SEQ ID NO: 4000222 - RNA, 20 nt, Staphylococcus aureus subsp. aureus MW2
acucguugcgcucuuuucuu

SEQ ID NO: 4000223 - RNA, 21 nt, Staphylococcus aureus subsp. aureus MW2
acucguugcgcucuuuucuug

SEQ ID NO: 4000224 - RNA, 22 nt, Staphylococcus aureus subsp. aureus MW2
acucuaaaacgauuaauaguuu

SEQ ID NO: 4000225 - RNA, 17 nt, Staphylococcus aureus subsp. aureus MW2
acucuaauuacauauac

SEQ ID NO: 4000226 - RNA, 18 nt, Staphylococcus aureus subsp. aureus MW2
acucuaucaaauuacuua

SEQ ID NO: 4000227 - RNA, 22 nt, Staphylococcus aureus subsp. aureus MW2
acucugauauugaucugauuuc

SEQ ID NO: 4000228 - RNA, 24 nt, Staphylococcus aureus subsp. aureus MW2
acucuucaguacgaacaacuaaca

SEQ ID NO: 4000229 - RNA, 19 nt, Staphylococcus aureus subsp. aureus MW2
acucuucuaaguuauuaca

SEQ ID NO: 4000230 - RNA, 14 nt, Staphylococcus aureus subsp. aureus MW2
acucuugaaacaca

SEQ ID NO: 4000231 - RNA, 18 nt, Staphylococcus aureus subsp. aureus MW2
acucuuuaaaucaaagag

SEQ ID NO: 4000232 - RNA, 12 nt, Staphylococcus aureus subsp. aureus MW2
acucuuugcaau

SEQ ID NO: 4000233 - RNA, 17 nt, Staphylococcus aureus subsp. aureus MW2
acucuuuuuaauauuuu

SEQ ID NO: 4000234 - RNA, 22 nt, Staphylococcus aureus subsp. aureus MW2
acugaaauuucauaaaguuuau

SEQ ID NO: 4000235 - RNA, 18 nt, Staphylococcus aureus subsp. aureus MW2
acugaaugcuaauacuaa

SEQ ID NO: 4000236 - RNA, 20 nt, Staphylococcus aureus subsp. aureus MW2
acugacaaugcaaguuggcg

SEQ ID NO: 4000237 - RNA, 16 nt, Staphylococcus aureus subsp. aureus MW2
acugacacaguaauuc

SEQ ID NO: 4000238 - RNA, 19 nt, Staphylococcus aureus subsp. aureus MW2
acugagcaacaaaagaugu

SEQ ID NO: 4000239 - RNA, 16 nt, Staphylococcus aureus subsp. aureus MW2
acugauaaaaggggaa

SEQ ID NO: 4000240 - RNA, 22 nt, Staphylococcus aureus subsp. aureus MW2
acugauaaaaggggaaaucauu

SEQ ID NO: 4000241 - RNA, 21 nt, Staphylococcus aureus subsp. aureus MW2
acugaugaaaacuuaaaaaug

SEQ ID NO: 4000242 - RNA, 13 nt, Staphylococcus aureus subsp. aureus MW2
acugauuaaacug

SEQ ID NO: 4000243 - RNA, 22 nt, Staphylococcus aureus subsp. aureus MW2
acugauucaccagguuuuuuau

SEQ ID NO: 4000244 - RNA, 19 nt, Staphylococcus aureus subsp. aureus MW2
acugcaaacacaguacaaa

SEQ ID NO: 4000245 - RNA, 21 nt, Staphylococcus aureus subsp. aureus MW2
acugcaacaccacacagcauu

SEQ ID NO: 4000246 - RNA, 20 nt, Staphylococcus aureus subsp. aureus MW2
acugcaauggcuaaugacuu

SEQ ID NO: 4000247 - RNA, 14 nt, Staphylococcus aureus subsp. aureus MW2
acugcaccuccaac

SEQ ID NO: 4000248 - RNA, 16 nt, Staphylococcus aureus subsp. aureus MW2
acugccauauguuuua

SEQ ID NO: 4000249 - RNA, 20 nt, Staphylococcus aureus subsp. aureus MW2
acugcguuaugaauugcuuu

SEQ ID NO: 4000250 - RNA, 13 nt, Staphylococcus aureus subsp. aureus MW2
acugcuaauauua

SEQ ID NO: 4000251 - RNA, 18 nt, Staphylococcus aureus subsp. aureus MW2
acugcuaauauuagauau

SEQ ID NO: 4000252 - RNA, 14 nt, Staphylococcus aureus subsp. aureus MW2
acugcuaauuuuuu

SEQ ID NO: 4000253 - RNA, 19 nt, Staphylococcus aureus subsp. aureus MW2
acugcuaauuuuuucauca

SEQ ID NO: 4000254 - RNA, 18 nt, Staphylococcus aureus subsp. aureus MW2
acugcuggaacaccaaua

SEQ ID NO: 4000255 - RNA, 15 nt, Staphylococcus aureus subsp. aureus MW2
acugcuguucuuuuu

SEQ ID NO: 4000256 - RNA, 22 nt, Staphylococcus aureus subsp. aureus MW2
acugcuuuggacacaauaccuu

SEQ ID NO: 4000257 - RNA, 16 nt, Staphylococcus aureus subsp. aureus MW2
acugcuuuuaaaucau

SEQ ID NO: 4000258 - RNA, 19 nt, Staphylococcus aureus subsp. aureus MW2
acugcuuuuuuaaauuuaa

SEQ ID NO: 4000259 - RNA, 19 nt, Staphylococcus aureus subsp. aureus MW2
acuggauaaauaaagauuc

SEQ ID NO: 4000260 - RNA, 16 nt, Staphylococcus aureus subsp. aureus MW2
acuggcaaaucaaaca

SEQ ID NO: 4000261 - RNA, 18 nt, Staphylococcus aureus subsp. aureus MW2
acuggcguuaaagcuuuu

SEQ ID NO: 4000262 - RNA, 14 nt, Staphylococcus aureus subsp. aureus MW2
acugguugauaaau

SEQ ID NO: 4000263 - RNA, 13 nt, Staphylococcus aureus subsp. aureus MW2
acuguaaaucauc

SEQ ID NO: 4000264 - RNA, 15 nt, Staphylococcus aureus subsp. aureus MW2
acuguaaaugaaaug

SEQ ID NO: 4000265 - RNA, 23 nt, Staphylococcus aureus subsp. aureus MW2
acuguauaaauaaccgcacuuuc

SEQ ID NO: 4000266 - RNA, 22 nt, Staphylococcus aureus subsp. aureus MW2
acuguauuuuagcgucauuuuu

SEQ ID NO: 4000267 - RNA, 18 nt, Staphylococcus aureus subsp. aureus MW2
acugucaccuucuauauu

SEQ ID NO: 4000268 - RNA, 17 nt, Staphylococcus aureus subsp. aureus MW2
acugucaugaaguaauu

SEQ ID NO: 4000269 - RNA, 20 nt, Staphylococcus aureus subsp. aureus MW2
acugucgguucaucuaaaau

SEQ ID NO: 4000270 - RNA, 23 nt, Staphylococcus aureus subsp. aureus MW2
acugucucaucuucuaaaucaau

SEQ ID NO: 4000271 - RNA, 22 nt, Staphylococcus aureus subsp. aureus MW2
acuguuaaagucuguugguuua

SEQ ID NO: 4000272 - RNA, 21 nt, Staphylococcus aureus subsp. aureus MW2
acuguucuuucgucuuguaaa

SEQ ID NO: 4000273 - RNA, 16 nt, Staphylococcus aureus subsp. aureus MW2
acuguuugcuuuauca

SEQ ID NO: 4000274 - RNA, 20 nt, Staphylococcus aureus subsp. aureus MW2
acuguuuguuuauugagaau

SEQ ID NO: 4000275 - RNA, 14 nt, Staphylococcus aureus subsp. aureus MW2
acuguuuucauuug

SEQ ID NO: 4000276 - RNA, 15 nt, Staphylococcus aureus subsp. aureus MW2
acuguuuucauuugu

SEQ ID NO: 4000277 - RNA, 17 nt, Staphylococcus aureus subsp. aureus MW2
acuuaaaacuauaaccu

SEQ ID NO: 4000278 - RNA, 18 nt, Staphylococcus aureus subsp. aureus MW2
acuuaaaagagaauauaa

SEQ ID NO: 4000279 - RNA, 21 nt, Staphylococcus aureus subsp. aureus MW2
acuuaaaagagaauauaaaau

SEQ ID NO: 4000280 - RNA, 14 nt, Staphylococcus aureus subsp. aureus MW2
acuuaaaauauuua

SEQ ID NO: 4000281 - RNA, 15 nt, Staphylococcus aureus subsp. aureus MW2
acuuaaaauauuuaa

SEQ ID NO: 4000282 - RNA, 20 nt, Staphylococcus aureus subsp. aureus MW2
acuuaacaucuuuuucaccu

SEQ ID NO: 4000283 - RNA, 13 nt, Staphylococcus aureus subsp. aureus MW2
acuuaauaucaua

SEQ ID NO: 4000284 - RNA, 23 nt, Staphylococcus aureus subsp. aureus MW2
acuuaaugacuucuuuauauuua

SEQ ID NO: 4000285 - RNA, 16 nt, Staphylococcus aureus subsp. aureus MW2
acuuaaugcuucaaau

SEQ ID NO: 4000286 - RNA, 18 nt, Staphylococcus aureus subsp. aureus MW2
acuuaauuaauaauuuaa

SEQ ID NO: 4000287 - RNA, 12 nt, Staphylococcus aureus subsp. aureus MW2
acuuacaaauau

SEQ ID NO: 4000288 - RNA, 17 nt, Staphylococcus aureus subsp. aureus MW2
acuuacauuacauauau

SEQ ID NO: 4000289 - RNA, 23 nt, Staphylococcus aureus subsp. aureus MW2
acuuacauuuuaauaaaaucauc

SEQ ID NO: 4000290 - RNA, 13 nt, Staphylococcus aureus subsp. aureus MW2
acuuacugcugcu

SEQ ID NO: 4000291 - RNA, 13 nt, Staphylococcus aureus subsp. aureus MW2
acuuacuuuucua

SEQ ID NO: 4000292 - RNA, 14 nt, Staphylococcus aureus subsp. aureus MW2
acuuacuuuucuaa

SEQ ID NO: 4000293 - RNA, 22 nt, Staphylococcus aureus subsp. aureus MW2
acuuacuuuucuaaacaacuuc

SEQ ID NO: 4000294 - RNA, 18 nt, Staphylococcus aureus subsp. aureus MW2
acuuagaccccuaauuaa

SEQ ID NO: 4000295 - RNA, 22 nt, Staphylococcus aureus subsp. aureus MW2
acuuagaccccuaauuaaaaug

SEQ ID NO: 4000296 - RNA, 15 nt, Staphylococcus aureus subsp. aureus MW2
acuuaguaauaagac

SEQ ID NO: 4000297 - RNA, 15 nt, Staphylococcus aureus subsp. aureus MW2
acuuuguuaaaaaau

SEQ ID NO: 4000298 - RNA, 19 nt, Staphylococcus aureus subsp. aureus MW2
acuuuguucugcuuuuucu

SEQ ID NO: 4000299 - RNA, 16 nt, Staphylococcus aureus subsp. aureus MW2
acuuuuacaaucauca

SEQ ID NO: 4000300 - RNA, 22 nt, Staphylococcus aureus subsp. aureus MW2
acuuuuauggagugauauagau

SEQ ID NO: 4000301 - RNA, 15 nt, Staphylococcus aureus subsp. aureus MW2
acuuuuauuuuuuau

SEQ ID NO: 4000302 - RNA, 17 nt, Staphylococcus aureus subsp. aureus MW2
acuuuucaacuuuaguu

SEQ ID NO: 4000303 - RNA, 16 nt, Staphylococcus aureus subsp. aureus MW2
acuuuugauuuugaau

SEQ ID NO: 4000304 - RNA, 24 nt, Staphylococcus aureus subsp. aureus MW2
acuuuugcaucacagauaaugcau

SEQ ID NO: 4000305 - RNA, 20 nt, Staphylococcus aureus subsp. aureus MW2
acuuuuggucuguugaaguc

SEQ ID NO: 4000306 - RNA, 23 nt, Staphylococcus aureus subsp. aureus MW2
acuuuuuaaacguacauuuuuau

SEQ ID NO: 4000307 - RNA, 17 nt, Staphylococcus aureus subsp. aureus MW2
acuuuuuaauuccaaag

SEQ ID NO: 4000308 - RNA, 16 nt, Staphylococcus aureus subsp. aureus MW2
acuuuuuauauugcga

SEQ ID NO: 4000309 - RNA, 14 nt, Staphylococcus aureus subsp. aureus MW2
acuuuuucaucuuu

SEQ ID NO: 4000310 - RNA, 19 nt, Staphylococcus aureus subsp. aureus MW2
acuuuuucgauuaauucuu

SEQ ID NO: 4000311 - RNA, 22 nt, Staphylococcus aureus subsp. aureus MW2
acuuuuugacauauuuuuuaaa

SEQ ID NO: 4000312 - RNA, 16 nt, Staphylococcus aureus subsp. aureus MW2
acuuuuugaguaucca

SEQ ID NO: 4000313 - RNA, 22 nt, Staphylococcus aureus subsp. aureus MW2
acuuuuugaguauccaauacua

SEQ ID NO: 4000314 - RNA, 18 nt, Staphylococcus aureus subsp. aureus MW2
acuuuuuugugauuauua

SEQ ID NO: 4000315 - RNA, 14 nt, Staphylococcus aureus subsp. aureus MW2
acuuuuuuguucaa

SEQ ID NO: 4000316 - RNA, 19 nt, Staphylococcus aureus subsp. aureus MW2
acuuuuuuguucaaucacu

SEQ ID NO: 4000317 - RNA, 11 nt, Staphylococcus aureus subsp. aureus MW2
agaaaaaaauc

SEQ ID NO: 4000318 - RNA, 14 nt, Staphylococcus aureus subsp. aureus MW2
agaaaaaacaagau

SEQ ID NO: 4000319 - RNA, 18 nt, Staphylococcus aureus subsp. aureus MW2
agaaaaagggcaaaaaag

SEQ ID NO: 4000320 - RNA, 14 nt, Staphylococcus aureus subsp. aureus MW2
agaaaaagugauaa

SEQ ID NO: 4000321 - RNA, 17 nt, Staphylococcus aureus subsp. aureus MW2
agaaaagcuagaaguuc

SEQ ID NO: 4000322 - RNA, 21 nt, Staphylococcus aureus subsp. aureus MW2
agaaaagcuagaaguucuuau

SEQ ID NO: 4000323 - RNA, 23 nt, Staphylococcus aureus subsp. aureus MW2
agaaaaggcucauuuguuaaauu

SEQ ID NO: 4000324 - RNA, 16 nt, Staphylococcus aureus subsp. aureus MW2
agaaaaguaaguaaaa

SEQ ID NO: 4000325 - RNA, 21 nt, Staphylococcus aureus subsp. aureus MW2
agaaaauaugacgaucuucau

SEQ ID NO: 4000326 - RNA, 19 nt, Staphylococcus aureus subsp. aureus MW2
agaaaauuuguaacaggau

SEQ ID NO: 4000327 - RNA, 13 nt, Staphylococcus aureus subsp. aureus MW2
agaaacacaagga

SEQ ID NO: 4000328 - RNA, 18 nt, Staphylococcus aureus subsp. aureus MW2
agaaaccuuaaaaucagu

SEQ ID NO: 4000329 - RNA, 15 nt, Staphylococcus aureus subsp. aureus MW2
agaaacgaaauuaua

SEQ ID NO: 4000330 - RNA, 14 nt, Staphylococcus aureus subsp. aureus MW2
agaaagauguguau

SEQ ID NO: 4000331 - RNA, 23 nt, Staphylococcus aureus subsp. aureus MW2
agaaagcgucuuuuuauacuuga

SEQ ID NO: 4000332 - RNA, 16 nt, Staphylococcus aureus subsp. aureus MW2
agaaagcuaauaucaa

SEQ ID NO: 4000333 - RNA, 18 nt, Staphylococcus aureus subsp. aureus MW2
agaaagcuaauaucaaua

SEQ ID NO: 4000334 - RNA, 19 nt, Staphylococcus aureus subsp. aureus MW2
agaaaggcuagcuaaaauu

SEQ ID NO: 4000335 - RNA, 21 nt, Staphylococcus aureus subsp. aureus MW2
agaaaggcuagcuaaaauuug

SEQ ID NO: 4000336 - RNA, 22 nt, Staphylococcus aureus subsp. aureus MW2
agaaaggcuagcuaaaauuugc

SEQ ID NO: 4000337 - RNA, 17 nt, Staphylococcus aureus subsp. aureus MW2
agaaagugcgguuauuu

SEQ ID NO: 4000338 - RNA, 21 nt, Staphylococcus aureus subsp. aureus MW2
agaaauaacgauaccuuuaau

SEQ ID NO: 4000339 - RNA, 14 nt, Staphylococcus aureus subsp. aureus MW2
agaaauaauuuaaa

SEQ ID NO: 4000340 - RNA, 17 nt, Staphylococcus aureus subsp. aureus MW2
agaaaucucuaucgccu

SEQ ID NO: 4000341 - RNA, 21 nt, Staphylococcus aureus subsp. aureus MW2
agaaaucuuauagauuuuuca

SEQ ID NO: 4000342 - RNA, 16 nt, Staphylococcus aureus subsp. aureus MW2
agaaaugucaguuuug

SEQ ID NO: 4000343 - RNA, 21 nt, Staphylococcus aureus subsp. aureus MW2
agaaauucgcaagccuucuau

SEQ ID NO: 4000344 - RNA, 21 nt, Staphylococcus aureus subsp. aureus MW2
agaaauucuacagacaaugca

SEQ ID NO: 4000345 - RNA, 19 nt, Staphylococcus aureus subsp. aureus MW2
agaaauucuacaggcaaug

SEQ ID NO: 4000346 - RNA, 18 nt, Staphylococcus aureus subsp. aureus MW2
agaaauuggcuccccaau

SEQ ID NO: 4000347 - RNA, 20 nt, Staphylococcus aureus subsp. aureus MW2
agaaauuugauuuucaauuu

SEQ ID NO: 4000348 - RNA, 12 nt, Staphylococcus aureus subsp. aureus MW2
agaacaaaaugu

SEQ ID NO: 4000349 - RNA, 15 nt, Staphylococcus aureus subsp. aureus MW2
agaacaauaauugau

SEQ ID NO: 4000350 - RNA, 17 nt, Staphylococcus aureus subsp. aureus MW2
agaacagauauacuacu

SEQ ID NO: 4000351 - RNA, 17 nt, Staphylococcus aureus subsp. aureus MW2
agaacagcacauuuuua

SEQ ID NO: 4000352 - RNA, 21 nt, Staphylococcus aureus subsp. aureus MW2
agaacaucaucauguuuauua

SEQ ID NO: 4000353 - RNA, 23 nt, Staphylococcus aureus subsp. aureus MW2
agaacaugauacugaaauuucau

SEQ ID NO: 4000354 - RNA, 15 nt, Staphylococcus aureus subsp. aureus MW2
agaaccaacaauaaa

SEQ ID NO: 4000355 - RNA, 18 nt, Staphylococcus aureus subsp. aureus MW2
agaaccacgcaucaugua

SEQ ID NO: 4000356 - RNA, 22 nt, Staphylococcus aureus subsp. aureus MW2
agaaccacgcaucauguauaug

SEQ ID NO: 4000357 - RNA, 21 nt, Staphylococcus aureus subsp. aureus MW2
agaaccaucauuuauauggaa

SEQ ID NO: 4000358 - RNA, 23 nt, Staphylococcus aureus subsp. aureus MW2
agaaccuauauuaagcauuuguc

SEQ ID NO: 4000359 - RNA, 14 nt, Staphylococcus aureus subsp. aureus MW2
agaacgagaauuuc

SEQ ID NO: 4000360 - RNA, 14 nt, Staphylococcus aureus subsp. aureus MW2
agaacuaauguaaa

SEQ ID NO: 4000361 - RNA, 14 nt, Staphylococcus aureus subsp. aureus MW2
agaacuucucuuug

SEQ ID NO: 4000362 - RNA, 21 nt, Staphylococcus aureus subsp. aureus MW2
agaacuugcuuuucauuuaau

SEQ ID NO: 4000363 - RNA, 23 nt, Staphylococcus aureus subsp. aureus MW2
agaacuuuaaaaauugcaaugcu

SEQ ID NO: 4000364 - RNA, 16 nt, Staphylococcus aureus subsp. aureus MW2
agaagaaacuuaauca

SEQ ID NO: 4000365 - RNA, 21 nt, Staphylococcus aureus subsp. aureus MW2
agaagacauuccccauuuauc

SEQ ID NO: 4000366 - RNA, 16 nt, Staphylococcus aureus subsp. aureus MW2
agaagauuagaugaua

SEQ ID NO: 4000367 - RNA, 17 nt, Staphylococcus aureus subsp. aureus MW2
agaagcugacgaaaagu

SEQ ID NO: 4000368 - RNA, 20 nt, Staphylococcus aureus subsp. aureus MW2
agaagcugacgaaaagucag

SEQ ID NO: 4000369 - RNA, 13 nt, Staphylococcus aureus subsp. aureus MW2
agaagcuggcgga

SEQ ID NO: 4000370 - RNA, 16 nt, Staphylococcus aureus subsp. aureus MW2
agaagcuggcggaaag

SEQ ID NO: 4000371 - RNA, 22 nt, Staphylococcus aureus subsp. aureus MW2
agaagcuggcggaaagucaggu

SEQ ID NO: 4000372 - RNA, 15 nt, Staphylococcus aureus subsp. aureus MW2
agaagcuuucuggaa

SEQ ID NO: 4000373 - RNA, 20 nt, Staphylococcus aureus subsp. aureus MW2
agaaggggacuuaaccauuu

SEQ ID NO: 4000374 - RNA, 13 nt, Staphylococcus aureus subsp. aureus MW2
agaaguauuauga

SEQ ID NO: 4000375 - RNA, 22 nt, Staphylococcus aureus subsp. aureus MW2
agaagugcgguuuaaucuauau

SEQ ID NO: 4000376 - RNA, 16 nt, Staphylococcus aureus subsp. aureus MW2
agaaguucuuaugcag

SEQ ID NO: 4000377 - RNA, 18 nt, Staphylococcus aureus subsp. aureus MW2
agaaguuuccaacguuau

SEQ ID NO: 4000378 - RNA, 15 nt, Staphylococcus aureus subsp. aureus MW2
agaaguuuuuugauu

SEQ ID NO: 4000379 - RNA, 13 nt, Staphylococcus aureus subsp. aureus MW2
agaauaaaaaagu

SEQ ID NO: 4000380 - RNA, 16 nt, Staphylococcus aureus subsp. aureus MW2
agaauaaacaacauac

SEQ ID NO: 4000381 - RNA, 17 nt, Staphylococcus aureus subsp. aureus MW2
agaauacuaaaaguguu

SEQ ID NO: 4000382 - RNA, 17 nt, Staphylococcus aureus subsp. aureus MW2
agaauaguuaccaaaau

SEQ ID NO: 4000383 - RNA, 14 nt, Staphylococcus aureus subsp. aureus MW2
agaauauaaaauaa

SEQ ID NO: 4000384 - RNA, 15 nt, Staphylococcus aureus subsp. aureus MW2
agaauauaaaauaau

SEQ ID NO: 4000385 - RNA, 23 nt, Staphylococcus aureus subsp. aureus MW2
agaguaguucggaugagaaaugu

SEQ ID NO: 4000386 - RNA, 12 nt, Staphylococcus aureus subsp. aureus MW2
agauaaaaaaua

SEQ ID NO: 4000387 - RNA, 21 nt, Staphylococcus aureus subsp. aureus MW2
agauaaauaaaaggcauucuu

SEQ ID NO: 4000388 - RNA, 14 nt, Staphylococcus aureus subsp. aureus MW2
agauaaaucaucau

SEQ ID NO: 4000389 - RNA, 19 nt, Staphylococcus aureus subsp. aureus MW2
agauaaaucgauaaaaugu

SEQ ID NO: 4000390 - RNA, 15 nt, Staphylococcus aureus subsp. aureus MW2
agauaaauuaauaug

SEQ ID NO: 4000391 - RNA, 17 nt, Staphylococcus aureus subsp. aureus MW2
agauaaauuaauaugaa

SEQ ID NO: 4000392 - RNA, 20 nt, Staphylococcus aureus subsp. aureus MW2
agauaacuagaaugauuaaa

SEQ ID NO: 4000393 - RNA, 15 nt, Staphylococcus aureus subsp. aureus MW2
agauaagaauauuua

SEQ ID NO: 4000394 - RNA, 12 nt, Staphylococcus aureus subsp. aureus MW2
agauaaugcacc

SEQ ID NO: 4000395 - RNA, 17 nt, Staphylococcus aureus subsp. aureus MW2
agauacaccaauauuuu

SEQ ID NO: 4000396 - RNA, 16 nt, Staphylococcus aureus subsp. aureus MW2
agauacacguaacgca

SEQ ID NO: 4000397 - RNA, 14 nt, Staphylococcus aureus subsp. aureus MW2
agauacguuauuuc

SEQ ID NO: 4000398 - RNA, 21 nt, Staphylococcus aureus subsp. aureus MW2
agauaguuugagaaaauuaau

SEQ ID NO: 4000399 - RNA, 22 nt, Staphylococcus aureus subsp. aureus MW2
agauaguuugagaaaauuaaua

SEQ ID NO: 4000400 - RNA, 15 nt, Staphylococcus aureus subsp. aureus MW2
agauauaagaaaaag

SEQ ID NO: 4000401 - RNA, 16 nt, Staphylococcus aureus subsp. aureus MW2
agauauaagaaaaaga

SEQ ID NO: 4000402 - RNA, 18 nt, Staphylococcus aureus subsp. aureus MW2
agauauauaauaccccaa

SEQ ID NO: 4000403 - RNA, 19 nt, Staphylococcus aureus subsp. aureus MW2
agauauauuaauauuugau

SEQ ID NO: 4000404 - RNA, 15 nt, Staphylococcus aureus subsp. aureus MW2
agauaucauaauauu

SEQ ID NO: 4000405 - RNA, 19 nt, Staphylococcus aureus subsp. aureus MW2
agauaucauuuuauccaaa

SEQ ID NO: 4000406 - RNA, 16 nt, Staphylococcus aureus subsp. aureus MW2
agauaucuuauaacaa

SEQ ID NO: 4000407 - RNA, 21 nt, Staphylococcus aureus subsp. aureus MW2
agauaucuuauaacaaaaauu

SEQ ID NO: 4000408 - RNA, 21 nt, Staphylococcus aureus subsp. aureus MW2
agauauuauugugaaaucuau

SEQ ID NO: 4000409 - RNA, 21 nt, Staphylococcus aureus subsp. aureus MW2
agauauuucggacaauaacag

SEQ ID NO: 4000410 - RNA, 12 nt, Staphylococcus aureus subsp. aureus MW2
agaucaauauca

SEQ ID NO: 4000411 - RNA, 20 nt, Staphylococcus aureus subsp. aureus MW2
agaucauacauuagaacaau

SEQ ID NO: 4000412 - RNA, 21 nt, Staphylococcus aureus subsp. aureus MW2
agaucgauguguaacauuacg

SEQ ID NO: 4000413 - RNA, 13 nt, Staphylococcus aureus subsp. aureus MW2
agaucguuuucaa

SEQ ID NO: 4000414 - RNA, 19 nt, Staphylococcus aureus subsp. aureus MW2
agaucuaugauaugugaaa

SEQ ID NO: 4000415 - RNA, 21 nt, Staphylococcus aureus subsp. aureus MW2
agaucucaauccaauuaaaua

SEQ ID NO: 4000416 - RNA, 22 nt, Staphylococcus aureus subsp. aureus MW2
agaugaaauacuugaauguaag

SEQ ID NO: 4000417 - RNA, 22 nt, Staphylococcus aureus subsp. aureus MW2
agaugaaugccuaauuuuguga

SEQ ID NO: 4000418 - RNA, 17 nt, Staphylococcus aureus subsp. aureus MW2
agaugagauuucguuag

SEQ ID NO: 4000419 - RNA, 19 nt, Staphylococcus aureus subsp. aureus MW2
agaugaggcgauaaaagaa

SEQ ID NO: 4000420 - RNA, 16 nt, Staphylococcus aureus subsp. aureus MW2
agaugauugucuagca

SEQ ID NO: 4000421 - RNA, 19 nt, Staphylococcus aureus subsp. aureus MW2
agaugauugucuagcagag

SEQ ID NO: 4000422 - RNA, 16 nt, Staphylococcus aureus subsp. aureus MW2
agaugauuucaaaugu

SEQ ID NO: 4000423 - RNA, 16 nt, Staphylococcus aureus subsp. aureus MW2
agaugcauaaaaaaag

SEQ ID NO: 4000424 - RNA, 19 nt, Staphylococcus aureus subsp. aureus MW2
agaugcuugaccuucaguu

SEQ ID NO: 4000425 - RNA, 20 nt, Staphylococcus aureus subsp. aureus MW2
agauggucuuuuaauuaaaa

SEQ ID NO: 4000426 - RNA, 15 nt, Staphylococcus aureus subsp. aureus MW2
agauguauaaaacua

SEQ ID NO: 4000427 - RNA, 21 nt, Staphylococcus aureus subsp. aureus MW2
agaugucacuguuaaagaugu

SEQ ID NO: 4000428 - RNA, 18 nt, Staphylococcus aureus subsp. aureus MW2
agaugugaugcuugaaug

SEQ ID NO: 4000429 - RNA, 17 nt, Staphylococcus aureus subsp. aureus MW2
agaugugcgugguuuau

SEQ ID NO: 4000430 - RNA, 16 nt, Staphylococcus aureus subsp. aureus MW2
agauguucacauucuu

SEQ ID NO: 4000431 - RNA, 18 nt, Staphylococcus aureus subsp. aureus MW2
agauguugaaaaguauau

SEQ ID NO: 4000432 - RNA, 20 nt, Staphylococcus aureus subsp. aureus MW2
agauguugcuagugcauuua

SEQ ID NO: 4000433 - RNA, 15 nt, Staphylococcus aureus subsp. aureus MW2
agauguuucaaaaua

SEQ ID NO: 4000434 - RNA, 19 nt, Staphylococcus aureus subsp. aureus MW2
agauuaaaauaugacacau

SEQ ID NO: 4000435 - RNA, 15 nt, Staphylococcus aureus subsp. aureus MW2
agauuaccuacaaua

SEQ ID NO: 4000436 - RNA, 24 nt, Staphylococcus aureus subsp. aureus MW2
agauuaguguagggggcauuauua

SEQ ID NO: 4000437 - RNA, 13 nt, Staphylococcus aureus subsp. aureus MW2
agauuauuaugug

SEQ ID NO: 4000438 - RNA, 17 nt, Staphylococcus aureus subsp. aureus MW2
agauuauuuaaaacuug

SEQ ID NO: 4000439 - RNA, 19 nt, Staphylococcus aureus subsp. aureus MW2
agauuauuuaaaacuugua

SEQ ID NO: 4000440 - RNA, 15 nt, Staphylococcus aureus subsp. aureus MW2
agauucaaaauuaua

SEQ ID NO: 4000441 - RNA, 11 nt, Staphylococcus aureus subsp. aureus MW2
agauucaaacg

SEQ ID NO: 4000442 - RNA, 12 nt, Staphylococcus aureus subsp. aureus MW2
agauucaccuaa

SEQ ID NO: 4000443 - RNA, 20 nt, Staphylococcus aureus subsp. aureus MW2
agauucauaucuuucaauua

SEQ ID NO: 4000444 - RNA, 15 nt, Staphylococcus aureus subsp. aureus MW2
agauuccuguaacaa

SEQ ID NO: 4000445 - RNA, 20 nt, Staphylococcus aureus subsp. aureus MW2
agauucggaaaauaugauaa

SEQ ID NO: 4000446 - RNA, 16 nt, Staphylococcus aureus subsp. aureus MW2
agauugauauaaauua

SEQ ID NO: 4000447 - RNA, 15 nt, Staphylococcus aureus subsp. aureus MW2
agauuguauguuaua

SEQ ID NO: 4000448 - RNA, 20 nt, Staphylococcus aureus subsp. aureus MW2
agauuguauguuauagcuag

SEQ ID NO: 4000449 - RNA, 15 nt, Staphylococcus aureus subsp. aureus MW2
agauuguauuuaaua

SEQ ID NO: 4000450 - RNA, 13 nt, Staphylococcus aureus subsp. aureus MW2
agauuuaacaaua

SEQ ID NO: 4000451 - RNA, 14 nt, Staphylococcus aureus subsp. aureus MW2
agauuuaacaauau

SEQ ID NO: 4000452 - RNA, 17 nt, Staphylococcus aureus subsp. aureus MW2
agauuuaacaauauaua

SEQ ID NO: 4000453 - RNA, 19 nt, Staphylococcus aureus subsp. aureus MW2
agauuucaaacgauuuuca

SEQ ID NO: 4000454 - RNA, 11 nt, Staphylococcus aureus subsp. aureus MW2
agauuucucag

SEQ ID NO: 4000455 - RNA, 18 nt, Staphylococcus aureus subsp. aureus MW2
agauuugaauuuaauuuc

SEQ ID NO: 4000456 - RNA, 17 nt, Staphylococcus aureus subsp. aureus MW2
agauuuuaaacgcucau

SEQ ID NO: 4000457 - RNA, 20 nt, Staphylococcus aureus subsp. aureus MW2
agauuuuaauaaauuagcca

SEQ ID NO: 4000458 - RNA, 19 nt, Staphylococcus aureus subsp. aureus MW2
agauuuuaugcuuuacuug

SEQ ID NO: 4000459 - RNA, 15 nt, Staphylococcus aureus subsp. aureus MW2
agauuuuauuaaauc

SEQ ID NO: 4000460 - RNA, 18 nt, Staphylococcus aureus subsp. aureus MW2
agauuuuguauuagcauc

SEQ ID NO: 4000461 - RNA, 14 nt, Staphylococcus aureus subsp. aureus MW2
agauuuuuucauag

SEQ ID NO: 4000462 - RNA, 15 nt, Staphylococcus aureus subsp. aureus MW2
agcaaaaauauuuaa

SEQ ID NO: 4000463 - RNA, 17 nt, Staphylococcus aureus subsp. aureus MW2
agcaaaaauauuuaaac

SEQ ID NO: 4000464 - RNA, 15 nt, Staphylococcus aureus subsp. aureus MW2
agcaaaagaugaaaa

SEQ ID NO: 4000465 - RNA, 16 nt, Staphylococcus aureus subsp. aureus MW2
agcaaaauuauguaaa

SEQ ID NO: 4000466 - RNA, 22 nt, Staphylococcus aureus subsp. aureus MW2
agcaaaauuauguaaaaaauau

SEQ ID NO: 4000467 - RNA, 13 nt, Staphylococcus aureus subsp. aureus MW2
agcaaauaaaauc

SEQ ID NO: 4000468 - RNA, 17 nt, Staphylococcus aureus subsp. aureus MW2
agcaaauauuauuaaau

SEQ ID NO: 4000469 - RNA, 13 nt, Staphylococcus aureus subsp. aureus MW2
agcaaauauuucu

SEQ ID NO: 4000470 - RNA, 16 nt, Staphylococcus aureus subsp. aureus MW2
agcaaaugcacuguau

SEQ ID NO: 4000471 - RNA, 19 nt, Staphylococcus aureus subsp. aureus MW2
agcaaaugcuuaagaaauu

SEQ ID NO: 4000472 - RNA, 17 nt, Staphylococcus aureus subsp. aureus MW2
agcaaaugguccaacug

SEQ ID NO: 4000473 - RNA, 16 nt, Staphylococcus aureus subsp. aureus MW2
agcaaauugauuaaau

SEQ ID NO: 4000474 - RNA, 12 nt, Staphylococcus aureus subsp. aureus MW2
agcgauuaaaug

SEQ ID NO: 4000475 - RNA, 17 nt, Staphylococcus aureus subsp. aureus MW2
agcgcaccaauuaucaa

SEQ ID NO: 4000476 - RNA, 21 nt, Staphylococcus aureus subsp. aureus MW2
agcgccuaugugaugguaaau

SEQ ID NO: 4000477 - RNA, 20 nt, Staphylococcus aureus subsp. aureus MW2
agcggaaauaugauugaaug

SEQ ID NO: 4000478 - RNA, 19 nt, Staphylococcus aureus subsp. aureus MW2
agcggccgugguaugauuu

SEQ ID NO: 4000479 - RNA, 18 nt, Staphylococcus aureus subsp. aureus MW2
agcguaauggauuauuau

SEQ ID NO: 4000480 - RNA, 16 nt, Staphylococcus aureus subsp. aureus MW2
agcguauuuuaaugau

SEQ ID NO: 4000481 - RNA, 13 nt, Staphylococcus aureus subsp. aureus MW2
agcgucagcaaaa

SEQ ID NO: 4000482 - RNA, 19 nt, Staphylococcus aureus subsp. aureus MW2
agcguuccauuaaugcauu

SEQ ID NO: 4000483 - RNA, 15 nt, Staphylococcus aureus subsp. aureus MW2
agcguucgugauaga

SEQ ID NO: 4000484 - RNA, 21 nt, Staphylococcus aureus subsp. aureus MW2
agcguuucuugaucuaaugua

SEQ ID NO: 4000485 - RNA, 14 nt, Staphylococcus aureus subsp. aureus MW2
agcguuuuuauuac

SEQ ID NO: 4000486 - RNA, 13 nt, Staphylococcus aureus subsp. aureus MW2
agcuaaaaguuuc

SEQ ID NO: 4000487 - RNA, 15 nt, Staphylococcus aureus subsp. aureus MW2
agcuaaccacaucau

SEQ ID NO: 4000488 - RNA, 17 nt, Staphylococcus aureus subsp. aureus MW2
agcuaaguauauaagca

SEQ ID NO: 4000489 - RNA, 16 nt, Staphylococcus aureus subsp. aureus MW2
agcuaauaucaauaau

SEQ ID NO: 4000490 - RNA, 19 nt, Staphylococcus aureus subsp. aureus MW2
agcuaauaucaauaaugcu

SEQ ID NO: 4000491 - RNA, 13 nt, Staphylococcus aureus subsp. aureus MW2
agcuaaugcaagc

SEQ ID NO: 4000492 - RNA, 12 nt, Staphylococcus aureus subsp. aureus MW2
agcuaaugcauu

SEQ ID NO: 4000493 - RNA, 22 nt, Staphylococcus aureus subsp. aureus MW2
agcuaauuucuaauacauacug

SEQ ID NO: 4000494 - RNA, 15 nt, Staphylococcus aureus subsp. aureus MW2
agcuacaauuaaagu

SEQ ID NO: 4000495 - RNA, 18 nt, Staphylococcus aureus subsp. aureus MW2
agcuacccuauuuuacaa

SEQ ID NO: 4000496 - RNA, 19 nt, Staphylococcus aureus subsp. aureus MW2
agcuacuaaaggaauuuca

SEQ ID NO: 4000497 - RNA, 20 nt, Staphylococcus aureus subsp. aureus MW2
agcuacuaaaggaauuucaa

SEQ ID NO: 4000498 - RNA, 15 nt, Staphylococcus aureus subsp. aureus MW2
agcuagaaacaaugc

SEQ ID NO: 4000499 - RNA, 14 nt, Staphylococcus aureus subsp. aureus MW2
agcuagaaacacau

SEQ ID NO: 4000500 - RNA, 12 nt, Staphylococcus aureus subsp. aureus MW2
agcuauaaaagu

SEQ ID NO: 4000501 - RNA, 18 nt, Staphylococcus aureus subsp. aureus MW2
agcuauaaaaguacuuua

SEQ ID NO: 4000502 - RNA, 13 nt, Staphylococcus aureus subsp. aureus MW2
agcuauagaaaug

SEQ ID NO: 4000503 - RNA, 14 nt, Staphylococcus aureus subsp. aureus MW2
agcuauauuuuuuu

SEQ ID NO: 4000504 - RNA, 15 nt, Staphylococcus aureus subsp. aureus MW2
agcuaucguaaacaa

SEQ ID NO: 4000505 - RNA, 22 nt, Staphylococcus aureus subsp. aureus MW2
agcuaugauuugauauuucaaa

SEQ ID NO: 4000506 - RNA, 19 nt, Staphylococcus aureus subsp. aureus MW2
agcuaugcuuuuuuuacaa

SEQ ID NO: 4000507 - RNA, 19 nt, Staphylococcus aureus subsp. aureus MW2
agcucaauaaauuaugaaa

SEQ ID NO: 4000508 - RNA, 19 nt, Staphylococcus aureus subsp. aureus MW2
agcucaugaaucagaugau

SEQ ID NO: 4000509 - RNA, 17 nt, Staphylococcus aureus subsp. aureus MW2
agcucguuaaaucacau

SEQ ID NO: 4000510 - RNA, 17 nt, Staphylococcus aureus subsp. aureus MW2
agcucguuuuuugauug

SEQ ID NO: 4000511 - RNA, 15 nt, Staphylococcus aureus subsp. aureus MW2
agcucugaagaagac

SEQ ID NO: 4000512 - RNA, 17 nt, Staphylococcus aureus subsp. aureus MW2
agcucugaagaagacau

SEQ ID NO: 4000513 - RNA, 19 nt, Staphylococcus aureus subsp. aureus MW2
agcucuuaaaucacuagcu

SEQ ID NO: 4000514 - RNA, 20 nt, Staphylococcus aureus subsp. aureus MW2
agcucuuaaucuauaaauua

SEQ ID NO: 4000515 - RNA, 22 nt, Staphylococcus aureus subsp. aureus MW2
agcucuugcuaaaguguagcca

SEQ ID NO: 4000516 - RNA, 16 nt, Staphylococcus aureus subsp. aureus MW2
agcucuuuuuugauuu

SEQ ID NO: 4000517 - RNA, 17 nt, Staphylococcus aureus subsp. aureus MW2
agcugacgaaaagucag

SEQ ID NO: 4000518 - RNA, 19 nt, Staphylococcus aureus subsp. aureus MW2
agcugacgaaaagucagcu

SEQ ID NO: 4000519 - RNA, 18 nt, Staphylococcus aureus subsp. aureus MW2
agcugauuccauuucgau

SEQ ID NO: 4000520 - RNA, 22 nt, Staphylococcus aureus subsp. aureus MW2
agcugauuucuauuaauuauuu

SEQ ID NO: 4000521 - RNA, 14 nt, Staphylococcus aureus subsp. aureus MW2
agcugcgauauaac

SEQ ID NO: 4000522 - RNA, 17 nt, Staphylococcus aureus subsp. aureus MW2
agcuggcggaaagucag

SEQ ID NO: 4000523 - RNA, 18 nt, Staphylococcus aureus subsp. aureus MW2
agcuggcggaaagucagc

SEQ ID NO: 4000524 - RNA, 19 nt, Staphylococcus aureus subsp. aureus MW2
agcuggcggaaagucagcu

SEQ ID NO: 4000525 - RNA, 20 nt, Staphylococcus aureus subsp. aureus MW2
agcuggcggaaagucagcuu

SEQ ID NO: 4000526 - RNA, 17 nt, Staphylococcus aureus subsp. aureus MW2
agcugugauuugaucaa

SEQ ID NO: 4000527 - RNA, 12 nt, Staphylococcus aureus subsp. aureus MW2
agcuuaaugcau

SEQ ID NO: 4000528 - RNA, 13 nt, Staphylococcus aureus subsp. aureus MW2
agcuuaauuuuau

SEQ ID NO: 4000529 - RNA, 19 nt, Staphylococcus aureus subsp. aureus MW2
agcuuaauuuuauuauuaa

SEQ ID NO: 4000530 - RNA, 20 nt, Staphylococcus aureus subsp. aureus MW2
agcuuaucaacgauuuuguc

SEQ ID NO: 4000531 - RNA, 23 nt, Staphylococcus aureus subsp. aureus MW2
agcuucaacacgacguucuucaa

SEQ ID NO: 4000532 - RNA, 14 nt, Staphylococcus aureus subsp. aureus MW2
agcuucuacuuuug

SEQ ID NO: 4000533 - RNA, 21 nt, Staphylococcus aureus subsp. aureus MW2
agcuucuauguuggggccccg

SEQ ID NO: 4000534 - RNA, 22 nt, Staphylococcus aureus subsp. aureus MW2
agcuucuauguuggggccccgc

SEQ ID NO: 4000535 - RNA, 16 nt, Staphylococcus aureus subsp. aureus MW2
agcuucuuaaaucaac

SEQ ID NO: 4000536 - RNA, 16 nt, Staphylococcus aureus subsp. aureus MW2
agcuucuuuaacaauu

SEQ ID NO: 4000537 - RNA, 20 nt, Staphylococcus aureus subsp. aureus MW2
agcuucuuuaacaauugauu

SEQ ID NO: 4000538 - RNA, 19 nt, Staphylococcus aureus subsp. aureus MW2
agcuucuuuguuggggccc

SEQ ID NO: 4000539 - RNA, 20 nt, Staphylococcus aureus subsp. aureus MW2
agcuucuuuguuggggcccc

SEQ ID NO: 4000540 - RNA, 21 nt, Staphylococcus aureus subsp. aureus MW2
agcuucuuuguuggggccccg

SEQ ID NO: 4000541 - RNA, 22 nt, Staphylococcus aureus subsp. aureus MW2
agcuucuuuguuggggccccgc

SEQ ID NO: 4000542 - RNA, 18 nt, Staphylococcus aureus subsp. aureus MW2
agcuugaccgccuaugau

SEQ ID NO: 4000543 - RNA, 15 nt, Staphylococcus aureus subsp. aureus MW2
agcuugauuuaacaa

SEQ ID NO: 4000544 - RNA, 22 nt, Staphylococcus aureus subsp. aureus MW2
agcuugauuuaacaaccucuga

SEQ ID NO: 4000545 - RNA, 19 nt, Staphylococcus aureus subsp. aureus MW2
agcuugggacagaaaacaa

SEQ ID NO: 4000546 - RNA, 20 nt, Staphylococcus aureus subsp. aureus MW2
agcuugggacagaaaacaaa

SEQ ID NO: 4000547 - RNA, 17 nt, Staphylococcus aureus subsp. aureus MW2
agcuuguaaaucacgau

SEQ ID NO: 4000548 - RNA, 12 nt, Staphylococcus aureus subsp. aureus MW2
agcuuguaauca

SEQ ID NO: 4000549 - RNA, 22 nt, Staphylococcus aureus subsp. aureus MW2
agcuuguuuguuacauauugca

SEQ ID NO: 4000550 - RNA, 20 nt, Staphylococcus aureus subsp. aureus MW2
agcuuucgggcuaguuuuuu

SEQ ID NO: 4000551 - RNA, 20 nt, Staphylococcus aureus subsp. aureus MW2
agcuuuguuagcaucugcau

SEQ ID NO: 4000552 - RNA, 17 nt, Staphylococcus aureus subsp. aureus MW2
agcuuuuacgccuucuu

SEQ ID NO: 4000553 - RNA, 14 nt, Staphylococcus aureus subsp. aureus MW2
agcuuuucuaaugc

SEQ ID NO: 4000554 - RNA, 12 nt, Staphylococcus aureus subsp. aureus MW2
agcuuuucuuca

SEQ ID NO: 4000555 - RNA, 12 nt, Staphylococcus aureus subsp. aureus MW2
agcuuuuguaaa

SEQ ID NO: 4000556 - RNA, 13 nt, Staphylococcus aureus subsp. aureus MW2
agcuuuuguaaag

SEQ ID NO: 4000557 - RNA, 23 nt, Staphylococcus aureus subsp. aureus MW2
agcuuuuuucaauucuagucagg

SEQ ID NO: 4000558 - RNA, 15 nt, Staphylococcus aureus subsp. aureus MW2
aggaaauaaaaaaua

SEQ ID NO: 4000559 - RNA, 18 nt, Staphylococcus aureus subsp. aureus MW2
aggaaauccgcauaaauu

SEQ ID NO: 4000560 - RNA, 22 nt, Staphylococcus aureus subsp. aureus MW2
aggaacaguggaauacagauga

SEQ ID NO: 4000561 - RNA, 17 nt, Staphylococcus aureus subsp. aureus MW2
aggaauaccacuuaauc

SEQ ID NO: 4000562 - RNA, 17 nt, Staphylococcus aureus subsp. aureus MW2
aguaacagacuuuguua

SEQ ID NO: 4000563 - RNA, 23 nt, Staphylococcus aureus subsp. aureus MW2
aguaacauguaaugaaucaaauc

SEQ ID NO: 4000564 - RNA, 18 nt, Staphylococcus aureus subsp. aureus MW2
aguaaccacaacaaugaa

SEQ ID NO: 4000565 - RNA, 15 nt, Staphylococcus aureus subsp. aureus MW2
aguaacguacugugu

SEQ ID NO: 4000566 - RNA, 15 nt, Staphylococcus aureus subsp. aureus MW2
aguaacucaagugau

SEQ ID NO: 4000567 - RNA, 12 nt, Staphylococcus aureus subsp. aureus MW2
aguaacuuuguc

SEQ ID NO: 4000568 - RNA, 14 nt, Staphylococcus aureus subsp. aureus MW2
aguaagacugccau

SEQ ID NO: 4000569 - RNA, 15 nt, Staphylococcus aureus subsp. aureus MW2
aguaagaugauuuca

SEQ ID NO: 4000570 - RNA, 20 nt, Staphylococcus aureus subsp. aureus MW2
aguaagauuauuuucaauua

SEQ ID NO: 4000571 - RNA, 18 nt, Staphylococcus aureus subsp. aureus MW2
aguaagcguaauauuuaa

SEQ ID NO: 4000572 - RNA, 15 nt, Staphylococcus aureus subsp. aureus MW2
aguaaguaaaauaaa

SEQ ID NO: 4000573 - RNA, 22 nt, Staphylococcus aureus subsp. aureus MW2
aguaaguuguacuucuuugguc

SEQ ID NO: 4000574 - RNA, 15 nt, Staphylococcus aureus subsp. aureus MW2
aguaauaacaucuaa

SEQ ID NO: 4000575 - RNA, 13 nt, Staphylococcus aureus subsp. aureus MW2
aguaauaauauaa

SEQ ID NO: 4000576 - RNA, 16 nt, Staphylococcus aureus subsp. aureus MW2
aguaauaauuuauuga

SEQ ID NO: 4000577 - RNA, 16 nt, Staphylococcus aureus subsp. aureus MW2
aguaaucaagcaaugc

SEQ ID NO: 4000578 - RNA, 19 nt, Staphylococcus aureus subsp. aureus MW2
aguaaucagcuuuuucaca

SEQ ID NO: 4000579 - RNA, 23 nt, Staphylococcus aureus subsp. aureus MW2
aguaaucugcaaaugccucuuuu

SEQ ID NO: 4000580 - RNA, 22 nt, Staphylococcus aureus subsp. aureus MW2
aguaaucuuguuuucauuuaaa

SEQ ID NO: 4000581 - RNA, 14 nt, Staphylococcus aureus subsp. aureus MW2
aguaaugaagcuuc

SEQ ID NO: 4000582 - RNA, 18 nt, Staphylococcus aureus subsp. aureus MW2
aguaaugugcauugcuuu

SEQ ID NO: 4000583 - RNA, 16 nt, Staphylococcus aureus subsp. aureus MW2
aguaauuaaauacuug

SEQ ID NO: 4000584 - RNA, 19 nt, Staphylococcus aureus subsp. aureus MW2
aguaauucuuuaccauuca

SEQ ID NO: 4000585 - RNA, 14 nt, Staphylococcus aureus subsp. aureus MW2
aguaauuuuacaaa

SEQ ID NO: 4000586 - RNA, 15 nt, Staphylococcus aureus subsp. aureus MW2
aguacaaauaacaaa

SEQ ID NO: 4000587 - RNA, 21 nt, Staphylococcus aureus subsp. aureus MW2
aguacaaauaacaaacauuaa

SEQ ID NO: 4000588 - RNA, 12 nt, Staphylococcus aureus subsp. aureus MW2
aguacaaauaau

SEQ ID NO: 4000589 - RNA, 13 nt, Staphylococcus aureus subsp. aureus MW2
aguacaaauaaua

SEQ ID NO: 4000590 - RNA, 15 nt, Staphylococcus aureus subsp. aureus MW2
aguacaacaguugca

SEQ ID NO: 4000591 - RNA, 21 nt, Staphylococcus aureus subsp. aureus MW2
aguacaauaauaccuucaauu

SEQ ID NO: 4000592 - RNA, 23 nt, Staphylococcus aureus subsp. aureus MW2
aguacauuuauuuucaauaaaua

SEQ ID NO: 4000593 - RNA, 20 nt, Staphylococcus aureus subsp. aureus MW2
aguacgaggaccaucucuaa

SEQ ID NO: 4000594 - RNA, 18 nt, Staphylococcus aureus subsp. aureus MW2
aguacggcugcuuuaacu

SEQ ID NO: 4000595 - RNA, 22 nt, Staphylococcus aureus subsp. aureus MW2
aguacggcugcuuuaacuguac

SEQ ID NO: 4000596 - RNA, 16 nt, Staphylococcus aureus subsp. aureus MW2
aguacuaaaaguauga

SEQ ID NO: 4000597 - RNA, 21 nt, Staphylococcus aureus subsp. aureus MW2
aguacuaaaccgauuaauaua

SEQ ID NO: 4000598 - RNA, 23 nt, Staphylococcus aureus subsp. aureus MW2
aguacuaaucaauacuaaaccaa

SEQ ID NO: 4000599 - RNA, 22 nt, Staphylococcus aureus subsp. aureus MW2
aguacucaauguuaggugcuug

SEQ ID NO: 4000600 - RNA, 17 nt, Staphylococcus aureus subsp. aureus MW2
aguacuucaaagcaucu

SEQ ID NO: 4000601 - RNA, 21 nt, Staphylococcus aureus subsp. aureus MW2
aguacuucaaagcaucuaauc

SEQ ID NO: 4000602 - RNA, 23 nt, Staphylococcus aureus subsp. aureus MW2
aguacuuuaaaauuguauagaau

SEQ ID NO: 4000603 - RNA, 21 nt, Staphylococcus aureus subsp. aureus MW2
aguacuuucgaguaauacuuu

SEQ ID NO: 4000604 - RNA, 20 nt, Staphylococcus aureus subsp. aureus MW2
aguaggguauugaaauaaua

SEQ ID NO: 4000605 - RNA, 13 nt, Staphylococcus aureus subsp. aureus MW2
aguaguauuaucu

SEQ ID NO: 4000606 - RNA, 15 nt, Staphylococcus aureus subsp. aureus MW2
aguaguguauucauu

SEQ ID NO: 4000607 - RNA, 14 nt, Staphylococcus aureus subsp. aureus MW2
aguaguuuauauca

SEQ ID NO: 4000608 - RNA, 23 nt, Staphylococcus aureus subsp. aureus MW2
aguauaaaccgccaacuaauguu

SEQ ID NO: 4000609 - RNA, 12 nt, Staphylococcus aureus subsp. aureus MW2
aguauaaauaaa

SEQ ID NO: 4000610 - RNA, 13 nt, Staphylococcus aureus subsp. aureus MW2
aguauaaauaaaa

SEQ ID NO: 4000611 - RNA, 14 nt, Staphylococcus aureus subsp. aureus MW2
aguauaaauaaaaa

SEQ ID NO: 4000612 - RNA, 20 nt, Staphylococcus aureus subsp. aureus MW2
aguauaaauaaaaauacaua

SEQ ID NO: 4000613 - RNA, 19 nt, Staphylococcus aureus subsp. aureus MW2
aguauaaauaucauaaaug

SEQ ID NO: 4000614 - RNA, 18 nt, Staphylococcus aureus subsp. aureus MW2
aguauaagguugaagaag

SEQ ID NO: 4000615 - RNA, 21 nt, Staphylococcus aureus subsp. aureus MW2
aguauaaguagcucaaaacaa

SEQ ID NO: 4000616 - RNA, 16 nt, Staphylococcus aureus subsp. aureus MW2
aguauaaucagcaaug

SEQ ID NO: 4000617 - RNA, 13 nt, Staphylococcus aureus subsp. aureus MW2
aguauaauuaaac

SEQ ID NO: 4000618 - RNA, 12 nt, Staphylococcus aureus subsp. aureus MW2
aguauauaagca

SEQ ID NO: 4000619 - RNA, 16 nt, Staphylococcus aureus subsp. aureus MW2
aguauauaagcaaaga

SEQ ID NO: 4000620 - RNA, 15 nt, Staphylococcus aureus subsp. aureus MW2
aguauauaucaaaua

SEQ ID NO: 4000621 - RNA, 18 nt, Staphylococcus aureus subsp. aureus MW2
aguauauccgcaucuuuu

SEQ ID NO: 4000622 - RNA, 17 nt, Staphylococcus aureus subsp. aureus MW2
aguauaugucgcaaauu

SEQ ID NO: 4000623 - RNA, 15 nt, Staphylococcus aureus subsp. aureus MW2
aguauauuuuaacaa

SEQ ID NO: 4000624 - RNA, 16 nt, Staphylococcus aureus subsp. aureus MW2
aguauccuuuauaaau

SEQ ID NO: 4000625 - RNA, 21 nt, Staphylococcus aureus subsp. aureus MW2
aguauccuuuauaaauaaaca

SEQ ID NO: 4000626 - RNA, 18 nt, Staphylococcus aureus subsp. aureus MW2
aguaucugugaauaugcu

SEQ ID NO: 4000627 - RNA, 22 nt, Staphylococcus aureus subsp. aureus MW2
aguaugacaaauuaaaaaggcg

SEQ ID NO: 4000628 - RNA, 15 nt, Staphylococcus aureus subsp. aureus MW2
aguaugauagaaauc

SEQ ID NO: 4000629 - RNA, 14 nt, Staphylococcus aureus subsp. aureus MW2
aguaugucaucuuc

SEQ ID NO: 4000630 - RNA, 16 nt, Staphylococcus aureus subsp. aureus MW2
aguauucaaaaaaaua

SEQ ID NO: 4000631 - RNA, 14 nt, Staphylococcus aureus subsp. aureus MW2
aguauucauuuucu

SEQ ID NO: 4000632 - RNA, 15 nt, Staphylococcus aureus subsp. aureus MW2
aguauugccguuauu

SEQ ID NO: 4000633 - RNA, 15 nt, Staphylococcus aureus subsp. aureus MW2
aguauuguuuuauau

SEQ ID NO: 4000634 - RNA, 21 nt, Staphylococcus aureus subsp. aureus MW2
aguauuguuuuauauuuaaac

SEQ ID NO: 4000635 - RNA, 22 nt, Staphylococcus aureus subsp. aureus MW2
aguauuguuuuauauuuaaacu

SEQ ID NO: 4000636 - RNA, 18 nt, Staphylococcus aureus subsp. aureus MW2
aguauuuaauguuuuagu

SEQ ID NO: 4000637 - RNA, 20 nt, Staphylococcus aureus subsp. aureus MW2
aguauuugaaguauuuuccu

SEQ ID NO: 4000638 - RNA, 18 nt, Staphylococcus aureus subsp. aureus MW2
aguauuugccuuuugaau

SEQ ID NO: 4000639 - RNA, 22 nt, Staphylococcus aureus subsp. aureus MW2
aguauuuuccuucagucuucau

SEQ ID NO: 4000640 - RNA, 13 nt, Staphylococcus aureus subsp. aureus MW2
aguauuuucucua

SEQ ID NO: 4000641 - RNA, 14 nt, Staphylococcus aureus subsp. aureus MW2
aguauuuuuugcca

SEQ ID NO: 4000642 - RNA, 23 nt, Staphylococcus aureus subsp. aureus MW2
agucaaaaaaucgaacaaaugaa

SEQ ID NO: 4000643 - RNA, 21 nt, Staphylococcus aureus subsp. aureus MW2
agucaaacacugccaauauaa

SEQ ID NO: 4000644 - RNA, 15 nt, Staphylococcus aureus subsp. aureus MW2
agucaauacaaaaca

SEQ ID NO: 4000645 - RNA, 13 nt, Staphylococcus aureus subsp. aureus MW2
agucaaucaaguu

SEQ ID NO: 4000646 - RNA, 17 nt, Staphylococcus aureus subsp. aureus MW2
agucaauuuaaauaagu

SEQ ID NO: 4000647 - RNA, 14 nt, Staphylococcus aureus subsp. aureus MW2
agucaauuuuuuca

SEQ ID NO: 4000648 - RNA, 13 nt, Staphylococcus aureus subsp. aureus MW2
agucagaaagaau

SEQ ID NO: 4000649 - RNA, 16 nt, Staphylococcus aureus subsp. aureus MW2
agucagcuuacaauaa

SEQ ID NO: 4000650 - RNA, 19 nt, Staphylococcus aureus subsp. aureus MW2
agucagcuuacaauaaugu

SEQ ID NO: 4000651 - RNA, 13 nt, Staphylococcus aureus subsp. aureus MW2
aguguuuguaaug

SEQ ID NO: 4000652 - RNA, 16 nt, Staphylococcus aureus subsp. aureus MW2
aguuaaaaauguaaau

SEQ ID NO: 4000653 - RNA, 11 nt, Staphylococcus aureus subsp. aureus MW2
aguuaaaaccu

SEQ ID NO: 4000654 - RNA, 17 nt, Staphylococcus aureus subsp. aureus MW2
aguuaaaagugguuuua

SEQ ID NO: 4000655 - RNA, 23 nt, Staphylococcus aureus subsp. aureus MW2
aguuaaaguuccaaguuaaugca

SEQ ID NO: 4000656 - RNA, 18 nt, Staphylococcus aureus subsp. aureus MW2
aguuaaauaucauaccgu

SEQ ID NO: 4000657 - RNA, 13 nt, Staphylococcus aureus subsp. aureus MW2
aguuaaauuaaac

SEQ ID NO: 4000658 - RNA, 15 nt, Staphylococcus aureus subsp. aureus MW2
aguuaacuauaacaa

SEQ ID NO: 4000659 - RNA, 20 nt, Staphylococcus aureus subsp. aureus MW2
aguuaagugucuauguugaa

SEQ ID NO: 4000660 - RNA, 15 nt, Staphylococcus aureus subsp. aureus MW2
aguuaauauaauuaa

SEQ ID NO: 4000661 - RNA, 16 nt, Staphylococcus aureus subsp. aureus MW2
aguuaauauaauuaaa

SEQ ID NO: 4000662 - RNA, 21 nt, Staphylococcus aureus subsp. aureus MW2
aguuaauccucauuaugagau

SEQ ID NO: 4000663 - RNA, 13 nt, Staphylococcus aureus subsp. aureus MW2
aguuaauuauuua

SEQ ID NO: 4000664 - RNA, 17 nt, Staphylococcus aureus subsp. aureus MW2
aguuaauuauuuagauu

SEQ ID NO: 4000665 - RNA, 15 nt, Staphylococcus aureus subsp. aureus MW2
aguuacgauaucaua

SEQ ID NO: 4000666 - RNA, 14 nt, Staphylococcus aureus subsp. aureus MW2
aguuacguuuucaa

SEQ ID NO: 4000667 - RNA, 19 nt, Staphylococcus aureus subsp. aureus MW2
aguuacuauauuuauuagu

SEQ ID NO: 4000668 - RNA, 17 nt, Staphylococcus aureus subsp. aureus MW2
aguuacucaauauaaaa

SEQ ID NO: 4000669 - RNA, 17 nt, Staphylococcus aureus subsp. aureus MW2
aguuacuucaguuuggu

SEQ ID NO: 4000670 - RNA, 16 nt, Staphylococcus aureus subsp. aureus MW2
aguuagacuaaaaaac

SEQ ID NO: 4000671 - RNA, 20 nt, Staphylococcus aureus subsp. aureus MW2
aguuaggcgacuuaacuuaa

SEQ ID NO: 4000672 - RNA, 21 nt, Staphylococcus aureus subsp. aureus MW2
aguuaggcgacuuaacuuaag

SEQ ID NO: 4000673 - RNA, 18 nt, Staphylococcus aureus subsp. aureus MW2
aguuagguaaaaauuaac

SEQ ID NO: 4000674 - RNA, 11 nt, Staphylococcus aureus subsp. aureus MW2
aguuaguuuuc

SEQ ID NO: 4000675 - RNA, 21 nt, Staphylococcus aureus subsp. aureus MW2
aguuaguuuucgugcacguuc

SEQ ID NO: 4000676 - RNA, 19 nt, Staphylococcus aureus subsp. aureus MW2
aguuauaccauauuuaugg

SEQ ID NO: 4000677 - RNA, 17 nt, Staphylococcus aureus subsp. aureus MW2
aguuauauauuacuuaa

SEQ ID NO: 4000678 - RNA, 21 nt, Staphylococcus aureus subsp. aureus MW2
aguuaugaagggaaaaaaugg

SEQ ID NO: 4000679 - RNA, 17 nt, Staphylococcus aureus subsp. aureus MW2
aguuaugacuaacgaaa

SEQ ID NO: 4000680 - RNA, 13 nt, Staphylococcus aureus subsp. aureus MW2
aguuauuaagcca

SEQ ID NO: 4000681 - RNA, 20 nt, Staphylococcus aureus subsp. aureus MW2
aguucaaagcgauaaaguau

SEQ ID NO: 4000682 - RNA, 23 nt, Staphylococcus aureus subsp. aureus MW2
aguucaaauggacuaacgucauu

SEQ ID NO: 4000683 - RNA, 16 nt, Staphylococcus aureus subsp. aureus MW2
aguucaaauugaacuu

SEQ ID NO: 4000684 - RNA, 19 nt, Staphylococcus aureus subsp. aureus MW2
aguucaaauugaacuucuu

SEQ ID NO: 4000685 - RNA, 15 nt, Staphylococcus aureus subsp. aureus MW2
aguucauuucaauac

SEQ ID NO: 4000686 - RNA, 20 nt, Staphylococcus aureus subsp. aureus MW2
aguuccguugaauuaacaau

SEQ ID NO: 4000687 - RNA, 16 nt, Staphylococcus aureus subsp. aureus MW2
aguuccucgguauuca

SEQ ID NO: 4000688 - RNA, 23 nt, Staphylococcus aureus subsp. aureus MW2
aguuccucgguauucaauucugu

SEQ ID NO: 4000689 - RNA, 16 nt, Staphylococcus aureus subsp. aureus MW2
aguucgaacacacacu

SEQ ID NO: 4000690 - RNA, 23 nt, Staphylococcus aureus subsp. aureus MW2
aguucgacacguccgacaucaua

SEQ ID NO: 4000691 - RNA, 18 nt, Staphylococcus aureus subsp. aureus MW2
aguucggaugagaaaugu

SEQ ID NO: 4000692 - RNA, 22 nt, Staphylococcus aureus subsp. aureus MW2
aguucggaugagaaauguuaac

SEQ ID NO: 4000693 - RNA, 19 nt, Staphylococcus aureus subsp. aureus MW2
aguucuuaggcaauguaaa

SEQ ID NO: 4000694 - RNA, 12 nt, Staphylococcus aureus subsp. aureus MW2
aguucuuuaaau

SEQ ID NO: 4000695 - RNA, 23 nt, Staphylococcus aureus subsp. aureus MW2
aguugaaaauaaucgaacagaaa

SEQ ID NO: 4000696 - RNA, 23 nt, Staphylococcus aureus subsp. aureus MW2
aguugaaccguaacuauaugaaa

SEQ ID NO: 4000697 - RNA, 23 nt, Staphylococcus aureus subsp. aureus MW2
aguugaagcggguugaagcaauu

SEQ ID NO: 4000698 - RNA, 14 nt, Staphylococcus aureus subsp. aureus MW2
aguugacaauacaa

SEQ ID NO: 4000699 - RNA, 12 nt, Staphylococcus aureus subsp. aureus MW2
aguugauaaugu

SEQ ID NO: 4000700 - RNA, 22 nt, Staphylococcus aureus subsp. aureus MW2
aguugaucaaaaauguuaucua

SEQ ID NO: 4000701 - RNA, 20 nt, Staphylococcus aureus subsp. aureus MW2
aguugcaaacgcguuauaga

SEQ ID NO: 4000702 - RNA, 24 nt, Staphylococcus aureus subsp. aureus MW2
aguugcacucgguucauaaugauc

SEQ ID NO: 4000703 - RNA, 22 nt, Staphylococcus aureus subsp. aureus MW2
aguugcauaaucaauuucaccu

SEQ ID NO: 4000704 - RNA, 14 nt, Staphylococcus aureus subsp. aureus MW2
aguugcuucauaaa

SEQ ID NO: 4000705 - RNA, 22 nt, Staphylococcus aureus subsp. aureus MW2
aguuggcggggcccaaacauag

SEQ ID NO: 4000706 - RNA, 15 nt, Staphylococcus aureus subsp. aureus MW2
aguuggcggggcccc

SEQ ID NO: 4000707 - RNA, 22 nt, Staphylococcus aureus subsp. aureus MW2
aguuggggaugggccccaacac

SEQ ID NO: 4000708 - RNA, 15 nt, Staphylococcus aureus subsp. aureus MW2
aguugguggauguca

SEQ ID NO: 4000709 - RNA, 18 nt, Staphylococcus aureus subsp. aureus MW2
aguugguggaugucaugu

SEQ ID NO: 4000710 - RNA, 17 nt, Staphylococcus aureus subsp. aureus MW2
aguuguaacuguuugau

SEQ ID NO: 4000711 - RNA, 18 nt, Staphylococcus aureus subsp. aureus MW2
aguugucaucuaauuaca

SEQ ID NO: 4000712 - RNA, 15 nt, Staphylococcus aureus subsp. aureus MW2
aguuguuaggggcuc

SEQ ID NO: 4000713 - RNA, 15 nt, Staphylococcus aureus subsp. aureus MW2
aguuguuaggggcuu

SEQ ID NO: 4000714 - RNA, 15 nt, Staphylococcus aureus subsp. aureus MW2
aguuguugcaacuug

SEQ ID NO: 4000715 - RNA, 14 nt, Staphylococcus aureus subsp. aureus MW2
aguuguugcuuugg

SEQ ID NO: 4000716 - RNA, 21 nt, Staphylococcus aureus subsp. aureus MW2
aguuguuucuccaguuuuugg

SEQ ID NO: 4000717 - RNA, 11 nt, Staphylococcus aureus subsp. aureus MW2
aguuuaaaaau

SEQ ID NO: 4000718 - RNA, 21 nt, Staphylococcus aureus subsp. aureus MW2
aguuuaaucguauuagccaau

SEQ ID NO: 4000719 - RNA, 23 nt, Staphylococcus aureus subsp. aureus MW2
aguuuagauucacuguauaaaua

SEQ ID NO: 4000720 - RNA, 19 nt, Staphylococcus aureus subsp. aureus MW2
aguuucaaucgcauuuugu

SEQ ID NO: 4000721 - RNA, 18 nt, Staphylococcus aureus subsp. aureus MW2
aguuucaucgaagauguu

SEQ ID NO: 4000722 - RNA, 18 nt, Staphylococcus aureus subsp. aureus MW2
aguuucaucuucaacuuu

SEQ ID NO: 4000723 - RNA, 23 nt, Staphylococcus aureus subsp. aureus MW2
aguuucaucuucaacuuucucua

SEQ ID NO: 4000724 - RNA, 20 nt, Staphylococcus aureus subsp. aureus MW2
aguuuccauaaauaaaaugc

SEQ ID NO: 4000725 - RNA, 19 nt, Staphylococcus aureus subsp. aureus MW2
aguuucuacuguauaagug

SEQ ID NO: 4000726 - RNA, 22 nt, Staphylococcus aureus subsp. aureus MW2
aguuucugacuuuuaaaaaaca

SEQ ID NO: 4000727 - RNA, 17 nt, Staphylococcus aureus subsp. aureus MW2
aguuugaaggugauaau

SEQ ID NO: 4000728 - RNA, 19 nt, Staphylococcus aureus subsp. aureus MW2
aguuugaaggugauaaugu

SEQ ID NO: 4000729 - RNA, 14 nt, Staphylococcus aureus subsp. aureus MW2
aguuugacaucuau

SEQ ID NO: 4000730 - RNA, 18 nt, Staphylococcus aureus subsp. aureus MW2
aguuugauagaugauaca

SEQ ID NO: 4000731 - RNA, 17 nt, Staphylococcus aureus subsp. aureus MW2
aguuugaucauaauuca

SEQ ID NO: 4000732 - RNA, 15 nt, Staphylococcus aureus subsp. aureus MW2
aguuugaucauuuac

SEQ ID NO: 4000733 - RNA, 14 nt, Staphylococcus aureus subsp. aureus MW2
aguuuguaauaauu

SEQ ID NO: 4000734 - RNA, 19 nt, Staphylococcus aureus subsp. aureus MW2
aguuuguuuacggauuuuu

SEQ ID NO: 4000735 - RNA, 15 nt, Staphylococcus aureus subsp. aureus MW2
aguuuguuucuaaau

SEQ ID NO: 4000736 - RNA, 16 nt, Staphylococcus aureus subsp. aureus MW2
aguuuguuuucuuucg

SEQ ID NO: 4000737 - RNA, 16 nt, Staphylococcus aureus subsp. aureus MW2
aguuuuacugagggau

SEQ ID NO: 4000738 - RNA, 13 nt, Staphylococcus aureus subsp. aureus MW2
aguuuuaugaaua

SEQ ID NO: 4000739 - RNA, 18 nt, Staphylococcus aureus subsp. aureus MW2
auaaauaaaaauauaucu

SEQ ID NO: 4000740 - RNA, 12 nt, Staphylococcus aureus subsp. aureus MW2
auaaauaaaaug

SEQ ID NO: 4000741 - RNA, 14 nt, Staphylococcus aureus subsp. aureus MW2
auaaauaaaaugcu

SEQ ID NO: 4000742 - RNA, 13 nt, Staphylococcus aureus subsp. aureus MW2
auaaauaaacaua

SEQ ID NO: 4000743 - RNA, 13 nt, Staphylococcus aureus subsp. aureus MW2
auaaauaaacuca

SEQ ID NO: 4000744 - RNA, 13 nt, Staphylococcus aureus subsp. aureus MW2
auaaauaaagauu

SEQ ID NO: 4000745 - RNA, 20 nt, Staphylococcus aureus subsp. aureus MW2
auaaauaacacgauuugguu

SEQ ID NO: 4000746 - RNA, 22 nt, Staphylococcus aureus subsp. aureus MW2
auaaauaacuucguuuuaauaa

SEQ ID NO: 4000747 - RNA, 19 nt, Staphylococcus aureus subsp. aureus MW2
auaaauaagugauaaauaa

SEQ ID NO: 4000748 - RNA, 16 nt, Staphylococcus aureus subsp. aureus MW2
auaaauaauuuagaaa

SEQ ID NO: 4000749 - RNA, 13 nt, Staphylococcus aureus subsp. aureus MW2
auaaauagauaau

SEQ ID NO: 4000750 - RNA, 17 nt, Staphylococcus aureus subsp. aureus MW2
auaaauagauaauauau

SEQ ID NO: 4000751 - RNA, 16 nt, Staphylococcus aureus subsp. aureus MW2
auaaauaggucacuuu

SEQ ID NO: 4000752 - RNA, 20 nt, Staphylococcus aureus subsp. aureus MW2
auaaauaggucacuuuuaau

SEQ ID NO: 4000753 - RNA, 17 nt, Staphylococcus aureus subsp. aureus MW2
auaaauaucaauaauuc

SEQ ID NO: 4000754 - RNA, 20 nt, Staphylococcus aureus subsp. aureus MW2
auaaauaucauaaaugcaua

SEQ ID NO: 4000755 - RNA, 21 nt, Staphylococcus aureus subsp. aureus MW2
auaaauaugauguuaaaaaau

SEQ ID NO: 4000756 - RNA, 21 nt, Staphylococcus aureus subsp. aureus MW2
auaaauauuggaauacucuuu

SEQ ID NO: 4000757 - RNA, 14 nt, Staphylococcus aureus subsp. aureus MW2
auaaaucaaacuuu

SEQ ID NO: 4000758 - RNA, 15 nt, Staphylococcus aureus subsp. aureus MW2
auaaaucaacuuaaa

SEQ ID NO: 4000759 - RNA, 16 nt, Staphylococcus aureus subsp. aureus MW2
auaaaucaagaaaugu

SEQ ID NO: 4000760 - RNA, 17 nt, Staphylococcus aureus subsp. aureus MW2
auaaaucaagaaauguu

SEQ ID NO: 4000761 - RNA, 20 nt, Staphylococcus aureus subsp. aureus MW2
auaaaucaagaaauguuaaa

SEQ ID NO: 4000762 - RNA, 14 nt, Staphylococcus aureus subsp. aureus MW2
auaaaucaauguac

SEQ ID NO: 4000763 - RNA, 23 nt, Staphylococcus aureus subsp. aureus MW2
auaaaucacgccauaaucuucau

SEQ ID NO: 4000764 - RNA, 22 nt, Staphylococcus aureus subsp. aureus MW2
auaaaucauacgagaaauuaga

SEQ ID NO: 4000765 - RNA, 20 nt, Staphylococcus aureus subsp. aureus MW2
auaaaucaugaaauuaaaaa

SEQ ID NO: 4000766 - RNA, 22 nt, Staphylococcus aureus subsp. aureus MW2
auaaaucauuaguuguaucagu

SEQ ID NO: 4000767 - RNA, 16 nt, Staphylococcus aureus subsp. aureus MW2
auaaaucauucuuuau

SEQ ID NO: 4000768 - RNA, 21 nt, Staphylococcus aureus subsp. aureus MW2
auaaaucauucuuuauagaaa

SEQ ID NO: 4000769 - RNA, 17 nt, Staphylococcus aureus subsp. aureus MW2
auaaauccaaugaugaa

SEQ ID NO: 4000770 - RNA, 15 nt, Staphylococcus aureus subsp. aureus MW2
auaaaucgauaaaau

SEQ ID NO: 4000771 - RNA, 16 nt, Staphylococcus aureus subsp. aureus MW2
auaaaucgauaaaaug

SEQ ID NO: 4000772 - RNA, 20 nt, Staphylococcus aureus subsp. aureus MW2
auaaaucggacugauagaaa

SEQ ID NO: 4000773 - RNA, 18 nt, Staphylococcus aureus subsp. aureus MW2
auaaaucguguuaauucu

SEQ ID NO: 4000774 - RNA, 13 nt, Staphylococcus aureus subsp. aureus MW2
auaaaucuuuuuu

SEQ ID NO: 4000775 - RNA, 22 nt, Staphylococcus aureus subsp. aureus MW2
auaaaugaauuauuuaaaaugc

SEQ ID NO: 4000776 - RNA, 13 nt, Staphylococcus aureus subsp. aureus MW2
auaaaugauuaaa

SEQ ID NO: 4000777 - RNA, 22 nt, Staphylococcus aureus subsp. aureus MW2
auaaaugcgguuaaugacuaug

SEQ ID NO: 4000778 - RNA, 17 nt, Staphylococcus aureus subsp. aureus MW2
auaaaugcuaaaaguau

SEQ ID NO: 4000779 - RNA, 22 nt, Staphylococcus aureus subsp. aureus MW2
auaaauguccgauuugauaaaa

SEQ ID NO: 4000780 - RNA, 12 nt, Staphylococcus aureus subsp. aureus MW2
auaaauguuaaa

SEQ ID NO: 4000781 - RNA, 18 nt, Staphylococcus aureus subsp. aureus MW2
auaaauguuagauuucaa

SEQ ID NO: 4000782 - RNA, 19 nt, Staphylococcus aureus subsp. aureus MW2
auaaauguuagauuucaaa

SEQ ID NO: 4000783 - RNA, 18 nt, Staphylococcus aureus subsp. aureus MW2
auaaauguuauuaaccaa

SEQ ID NO: 4000784 - RNA, 18 nt, Staphylococcus aureus subsp. aureus MW2
auaaauguuauugcuuau

SEQ ID NO: 4000785 - RNA, 16 nt, Staphylococcus aureus subsp. aureus MW2
auaaauuagaugaaau

SEQ ID NO: 4000786 - RNA, 14 nt, Staphylococcus aureus subsp. aureus MW2
auaaauucuaucua

SEQ ID NO: 4000787 - RNA, 12 nt, Staphylococcus aureus subsp. aureus MW2
auaaauucucua

SEQ ID NO: 4000788 - RNA, 20 nt, Staphylococcus aureus subsp. aureus MW2
auaaauugaguuuuuuaaaa

SEQ ID NO: 4000789 - RNA, 22 nt, Staphylococcus aureus subsp. aureus MW2
auaaauugaguuuuuuaaaaua

SEQ ID NO: 4000790 - RNA, 23 nt, Staphylococcus aureus subsp. aureus MW2
auaaauugaguuuuuuaaaauaa

SEQ ID NO: 4000791 - RNA, 21 nt, Staphylococcus aureus subsp. aureus MW2
auaaauuuauauauagaaaua

SEQ ID NO: 4000792 - RNA, 22 nt, Staphylococcus aureus subsp. aureus MW2
auaaauuuauauauagaaauaa

SEQ ID NO: 4000793 - RNA, 22 nt, Staphylococcus aureus subsp. aureus MW2
auaaauuucaagguauacacaa

SEQ ID NO: 4000794 - RNA, 21 nt, Staphylococcus aureus subsp. aureus MW2
auaaauuuugaauuacagauu

SEQ ID NO: 4000795 - RNA, 23 nt, Staphylococcus aureus subsp. aureus MW2
auaaauuuugagaaaauaucauu

SEQ ID NO: 4000796 - RNA, 23 nt, Staphylococcus aureus subsp. aureus MW2
auaacaaaaauugcuauauuagu

SEQ ID NO: 4000797 - RNA, 11 nt, Staphylococcus aureus subsp. aureus MW2
auaacaaacau

SEQ ID NO: 4000798 - RNA, 12 nt, Staphylococcus aureus subsp. aureus MW2
auaacaaacauu

SEQ ID NO: 4000799 - RNA, 14 nt, Staphylococcus aureus subsp. aureus MW2
auaacaaacauuaa

SEQ ID NO: 4000800 - RNA, 15 nt, Staphylococcus aureus subsp. aureus MW2
auaacaaacauuaau

SEQ ID NO: 4000801 - RNA, 16 nt, Staphylococcus aureus subsp. aureus MW2
auaacaacgauaauug

SEQ ID NO: 4000802 - RNA, 16 nt, Staphylococcus aureus subsp. aureus MW2
auaacaauuuauuaaa

SEQ ID NO: 4000803 - RNA, 18 nt, Staphylococcus aureus subsp. aureus MW2
auaacaauuuuaaaucuu

SEQ ID NO: 4000804 - RNA, 21 nt, Staphylococcus aureus subsp. aureus MW2
auaacaauuuuaaaucuuuua

SEQ ID NO: 4000805 - RNA, 13 nt, Staphylococcus aureus subsp. aureus MW2
auaacacaucaug

SEQ ID NO: 4000806 - RNA, 15 nt, Staphylococcus aureus subsp. aureus MW2
auaacacaucaugac

SEQ ID NO: 4000807 - RNA, 14 nt, Staphylococcus aureus subsp. aureus MW2
auaacaccaauuaa

SEQ ID NO: 4000808 - RNA, 17 nt, Staphylococcus aureus subsp. aureus MW2
auaacaccaauuaaauc

SEQ ID NO: 4000809 - RNA, 14 nt, Staphylococcus aureus subsp. aureus MW2
auaacaccauaaca

SEQ ID NO: 4000810 - RNA, 20 nt, Staphylococcus aureus subsp. aureus MW2
auaacaccgcaaugccacau

SEQ ID NO: 4000811 - RNA, 18 nt, Staphylococcus aureus subsp. aureus MW2
auaacaccuuucauuugg

SEQ ID NO: 4000812 - RNA, 16 nt, Staphylococcus aureus subsp. aureus MW2
auaacagcuacaaaua

SEQ ID NO: 4000813 - RNA, 21 nt, Staphylococcus aureus subsp. aureus MW2
auaacagcuacaaauaaugag

SEQ ID NO: 4000814 - RNA, 24 nt, Staphylococcus aureus subsp. aureus MW2
auaacaguauuuuagguuuaucau

SEQ ID NO: 4000815 - RNA, 15 nt, Staphylococcus aureus subsp. aureus MW2
auaacaucaaauaga

SEQ ID NO: 4000816 - RNA, 17 nt, Staphylococcus aureus subsp. aureus MW2
auaacauuaaaaugaua

SEQ ID NO: 4000817 - RNA, 20 nt, Staphylococcus aureus subsp. aureus MW2
auaacauucuucaaaaaaua

SEQ ID NO: 4000818 - RNA, 23 nt, Staphylococcus aureus subsp. aureus MW2
auaacauugaacgauaacaauuu

SEQ ID NO: 4000819 - RNA, 23 nt, Staphylococcus aureus subsp. aureus MW2
auaacauuggcaaacgaauauuc

SEQ ID NO: 4000820 - RNA, 15 nt, Staphylococcus aureus subsp. aureus MW2
auaacauuuaagaaa

SEQ ID NO: 4000821 - RNA, 16 nt, Staphylococcus aureus subsp. aureus MW2
auaaccaaaccauuaa

SEQ ID NO: 4000822 - RNA, 16 nt, Staphylococcus aureus subsp. aureus MW2
auaaccaaguaauucu

SEQ ID NO: 4000823 - RNA, 17 nt, Staphylococcus aureus subsp. aureus MW2
auaaccaaguaauucuu

SEQ ID NO: 4000824 - RNA, 20 nt, Staphylococcus aureus subsp. aureus MW2
auaaccaaguaauucuuuac

SEQ ID NO: 4000825 - RNA, 22 nt, Staphylococcus aureus subsp. aureus MW2
auaaccaccaucccauuaaacc

SEQ ID NO: 4000826 - RNA, 18 nt, Staphylococcus aureus subsp. aureus MW2
auaaccauaguaacaaaa

SEQ ID NO: 4000827 - RNA, 17 nt, Staphylococcus aureus subsp. aureus MW2
auaauaaaacuugugau

SEQ ID NO: 4000828 - RNA, 20 nt, Staphylococcus aureus subsp. aureus MW2
auaauaaaacuugugauaua

SEQ ID NO: 4000829 - RNA, 12 nt, Staphylococcus aureus subsp. aureus MW2
auaauaaaauag

SEQ ID NO: 4000830 - RNA, 23 nt, Staphylococcus aureus subsp. aureus MW2
auaauaaauagacugccaauaaa

SEQ ID NO: 4000831 - RNA, 18 nt, Staphylococcus aureus subsp. aureus MW2
auaauaacuggcaaauca

SEQ ID NO: 4000832 - RNA, 20 nt, Staphylococcus aureus subsp. aureus MW2
auaauaagagguauagcaag

SEQ ID NO: 4000833 - RNA, 15 nt, Staphylococcus aureus subsp. aureus MW2
auaauaauauugaaa

SEQ ID NO: 4000834 - RNA, 12 nt, Staphylococcus aureus subsp. aureus MW2
auaauaauccac

SEQ ID NO: 4000835 - RNA, 14 nt, Staphylococcus aureus subsp. aureus MW2
auaauaaucuuuaa

SEQ ID NO: 4000836 - RNA, 16 nt, Staphylococcus aureus subsp. aureus MW2
auaauaaucuuuaaca

SEQ ID NO: 4000837 - RNA, 16 nt, Staphylococcus aureus subsp. aureus MW2
auaauacaauuuuagc

SEQ ID NO: 4000838 - RNA, 11 nt, Staphylococcus aureus subsp. aureus MW2
auaauacacau

SEQ ID NO: 4000839 - RNA, 19 nt, Staphylococcus aureus subsp. aureus MW2
auaauaccuucaauugaca

SEQ ID NO: 4000840 - RNA, 22 nt, Staphylococcus aureus subsp. aureus MW2
auaauacgcaauugauauuuac

SEQ ID NO: 4000841 - RNA, 16 nt, Staphylococcus aureus subsp. aureus MW2
auaauacuguauuuua

SEQ ID NO: 4000842 - RNA, 15 nt, Staphylococcus aureus subsp. aureus MW2
auaauacuguuuaaa

SEQ ID NO: 4000843 - RNA, 13 nt, Staphylococcus aureus subsp. aureus MW2
auaauagaaauaa

SEQ ID NO: 4000844 - RNA, 23 nt, Staphylococcus aureus subsp. aureus MW2
auaauagaaauaaucacauuaau

SEQ ID NO: 4000845 - RNA, 15 nt, Staphylococcus aureus subsp. aureus MW2
auaauagauaauagu

SEQ ID NO: 4000846 - RNA, 13 nt, Staphylococcus aureus subsp. aureus MW2
auaauauaaaaac

SEQ ID NO: 4000847 - RNA, 15 nt, Staphylococcus aureus subsp. aureus MW2
auaauauaaaacgau

SEQ ID NO: 4000848 - RNA, 14 nt, Staphylococcus aureus subsp. aureus MW2
auaauauaaauaaa

SEQ ID NO: 4000849 - RNA, 17 nt, Staphylococcus aureus subsp. aureus MW2
auaauauauacaaauaa

SEQ ID NO: 4000850 - RNA, 22 nt, Staphylococcus aureus subsp. aureus MW2
auaauauauccugccaauauau

SEQ ID NO: 4000851 - RNA, 15 nt, Staphylococcus aureus subsp. aureus MW2
auaauauauuaaaaa

SEQ ID NO: 4000852 - RNA, 16 nt, Staphylococcus aureus subsp. aureus MW2
auaauauauuaacaac

SEQ ID NO: 4000853 - RNA, 18 nt, Staphylococcus aureus subsp. aureus MW2
auaauaugugcaugagac

SEQ ID NO: 4000854 - RNA, 23 nt, Staphylococcus aureus subsp. aureus MW2
auaauauuaacgaguuuucagua

SEQ ID NO: 4000855 - RNA, 19 nt, Staphylococcus aureus subsp. aureus MW2
auaauauugaugaauaaau

SEQ ID NO: 4000856 - RNA, 15 nt, Staphylococcus aureus subsp. aureus MW2
auaauauuggacuuu

SEQ ID NO: 4000857 - RNA, 14 nt, Staphylococcus aureus subsp. aureus MW2
auaaucaagaauau

SEQ ID NO: 4000858 - RNA, 15 nt, Staphylococcus aureus subsp. aureus MW2
auaaucaagaauaua

SEQ ID NO: 4000859 - RNA, 18 nt, Staphylococcus aureus subsp. aureus MW2
auaaucaagaauauaaau

SEQ ID NO: 4000860 - RNA, 22 nt, Staphylococcus aureus subsp. aureus MW2
auaaucaagaauauaaaugauu

SEQ ID NO: 4000861 - RNA, 13 nt, Staphylococcus aureus subsp. aureus MW2
auaaucacauuaa

SEQ ID NO: 4000862 - RNA, 15 nt, Staphylococcus aureus subsp. aureus MW2
auaaucauaaaaauc

SEQ ID NO: 4000863 - RNA, 13 nt, Staphylococcus aureus subsp. aureus MW2
auaauccaccuaa

SEQ ID NO: 4000864 - RNA, 21 nt, Staphylococcus aureus subsp. aureus MW2
auaauccaccuaaaaaguacu

SEQ ID NO: 4000865 - RNA, 11 nt, Staphylococcus aureus subsp. aureus MW2
auaauccauuc

SEQ ID NO: 4000866 - RNA, 18 nt, Staphylococcus aureus subsp. aureus MW2
auaaucccaaccauucua

SEQ ID NO: 4000867 - RNA, 21 nt, Staphylococcus aureus subsp. aureus MW2
auaauccgagucauacucauc

SEQ ID NO: 4000868 - RNA, 13 nt, Staphylococcus aureus subsp. aureus MW2
auaaucuaguauc

SEQ ID NO: 4000869 - RNA, 12 nt, Staphylococcus aureus subsp. aureus MW2
auaaucuaucuu

SEQ ID NO: 4000870 - RNA, 15 nt, Staphylococcus aureus subsp. aureus MW2
auaaucucuucaauu

SEQ ID NO: 4000871 - RNA, 19 nt, Staphylococcus aureus subsp. aureus MW2
auaaucucuucaauuuauu

SEQ ID NO: 4000872 - RNA, 23 nt, Staphylococcus aureus subsp. aureus MW2
auaaucucuucaauuuauuuuua

SEQ ID NO: 4000873 - RNA, 13 nt, Staphylococcus aureus subsp. aureus MW2
auaaucucuuuac

SEQ ID NO: 4000874 - RNA, 14 nt, Staphylococcus aureus subsp. aureus MW2
auaaucucuuuaca

SEQ ID NO: 4000875 - RNA, 15 nt, Staphylococcus aureus subsp. aureus MW2
auaaucuuuauuaau

SEQ ID NO: 4000876 - RNA, 16 nt, Staphylococcus aureus subsp. aureus MW2
auaaucuuuauuaaua

SEQ ID NO: 4000877 - RNA, 17 nt, Staphylococcus aureus subsp. aureus MW2
auaaucuuuuuuacuaa

SEQ ID NO: 4000878 - RNA, 19 nt, Staphylococcus aureus subsp. aureus MW2
auaaucuuuuuuacuaaaa

SEQ ID NO: 4000879 - RNA, 17 nt, Staphylococcus aureus subsp. aureus MW2
auaaugaauaaauaauu

SEQ ID NO: 4000880 - RNA, 17 nt, Staphylococcus aureus subsp. aureus MW2
auaaugacgagaauuaa

SEQ ID NO: 4000881 - RNA, 15 nt, Staphylococcus aureus subsp. aureus MW2
auaaugacugacacu

SEQ ID NO: 4000882 - RNA, 14 nt, Staphylococcus aureus subsp. aureus MW2
auaaugacugcaga

SEQ ID NO: 4000883 - RNA, 14 nt, Staphylococcus aureus subsp. aureus MW2
auaaugauacuaau

SEQ ID NO: 4000884 - RNA, 14 nt, Staphylococcus aureus subsp. aureus MW2
auaaugaucaagua

SEQ ID NO: 4000885 - RNA, 23 nt, Staphylococcus aureus subsp. aureus MW2
auaaugaugugccucaucuucaa

SEQ ID NO: 4000886 - RNA, 13 nt, Staphylococcus aureus subsp. aureus MW2
auaaugauugucu

SEQ ID NO: 4000887 - RNA, 20 nt, Staphylococcus aureus subsp. aureus MW2
auaaugcacgcgugccaaca

SEQ ID NO: 4000888 - RNA, 21 nt, Staphylococcus aureus subsp. aureus MW2
auaaugcagauucuucaccaa

SEQ ID NO: 4000889 - RNA, 18 nt, Staphylococcus aureus subsp. aureus MW2
auaaugcaugugaaauua

SEQ ID NO: 4000890 - RNA, 14 nt, Staphylococcus aureus subsp. aureus MW2
auaaugcuacuauu

SEQ ID NO: 4000891 - RNA, 16 nt, Staphylococcus aureus subsp. aureus MW2
auaaugcuacuauuaa

SEQ ID NO: 4000892 - RNA, 16 nt, Staphylococcus aureus subsp. aureus MW2
auaaugcuuauuaaaa

SEQ ID NO: 4000893 - RNA, 19 nt, Staphylococcus aureus subsp. aureus MW2
auaaugguucuaaaauaga

SEQ ID NO: 4000894 - RNA, 19 nt, Staphylococcus aureus subsp. aureus MW2
auaaugguucucugucaaa

SEQ ID NO: 4000895 - RNA, 17 nt, Staphylococcus aureus subsp. aureus MW2
auaaugguugaauaaca

SEQ ID NO: 4000896 - RNA, 15 nt, Staphylococcus aureus subsp. aureus MW2
auaauguaaaaugau

SEQ ID NO: 4000897 - RNA, 15 nt, Staphylococcus aureus subsp. aureus MW2
auaauguacauguau

SEQ ID NO: 4000898 - RNA, 18 nt, Staphylococcus aureus subsp. aureus MW2
auaauguacauguauaaa

SEQ ID NO: 4000899 - RNA, 19 nt, Staphylococcus aureus subsp. aureus MW2
auaauguauaaaacagaau

SEQ ID NO: 4000900 - RNA, 23 nt, Staphylococcus aureus subsp. aureus MW2
auaauguauaaaacagaauuuca

SEQ ID NO: 4000901 - RNA, 16 nt, Staphylococcus aureus subsp. aureus MW2
auaaugucuuacuugu

SEQ ID NO: 4000902 - RNA, 19 nt, Staphylococcus aureus subsp. aureus MW2
auaauguuaagcaguuggu

SEQ ID NO: 4000903 - RNA, 21 nt, Staphylococcus aureus subsp. aureus MW2
auaauguuuccugauauuuca

SEQ ID NO: 4000904 - RNA, 21 nt, Staphylococcus aureus subsp. aureus MW2
auaauuaaaauaagauauaua

SEQ ID NO: 4000905 - RNA, 13 nt, Staphylococcus aureus subsp. aureus MW2
auaauuaaacaaa

SEQ ID NO: 4000906 - RNA, 23 nt, Staphylococcus aureus subsp. aureus MW2
auaauuaaacaaaacuuaaaaua

SEQ ID NO: 4000907 - RNA, 12 nt, Staphylococcus aureus subsp. aureus MW2
auaauuaaacua

SEQ ID NO: 4000908 - RNA, 24 nt, Staphylococcus aureus subsp. aureus MW2
auaauuaaacuaauagcauuugua

SEQ ID NO: 4000909 - RNA, 12 nt, Staphylococcus aureus subsp. aureus MW2
auaauuaaauaa

SEQ ID NO: 4000910 - RNA, 17 nt, Staphylococcus aureus subsp. aureus MW2
auaauuaaauaaaaaua

SEQ ID NO: 4000911 - RNA, 18 nt, Staphylococcus aureus subsp. aureus MW2
auaauuaaauaaaaauau

SEQ ID NO: 4000912 - RNA, 15 nt, Staphylococcus aureus subsp. aureus MW2
auaauuaaauaacuu

SEQ ID NO: 4000913 - RNA, 15 nt, Staphylococcus aureus subsp. aureus MW2
auaauuaaauagcuu

SEQ ID NO: 4000914 - RNA, 16 nt, Staphylococcus aureus subsp. aureus MW2
auaauuaaauauaaag

SEQ ID NO: 4000915 - RNA, 23 nt, Staphylococcus aureus subsp. aureus MW2
auaauuaacuuacuuuuguaaaa

SEQ ID NO: 4000916 - RNA, 14 nt, Staphylococcus aureus subsp. aureus MW2
auacaucaauaucu

SEQ ID NO: 4000917 - RNA, 14 nt, Staphylococcus aureus subsp. aureus MW2
auacaucaauuucu

SEQ ID NO: 4000918 - RNA, 20 nt, Staphylococcus aureus subsp. aureus MW2
auacaucauuagacuuucuu

SEQ ID NO: 4000919 - RNA, 22 nt, Staphylococcus aureus subsp. aureus MW2
auacaucggaauucaaccaauu

SEQ ID NO: 4000920 - RNA, 17 nt, Staphylococcus aureus subsp. aureus MW2
auacaugacauucauuu

SEQ ID NO: 4000921 - RNA, 17 nt, Staphylococcus aureus subsp. aureus MW2
auacaugccaauggaag

SEQ ID NO: 4000922 - RNA, 16 nt, Staphylococcus aureus subsp. aureus MW2
auacauguacauuauc

SEQ ID NO: 4000923 - RNA, 20 nt, Staphylococcus aureus subsp. aureus MW2
auacauuaaacauauuuuuu

SEQ ID NO: 4000924 - RNA, 16 nt, Staphylococcus aureus subsp. aureus MW2
auacauuaacgauuaa

SEQ ID NO: 4000925 - RNA, 15 nt, Staphylococcus aureus subsp. aureus MW2
auacauuaauauaaa

SEQ ID NO: 4000926 - RNA, 18 nt, Staphylococcus aureus subsp. aureus MW2
auacauuaauauaaauau

SEQ ID NO: 4000927 - RNA, 12 nt, Staphylococcus aureus subsp. aureus MW2
auacauuauuaa

SEQ ID NO: 4000928 - RNA, 12 nt, Staphylococcus aureus subsp. aureus MW2
auacauugauaa

SEQ ID NO: 4000929 - RNA, 14 nt, Staphylococcus aureus subsp. aureus MW2
auacauuuacauau

SEQ ID NO: 4000930 - RNA, 13 nt, Staphylococcus aureus subsp. aureus MW2
auacauuucaaaa

SEQ ID NO: 4000931 - RNA, 15 nt, Staphylococcus aureus subsp. aureus MW2
auacauuucaaaaaa

SEQ ID NO: 4000932 - RNA, 18 nt, Staphylococcus aureus subsp. aureus MW2
auacauuucuguauaaac

SEQ ID NO: 4000933 - RNA, 13 nt, Staphylococcus aureus subsp. aureus MW2
auacauuuugaaa

SEQ ID NO: 4000934 - RNA, 15 nt, Staphylococcus aureus subsp. aureus MW2
auacauuuugcucua

SEQ ID NO: 4000935 - RNA, 20 nt, Staphylococcus aureus subsp. aureus MW2
auacauuuugcucuaaacuu

SEQ ID NO: 4000936 - RNA, 15 nt, Staphylococcus aureus subsp. aureus MW2
auaccaaauauauuu

SEQ ID NO: 4000937 - RNA, 18 nt, Staphylococcus aureus subsp. aureus MW2
auaccaaccaaaaccaaa

SEQ ID NO: 4000938 - RNA, 22 nt, Staphylococcus aureus subsp. aureus MW2
auaccaaccaaaaccaaaugaa

SEQ ID NO: 4000939 - RNA, 18 nt, Staphylococcus aureus subsp. aureus MW2
auaccaacugcaaauaca

SEQ ID NO: 4000940 - RNA, 21 nt, Staphylococcus aureus subsp. aureus MW2
auaccaacugucgguucaucu

SEQ ID NO: 4000941 - RNA, 21 nt, Staphylococcus aureus subsp. aureus MW2
auaccacaucgcauaauaucu

SEQ ID NO: 4000942 - RNA, 18 nt, Staphylococcus aureus subsp. aureus MW2
auaccacggccgcucggu

SEQ ID NO: 4000943 - RNA, 22 nt, Staphylococcus aureus subsp. aureus MW2
auaccacuuaaucguucccauu

SEQ ID NO: 4000944 - RNA, 15 nt, Staphylococcus aureus subsp. aureus MW2
auaccauaauuaaau

SEQ ID NO: 4000945 - RNA, 18 nt, Staphylococcus aureus subsp. aureus MW2
auaccauuccaaaaauug

SEQ ID NO: 4000946 - RNA, 20 nt, Staphylococcus aureus subsp. aureus MW2
auaccauugugaugauaauu

SEQ ID NO: 4000947 - RNA, 18 nt, Staphylococcus aureus subsp. aureus MW2
auaccgaauaauuuugau

SEQ ID NO: 4000948 - RNA, 20 nt, Staphylococcus aureus subsp. aureus MW2
auaccguuaguacggcugcu

SEQ ID NO: 4000949 - RNA, 14 nt, Staphylococcus aureus subsp. aureus MW2
auaccuaaaauacc

SEQ ID NO: 4000950 - RNA, 21 nt, Staphylococcus aureus subsp. aureus MW2
auaccuacaaauauguaauca

SEQ ID NO: 4000951 - RNA, 21 nt, Staphylococcus aureus subsp. aureus MW2
auaccuacagauuuuaaaaau

SEQ ID NO: 4000952 - RNA, 22 nt, Staphylococcus aureus subsp. aureus MW2
auaccuaucccuguaaaaccau

SEQ ID NO: 4000953 - RNA, 15 nt, Staphylococcus aureus subsp. aureus MW2
auaccuauuccuauu

SEQ ID NO: 4000954 - RNA, 20 nt, Staphylococcus aureus subsp. aureus MW2
auaccucauccgccaauuaa

SEQ ID NO: 4000955 - RNA, 15 nt, Staphylococcus aureus subsp. aureus MW2
auaccugcauauuca

SEQ ID NO: 4000956 - RNA, 15 nt, Staphylococcus aureus subsp. aureus MW2
auaccuuauuucagc

SEQ ID NO: 4000957 - RNA, 12 nt, Staphylococcus aureus subsp. aureus MW2
auaccuuuaaau

SEQ ID NO: 4000958 - RNA, 14 nt, Staphylococcus aureus subsp. aureus MW2
auaccuuuaauauc

SEQ ID NO: 4000959 - RNA, 19 nt, Staphylococcus aureus subsp. aureus MW2
auaccuuugccguauuuca

SEQ ID NO: 4000960 - RNA, 14 nt, Staphylococcus aureus subsp. aureus MW2
auaccuuuuucuaa

SEQ ID NO: 4000961 - RNA, 16 nt, Staphylococcus aureus subsp. aureus MW2
auaccuuuuucuacca

SEQ ID NO: 4000962 - RNA, 14 nt, Staphylococcus aureus subsp. aureus MW2
auacgaauuaaaau

SEQ ID NO: 4000963 - RNA, 16 nt, Staphylococcus aureus subsp. aureus MW2
auacgaauuaaaauaa

SEQ ID NO: 4000964 - RNA, 16 nt, Staphylococcus aureus subsp. aureus MW2
auacgacaaucacagc

SEQ ID NO: 4000965 - RNA, 15 nt, Staphylococcus aureus subsp. aureus MW2
auacgagaauaugau

SEQ ID NO: 4000966 - RNA, 24 nt, Staphylococcus aureus subsp. aureus MW2
auacgagcuuugcucauagaugac

SEQ ID NO: 4000967 - RNA, 14 nt, Staphylococcus aureus subsp. aureus MW2
auacgcaaaccaau

SEQ ID NO: 4000968 - RNA, 14 nt, Staphylococcus aureus subsp. aureus MW2
auacgccuaaauau

SEQ ID NO: 4000969 - RNA, 20 nt, Staphylococcus aureus subsp. aureus MW2
auacgcgcuucaucaaugga

SEQ ID NO: 4000970 - RNA, 14 nt, Staphylococcus aureus subsp. aureus MW2
auacgcuuuuuaaa

SEQ ID NO: 4000971 - RNA, 19 nt, Staphylococcus aureus subsp. aureus MW2
auacgcuuuuuaaaaaauu

SEQ ID NO: 4000972 - RNA, 20 nt, Staphylococcus aureus subsp. aureus MW2
auacguaaacacuuuaguau

SEQ ID NO: 4000973 - RNA, 13 nt, Staphylococcus aureus subsp. aureus MW2
auacguaaauggu

SEQ ID NO: 4000974 - RNA, 22 nt, Staphylococcus aureus subsp. aureus MW2
auacguauauucggauccaauc

SEQ ID NO: 4000975 - RNA, 18 nt, Staphylococcus aureus subsp. aureus MW2
auacguugauguaauucu

SEQ ID NO: 4000976 - RNA, 19 nt, Staphylococcus aureus subsp. aureus MW2
auacguugauguaauucug

SEQ ID NO: 4000977 - RNA, 14 nt, Staphylococcus aureus subsp. aureus MW2
auacguuuauaucu

SEQ ID NO: 4000978 - RNA, 19 nt, Staphylococcus aureus subsp. aureus MW2
auacguuuauccuuuaaau

SEQ ID NO: 4000979 - RNA, 13 nt, Staphylococcus aureus subsp. aureus MW2
auacuaaaacaug

SEQ ID NO: 4000980 - RNA, 21 nt, Staphylococcus aureus subsp. aureus MW2
auacuaaaaguguuaugaauu

SEQ ID NO: 4000981 - RNA, 24 nt, Staphylococcus aureus subsp. aureus MW2
auacuaagauuagcuaugaacgaa

SEQ ID NO: 4000982 - RNA, 15 nt, Staphylococcus aureus subsp. aureus MW2
auacuaaucaaagaa

SEQ ID NO: 4000983 - RNA, 22 nt, Staphylococcus aureus subsp. aureus MW2
auacuaaucaaagaaaaaguga

SEQ ID NO: 4000984 - RNA, 16 nt, Staphylococcus aureus subsp. aureus MW2
auacuaccguuuuuau

SEQ ID NO: 4000985 - RNA, 18 nt, Staphylococcus aureus subsp. aureus MW2
auacuaccguuuuuauau

SEQ ID NO: 4000986 - RNA, 23 nt, Staphylococcus aureus subsp. aureus MW2
auacuacucccccguaguauaua

SEQ ID NO: 4000987 - RNA, 21 nt, Staphylococcus aureus subsp. aureus MW2
auacuacuguugacauuugac

SEQ ID NO: 4000988 - RNA, 19 nt, Staphylococcus aureus subsp. aureus MW2
auacuacuuguuuguuuuu

SEQ ID NO: 4000989 - RNA, 13 nt, Staphylococcus aureus subsp. aureus MW2
auacuauaaauaa

SEQ ID NO: 4000990 - RNA, 18 nt, Staphylococcus aureus subsp. aureus MW2
auacuauaaauaaaaaua

SEQ ID NO: 4000991 - RNA, 14 nt, Staphylococcus aureus subsp. aureus MW2
auacuauacaaugu

SEQ ID NO: 4000992 - RNA, 14 nt, Staphylococcus aureus subsp. aureus MW2
auacuauacugaug

SEQ ID NO: 4000993 - RNA, 16 nt, Staphylococcus aureus subsp. aureus MW2
auacuauaugaaaaga

SEQ ID NO: 4000994 - RNA, 17 nt, Staphylococcus aureus subsp. aureus MW2
auacuauaugaaaagag

SEQ ID NO: 4000995 - RNA, 20 nt, Staphylococcus aureus subsp. aureus MW2
auacuccaguuuauaacugg

SEQ ID NO: 4000996 - RNA, 23 nt, Staphylococcus aureus subsp. aureus MW2
auacucgguacuucgcccuucca

SEQ ID NO: 4000997 - RNA, 16 nt, Staphylococcus aureus subsp. aureus MW2
auacucugaaaagccu

SEQ ID NO: 4000998 - RNA, 19 nt, Staphylococcus aureus subsp. aureus MW2
auacugcucuuuauauaua

SEQ ID NO: 4000999 - RNA, 22 nt, Staphylococcus aureus subsp. aureus MW2
auacugucaucuuucaaugcau

SEQ ID NO: 4001000 - RNA, 14 nt, Staphylococcus aureus subsp. aureus MW2
auacuguuuaaaua

SEQ ID NO: 4001001 - RNA, 15 nt, Staphylococcus aureus subsp. aureus MW2
auacuuaauuuaaau

SEQ ID NO: 4001002 - RNA, 20 nt, Staphylococcus aureus subsp. aureus MW2
auacuucaaacguuauguac

SEQ ID NO: 4001003 - RNA, 13 nt, Staphylococcus aureus subsp. aureus MW2
auacuucuauuuu

SEQ ID NO: 4001004 - RNA, 13 nt, Staphylococcus aureus subsp. aureus MW2
auacuucuuguuc

SEQ ID NO: 4001005 - RNA, 16 nt, Staphylococcus aureus subsp. aureus MW2
auagucgguuauuaca

SEQ ID NO: 4001006 - RNA, 16 nt, Staphylococcus aureus subsp. aureus MW2
auagucuuaaacauaa

SEQ ID NO: 4001007 - RNA, 22 nt, Staphylococcus aureus subsp. aureus MW2
auagucuuaaacauaacaugac

SEQ ID NO: 4001008 - RNA, 15 nt, Staphylococcus aureus subsp. aureus MW2
auagugacauuccaa

SEQ ID NO: 4001009 - RNA, 16 nt, Staphylococcus aureus subsp. aureus MW2
auagugguaaaaaguu

SEQ ID NO: 4001010 - RNA, 18 nt, Staphylococcus aureus subsp. aureus MW2
auagugugucauaaugaa

SEQ ID NO: 4001011 - RNA, 20 nt, Staphylococcus aureus subsp. aureus MW2
auaguuaagauuuuaacuuc

SEQ ID NO: 4001012 - RNA, 22 nt, Staphylococcus aureus subsp. aureus MW2
auaguucaaauugaacuucuuu

SEQ ID NO: 4001013 - RNA, 14 nt, Staphylococcus aureus subsp. aureus MW2
auaguucuuuaaau

SEQ ID NO: 4001014 - RNA, 20 nt, Staphylococcus aureus subsp. aureus MW2
auaguugucuuuacauucuu

SEQ ID NO: 4001015 - RNA, 16 nt, Staphylococcus aureus subsp. aureus MW2
auaguuguuuauuaua

SEQ ID NO: 4001016 - RNA, 15 nt, Staphylococcus aureus subsp. aureus MW2
auaguuucaaugccu

SEQ ID NO: 4001017 - RNA, 18 nt, Staphylococcus aureus subsp. aureus MW2
auaguuucuucuauuaua

SEQ ID NO: 4001018 - RNA, 15 nt, Staphylococcus aureus subsp. aureus MW2
auaguuuucuucacu

SEQ ID NO: 4001019 - RNA, 17 nt, Staphylococcus aureus subsp. aureus MW2
auaguuuuucauauuca

SEQ ID NO: 4001020 - RNA, 18 nt, Staphylococcus aureus subsp. aureus MW2
auaguuuuucauauucac

SEQ ID NO: 4001021 - RNA, 23 nt, Staphylococcus aureus subsp. aureus MW2
auauaaaaaccccuguugaacuu

SEQ ID NO: 4001022 - RNA, 22 nt, Staphylococcus aureus subsp. aureus MW2
auauaaaaagucccgcuuaaaa

SEQ ID NO: 4001023 - RNA, 13 nt, Staphylococcus aureus subsp. aureus MW2
auauaaaaucauu

SEQ ID NO: 4001024 - RNA, 16 nt, Staphylococcus aureus subsp. aureus MW2
auauaaaaucauuaau

SEQ ID NO: 4001025 - RNA, 15 nt, Staphylococcus aureus subsp. aureus MW2
auauaaaauccuaag

SEQ ID NO: 4001026 - RNA, 17 nt, Staphylococcus aureus subsp. aureus MW2
auauaaaauccuaagca

SEQ ID NO: 4001027 - RNA, 21 nt, Staphylococcus aureus subsp. aureus MW2
auauaaacaucuucuucauca

SEQ ID NO: 4001028 - RNA, 18 nt, Staphylococcus aureus subsp. aureus MW2
auauaaacuauuaaauca

SEQ ID NO: 4001029 - RNA, 18 nt, Staphylococcus aureus subsp. aureus MW2
auauaaaggaauagcuac

SEQ ID NO: 4001030 - RNA, 20 nt, Staphylococcus aureus subsp. aureus MW2
auauaaagucguaucauaua

SEQ ID NO: 4001031 - RNA, 16 nt, Staphylococcus aureus subsp. aureus MW2
auauaaauagcuucuu

SEQ ID NO: 4001032 - RNA, 13 nt, Staphylococcus aureus subsp. aureus MW2
auauaaaucauuu

SEQ ID NO: 4001033 - RNA, 18 nt, Staphylococcus aureus subsp. aureus MW2
auauaaauuaucagaauc

SEQ ID NO: 4001034 - RNA, 23 nt, Staphylococcus aureus subsp. aureus MW2
auauaaccauaguaacaaaauga

SEQ ID NO: 4001035 - RNA, 20 nt, Staphylococcus aureus subsp. aureus MW2
auauaaccuauuucauugau

SEQ ID NO: 4001036 - RNA, 16 nt, Staphylococcus aureus subsp. aureus MW2
auauaacgcuuuaaau

SEQ ID NO: 4001037 - RNA, 19 nt, Staphylococcus aureus subsp. aureus MW2
auauaacgcuuuaaaucau

SEQ ID NO: 4001038 - RNA, 13 nt, Staphylococcus aureus subsp. aureus MW2
auauaacguucgc

SEQ ID NO: 4001039 - RNA, 20 nt, Staphylococcus aureus subsp. aureus MW2
auauaacuauggucaucaau

SEQ ID NO: 4001040 - RNA, 16 nt, Staphylococcus aureus subsp. aureus MW2
auauaagcaaagacaa

SEQ ID NO: 4001041 - RNA, 14 nt, Staphylococcus aureus subsp. aureus MW2
auauaauaaaaaca

SEQ ID NO: 4001042 - RNA, 14 nt, Staphylococcus aureus subsp. aureus MW2
auauaauagaaaua

SEQ ID NO: 4001043 - RNA, 20 nt, Staphylococcus aureus subsp. aureus MW2
auauaauauauacaaauaaa

SEQ ID NO: 4001044 - RNA, 21 nt, Staphylococcus aureus subsp. aureus MW2
auauaaugauuuaauuuguua

SEQ ID NO: 4001045 - RNA, 21 nt, Staphylococcus aureus subsp. aureus MW2
auauaaugcugauaauuuuuc

SEQ ID NO: 4001046 - RNA, 14 nt, Staphylococcus aureus subsp. aureus MW2
auauaaugguugaa

SEQ ID NO: 4001047 - RNA, 17 nt, Staphylococcus aureus subsp. aureus MW2
auauaauguauaaaaca

SEQ ID NO: 4001048 - RNA, 18 nt, Staphylococcus aureus subsp. aureus MW2
auauaauuuauaaaaaga

SEQ ID NO: 4001049 - RNA, 14 nt, Staphylococcus aureus subsp. aureus MW2
auauaauuuauuua

SEQ ID NO: 4001050 - RNA, 13 nt, Staphylococcus aureus subsp. aureus MW2
auauaauuuuaau

SEQ ID NO: 4001051 - RNA, 13 nt, Staphylococcus aureus subsp. aureus MW2
auauacaaauaaa

SEQ ID NO: 4001052 - RNA, 15 nt, Staphylococcus aureus subsp. aureus MW2
auauacaaauuuaua

SEQ ID NO: 4001053 - RNA, 15 nt, Staphylococcus aureus subsp. aureus MW2
auauacauuuacaua

SEQ ID NO: 4001054 - RNA, 16 nt, Staphylococcus aureus subsp. aureus MW2
auauacgacaaucaca

SEQ ID NO: 4001055 - RNA, 22 nt, Staphylococcus aureus subsp. aureus MW2
auauacgauugaguugaaaaua

SEQ ID NO: 4001056 - RNA, 18 nt, Staphylococcus aureus subsp. aureus MW2
auauacguauacaucauu

SEQ ID NO: 4001057 - RNA, 17 nt, Staphylococcus aureus subsp. aureus MW2
auauacuaaauuugaaa

SEQ ID NO: 4001058 - RNA, 22 nt, Staphylococcus aureus subsp. aureus MW2
auauacuagcaauucacaucau

SEQ ID NO: 4001059 - RNA, 14 nt, Staphylococcus aureus subsp. aureus MW2
auauacucuaaaaa

SEQ ID NO: 4001060 - RNA, 19 nt, Staphylococcus aureus subsp. aureus MW2
auauacuugaagcaucgau

SEQ ID NO: 4001061 - RNA, 23 nt, Staphylococcus aureus subsp. aureus MW2
auauacuugaagcaucgauuuau

SEQ ID NO: 4001062 - RNA, 20 nt, Staphylococcus aureus subsp. aureus MW2
auauacuuuuauagaaaauu

SEQ ID NO: 4001063 - RNA, 11 nt, Staphylococcus aureus subsp. aureus MW2
auauacuuuuu

SEQ ID NO: 4001064 - RNA, 17 nt, Staphylococcus aureus subsp. aureus MW2
auauacuuuuuaaauga

SEQ ID NO: 4001065 - RNA, 19 nt, Staphylococcus aureus subsp. aureus MW2
auauacuuuuuaaaugauu

SEQ ID NO: 4001066 - RNA, 11 nt, Staphylococcus aureus subsp. aureus MW2
auauagaaaau

SEQ ID NO: 4001067 - RNA, 20 nt, Staphylococcus aureus subsp. aureus MW2
auauagaaauaauuuaaagg

SEQ ID NO: 4001068 - RNA, 20 nt, Staphylococcus aureus subsp. aureus MW2
auauagaagauauaacaugu

SEQ ID NO: 4001069 - RNA, 22 nt, Staphylococcus aureus subsp. aureus MW2
auauagaagauauaacauguau

SEQ ID NO: 4001070 - RNA, 19 nt, Staphylococcus aureus subsp. aureus MW2
auauagagccgugaaagaa

SEQ ID NO: 4001071 - RNA, 21 nt, Staphylococcus aureus subsp. aureus MW2
auauagcacgcuuauugaaaa

SEQ ID NO: 4001072 - RNA, 15 nt, Staphylococcus aureus subsp. aureus MW2
auauagcauaaaauu

SEQ ID NO: 4001073 - RNA, 22 nt, Staphylococcus aureus subsp. aureus MW2
auauagcauaaaauuucugcuu

SEQ ID NO: 4001074 - RNA, 18 nt, Staphylococcus aureus subsp. aureus MW2
auauagcggugucaauau

SEQ ID NO: 4001075 - RNA, 18 nt, Staphylococcus aureus subsp. aureus MW2
auauagcugugauuugau

SEQ ID NO: 4001076 - RNA, 19 nt, Staphylococcus aureus subsp. aureus MW2
auauaguaaaauaaauaca

SEQ ID NO: 4001077 - RNA, 23 nt, Staphylococcus aureus subsp. aureus MW2
auauaguaggagugaacuauaua

SEQ ID NO: 4001078 - RNA, 14 nt, Staphylococcus aureus subsp. aureus MW2
auauagucaaugaa

SEQ ID NO: 4001079 - RNA, 19 nt, Staphylococcus aureus subsp. aureus MW2
auauagucaaugaauaaug

SEQ ID NO: 4001080 - RNA, 14 nt, Staphylococcus aureus subsp. aureus MW2
auauaguuggcaau

SEQ ID NO: 4001081 - RNA, 15 nt, Staphylococcus aureus subsp. aureus MW2
auauauaacaaguac

SEQ ID NO: 4001082 - RNA, 22 nt, Staphylococcus aureus subsp. aureus MW2
auauauaaccauaguaacaaaa

SEQ ID NO: 4001083 - RNA, 13 nt, Staphylococcus aureus subsp. aureus MW2
auauauacaaaua

SEQ ID NO: 4001084 - RNA, 14 nt, Staphylococcus aureus subsp. aureus MW2
auauauacaaauaa

SEQ ID NO: 4001085 - RNA, 13 nt, Staphylococcus aureus subsp. aureus MW2
auauauagaaaua

SEQ ID NO: 4001086 - RNA, 13 nt, Staphylococcus aureus subsp. aureus MW2
auauauagauuaa

SEQ ID NO: 4001087 - RNA, 11 nt, Staphylococcus aureus subsp. aureus MW2
auauauauucg

SEQ ID NO: 4001088 - RNA, 12 nt, Staphylococcus aureus subsp. aureus MW2
auauaucaaaua

SEQ ID NO: 4001089 - RNA, 14 nt, Staphylococcus aureus subsp. aureus MW2
auauaugaaauauu

SEQ ID NO: 4001090 - RNA, 13 nt, Staphylococcus aureus subsp. aureus MW2
auauauuaaaaau

SEQ ID NO: 4001091 - RNA, 18 nt, Staphylococcus aureus subsp. aureus MW2
auauauuaacaacuuuau

SEQ ID NO: 4001092 - RNA, 19 nt, Staphylococcus aureus subsp. aureus MW2
auauauuaacaacuuuauu

SEQ ID NO: 4001093 - RNA, 15 nt, Staphylococcus aureus subsp. aureus MW2
auauauuacaucauu

SEQ ID NO: 4001094 - RNA, 22 nt, Staphylococcus aureus subsp. aureus MW2
auaugcuugcugugaauaaaau

SEQ ID NO: 4001095 - RNA, 16 nt, Staphylococcus aureus subsp. aureus MW2
auauggaauacuacac

SEQ ID NO: 4001096 - RNA, 19 nt, Staphylococcus aureus subsp. aureus MW2
auauggaauuucauauaau

SEQ ID NO: 4001097 - RNA, 17 nt, Staphylococcus aureus subsp. aureus MW2
auauggucuuuuaauau

SEQ ID NO: 4001098 - RNA, 21 nt, Staphylococcus aureus subsp. aureus MW2
auauggugguauuagaacuuc

SEQ ID NO: 4001099 - RNA, 16 nt, Staphylococcus aureus subsp. aureus MW2
auaugguuagaaaaaa

SEQ ID NO: 4001100 - RNA, 17 nt, Staphylococcus aureus subsp. aureus MW2
auaugguuagaaaaaaa

SEQ ID NO: 4001101 - RNA, 21 nt, Staphylococcus aureus subsp. aureus MW2
auaugguuagaaaaaaaucug

SEQ ID NO: 4001102 - RNA, 23 nt, Staphylococcus aureus subsp. aureus MW2
auaugguuguuuuccaauaauaa

SEQ ID NO: 4001103 - RNA, 15 nt, Staphylococcus aureus subsp. aureus MW2
auauguacuauuauc

SEQ ID NO: 4001104 - RNA, 17 nt, Staphylococcus aureus subsp. aureus MW2
auauguacuauuaucua

SEQ ID NO: 4001105 - RNA, 23 nt, Staphylococcus aureus subsp. aureus MW2
auauguauagaggauauuuauuc

SEQ ID NO: 4001106 - RNA, 17 nt, Staphylococcus aureus subsp. aureus MW2
auauguauuauagauua

SEQ ID NO: 4001107 - RNA, 21 nt, Staphylococcus aureus subsp. aureus MW2
auaugucucucuuucuuauuc

SEQ ID NO: 4001108 - RNA, 14 nt, Staphylococcus aureus subsp. aureus MW2
auaugugaaaaagc

SEQ ID NO: 4001109 - RNA, 16 nt, Staphylococcus aureus subsp. aureus MW2
auauguguagugaaaa

SEQ ID NO: 4001110 - RNA, 22 nt, Staphylococcus aureus subsp. aureus MW2
auauguuuauauugcaaaaaua

SEQ ID NO: 4001111 - RNA, 15 nt, Staphylococcus aureus subsp. aureus MW2
auauguuuuauaaua

SEQ ID NO: 4001112 - RNA, 13 nt, Staphylococcus aureus subsp. aureus MW2
auauuaaaguaaa

SEQ ID NO: 4001113 - RNA, 16 nt, Staphylococcus aureus subsp. aureus MW2
auauuaaaguaaaaua

SEQ ID NO: 4001114 - RNA, 17 nt, Staphylococcus aureus subsp. aureus MW2
auauuaaauuuacaaaa

SEQ ID NO: 4001115 - RNA, 22 nt, Staphylococcus aureus subsp. aureus MW2
auauuaaauuuacaaaaacuau

SEQ ID NO: 4001116 - RNA, 15 nt, Staphylococcus aureus subsp. aureus MW2
auauuaacaacuuua

SEQ ID NO: 4001117 - RNA, 19 nt, Staphylococcus aureus subsp. aureus MW2
auauuaacguuaguauaaa

SEQ ID NO: 4001118 - RNA, 18 nt, Staphylococcus aureus subsp. aureus MW2
auauuaacuguuagacuu

SEQ ID NO: 4001119 - RNA, 15 nt, Staphylococcus aureus subsp. aureus MW2
auauuaagauguaua

SEQ ID NO: 4001120 - RNA, 18 nt, Staphylococcus aureus subsp. aureus MW2
auauuaagcgucuaucuc

SEQ ID NO: 4001121 - RNA, 15 nt, Staphylococcus aureus subsp. aureus MW2
auauuaauagaaagu

SEQ ID NO: 4001122 - RNA, 14 nt, Staphylococcus aureus subsp. aureus MW2
auauuaauauauuu

SEQ ID NO: 4001123 - RNA, 16 nt, Staphylococcus aureus subsp. aureus MW2
auauuaauauauuuaa

SEQ ID NO: 4001124 - RNA, 17 nt, Staphylococcus aureus subsp. aureus MW2
auauuaauauauuuaaa

SEQ ID NO: 4001125 - RNA, 18 nt, Staphylococcus aureus subsp. aureus MW2
auauuaauauuuuuugau

SEQ ID NO: 4001126 - RNA, 21 nt, Staphylococcus aureus subsp. aureus MW2
auauuaauccacaaauaacac

SEQ ID NO: 4001127 - RNA, 14 nt, Staphylococcus aureus subsp. aureus MW2
auauuaauugaaaa

SEQ ID NO: 4001128 - RNA, 13 nt, Staphylococcus aureus subsp. aureus MW2
auauuaauuuuac

SEQ ID NO: 4001129 - RNA, 16 nt, Staphylococcus aureus subsp. aureus MW2
auauuaauuuuacguu

SEQ ID NO: 4001130 - RNA, 19 nt, Staphylococcus aureus subsp. aureus MW2
auauuacuaaccuauuaaa

SEQ ID NO: 4001131 - RNA, 22 nt, Staphylococcus aureus subsp. aureus MW2
auauuacuaaccuauuaaaaua

SEQ ID NO: 4001132 - RNA, 23 nt, Staphylococcus aureus subsp. aureus MW2
auauuacuaaccuauuaaaauaa

SEQ ID NO: 4001133 - RNA, 18 nt, Staphylococcus aureus subsp. aureus MW2
auauuacuucucaucgaa

SEQ ID NO: 4001134 - RNA, 21 nt, Staphylococcus aureus subsp. aureus MW2
auauuacuuuggaaauuuauu

SEQ ID NO: 4001135 - RNA, 18 nt, Staphylococcus aureus subsp. aureus MW2
auauuauaaaaagauaua

SEQ ID NO: 4001136 - RNA, 14 nt, Staphylococcus aureus subsp. aureus MW2
auauuauaaaaaua

SEQ ID NO: 4001137 - RNA, 12 nt, Staphylococcus aureus subsp. aureus MW2
auauuauauaua

SEQ ID NO: 4001138 - RNA, 18 nt, Staphylococcus aureus subsp. aureus MW2
auauuaucguaauuguua

SEQ ID NO: 4001139 - RNA, 23 nt, Staphylococcus aureus subsp. aureus MW2
auauuaugaacaugaaauuaauc

SEQ ID NO: 4001140 - RNA, 22 nt, Staphylococcus aureus subsp. aureus MW2
auauuaugauacgcuuuuuaaa

SEQ ID NO: 4001141 - RNA, 19 nt, Staphylococcus aureus subsp. aureus MW2
auauuaugccauucauuaa

SEQ ID NO: 4001142 - RNA, 14 nt, Staphylococcus aureus subsp. aureus MW2
auauuauuaaauca

SEQ ID NO: 4001143 - RNA, 13 nt, Staphylococcus aureus subsp. aureus MW2
auauuauuacuua

SEQ ID NO: 4001144 - RNA, 20 nt, Staphylococcus aureus subsp. aureus MW2
auauuauugugaaaucuauu

SEQ ID NO: 4001145 - RNA, 18 nt, Staphylococcus aureus subsp. aureus MW2
auauuauuuugcuuuaau

SEQ ID NO: 4001146 - RNA, 14 nt, Staphylococcus aureus subsp. aureus MW2
auauucaaacgaag

SEQ ID NO: 4001147 - RNA, 13 nt, Staphylococcus aureus subsp. aureus MW2
auauucaaauuua

SEQ ID NO: 4001148 - RNA, 14 nt, Staphylococcus aureus subsp. aureus MW2
auauucaacuuauu

SEQ ID NO: 4001149 - RNA, 13 nt, Staphylococcus aureus subsp. aureus MW2
auauucaaugaau

SEQ ID NO: 4001150 - RNA, 13 nt, Staphylococcus aureus subsp. aureus MW2
auauucacaucuu

SEQ ID NO: 4001151 - RNA, 14 nt, Staphylococcus aureus subsp. aureus MW2
auauucacaucuuu

SEQ ID NO: 4001152 - RNA, 21 nt, Staphylococcus aureus subsp. aureus MW2
auauucaccuacaacaccaau

SEQ ID NO: 4001153 - RNA, 12 nt, Staphylococcus aureus subsp. aureus MW2
auauucaucaua

SEQ ID NO: 4001154 - RNA, 22 nt, Staphylococcus aureus subsp. aureus MW2
auauucauguucuuguaauccu

SEQ ID NO: 4001155 - RNA, 20 nt, Staphylococcus aureus subsp. aureus MW2
auauuccacgcucacauuaa

SEQ ID NO: 4001156 - RNA, 20 nt, Staphylococcus aureus subsp. aureus MW2
auauucguagcaugacauua

SEQ ID NO: 4001157 - RNA, 20 nt, Staphylococcus aureus subsp. aureus MW2
auauucguugauaguuguau

SEQ ID NO: 4001158 - RNA, 22 nt, Staphylococcus aureus subsp. aureus MW2
auauucuaauugcacauuuaaa

SEQ ID NO: 4001159 - RNA, 22 nt, Staphylococcus aureus subsp. aureus MW2
auauucuccaacucuaacagcu

SEQ ID NO: 4001160 - RNA, 13 nt, Staphylococcus aureus subsp. aureus MW2
auauucucugcuu

SEQ ID NO: 4001161 - RNA, 15 nt, Staphylococcus aureus subsp. aureus MW2
auauucucuuuacca

SEQ ID NO: 4001162 - RNA, 21 nt, Staphylococcus aureus subsp. aureus MW2
auauucugcaccuguuuuaau

SEQ ID NO: 4001163 - RNA, 17 nt, Staphylococcus aureus subsp. aureus MW2
auauucuuaaaagacau

SEQ ID NO: 4001164 - RNA, 12 nt, Staphylococcus aureus subsp. aureus MW2
auauucuuaucu

SEQ ID NO: 4001165 - RNA, 14 nt, Staphylococcus aureus subsp. aureus MW2
auauugaaaacacg

SEQ ID NO: 4001166 - RNA, 19 nt, Staphylococcus aureus subsp. aureus MW2
auauugaaaguguaugcau

SEQ ID NO: 4001167 - RNA, 16 nt, Staphylococcus aureus subsp. aureus MW2
auauugaauaaaaaaa

SEQ ID NO: 4001168 - RNA, 20 nt, Staphylococcus aureus subsp. aureus MW2
auauugaauaaaaaaacacg

SEQ ID NO: 4001169 - RNA, 17 nt, Staphylococcus aureus subsp. aureus MW2
auauugaauugaaaaau

SEQ ID NO: 4001170 - RNA, 18 nt, Staphylococcus aureus subsp. aureus MW2
auauugaauugaaaaauu

SEQ ID NO: 4001171 - RNA, 12 nt, Staphylococcus aureus subsp. aureus MW2
auauugacugcc

SEQ ID NO: 4001172 - RNA, 13 nt, Staphylococcus aureus subsp. aureus MW2
auauugacugccu

SEQ ID NO: 4001173 - RNA, 16 nt, Staphylococcus aureus subsp. aureus MW2
auauugagaauauuaa

SEQ ID NO: 4001174 - RNA, 11 nt, Staphylococcus aureus subsp. aureus MW2
auauugauagc

SEQ ID NO: 4001175 - RNA, 16 nt, Staphylococcus aureus subsp. aureus MW2
auauugaugaauaaau

SEQ ID NO: 4001176 - RNA, 20 nt, Staphylococcus aureus subsp. aureus MW2
auauugauucuagugaaaua

SEQ ID NO: 4001177 - RNA, 22 nt, Staphylococcus aureus subsp. aureus MW2
auauugcaaaaauaauaugaau

SEQ ID NO: 4001178 - RNA, 16 nt, Staphylococcus aureus subsp. aureus MW2
auauugcgaaaaauaa

SEQ ID NO: 4001179 - RNA, 16 nt, Staphylococcus aureus subsp. aureus MW2
auauugcuuauguaca

SEQ ID NO: 4001180 - RNA, 20 nt, Staphylococcus aureus subsp. aureus MW2
auauuggaauacucuuuaau

SEQ ID NO: 4001181 - RNA, 22 nt, Staphylococcus aureus subsp. aureus MW2
auauuggcaguaguugacugaa

SEQ ID NO: 4001182 - RNA, 22 nt, Staphylococcus aureus subsp. aureus MW2
auauuggcaguguuugacugaa

SEQ ID NO: 4001183 - RNA, 16 nt, Staphylococcus aureus subsp. aureus MW2
aucaacuauuuacauc

SEQ ID NO: 4001184 - RNA, 12 nt, Staphylococcus aureus subsp. aureus MW2
aucaacuuuaau

SEQ ID NO: 4001185 - RNA, 13 nt, Staphylococcus aureus subsp. aureus MW2
aucaacuuuucua

SEQ ID NO: 4001186 - RNA, 14 nt, Staphylococcus aureus subsp. aureus MW2
aucaagaaauguua

SEQ ID NO: 4001187 - RNA, 14 nt, Staphylococcus aureus subsp. aureus MW2
aucaagaauauaaa

SEQ ID NO: 4001188 - RNA, 19 nt, Staphylococcus aureus subsp. aureus MW2
aucaagaauauaaaugauu

SEQ ID NO: 4001189 - RNA, 15 nt, Staphylococcus aureus subsp. aureus MW2
aucaagacauuuuaa

SEQ ID NO: 4001190 - RNA, 23 nt, Staphylococcus aureus subsp. aureus MW2
aucaagacucccuuuuuaaaaua

SEQ ID NO: 4001191 - RNA, 16 nt, Staphylococcus aureus subsp. aureus MW2
aucaagcuagcaucau

SEQ ID NO: 4001192 - RNA, 16 nt, Staphylococcus aureus subsp. aureus MW2
aucaaguauaaauguu

SEQ ID NO: 4001193 - RNA, 19 nt, Staphylococcus aureus subsp. aureus MW2
aucaagucgcaucguagca

SEQ ID NO: 4001194 - RNA, 18 nt, Staphylococcus aureus subsp. aureus MW2
aucaagucugcauuaauu

SEQ ID NO: 4001195 - RNA, 15 nt, Staphylococcus aureus subsp. aureus MW2
aucaaguugauaaug

SEQ ID NO: 4001196 - RNA, 12 nt, Staphylococcus aureus subsp. aureus MW2
aucaauaaaaau

SEQ ID NO: 4001197 - RNA, 21 nt, Staphylococcus aureus subsp. aureus MW2
aucaauaccauaauuaaauaa

SEQ ID NO: 4001198 - RNA, 20 nt, Staphylococcus aureus subsp. aureus MW2
aucaauagaugaaaauuuaa

SEQ ID NO: 4001199 - RNA, 20 nt, Staphylococcus aureus subsp. aureus MW2
aucaauaguuuauaauuuaa

SEQ ID NO: 4001200 - RNA, 13 nt, Staphylococcus aureus subsp. aureus MW2
aucaauauaaccg

SEQ ID NO: 4001201 - RNA, 17 nt, Staphylococcus aureus subsp. aureus MW2
aucaauaucaaauuugg

SEQ ID NO: 4001202 - RNA, 14 nt, Staphylococcus aureus subsp. aureus MW2
aucaauauugauau

SEQ ID NO: 4001203 - RNA, 21 nt, Staphylococcus aureus subsp. aureus MW2
aucaauauugucuucauuaac

SEQ ID NO: 4001204 - RNA, 23 nt, Staphylococcus aureus subsp. aureus MW2
aucaauauugucuucauuaacau

SEQ ID NO: 4001205 - RNA, 11 nt, Staphylococcus aureus subsp. aureus MW2
aucaauauuua

SEQ ID NO: 4001206 - RNA, 17 nt, Staphylococcus aureus subsp. aureus MW2
aucaauccaucaauacc

SEQ ID NO: 4001207 - RNA, 13 nt, Staphylococcus aureus subsp. aureus MW2
aucaauuaaacuu

SEQ ID NO: 4001208 - RNA, 21 nt, Staphylococcus aureus subsp. aureus MW2
aucaauuaacacucagauuuu

SEQ ID NO: 4001209 - RNA, 15 nt, Staphylococcus aureus subsp. aureus MW2
aucaauuuaauuaag

SEQ ID NO: 4001210 - RNA, 18 nt, Staphylococcus aureus subsp. aureus MW2
aucaauuucgacuccauu

SEQ ID NO: 4001211 - RNA, 22 nt, Staphylococcus aureus subsp. aureus MW2
aucacacgacauguagguaauu

SEQ ID NO: 4001212 - RNA, 15 nt, Staphylococcus aureus subsp. aureus MW2
aucacagaaaauaca

SEQ ID NO: 4001213 - RNA, 22 nt, Staphylococcus aureus subsp. aureus MW2
aucacagaaaauacauuucugu

SEQ ID NO: 4001214 - RNA, 15 nt, Staphylococcus aureus subsp. aureus MW2
aucacagcaauaaua

SEQ ID NO: 4001215 - RNA, 16 nt, Staphylococcus aureus subsp. aureus MW2
aucacagcaauaauaa

SEQ ID NO: 4001216 - RNA, 21 nt, Staphylococcus aureus subsp. aureus MW2
aucacaguguugaauuuaaaa

SEQ ID NO: 4001217 - RNA, 16 nt, Staphylococcus aureus subsp. aureus MW2
aucacaguuauauauu

SEQ ID NO: 4001218 - RNA, 20 nt, Staphylococcus aureus subsp. aureus MW2
aucacaucauaccaauccga

SEQ ID NO: 4001219 - RNA, 13 nt, Staphylococcus aureus subsp. aureus MW2
aucacauuaacaa

SEQ ID NO: 4001220 - RNA, 14 nt, Staphylococcus aureus subsp. aureus MW2
aucacauuaacaag

SEQ ID NO: 4001221 - RNA, 14 nt, Staphylococcus aureus subsp. aureus MW2
aucaccauaaaaau

SEQ ID NO: 4001222 - RNA, 14 nt, Staphylococcus aureus subsp. aureus MW2
aucaccauacuaaa

SEQ ID NO: 4001223 - RNA, 17 nt, Staphylococcus aureus subsp. aureus MW2
aucaccauacuaaaaca

SEQ ID NO: 4001224 - RNA, 17 nt, Staphylococcus aureus subsp. aureus MW2
aucaccuuuuuuaacuu

SEQ ID NO: 4001225 - RNA, 14 nt, Staphylococcus aureus subsp. aureus MW2
aucacgauuuucaa

SEQ ID NO: 4001226 - RNA, 18 nt, Staphylococcus aureus subsp. aureus MW2
aucacgauuuucaaguaa

SEQ ID NO: 4001227 - RNA, 13 nt, Staphylococcus aureus subsp. aureus MW2
aucacuaaaguaa

SEQ ID NO: 4001228 - RNA, 14 nt, Staphylococcus aureus subsp. aureus MW2
aucacuaaaguaaa

SEQ ID NO: 4001229 - RNA, 15 nt, Staphylococcus aureus subsp. aureus MW2
aucacuaauauauuu

SEQ ID NO: 4001230 - RNA, 15 nt, Staphylococcus aureus subsp. aureus MW2
aucacucaacugaug

SEQ ID NO: 4001231 - RNA, 14 nt, Staphylococcus aureus subsp. aureus MW2
aucacuccucuauu

SEQ ID NO: 4001232 - RNA, 15 nt, Staphylococcus aureus subsp. aureus MW2
aucacuguagauuca

SEQ ID NO: 4001233 - RNA, 16 nt, Staphylococcus aureus subsp. aureus MW2
aucacuucugaaaaua

SEQ ID NO: 4001234 - RNA, 22 nt, Staphylococcus aureus subsp. aureus MW2
aucacuugcuguugcaauaaaa

SEQ ID NO: 4001235 - RNA, 13 nt, Staphylococcus aureus subsp. aureus MW2
aucacuuuuuaaa

SEQ ID NO: 4001236 - RNA, 14 nt, Staphylococcus aureus subsp. aureus MW2
aucagaaucaagua

SEQ ID NO: 4001237 - RNA, 12 nt, Staphylococcus aureus subsp. aureus MW2
aucagacuaaaa

SEQ ID NO: 4001238 - RNA, 13 nt, Staphylococcus aureus subsp. aureus MW2
aucagacuaaaau

SEQ ID NO: 4001239 - RNA, 16 nt, Staphylococcus aureus subsp. aureus MW2
aucagcuauaaaagua

SEQ ID NO: 4001240 - RNA, 17 nt, Staphylococcus aureus subsp. aureus MW2
aucaggcuuuauuguug

SEQ ID NO: 4001241 - RNA, 15 nt, Staphylococcus aureus subsp. aureus MW2
aucagggaaaucauc

SEQ ID NO: 4001242 - RNA, 14 nt, Staphylococcus aureus subsp. aureus MW2
aucaguaauaucaa

SEQ ID NO: 4001243 - RNA, 19 nt, Staphylococcus aureus subsp. aureus MW2
aucaguagcauauugaugu

SEQ ID NO: 4001244 - RNA, 24 nt, Staphylococcus aureus subsp. aureus MW2
aucaguauuuguauugacaucuuc

SEQ ID NO: 4001245 - RNA, 13 nt, Staphylococcus aureus subsp. aureus MW2
aucagucauucac

SEQ ID NO: 4001246 - RNA, 17 nt, Staphylococcus aureus subsp. aureus MW2
aucaguccgcuuuuuca

SEQ ID NO: 4001247 - RNA, 18 nt, Staphylococcus aureus subsp. aureus MW2
aucaguccgcuuuuucau

SEQ ID NO: 4001248 - RNA, 13 nt, Staphylococcus aureus subsp. aureus MW2
aucagugaagcua

SEQ ID NO: 4001249 - RNA, 21 nt, Staphylococcus aureus subsp. aureus MW2
aucaguguagcaguauauguc

SEQ ID NO: 4001250 - RNA, 15 nt, Staphylococcus aureus subsp. aureus MW2
aucagugugauuuug

SEQ ID NO: 4001251 - RNA, 17 nt, Staphylococcus aureus subsp. aureus MW2
aucagugugauuuugga

SEQ ID NO: 4001252 - RNA, 19 nt, Staphylococcus aureus subsp. aureus MW2
aucagugugauuuuggaac

SEQ ID NO: 4001253 - RNA, 15 nt, Staphylococcus aureus subsp. aureus MW2
aucaguuauuuuaau

SEQ ID NO: 4001254 - RNA, 20 nt, Staphylococcus aureus subsp. aureus MW2
aucaguuguguaauaaagca

SEQ ID NO: 4001255 - RNA, 21 nt, Staphylococcus aureus subsp. aureus MW2
aucaguuucaucaaguauaaa

SEQ ID NO: 4001256 - RNA, 14 nt, Staphylococcus aureus subsp. aureus MW2
aucaguuuuugaau

SEQ ID NO: 4001257 - RNA, 17 nt, Staphylococcus aureus subsp. aureus MW2
aucaguuuuugaauauu

SEQ ID NO: 4001258 - RNA, 19 nt, Staphylococcus aureus subsp. aureus MW2
aucaguuuuugaauauuug

SEQ ID NO: 4001259 - RNA, 13 nt, Staphylococcus aureus subsp. aureus MW2
aucauaaaguaaa

SEQ ID NO: 4001260 - RNA, 13 nt, Staphylococcus aureus subsp. aureus MW2
aucauaaauauaa

SEQ ID NO: 4001261 - RNA, 12 nt, Staphylococcus aureus subsp. aureus MW2
aucauaaauauu

SEQ ID NO: 4001262 - RNA, 13 nt, Staphylococcus aureus subsp. aureus MW2
aucauaaaugacg

SEQ ID NO: 4001263 - RNA, 15 nt, Staphylococcus aureus subsp. aureus MW2
aucauaacuuaacuc

SEQ ID NO: 4001264 - RNA, 19 nt, Staphylococcus aureus subsp. aureus MW2
aucauaauaagauuuuuua

SEQ ID NO: 4001265 - RNA, 23 nt, Staphylococcus aureus subsp. aureus MW2
aucauaauagccgcuucauugau

SEQ ID NO: 4001266 - RNA, 13 nt, Staphylococcus aureus subsp. aureus MW2
aucauaauauuga

SEQ ID NO: 4001267 - RNA, 21 nt, Staphylococcus aureus subsp. aureus MW2
aucauaaucaagaauauaaau

SEQ ID NO: 4001268 - RNA, 16 nt, Staphylococcus aureus subsp. aureus MW2
aucauaaucuacugcu

SEQ ID NO: 4001269 - RNA, 19 nt, Staphylococcus aureus subsp. aureus MW2
aucauaauucccuguuaug

SEQ ID NO: 4001270 - RNA, 17 nt, Staphylococcus aureus subsp. aureus MW2
aucauacauauuuauau

SEQ ID NO: 4001271 - RNA, 14 nt, Staphylococcus aureus subsp. aureus MW2
aucauacauuagaa

SEQ ID NO: 4001272 - RNA, 19 nt, Staphylococcus aureus subsp. aureus MW2
aucauaccagcaaguguau

SEQ ID NO: 4001273 - RNA, 14 nt, Staphylococcus aureus subsp. aureus MW2
aucccggaauauua

SEQ ID NO: 4001274 - RNA, 16 nt, Staphylococcus aureus subsp. aureus MW2
aucccuguaaaaccau

SEQ ID NO: 4001275 - RNA, 15 nt, Staphylococcus aureus subsp. aureus MW2
auccgaaaauugcua

SEQ ID NO: 4001276 - RNA, 19 nt, Staphylococcus aureus subsp. aureus MW2
auccgaaaauugcuaaaaa

SEQ ID NO: 4001277 - RNA, 22 nt, Staphylococcus aureus subsp. aureus MW2
auccgauuuugauauaaaaagu

SEQ ID NO: 4001278 - RNA, 17 nt, Staphylococcus aureus subsp. aureus MW2
auccgccaauuaaaauu

SEQ ID NO: 4001279 - RNA, 18 nt, Staphylococcus aureus subsp. aureus MW2
auccuaaaaagcucaauc

SEQ ID NO: 4001280 - RNA, 20 nt, Staphylococcus aureus subsp. aureus MW2
auccuaaaaagcucaauccu

SEQ ID NO: 4001281 - RNA, 17 nt, Staphylococcus aureus subsp. aureus MW2
auccuaugccaaauaac

SEQ ID NO: 4001282 - RNA, 21 nt, Staphylococcus aureus subsp. aureus MW2
auccuauggcgcaauuuuuaa

SEQ ID NO: 4001283 - RNA, 24 nt, Staphylococcus aureus subsp. aureus MW2
auccucacaaauuugaauauacuu

SEQ ID NO: 4001284 - RNA, 23 nt, Staphylococcus aureus subsp. aureus MW2
auccucaguauuuaauguuuuag

SEQ ID NO: 4001285 - RNA, 16 nt, Staphylococcus aureus subsp. aureus MW2
auccugaagagaaaau

SEQ ID NO: 4001286 - RNA, 15 nt, Staphylococcus aureus subsp. aureus MW2
auccugccaauauau

SEQ ID NO: 4001287 - RNA, 19 nt, Staphylococcus aureus subsp. aureus MW2
auccugccaauauauucac

SEQ ID NO: 4001288 - RNA, 20 nt, Staphylococcus aureus subsp. aureus MW2
auccugccauuaaacgaaug

SEQ ID NO: 4001289 - RNA, 19 nt, Staphylococcus aureus subsp. aureus MW2
auccugcuuauuaauuguu

SEQ ID NO: 4001290 - RNA, 18 nt, Staphylococcus aureus subsp. aureus MW2
auccugugacucaaugau

SEQ ID NO: 4001291 - RNA, 21 nt, Staphylococcus aureus subsp. aureus MW2
auccuguguaaaauaaaucau

SEQ ID NO: 4001292 - RNA, 11 nt, Staphylococcus aureus subsp. aureus MW2
auccuuaaaug

SEQ ID NO: 4001293 - RNA, 20 nt, Staphylococcus aureus subsp. aureus MW2
auccuucaaagauuuuaccu

SEQ ID NO: 4001294 - RNA, 15 nt, Staphylococcus aureus subsp. aureus MW2
auccuuuaaaucauu

SEQ ID NO: 4001295 - RNA, 22 nt, Staphylococcus aureus subsp. aureus MW2
auccuuuauaaauaaacauaaa

SEQ ID NO: 4001296 - RNA, 14 nt, Staphylococcus aureus subsp. aureus MW2
auccuuuuugacuc

SEQ ID NO: 4001297 - RNA, 14 nt, Staphylococcus aureus subsp. aureus MW2
aucgaacuagacaa

SEQ ID NO: 4001298 - RNA, 19 nt, Staphylococcus aureus subsp. aureus MW2
aucgaagauguuaaacugu

SEQ ID NO: 4001299 - RNA, 20 nt, Staphylococcus aureus subsp. aureus MW2
aucgaauaacuguuuaucau

SEQ ID NO: 4001300 - RNA, 23 nt, Staphylococcus aureus subsp. aureus MW2
aucgaauuagaucuaugguuaug

SEQ ID NO: 4001301 - RNA, 18 nt, Staphylococcus aureus subsp. aureus MW2
aucgaauugguaaaaauc

SEQ ID NO: 4001302 - RNA, 22 nt, Staphylococcus aureus subsp. aureus MW2
aucgacacuuccaucaauccaa

SEQ ID NO: 4001303 - RNA, 21 nt, Staphylococcus aureus subsp. aureus MW2
aucgacuuuuacaaucaucac

SEQ ID NO: 4001304 - RNA, 21 nt, Staphylococcus aureus subsp. aureus MW2
aucgagagauuaugcuugcca

SEQ ID NO: 4001305 - RNA, 21 nt, Staphylococcus aureus subsp. aureus MW2
aucgagaggguacacuucaac

SEQ ID NO: 4001306 - RNA, 20 nt, Staphylococcus aureus subsp. aureus MW2
aucgaguuugaaauaaucua

SEQ ID NO: 4001307 - RNA, 21 nt, Staphylococcus aureus subsp. aureus MW2
aucgauaaauguauuaaacau

SEQ ID NO: 4001308 - RNA, 16 nt, Staphylococcus aureus subsp. aureus MW2
aucgauacuaauaucu

SEQ ID NO: 4001309 - RNA, 18 nt, Staphylococcus aureus subsp. aureus MW2
aucgauauagcauaaaau

SEQ ID NO: 4001310 - RNA, 19 nt, Staphylococcus aureus subsp. aureus MW2
aucgauauugagaauauua

SEQ ID NO: 4001311 - RNA, 19 nt, Staphylococcus aureus subsp. aureus MW2
aucgaugacuuugucuuua

SEQ ID NO: 4001312 - RNA, 20 nt, Staphylococcus aureus subsp. aureus MW2
aucgauuaagaaugcaccaa

SEQ ID NO: 4001313 - RNA, 22 nt, Staphylococcus aureus subsp. aureus MW2
aucgauuuuaucgaaauauuua

SEQ ID NO: 4001314 - RNA, 16 nt, Staphylococcus aureus subsp. aureus MW2
aucgcacgauauggug

SEQ ID NO: 4001315 - RNA, 22 nt, Staphylococcus aureus subsp. aureus MW2
aucgcaucuguuaacugaauuu

SEQ ID NO: 4001316 - RNA, 15 nt, Staphylococcus aureus subsp. aureus MW2
aucgcauuuaaauau

SEQ ID NO: 4001317 - RNA, 23 nt, Staphylococcus aureus subsp. aureus MW2
aucgcauuuuguuucaacauuuc

SEQ ID NO: 4001318 - RNA, 13 nt, Staphylococcus aureus subsp. aureus MW2
aucgcccauacca

SEQ ID NO: 4001319 - RNA, 13 nt, Staphylococcus aureus subsp. aureus MW2
aucgccuaaaaau

SEQ ID NO: 4001320 - RNA, 16 nt, Staphylococcus aureus subsp. aureus MW2
aucgccuaaaaauaaa

SEQ ID NO: 4001321 - RNA, 13 nt, Staphylococcus aureus subsp. aureus MW2
aucgcuaauacuu

SEQ ID NO: 4001322 - RNA, 15 nt, Staphylococcus aureus subsp. aureus MW2
aucggaauaaaauaa

SEQ ID NO: 4001323 - RNA, 17 nt, Staphylococcus aureus subsp. aureus MW2
aucggaauaaaauaaau

SEQ ID NO: 4001324 - RNA, 16 nt, Staphylococcus aureus subsp. aureus MW2
aucgggaucuaauuuu

SEQ ID NO: 4001325 - RNA, 15 nt, Staphylococcus aureus subsp. aureus MW2
aucgguaauuacuug

SEQ ID NO: 4001326 - RNA, 17 nt, Staphylococcus aureus subsp. aureus MW2
aucgguaucgaauguuu

SEQ ID NO: 4001327 - RNA, 22 nt, Staphylococcus aureus subsp. aureus MW2
aucguagcaccagcacaucaaa

SEQ ID NO: 4001328 - RNA, 16 nt, Staphylococcus aureus subsp. aureus MW2
aucguauucuuuuaau

SEQ ID NO: 4001329 - RNA, 14 nt, Staphylococcus aureus subsp. aureus MW2
aucguauugaaaau

SEQ ID NO: 4001330 - RNA, 22 nt, Staphylococcus aureus subsp. aureus MW2
aucguauugaaaaugagcugaa

SEQ ID NO: 4001331 - RNA, 23 nt, Staphylococcus aureus subsp. aureus MW2
aucgucgcuaaagaccuuucuug

SEQ ID NO: 4001332 - RNA, 17 nt, Staphylococcus aureus subsp. aureus MW2
aucgugcccauaugauu

SEQ ID NO: 4001333 - RNA, 20 nt, Staphylococcus aureus subsp. aureus MW2
aucguuaauuggauuuuuac

SEQ ID NO: 4001334 - RNA, 14 nt, Staphylococcus aureus subsp. aureus MW2
aucguugaaaaaua

SEQ ID NO: 4001335 - RNA, 12 nt, Staphylococcus aureus subsp. aureus MW2
aucguuucuucc

SEQ ID NO: 4001336 - RNA, 18 nt, Staphylococcus aureus subsp. aureus MW2
aucguuuucaacauaaua

SEQ ID NO: 4001337 - RNA, 22 nt, Staphylococcus aureus subsp. aureus MW2
aucguuuucaacauaauauuuc

SEQ ID NO: 4001338 - RNA, 15 nt, Staphylococcus aureus subsp. aureus MW2
aucuaaaaauccauu

SEQ ID NO: 4001339 - RNA, 17 nt, Staphylococcus aureus subsp. aureus MW2
aucuaaacuauaauaau

SEQ ID NO: 4001340 - RNA, 13 nt, Staphylococcus aureus subsp. aureus MW2
aucuaaaguacuc

SEQ ID NO: 4001341 - RNA, 19 nt, Staphylococcus aureus subsp. aureus MW2
aucuaaaguacucaaguaa

SEQ ID NO: 4001342 - RNA, 13 nt, Staphylococcus aureus subsp. aureus MW2
aucuaaaugauca

SEQ ID NO: 4001343 - RNA, 14 nt, Staphylococcus aureus subsp. aureus MW2
aucuaaauguaaaa

SEQ ID NO: 4001344 - RNA, 14 nt, Staphylococcus aureus subsp. aureus MW2
aucuaaaugugaaa

SEQ ID NO: 4001345 - RNA, 22 nt, Staphylococcus aureus subsp. aureus MW2
aucuaacaaucguuuuaaugcc

SEQ ID NO: 4001346 - RNA, 13 nt, Staphylococcus aureus subsp. aureus MW2
aucuaacaucauu

SEQ ID NO: 4001347 - RNA, 13 nt, Staphylococcus aureus subsp. aureus MW2
aucuaacuggaaa

SEQ ID NO: 4001348 - RNA, 18 nt, Staphylococcus aureus subsp. aureus MW2
aucuaacuggaaaugaua

SEQ ID NO: 4001349 - RNA, 17 nt, Staphylococcus aureus subsp. aureus MW2
aucuaaucuuaauuguc

SEQ ID NO: 4001350 - RNA, 14 nt, Staphylococcus aureus subsp. aureus MW2
aucuaauucaaugu

SEQ ID NO: 4001351 - RNA, 14 nt, Staphylococcus aureus subsp. aureus MW2
aucuaauucguaau

SEQ ID NO: 4001352 - RNA, 22 nt, Staphylococcus aureus subsp. aureus MW2
aucuaauucuguuucaaagcug

SEQ ID NO: 4001353 - RNA, 19 nt, Staphylococcus aureus subsp. aureus MW2
aucuacaauauuaaaauua

SEQ ID NO: 4001354 - RNA, 18 nt, Staphylococcus aureus subsp. aureus MW2
aucuacagagaaucaauu

SEQ ID NO: 4001355 - RNA, 15 nt, Staphylococcus aureus subsp. aureus MW2
aucuacuaaaucaaa

SEQ ID NO: 4001356 - RNA, 17 nt, Staphylococcus aureus subsp. aureus MW2
aucuacuaaaucaaauu

SEQ ID NO: 4001357 - RNA, 21 nt, Staphylococcus aureus subsp. aureus MW2
aucuacuuaaaauaaguauuu

SEQ ID NO: 4001358 - RNA, 22 nt, Staphylococcus aureus subsp. aureus MW2
aucuacuuaaaauaaguauuuu

SEQ ID NO: 4001359 - RNA, 23 nt, Staphylococcus aureus subsp. aureus MW2
aucuacuuccuuacagacaaaca

SEQ ID NO: 4001360 - RNA, 21 nt, Staphylococcus aureus subsp. aureus MW2
aucuacuuuguucugcuuuuu

SEQ ID NO: 4001361 - RNA, 18 nt, Staphylococcus aureus subsp. aureus MW2
aucuugaacaauucuuca

SEQ ID NO: 4001362 - RNA, 22 nt, Staphylococcus aureus subsp. aureus MW2
aucuugaacaauucuucaucau

SEQ ID NO: 4001363 - RNA, 12 nt, Staphylococcus aureus subsp. aureus MW2
aucuugacacaa

SEQ ID NO: 4001364 - RNA, 19 nt, Staphylococcus aureus subsp. aureus MW2
aucuugacacaaugauuca

SEQ ID NO: 4001365 - RNA, 20 nt, Staphylococcus aureus subsp. aureus MW2
aucuugcuuauugauauaag

SEQ ID NO: 4001366 - RNA, 21 nt, Staphylococcus aureus subsp. aureus MW2
aucuugcuuggauaauugcau

SEQ ID NO: 4001367 - RNA, 15 nt, Staphylococcus aureus subsp. aureus MW2
aucuugguucagcuu

SEQ ID NO: 4001368 - RNA, 21 nt, Staphylococcus aureus subsp. aureus MW2
aucuugucuaguucgauuuuu

SEQ ID NO: 4001369 - RNA, 23 nt, Staphylococcus aureus subsp. aureus MW2
aucuugucuaguucgauuuuuua

SEQ ID NO: 4001370 - RNA, 14 nt, Staphylococcus aureus subsp. aureus MW2
aucuuguucuucuu

SEQ ID NO: 4001371 - RNA, 19 nt, Staphylococcus aureus subsp. aureus MW2
aucuuguuuucauuuaaaa

SEQ ID NO: 4001372 - RNA, 18 nt, Staphylococcus aureus subsp. aureus MW2
aucuuuaaauauacuucu

SEQ ID NO: 4001373 - RNA, 14 nt, Staphylococcus aureus subsp. aureus MW2
aucuuuaaucaaag

SEQ ID NO: 4001374 - RNA, 21 nt, Staphylococcus aureus subsp. aureus MW2
aucuuuaauuuucuugccauc

SEQ ID NO: 4001375 - RNA, 16 nt, Staphylococcus aureus subsp. aureus MW2
aucuuuacaacaguaa

SEQ ID NO: 4001376 - RNA, 23 nt, Staphylococcus aureus subsp. aureus MW2
aucuuuacaacaguaaucaugca

SEQ ID NO: 4001377 - RNA, 15 nt, Staphylococcus aureus subsp. aureus MW2
aucuuuagacauaaa

SEQ ID NO: 4001378 - RNA, 22 nt, Staphylococcus aureus subsp. aureus MW2
aucuuuagagacuuauuuuaua

SEQ ID NO: 4001379 - RNA, 13 nt, Staphylococcus aureus subsp. aureus MW2
aucuuuaguauuu

SEQ ID NO: 4001380 - RNA, 19 nt, Staphylococcus aureus subsp. aureus MW2
aucuuuaguauuucaucau

SEQ ID NO: 4001381 - RNA, 19 nt, Staphylococcus aureus subsp. aureus MW2
aucuuuaucaguuuguccu

SEQ ID NO: 4001382 - RNA, 14 nt, Staphylococcus aureus subsp. aureus MW2
aucuuuauuuuuua

SEQ ID NO: 4001383 - RNA, 15 nt, Staphylococcus aureus subsp. aureus MW2
aucuuuauuuuuuau

SEQ ID NO: 4001384 - RNA, 18 nt, Staphylococcus aureus subsp. aureus MW2
aucuuuccacggcauuua

SEQ ID NO: 4001385 - RNA, 16 nt, Staphylococcus aureus subsp. aureus MW2
aucuuugauuaugaac

SEQ ID NO: 4001386 - RNA, 17 nt, Staphylococcus aureus subsp. aureus MW2
aucuuuguaaauuuuua

SEQ ID NO: 4001387 - RNA, 22 nt, Staphylococcus aureus subsp. aureus MW2
aucuuuguaaccuaaaaacaaa

SEQ ID NO: 4001388 - RNA, 23 nt, Staphylococcus aureus subsp. aureus MW2
aucuuuguaugcaucaguuaaua

SEQ ID NO: 4001389 - RNA, 14 nt, Staphylococcus aureus subsp. aureus MW2
aucuuuuaauucuu

SEQ ID NO: 4001390 - RNA, 11 nt, Staphylococcus aureus subsp. aureus MW2
aucuuuuacua

SEQ ID NO: 4001391 - RNA, 23 nt, Staphylococcus aureus subsp. aureus MW2
aucuuuuacuaaaugaauugcuu

SEQ ID NO: 4001392 - RNA, 16 nt, Staphylococcus aureus subsp. aureus MW2
aucuuuuauaaugaac

SEQ ID NO: 4001393 - RNA, 17 nt, Staphylococcus aureus subsp. aureus MW2
aucuuuugcaccuucaa

SEQ ID NO: 4001394 - RNA, 19 nt, Staphylococcus aureus subsp. aureus MW2
aucuuuugcuguaucuuca

SEQ ID NO: 4001395 - RNA, 13 nt, Staphylococcus aureus subsp. aureus MW2
aucuuuugcuucg

SEQ ID NO: 4001396 - RNA, 21 nt, Staphylococcus aureus subsp. aureus MW2
aucuuuugguuuaucuguugu

SEQ ID NO: 4001397 - RNA, 13 nt, Staphylococcus aureus subsp. aureus MW2
aucuuuuguuguu

SEQ ID NO: 4001398 - RNA, 14 nt, Staphylococcus aureus subsp. aureus MW2
aucuuuuuaaaagg

SEQ ID NO: 4001399 - RNA, 20 nt, Staphylococcus aureus subsp. aureus MW2
aucuuuuucaaaaauuguua

SEQ ID NO: 4001400 - RNA, 22 nt, Staphylococcus aureus subsp. aureus MW2
aucuuuuucaaugugauuuucu

SEQ ID NO: 4001401 - RNA, 13 nt, Staphylococcus aureus subsp. aureus MW2
aucuuuuugaaau

SEQ ID NO: 4001402 - RNA, 14 nt, Staphylococcus aureus subsp. aureus MW2
aucuuuuugaaauu

SEQ ID NO: 4001403 - RNA, 15 nt, Staphylococcus aureus subsp. aureus MW2
aucuuuuugaaauuu

SEQ ID NO: 4001404 - RNA, 18 nt, Staphylococcus aureus subsp. aureus MW2
aucuuuuuguuuaucgau

SEQ ID NO: 4001405 - RNA, 16 nt, Staphylococcus aureus subsp. aureus MW2
aucuuuuuuacuaaaa

SEQ ID NO: 4001406 - RNA, 13 nt, Staphylococcus aureus subsp. aureus MW2
aucuuuuuuaugu

SEQ ID NO: 4001407 - RNA, 22 nt, Staphylococcus aureus subsp. aureus MW2
augaaaaagaguuaauaaaauu

SEQ ID NO: 4001408 - RNA, 10 nt, Staphylococcus aureus subsp. aureus MW2
augaaaagaa

SEQ ID NO: 4001409 - RNA, 23 nt, Staphylococcus aureus subsp. aureus MW2
augaaaagagauuuuuuugaaaa

SEQ ID NO: 4001410 - RNA, 11 nt, Staphylococcus aureus subsp. aureus MW2
augaaaaguga

SEQ ID NO: 4001411 - RNA, 13 nt, Staphylococcus aureus subsp. aureus MW2
augaaaagugaau

SEQ ID NO: 4001412 - RNA, 14 nt, Staphylococcus aureus subsp. aureus MW2
augaaaauuaaaaa

SEQ ID NO: 4001413 - RNA, 15 nt, Staphylococcus aureus subsp. aureus MW2
augaaaccguauuau

SEQ ID NO: 4001414 - RNA, 23 nt, Staphylococcus aureus subsp. aureus MW2
augaaacuggauaaauaaagauu

SEQ ID NO: 4001415 - RNA, 22 nt, Staphylococcus aureus subsp. aureus MW2
augaaagcaccuaaaauagaaa

SEQ ID NO: 4001416 - RNA, 16 nt, Staphylococcus aureus subsp. aureus MW2
augaaagcaucuugca

SEQ ID NO: 4001417 - RNA, 16 nt, Staphylococcus aureus subsp. aureus MW2
augaaauuagauuuua

SEQ ID NO: 4001418 - RNA, 14 nt, Staphylococcus aureus subsp. aureus MW2
augaaauucuuuug

SEQ ID NO: 4001419 - RNA, 22 nt, Staphylococcus aureus subsp. aureus MW2
augaaauuggaauagauguuga

SEQ ID NO: 4001420 - RNA, 16 nt, Staphylococcus aureus subsp. aureus MW2
augaaauuguguugaa

SEQ ID NO: 4001421 - RNA, 21 nt, Staphylococcus aureus subsp. aureus MW2
augaaauuguguugaaucaac

SEQ ID NO: 4001422 - RNA, 14 nt, Staphylococcus aureus subsp. aureus MW2
augaacaaaauaac

SEQ ID NO: 4001423 - RNA, 14 nt, Staphylococcus aureus subsp. aureus MW2
augaacauaccugc

SEQ ID NO: 4001424 - RNA, 23 nt, Staphylococcus aureus subsp. aureus MW2
augaacgaaucuauaacgauaga

SEQ ID NO: 4001425 - RNA, 14 nt, Staphylococcus aureus subsp. aureus MW2
augaacucacaaca

SEQ ID NO: 4001426 - RNA, 15 nt, Staphylococcus aureus subsp. aureus MW2
augaacuuaaugcuu

SEQ ID NO: 4001427 - RNA, 20 nt, Staphylococcus aureus subsp. aureus MW2
augaacuuaaugcuucaaau

SEQ ID NO: 4001428 - RNA, 22 nt, Staphylococcus aureus subsp. aureus MW2
augaacuucuacaguuggaggu

SEQ ID NO: 4001429 - RNA, 21 nt, Staphylococcus aureus subsp. aureus MW2
augaagcaguuguugguuuug

SEQ ID NO: 4001430 - RNA, 16 nt, Staphylococcus aureus subsp. aureus MW2
augaagggaaaaaaug

SEQ ID NO: 4001431 - RNA, 22 nt, Staphylococcus aureus subsp. aureus MW2
augaaguaauauauaaaagucg

SEQ ID NO: 4001432 - RNA, 21 nt, Staphylococcus aureus subsp. aureus MW2
augaaguggauagcugcauaa

SEQ ID NO: 4001433 - RNA, 18 nt, Staphylococcus aureus subsp. aureus MW2
augaagugggauaugaau

SEQ ID NO: 4001434 - RNA, 16 nt, Staphylococcus aureus subsp. aureus MW2
augaaguugguuuaga

SEQ ID NO: 4001435 - RNA, 21 nt, Staphylococcus aureus subsp. aureus MW2
augaauaaauuguaauauauu

SEQ ID NO: 4001436 - RNA, 12 nt, Staphylococcus aureus subsp. aureus MW2
augaauauauug

SEQ ID NO: 4001437 - RNA, 20 nt, Staphylococcus aureus subsp. aureus MW2
augaaucaaaucaauaucau

SEQ ID NO: 4001438 - RNA, 17 nt, Staphylococcus aureus subsp. aureus MW2
augaaucaacaauauaa

SEQ ID NO: 4001439 - RNA, 14 nt, Staphylococcus aureus subsp. aureus MW2
augaaucagaugau

SEQ ID NO: 4001440 - RNA, 15 nt, Staphylococcus aureus subsp. aureus MW2
augaauccaaauauu

SEQ ID NO: 4001441 - RNA, 22 nt, Staphylococcus aureus subsp. aureus MW2
augaauccugugacucaaugau

SEQ ID NO: 4001442 - RNA, 19 nt, Staphylococcus aureus subsp. aureus MW2
augaauggcauuuaauacu

SEQ ID NO: 4001443 - RNA, 20 nt, Staphylococcus aureus subsp. aureus MW2
augaauggcauuuaauacua

SEQ ID NO: 4001444 - RNA, 22 nt, Staphylococcus aureus subsp. aureus MW2
augaauguuaagacauaugcag

SEQ ID NO: 4001445 - RNA, 14 nt, Staphylococcus aureus subsp. aureus MW2
augaauuaauagcu

SEQ ID NO: 4001446 - RNA, 15 nt, Staphylococcus aureus subsp. aureus MW2
augaauuauuuaaaa

SEQ ID NO: 4001447 - RNA, 19 nt, Staphylococcus aureus subsp. aureus MW2
augaauuauuuaaaaugcu

SEQ ID NO: 4001448 - RNA, 18 nt, Staphylococcus aureus subsp. aureus MW2
augaauuguuguacaugu

SEQ ID NO: 4001449 - RNA, 20 nt, Staphylococcus aureus subsp. aureus MW2
augauuugauauuucaaaua

SEQ ID NO: 4001450 - RNA, 23 nt, Staphylococcus aureus subsp. aureus MW2
augauuugauuuggguaauguuu

SEQ ID NO: 4001451 - RNA, 13 nt, Staphylococcus aureus subsp. aureus MW2
augauuuugcuuu

SEQ ID NO: 4001452 - RNA, 22 nt, Staphylococcus aureus subsp. aureus MW2
augauuuuuauuauugucauca

SEQ ID NO: 4001453 - RNA, 20 nt, Staphylococcus aureus subsp. aureus MW2
augauuuuucaucaauauca

SEQ ID NO: 4001454 - RNA, 21 nt, Staphylococcus aureus subsp. aureus MW2
augcaaaucaaauacaucaau

SEQ ID NO: 4001455 - RNA, 17 nt, Staphylococcus aureus subsp. aureus MW2
augcaaccuaaaauauu

SEQ ID NO: 4001456 - RNA, 17 nt, Staphylococcus aureus subsp. aureus MW2
augcaacuaaaacuauc

SEQ ID NO: 4001457 - RNA, 19 nt, Staphylococcus aureus subsp. aureus MW2
augcaagcgacgauuggaa

SEQ ID NO: 4001458 - RNA, 20 nt, Staphylococcus aureus subsp. aureus MW2
augcaaguuggcggggcccc

SEQ ID NO: 4001459 - RNA, 22 nt, Staphylococcus aureus subsp. aureus MW2
augcaaguuggggaugggcccc

SEQ ID NO: 4001460 - RNA, 12 nt, Staphylococcus aureus subsp. aureus MW2
augcaauacauu

SEQ ID NO: 4001461 - RNA, 19 nt, Staphylococcus aureus subsp. aureus MW2
augcaauacauuaauauaa

SEQ ID NO: 4001462 - RNA, 20 nt, Staphylococcus aureus subsp. aureus MW2
augcacaucauugauagaua

SEQ ID NO: 4001463 - RNA, 21 nt, Staphylococcus aureus subsp. aureus MW2
augcaccuuuacaacauacau

SEQ ID NO: 4001464 - RNA, 17 nt, Staphylococcus aureus subsp. aureus MW2
augcacgaaugguucuu

SEQ ID NO: 4001465 - RNA, 21 nt, Staphylococcus aureus subsp. aureus MW2
augcacgcgugccaacaucuu

SEQ ID NO: 4001466 - RNA, 14 nt, Staphylococcus aureus subsp. aureus MW2
augcacuguauagc

SEQ ID NO: 4001467 - RNA, 14 nt, Staphylococcus aureus subsp. aureus MW2
augcacuuuauuaa

SEQ ID NO: 4001468 - RNA, 14 nt, Staphylococcus aureus subsp. aureus MW2
augcacuuuuuaua

SEQ ID NO: 4001469 - RNA, 20 nt, Staphylococcus aureus subsp. aureus MW2
augcaguaaaaccaaaucgu

SEQ ID NO: 4001470 - RNA, 18 nt, Staphylococcus aureus subsp. aureus MW2
augcaguuuuaauuaaac

SEQ ID NO: 4001471 - RNA, 13 nt, Staphylococcus aureus subsp. aureus MW2
augcauaaaaaaa

SEQ ID NO: 4001472 - RNA, 18 nt, Staphylococcus aureus subsp. aureus MW2
augcauaaaaaaagaacu

SEQ ID NO: 4001473 - RNA, 20 nt, Staphylococcus aureus subsp. aureus MW2
augcauaaaaccuucaauca

SEQ ID NO: 4001474 - RNA, 14 nt, Staphylococcus aureus subsp. aureus MW2
augcauaauaccaa

SEQ ID NO: 4001475 - RNA, 20 nt, Staphylococcus aureus subsp. aureus MW2
augcauaauaccaauugcuu

SEQ ID NO: 4001476 - RNA, 15 nt, Staphylococcus aureus subsp. aureus MW2
augcauaauauauua

SEQ ID NO: 4001477 - RNA, 20 nt, Staphylococcus aureus subsp. aureus MW2
augcauaauauauuaaaaau

SEQ ID NO: 4001478 - RNA, 21 nt, Staphylococcus aureus subsp. aureus MW2
augcauaauuaggauuaacau

SEQ ID NO: 4001479 - RNA, 13 nt, Staphylococcus aureus subsp. aureus MW2
augcauauaagau

SEQ ID NO: 4001480 - RNA, 16 nt, Staphylococcus aureus subsp. aureus MW2
augcauauucaucaua

SEQ ID NO: 4001481 - RNA, 17 nt, Staphylococcus aureus subsp. aureus MW2
augcaucaacuauuuac

SEQ ID NO: 4001482 - RNA, 12 nt, Staphylococcus aureus subsp. aureus MW2
augcaucuauga

SEQ ID NO: 4001483 - RNA, 21 nt, Staphylococcus aureus subsp. aureus MW2
augcaugccagaugcaaugau

SEQ ID NO: 4001484 - RNA, 16 nt, Staphylococcus aureus subsp. aureus MW2
augccaaaaacauuaa

SEQ ID NO: 4001485 - RNA, 12 nt, Staphylococcus aureus subsp. aureus MW2
augccaaauaac

SEQ ID NO: 4001486 - RNA, 14 nt, Staphylococcus aureus subsp. aureus MW2
augccaacacguuu

SEQ ID NO: 4001487 - RNA, 16 nt, Staphylococcus aureus subsp. aureus MW2
augccauucauuaagc

SEQ ID NO: 4001488 - RNA, 17 nt, Staphylococcus aureus subsp. aureus MW2
augccauuguuauccaa

SEQ ID NO: 4001489 - RNA, 23 nt, Staphylococcus aureus subsp. aureus MW2
augcccgauaaaaccaccuacca

SEQ ID NO: 4001490 - RNA, 20 nt, Staphylococcus aureus subsp. aureus MW2
augcccuagguuuauauauc

SEQ ID NO: 4001491 - RNA, 14 nt, Staphylococcus aureus subsp. aureus MW2
augccgagauuauu

SEQ ID NO: 4001492 - RNA, 17 nt, Staphylococcus aureus subsp. aureus MW2
augccgccuaauaauaa

SEQ ID NO: 4001493 - RNA, 22 nt, Staphylococcus aureus subsp. aureus MW2
augccggucaaagcgaauagaa

SEQ ID NO: 4001494 - RNA, 18 nt, Staphylococcus aureus subsp. aureus MW2
augccucaguuagaagau

SEQ ID NO: 4001495 - RNA, 21 nt, Staphylococcus aureus subsp. aureus MW2
augccuuuaaagcacauguau

SEQ ID NO: 4001496 - RNA, 15 nt, Staphylococcus aureus subsp. aureus MW2
augcgauugaugcgu

SEQ ID NO: 4001497 - RNA, 15 nt, Staphylococcus aureus subsp. aureus MW2
augcgcaaugaaaac

SEQ ID NO: 4001498 - RNA, 20 nt, Staphylococcus aureus subsp. aureus MW2
augcgucguagauugauucu

SEQ ID NO: 4001499 - RNA, 14 nt, Staphylococcus aureus subsp. aureus MW2
augcuacaucaaua

SEQ ID NO: 4001500 - RNA, 16 nt, Staphylococcus aureus subsp. aureus MW2
augcuacaucaauauu

SEQ ID NO: 4001501 - RNA, 23 nt, Staphylococcus aureus subsp. aureus MW2
augcuagaaaguaaugcuuuacu

SEQ ID NO: 4001502 - RNA, 19 nt, Staphylococcus aureus subsp. aureus MW2
augcuauauccaguuaauu

SEQ ID NO: 4001503 - RNA, 14 nt, Staphylococcus aureus subsp. aureus MW2
augcucaaugcauu

SEQ ID NO: 4001504 - RNA, 20 nt, Staphylococcus aureus subsp. aureus MW2
augcucacuuuuuaaaguaa

SEQ ID NO: 4001505 - RNA, 20 nt, Staphylococcus aureus subsp. aureus MW2
augcucuauauauccauuca

SEQ ID NO: 4001506 - RNA, 18 nt, Staphylococcus aureus subsp. aureus MW2
augcuuaaaaacaauauu

SEQ ID NO: 4001507 - RNA, 14 nt, Staphylococcus aureus subsp. aureus MW2
augcuucauaugga

SEQ ID NO: 4001508 - RNA, 21 nt, Staphylococcus aureus subsp. aureus MW2
augcuugccacugcaauggcu

SEQ ID NO: 4001509 - RNA, 17 nt, Staphylococcus aureus subsp. aureus MW2
augcuuguacaaaaaau

SEQ ID NO: 4001510 - RNA, 14 nt, Staphylococcus aureus subsp. aureus MW2
augcuuuaaauauu

SEQ ID NO: 4001511 - RNA, 17 nt, Staphylococcus aureus subsp. aureus MW2
augcuuuaauuaaaguu

SEQ ID NO: 4001512 - RNA, 22 nt, Staphylococcus aureus subsp. aureus MW2
augcuuuacuauauucaaugau

SEQ ID NO: 4001513 - RNA, 21 nt, Staphylococcus aureus subsp. aureus MW2
augcuuuaugugcagcuugau

SEQ ID NO: 4001514 - RNA, 22 nt, Staphylococcus aureus subsp. aureus MW2
augcuuuuuagcauauucugca

SEQ ID NO: 4001515 - RNA, 20 nt, Staphylococcus aureus subsp. aureus MW2
augcuuuuuuuacaauauga

SEQ ID NO: 4001516 - RNA, 23 nt, Staphylococcus aureus subsp. aureus MW2
augcuuuuuuuacaauaugauua

SEQ ID NO: 4001517 - RNA, 16 nt, Staphylococcus aureus subsp. aureus MW2
auggaaaaguuuuuua

SEQ ID NO: 4001518 - RNA, 22 nt, Staphylococcus aureus subsp. aureus MW2
auggaaaauauauuauaaaaau

SEQ ID NO: 4001519 - RNA, 17 nt, Staphylococcus aureus subsp. aureus MW2
auggaaaggcguuuuuu

SEQ ID NO: 4001520 - RNA, 21 nt, Staphylococcus aureus subsp. aureus MW2
auggaacgccgaauaauccag

SEQ ID NO: 4001521 - RNA, 23 nt, Staphylococcus aureus subsp. aureus MW2
auggaaguauauguuacucuuag

SEQ ID NO: 4001522 - RNA, 21 nt, Staphylococcus aureus subsp. aureus MW2
auggacguaacuguuuuaaau

SEQ ID NO: 4001523 - RNA, 13 nt, Staphylococcus aureus subsp. aureus MW2
auggagcaugauu

SEQ ID NO: 4001524 - RNA, 16 nt, Staphylococcus aureus subsp. aureus MW2
auggauacuuaaagau

SEQ ID NO: 4001525 - RNA, 17 nt, Staphylococcus aureus subsp. aureus MW2
auggauaugauaaccaa

SEQ ID NO: 4001526 - RNA, 15 nt, Staphylococcus aureus subsp. aureus MW2
auggauuuauugggu

SEQ ID NO: 4001527 - RNA, 17 nt, Staphylococcus aureus subsp. aureus MW2
auggcaaucuauauaaa

SEQ ID NO: 4001528 - RNA, 19 nt, Staphylococcus aureus subsp. aureus MW2
auggcaucuggcaaauugc

SEQ ID NO: 4001529 - RNA, 20 nt, Staphylococcus aureus subsp. aureus MW2
auggcaucuggcaaauugcc

SEQ ID NO: 4001530 - RNA, 14 nt, Staphylococcus aureus subsp. aureus MW2
auggcauuauugcc

SEQ ID NO: 4001531 - RNA, 14 nt, Staphylococcus aureus subsp. aureus MW2
auggcugcaacaau

SEQ ID NO: 4001532 - RNA, 21 nt, Staphylococcus aureus subsp. aureus MW2
auggcugcaacaauuugcaua

SEQ ID NO: 4001533 - RNA, 19 nt, Staphylococcus aureus subsp. aureus MW2
auggcugcaucaauaugac

SEQ ID NO: 4001534 - RNA, 19 nt, Staphylococcus aureus subsp. aureus MW2
auggcuuaaaucaaauggu

SEQ ID NO: 4001535 - RNA, 18 nt, Staphylococcus aureus subsp. aureus MW2
auggcuugguuauuuuca

SEQ ID NO: 4001536 - RNA, 17 nt, Staphylococcus aureus subsp. aureus MW2
auggguaaucuuuagga

SEQ ID NO: 4001537 - RNA, 12 nt, Staphylococcus aureus subsp. aureus MW2
augugaugauua

SEQ ID NO: 4001538 - RNA, 19 nt, Staphylococcus aureus subsp. aureus MW2
augugaugcuugaauguuu

SEQ ID NO: 4001539 - RNA, 18 nt, Staphylococcus aureus subsp. aureus MW2
augugaugguucaaauau

SEQ ID NO: 4001540 - RNA, 20 nt, Staphylococcus aureus subsp. aureus MW2
augugcaacgguuugaaaaa

SEQ ID NO: 4001541 - RNA, 21 nt, Staphylococcus aureus subsp. aureus MW2
augugcaagugguaaaaauga

SEQ ID NO: 4001542 - RNA, 22 nt, Staphylococcus aureus subsp. aureus MW2
augugcaaguuggcggggcccc

SEQ ID NO: 4001543 - RNA, 14 nt, Staphylococcus aureus subsp. aureus MW2
augugcaaguuggg

SEQ ID NO: 4001544 - RNA, 17 nt, Staphylococcus aureus subsp. aureus MW2
augugcgucacucacuu

SEQ ID NO: 4001545 - RNA, 21 nt, Staphylococcus aureus subsp. aureus MW2
augugcgugguuuauuuuaau

SEQ ID NO: 4001546 - RNA, 16 nt, Staphylococcus aureus subsp. aureus MW2
augugcuaaucuauuu

SEQ ID NO: 4001547 - RNA, 17 nt, Staphylococcus aureus subsp. aureus MW2
augugcuuuaaaggcau

SEQ ID NO: 4001548 - RNA, 17 nt, Staphylococcus aureus subsp. aureus MW2
auguggcgcucuuauaa

SEQ ID NO: 4001549 - RNA, 18 nt, Staphylococcus aureus subsp. aureus MW2
auguggcgcucuuauaaa

SEQ ID NO: 4001550 - RNA, 17 nt, Staphylococcus aureus subsp. aureus MW2
auguggguguaccaauu

SEQ ID NO: 4001551 - RNA, 18 nt, Staphylococcus aureus subsp. aureus MW2
augugucacaaugaccau

SEQ ID NO: 4001552 - RNA, 17 nt, Staphylococcus aureus subsp. aureus MW2
augugucacauuauaac

SEQ ID NO: 4001553 - RNA, 20 nt, Staphylococcus aureus subsp. aureus MW2
augugucauaauccauucuu

SEQ ID NO: 4001554 - RNA, 22 nt, Staphylococcus aureus subsp. aureus MW2
augugucauaauccauucuucu

SEQ ID NO: 4001555 - RNA, 18 nt, Staphylococcus aureus subsp. aureus MW2
auguguuaaaauauauuu

SEQ ID NO: 4001556 - RNA, 15 nt, Staphylococcus aureus subsp. aureus MW2
auguguuaaaccaac

SEQ ID NO: 4001557 - RNA, 22 nt, Staphylococcus aureus subsp. aureus MW2
auguuaaacuagaaaacauaaa

SEQ ID NO: 4001558 - RNA, 17 nt, Staphylococcus aureus subsp. aureus MW2
auguuacauuugaagca

SEQ ID NO: 4001559 - RNA, 13 nt, Staphylococcus aureus subsp. aureus MW2
auguuacugauga

SEQ ID NO: 4001560 - RNA, 15 nt, Staphylococcus aureus subsp. aureus MW2
auguuagauuucaaa

SEQ ID NO: 4001561 - RNA, 15 nt, Staphylococcus aureus subsp. aureus MW2
auguuauauuaugaa

SEQ ID NO: 4001562 - RNA, 20 nt, Staphylococcus aureus subsp. aureus MW2
auguuaucgauauagcauaa

SEQ ID NO: 4001563 - RNA, 15 nt, Staphylococcus aureus subsp. aureus MW2
auguucaauauuuuc

SEQ ID NO: 4001564 - RNA, 15 nt, Staphylococcus aureus subsp. aureus MW2
auguucagaaauuua

SEQ ID NO: 4001565 - RNA, 20 nt, Staphylococcus aureus subsp. aureus MW2
auguuccauauaaccuauuu

SEQ ID NO: 4001566 - RNA, 22 nt, Staphylococcus aureus subsp. aureus MW2
auguucccuuaccauuucuuca

SEQ ID NO: 4001567 - RNA, 18 nt, Staphylococcus aureus subsp. aureus MW2
auguuccgcuacaaaaca

SEQ ID NO: 4001568 - RNA, 22 nt, Staphylococcus aureus subsp. aureus MW2
auguucuaggcuccuaaauguu

SEQ ID NO: 4001569 - RNA, 20 nt, Staphylococcus aureus subsp. aureus MW2
auguucuuaacaauaucauc

SEQ ID NO: 4001570 - RNA, 12 nt, Staphylococcus aureus subsp. aureus MW2
auguucuuauaa

SEQ ID NO: 4001571 - RNA, 16 nt, Staphylococcus aureus subsp. aureus MW2
auguucuuauaaaagu

SEQ ID NO: 4001572 - RNA, 15 nt, Staphylococcus aureus subsp. aureus MW2
auguucuuuuuuaau

SEQ ID NO: 4001573 - RNA, 20 nt, Staphylococcus aureus subsp. aureus MW2
auguugaaaaguauaugaau

SEQ ID NO: 4001574 - RNA, 18 nt, Staphylococcus aureus subsp. aureus MW2
auguugacucuacuagaa

SEQ ID NO: 4001575 - RNA, 14 nt, Staphylococcus aureus subsp. aureus MW2
auguugauaaaaag

SEQ ID NO: 4001576 - RNA, 20 nt, Staphylococcus aureus subsp. aureus MW2
auguuggaaaaggucaaaaa

SEQ ID NO: 4001577 - RNA, 23 nt, Staphylococcus aureus subsp. aureus MW2
auguuggcauaaccuguuuuuau

SEQ ID NO: 4001578 - RNA, 15 nt, Staphylococcus aureus subsp. aureus MW2
auguuggggccccgc

SEQ ID NO: 4001579 - RNA, 18 nt, Staphylococcus aureus subsp. aureus MW2
auguugguucaucaaaca

SEQ ID NO: 4001580 - RNA, 20 nt, Staphylococcus aureus subsp. aureus MW2
auguugguucaucaaacaac

SEQ ID NO: 4001581 - RNA, 18 nt, Staphylococcus aureus subsp. aureus MW2
auguugucacuuggauuc

SEQ ID NO: 4001582 - RNA, 19 nt, Staphylococcus aureus subsp. aureus MW2
auguuguuuaaauuucaaa

SEQ ID NO: 4001583 - RNA, 13 nt, Staphylococcus aureus subsp. aureus MW2
auguuuaaaaaac

SEQ ID NO: 4001584 - RNA, 16 nt, Staphylococcus aureus subsp. aureus MW2
auguuuaaaaaacuac

SEQ ID NO: 4001585 - RNA, 14 nt, Staphylococcus aureus subsp. aureus MW2
auguuuaaacauuu

SEQ ID NO: 4001586 - RNA, 18 nt, Staphylococcus aureus subsp. aureus MW2
auguuuaacuaaaccauu

SEQ ID NO: 4001587 - RNA, 21 nt, Staphylococcus aureus subsp. aureus MW2
auguuuaagacuauaaugaau

SEQ ID NO: 4001588 - RNA, 13 nt, Staphylococcus aureus subsp. aureus MW2
auguuuaauguau

SEQ ID NO: 4001589 - RNA, 17 nt, Staphylococcus aureus subsp. aureus MW2
auguuuaauuuucuaaa

SEQ ID NO: 4001590 - RNA, 19 nt, Staphylococcus aureus subsp. aureus MW2
auguuuauauugcaaaaau

SEQ ID NO: 4001591 - RNA, 14 nt, Staphylococcus aureus subsp. aureus MW2
auguuuaugacaaa

SEQ ID NO: 4001592 - RNA, 20 nt, Staphylococcus aureus subsp. aureus MW2
auguuuauuagcuuuuucaa

SEQ ID NO: 4001593 - RNA, 12 nt, Staphylococcus aureus subsp. aureus MW2
auguuuccauuu

SEQ ID NO: 4001594 - RNA, 18 nt, Staphylococcus aureus subsp. aureus MW2
auguuucuucaauugucu

SEQ ID NO: 4001595 - RNA, 22 nt, Staphylococcus aureus subsp. aureus MW2
auguuucuucaauuuaauguau

SEQ ID NO: 4001596 - RNA, 19 nt, Staphylococcus aureus subsp. aureus MW2
auguuugauucuaaauaau

SEQ ID NO: 4001597 - RNA, 21 nt, Staphylococcus aureus subsp. aureus MW2
auguuugcauaccuauaaaca

SEQ ID NO: 4001598 - RNA, 16 nt, Staphylococcus aureus subsp. aureus MW2
auguuugccagguaaa

SEQ ID NO: 4001599 - RNA, 16 nt, Staphylococcus aureus subsp. aureus MW2
auguuuggaugaacaa

SEQ ID NO: 4001600 - RNA, 22 nt, Staphylococcus aureus subsp. aureus MW2
auguuugucguuacuaccuauu

SEQ ID NO: 4001601 - RNA, 21 nt, Staphylococcus aureus subsp. aureus MW2
auguuuuagugacaaacauuu

SEQ ID NO: 4001602 - RNA, 22 nt, Staphylococcus aureus subsp. aureus MW2
auguuuuauaaggaugucgauu

SEQ ID NO: 4001603 - RNA, 22 nt, Staphylococcus aureus subsp. aureus MW2
auguuuucguuugcaaucaucu

SEQ ID NO: 4001604 - RNA, 16 nt, Staphylococcus aureus subsp. aureus MW2
auguuuuuauuauaca

SEQ ID NO: 4001605 - RNA, 19 nt, Staphylococcus aureus subsp. aureus MW2
auuaaaaaacaauaaaauu

SEQ ID NO: 4001606 - RNA, 22 nt, Staphylococcus aureus subsp. aureus MW2
auuaaaaaacaauaaaauuacu

SEQ ID NO: 4001607 - RNA, 12 nt, Staphylococcus aureus subsp. aureus MW2
auuaaaaacacc

SEQ ID NO: 4001608 - RNA, 19 nt, Staphylococcus aureus subsp. aureus MW2
auuaaaaaucggacagaug

SEQ ID NO: 4001609 - RNA, 23 nt, Staphylococcus aureus subsp. aureus MW2
auuaaaaauuucgccucaucuaa

SEQ ID NO: 4001610 - RNA, 23 nt, Staphylococcus aureus subsp. aureus MW2
auuaaaacgaaguuauuuauuca

SEQ ID NO: 4001611 - RNA, 21 nt, Staphylococcus aureus subsp. aureus MW2
auuaaaagaguacauuuauuu

SEQ ID NO: 4001612 - RNA, 20 nt, Staphylococcus aureus subsp. aureus MW2
auuaaaaguguugacuuuau

SEQ ID NO: 4001613 - RNA, 15 nt, Staphylococcus aureus subsp. aureus MW2
auuaaaauaaaccac

SEQ ID NO: 4001614 - RNA, 15 nt, Staphylococcus aureus subsp. aureus MW2
auuaaaauaauuaaa

SEQ ID NO: 4001615 - RNA, 17 nt, Staphylococcus aureus subsp. aureus MW2
auuaaaauaauuaaacu

SEQ ID NO: 4001616 - RNA, 12 nt, Staphylococcus aureus subsp. aureus MW2
auuaaaauagag

SEQ ID NO: 4001617 - RNA, 18 nt, Staphylococcus aureus subsp. aureus MW2
auuaaaauuaaauaauga

SEQ ID NO: 4001618 - RNA, 18 nt, Staphylococcus aureus subsp. aureus MW2
auuaaacaaaacuuaaaa

SEQ ID NO: 4001619 - RNA, 16 nt, Staphylococcus aureus subsp. aureus MW2
auuaaacauauuuuuu

SEQ ID NO: 4001620 - RNA, 23 nt, Staphylococcus aureus subsp. aureus MW2
auuaaacauauuuuuugauauaa

SEQ ID NO: 4001621 - RNA, 16 nt, Staphylococcus aureus subsp. aureus MW2
auuaaacauuuagauu

SEQ ID NO: 4001622 - RNA, 23 nt, Staphylococcus aureus subsp. aureus MW2
auuaaaccuacaacgaagaaucc

SEQ ID NO: 4001623 - RNA, 19 nt, Staphylococcus aureus subsp. aureus MW2
auuaaacucaaaaagccaa

SEQ ID NO: 4001624 - RNA, 21 nt, Staphylococcus aureus subsp. aureus MW2
auuaaacuuuaugaaaauggu

SEQ ID NO: 4001625 - RNA, 16 nt, Staphylococcus aureus subsp. aureus MW2
auuaauuuuucaaaug

SEQ ID NO: 4001626 - RNA, 15 nt, Staphylococcus aureus subsp. aureus MW2
auuacaaaaguauga

SEQ ID NO: 4001627 - RNA, 12 nt, Staphylococcus aureus subsp. aureus MW2
auuacaaacauu

SEQ ID NO: 4001628 - RNA, 21 nt, Staphylococcus aureus subsp. aureus MW2
auuacaaauacaguuaucacc

SEQ ID NO: 4001629 - RNA, 13 nt, Staphylococcus aureus subsp. aureus MW2
auuacaaaucaug

SEQ ID NO: 4001630 - RNA, 18 nt, Staphylococcus aureus subsp. aureus MW2
auuacacccuuuaaauuu

SEQ ID NO: 4001631 - RNA, 22 nt, Staphylococcus aureus subsp. aureus MW2
auuacacccuuuaaauuuaacu

SEQ ID NO: 4001632 - RNA, 15 nt, Staphylococcus aureus subsp. aureus MW2
auuacacuuuaaaua

SEQ ID NO: 4001633 - RNA, 18 nt, Staphylococcus aureus subsp. aureus MW2
auuacacuuuaaauacau

SEQ ID NO: 4001634 - RNA, 20 nt, Staphylococcus aureus subsp. aureus MW2
auuacagcguacuaaagaau

SEQ ID NO: 4001635 - RNA, 19 nt, Staphylococcus aureus subsp. aureus MW2
auuacauauaagauagaua

SEQ ID NO: 4001636 - RNA, 17 nt, Staphylococcus aureus subsp. aureus MW2
auuacauuuuaugucca

SEQ ID NO: 4001637 - RNA, 15 nt, Staphylococcus aureus subsp. aureus MW2
auuaccaaugaauaa

SEQ ID NO: 4001638 - RNA, 13 nt, Staphylococcus aureus subsp. aureus MW2
auuaccauaaauu

SEQ ID NO: 4001639 - RNA, 13 nt, Staphylococcus aureus subsp. aureus MW2
auuaccauauaaa

SEQ ID NO: 4001640 - RNA, 23 nt, Staphylococcus aureus subsp. aureus MW2
auuaccauucaucgucucacuua

SEQ ID NO: 4001641 - RNA, 22 nt, Staphylococcus aureus subsp. aureus MW2
auuacccacaucuuuuuaaaag

SEQ ID NO: 4001642 - RNA, 18 nt, Staphylococcus aureus subsp. aureus MW2
auuacccuuuaaucucau

SEQ ID NO: 4001643 - RNA, 20 nt, Staphylococcus aureus subsp. aureus MW2
auuaccuggguauacagguu

SEQ ID NO: 4001644 - RNA, 17 nt, Staphylococcus aureus subsp. aureus MW2
auuacgcucauaugucu

SEQ ID NO: 4001645 - RNA, 16 nt, Staphylococcus aureus subsp. aureus MW2
auuacguaucuuuaca

SEQ ID NO: 4001646 - RNA, 17 nt, Staphylococcus aureus subsp. aureus MW2
auuacgucauaaaauac

SEQ ID NO: 4001647 - RNA, 15 nt, Staphylococcus aureus subsp. aureus MW2
auuacuaaaacaaau

SEQ ID NO: 4001648 - RNA, 18 nt, Staphylococcus aureus subsp. aureus MW2
auuacuaaaacaaauuca

SEQ ID NO: 4001649 - RNA, 21 nt, Staphylococcus aureus subsp. aureus MW2
auuacuaaccuauuaaaauaa

SEQ ID NO: 4001650 - RNA, 22 nt, Staphylococcus aureus subsp. aureus MW2
auuacuaaccuauuaaaauaaa

SEQ ID NO: 4001651 - RNA, 17 nt, Staphylococcus aureus subsp. aureus MW2
auuacuauaaaaaacag

SEQ ID NO: 4001652 - RNA, 23 nt, Staphylococcus aureus subsp. aureus MW2
auuacuauauuuaaauuggaauc

SEQ ID NO: 4001653 - RNA, 15 nt, Staphylococcus aureus subsp. aureus MW2
auuacugauuguuaa

SEQ ID NO: 4001654 - RNA, 15 nt, Staphylococcus aureus subsp. aureus MW2
auuacuguuugcuuu

SEQ ID NO: 4001655 - RNA, 21 nt, Staphylococcus aureus subsp. aureus MW2
auuacuguuugcuuuaucaau

SEQ ID NO: 4001656 - RNA, 13 nt, Staphylococcus aureus subsp. aureus MW2
auuacuuauucaa

SEQ ID NO: 4001657 - RNA, 18 nt, Staphylococcus aureus subsp. aureus MW2
auuacuuauuucuuuuca

SEQ ID NO: 4001658 - RNA, 16 nt, Staphylococcus aureus subsp. aureus MW2
auuacuuccauugcuu

SEQ ID NO: 4001659 - RNA, 15 nt, Staphylococcus aureus subsp. aureus MW2
auuacuugaauauua

SEQ ID NO: 4001660 - RNA, 17 nt, Staphylococcus aureus subsp. aureus MW2
auuacuugcacaccagu

SEQ ID NO: 4001661 - RNA, 21 nt, Staphylococcus aureus subsp. aureus MW2
auuacuuucugcccacuuaau

SEQ ID NO: 4001662 - RNA, 15 nt, Staphylococcus aureus subsp. aureus MW2
auuacuuuggaaauu

SEQ ID NO: 4001663 - RNA, 16 nt, Staphylococcus aureus subsp. aureus MW2
auuagaaaauuucuca

SEQ ID NO: 4001664 - RNA, 14 nt, Staphylococcus aureus subsp. aureus MW2
auuagaaccaucau

SEQ ID NO: 4001665 - RNA, 15 nt, Staphylococcus aureus subsp. aureus MW2
auuagaacuucucuu

SEQ ID NO: 4001666 - RNA, 17 nt, Staphylococcus aureus subsp. aureus MW2
auuagaacuucucuuug

SEQ ID NO: 4001667 - RNA, 19 nt, Staphylococcus aureus subsp. aureus MW2
auuagaacuucucuuugaa

SEQ ID NO: 4001668 - RNA, 23 nt, Staphylococcus aureus subsp. aureus MW2
auuagaacuucucuuugaacgaa

SEQ ID NO: 4001669 - RNA, 21 nt, Staphylococcus aureus subsp. aureus MW2
auuagagccuacucauauuca

SEQ ID NO: 4001670 - RNA, 21 nt, Staphylococcus aureus subsp. aureus MW2
auuagagggcacgagaaaugu

SEQ ID NO: 4001671 - RNA, 14 nt, Staphylococcus aureus subsp. aureus MW2
auuagauacuucuu

SEQ ID NO: 4001672 - RNA, 13 nt, Staphylococcus aureus subsp. aureus MW2
auuagauauauuu

SEQ ID NO: 4001673 - RNA, 19 nt, Staphylococcus aureus subsp. aureus MW2
auuagauauauuugaaagg

SEQ ID NO: 4001674 - RNA, 14 nt, Staphylococcus aureus subsp. aureus MW2
auuagaucauacau

SEQ ID NO: 4001675 - RNA, 15 nt, Staphylococcus aureus subsp. aureus MW2
auuagaucuaugguu

SEQ ID NO: 4001676 - RNA, 14 nt, Staphylococcus aureus subsp. aureus MW2
auuagccauuucaa

SEQ ID NO: 4001677 - RNA, 20 nt, Staphylococcus aureus subsp. aureus MW2
auuagcgaaaacuaaaggga

SEQ ID NO: 4001678 - RNA, 15 nt, Staphylococcus aureus subsp. aureus MW2
auuagcuaauucacu

SEQ ID NO: 4001679 - RNA, 23 nt, Staphylococcus aureus subsp. aureus MW2
auuaggaauccaauuucucuaug

SEQ ID NO: 4001680 - RNA, 21 nt, Staphylococcus aureus subsp. aureus MW2
auuaggaaugacauuuaaaga

SEQ ID NO: 4001681 - RNA, 14 nt, Staphylococcus aureus subsp. aureus MW2
auuagguaauacuu

SEQ ID NO: 4001682 - RNA, 20 nt, Staphylococcus aureus subsp. aureus MW2
auuaggucuacgaucaaaau

SEQ ID NO: 4001683 - RNA, 12 nt, Staphylococcus aureus subsp. aureus MW2
auuaguaaauau

SEQ ID NO: 4001684 - RNA, 20 nt, Staphylococcus aureus subsp. aureus MW2
auuaguacuaaaccgauuaa

SEQ ID NO: 4001685 - RNA, 20 nt, Staphylococcus aureus subsp. aureus MW2
auuaguauucaaaaaaauau

SEQ ID NO: 4001686 - RNA, 17 nt, Staphylococcus aureus subsp. aureus MW2
auuagucauugaaaaua

SEQ ID NO: 4001687 - RNA, 13 nt, Staphylococcus aureus subsp. aureus MW2
auuaguuauacua

SEQ ID NO: 4001688 - RNA, 16 nt, Staphylococcus aureus subsp. aureus MW2
auuaguuuaugucuca

SEQ ID NO: 4001689 - RNA, 16 nt, Staphylococcus aureus subsp. aureus MW2
auuaguuugaucauuu

SEQ ID NO: 4001690 - RNA, 18 nt, Staphylococcus aureus subsp. aureus MW2
auuaguuugaucauuuac

SEQ ID NO: 4001691 - RNA, 15 nt, Staphylococcus aureus subsp. aureus MW2
auuaguuuuuaaaau

SEQ ID NO: 4001692 - RNA, 16 nt, Staphylococcus aureus subsp. aureus MW2
auuaguuuuuaaaauu

SEQ ID NO: 4001693 - RNA, 21 nt, Staphylococcus aureus subsp. aureus MW2
auuaguuuuuaaaauuaucaa

SEQ ID NO: 4001694 - RNA, 21 nt, Staphylococcus aureus subsp. aureus MW2
auuaguuuuuguuuacagaug

SEQ ID NO: 4001695 - RNA, 12 nt, Staphylococcus aureus subsp. aureus MW2
auuauaaaauaa

SEQ ID NO: 4001696 - RNA, 13 nt, Staphylococcus aureus subsp. aureus MW2
auuauaaaugauu

SEQ ID NO: 4001697 - RNA, 20 nt, Staphylococcus aureus subsp. aureus MW2
auuauaaguagugauuuuuu

SEQ ID NO: 4001698 - RNA, 16 nt, Staphylococcus aureus subsp. aureus MW2
auuauaauaaauagac

SEQ ID NO: 4001699 - RNA, 18 nt, Staphylococcus aureus subsp. aureus MW2
auuauaauaaauagacug

SEQ ID NO: 4001700 - RNA, 21 nt, Staphylococcus aureus subsp. aureus MW2
auuauaauuguaaugcuucuu

SEQ ID NO: 4001701 - RNA, 17 nt, Staphylococcus aureus subsp. aureus MW2
auuauaauuuuguuuca

SEQ ID NO: 4001702 - RNA, 18 nt, Staphylococcus aureus subsp. aureus MW2
auuauacaauaugugaua

SEQ ID NO: 4001703 - RNA, 16 nt, Staphylococcus aureus subsp. aureus MW2
auuauagacauaagca

SEQ ID NO: 4001704 - RNA, 20 nt, Staphylococcus aureus subsp. aureus MW2
auuauagacauaagcaaaga

SEQ ID NO: 4001705 - RNA, 17 nt, Staphylococcus aureus subsp. aureus MW2
auuauagccuauccauu

SEQ ID NO: 4001706 - RNA, 19 nt, Staphylococcus aureus subsp. aureus MW2
auuauagggcuguuuuuua

SEQ ID NO: 4001707 - RNA, 21 nt, Staphylococcus aureus subsp. aureus MW2
auuauagggcuguuuuuuaau

SEQ ID NO: 4001708 - RNA, 19 nt, Staphylococcus aureus subsp. aureus MW2
auuauagucuuaaacauaa

SEQ ID NO: 4001709 - RNA, 16 nt, Staphylococcus aureus subsp. aureus MW2
auuauauaauucuuca

SEQ ID NO: 4001710 - RNA, 20 nt, Staphylococcus aureus subsp. aureus MW2
auuauaucgucguaacucuu

SEQ ID NO: 4001711 - RNA, 21 nt, Staphylococcus aureus subsp. aureus MW2
auuauauuuuucuucaguuaa

SEQ ID NO: 4001712 - RNA, 13 nt, Staphylococcus aureus subsp. aureus MW2
auuaucaaagaaa

SEQ ID NO: 4001713 - RNA, 14 nt, Staphylococcus aureus subsp. aureus MW2
auuaucaacauaau

SEQ ID NO: 4001714 - RNA, 14 nt, Staphylococcus aureus subsp. aureus MW2
auucaacuuguuaa

SEQ ID NO: 4001715 - RNA, 16 nt, Staphylococcus aureus subsp. aureus MW2
auucaagcaucauuuu

SEQ ID NO: 4001716 - RNA, 18 nt, Staphylococcus aureus subsp. aureus MW2
auucaagcaucauuuuuc

SEQ ID NO: 4001717 - RNA, 21 nt, Staphylococcus aureus subsp. aureus MW2
auucaauacgaaguguuauaa

SEQ ID NO: 4001718 - RNA, 14 nt, Staphylococcus aureus subsp. aureus MW2
auucaauauuuuuu

SEQ ID NO: 4001719 - RNA, 17 nt, Staphylococcus aureus subsp. aureus MW2
auucaaugauuuuuaaa

SEQ ID NO: 4001720 - RNA, 18 nt, Staphylococcus aureus subsp. aureus MW2
auucaaugauuuuuaaaa

SEQ ID NO: 4001721 - RNA, 21 nt, Staphylococcus aureus subsp. aureus MW2
auucaauguaucaccuaauug

SEQ ID NO: 4001722 - RNA, 14 nt, Staphylococcus aureus subsp. aureus MW2
auucaauucuguga

SEQ ID NO: 4001723 - RNA, 22 nt, Staphylococcus aureus subsp. aureus MW2
auucaauugcuaaaucaucuuc

SEQ ID NO: 4001724 - RNA, 16 nt, Staphylococcus aureus subsp. aureus MW2
auucaauuuaguucac

SEQ ID NO: 4001725 - RNA, 13 nt, Staphylococcus aureus subsp. aureus MW2
auucaauuucuca

SEQ ID NO: 4001726 - RNA, 14 nt, Staphylococcus aureus subsp. aureus MW2
auucaauuucucac

SEQ ID NO: 4001727 - RNA, 22 nt, Staphylococcus aureus subsp. aureus MW2
auucacauagccucuuaaaaua

SEQ ID NO: 4001728 - RNA, 16 nt, Staphylococcus aureus subsp. aureus MW2
auucaccaauuaggau

SEQ ID NO: 4001729 - RNA, 19 nt, Staphylococcus aureus subsp. aureus MW2
auucaccaauuaggauucg

SEQ ID NO: 4001730 - RNA, 18 nt, Staphylococcus aureus subsp. aureus MW2
auucaccagguuuuuuau

SEQ ID NO: 4001731 - RNA, 22 nt, Staphylococcus aureus subsp. aureus MW2
auucaccaguuaccucgaguuu

SEQ ID NO: 4001732 - RNA, 23 nt, Staphylococcus aureus subsp. aureus MW2
auucaccguaugauggaaucauu

SEQ ID NO: 4001733 - RNA, 20 nt, Staphylococcus aureus subsp. aureus MW2
auucacgcguucaaauguug

SEQ ID NO: 4001734 - RNA, 22 nt, Staphylococcus aureus subsp. aureus MW2
auucacucuguaauaaagaaua

SEQ ID NO: 4001735 - RNA, 15 nt, Staphylococcus aureus subsp. aureus MW2
auucaguauauguau

SEQ ID NO: 4001736 - RNA, 17 nt, Staphylococcus aureus subsp. aureus MW2
auucagucaguaaaaau

SEQ ID NO: 4001737 - RNA, 14 nt, Staphylococcus aureus subsp. aureus MW2
auucaguucaaaca

SEQ ID NO: 4001738 - RNA, 20 nt, Staphylococcus aureus subsp. aureus MW2
auucauaaaugacugaauua

SEQ ID NO: 4001739 - RNA, 23 nt, Staphylococcus aureus subsp. aureus MW2
auucauaacaacaucaaaacccc

SEQ ID NO: 4001740 - RNA, 12 nt, Staphylococcus aureus subsp. aureus MW2
auucauaauauc

SEQ ID NO: 4001741 - RNA, 22 nt, Staphylococcus aureus subsp. aureus MW2
auucauaauuuguugauaguaa

SEQ ID NO: 4001742 - RNA, 20 nt, Staphylococcus aureus subsp. aureus MW2
auucauacacugcacaucau

SEQ ID NO: 4001743 - RNA, 21 nt, Staphylococcus aureus subsp. aureus MW2
auucauacacugcacaucaua

SEQ ID NO: 4001744 - RNA, 17 nt, Staphylococcus aureus subsp. aureus MW2
auucauauauacugccc

SEQ ID NO: 4001745 - RNA, 18 nt, Staphylococcus aureus subsp. aureus MW2
auucauaucuuucaauua

SEQ ID NO: 4001746 - RNA, 19 nt, Staphylococcus aureus subsp. aureus MW2
auucauaucuuucaauuaa

SEQ ID NO: 4001747 - RNA, 16 nt, Staphylococcus aureus subsp. aureus MW2
auucauauucaaauuu

SEQ ID NO: 4001748 - RNA, 16 nt, Staphylococcus aureus subsp. aureus MW2
auucaucaguguagca

SEQ ID NO: 4001749 - RNA, 15 nt, Staphylococcus aureus subsp. aureus MW2
auucaucgucucacu

SEQ ID NO: 4001750 - RNA, 22 nt, Staphylococcus aureus subsp. aureus MW2
auucaucguuuacuacaucaua

SEQ ID NO: 4001751 - RNA, 16 nt, Staphylococcus aureus subsp. aureus MW2
auucaucuguugauaa

SEQ ID NO: 4001752 - RNA, 17 nt, Staphylococcus aureus subsp. aureus MW2
auucaucuuaucaagaa

SEQ ID NO: 4001753 - RNA, 14 nt, Staphylococcus aureus subsp. aureus MW2
auucaucuucaaac

SEQ ID NO: 4001754 - RNA, 12 nt, Staphylococcus aureus subsp. aureus MW2
auucaugaauaa

SEQ ID NO: 4001755 - RNA, 21 nt, Staphylococcus aureus subsp. aureus MW2
auucaugaaucgaacuaguac

SEQ ID NO: 4001756 - RNA, 15 nt, Staphylococcus aureus subsp. aureus MW2
auucaugauauguuc

SEQ ID NO: 4001757 - RNA, 13 nt, Staphylococcus aureus subsp. aureus MW2
auucauuaagcuu

SEQ ID NO: 4001758 - RNA, 15 nt, Staphylococcus aureus subsp. aureus MW2
auucauuaauaggau

SEQ ID NO: 4001759 - RNA, 16 nt, Staphylococcus aureus subsp. aureus MW2
auucauuacaaccauu

SEQ ID NO: 4001760 - RNA, 13 nt, Staphylococcus aureus subsp. aureus MW2
auucauucaauac

SEQ ID NO: 4001761 - RNA, 14 nt, Staphylococcus aureus subsp. aureus MW2
auucauucaauacg

SEQ ID NO: 4001762 - RNA, 21 nt, Staphylococcus aureus subsp. aureus MW2
auucauuccuaagaauguaau

SEQ ID NO: 4001763 - RNA, 16 nt, Staphylococcus aureus subsp. aureus MW2
auucauuuauuuucuu

SEQ ID NO: 4001764 - RNA, 20 nt, Staphylococcus aureus subsp. aureus MW2
auucauuucgauuaauuuaa

SEQ ID NO: 4001765 - RNA, 22 nt, Staphylococcus aureus subsp. aureus MW2
auucauuuucuuuuucuugaag

SEQ ID NO: 4001766 - RNA, 15 nt, Staphylococcus aureus subsp. aureus MW2
auuccaaaaauugua

SEQ ID NO: 4001767 - RNA, 21 nt, Staphylococcus aureus subsp. aureus MW2
auuccaaaaauuguaaaaccu

SEQ ID NO: 4001768 - RNA, 20 nt, Staphylococcus aureus subsp. aureus MW2
auuccaaacacacuguugaa

SEQ ID NO: 4001769 - RNA, 18 nt, Staphylococcus aureus subsp. aureus MW2
auuccaaguauuuucucu

SEQ ID NO: 4001770 - RNA, 14 nt, Staphylococcus aureus subsp. aureus MW2
auuccaaucuauuu

SEQ ID NO: 4001771 - RNA, 19 nt, Staphylococcus aureus subsp. aureus MW2
auuccaaucuauuuuaaac

SEQ ID NO: 4001772 - RNA, 14 nt, Staphylococcus aureus subsp. aureus MW2
auuccacuacaauc

SEQ ID NO: 4001773 - RNA, 20 nt, Staphylococcus aureus subsp. aureus MW2
auuccauacgaucuuuuuca

SEQ ID NO: 4001774 - RNA, 19 nt, Staphylococcus aureus subsp. aureus MW2
auuccauaguauguaucuu

SEQ ID NO: 4001775 - RNA, 15 nt, Staphylococcus aureus subsp. aureus MW2
auuccaucucauacu

SEQ ID NO: 4001776 - RNA, 15 nt, Staphylococcus aureus subsp. aureus MW2
auucccaaagcgaau

SEQ ID NO: 4001777 - RNA, 23 nt, Staphylococcus aureus subsp. aureus MW2
auucccaccggacaauguagaua

SEQ ID NO: 4001778 - RNA, 15 nt, Staphylococcus aureus subsp. aureus MW2
auuccccauuuaucu

SEQ ID NO: 4001779 - RNA, 17 nt, Staphylococcus aureus subsp. aureus MW2
auucccugcagcaauca

SEQ ID NO: 4001780 - RNA, 16 nt, Staphylococcus aureus subsp. aureus MW2
auucccuuuucaucaa

SEQ ID NO: 4001781 - RNA, 21 nt, Staphylococcus aureus subsp. aureus MW2
auuccgagaauuauuauucua

SEQ ID NO: 4001782 - RNA, 15 nt, Staphylococcus aureus subsp. aureus MW2
auuccuagcuuuuau

SEQ ID NO: 4001783 - RNA, 18 nt, Staphylococcus aureus subsp. aureus MW2
auuccuuggugccgaaau

SEQ ID NO: 4001784 - RNA, 22 nt, Staphylococcus aureus subsp. aureus MW2
auuccuuggugccgaaauuguu

SEQ ID NO: 4001785 - RNA, 15 nt, Staphylococcus aureus subsp. aureus MW2
auucgaaagccaauu

SEQ ID NO: 4001786 - RNA, 18 nt, Staphylococcus aureus subsp. aureus MW2
auucgaugacuuuuuaau

SEQ ID NO: 4001787 - RNA, 16 nt, Staphylococcus aureus subsp. aureus MW2
auucgauuauuuagau

SEQ ID NO: 4001788 - RNA, 20 nt, Staphylococcus aureus subsp. aureus MW2
auucgauuauuuagauaaaa

SEQ ID NO: 4001789 - RNA, 18 nt, Staphylococcus aureus subsp. aureus MW2
auucgauugguuuaaaaa

SEQ ID NO: 4001790 - RNA, 16 nt, Staphylococcus aureus subsp. aureus MW2
auucgcaccacuggcc

SEQ ID NO: 4001791 - RNA, 15 nt, Staphylococcus aureus subsp. aureus MW2
auucgccuaaauggu

SEQ ID NO: 4001792 - RNA, 17 nt, Staphylococcus aureus subsp. aureus MW2
auucgcuuguucaguaa

SEQ ID NO: 4001793 - RNA, 15 nt, Staphylococcus aureus subsp. aureus MW2
auucguuucuuuauu

SEQ ID NO: 4001794 - RNA, 20 nt, Staphylococcus aureus subsp. aureus MW2
auucguuugaauuauuuaau

SEQ ID NO: 4001795 - RNA, 14 nt, Staphylococcus aureus subsp. aureus MW2
auucuaaaacggaa

SEQ ID NO: 4001796 - RNA, 14 nt, Staphylococcus aureus subsp. aureus MW2
auucuaacugcaaa

SEQ ID NO: 4001797 - RNA, 18 nt, Staphylococcus aureus subsp. aureus MW2
auucuaacuuuguaugaa

SEQ ID NO: 4001798 - RNA, 16 nt, Staphylococcus aureus subsp. aureus MW2
auucuaagucuuuuga

SEQ ID NO: 4001799 - RNA, 21 nt, Staphylococcus aureus subsp. aureus MW2
auucuacaggcaaugcaaguu

SEQ ID NO: 4001800 - RNA, 19 nt, Staphylococcus aureus subsp. aureus MW2
auucuaccaguugauuuaa

SEQ ID NO: 4001801 - RNA, 13 nt, Staphylococcus aureus subsp. aureus MW2
auucuauacuuuu

SEQ ID NO: 4001802 - RNA, 21 nt, Staphylococcus aureus subsp. aureus MW2
auugccaguaucucuuuucua

SEQ ID NO: 4001803 - RNA, 20 nt, Staphylococcus aureus subsp. aureus MW2
auugccuaaagacuuuaugc

SEQ ID NO: 4001804 - RNA, 17 nt, Staphylococcus aureus subsp. aureus MW2
auugccuaacguguuug

SEQ ID NO: 4001805 - RNA, 18 nt, Staphylococcus aureus subsp. aureus MW2
auugccuaagaacuuaau

SEQ ID NO: 4001806 - RNA, 16 nt, Staphylococcus aureus subsp. aureus MW2
auugcgaaaaauaauu

SEQ ID NO: 4001807 - RNA, 22 nt, Staphylococcus aureus subsp. aureus MW2
auugcguaagguauuucauuga

SEQ ID NO: 4001808 - RNA, 21 nt, Staphylococcus aureus subsp. aureus MW2
auugcgugcuucacuaaaaau

SEQ ID NO: 4001809 - RNA, 12 nt, Staphylococcus aureus subsp. aureus MW2
auugcuaaaaaa

SEQ ID NO: 4001810 - RNA, 13 nt, Staphylococcus aureus subsp. aureus MW2
auugcuaaaucau

SEQ ID NO: 4001811 - RNA, 14 nt, Staphylococcus aureus subsp. aureus MW2
auugcuaaaucauc

SEQ ID NO: 4001812 - RNA, 20 nt, Staphylococcus aureus subsp. aureus MW2
auugcuacccaccuuucuuu

SEQ ID NO: 4001813 - RNA, 24 nt, Staphylococcus aureus subsp. aureus MW2
auugcuacccaccuuucuuuauca

SEQ ID NO: 4001814 - RNA, 22 nt, Staphylococcus aureus subsp. aureus MW2
auugcuauauuaguauaauuua

SEQ ID NO: 4001815 - RNA, 23 nt, Staphylococcus aureus subsp. aureus MW2
auugcugccacuguagaaacaca

SEQ ID NO: 4001816 - RNA, 23 nt, Staphylococcus aureus subsp. aureus MW2
auugcugcuguacaauuucgcuu

SEQ ID NO: 4001817 - RNA, 15 nt, Staphylococcus aureus subsp. aureus MW2
auugcuuauuuuugu

SEQ ID NO: 4001818 - RNA, 18 nt, Staphylococcus aureus subsp. aureus MW2
auugcuuguccucuaaaa

SEQ ID NO: 4001819 - RNA, 21 nt, Staphylococcus aureus subsp. aureus MW2
auugcuuguccucuaaaacau

SEQ ID NO: 4001820 - RNA, 17 nt, Staphylococcus aureus subsp. aureus MW2
auugcuuguucuuucuu

SEQ ID NO: 4001821 - RNA, 16 nt, Staphylococcus aureus subsp. aureus MW2
auugcuuuagaaaguc

SEQ ID NO: 4001822 - RNA, 21 nt, Staphylococcus aureus subsp. aureus MW2
auugcuuuuucuuaauuauuu

SEQ ID NO: 4001823 - RNA, 15 nt, Staphylococcus aureus subsp. aureus MW2
auuggaaaaauaaau

SEQ ID NO: 4001824 - RNA, 19 nt, Staphylococcus aureus subsp. aureus MW2
auuggaaucaucuuuuuga

SEQ ID NO: 4001825 - RNA, 20 nt, Staphylococcus aureus subsp. aureus MW2
auuggaaucaucuuuuugaa

SEQ ID NO: 4001826 - RNA, 18 nt, Staphylococcus aureus subsp. aureus MW2
auuggaaucccaaugcuu

SEQ ID NO: 4001827 - RNA, 23 nt, Staphylococcus aureus subsp. aureus MW2
auuggauuacuuccauugcuucu

SEQ ID NO: 4001828 - RNA, 20 nt, Staphylococcus aureus subsp. aureus MW2
auuggauuaucgaauuagau

SEQ ID NO: 4001829 - RNA, 12 nt, Staphylococcus aureus subsp. aureus MW2
auuggcagauag

SEQ ID NO: 4001830 - RNA, 23 nt, Staphylococcus aureus subsp. aureus MW2
auuggcgggccccaacauagaag

SEQ ID NO: 4001831 - RNA, 23 nt, Staphylococcus aureus subsp. aureus MW2
auuggcuccccaauuucucugug

SEQ ID NO: 4001832 - RNA, 20 nt, Staphylococcus aureus subsp. aureus MW2
auugggagcaaucaauacaa

SEQ ID NO: 4001833 - RNA, 14 nt, Staphylococcus aureus subsp. aureus MW2
auugguuuaaaaag

SEQ ID NO: 4001834 - RNA, 17 nt, Staphylococcus aureus subsp. aureus MW2
auugguuuggauaaaau

SEQ ID NO: 4001835 - RNA, 18 nt, Staphylococcus aureus subsp. aureus MW2
auuguaaaaauacauaau

SEQ ID NO: 4001836 - RNA, 13 nt, Staphylococcus aureus subsp. aureus MW2
auuguaaaacaaa

SEQ ID NO: 4001837 - RNA, 13 nt, Staphylococcus aureus subsp. aureus MW2
auuguaaaaugcu

SEQ ID NO: 4001838 - RNA, 14 nt, Staphylococcus aureus subsp. aureus MW2
auuguaaaaugcuc

SEQ ID NO: 4001839 - RNA, 22 nt, Staphylococcus aureus subsp. aureus MW2
auuguaaaugaucaucguauag

SEQ ID NO: 4001840 - RNA, 13 nt, Staphylococcus aureus subsp. aureus MW2
auuguaaccugac

SEQ ID NO: 4001841 - RNA, 13 nt, Staphylococcus aureus subsp. aureus MW2
auuguaacucaau

SEQ ID NO: 4001842 - RNA, 12 nt, Staphylococcus aureus subsp. aureus MW2
auuguaauaaua

SEQ ID NO: 4001843 - RNA, 16 nt, Staphylococcus aureus subsp. aureus MW2
auuguaauauauuaau

SEQ ID NO: 4001844 - RNA, 15 nt, Staphylococcus aureus subsp. aureus MW2
auuguaaucacuauu

SEQ ID NO: 4001845 - RNA, 16 nt, Staphylococcus aureus subsp. aureus MW2
auuguaaucuauuuuc

SEQ ID NO: 4001846 - RNA, 21 nt, Staphylococcus aureus subsp. aureus MW2
auuguacgcuucaauuauuuc

SEQ ID NO: 4001847 - RNA, 15 nt, Staphylococcus aureus subsp. aureus MW2
auuguacugauauau

SEQ ID NO: 4001848 - RNA, 13 nt, Staphylococcus aureus subsp. aureus MW2
auuguaguauuuu

SEQ ID NO: 4001849 - RNA, 17 nt, Staphylococcus aureus subsp. aureus MW2
auuguauauguguguug

SEQ ID NO: 4001850 - RNA, 16 nt, Staphylococcus aureus subsp. aureus MW2
auuguaucuugucauu

SEQ ID NO: 4001851 - RNA, 18 nt, Staphylococcus aureus subsp. aureus MW2
auuguauucgcuuacauu

SEQ ID NO: 4001852 - RNA, 13 nt, Staphylococcus aureus subsp. aureus MW2
auuguauuuuaau

SEQ ID NO: 4001853 - RNA, 19 nt, Staphylococcus aureus subsp. aureus MW2
auuguauuuuucaagcauu

SEQ ID NO: 4001854 - RNA, 16 nt, Staphylococcus aureus subsp. aureus MW2
auugucaauuuaaagu

SEQ ID NO: 4001855 - RNA, 16 nt, Staphylococcus aureus subsp. aureus MW2
auugucaugccuucau

SEQ ID NO: 4001856 - RNA, 15 nt, Staphylococcus aureus subsp. aureus MW2
auugugaaaucuauu

SEQ ID NO: 4001857 - RNA, 16 nt, Staphylococcus aureus subsp. aureus MW2
auugugccauuuguaa

SEQ ID NO: 4001858 - RNA, 14 nt, Staphylococcus aureus subsp. aureus MW2
auugugcuuuuuca

SEQ ID NO: 4001859 - RNA, 15 nt, Staphylococcus aureus subsp. aureus MW2
auuguggaauuaauu

SEQ ID NO: 4001860 - RNA, 18 nt, Staphylococcus aureus subsp. aureus MW2
auuguguccauaaauauu

SEQ ID NO: 4001861 - RNA, 13 nt, Staphylococcus aureus subsp. aureus MW2
auuguuaaacauu

SEQ ID NO: 4001862 - RNA, 19 nt, Staphylococcus aureus subsp. aureus MW2
auuguuaagcccucauuuu

SEQ ID NO: 4001863 - RNA, 14 nt, Staphylococcus aureus subsp. aureus MW2
auuguuaauacaug

SEQ ID NO: 4001864 - RNA, 15 nt, Staphylococcus aureus subsp. aureus MW2
auuguuacuuuaacu

SEQ ID NO: 4001865 - RNA, 19 nt, Staphylococcus aureus subsp. aureus MW2
auuguuagauaaucucauu

SEQ ID NO: 4001866 - RNA, 18 nt, Staphylococcus aureus subsp. aureus MW2
auuguuauacauauauuc

SEQ ID NO: 4001867 - RNA, 22 nt, Staphylococcus aureus subsp. aureus MW2
auuguuauagcguuuaagaaau

SEQ ID NO: 4001868 - RNA, 19 nt, Staphylococcus aureus subsp. aureus MW2
auuguuauccaaaacauuu

SEQ ID NO: 4001869 - RNA, 16 nt, Staphylococcus aureus subsp. aureus MW2
auuguucauguuuaaa

SEQ ID NO: 4001870 - RNA, 19 nt, Staphylococcus aureus subsp. aureus MW2
auuguucauguuuaaaaua

SEQ ID NO: 4001871 - RNA, 14 nt, Staphylococcus aureus subsp. aureus MW2
auuguugauaaaug

SEQ ID NO: 4001872 - RNA, 13 nt, Staphylococcus aureus subsp. aureus MW2
auuguugcaaaau

SEQ ID NO: 4001873 - RNA, 19 nt, Staphylococcus aureus subsp. aureus MW2
auuguugcaaaauacgauu

SEQ ID NO: 4001874 - RNA, 20 nt, Staphylococcus aureus subsp. aureus MW2
auuguugcaaaauacgauuu

SEQ ID NO: 4001875 - RNA, 18 nt, Staphylococcus aureus subsp. aureus MW2
auuguugcaaugauuaau

SEQ ID NO: 4001876 - RNA, 12 nt, Staphylococcus aureus subsp. aureus MW2
auuguugugcuu

SEQ ID NO: 4001877 - RNA, 12 nt, Staphylococcus aureus subsp. aureus MW2
auuguuuaaaca

SEQ ID NO: 4001878 - RNA, 17 nt, Staphylococcus aureus subsp. aureus MW2
auuguuuaauaacaaaa

SEQ ID NO: 4001879 - RNA, 18 nt, Staphylococcus aureus subsp. aureus MW2
auuguuuaauaacaaaau

SEQ ID NO: 4001880 - RNA, 21 nt, Staphylococcus aureus subsp. aureus MW2
auuguuuauuccuucucuauu

SEQ ID NO: 4001881 - RNA, 18 nt, Staphylococcus aureus subsp. aureus MW2
auuguuucaccagcuugu

SEQ ID NO: 4001882 - RNA, 19 nt, Staphylococcus aureus subsp. aureus MW2
auuguuugaaaauuaacua

SEQ ID NO: 4001883 - RNA, 16 nt, Staphylococcus aureus subsp. aureus MW2
auuguuuguagaauuu

SEQ ID NO: 4001884 - RNA, 15 nt, Staphylococcus aureus subsp. aureus MW2
auuguuuguuuuuau

SEQ ID NO: 4001885 - RNA, 20 nt, Staphylococcus aureus subsp. aureus MW2
auuguuuuagcaauuugcug

SEQ ID NO: 4001886 - RNA, 19 nt, Staphylococcus aureus subsp. aureus MW2
auuguuuugagauauuugu

SEQ ID NO: 4001887 - RNA, 13 nt, Staphylococcus aureus subsp. aureus MW2
auuguuuuuaaaa

SEQ ID NO: 4001888 - RNA, 16 nt, Staphylococcus aureus subsp. aureus MW2
auuuaaaaaaauuaau

SEQ ID NO: 4001889 - RNA, 16 nt, Staphylococcus aureus subsp. aureus MW2
auuuaaaaauagccuu

SEQ ID NO: 4001890 - RNA, 22 nt, Staphylococcus aureus subsp. aureus MW2
auuuaaaaauaguucuuuaaau

SEQ ID NO: 4001891 - RNA, 19 nt, Staphylococcus aureus subsp. aureus MW2
auuuaguucgauaacacau

SEQ ID NO: 4001892 - RNA, 15 nt, Staphylococcus aureus subsp. aureus MW2
auuuauaaacaauaa

SEQ ID NO: 4001893 - RNA, 19 nt, Staphylococcus aureus subsp. aureus MW2
auuuauaaacaauuacaaa

SEQ ID NO: 4001894 - RNA, 16 nt, Staphylococcus aureus subsp. aureus MW2
auuuauaaauguuuca

SEQ ID NO: 4001895 - RNA, 21 nt, Staphylococcus aureus subsp. aureus MW2
auuuauaacgacguaauccuu

SEQ ID NO: 4001896 - RNA, 15 nt, Staphylococcus aureus subsp. aureus MW2
auuuauacagugaau

SEQ ID NO: 4001897 - RNA, 14 nt, Staphylococcus aureus subsp. aureus MW2
auuuauacuauaaa

SEQ ID NO: 4001898 - RNA, 15 nt, Staphylococcus aureus subsp. aureus MW2
auuuauacuauaaau

SEQ ID NO: 4001899 - RNA, 16 nt, Staphylococcus aureus subsp. aureus MW2
auuuauacuauaaaua

SEQ ID NO: 4001900 - RNA, 18 nt, Staphylococcus aureus subsp. aureus MW2
auuuauacugaucaaaug

SEQ ID NO: 4001901 - RNA, 19 nt, Staphylococcus aureus subsp. aureus MW2
auuuauauagucuaugaau

SEQ ID NO: 4001902 - RNA, 21 nt, Staphylococcus aureus subsp. aureus MW2
auuuauauagucuaugaauaa

SEQ ID NO: 4001903 - RNA, 17 nt, Staphylococcus aureus subsp. aureus MW2
auuuauauauagaaaua

SEQ ID NO: 4001904 - RNA, 17 nt, Staphylococcus aureus subsp. aureus MW2
auuuauaugauguucaa

SEQ ID NO: 4001905 - RNA, 21 nt, Staphylococcus aureus subsp. aureus MW2
auuuauaugauguucaauauu

SEQ ID NO: 4001906 - RNA, 17 nt, Staphylococcus aureus subsp. aureus MW2
auuuauauuaaauacua

SEQ ID NO: 4001907 - RNA, 14 nt, Staphylococcus aureus subsp. aureus MW2
auuuauauuccauu

SEQ ID NO: 4001908 - RNA, 15 nt, Staphylococcus aureus subsp. aureus MW2
auuuauauuccauuu

SEQ ID NO: 4001909 - RNA, 21 nt, Staphylococcus aureus subsp. aureus MW2
auuuauauuccauuucaaaug

SEQ ID NO: 4001910 - RNA, 17 nt, Staphylococcus aureus subsp. aureus MW2
auuuaucaccuuuaggc

SEQ ID NO: 4001911 - RNA, 16 nt, Staphylococcus aureus subsp. aureus MW2
auuuaucauacuucaa

SEQ ID NO: 4001912 - RNA, 17 nt, Staphylococcus aureus subsp. aureus MW2
auuuaucuuuuaaaauc

SEQ ID NO: 4001913 - RNA, 22 nt, Staphylococcus aureus subsp. aureus MW2
auuuaugcgauucucauuuacu

SEQ ID NO: 4001914 - RNA, 14 nt, Staphylococcus aureus subsp. aureus MW2
auuuauuaauccau

SEQ ID NO: 4001915 - RNA, 22 nt, Staphylococcus aureus subsp. aureus MW2
auuuauuaguugugguuguuaa

SEQ ID NO: 4001916 - RNA, 23 nt, Staphylococcus aureus subsp. aureus MW2
auuuauuaguugugguuguuaau

SEQ ID NO: 4001917 - RNA, 14 nt, Staphylococcus aureus subsp. aureus MW2
auuuauuauaaaau

SEQ ID NO: 4001918 - RNA, 18 nt, Staphylococcus aureus subsp. aureus MW2
auuuauuauaauuguuca

SEQ ID NO: 4001919 - RNA, 15 nt, Staphylococcus aureus subsp. aureus MW2
auuuauuauuaccau

SEQ ID NO: 4001920 - RNA, 19 nt, Staphylococcus aureus subsp. aureus MW2
auuuauuggguaauauuag

SEQ ID NO: 4001921 - RNA, 17 nt, Staphylococcus aureus subsp. aureus MW2
auuuauuguuuuuaaaa

SEQ ID NO: 4001922 - RNA, 18 nt, Staphylococcus aureus subsp. aureus MW2
auuuauuucauauuuaau

SEQ ID NO: 4001923 - RNA, 18 nt, Staphylococcus aureus subsp. aureus MW2
auuuauuuucaauaaaua

SEQ ID NO: 4001924 - RNA, 19 nt, Staphylococcus aureus subsp. aureus MW2
auuuauuuucaauaaauaa

SEQ ID NO: 4001925 - RNA, 15 nt, Staphylococcus aureus subsp. aureus MW2
auuuauuuucuuugg

SEQ ID NO: 4001926 - RNA, 16 nt, Staphylococcus aureus subsp. aureus MW2
auuuauuuucuuuggu

SEQ ID NO: 4001927 - RNA, 13 nt, Staphylococcus aureus subsp. aureus MW2
auuuauuuuuaau

SEQ ID NO: 4001928 - RNA, 14 nt, Staphylococcus aureus subsp. aureus MW2
auuucaaaaaggaa

SEQ ID NO: 4001929 - RNA, 15 nt, Staphylococcus aureus subsp. aureus MW2
auuucaaaaauagcg

SEQ ID NO: 4001930 - RNA, 16 nt, Staphylococcus aureus subsp. aureus MW2
auuucaaauauaaaaa

SEQ ID NO: 4001931 - RNA, 17 nt, Staphylococcus aureus subsp. aureus MW2
auuucaaauauaaaaaa

SEQ ID NO: 4001932 - RNA, 18 nt, Staphylococcus aureus subsp. aureus MW2
auuucaaauguaauuggu

SEQ ID NO: 4001933 - RNA, 20 nt, Staphylococcus aureus subsp. aureus MW2
auuucaacuuuuuaauaaua

SEQ ID NO: 4001934 - RNA, 16 nt, Staphylococcus aureus subsp. aureus MW2
auuucaauccuuuguu

SEQ ID NO: 4001935 - RNA, 20 nt, Staphylococcus aureus subsp. aureus MW2
auuucaaugagaagcugucu

SEQ ID NO: 4001936 - RNA, 13 nt, Staphylococcus aureus subsp. aureus MW2
auuucaauugcau

SEQ ID NO: 4001937 - RNA, 14 nt, Staphylococcus aureus subsp. aureus MW2
auuucaauuuggaa

SEQ ID NO: 4001938 - RNA, 17 nt, Staphylococcus aureus subsp. aureus MW2
auuucaauuuggaaaua

SEQ ID NO: 4001939 - RNA, 18 nt, Staphylococcus aureus subsp. aureus MW2
auuucaauuuggaaauau

SEQ ID NO: 4001940 - RNA, 23 nt, Staphylococcus aureus subsp. aureus MW2
auuucaauuuggaaauaucuuac

SEQ ID NO: 4001941 - RNA, 11 nt, Staphylococcus aureus subsp. aureus MW2
auuucacuuua

SEQ ID NO: 4001942 - RNA, 13 nt, Staphylococcus aureus subsp. aureus MW2
auuucacuuuaac

SEQ ID NO: 4001943 - RNA, 14 nt, Staphylococcus aureus subsp. aureus MW2
auuucacuuuaacu

SEQ ID NO: 4001944 - RNA, 15 nt, Staphylococcus aureus subsp. aureus MW2
auuucacuuuaacuu

SEQ ID NO: 4001945 - RNA, 18 nt, Staphylococcus aureus subsp. aureus MW2
auuucacuuuaacuucuu

SEQ ID NO: 4001946 - RNA, 19 nt, Staphylococcus aureus subsp. aureus MW2
auuucagcuuauuaagcuu

SEQ ID NO: 4001947 - RNA, 20 nt, Staphylococcus aureus subsp. aureus MW2
auuucaggcguuaauacaua

SEQ ID NO: 4001948 - RNA, 21 nt, Staphylococcus aureus subsp. aureus MW2
auuucaguaggacacauaaau

SEQ ID NO: 4001949 - RNA, 22 nt, Staphylococcus aureus subsp. aureus MW2
auuucaguaggacacauaaaug

SEQ ID NO: 4001950 - RNA, 19 nt, Staphylococcus aureus subsp. aureus MW2
auuucaguauauuuuaaca

SEQ ID NO: 4001951 - RNA, 17 nt, Staphylococcus aureus subsp. aureus MW2
auuucauaguguuugua

SEQ ID NO: 4001952 - RNA, 11 nt, Staphylococcus aureus subsp. aureus MW2
auuucaucaaa

SEQ ID NO: 4001953 - RNA, 13 nt, Staphylococcus aureus subsp. aureus MW2
auuucaucaauaa

SEQ ID NO: 4001954 - RNA, 15 nt, Staphylococcus aureus subsp. aureus MW2
auuucaucaauaauu

SEQ ID NO: 4001955 - RNA, 18 nt, Staphylococcus aureus subsp. aureus MW2
auuucaugugcaagcuuu

SEQ ID NO: 4001956 - RNA, 21 nt, Staphylococcus aureus subsp. aureus MW2
auuucaugugcaagcuuuuua

SEQ ID NO: 4001957 - RNA, 16 nt, Staphylococcus aureus subsp. aureus MW2
auuucauuaauuuuuu

SEQ ID NO: 4001958 - RNA, 13 nt, Staphylococcus aureus subsp. aureus MW2
auuucauuuaugc

SEQ ID NO: 4001959 - RNA, 21 nt, Staphylococcus aureus subsp. aureus MW2
auuucauuugaaauaguuaaa

SEQ ID NO: 4001960 - RNA, 12 nt, Staphylococcus aureus subsp. aureus MW2
auuucauuugac

SEQ ID NO: 4001961 - RNA, 13 nt, Staphylococcus aureus subsp. aureus MW2
auuuccacuuuga

SEQ ID NO: 4001962 - RNA, 18 nt, Staphylococcus aureus subsp. aureus MW2
auuucccacgugccucau

SEQ ID NO: 4001963 - RNA, 23 nt, Staphylococcus aureus subsp. aureus MW2
auuuccgaauaaaggucuauaua

SEQ ID NO: 4001964 - RNA, 15 nt, Staphylococcus aureus subsp. aureus MW2
auuuccuauuaggau

SEQ ID NO: 4001965 - RNA, 17 nt, Staphylococcus aureus subsp. aureus MW2
auuuccuauuaggaucc

SEQ ID NO: 4001966 - RNA, 16 nt, Staphylococcus aureus subsp. aureus MW2
auuuccucgguuuuau

SEQ ID NO: 4001967 - RNA, 23 nt, Staphylococcus aureus subsp. aureus MW2
auuuccugaugaggcuaauuuuu

SEQ ID NO: 4001968 - RNA, 18 nt, Staphylococcus aureus subsp. aureus MW2
auuuccuuuagcaaaaau

SEQ ID NO: 4001969 - RNA, 14 nt, Staphylococcus aureus subsp. aureus MW2
auuucgaaaagaaa

SEQ ID NO: 4001970 - RNA, 15 nt, Staphylococcus aureus subsp. aureus MW2
auuucgacuccauua

SEQ ID NO: 4001971 - RNA, 15 nt, Staphylococcus aureus subsp. aureus MW2
auuucgccucaucua

SEQ ID NO: 4001972 - RNA, 22 nt, Staphylococcus aureus subsp. aureus MW2
auuucgccuuuuuuauuuuucu

SEQ ID NO: 4001973 - RNA, 15 nt, Staphylococcus aureus subsp. aureus MW2
auuucggacaauaac

SEQ ID NO: 4001974 - RNA, 19 nt, Staphylococcus aureus subsp. aureus MW2
auuucgucgucccacccca

SEQ ID NO: 4001975 - RNA, 20 nt, Staphylococcus aureus subsp. aureus MW2
auuucguuuuauuaaugaag

SEQ ID NO: 4001976 - RNA, 13 nt, Staphylococcus aureus subsp. aureus MW2
auuucuaaauuau

SEQ ID NO: 4001977 - RNA, 20 nt, Staphylococcus aureus subsp. aureus MW2
auuucuaaauuauuuauuca

SEQ ID NO: 4001978 - RNA, 13 nt, Staphylococcus aureus subsp. aureus MW2
auuucuaauuuag

SEQ ID NO: 4001979 - RNA, 20 nt, Staphylococcus aureus subsp. aureus MW2
auuucuacagacaaugcaag

SEQ ID NO: 4001980 - RNA, 14 nt, Staphylococcus aureus subsp. aureus MW2
auuuuaauauauuu

SEQ ID NO: 4001981 - RNA, 14 nt, Staphylococcus aureus subsp. aureus MW2
auuuuaauauuuuc

SEQ ID NO: 4001982 - RNA, 15 nt, Staphylococcus aureus subsp. aureus MW2
auuuuaauauuuucu

SEQ ID NO: 4001983 - RNA, 20 nt, Staphylococcus aureus subsp. aureus MW2
auuuuaaucauuguuuuaaa

SEQ ID NO: 4001984 - RNA, 22 nt, Staphylococcus aureus subsp. aureus MW2
auuuuaaucauuguuuuaaauu

SEQ ID NO: 4001985 - RNA, 21 nt, Staphylococcus aureus subsp. aureus MW2
auuuuaaugaccuaacuguuu

SEQ ID NO: 4001986 - RNA, 17 nt, Staphylococcus aureus subsp. aureus MW2
auuuuaaugauuuuuca

SEQ ID NO: 4001987 - RNA, 14 nt, Staphylococcus aureus subsp. aureus MW2
auuuuaauuuuuca

SEQ ID NO: 4001988 - RNA, 18 nt, Staphylococcus aureus subsp. aureus MW2
auuuuacaaaaugaugaa

SEQ ID NO: 4001989 - RNA, 17 nt, Staphylococcus aureus subsp. aureus MW2
auuuuacaaucaacuua

SEQ ID NO: 4001990 - RNA, 19 nt, Staphylococcus aureus subsp. aureus MW2
auuuuaccaucaaugagca

SEQ ID NO: 4001991 - RNA, 17 nt, Staphylococcus aureus subsp. aureus MW2
auuuuaccauguuuuac

SEQ ID NO: 4001992 - RNA, 17 nt, Staphylococcus aureus subsp. aureus MW2
auuuuaccuguuucuau

SEQ ID NO: 4001993 - RNA, 21 nt, Staphylococcus aureus subsp. aureus MW2
auuuuaccuguuucuauauua

SEQ ID NO: 4001994 - RNA, 21 nt, Staphylococcus aureus subsp. aureus MW2
auuuuaccuucgcauacuuuu

SEQ ID NO: 4001995 - RNA, 13 nt, Staphylococcus aureus subsp. aureus MW2
auuuuacuuugua

SEQ ID NO: 4001996 - RNA, 20 nt, Staphylococcus aureus subsp. aureus MW2
auuuuagacuacauucuuca

SEQ ID NO: 4001997 - RNA, 21 nt, Staphylococcus aureus subsp. aureus MW2
auuuuagagccccuuacaacu

SEQ ID NO: 4001998 - RNA, 12 nt, Staphylococcus aureus subsp. aureus MW2
auuuuagauuga

SEQ ID NO: 4001999 - RNA, 20 nt, Staphylococcus aureus subsp. aureus MW2
auuuuagcgucauuuuuaau

SEQ ID NO: 4002000 - RNA, 20 nt, Staphylococcus aureus subsp. aureus MW2
auuuuagcucuuguucaagu

SEQ ID NO: 4002001 - RNA, 19 nt, Staphylococcus aureus subsp. aureus MW2
auuuuaggcauuuuagauu

SEQ ID NO: 4002002 - RNA, 21 nt, Staphylococcus aureus subsp. aureus MW2
auuuuagucgucgaaaugccu

SEQ ID NO: 4002003 - RNA, 20 nt, Staphylococcus aureus subsp. aureus MW2
auuuuaguucacaugaauuu

SEQ ID NO: 4002004 - RNA, 16 nt, Staphylococcus aureus subsp. aureus MW2
auuuuauaaaaaguua

SEQ ID NO: 4002005 - RNA, 14 nt, Staphylococcus aureus subsp. aureus MW2
auuuuauaagaauu

SEQ ID NO: 4002006 - RNA, 18 nt, Staphylococcus aureus subsp. aureus MW2
auuuuauaagaauuuaaa

SEQ ID NO: 4002007 - RNA, 21 nt, Staphylococcus aureus subsp. aureus MW2
auuuuauaauaaccuacauua

SEQ ID NO: 4002008 - RNA, 22 nt, Staphylococcus aureus subsp. aureus MW2
auuuuauaauaaccuacauuaa

SEQ ID NO: 4002009 - RNA, 18 nt, Staphylococcus aureus subsp. aureus MW2
auuuuauacauaaauauu

SEQ ID NO: 4002010 - RNA, 14 nt, Staphylococcus aureus subsp. aureus MW2
auuuuauauaaaaa

SEQ ID NO: 4002011 - RNA, 12 nt, Staphylococcus aureus subsp. aureus MW2
auuuuauauauc

SEQ ID NO: 4002012 - RNA, 23 nt, Staphylococcus aureus subsp. aureus MW2
auuuuauauauccuguuucauau

SEQ ID NO: 4002013 - RNA, 14 nt, Staphylococcus aureus subsp. aureus MW2
auuuuauauuuuag

SEQ ID NO: 4002014 - RNA, 12 nt, Staphylococcus aureus subsp. aureus MW2
auuuuaucaucu

SEQ ID NO: 4002015 - RNA, 14 nt, Staphylococcus aureus subsp. aureus MW2
auuuuaucaucuau

SEQ ID NO: 4002016 - RNA, 15 nt, Staphylococcus aureus subsp. aureus MW2
auuuuaucaucuauu

SEQ ID NO: 4002017 - RNA, 20 nt, Staphylococcus aureus subsp. aureus MW2
auuuuaucuaaagcuauaaa

SEQ ID NO: 4002018 - RNA, 22 nt, Staphylococcus aureus subsp. aureus MW2
auuuuaucuaaagcuauaaaaa

SEQ ID NO: 4002019 - RNA, 13 nt, Staphylococcus aureus subsp. aureus MW2
auuuuaucugaau

SEQ ID NO: 4002020 - RNA, 12 nt, Staphylococcus aureus subsp. aureus MW2
auuuuaugauuu

SEQ ID NO: 4002021 - RNA, 18 nt, Staphylococcus aureus subsp. aureus MW2
auuuuaugauuugauuug

SEQ ID NO: 4002022 - RNA, 16 nt, Staphylococcus aureus subsp. aureus MW2
auuuuauggugcuaaa

SEQ ID NO: 4002023 - RNA, 20 nt, Staphylococcus aureus subsp. aureus MW2
auuuuauggugcuaaaaaau

SEQ ID NO: 4002024 - RNA, 22 nt, Staphylococcus aureus subsp. aureus MW2
auuuuauggugcuaaaaaauuu

SEQ ID NO: 4002025 - RNA, 23 nt, Staphylococcus aureus subsp. aureus MW2
auuuuauuaaaucguauauuaaa

SEQ ID NO: 4002026 - RNA, 23 nt, Staphylococcus aureus subsp. aureus MW2
auuuuauugaguaucaugcuuuu

SEQ ID NO: 4002027 - RNA, 14 nt, Staphylococcus aureus subsp. aureus MW2
auuuuauuuugugc

SEQ ID NO: 4002028 - RNA, 16 nt, Staphylococcus aureus subsp. aureus MW2
auuuuauuuuuaaaua

SEQ ID NO: 4002029 - RNA, 13 nt, Staphylococcus aureus subsp. aureus MW2
auuuucaaagcug

SEQ ID NO: 4002030 - RNA, 18 nt, Staphylococcus aureus subsp. aureus MW2
auuuucaaagcugccaaa

SEQ ID NO: 4002031 - RNA, 19 nt, Staphylococcus aureus subsp. aureus MW2
auuuucaaauuucuaacuu

SEQ ID NO: 4002032 - RNA, 23 nt, Staphylococcus aureus subsp. aureus MW2
auuuucaagaccaaauauuuuau

SEQ ID NO: 4002033 - RNA, 18 nt, Staphylococcus aureus subsp. aureus MW2
auuuucaaguuuaaaaua

SEQ ID NO: 4002034 - RNA, 19 nt, Staphylococcus aureus subsp. aureus MW2
auuuucaauaaauuuuaua

SEQ ID NO: 4002035 - RNA, 22 nt, Staphylococcus aureus subsp. aureus MW2
auuuucaauuagaaaauuucuc

SEQ ID NO: 4002036 - RNA, 15 nt, Staphylococcus aureus subsp. aureus MW2
auuuucauauaaaua

SEQ ID NO: 4002037 - RNA, 13 nt, Staphylococcus aureus subsp. aureus MW2
auuuucauuuuag

SEQ ID NO: 4002038 - RNA, 14 nt, Staphylococcus aureus subsp. aureus MW2
auuuucauuuuucu

SEQ ID NO: 4002039 - RNA, 18 nt, Staphylococcus aureus subsp. aureus MW2
auuuucgcaaaauuauuu

SEQ ID NO: 4002040 - RNA, 16 nt, Staphylococcus aureus subsp. aureus MW2
auuuucgggaauuuua

SEQ ID NO: 4002041 - RNA, 18 nt, Staphylococcus aureus subsp. aureus MW2
auuuucuaaagauauaag

SEQ ID NO: 4002042 - RNA, 17 nt, Staphylococcus aureus subsp. aureus MW2
auuuucuguccaaaaag

SEQ ID NO: 4002043 - RNA, 20 nt, Staphylococcus aureus subsp. aureus MW2
auuuucuuagaaaaucaagu

SEQ ID NO: 4002044 - RNA, 20 nt, Staphylococcus aureus subsp. aureus MW2
auuuucuucaccaguuucug

SEQ ID NO: 4002045 - RNA, 17 nt, Staphylococcus aureus subsp. aureus MW2
auuuucuugccaucaau

SEQ ID NO: 4002046 - RNA, 21 nt, Staphylococcus aureus subsp. aureus MW2
auuuucuuuuuuuauggauuu

SEQ ID NO: 4002047 - RNA, 11 nt, Staphylococcus aureus subsp. aureus MW2
auuuugaagaa

SEQ ID NO: 4002048 - RNA, 20 nt, Staphylococcus aureus subsp. aureus MW2
auuuugacguuuuagacaua

SEQ ID NO: 4002049 - RNA, 13 nt, Staphylococcus aureus subsp. aureus MW2
auuuugagaaaau

SEQ ID NO: 4002050 - RNA, 19 nt, Staphylococcus aureus subsp. aureus MW2
auuuugagacaaaaaauga

SEQ ID NO: 4002051 - RNA, 21 nt, Staphylococcus aureus subsp. aureus MW2
auuuugagcuaaccacaucau

SEQ ID NO: 4002052 - RNA, 22 nt, Staphylococcus aureus subsp. aureus MW2
auuuugagucguagauacuacc

SEQ ID NO: 4002053 - RNA, 15 nt, Staphylococcus aureus subsp. aureus MW2
auuuugauauaaaaa

SEQ ID NO: 4002054 - RNA, 18 nt, Staphylococcus aureus subsp. aureus MW2
auuuugauauuuuucacg

SEQ ID NO: 4002055 - RNA, 22 nt, Staphylococcus aureus subsp. aureus MW2
auuuugcgaaaauaucauuucu

SEQ ID NO: 4002056 - RNA, 21 nt, Staphylococcus aureus subsp. aureus MW2
auuuugcugccaaaaaguauu

SEQ ID NO: 4002057 - RNA, 17 nt, Staphylococcus aureus subsp. aureus MW2
auuuugcuuuaaacauu

SEQ ID NO: 4002058 - RNA, 18 nt, Staphylococcus aureus subsp. aureus MW2
auuuugcuuuaaacauug

SEQ ID NO: 4002059 - RNA, 17 nt, Staphylococcus aureus subsp. aureus MW2
auuuugcuuuauuuucu

SEQ ID NO: 4002060 - RNA, 16 nt, Staphylococcus aureus subsp. aureus MW2
auuuuggcaaaagcuu

SEQ ID NO: 4002061 - RNA, 15 nt, Staphylococcus aureus subsp. aureus MW2
auuuuguaaccugau

SEQ ID NO: 4002062 - RNA, 20 nt, Staphylococcus aureus subsp. aureus MW2
auuuuguaagcucaugaauc

SEQ ID NO: 4002063 - RNA, 16 nt, Staphylococcus aureus subsp. aureus MW2
auuuuguauuagcauc

SEQ ID NO: 4002064 - RNA, 15 nt, Staphylococcus aureus subsp. aureus MW2
auuuuguauuuuuca

SEQ ID NO: 4002065 - RNA, 17 nt, Staphylococcus aureus subsp. aureus MW2
auuuuguauuuuucaaa

SEQ ID NO: 4002066 - RNA, 23 nt, Staphylococcus aureus subsp. aureus MW2
auuuuguauuuuucaaauaaaga

SEQ ID NO: 4002067 - RNA, 17 nt, Staphylococcus aureus subsp. aureus MW2
auuuugucuuuuauauu

SEQ ID NO: 4002068 - RNA, 18 nt, Staphylococcus aureus subsp. aureus MW2
caaaacgcauuucaugug

SEQ ID NO: 4002069 - RNA, 20 nt, Staphylococcus aureus subsp. aureus MW2
caaaacgcauuucauguguc

SEQ ID NO: 4002070 - RNA, 16 nt, Staphylococcus aureus subsp. aureus MW2
caaaacguuugaagaa

SEQ ID NO: 4002071 - RNA, 22 nt, Staphylococcus aureus subsp. aureus MW2
caaaacuagcaguaauauguug

SEQ ID NO: 4002072 - RNA, 14 nt, Staphylococcus aureus subsp. aureus MW2
caaaacuuaaaaua

SEQ ID NO: 4002073 - RNA, 16 nt, Staphylococcus aureus subsp. aureus MW2
caaaacuugcgcaugc

SEQ ID NO: 4002074 - RNA, 12 nt, Staphylococcus aureus subsp. aureus MW2
caaaagaugaaa

SEQ ID NO: 4002075 - RNA, 23 nt, Staphylococcus aureus subsp. aureus MW2
caaaagauguuucaaaauaauuu

SEQ ID NO: 4002076 - RNA, 20 nt, Staphylococcus aureus subsp. aureus MW2
caaaaggauaagaacgagaa

SEQ ID NO: 4002077 - RNA, 21 nt, Staphylococcus aureus subsp. aureus MW2
caaaaguaugauuuguuugau

SEQ ID NO: 4002078 - RNA, 20 nt, Staphylococcus aureus subsp. aureus MW2
caaaagugguuguucccauu

SEQ ID NO: 4002079 - RNA, 21 nt, Staphylococcus aureus subsp. aureus MW2
caaaauaacauguuuguggca

SEQ ID NO: 4002080 - RNA, 19 nt, Staphylococcus aureus subsp. aureus MW2
caaaauaaugauacuaaua

SEQ ID NO: 4002081 - RNA, 24 nt, Staphylococcus aureus subsp. aureus MW2
caaaauacucaacacgauagucau

SEQ ID NO: 4002082 - RNA, 14 nt, Staphylococcus aureus subsp. aureus MW2
caaaauauaaaauc

SEQ ID NO: 4002083 - RNA, 15 nt, Staphylococcus aureus subsp. aureus MW2
caaaauauacuaaau

SEQ ID NO: 4002084 - RNA, 20 nt, Staphylococcus aureus subsp. aureus MW2
caaaauauacuaaauuugaa

SEQ ID NO: 4002085 - RNA, 15 nt, Staphylococcus aureus subsp. aureus MW2
caaaaucuuacauug

SEQ ID NO: 4002086 - RNA, 15 nt, Staphylococcus aureus subsp. aureus MW2
caaaaucuuuacuug

SEQ ID NO: 4002087 - RNA, 15 nt, Staphylococcus aureus subsp. aureus MW2
caaaaugauugguaa

SEQ ID NO: 4002088 - RNA, 23 nt, Staphylococcus aureus subsp. aureus MW2
caaaaugccaagaagacauugga

SEQ ID NO: 4002089 - RNA, 22 nt, Staphylococcus aureus subsp. aureus MW2
caaaaugguuaaaaucgcagca

SEQ ID NO: 4002090 - RNA, 21 nt, Staphylococcus aureus subsp. aureus MW2
caaaaugguuauauaaacaaa

SEQ ID NO: 4002091 - RNA, 17 nt, Staphylococcus aureus subsp. aureus MW2
caaaauuauguaaaaaa

SEQ ID NO: 4002092 - RNA, 17 nt, Staphylococcus aureus subsp. aureus MW2
caaaauugaacuuugua

SEQ ID NO: 4002093 - RNA, 12 nt, Staphylococcus aureus subsp. aureus MW2
caaaauugucuc

SEQ ID NO: 4002094 - RNA, 17 nt, Staphylococcus aureus subsp. aureus MW2
caaaauuuccacuuuga

SEQ ID NO: 4002095 - RNA, 20 nt, Staphylococcus aureus subsp. aureus MW2
caaaauuuugacuauucuca

SEQ ID NO: 4002096 - RNA, 18 nt, Staphylococcus aureus subsp. aureus MW2
caaaauuuugcaaaaaaa

SEQ ID NO: 4002097 - RNA, 18 nt, Staphylococcus aureus subsp. aureus MW2
caaacaaagcucaauaaa

SEQ ID NO: 4002098 - RNA, 16 nt, Staphylococcus aureus subsp. aureus MW2
caaacaacaaucaaau

SEQ ID NO: 4002099 - RNA, 22 nt, Staphylococcus aureus subsp. aureus MW2
caaacaacaucacuuuaggguu

SEQ ID NO: 4002100 - RNA, 22 nt, Staphylococcus aureus subsp. aureus MW2
caaacaaccugugauaaaaauc

SEQ ID NO: 4002101 - RNA, 19 nt, Staphylococcus aureus subsp. aureus MW2
caaacaagcuagaaacaca

SEQ ID NO: 4002102 - RNA, 12 nt, Staphylococcus aureus subsp. aureus MW2
caaacaauacau

SEQ ID NO: 4002103 - RNA, 14 nt, Staphylococcus aureus subsp. aureus MW2
caaacaaugcaagu

SEQ ID NO: 4002104 - RNA, 18 nt, Staphylococcus aureus subsp. aureus MW2
caaacacaguacaaauaa

SEQ ID NO: 4002105 - RNA, 22 nt, Staphylococcus aureus subsp. aureus MW2
caaacacugccaauauaacauu

SEQ ID NO: 4002106 - RNA, 13 nt, Staphylococcus aureus subsp. aureus MW2
caaacauaaucau

SEQ ID NO: 4002107 - RNA, 14 nt, Staphylococcus aureus subsp. aureus MW2
caaacauagagaau

SEQ ID NO: 4002108 - RNA, 12 nt, Staphylococcus aureus subsp. aureus MW2
caaacauuuguu

SEQ ID NO: 4002109 - RNA, 16 nt, Staphylococcus aureus subsp. aureus MW2
caaaccauuaauaaaa

SEQ ID NO: 4002110 - RNA, 21 nt, Staphylococcus aureus subsp. aureus MW2
caaaccggucuauaacaccau

SEQ ID NO: 4002111 - RNA, 23 nt, Staphylococcus aureus subsp. aureus MW2
caaacgaaggucuacuaaauaac

SEQ ID NO: 4002112 - RNA, 16 nt, Staphylococcus aureus subsp. aureus MW2
caaacguuuucacuuc

SEQ ID NO: 4002113 - RNA, 16 nt, Staphylococcus aureus subsp. aureus MW2
caaacugauuuuuuau

SEQ ID NO: 4002114 - RNA, 18 nt, Staphylococcus aureus subsp. aureus MW2
caaacugccuaauacacu

SEQ ID NO: 4002115 - RNA, 23 nt, Staphylococcus aureus subsp. aureus MW2
caaagaaaaacaucgauugauaa

SEQ ID NO: 4002116 - RNA, 19 nt, Staphylococcus aureus subsp. aureus MW2
caaagaaacggaaaugacu

SEQ ID NO: 4002117 - RNA, 20 nt, Staphylococcus aureus subsp. aureus MW2
caaagaaccacgcaucaugu

SEQ ID NO: 4002118 - RNA, 21 nt, Staphylococcus aureus subsp. aureus MW2
caaagacucaauuucauuuga

SEQ ID NO: 4002119 - RNA, 17 nt, Staphylococcus aureus subsp. aureus MW2
caaagaggcuuuaaaau

SEQ ID NO: 4002120 - RNA, 19 nt, Staphylococcus aureus subsp. aureus MW2
caaagauuauugaaauuug

SEQ ID NO: 4002121 - RNA, 21 nt, Staphylococcus aureus subsp. aureus MW2
caaagcacaccuaauucauau

SEQ ID NO: 4002122 - RNA, 19 nt, Staphylococcus aureus subsp. aureus MW2
caaagcuaaguuugaagga

SEQ ID NO: 4002123 - RNA, 16 nt, Staphylococcus aureus subsp. aureus MW2
caaagcuugauuuaac

SEQ ID NO: 4002124 - RNA, 18 nt, Staphylococcus aureus subsp. aureus MW2
caaagcuugauuuaacaa

SEQ ID NO: 4002125 - RNA, 18 nt, Staphylococcus aureus subsp. aureus MW2
caaaggacgucuuuuuag

SEQ ID NO: 4002126 - RNA, 13 nt, Staphylococcus aureus subsp. aureus MW2
caaaggauauuga

SEQ ID NO: 4002127 - RNA, 15 nt, Staphylococcus aureus subsp. aureus MW2
caaaggauauugaaa

SEQ ID NO: 4002128 - RNA, 23 nt, Staphylococcus aureus subsp. aureus MW2
caaagguuuacuauuaaaggaaa

SEQ ID NO: 4002129 - RNA, 13 nt, Staphylococcus aureus subsp. aureus MW2
caaagguuuguaa

SEQ ID NO: 4002130 - RNA, 19 nt, Staphylococcus aureus subsp. aureus MW2
caaaguaccaucucuauuu

SEQ ID NO: 4002131 - RNA, 13 nt, Staphylococcus aureus subsp. aureus MW2
caaaguagacauu

SEQ ID NO: 4002132 - RNA, 17 nt, Staphylococcus aureus subsp. aureus MW2
caaagucauuaaaugua

SEQ ID NO: 4002133 - RNA, 17 nt, Staphylococcus aureus subsp. aureus MW2
caaagucucuaguaucu

SEQ ID NO: 4002134 - RNA, 17 nt, Staphylococcus aureus subsp. aureus MW2
caaaguuuauacuuaau

SEQ ID NO: 4002135 - RNA, 12 nt, Staphylococcus aureus subsp. aureus MW2
caaaguuuucau

SEQ ID NO: 4002136 - RNA, 18 nt, Staphylococcus aureus subsp. aureus MW2
caaauaaaaaaaccguua

SEQ ID NO: 4002137 - RNA, 19 nt, Staphylococcus aureus subsp. aureus MW2
caaauaaaacgcuucauau

SEQ ID NO: 4002138 - RNA, 16 nt, Staphylococcus aureus subsp. aureus MW2
caaauaaaagcaacaa

SEQ ID NO: 4002139 - RNA, 17 nt, Staphylococcus aureus subsp. aureus MW2
caaauaaacacaucuau

SEQ ID NO: 4002140 - RNA, 19 nt, Staphylococcus aureus subsp. aureus MW2
caaauaaacacaucuaugu

SEQ ID NO: 4002141 - RNA, 19 nt, Staphylococcus aureus subsp. aureus MW2
caaauaaauaagugauaaa

SEQ ID NO: 4002142 - RNA, 14 nt, Staphylococcus aureus subsp. aureus MW2
caaauaaaucaaac

SEQ ID NO: 4002143 - RNA, 18 nt, Staphylococcus aureus subsp. aureus MW2
caaauaaaucaaacuuuu

SEQ ID NO: 4002144 - RNA, 12 nt, Staphylococcus aureus subsp. aureus MW2
caaauaaauguc

SEQ ID NO: 4002145 - RNA, 15 nt, Staphylococcus aureus subsp. aureus MW2
caaauaaauuuugac

SEQ ID NO: 4002146 - RNA, 13 nt, Staphylococcus aureus subsp. aureus MW2
caaauaaugaaua

SEQ ID NO: 4002147 - RNA, 19 nt, Staphylococcus aureus subsp. aureus MW2
caaauacaguuguaccaau

SEQ ID NO: 4002148 - RNA, 15 nt, Staphylococcus aureus subsp. aureus MW2
caaauacaucaauuu

SEQ ID NO: 4002149 - RNA, 17 nt, Staphylococcus aureus subsp. aureus MW2
caaauacaucaauuucu

SEQ ID NO: 4002150 - RNA, 16 nt, Staphylococcus aureus subsp. aureus MW2
caaauacauuucaaaa

SEQ ID NO: 4002151 - RNA, 15 nt, Staphylococcus aureus subsp. aureus MW2
caaauacuaguaaua

SEQ ID NO: 4002152 - RNA, 18 nt, Staphylococcus aureus subsp. aureus MW2
caaauacuaguaauaaua

SEQ ID NO: 4002153 - RNA, 17 nt, Staphylococcus aureus subsp. aureus MW2
caaauauaauguauaaa

SEQ ID NO: 4002154 - RNA, 21 nt, Staphylococcus aureus subsp. aureus MW2
caaauauacuugccuucaaau

SEQ ID NO: 4002155 - RNA, 18 nt, Staphylococcus aureus subsp. aureus MW2
caaauaucauuuguacaa

SEQ ID NO: 4002156 - RNA, 13 nt, Staphylococcus aureus subsp. aureus MW2
caaccaauuauua

SEQ ID NO: 4002157 - RNA, 18 nt, Staphylococcus aureus subsp. aureus MW2
caaccagucagaaagaau

SEQ ID NO: 4002158 - RNA, 15 nt, Staphylococcus aureus subsp. aureus MW2
caaccuaaaauauug

SEQ ID NO: 4002159 - RNA, 14 nt, Staphylococcus aureus subsp. aureus MW2
caaccuaucacgau

SEQ ID NO: 4002160 - RNA, 15 nt, Staphylococcus aureus subsp. aureus MW2
caaccuaucacgauu

SEQ ID NO: 4002161 - RNA, 21 nt, Staphylococcus aureus subsp. aureus MW2
caaccuaugguuacccuuuuu

SEQ ID NO: 4002162 - RNA, 22 nt, Staphylococcus aureus subsp. aureus MW2
caaccuauuaauugaaaugaua

SEQ ID NO: 4002163 - RNA, 18 nt, Staphylococcus aureus subsp. aureus MW2
caaccugugauaaaaauc

SEQ ID NO: 4002164 - RNA, 22 nt, Staphylococcus aureus subsp. aureus MW2
caaccuguucuuuauuuaaagg

SEQ ID NO: 4002165 - RNA, 20 nt, Staphylococcus aureus subsp. aureus MW2
caaccuuaauaggauaugcu

SEQ ID NO: 4002166 - RNA, 18 nt, Staphylococcus aureus subsp. aureus MW2
caacgucaucugcuugua

SEQ ID NO: 4002167 - RNA, 15 nt, Staphylococcus aureus subsp. aureus MW2
caacuaaaucaccau

SEQ ID NO: 4002168 - RNA, 14 nt, Staphylococcus aureus subsp. aureus MW2
caacuaaauuuucu

SEQ ID NO: 4002169 - RNA, 18 nt, Staphylococcus aureus subsp. aureus MW2
caacuaauaugauugguu

SEQ ID NO: 4002170 - RNA, 18 nt, Staphylococcus aureus subsp. aureus MW2
caacuaauguuaaaauaa

SEQ ID NO: 4002171 - RNA, 21 nt, Staphylococcus aureus subsp. aureus MW2
caacuacugcuaaaauaaaau

SEQ ID NO: 4002172 - RNA, 21 nt, Staphylococcus aureus subsp. aureus MW2
caacuacugucaauauaacau

SEQ ID NO: 4002173 - RNA, 19 nt, Staphylococcus aureus subsp. aureus MW2
caacugauaauugaugugc

SEQ ID NO: 4002174 - RNA, 17 nt, Staphylococcus aureus subsp. aureus MW2
caacugaucauuuucau

SEQ ID NO: 4002175 - RNA, 16 nt, Staphylococcus aureus subsp. aureus MW2
caacugaugaaaaggu

SEQ ID NO: 4002176 - RNA, 19 nt, Staphylococcus aureus subsp. aureus MW2
caacugcauauaaagucau

SEQ ID NO: 4002177 - RNA, 16 nt, Staphylococcus aureus subsp. aureus MW2
caacugcgacaugucc

SEQ ID NO: 4002178 - RNA, 14 nt, Staphylococcus aureus subsp. aureus MW2
caacugcuuuuuau

SEQ ID NO: 4002179 - RNA, 16 nt, Staphylococcus aureus subsp. aureus MW2
caacugcuuuuuauua

SEQ ID NO: 4002180 - RNA, 20 nt, Staphylococcus aureus subsp. aureus MW2
caacuguaguggaagacaau

SEQ ID NO: 4002181 - RNA, 18 nt, Staphylococcus aureus subsp. aureus MW2
caacugucgguucaucua

SEQ ID NO: 4002182 - RNA, 16 nt, Staphylococcus aureus subsp. aureus MW2
caacuguucuaaaauu

SEQ ID NO: 4002183 - RNA, 22 nt, Staphylococcus aureus subsp. aureus MW2
caacuuaauaaccauguaaaau

SEQ ID NO: 4002184 - RNA, 11 nt, Staphylococcus aureus subsp. aureus MW2
caacuuaauac

SEQ ID NO: 4002185 - RNA, 18 nt, Staphylococcus aureus subsp. aureus MW2
caacuuaauacgauaaua

SEQ ID NO: 4002186 - RNA, 22 nt, Staphylococcus aureus subsp. aureus MW2
caacuuaauacgauaauaacua

SEQ ID NO: 4002187 - RNA, 17 nt, Staphylococcus aureus subsp. aureus MW2
caacuuagaauuuacaa

SEQ ID NO: 4002188 - RNA, 15 nt, Staphylococcus aureus subsp. aureus MW2
caacuuauaauauua

SEQ ID NO: 4002189 - RNA, 13 nt, Staphylococcus aureus subsp. aureus MW2
caacuuauuauuu

SEQ ID NO: 4002190 - RNA, 14 nt, Staphylococcus aureus subsp. aureus MW2
caacuucaucuaaa

SEQ ID NO: 4002191 - RNA, 12 nt, Staphylococcus aureus subsp. aureus MW2
caacuucuuuug

SEQ ID NO: 4002192 - RNA, 15 nt, Staphylococcus aureus subsp. aureus MW2
caacuugcacauuau

SEQ ID NO: 4002193 - RNA, 21 nt, Staphylococcus aureus subsp. aureus MW2
caacuugcacauuauuguaac

SEQ ID NO: 4002194 - RNA, 13 nt, Staphylococcus aureus subsp. aureus MW2
caacuugucuacc

SEQ ID NO: 4002195 - RNA, 23 nt, Staphylococcus aureus subsp. aureus MW2
caacuugucuaccgaaugaguuu

SEQ ID NO: 4002196 - RNA, 17 nt, Staphylococcus aureus subsp. aureus MW2
caacuugugguuggaag

SEQ ID NO: 4002197 - RNA, 22 nt, Staphylococcus aureus subsp. aureus MW2
caacuugugguuggaagucugc

SEQ ID NO: 4002198 - RNA, 23 nt, Staphylococcus aureus subsp. aureus MW2
caacuugugguuggaagucugcu

SEQ ID NO: 4002199 - RNA, 15 nt, Staphylococcus aureus subsp. aureus MW2
caacuuuaaauguuu

SEQ ID NO: 4002200 - RNA, 14 nt, Staphylococcus aureus subsp. aureus MW2
caacuuuaguuguu

SEQ ID NO: 4002201 - RNA, 24 nt, Staphylococcus aureus subsp. aureus MW2
caacuuuuuaauaauacuucuaau

SEQ ID NO: 4002202 - RNA, 16 nt, Staphylococcus aureus subsp. aureus MW2
caacuuuuuuaacagc

SEQ ID NO: 4002203 - RNA, 23 nt, Staphylococcus aureus subsp. aureus MW2
caacuuuuuuaacagcugcaguc

SEQ ID NO: 4002204 - RNA, 19 nt, Staphylococcus aureus subsp. aureus MW2
caacuuuuuuaacuuuaac

SEQ ID NO: 4002205 - RNA, 21 nt, Staphylococcus aureus subsp. aureus MW2
caacuuuuuuagguguaaaau

SEQ ID NO: 4002206 - RNA, 20 nt, Staphylococcus aureus subsp. aureus MW2
caagaaacaauucauuaaua

SEQ ID NO: 4002207 - RNA, 23 nt, Staphylococcus aureus subsp. aureus MW2
caagaauuauggcagauccauaa

SEQ ID NO: 4002208 - RNA, 14 nt, Staphylococcus aureus subsp. aureus MW2
caagacgaacauca

SEQ ID NO: 4002209 - RNA, 19 nt, Staphylococcus aureus subsp. aureus MW2
caagacucccuuuuuaaaa

SEQ ID NO: 4002210 - RNA, 14 nt, Staphylococcus aureus subsp. aureus MW2
caagagauaagaaa

SEQ ID NO: 4002211 - RNA, 22 nt, Staphylococcus aureus subsp. aureus MW2
caagagccuuguuggcuuuuuu

SEQ ID NO: 4002212 - RNA, 16 nt, Staphylococcus aureus subsp. aureus MW2
caagagguaaaucugu

SEQ ID NO: 4002213 - RNA, 21 nt, Staphylococcus aureus subsp. aureus MW2
caagagguaaaucuguuuaaa

SEQ ID NO: 4002214 - RNA, 14 nt, Staphylococcus aureus subsp. aureus MW2
caagauaaaucauc

SEQ ID NO: 4002215 - RNA, 18 nt, Staphylococcus aureus subsp. aureus MW2
caagauuaugacaacaua

SEQ ID NO: 4002216 - RNA, 21 nt, Staphylococcus aureus subsp. aureus MW2
caagauuaugacaacauaaca

SEQ ID NO: 4002217 - RNA, 13 nt, Staphylococcus aureus subsp. aureus MW2
caagcaaucuuag

SEQ ID NO: 4002218 - RNA, 15 nt, Staphylococcus aureus subsp. aureus MW2
caagccguugguugu

SEQ ID NO: 4002219 - RNA, 14 nt, Staphylococcus aureus subsp. aureus MW2
caagcuuuauaaaa

SEQ ID NO: 4002220 - RNA, 21 nt, Staphylococcus aureus subsp. aureus MW2
caagcuuugcugcuuuuccau

SEQ ID NO: 4002221 - RNA, 16 nt, Staphylococcus aureus subsp. aureus MW2
caagcuuuuuaggaau

SEQ ID NO: 4002222 - RNA, 17 nt, Staphylococcus aureus subsp. aureus MW2
caagcuuuuuaggaaug

SEQ ID NO: 4002223 - RNA, 15 nt, Staphylococcus aureus subsp. aureus MW2
caaggagaugauaac

SEQ ID NO: 4002224 - RNA, 18 nt, Staphylococcus aureus subsp. aureus MW2
caaggauguuauaaaaug

SEQ ID NO: 4002225 - RNA, 22 nt, Staphylococcus aureus subsp. aureus MW2
caaggcauauccgaaaauugcu

SEQ ID NO: 4002226 - RNA, 15 nt, Staphylococcus aureus subsp. aureus MW2
caagguuuucgccaa

SEQ ID NO: 4002227 - RNA, 13 nt, Staphylococcus aureus subsp. aureus MW2
caaguaaauguuu

SEQ ID NO: 4002228 - RNA, 18 nt, Staphylococcus aureus subsp. aureus MW2
caaguaacucaagugauu

SEQ ID NO: 4002229 - RNA, 12 nt, Staphylococcus aureus subsp. aureus MW2
caaguauagacc

SEQ ID NO: 4002230 - RNA, 20 nt, Staphylococcus aureus subsp. aureus MW2
caaguaugagacgcauugca

SEQ ID NO: 4002231 - RNA, 14 nt, Staphylococcus aureus subsp. aureus MW2
caagucgcaucgua

SEQ ID NO: 4002232 - RNA, 17 nt, Staphylococcus aureus subsp. aureus MW2
caagucuaguucgaaca

SEQ ID NO: 4002233 - RNA, 18 nt, Staphylococcus aureus subsp. aureus MW2
caagucuucuaaaaaauc

SEQ ID NO: 4002234 - RNA, 14 nt, Staphylococcus aureus subsp. aureus MW2
caagugcagauguu

SEQ ID NO: 4002235 - RNA, 17 nt, Staphylococcus aureus subsp. aureus MW2
caagugguaaaaaugaa

SEQ ID NO: 4002236 - RNA, 18 nt, Staphylococcus aureus subsp. aureus MW2
caaguguaucgcccauac

SEQ ID NO: 4002237 - RNA, 16 nt, Staphylococcus aureus subsp. aureus MW2
caaguuacgauaucau

SEQ ID NO: 4002238 - RNA, 18 nt, Staphylococcus aureus subsp. aureus MW2
caaguuacgauaucauac

SEQ ID NO: 4002239 - RNA, 20 nt, Staphylococcus aureus subsp. aureus MW2
caaguucaccguaaucuuuu

SEQ ID NO: 4002240 - RNA, 22 nt, Staphylococcus aureus subsp. aureus MW2
caaguugauaaugucuuacuug

SEQ ID NO: 4002241 - RNA, 17 nt, Staphylococcus aureus subsp. aureus MW2
caaguugcacauuauaa

SEQ ID NO: 4002242 - RNA, 19 nt, Staphylococcus aureus subsp. aureus MW2
caaguugcugaauaaaaua

SEQ ID NO: 4002243 - RNA, 16 nt, Staphylococcus aureus subsp. aureus MW2
caaguuggcggggccc

SEQ ID NO: 4002244 - RNA, 15 nt, Staphylococcus aureus subsp. aureus MW2
caaucuauuuuaaac

SEQ ID NO: 4002245 - RNA, 12 nt, Staphylococcus aureus subsp. aureus MW2
caaucuuuuuaa

SEQ ID NO: 4002246 - RNA, 20 nt, Staphylococcus aureus subsp. aureus MW2
caaugaaaacagguggaagu

SEQ ID NO: 4002247 - RNA, 16 nt, Staphylococcus aureus subsp. aureus MW2
caaugaauccaaauau

SEQ ID NO: 4002248 - RNA, 21 nt, Staphylococcus aureus subsp. aureus MW2
caaugaauccaaauauuaaaa

SEQ ID NO: 4002249 - RNA, 17 nt, Staphylococcus aureus subsp. aureus MW2
caaugaauucauuuuau

SEQ ID NO: 4002250 - RNA, 15 nt, Staphylococcus aureus subsp. aureus MW2
caaugacugagaaaa

SEQ ID NO: 4002251 - RNA, 19 nt, Staphylococcus aureus subsp. aureus MW2
caaugacugagaaaaauau

SEQ ID NO: 4002252 - RNA, 22 nt, Staphylococcus aureus subsp. aureus MW2
caaugacuuaacaucuuuuuca

SEQ ID NO: 4002253 - RNA, 17 nt, Staphylococcus aureus subsp. aureus MW2
caaugauaccuuuaaau

SEQ ID NO: 4002254 - RNA, 11 nt, Staphylococcus aureus subsp. aureus MW2
caaugauuaau

SEQ ID NO: 4002255 - RNA, 18 nt, Staphylococcus aureus subsp. aureus MW2
caaugauuuuuaaaaaua

SEQ ID NO: 4002256 - RNA, 17 nt, Staphylococcus aureus subsp. aureus MW2
caaugcaaguuggcggg

SEQ ID NO: 4002257 - RNA, 14 nt, Staphylococcus aureus subsp. aureus MW2
caaugcaaguuggg

SEQ ID NO: 4002258 - RNA, 19 nt, Staphylococcus aureus subsp. aureus MW2
caaugccacaucauagcac

SEQ ID NO: 4002259 - RNA, 16 nt, Staphylococcus aureus subsp. aureus MW2
caaugcgcaaugaaaa

SEQ ID NO: 4002260 - RNA, 14 nt, Staphylococcus aureus subsp. aureus MW2
caaugcuaucaugc

SEQ ID NO: 4002261 - RNA, 17 nt, Staphylococcus aureus subsp. aureus MW2
caaugcugauaccuaag

SEQ ID NO: 4002262 - RNA, 16 nt, Staphylococcus aureus subsp. aureus MW2
caauguagcaauuuuc

SEQ ID NO: 4002263 - RNA, 13 nt, Staphylococcus aureus subsp. aureus MW2
caauguauuaccu

SEQ ID NO: 4002264 - RNA, 13 nt, Staphylococcus aureus subsp. aureus MW2
caaugucaucuug

SEQ ID NO: 4002265 - RNA, 17 nt, Staphylococcus aureus subsp. aureus MW2
caaugucuacuuugaag

SEQ ID NO: 4002266 - RNA, 24 nt, Staphylococcus aureus subsp. aureus MW2
caaugucuugauugaauaugugua

SEQ ID NO: 4002267 - RNA, 16 nt, Staphylococcus aureus subsp. aureus MW2
caauguuaucuugcuu

SEQ ID NO: 4002268 - RNA, 14 nt, Staphylococcus aureus subsp. aureus MW2
caauguucaauuca

SEQ ID NO: 4002269 - RNA, 13 nt, Staphylococcus aureus subsp. aureus MW2
caauguugcuugu

SEQ ID NO: 4002270 - RNA, 16 nt, Staphylococcus aureus subsp. aureus MW2
caauguuuaauuuucu

SEQ ID NO: 4002271 - RNA, 14 nt, Staphylococcus aureus subsp. aureus MW2
caauguuuuacuug

SEQ ID NO: 4002272 - RNA, 15 nt, Staphylococcus aureus subsp. aureus MW2
caauuaaaacuauaa

SEQ ID NO: 4002273 - RNA, 19 nt, Staphylococcus aureus subsp. aureus MW2
caauuaaaacuauaauaaa

SEQ ID NO: 4002274 - RNA, 15 nt, Staphylococcus aureus subsp. aureus MW2
caauuaaagugaaua

SEQ ID NO: 4002275 - RNA, 19 nt, Staphylococcus aureus subsp. aureus MW2
caauuaacuugauaucauc

SEQ ID NO: 4002276 - RNA, 22 nt, Staphylococcus aureus subsp. aureus MW2
caauuaaucggaucauuauuua

SEQ ID NO: 4002277 - RNA, 17 nt, Staphylococcus aureus subsp. aureus MW2
caauuaaugauaaaccg

SEQ ID NO: 4002278 - RNA, 16 nt, Staphylococcus aureus subsp. aureus MW2
caauuaaugcaucagu

SEQ ID NO: 4002279 - RNA, 18 nt, Staphylococcus aureus subsp. aureus MW2
caauuaauguaaugauac

SEQ ID NO: 4002280 - RNA, 17 nt, Staphylococcus aureus subsp. aureus MW2
caauuaauuacuguaaa

SEQ ID NO: 4002281 - RNA, 22 nt, Staphylococcus aureus subsp. aureus MW2
caauuaauuuagucauuacaaa

SEQ ID NO: 4002282 - RNA, 19 nt, Staphylococcus aureus subsp. aureus MW2
caauuagaaaauuucucac

SEQ ID NO: 4002283 - RNA, 22 nt, Staphylococcus aureus subsp. aureus MW2
caauuagccccaguauagaagc

SEQ ID NO: 4002284 - RNA, 17 nt, Staphylococcus aureus subsp. aureus MW2
caauuauaaaugauuaa

SEQ ID NO: 4002285 - RNA, 12 nt, Staphylococcus aureus subsp. aureus MW2
caauuauggaua

SEQ ID NO: 4002286 - RNA, 18 nt, Staphylococcus aureus subsp. aureus MW2
caauuauuauugcuguga

SEQ ID NO: 4002287 - RNA, 13 nt, Staphylococcus aureus subsp. aureus MW2
caauuauuucauc

SEQ ID NO: 4002288 - RNA, 23 nt, Staphylococcus aureus subsp. aureus MW2
caauucaauguaucaccuaauug

SEQ ID NO: 4002289 - RNA, 16 nt, Staphylococcus aureus subsp. aureus MW2
caauucacuuauacau

SEQ ID NO: 4002290 - RNA, 17 nt, Staphylococcus aureus subsp. aureus MW2
caauucacuuauacaug

SEQ ID NO: 4002291 - RNA, 21 nt, Staphylococcus aureus subsp. aureus MW2
caauucgcucacaugugaaau

SEQ ID NO: 4002292 - RNA, 18 nt, Staphylococcus aureus subsp. aureus MW2
caauugaaucaaauacau

SEQ ID NO: 4002293 - RNA, 22 nt, Staphylococcus aureus subsp. aureus MW2
caauugauauuuaccgucuuau

SEQ ID NO: 4002294 - RNA, 17 nt, Staphylococcus aureus subsp. aureus MW2
caauugcacuuacugcu

SEQ ID NO: 4002295 - RNA, 13 nt, Staphylococcus aureus subsp. aureus MW2
caauugcauacgu

SEQ ID NO: 4002296 - RNA, 18 nt, Staphylococcus aureus subsp. aureus MW2
caauugcauacguaaaug

SEQ ID NO: 4002297 - RNA, 21 nt, Staphylococcus aureus subsp. aureus MW2
caauuguaguaaugaagcuuc

SEQ ID NO: 4002298 - RNA, 15 nt, Staphylococcus aureus subsp. aureus MW2
caauugucguuuaau

SEQ ID NO: 4002299 - RNA, 16 nt, Staphylococcus aureus subsp. aureus MW2
caauuuaaaaagcagu

SEQ ID NO: 4002300 - RNA, 12 nt, Staphylococcus aureus subsp. aureus MW2
caauuuaaauaa

SEQ ID NO: 4002301 - RNA, 16 nt, Staphylococcus aureus subsp. aureus MW2
caauuuaaauuaagua

SEQ ID NO: 4002302 - RNA, 17 nt, Staphylococcus aureus subsp. aureus MW2
caauuuauaaugauuaa

SEQ ID NO: 4002303 - RNA, 20 nt, Staphylococcus aureus subsp. aureus MW2
caauuuauguaaauucaaaa

SEQ ID NO: 4002304 - RNA, 19 nt, Staphylococcus aureus subsp. aureus MW2
caauuuauuaacuguguau

SEQ ID NO: 4002305 - RNA, 17 nt, Staphylococcus aureus subsp. aureus MW2
caauuuauuauuaacug

SEQ ID NO: 4002306 - RNA, 17 nt, Staphylococcus aureus subsp. aureus MW2
caauuucgauucgugau

SEQ ID NO: 4002307 - RNA, 23 nt, Staphylococcus aureus subsp. aureus MW2
caauuucguuuuauuaaugaagc

SEQ ID NO: 4002308 - RNA, 22 nt, Staphylococcus aureus subsp. aureus MW2
caauuucuaggccacuaagacc

SEQ ID NO: 4002309 - RNA, 17 nt, Staphylococcus aureus subsp. aureus MW2
caauuucuauuuaaaca

SEQ ID NO: 4002310 - RNA, 12 nt, Staphylococcus aureus subsp. aureus MW2
caauuucucugu

SEQ ID NO: 4002311 - RNA, 15 nt, Staphylococcus aureus subsp. aureus MW2
caauuucuucauuuu

SEQ ID NO: 4002312 - RNA, 17 nt, Staphylococcus aureus subsp. aureus MW2
caauuucuucauuuuca

SEQ ID NO: 4002313 - RNA, 18 nt, Staphylococcus aureus subsp. aureus MW2
caauuucuucauuuucau

SEQ ID NO: 4002314 - RNA, 21 nt, Staphylococcus aureus subsp. aureus MW2
caauuuuaauuuuucauuaau

SEQ ID NO: 4002315 - RNA, 12 nt, Staphylococcus aureus subsp. aureus MW2
caauuuuaccag

SEQ ID NO: 4002316 - RNA, 23 nt, Staphylococcus aureus subsp. aureus MW2
caauuuuaccuucgcauacuuuu

SEQ ID NO: 4002317 - RNA, 15 nt, Staphylococcus aureus subsp. aureus MW2
caauuuuagacuaca

SEQ ID NO: 4002318 - RNA, 12 nt, Staphylococcus aureus subsp. aureus MW2
caauuuucucau

SEQ ID NO: 4002319 - RNA, 15 nt, Staphylococcus aureus subsp. aureus MW2
caauuuuuaaaaacc

SEQ ID NO: 4002320 - RNA, 16 nt, Staphylococcus aureus subsp. aureus MW2
caauuuuuaaaaaccu

SEQ ID NO: 4002321 - RNA, 23 nt, Staphylococcus aureus subsp. aureus MW2
caauuuuuaaaaaccuagggaua

SEQ ID NO: 4002322 - RNA, 16 nt, Staphylococcus aureus subsp. aureus MW2
caauuuuuaacaaaau

SEQ ID NO: 4002323 - RNA, 21 nt, Staphylococcus aureus subsp. aureus MW2
caauuuuuucaugauuuacua

SEQ ID NO: 4002324 - RNA, 19 nt, Staphylococcus aureus subsp. aureus MW2
cacaaagauauguuuauau

SEQ ID NO: 4002325 - RNA, 16 nt, Staphylococcus aureus subsp. aureus MW2
cacaaaguauuugaag

SEQ ID NO: 4002326 - RNA, 23 nt, Staphylococcus aureus subsp. aureus MW2
cacaaaguauuugaaguauuuuc

SEQ ID NO: 4002327 - RNA, 12 nt, Staphylococcus aureus subsp. aureus MW2
cacaaaugaaug

SEQ ID NO: 4002328 - RNA, 13 nt, Staphylococcus aureus subsp. aureus MW2
cacaaaugcuaca

SEQ ID NO: 4002329 - RNA, 12 nt, Staphylococcus aureus subsp. aureus MW2
cacaacaaucac

SEQ ID NO: 4002330 - RNA, 14 nt, Staphylococcus aureus subsp. aureus MW2
cacaacaaugaauc

SEQ ID NO: 4002331 - RNA, 19 nt, Staphylococcus aureus subsp. aureus MW2
cacaacaaugaauccaaau

SEQ ID NO: 4002332 - RNA, 23 nt, Staphylococcus aureus subsp. aureus MW2
cacaacaaugaauccaaauauua

SEQ ID NO: 4002333 - RNA, 14 nt, Staphylococcus aureus subsp. aureus MW2
cacguuugaaugaa

SEQ ID NO: 4002334 - RNA, 16 nt, Staphylococcus aureus subsp. aureus MW2
cacuaaaaauauauuu

SEQ ID NO: 4002335 - RNA, 11 nt, Staphylococcus aureus subsp. aureus MW2
cacuaaaaauc

SEQ ID NO: 4002336 - RNA, 19 nt, Staphylococcus aureus subsp. aureus MW2
cacuaaaugugacuuuaaa

SEQ ID NO: 4002337 - RNA, 14 nt, Staphylococcus aureus subsp. aureus MW2
cacuaauauuuaaa

SEQ ID NO: 4002338 - RNA, 20 nt, Staphylococcus aureus subsp. aureus MW2
cacuaauauuuaaaaaacaa

SEQ ID NO: 4002339 - RNA, 22 nt, Staphylococcus aureus subsp. aureus MW2
cacuacagugcaugaugaacuu

SEQ ID NO: 4002340 - RNA, 23 nt, Staphylococcus aureus subsp. aureus MW2
cacuacugucucaucuucuaaau

SEQ ID NO: 4002341 - RNA, 18 nt, Staphylococcus aureus subsp. aureus MW2
cacuagauaguuuauacu

SEQ ID NO: 4002342 - RNA, 14 nt, Staphylococcus aureus subsp. aureus MW2
cacuagcaacaucu

SEQ ID NO: 4002343 - RNA, 18 nt, Staphylococcus aureus subsp. aureus MW2
cacuaggauguucaucaa

SEQ ID NO: 4002344 - RNA, 16 nt, Staphylococcus aureus subsp. aureus MW2
cacuagguacauaaau

SEQ ID NO: 4002345 - RNA, 20 nt, Staphylococcus aureus subsp. aureus MW2
cacuaguguauacaaggcau

SEQ ID NO: 4002346 - RNA, 11 nt, Staphylococcus aureus subsp. aureus MW2
cacuauaaaag

SEQ ID NO: 4002347 - RNA, 15 nt, Staphylococcus aureus subsp. aureus MW2
cacuauaaaauucac

SEQ ID NO: 4002348 - RNA, 13 nt, Staphylococcus aureus subsp. aureus MW2
cacuauaauuucu

SEQ ID NO: 4002349 - RNA, 15 nt, Staphylococcus aureus subsp. aureus MW2
cacuaucuuuugcuu

SEQ ID NO: 4002350 - RNA, 15 nt, Staphylococcus aureus subsp. aureus MW2
cacucacuucaacgu

SEQ ID NO: 4002351 - RNA, 20 nt, Staphylococcus aureus subsp. aureus MW2
cacucacuucaacgucaucu

SEQ ID NO: 4002352 - RNA, 12 nt, Staphylococcus aureus subsp. aureus MW2
cacucauaaccg

SEQ ID NO: 4002353 - RNA, 20 nt, Staphylococcus aureus subsp. aureus MW2
cacucauaaucaagucugca

SEQ ID NO: 4002354 - RNA, 16 nt, Staphylococcus aureus subsp. aureus MW2
cacucauauuacuuug

SEQ ID NO: 4002355 - RNA, 15 nt, Staphylococcus aureus subsp. aureus MW2
cacucauucaauuua

SEQ ID NO: 4002356 - RNA, 13 nt, Staphylococcus aureus subsp. aureus MW2
cacucauuuuuug

SEQ ID NO: 4002357 - RNA, 14 nt, Staphylococcus aureus subsp. aureus MW2
cacuccucuauuuu

SEQ ID NO: 4002358 - RNA, 22 nt, Staphylococcus aureus subsp. aureus MW2
cacuccucuauuuuaugauuug

SEQ ID NO: 4002359 - RNA, 18 nt, Staphylococcus aureus subsp. aureus MW2
cacuccuuaaacaaauaa

SEQ ID NO: 4002360 - RNA, 20 nt, Staphylococcus aureus subsp. aureus MW2
cacuccuuaaacaaauaaau

SEQ ID NO: 4002361 - RNA, 15 nt, Staphylococcus aureus subsp. aureus MW2
cacugacaugauaaa

SEQ ID NO: 4002362 - RNA, 17 nt, Staphylococcus aureus subsp. aureus MW2
cacugacaugauaaauu

SEQ ID NO: 4002363 - RNA, 22 nt, Staphylococcus aureus subsp. aureus MW2
cacugcaauggcuaaugacuuc

SEQ ID NO: 4002364 - RNA, 14 nt, Staphylococcus aureus subsp. aureus MW2
cacugccuuuuugu

SEQ ID NO: 4002365 - RNA, 16 nt, Staphylococcus aureus subsp. aureus MW2
cacugccuuuuuguaa

SEQ ID NO: 4002366 - RNA, 22 nt, Staphylococcus aureus subsp. aureus MW2
cacuguaacgaguccauuuucu

SEQ ID NO: 4002367 - RNA, 15 nt, Staphylococcus aureus subsp. aureus MW2
cacuguuaaagaugu

SEQ ID NO: 4002368 - RNA, 22 nt, Staphylococcus aureus subsp. aureus MW2
cacuguuaaagauguugaaaag

SEQ ID NO: 4002369 - RNA, 18 nt, Staphylococcus aureus subsp. aureus MW2
cacuguuuuauaaaugaa

SEQ ID NO: 4002370 - RNA, 16 nt, Staphylococcus aureus subsp. aureus MW2
cacuuaagcuuuaauc

SEQ ID NO: 4002371 - RNA, 16 nt, Staphylococcus aureus subsp. aureus MW2
cacuuaauauaaggaa

SEQ ID NO: 4002372 - RNA, 19 nt, Staphylococcus aureus subsp. aureus MW2
cacuuaauaucaguagcau

SEQ ID NO: 4002373 - RNA, 21 nt, Staphylococcus aureus subsp. aureus MW2
cacuuaaucguucccauucuu

SEQ ID NO: 4002374 - RNA, 16 nt, Staphylococcus aureus subsp. aureus MW2
cacuuacugugaaaau

SEQ ID NO: 4002375 - RNA, 19 nt, Staphylococcus aureus subsp. aureus MW2
cacuuacugugaaaauacc

SEQ ID NO: 4002376 - RNA, 14 nt, Staphylococcus aureus subsp. aureus MW2
cacuucaaaagaaa

SEQ ID NO: 4002377 - RNA, 20 nt, Staphylococcus aureus subsp. aureus MW2
cacuucaacauauaaaucau

SEQ ID NO: 4002378 - RNA, 16 nt, Staphylococcus aureus subsp. aureus MW2
cacuucaguuaaaccu

SEQ ID NO: 4002379 - RNA, 17 nt, Staphylococcus aureus subsp. aureus MW2
cacuucaguuaaaccuu

SEQ ID NO: 4002380 - RNA, 17 nt, Staphylococcus aureus subsp. aureus MW2
cacuuccaucaauccaa

SEQ ID NO: 4002381 - RNA, 20 nt, Staphylococcus aureus subsp. aureus MW2
cacuucgccaagccaucuuu

SEQ ID NO: 4002382 - RNA, 19 nt, Staphylococcus aureus subsp. aureus MW2
cacuucugaaaauaaccau

SEQ ID NO: 4002383 - RNA, 23 nt, Staphylococcus aureus subsp. aureus MW2
cacuucuguaccgaauuggauga

SEQ ID NO: 4002384 - RNA, 20 nt, Staphylococcus aureus subsp. aureus MW2
cacuugaauacuuuuuaacu

SEQ ID NO: 4002385 - RNA, 17 nt, Staphylococcus aureus subsp. aureus MW2
cacuuggauucaaauga

SEQ ID NO: 4002386 - RNA, 21 nt, Staphylococcus aureus subsp. aureus MW2
cacuuggauuuuaauuauuug

SEQ ID NO: 4002387 - RNA, 22 nt, Staphylococcus aureus subsp. aureus MW2
cacuugguacaccuacaaauau

SEQ ID NO: 4002388 - RNA, 19 nt, Staphylococcus aureus subsp. aureus MW2
cacuuuaaacaagcaucau

SEQ ID NO: 4002389 - RNA, 23 nt, Staphylococcus aureus subsp. aureus MW2
cacuuuaaacaagcaucaugaaa

SEQ ID NO: 4002390 - RNA, 16 nt, Staphylococcus aureus subsp. aureus MW2
cacuuuaggguucauu

SEQ ID NO: 4002391 - RNA, 18 nt, Staphylococcus aureus subsp. aureus MW2
cacuuucaaugacaucua

SEQ ID NO: 4002392 - RNA, 21 nt, Staphylococcus aureus subsp. aureus MW2
cacuuucaguaauuguuacua

SEQ ID NO: 4002393 - RNA, 12 nt, Staphylococcus aureus subsp. aureus MW2
cacuuucuacuc

SEQ ID NO: 4002394 - RNA, 18 nt, Staphylococcus aureus subsp. aureus MW2
cacuuugaucuuuaaaua

SEQ ID NO: 4002395 - RNA, 23 nt, Staphylococcus aureus subsp. aureus MW2
cacuuuuuaaaguaaccacaaca

SEQ ID NO: 4002396 - RNA, 15 nt, Staphylococcus aureus subsp. aureus MW2
cacuuuuuauacauu

SEQ ID NO: 4002397 - RNA, 16 nt, Staphylococcus aureus subsp. aureus MW2
cacuuuuuauacauua

SEQ ID NO: 4002398 - RNA, 20 nt, Staphylococcus aureus subsp. aureus MW2
cacuuuuugacauauuuuuu

SEQ ID NO: 4002399 - RNA, 22 nt, Staphylococcus aureus subsp. aureus MW2
cagaaaagcagucgaacaauga

SEQ ID NO: 4002400 - RNA, 12 nt, Staphylococcus aureus subsp. aureus MW2
cagaaaguugca

SEQ ID NO: 4002401 - RNA, 16 nt, Staphylococcus aureus subsp. aureus MW2
cagaaaugauauuuuc

SEQ ID NO: 4002402 - RNA, 21 nt, Staphylococcus aureus subsp. aureus MW2
cagaaauuuaauauuguuaau

SEQ ID NO: 4002403 - RNA, 21 nt, Staphylococcus aureus subsp. aureus MW2
cagaacuacaauucauaagaa

SEQ ID NO: 4002404 - RNA, 21 nt, Staphylococcus aureus subsp. aureus MW2
cagaacugccaauauaacauu

SEQ ID NO: 4002405 - RNA, 20 nt, Staphylococcus aureus subsp. aureus MW2
cagaaugaacuucucuuagu

SEQ ID NO: 4002406 - RNA, 23 nt, Staphylococcus aureus subsp. aureus MW2
cagaauuauuugauuauguaaau

SEQ ID NO: 4002407 - RNA, 15 nt, Staphylococcus aureus subsp. aureus MW2
cagaauuucaucaaa

SEQ ID NO: 4002408 - RNA, 13 nt, Staphylococcus aureus subsp. aureus MW2
cagacaaugcaag

SEQ ID NO: 4002409 - RNA, 14 nt, Staphylococcus aureus subsp. aureus MW2
cagacaaugcaagu

SEQ ID NO: 4002410 - RNA, 17 nt, Staphylococcus aureus subsp. aureus MW2
cagacaaugcaaguugg

SEQ ID NO: 4002411 - RNA, 19 nt, Staphylococcus aureus subsp. aureus MW2
cagacaaugcaaguuggcg

SEQ ID NO: 4002412 - RNA, 18 nt, Staphylococcus aureus subsp. aureus MW2
cagacaaugcaaguuggg

SEQ ID NO: 4002413 - RNA, 20 nt, Staphylococcus aureus subsp. aureus MW2
cagaccaacgcuuaauggcg

SEQ ID NO: 4002414 - RNA, 16 nt, Staphylococcus aureus subsp. aureus MW2
cagacuaaaaguggcc

SEQ ID NO: 4002415 - RNA, 12 nt, Staphylococcus aureus subsp. aureus MW2
cagacuccuaaa

SEQ ID NO: 4002416 - RNA, 14 nt, Staphylococcus aureus subsp. aureus MW2
cagacuccuaaauu

SEQ ID NO: 4002417 - RNA, 21 nt, Staphylococcus aureus subsp. aureus MW2
cagacuuuguuaaaaaauuaa

SEQ ID NO: 4002418 - RNA, 16 nt, Staphylococcus aureus subsp. aureus MW2
cagagaauuucgaaaa

SEQ ID NO: 4002419 - RNA, 19 nt, Staphylococcus aureus subsp. aureus MW2
cagagaauuucgaaaagaa

SEQ ID NO: 4002420 - RNA, 17 nt, Staphylococcus aureus subsp. aureus MW2
cagagccguaaugagag

SEQ ID NO: 4002421 - RNA, 13 nt, Staphylococcus aureus subsp. aureus MW2
cagucugcucuuu

SEQ ID NO: 4002422 - RNA, 14 nt, Staphylococcus aureus subsp. aureus MW2
cagucuucauguuc

SEQ ID NO: 4002423 - RNA, 19 nt, Staphylococcus aureus subsp. aureus MW2
cagugaacaccccuucucu

SEQ ID NO: 4002424 - RNA, 15 nt, Staphylococcus aureus subsp. aureus MW2
cagugaaguuaacua

SEQ ID NO: 4002425 - RNA, 15 nt, Staphylococcus aureus subsp. aureus MW2
cagugacuagaggau

SEQ ID NO: 4002426 - RNA, 13 nt, Staphylococcus aureus subsp. aureus MW2
cagugcaugauga

SEQ ID NO: 4002427 - RNA, 15 nt, Staphylococcus aureus subsp. aureus MW2
cagugccuugcugga

SEQ ID NO: 4002428 - RNA, 22 nt, Staphylococcus aureus subsp. aureus MW2
cagugcuaauuuugagacaaaa

SEQ ID NO: 4002429 - RNA, 22 nt, Staphylococcus aureus subsp. aureus MW2
cagugggcgguuauuaacaaaa

SEQ ID NO: 4002430 - RNA, 13 nt, Staphylococcus aureus subsp. aureus MW2
caguguagcacaa

SEQ ID NO: 4002431 - RNA, 13 nt, Staphylococcus aureus subsp. aureus MW2
cagugugaaauaa

SEQ ID NO: 4002432 - RNA, 23 nt, Staphylococcus aureus subsp. aureus MW2
caguguguaucucuuauuuuaaa

SEQ ID NO: 4002433 - RNA, 19 nt, Staphylococcus aureus subsp. aureus MW2
caguguuauauuggcgggc

SEQ ID NO: 4002434 - RNA, 16 nt, Staphylococcus aureus subsp. aureus MW2
caguguugaauuuaaa

SEQ ID NO: 4002435 - RNA, 18 nt, Staphylococcus aureus subsp. aureus MW2
caguguuugacugaauga

SEQ ID NO: 4002436 - RNA, 13 nt, Staphylococcus aureus subsp. aureus MW2
caguuaauaagaa

SEQ ID NO: 4002437 - RNA, 23 nt, Staphylococcus aureus subsp. aureus MW2
caguuaauuauuuagauucuuuu

SEQ ID NO: 4002438 - RNA, 15 nt, Staphylococcus aureus subsp. aureus MW2
caguuacuucaguuu

SEQ ID NO: 4002439 - RNA, 21 nt, Staphylococcus aureus subsp. aureus MW2
caguuacuuucgcuugcaaag

SEQ ID NO: 4002440 - RNA, 17 nt, Staphylococcus aureus subsp. aureus MW2
caguuagaaacagaauu

SEQ ID NO: 4002441 - RNA, 17 nt, Staphylococcus aureus subsp. aureus MW2
caguuaugccugaagcg

SEQ ID NO: 4002442 - RNA, 21 nt, Staphylococcus aureus subsp. aureus MW2
caguugcacaaauugcaaugg

SEQ ID NO: 4002443 - RNA, 23 nt, Staphylococcus aureus subsp. aureus MW2
caguuguguaauaaagcaguguu

SEQ ID NO: 4002444 - RNA, 18 nt, Staphylococcus aureus subsp. aureus MW2
caguuguuuuuuugucag

SEQ ID NO: 4002445 - RNA, 22 nt, Staphylococcus aureus subsp. aureus MW2
caguuuaauucguuucacuacu

SEQ ID NO: 4002446 - RNA, 14 nt, Staphylococcus aureus subsp. aureus MW2
caguuucaucuuca

SEQ ID NO: 4002447 - RNA, 17 nt, Staphylococcus aureus subsp. aureus MW2
caguuuccauaaauaaa

SEQ ID NO: 4002448 - RNA, 14 nt, Staphylococcus aureus subsp. aureus MW2
caguuugauuaaaa

SEQ ID NO: 4002449 - RNA, 14 nt, Staphylococcus aureus subsp. aureus MW2
caguuuuaaagacu

SEQ ID NO: 4002450 - RNA, 18 nt, Staphylococcus aureus subsp. aureus MW2
caguuuuaauuaaacugu

SEQ ID NO: 4002451 - RNA, 23 nt, Staphylococcus aureus subsp. aureus MW2
caguuuuaauuaaacuguaaaca

SEQ ID NO: 4002452 - RNA, 19 nt, Staphylococcus aureus subsp. aureus MW2
caguuuugaagaauaaaaa

SEQ ID NO: 4002453 - RNA, 19 nt, Staphylococcus aureus subsp. aureus MW2
caguuuuugguagcauuuu

SEQ ID NO: 4002454 - RNA, 14 nt, Staphylococcus aureus subsp. aureus MW2
cauaaaaaaagaac

SEQ ID NO: 4002455 - RNA, 15 nt, Staphylococcus aureus subsp. aureus MW2
cauaaaaaaagaacu

SEQ ID NO: 4002456 - RNA, 22 nt, Staphylococcus aureus subsp. aureus MW2
cauaaaaaggucuauguacaau

SEQ ID NO: 4002457 - RNA, 12 nt, Staphylococcus aureus subsp. aureus MW2
cauaaaaauaag

SEQ ID NO: 4002458 - RNA, 13 nt, Staphylococcus aureus subsp. aureus MW2
cauaaaaauagaa

SEQ ID NO: 4002459 - RNA, 19 nt, Staphylococcus aureus subsp. aureus MW2
cauaaaaauagaaaaaaca

SEQ ID NO: 4002460 - RNA, 15 nt, Staphylococcus aureus subsp. aureus MW2
cauaaaaaucauaaa

SEQ ID NO: 4002461 - RNA, 13 nt, Staphylococcus aureus subsp. aureus MW2
cauaaaaccuuca

SEQ ID NO: 4002462 - RNA, 18 nt, Staphylococcus aureus subsp. aureus MW2
cauaaaacuuacauuaca

SEQ ID NO: 4002463 - RNA, 16 nt, Staphylococcus aureus subsp. aureus MW2
cauaaaagacagaaau

SEQ ID NO: 4002464 - RNA, 18 nt, Staphylococcus aureus subsp. aureus MW2
cauaaaauaccagaugaa

SEQ ID NO: 4002465 - RNA, 21 nt, Staphylococcus aureus subsp. aureus MW2
cauaaaauacgcaaaccaauc

SEQ ID NO: 4002466 - RNA, 16 nt, Staphylococcus aureus subsp. aureus MW2
cauaaaaugaguugaa

SEQ ID NO: 4002467 - RNA, 22 nt, Staphylococcus aureus subsp. aureus MW2
cauaaaauuaacuuaaaauuua

SEQ ID NO: 4002468 - RNA, 12 nt, Staphylococcus aureus subsp. aureus MW2
cauaaaauuuaa

SEQ ID NO: 4002469 - RNA, 14 nt, Staphylococcus aureus subsp. aureus MW2
cauaaaauuucugc

SEQ ID NO: 4002470 - RNA, 16 nt, Staphylococcus aureus subsp. aureus MW2
cauaaaauuucugcuu

SEQ ID NO: 4002471 - RNA, 20 nt, Staphylococcus aureus subsp. aureus MW2
cauaaacaauaacuguucuu

SEQ ID NO: 4002472 - RNA, 15 nt, Staphylococcus aureus subsp. aureus MW2
cauaaacgaaaauac

SEQ ID NO: 4002473 - RNA, 16 nt, Staphylococcus aureus subsp. aureus MW2
cauaaagcuguuuauu

SEQ ID NO: 4002474 - RNA, 15 nt, Staphylococcus aureus subsp. aureus MW2
cauaaauacaaaaau

SEQ ID NO: 4002475 - RNA, 15 nt, Staphylococcus aureus subsp. aureus MW2
cauaaauagugaaau

SEQ ID NO: 4002476 - RNA, 23 nt, Staphylococcus aureus subsp. aureus MW2
cauaaauagugaaauuauagccu

SEQ ID NO: 4002477 - RNA, 14 nt, Staphylococcus aureus subsp. aureus MW2
cauaaauauaaaau

SEQ ID NO: 4002478 - RNA, 15 nt, Staphylococcus aureus subsp. aureus MW2
cauaaaucaauguuc

SEQ ID NO: 4002479 - RNA, 22 nt, Staphylococcus aureus subsp. aureus MW2
cauaaaucaugaaauuaaaaac

SEQ ID NO: 4002480 - RNA, 14 nt, Staphylococcus aureus subsp. aureus MW2
cauaaaugacugaa

SEQ ID NO: 4002481 - RNA, 20 nt, Staphylococcus aureus subsp. aureus MW2
cauaaaugcuaaaaguauaa

SEQ ID NO: 4002482 - RNA, 21 nt, Staphylococcus aureus subsp. aureus MW2
cauaaauguuagauuucaaac

SEQ ID NO: 4002483 - RNA, 15 nt, Staphylococcus aureus subsp. aureus MW2
cauaaauuagaugaa

SEQ ID NO: 4002484 - RNA, 21 nt, Staphylococcus aureus subsp. aureus MW2
cauaaauuguuuuacaugauu

SEQ ID NO: 4002485 - RNA, 18 nt, Staphylococcus aureus subsp. aureus MW2
cauaacaaaaacaucuac

SEQ ID NO: 4002486 - RNA, 20 nt, Staphylococcus aureus subsp. aureus MW2
cauaacaaacauaccccuuu

SEQ ID NO: 4002487 - RNA, 21 nt, Staphylococcus aureus subsp. aureus MW2
cauaacaaacauaccccuuug

SEQ ID NO: 4002488 - RNA, 22 nt, Staphylococcus aureus subsp. aureus MW2
cauaacgagcaguauauaucaa

SEQ ID NO: 4002489 - RNA, 14 nt, Staphylococcus aureus subsp. aureus MW2
cauaacgcacugca

SEQ ID NO: 4002490 - RNA, 16 nt, Staphylococcus aureus subsp. aureus MW2
cauaacugaauaaacc

SEQ ID NO: 4002491 - RNA, 18 nt, Staphylococcus aureus subsp. aureus MW2
cauaacuguagcuccuaa

SEQ ID NO: 4002492 - RNA, 19 nt, Staphylococcus aureus subsp. aureus MW2
cauaacuguagcuccuaaa

SEQ ID NO: 4002493 - RNA, 15 nt, Staphylococcus aureus subsp. aureus MW2
cauaagaaaauacua

SEQ ID NO: 4002494 - RNA, 16 nt, Staphylococcus aureus subsp. aureus MW2
cauaagaaaauacuaa

SEQ ID NO: 4002495 - RNA, 16 nt, Staphylococcus aureus subsp. aureus MW2
cauaagccauaugcuu

SEQ ID NO: 4002496 - RNA, 18 nt, Staphylococcus aureus subsp. aureus MW2
cauaaggacucuguuuaa

SEQ ID NO: 4002497 - RNA, 16 nt, Staphylococcus aureus subsp. aureus MW2
cauaagguacauaaau

SEQ ID NO: 4002498 - RNA, 22 nt, Staphylococcus aureus subsp. aureus MW2
cauaagguacauaaauagugaa

SEQ ID NO: 4002499 - RNA, 17 nt, Staphylococcus aureus subsp. aureus MW2
cauaaggucuuggacua

SEQ ID NO: 4002500 - RNA, 22 nt, Staphylococcus aureus subsp. aureus MW2
cauaaggucuuggacuaauaau

SEQ ID NO: 4002501 - RNA, 17 nt, Staphylococcus aureus subsp. aureus MW2
cauaauaaucguaaaca

SEQ ID NO: 4002502 - RNA, 16 nt, Staphylococcus aureus subsp. aureus MW2
cauaauagauaaugca

SEQ ID NO: 4002503 - RNA, 14 nt, Staphylococcus aureus subsp. aureus MW2
cauaauauauuaaa

SEQ ID NO: 4002504 - RNA, 14 nt, Staphylococcus aureus subsp. aureus MW2
cauaauauauuaac

SEQ ID NO: 4002505 - RNA, 22 nt, Staphylococcus aureus subsp. aureus MW2
cauaauauauuaacaacuuuau

SEQ ID NO: 4002506 - RNA, 21 nt, Staphylococcus aureus subsp. aureus MW2
cauaauaucuuacuacuuaau

SEQ ID NO: 4002507 - RNA, 12 nt, Staphylococcus aureus subsp. aureus MW2
cauaaucaacau

SEQ ID NO: 4002508 - RNA, 17 nt, Staphylococcus aureus subsp. aureus MW2
cauaaucaacauguguc

SEQ ID NO: 4002509 - RNA, 16 nt, Staphylococcus aureus subsp. aureus MW2
cauaaucaagucugca

SEQ ID NO: 4002510 - RNA, 13 nt, Staphylococcus aureus subsp. aureus MW2
caucaaaaauaaa

SEQ ID NO: 4002511 - RNA, 13 nt, Staphylococcus aureus subsp. aureus MW2
caucaaacaacau

SEQ ID NO: 4002512 - RNA, 14 nt, Staphylococcus aureus subsp. aureus MW2
caucaaacaacauc

SEQ ID NO: 4002513 - RNA, 17 nt, Staphylococcus aureus subsp. aureus MW2
caucaaacaacaucacu

SEQ ID NO: 4002514 - RNA, 20 nt, Staphylococcus aureus subsp. aureus MW2
caucaaacaacaucacuuua

SEQ ID NO: 4002515 - RNA, 19 nt, Staphylococcus aureus subsp. aureus MW2
caucaaauagacaccaaaa

SEQ ID NO: 4002516 - RNA, 19 nt, Staphylococcus aureus subsp. aureus MW2
caucaacagauacuucagu

SEQ ID NO: 4002517 - RNA, 18 nt, Staphylococcus aureus subsp. aureus MW2
caucaacgccauauuuau

SEQ ID NO: 4002518 - RNA, 22 nt, Staphylococcus aureus subsp. aureus MW2
caucaaguauaaauguuauugc

SEQ ID NO: 4002519 - RNA, 18 nt, Staphylococcus aureus subsp. aureus MW2
caucaauaucuucuucua

SEQ ID NO: 4002520 - RNA, 19 nt, Staphylococcus aureus subsp. aureus MW2
caucaauaucuucuucuaa

SEQ ID NO: 4002521 - RNA, 14 nt, Staphylococcus aureus subsp. aureus MW2
caucaauauugaua

SEQ ID NO: 4002522 - RNA, 21 nt, Staphylococcus aureus subsp. aureus MW2
caucaaucgcuuuagcaauug

SEQ ID NO: 4002523 - RNA, 18 nt, Staphylococcus aureus subsp. aureus MW2
caucaauuucgacuccau

SEQ ID NO: 4002524 - RNA, 12 nt, Staphylococcus aureus subsp. aureus MW2
caucaauuucua

SEQ ID NO: 4002525 - RNA, 17 nt, Staphylococcus aureus subsp. aureus MW2
caucacauaacuaugcu

SEQ ID NO: 4002526 - RNA, 19 nt, Staphylococcus aureus subsp. aureus MW2
caucacuguagauucaaau

SEQ ID NO: 4002527 - RNA, 13 nt, Staphylococcus aureus subsp. aureus MW2
caucacuuuuuaa

SEQ ID NO: 4002528 - RNA, 15 nt, Staphylococcus aureus subsp. aureus MW2
caucaguauuuguau

SEQ ID NO: 4002529 - RNA, 14 nt, Staphylococcus aureus subsp. aureus MW2
caucaguguguguu

SEQ ID NO: 4002530 - RNA, 14 nt, Staphylococcus aureus subsp. aureus MW2
caucaguuaauaau

SEQ ID NO: 4002531 - RNA, 17 nt, Staphylococcus aureus subsp. aureus MW2
caucaguuguguaauaa

SEQ ID NO: 4002532 - RNA, 23 nt, Staphylococcus aureus subsp. aureus MW2
caucaguuguguaauaaagcagu

SEQ ID NO: 4002533 - RNA, 20 nt, Staphylococcus aureus subsp. aureus MW2
caucauaaucaagaauauaa

SEQ ID NO: 4002534 - RNA, 16 nt, Staphylococcus aureus subsp. aureus MW2
caucauaaucuacugc

SEQ ID NO: 4002535 - RNA, 19 nt, Staphylococcus aureus subsp. aureus MW2
caucauagcacuacaucaa

SEQ ID NO: 4002536 - RNA, 22 nt, Staphylococcus aureus subsp. aureus MW2
caucauauauucauugauuguu

SEQ ID NO: 4002537 - RNA, 23 nt, Staphylococcus aureus subsp. aureus MW2
caucauaucauaccaaaaaguau

SEQ ID NO: 4002538 - RNA, 15 nt, Staphylococcus aureus subsp. aureus MW2
caucauauucaacua

SEQ ID NO: 4002539 - RNA, 16 nt, Staphylococcus aureus subsp. aureus MW2
caucaucaaguucacc

SEQ ID NO: 4002540 - RNA, 13 nt, Staphylococcus aureus subsp. aureus MW2
caucaucaccaua

SEQ ID NO: 4002541 - RNA, 17 nt, Staphylococcus aureus subsp. aureus MW2
caucaucaccauacuaa

SEQ ID NO: 4002542 - RNA, 19 nt, Staphylococcus aureus subsp. aureus MW2
caucaucacuguagauuca

SEQ ID NO: 4002543 - RNA, 14 nt, Staphylococcus aureus subsp. aureus MW2
caucaugacauuaa

SEQ ID NO: 4002544 - RNA, 17 nt, Staphylococcus aureus subsp. aureus MW2
caucaugacuauuuucc

SEQ ID NO: 4002545 - RNA, 10 nt, Staphylococcus aureus subsp. aureus MW2
caucaugauu

SEQ ID NO: 4002546 - RNA, 15 nt, Staphylococcus aureus subsp. aureus MW2
caucauggucaacuu

SEQ ID NO: 4002547 - RNA, 15 nt, Staphylococcus aureus subsp. aureus MW2
caucauguuuauuag

SEQ ID NO: 4002548 - RNA, 20 nt, Staphylococcus aureus subsp. aureus MW2
caucauguuuauuagcuuuu

SEQ ID NO: 4002549 - RNA, 13 nt, Staphylococcus aureus subsp. aureus MW2
caucauuaaaauc

SEQ ID NO: 4002550 - RNA, 19 nt, Staphylococcus aureus subsp. aureus MW2
caucauuaguuuuuaaaau

SEQ ID NO: 4002551 - RNA, 23 nt, Staphylococcus aureus subsp. aureus MW2
caucauuaguuuuuaaaauuauc

SEQ ID NO: 4002552 - RNA, 16 nt, Staphylococcus aureus subsp. aureus MW2
caucauucaaacuccu

SEQ ID NO: 4002553 - RNA, 16 nt, Staphylococcus aureus subsp. aureus MW2
caucauuuaaauauuu

SEQ ID NO: 4002554 - RNA, 22 nt, Staphylococcus aureus subsp. aureus MW2
caucauuuauaugauguucaau

SEQ ID NO: 4002555 - RNA, 20 nt, Staphylococcus aureus subsp. aureus MW2
caucauuuguguaaaugaau

SEQ ID NO: 4002556 - RNA, 21 nt, Staphylococcus aureus subsp. aureus MW2
caucauuuguguaaaugaauu

SEQ ID NO: 4002557 - RNA, 14 nt, Staphylococcus aureus subsp. aureus MW2
caucauuuguguuu

SEQ ID NO: 4002558 - RNA, 17 nt, Staphylococcus aureus subsp. aureus MW2
caucauuuucaauacuu

SEQ ID NO: 4002559 - RNA, 23 nt, Staphylococcus aureus subsp. aureus MW2
caucauuuucaauacuugaaaga

SEQ ID NO: 4002560 - RNA, 14 nt, Staphylococcus aureus subsp. aureus MW2
cauccaauuauguu

SEQ ID NO: 4002561 - RNA, 20 nt, Staphylococcus aureus subsp. aureus MW2
cauccaauuauguuuaucua

SEQ ID NO: 4002562 - RNA, 21 nt, Staphylococcus aureus subsp. aureus MW2
cauccaauuauguuuaucuac

SEQ ID NO: 4002563 - RNA, 16 nt, Staphylococcus aureus subsp. aureus MW2
caucccauuaaaccac

SEQ ID NO: 4002564 - RNA, 16 nt, Staphylococcus aureus subsp. aureus MW2
cauccccaacuugcau

SEQ ID NO: 4002565 - RNA, 14 nt, Staphylococcus aureus subsp. aureus MW2
cauccccagccauu

SEQ ID NO: 4002566 - RNA, 15 nt, Staphylococcus aureus subsp. aureus MW2
caucgaagauguuaa

SEQ ID NO: 4002567 - RNA, 20 nt, Staphylococcus aureus subsp. aureus MW2
caucgauuuaucauuauuug

SEQ ID NO: 4002568 - RNA, 16 nt, Staphylococcus aureus subsp. aureus MW2
caucgggaucuaauuu

SEQ ID NO: 4002569 - RNA, 20 nt, Staphylococcus aureus subsp. aureus MW2
caucgguaucgaauguuuca

SEQ ID NO: 4002570 - RNA, 22 nt, Staphylococcus aureus subsp. aureus MW2
caucguaaaaaacaaaaaaccg

SEQ ID NO: 4002571 - RNA, 16 nt, Staphylococcus aureus subsp. aureus MW2
caucguagcaccagca

SEQ ID NO: 4002572 - RNA, 14 nt, Staphylococcus aureus subsp. aureus MW2
caucguauagaugu

SEQ ID NO: 4002573 - RNA, 21 nt, Staphylococcus aureus subsp. aureus MW2
caucgucgcuaaagaccuuuc

SEQ ID NO: 4002574 - RNA, 13 nt, Staphylococcus aureus subsp. aureus MW2
caucuaaaaugag

SEQ ID NO: 4002575 - RNA, 18 nt, Staphylococcus aureus subsp. aureus MW2
caucuaaauaguuuuuca

SEQ ID NO: 4002576 - RNA, 18 nt, Staphylococcus aureus subsp. aureus MW2
caucuaaaugcacuagca

SEQ ID NO: 4002577 - RNA, 18 nt, Staphylococcus aureus subsp. aureus MW2
caucuaaaugguuaucua

SEQ ID NO: 4002578 - RNA, 14 nt, Staphylococcus aureus subsp. aureus MW2
caucuaauccccaa

SEQ ID NO: 4002579 - RNA, 22 nt, Staphylococcus aureus subsp. aureus MW2
caucuacaacgccaauagguuc

SEQ ID NO: 4002580 - RNA, 13 nt, Staphylococcus aureus subsp. aureus MW2
caucuacacccau

SEQ ID NO: 4002581 - RNA, 17 nt, Staphylococcus aureus subsp. aureus MW2
caucuacuauuuaaucu

SEQ ID NO: 4002582 - RNA, 16 nt, Staphylococcus aureus subsp. aureus MW2
caucuacuuaaaauaa

SEQ ID NO: 4002583 - RNA, 17 nt, Staphylococcus aureus subsp. aureus MW2
caucuacuuaaaauaag

SEQ ID NO: 4002584 - RNA, 21 nt, Staphylococcus aureus subsp. aureus MW2
caucuauaauauucaauaauu

SEQ ID NO: 4002585 - RNA, 22 nt, Staphylococcus aureus subsp. aureus MW2
caucuauaauauucaauaauuc

SEQ ID NO: 4002586 - RNA, 14 nt, Staphylococcus aureus subsp. aureus MW2
caucuauauuuaau

SEQ ID NO: 4002587 - RNA, 20 nt, Staphylococcus aureus subsp. aureus MW2
caucuauauuuaauuuugau

SEQ ID NO: 4002588 - RNA, 21 nt, Staphylococcus aureus subsp. aureus MW2
caucuaugacucguuuauaau

SEQ ID NO: 4002589 - RNA, 15 nt, Staphylococcus aureus subsp. aureus MW2
caucuauuauuaugu

SEQ ID NO: 4002590 - RNA, 22 nt, Staphylococcus aureus subsp. aureus MW2
caucuauucaaaugauuuuagu

SEQ ID NO: 4002591 - RNA, 18 nt, Staphylococcus aureus subsp. aureus MW2
caucuauuuaauaaugua

SEQ ID NO: 4002592 - RNA, 14 nt, Staphylococcus aureus subsp. aureus MW2
caucuauuucuugu

SEQ ID NO: 4002593 - RNA, 14 nt, Staphylococcus aureus subsp. aureus MW2
caucucuaugucuc

SEQ ID NO: 4002594 - RNA, 13 nt, Staphylococcus aureus subsp. aureus MW2
caucucuauuuuu

SEQ ID NO: 4002595 - RNA, 21 nt, Staphylococcus aureus subsp. aureus MW2
caucucugcuuuaauauaauu

SEQ ID NO: 4002596 - RNA, 16 nt, Staphylococcus aureus subsp. aureus MW2
caucugaaaaaauuaa

SEQ ID NO: 4002597 - RNA, 21 nt, Staphylococcus aureus subsp. aureus MW2
caucugaugaggcaauauuaa

SEQ ID NO: 4002598 - RNA, 23 nt, Staphylococcus aureus subsp. aureus MW2
caucugaugaggcaauauuaaaa

SEQ ID NO: 4002599 - RNA, 12 nt, Staphylococcus aureus subsp. aureus MW2
cauuaaaccacu

SEQ ID NO: 4002600 - RNA, 13 nt, Staphylococcus aureus subsp. aureus MW2
cauuaaauuccau

SEQ ID NO: 4002601 - RNA, 13 nt, Staphylococcus aureus subsp. aureus MW2
cauuaaauugcuu

SEQ ID NO: 4002602 - RNA, 16 nt, Staphylococcus aureus subsp. aureus MW2
cauuaacuuucucaaa

SEQ ID NO: 4002603 - RNA, 14 nt, Staphylococcus aureus subsp. aureus MW2
cauuaaguacuuuu

SEQ ID NO: 4002604 - RNA, 18 nt, Staphylococcus aureus subsp. aureus MW2
cauuaaguacuuuuacaa

SEQ ID NO: 4002605 - RNA, 14 nt, Staphylococcus aureus subsp. aureus MW2
cauuaaguucauca

SEQ ID NO: 4002606 - RNA, 15 nt, Staphylococcus aureus subsp. aureus MW2
cauuaaguucaucau

SEQ ID NO: 4002607 - RNA, 19 nt, Staphylococcus aureus subsp. aureus MW2
cauuaaguucaucaugcac

SEQ ID NO: 4002608 - RNA, 18 nt, Staphylococcus aureus subsp. aureus MW2
cauuaauaauuaaacaag

SEQ ID NO: 4002609 - RNA, 14 nt, Staphylococcus aureus subsp. aureus MW2
cauuaauccuuuau

SEQ ID NO: 4002610 - RNA, 16 nt, Staphylococcus aureus subsp. aureus MW2
cauuaauccuuuauau

SEQ ID NO: 4002611 - RNA, 17 nt, Staphylococcus aureus subsp. aureus MW2
cauuaaucuauauaaaa

SEQ ID NO: 4002612 - RNA, 21 nt, Staphylococcus aureus subsp. aureus MW2
cauuaaucuauauaaaaacug

SEQ ID NO: 4002613 - RNA, 21 nt, Staphylococcus aureus subsp. aureus MW2
cauuaauuggauuaaauacgc

SEQ ID NO: 4002614 - RNA, 14 nt, Staphylococcus aureus subsp. aureus MW2
cauuaauuucaugu

SEQ ID NO: 4002615 - RNA, 20 nt, Staphylococcus aureus subsp. aureus MW2
cauuaauuuuuucguuaacu

SEQ ID NO: 4002616 - RNA, 22 nt, Staphylococcus aureus subsp. aureus MW2
cauuacaaaucaugacauaaaa

SEQ ID NO: 4002617 - RNA, 16 nt, Staphylococcus aureus subsp. aureus MW2
cauuacagauaauuau

SEQ ID NO: 4002618 - RNA, 16 nt, Staphylococcus aureus subsp. aureus MW2
cauuacaguauuugac

SEQ ID NO: 4002619 - RNA, 18 nt, Staphylococcus aureus subsp. aureus MW2
cauuacauauaucaacau

SEQ ID NO: 4002620 - RNA, 22 nt, Staphylococcus aureus subsp. aureus MW2
cauuacauuuggcguaaugaua

SEQ ID NO: 4002621 - RNA, 23 nt, Staphylococcus aureus subsp. aureus MW2
cauuacauuuggcguaaugauau

SEQ ID NO: 4002622 - RNA, 14 nt, Staphylococcus aureus subsp. aureus MW2
cauuacuacuuaau

SEQ ID NO: 4002623 - RNA, 20 nt, Staphylococcus aureus subsp. aureus MW2
cauuacuacuuuauaaauau

SEQ ID NO: 4002624 - RNA, 17 nt, Staphylococcus aureus subsp. aureus MW2
cauuacuaucuucauca

SEQ ID NO: 4002625 - RNA, 18 nt, Staphylococcus aureus subsp. aureus MW2
cauuacuaucuucaucau

SEQ ID NO: 4002626 - RNA, 13 nt, Staphylococcus aureus subsp. aureus MW2
cauuacuuucugc

SEQ ID NO: 4002627 - RNA, 16 nt, Staphylococcus aureus subsp. aureus MW2
cauuagcaugauaaag

SEQ ID NO: 4002628 - RNA, 17 nt, Staphylococcus aureus subsp. aureus MW2
cauuagcaugauaaagu

SEQ ID NO: 4002629 - RNA, 23 nt, Staphylococcus aureus subsp. aureus MW2
cauuagccaaaucuuuaauaacc

SEQ ID NO: 4002630 - RNA, 21 nt, Staphylococcus aureus subsp. aureus MW2
cauuagcgcaagagauaagaa

SEQ ID NO: 4002631 - RNA, 19 nt, Staphylococcus aureus subsp. aureus MW2
cauuagcuaauucacuuuu

SEQ ID NO: 4002632 - RNA, 12 nt, Staphylococcus aureus subsp. aureus MW2
cauuagcuucua

SEQ ID NO: 4002633 - RNA, 22 nt, Staphylococcus aureus subsp. aureus MW2
cauuaguugcauaaucaauuuc

SEQ ID NO: 4002634 - RNA, 20 nt, Staphylococcus aureus subsp. aureus MW2
cauuaguuugaucauuuacu

SEQ ID NO: 4002635 - RNA, 18 nt, Staphylococcus aureus subsp. aureus MW2
cauuaguuuuuaaaauua

SEQ ID NO: 4002636 - RNA, 18 nt, Staphylococcus aureus subsp. aureus MW2
cauuauauaauucuucaa

SEQ ID NO: 4002637 - RNA, 15 nt, Staphylococcus aureus subsp. aureus MW2
cauuaucaagaacuu

SEQ ID NO: 4002638 - RNA, 20 nt, Staphylococcus aureus subsp. aureus MW2
cauuaucaagaacuuuaaaa

SEQ ID NO: 4002639 - RNA, 22 nt, Staphylococcus aureus subsp. aureus MW2
cauuaucuuaucugcucuuuau

SEQ ID NO: 4002640 - RNA, 16 nt, Staphylococcus aureus subsp. aureus MW2
cauuaugugucuucca

SEQ ID NO: 4002641 - RNA, 19 nt, Staphylococcus aureus subsp. aureus MW2
cauuaugugucuuccaauc

SEQ ID NO: 4002642 - RNA, 13 nt, Staphylococcus aureus subsp. aureus MW2
cauuauuaaauag

SEQ ID NO: 4002643 - RNA, 17 nt, Staphylococcus aureus subsp. aureus MW2
cauuauuaagugaguuu

SEQ ID NO: 4002644 - RNA, 16 nt, Staphylococcus aureus subsp. aureus MW2
cauuauuaauuccucc

SEQ ID NO: 4002645 - RNA, 20 nt, Staphylococcus aureus subsp. aureus MW2
cauuauuacugauuguuaac

SEQ ID NO: 4002646 - RNA, 13 nt, Staphylococcus aureus subsp. aureus MW2
cauuauugccuaa

SEQ ID NO: 4002647 - RNA, 14 nt, Staphylococcus aureus subsp. aureus MW2
cauuauuguaaccu

SEQ ID NO: 4002648 - RNA, 15 nt, Staphylococcus aureus subsp. aureus MW2
cauuauuguaaccug

SEQ ID NO: 4002649 - RNA, 17 nt, Staphylococcus aureus subsp. aureus MW2
cauuauuguaaccugac

SEQ ID NO: 4002650 - RNA, 21 nt, Staphylococcus aureus subsp. aureus MW2
cauuauuguuguaucaucaua

SEQ ID NO: 4002651 - RNA, 11 nt, Staphylococcus aureus subsp. aureus MW2
cauuauuuaaa

SEQ ID NO: 4002652 - RNA, 18 nt, Staphylococcus aureus subsp. aureus MW2
cauuauuugauaaauaaa

SEQ ID NO: 4002653 - RNA, 16 nt, Staphylococcus aureus subsp. aureus MW2
cauuauuugcugcuaa

SEQ ID NO: 4002654 - RNA, 22 nt, Staphylococcus aureus subsp. aureus MW2
cauuauuuuucgcuucaaaagc

SEQ ID NO: 4002655 - RNA, 20 nt, Staphylococcus aureus subsp. aureus MW2
cauucaaacuccuuucuaag

SEQ ID NO: 4002656 - RNA, 15 nt, Staphylococcus aureus subsp. aureus MW2
cauucaauguuuaau

SEQ ID NO: 4002657 - RNA, 15 nt, Staphylococcus aureus subsp. aureus MW2
cauucaguuuuguau

SEQ ID NO: 4002658 - RNA, 18 nt, Staphylococcus aureus subsp. aureus MW2
cauucaguuuuguauuca

SEQ ID NO: 4002659 - RNA, 19 nt, Staphylococcus aureus subsp. aureus MW2
cauucauaauuuguugaua

SEQ ID NO: 4002660 - RNA, 21 nt, Staphylococcus aureus subsp. aureus MW2
cauucauaccgaagaaacuaa

SEQ ID NO: 4002661 - RNA, 13 nt, Staphylococcus aureus subsp. aureus MW2
cauucaucacaaa

SEQ ID NO: 4002662 - RNA, 22 nt, Staphylococcus aureus subsp. aureus MW2
cauucaucguuuacuacaucau

SEQ ID NO: 4002663 - RNA, 13 nt, Staphylococcus aureus subsp. aureus MW2
cauucauuaacag

SEQ ID NO: 4002664 - RNA, 21 nt, Staphylococcus aureus subsp. aureus MW2
cauucauuuaguuaaauacaa

SEQ ID NO: 4002665 - RNA, 14 nt, Staphylococcus aureus subsp. aureus MW2
cauucauuugcaaa

SEQ ID NO: 4002666 - RNA, 12 nt, Staphylococcus aureus subsp. aureus MW2
cauuccaaaaau

SEQ ID NO: 4002667 - RNA, 13 nt, Staphylococcus aureus subsp. aureus MW2
cauuccaaaaccg

SEQ ID NO: 4002668 - RNA, 17 nt, Staphylococcus aureus subsp. aureus MW2
cauucccuuuucaucaa

SEQ ID NO: 4002669 - RNA, 21 nt, Staphylococcus aureus subsp. aureus MW2
cauucccuuuucaucaaauuc

SEQ ID NO: 4002670 - RNA, 14 nt, Staphylococcus aureus subsp. aureus MW2
cauucucauucagu

SEQ ID NO: 4002671 - RNA, 17 nt, Staphylococcus aureus subsp. aureus MW2
cauucuucaaaaaauaa

SEQ ID NO: 4002672 - RNA, 22 nt, Staphylococcus aureus subsp. aureus MW2
cauucuuccaacacccauauaa

SEQ ID NO: 4002673 - RNA, 19 nt, Staphylococcus aureus subsp. aureus MW2
cauucuugaauaaauuuua

SEQ ID NO: 4002674 - RNA, 22 nt, Staphylococcus aureus subsp. aureus MW2
cauucuuuaguacgcuguaauc

SEQ ID NO: 4002675 - RNA, 21 nt, Staphylococcus aureus subsp. aureus MW2
cauucuuuuucucaaugugag

SEQ ID NO: 4002676 - RNA, 17 nt, Staphylococcus aureus subsp. aureus MW2
cauugaaaauauuuuau

SEQ ID NO: 4002677 - RNA, 21 nt, Staphylococcus aureus subsp. aureus MW2
cauugaaaauauuuuauuaua

SEQ ID NO: 4002678 - RNA, 16 nt, Staphylococcus aureus subsp. aureus MW2
cauugaacgauaacaa

SEQ ID NO: 4002679 - RNA, 14 nt, Staphylococcus aureus subsp. aureus MW2
cauugaaugaugcu

SEQ ID NO: 4002680 - RNA, 21 nt, Staphylococcus aureus subsp. aureus MW2
cauugacacacccaaauuuag

SEQ ID NO: 4002681 - RNA, 22 nt, Staphylococcus aureus subsp. aureus MW2
cauugacuaugaaacuggauaa

SEQ ID NO: 4002682 - RNA, 21 nt, Staphylococcus aureus subsp. aureus MW2
cauugagauuaucuuuagaca

SEQ ID NO: 4002683 - RNA, 13 nt, Staphylococcus aureus subsp. aureus MW2
cauugagcaucuu

SEQ ID NO: 4002684 - RNA, 22 nt, Staphylococcus aureus subsp. aureus MW2
cauugagcaucuugucuaguuc

SEQ ID NO: 4002685 - RNA, 15 nt, Staphylococcus aureus subsp. aureus MW2
cauugauaaaauaau

SEQ ID NO: 4002686 - RNA, 18 nt, Staphylococcus aureus subsp. aureus MW2
cauugauaaauuuuuagu

SEQ ID NO: 4002687 - RNA, 18 nt, Staphylococcus aureus subsp. aureus MW2
ccaaaaauaauuaugaaa

SEQ ID NO: 4002688 - RNA, 14 nt, Staphylococcus aureus subsp. aureus MW2
ccaaaaccaaauga

SEQ ID NO: 4002689 - RNA, 22 nt, Staphylococcus aureus subsp. aureus MW2
ccaaacaaccugugauaaaaau

SEQ ID NO: 4002690 - RNA, 21 nt, Staphylococcus aureus subsp. aureus MW2
ccaaagaaagcuaauaucaau

SEQ ID NO: 4002691 - RNA, 14 nt, Staphylococcus aureus subsp. aureus MW2
ccaaaguaccaucu

SEQ ID NO: 4002692 - RNA, 13 nt, Staphylococcus aureus subsp. aureus MW2
ccaaauaaauaua

SEQ ID NO: 4002693 - RNA, 15 nt, Staphylococcus aureus subsp. aureus MW2
ccaaauaaauuuuga

SEQ ID NO: 4002694 - RNA, 21 nt, Staphylococcus aureus subsp. aureus MW2
ccaaauaacguuaauauaauu

SEQ ID NO: 4002695 - RNA, 18 nt, Staphylococcus aureus subsp. aureus MW2
ccaaauacaguuguacca

SEQ ID NO: 4002696 - RNA, 22 nt, Staphylococcus aureus subsp. aureus MW2
ccaaauacuaguaauaauaggc

SEQ ID NO: 4002697 - RNA, 17 nt, Staphylococcus aureus subsp. aureus MW2
ccaaauauuuuaucugu

SEQ ID NO: 4002698 - RNA, 17 nt, Staphylococcus aureus subsp. aureus MW2
ccaaaucggaauaaaau

SEQ ID NO: 4002699 - RNA, 19 nt, Staphylococcus aureus subsp. aureus MW2
ccaaaucggaauaaaauaa

SEQ ID NO: 4002700 - RNA, 18 nt, Staphylococcus aureus subsp. aureus MW2
ccaaaucuuuaauaaccu

SEQ ID NO: 4002701 - RNA, 21 nt, Staphylococcus aureus subsp. aureus MW2
ccaacaauagguacaacuaaa

SEQ ID NO: 4002702 - RNA, 14 nt, Staphylococcus aureus subsp. aureus MW2
ccaacacagagaaa

SEQ ID NO: 4002703 - RNA, 13 nt, Staphylococcus aureus subsp. aureus MW2
ccaacacauaaau

SEQ ID NO: 4002704 - RNA, 14 nt, Staphylococcus aureus subsp. aureus MW2
ccaacagcuucaac

SEQ ID NO: 4002705 - RNA, 17 nt, Staphylococcus aureus subsp. aureus MW2
ccaacauagaagcuggc

SEQ ID NO: 4002706 - RNA, 23 nt, Staphylococcus aureus subsp. aureus MW2
ccaacauauuuuaacuaugaaug

SEQ ID NO: 4002707 - RNA, 15 nt, Staphylococcus aureus subsp. aureus MW2
ccaacaucuucaaca

SEQ ID NO: 4002708 - RNA, 14 nt, Staphylococcus aureus subsp. aureus MW2
ccaaccaugcuuuu

SEQ ID NO: 4002709 - RNA, 20 nt, Staphylococcus aureus subsp. aureus MW2
ccaacugucgguucaucuaa

SEQ ID NO: 4002710 - RNA, 13 nt, Staphylococcus aureus subsp. aureus MW2
ccaacuugcacau

SEQ ID NO: 4002711 - RNA, 14 nt, Staphylococcus aureus subsp. aureus MW2
ccaacuugcacauu

SEQ ID NO: 4002712 - RNA, 13 nt, Staphylococcus aureus subsp. aureus MW2
ccaacuuuuuuaa

SEQ ID NO: 4002713 - RNA, 17 nt, Staphylococcus aureus subsp. aureus MW2
ccaagaacguguuugaa

SEQ ID NO: 4002714 - RNA, 21 nt, Staphylococcus aureus subsp. aureus MW2
ccaagaagacauuggauuacu

SEQ ID NO: 4002715 - RNA, 20 nt, Staphylococcus aureus subsp. aureus MW2
ccaagauaaaucaucauucu

SEQ ID NO: 4002716 - RNA, 16 nt, Staphylococcus aureus subsp. aureus MW2
ccaagaugguauugcu

SEQ ID NO: 4002717 - RNA, 20 nt, Staphylococcus aureus subsp. aureus MW2
ccaagcucuuuuuuguuaua

SEQ ID NO: 4002718 - RNA, 20 nt, Staphylococcus aureus subsp. aureus MW2
ccaaguaauucuuuaccauu

SEQ ID NO: 4002719 - RNA, 13 nt, Staphylococcus aureus subsp. aureus MW2
ccaaguauuuucu

SEQ ID NO: 4002720 - RNA, 17 nt, Staphylococcus aureus subsp. aureus MW2
ccaagucuaaaugcaau

SEQ ID NO: 4002721 - RNA, 21 nt, Staphylococcus aureus subsp. aureus MW2
ccaagucuaaaugcaauaugu

SEQ ID NO: 4002722 - RNA, 19 nt, Staphylococcus aureus subsp. aureus MW2
ccaaguuuugcacgcauac

SEQ ID NO: 4002723 - RNA, 17 nt, Staphylococcus aureus subsp. aureus MW2
ccaauaaaacuaugugu

SEQ ID NO: 4002724 - RNA, 19 nt, Staphylococcus aureus subsp. aureus MW2
ccaauaaaaugcaauuuuu

SEQ ID NO: 4002725 - RNA, 23 nt, Staphylococcus aureus subsp. aureus MW2
ccaauaaaaugucagcaacuucu

SEQ ID NO: 4002726 - RNA, 10 nt, Staphylococcus aureus subsp. aureus MW2
ccaauaaucc

SEQ ID NO: 4002727 - RNA, 14 nt, Staphylococcus aureus subsp. aureus MW2
ccaauaauugcugu

SEQ ID NO: 4002728 - RNA, 19 nt, Staphylococcus aureus subsp. aureus MW2
ccaauacaauuuagguuaa

SEQ ID NO: 4002729 - RNA, 18 nt, Staphylococcus aureus subsp. aureus MW2
ccaauacagaacuuuaau

SEQ ID NO: 4002730 - RNA, 20 nt, Staphylococcus aureus subsp. aureus MW2
ccaauacuuuuuauauaauu

SEQ ID NO: 4002731 - RNA, 18 nt, Staphylococcus aureus subsp. aureus MW2
ccaauagguucauuauuu

SEQ ID NO: 4002732 - RNA, 14 nt, Staphylococcus aureus subsp. aureus MW2
ccaauaucauauuu

SEQ ID NO: 4002733 - RNA, 14 nt, Staphylococcus aureus subsp. aureus MW2
ccaauauuuuucga

SEQ ID NO: 4002734 - RNA, 13 nt, Staphylococcus aureus subsp. aureus MW2
ccaaucacaauau

SEQ ID NO: 4002735 - RNA, 22 nt, Staphylococcus aureus subsp. aureus MW2
ccaaucgguacgaagugcaaca

SEQ ID NO: 4002736 - RNA, 17 nt, Staphylococcus aureus subsp. aureus MW2
ccaaugaugaauuguaa

SEQ ID NO: 4002737 - RNA, 16 nt, Staphylococcus aureus subsp. aureus MW2
ccaaugauuguuaaua

SEQ ID NO: 4002738 - RNA, 18 nt, Staphylococcus aureus subsp. aureus MW2
ccaaugcugaauaaauaa

SEQ ID NO: 4002739 - RNA, 17 nt, Staphylococcus aureus subsp. aureus MW2
ccaaugcuugaauuuua

SEQ ID NO: 4002740 - RNA, 19 nt, Staphylococcus aureus subsp. aureus MW2
ccaauggaaguuuuuuagu

SEQ ID NO: 4002741 - RNA, 16 nt, Staphylococcus aureus subsp. aureus MW2
ccaauguguuuaacuu

SEQ ID NO: 4002742 - RNA, 22 nt, Staphylococcus aureus subsp. aureus MW2
ccaauuaaaucgauuaagaaug

SEQ ID NO: 4002743 - RNA, 15 nt, Staphylococcus aureus subsp. aureus MW2
ccaauuaauucuuug

SEQ ID NO: 4002744 - RNA, 16 nt, Staphylococcus aureus subsp. aureus MW2
ccaauuaauucuuuga

SEQ ID NO: 4002745 - RNA, 21 nt, Staphylococcus aureus subsp. aureus MW2
ccaauuaucaacauaauauuu

SEQ ID NO: 4002746 - RNA, 22 nt, Staphylococcus aureus subsp. aureus MW2
ccaauuguuucagcuuguccau

SEQ ID NO: 4002747 - RNA, 13 nt, Staphylococcus aureus subsp. aureus MW2
ccaauuucucugu

SEQ ID NO: 4002748 - RNA, 17 nt, Staphylococcus aureus subsp. aureus MW2
ccacaucccaauuuaaa

SEQ ID NO: 4002749 - RNA, 16 nt, Staphylococcus aureus subsp. aureus MW2
ccaccagucguaauga

SEQ ID NO: 4002750 - RNA, 18 nt, Staphylococcus aureus subsp. aureus MW2
ccaccgcugcucuucucu

SEQ ID NO: 4002751 - RNA, 21 nt, Staphylococcus aureus subsp. aureus MW2
ccaccguuaaaauauaugaau

SEQ ID NO: 4002752 - RNA, 14 nt, Staphylococcus aureus subsp. aureus MW2
ccaccuuguuuaag

SEQ ID NO: 4002753 - RNA, 14 nt, Staphylococcus aureus subsp. aureus MW2
ccaccuuuaucugu

SEQ ID NO: 4002754 - RNA, 13 nt, Staphylococcus aureus subsp. aureus MW2
ccaccuuucuuua

SEQ ID NO: 4002755 - RNA, 18 nt, Staphylococcus aureus subsp. aureus MW2
ccacggcauuuaagccug

SEQ ID NO: 4002756 - RNA, 14 nt, Staphylococcus aureus subsp. aureus MW2
ccacgguuuaccac

SEQ ID NO: 4002757 - RNA, 19 nt, Staphylococcus aureus subsp. aureus MW2
ccacucaauucucuaacuu

SEQ ID NO: 4002758 - RNA, 19 nt, Staphylococcus aureus subsp. aureus MW2
ccacucauaaucaagucug

SEQ ID NO: 4002759 - RNA, 16 nt, Staphylococcus aureus subsp. aureus MW2
ccacuccuuaaacaaa

SEQ ID NO: 4002760 - RNA, 17 nt, Staphylococcus aureus subsp. aureus MW2
ccacuguagaaacacaa

SEQ ID NO: 4002761 - RNA, 14 nt, Staphylococcus aureus subsp. aureus MW2
ccacuucuucaccu

SEQ ID NO: 4002762 - RNA, 19 nt, Staphylococcus aureus subsp. aureus MW2
ccacuucuucaccugcguc

SEQ ID NO: 4002763 - RNA, 20 nt, Staphylococcus aureus subsp. aureus MW2
ccacuugaauacuuuuuaac

SEQ ID NO: 4002764 - RNA, 15 nt, Staphylococcus aureus subsp. aureus MW2
ccacuuugaucuuua

SEQ ID NO: 4002765 - RNA, 12 nt, Staphylococcus aureus subsp. aureus MW2
ccagacuccuaa

SEQ ID NO: 4002766 - RNA, 20 nt, Staphylococcus aureus subsp. aureus MW2
ccagaugcaaugauaccuuu

SEQ ID NO: 4002767 - RNA, 12 nt, Staphylococcus aureus subsp. aureus MW2
ccagauuugaau

SEQ ID NO: 4002768 - RNA, 17 nt, Staphylococcus aureus subsp. aureus MW2
ccagcaaauacuucaag

SEQ ID NO: 4002769 - RNA, 15 nt, Staphylococcus aureus subsp. aureus MW2
ccagccuauucguuu

SEQ ID NO: 4002770 - RNA, 20 nt, Staphylococcus aureus subsp. aureus MW2
ccagcuugaccgccuaugau

SEQ ID NO: 4002771 - RNA, 20 nt, Staphylococcus aureus subsp. aureus MW2
ccagcuuucguaccugcucu

SEQ ID NO: 4002772 - RNA, 13 nt, Staphylococcus aureus subsp. aureus MW2
ccagguccacaau

SEQ ID NO: 4002773 - RNA, 17 nt, Staphylococcus aureus subsp. aureus MW2
ccagguccacaauaaga

SEQ ID NO: 4002774 - RNA, 15 nt, Staphylococcus aureus subsp. aureus MW2
ccaggugcaucuuuu

SEQ ID NO: 4002775 - RNA, 23 nt, Staphylococcus aureus subsp. aureus MW2
ccaguacuuucgaguaauacuuu

SEQ ID NO: 4002776 - RNA, 14 nt, Staphylococcus aureus subsp. aureus MW2
ccccuagcaaaaau

SEQ ID NO: 4002777 - RNA, 21 nt, Staphylococcus aureus subsp. aureus MW2
ccccuagcaaaaauacuuuuu

SEQ ID NO: 4002778 - RNA, 16 nt, Staphylococcus aureus subsp. aureus MW2
ccccuuacaacuuuag

SEQ ID NO: 4002779 - RNA, 14 nt, Staphylococcus aureus subsp. aureus MW2
cccggaauauuaac

SEQ ID NO: 4002780 - RNA, 18 nt, Staphylococcus aureus subsp. aureus MW2
cccguaauaauuuacagg

SEQ ID NO: 4002781 - RNA, 15 nt, Staphylococcus aureus subsp. aureus MW2
cccguuauaucuuuu

SEQ ID NO: 4002782 - RNA, 21 nt, Staphylococcus aureus subsp. aureus MW2
cccuacugcaccgauaucaua

SEQ ID NO: 4002783 - RNA, 19 nt, Staphylococcus aureus subsp. aureus MW2
cccuagguuuauauaucac

SEQ ID NO: 4002784 - RNA, 15 nt, Staphylococcus aureus subsp. aureus MW2
cccuauaauguuuug

SEQ ID NO: 4002785 - RNA, 16 nt, Staphylococcus aureus subsp. aureus MW2
cccuaugaaauaacua

SEQ ID NO: 4002786 - RNA, 13 nt, Staphylococcus aureus subsp. aureus MW2
cccuuagucaugu

SEQ ID NO: 4002787 - RNA, 22 nt, Staphylococcus aureus subsp. aureus MW2
cccuuauauuuuuuacaagcuu

SEQ ID NO: 4002788 - RNA, 24 nt, Staphylococcus aureus subsp. aureus MW2
ccgaaaaaaccgagaaucuccauu

SEQ ID NO: 4002789 - RNA, 18 nt, Staphylococcus aureus subsp. aureus MW2
ccgaaaauugcuaaaaaa

SEQ ID NO: 4002790 - RNA, 21 nt, Staphylococcus aureus subsp. aureus MW2
ccgaaaauugcuaaaaaaauu

SEQ ID NO: 4002791 - RNA, 19 nt, Staphylococcus aureus subsp. aureus MW2
ccgaaaguuagacuaaaaa

SEQ ID NO: 4002792 - RNA, 18 nt, Staphylococcus aureus subsp. aureus MW2
ccgaacacaaaaaugaag

SEQ ID NO: 4002793 - RNA, 19 nt, Staphylococcus aureus subsp. aureus MW2
ccgaacaucugaaaaaauu

SEQ ID NO: 4002794 - RNA, 22 nt, Staphylococcus aureus subsp. aureus MW2
ccgaacaucugaaaaaauuaau

SEQ ID NO: 4002795 - RNA, 21 nt, Staphylococcus aureus subsp. aureus MW2
ccgaauaaaggucuauauaua

SEQ ID NO: 4002796 - RNA, 22 nt, Staphylococcus aureus subsp. aureus MW2
ccgaauaaaggucuauauauau

SEQ ID NO: 4002797 - RNA, 15 nt, Staphylococcus aureus subsp. aureus MW2
ccgacugcaccucca

SEQ ID NO: 4002798 - RNA, 16 nt, Staphylococcus aureus subsp. aureus MW2
ccgagaauuauuauuc

SEQ ID NO: 4002799 - RNA, 19 nt, Staphylococcus aureus subsp. aureus MW2
ccgagauuggcaauuugga

SEQ ID NO: 4002800 - RNA, 16 nt, Staphylococcus aureus subsp. aureus MW2
ccgauuuugauauaaa

SEQ ID NO: 4002801 - RNA, 17 nt, Staphylococcus aureus subsp. aureus MW2
ccgauuuugauauaaaa

SEQ ID NO: 4002802 - RNA, 18 nt, Staphylococcus aureus subsp. aureus MW2
ccgcacuucuauauuaau

SEQ ID NO: 4002803 - RNA, 17 nt, Staphylococcus aureus subsp. aureus MW2
ccgccaacuugcacauu

SEQ ID NO: 4002804 - RNA, 14 nt, Staphylococcus aureus subsp. aureus MW2
ccgccuaauaauaa

SEQ ID NO: 4002805 - RNA, 13 nt, Staphylococcus aureus subsp. aureus MW2
ccggaaauuaaau

SEQ ID NO: 4002806 - RNA, 16 nt, Staphylococcus aureus subsp. aureus MW2
ccggaacauuaaaagg

SEQ ID NO: 4002807 - RNA, 20 nt, Staphylococcus aureus subsp. aureus MW2
ccggaauauuaacaccagau

SEQ ID NO: 4002808 - RNA, 15 nt, Staphylococcus aureus subsp. aureus MW2
ccggcuuuuucuuuu

SEQ ID NO: 4002809 - RNA, 15 nt, Staphylococcus aureus subsp. aureus MW2
ccguaaugagaguaa

SEQ ID NO: 4002810 - RNA, 13 nt, Staphylococcus aureus subsp. aureus MW2
ccguauuucaaau

SEQ ID NO: 4002811 - RNA, 16 nt, Staphylococcus aureus subsp. aureus MW2
ccguuaaaaagacggu

SEQ ID NO: 4002812 - RNA, 19 nt, Staphylococcus aureus subsp. aureus MW2
ccguuaacguguuguuaac

SEQ ID NO: 4002813 - RNA, 12 nt, Staphylococcus aureus subsp. aureus MW2
ccguuauuuuca

SEQ ID NO: 4002814 - RNA, 13 nt, Staphylococcus aureus subsp. aureus MW2
ccguuauuuuuuu

SEQ ID NO: 4002815 - RNA, 15 nt, Staphylococcus aureus subsp. aureus MW2
ccguugguugugauu

SEQ ID NO: 4002816 - RNA, 20 nt, Staphylococcus aureus subsp. aureus MW2
ccuaaaaauaaaaucaacuu

SEQ ID NO: 4002817 - RNA, 15 nt, Staphylococcus aureus subsp. aureus MW2
ccuaaaguauuaucu

SEQ ID NO: 4002818 - RNA, 14 nt, Staphylococcus aureus subsp. aureus MW2
ccuaaaugauuaau

SEQ ID NO: 4002819 - RNA, 19 nt, Staphylococcus aureus subsp. aureus MW2
ccuaagacauaaauuuuua

SEQ ID NO: 4002820 - RNA, 13 nt, Staphylococcus aureus subsp. aureus MW2
ccuaauaauaaaa

SEQ ID NO: 4002821 - RNA, 12 nt, Staphylococcus aureus subsp. aureus MW2
ccuaaugauaau

SEQ ID NO: 4002822 - RNA, 23 nt, Staphylococcus aureus subsp. aureus MW2
ccuaauucgccaucuuuuuuagc

SEQ ID NO: 4002823 - RNA, 20 nt, Staphylococcus aureus subsp. aureus MW2
ccuacaacaccaauugaaau

SEQ ID NO: 4002824 - RNA, 16 nt, Staphylococcus aureus subsp. aureus MW2
ccuacguguguaguag

SEQ ID NO: 4002825 - RNA, 12 nt, Staphylococcus aureus subsp. aureus MW2
ccuacugcuguc

SEQ ID NO: 4002826 - RNA, 18 nt, Staphylococcus aureus subsp. aureus MW2
ccuacuuuucaacuuuag

SEQ ID NO: 4002827 - RNA, 14 nt, Staphylococcus aureus subsp. aureus MW2
ccuacuuuuucaau

SEQ ID NO: 4002828 - RNA, 17 nt, Staphylococcus aureus subsp. aureus MW2
ccuagauaccaaacugc

SEQ ID NO: 4002829 - RNA, 20 nt, Staphylococcus aureus subsp. aureus MW2
ccuagcaaaaauacuuuuug

SEQ ID NO: 4002830 - RNA, 21 nt, Staphylococcus aureus subsp. aureus MW2
ccuaggaaauaaaaaauaacc

SEQ ID NO: 4002831 - RNA, 16 nt, Staphylococcus aureus subsp. aureus MW2
ccuagguuuauauauc

SEQ ID NO: 4002832 - RNA, 20 nt, Staphylococcus aureus subsp. aureus MW2
ccuagguuuauauaucacau

SEQ ID NO: 4002833 - RNA, 13 nt, Staphylococcus aureus subsp. aureus MW2
ccuauauguaggg

SEQ ID NO: 4002834 - RNA, 15 nt, Staphylococcus aureus subsp. aureus MW2
ccuaucgucgcuaau

SEQ ID NO: 4002835 - RNA, 16 nt, Staphylococcus aureus subsp. aureus MW2
ccuaugccaaauaacg

SEQ ID NO: 4002836 - RNA, 20 nt, Staphylococcus aureus subsp. aureus MW2
ccuauggcgcaauuuuuaac

SEQ ID NO: 4002837 - RNA, 21 nt, Staphylococcus aureus subsp. aureus MW2
ccuaugguuacccuuuuucaa

SEQ ID NO: 4002838 - RNA, 19 nt, Staphylococcus aureus subsp. aureus MW2
ccuauuaaaucugcuugug

SEQ ID NO: 4002839 - RNA, 12 nt, Staphylococcus aureus subsp. aureus MW2
ccuauuaggauc

SEQ ID NO: 4002840 - RNA, 22 nt, Staphylococcus aureus subsp. aureus MW2
ccuauuccuaauaaauaucuua

SEQ ID NO: 4002841 - RNA, 13 nt, Staphylococcus aureus subsp. aureus MW2
ccuauuugauuaa

SEQ ID NO: 4002842 - RNA, 19 nt, Staphylococcus aureus subsp. aureus MW2
ccuauuuuuuuauguuaua

SEQ ID NO: 4002843 - RNA, 18 nt, Staphylococcus aureus subsp. aureus MW2
ccucaacauuaaaaugug

SEQ ID NO: 4002844 - RNA, 14 nt, Staphylococcus aureus subsp. aureus MW2
ccucauaaaucaug

SEQ ID NO: 4002845 - RNA, 16 nt, Staphylococcus aureus subsp. aureus MW2
ccucgguauucaauuc

SEQ ID NO: 4002846 - RNA, 14 nt, Staphylococcus aureus subsp. aureus MW2
ccucuccuucggcu

SEQ ID NO: 4002847 - RNA, 16 nt, Staphylococcus aureus subsp. aureus MW2
ccucugcaacgccuuu

SEQ ID NO: 4002848 - RNA, 21 nt, Staphylococcus aureus subsp. aureus MW2
ccucuuuucuuuaaaaaagga

SEQ ID NO: 4002849 - RNA, 21 nt, Staphylococcus aureus subsp. aureus MW2
ccugaaucaggaauguuugua

SEQ ID NO: 4002850 - RNA, 18 nt, Staphylococcus aureus subsp. aureus MW2
ccugacauucaucacaaa

SEQ ID NO: 4002851 - RNA, 15 nt, Staphylococcus aureus subsp. aureus MW2
ccugauaaugcaugu

SEQ ID NO: 4002852 - RNA, 22 nt, Staphylococcus aureus subsp. aureus MW2
ccugauuccacuacaaucauac

SEQ ID NO: 4002853 - RNA, 21 nt, Staphylococcus aureus subsp. aureus MW2
ccugcaacuuuugguaauuua

SEQ ID NO: 4002854 - RNA, 18 nt, Staphylococcus aureus subsp. aureus MW2
ccugcauauucacgauau

SEQ ID NO: 4002855 - RNA, 15 nt, Staphylococcus aureus subsp. aureus MW2
ccugcuuuuuuuaua

SEQ ID NO: 4002856 - RNA, 23 nt, Staphylococcus aureus subsp. aureus MW2
ccuggaaucgaaaauaucaauuu

SEQ ID NO: 4002857 - RNA, 19 nt, Staphylococcus aureus subsp. aureus MW2
ccuguaaaaccauagauaa

SEQ ID NO: 4002858 - RNA, 12 nt, Staphylococcus aureus subsp. aureus MW2
ccugugauaaaa

SEQ ID NO: 4002859 - RNA, 13 nt, Staphylococcus aureus subsp. aureus MW2
ccugugauaaaaa

SEQ ID NO: 4002860 - RNA, 19 nt, Staphylococcus aureus subsp. aureus MW2
ccuguucuuuauuuaaagg

SEQ ID NO: 4002861 - RNA, 14 nt, Staphylococcus aureus subsp. aureus MW2
ccuuaaaauauuua

SEQ ID NO: 4002862 - RNA, 19 nt, Staphylococcus aureus subsp. aureus MW2
ccuuaaauauaguugccau

SEQ ID NO: 4002863 - RNA, 18 nt, Staphylococcus aureus subsp. aureus MW2
ccuuacccaaaaaauugu

SEQ ID NO: 4002864 - RNA, 13 nt, Staphylococcus aureus subsp. aureus MW2
ccuuauauuuuau

SEQ ID NO: 4002865 - RNA, 17 nt, Staphylococcus aureus subsp. aureus MW2
cgauaacaauuuauuaa

SEQ ID NO: 4002866 - RNA, 17 nt, Staphylococcus aureus subsp. aureus MW2
cgauaacuacacuuaau

SEQ ID NO: 4002867 - RNA, 17 nt, Staphylococcus aureus subsp. aureus MW2
cgauaagcaaaaauucu

SEQ ID NO: 4002868 - RNA, 13 nt, Staphylococcus aureus subsp. aureus MW2
cgauaauaacuag

SEQ ID NO: 4002869 - RNA, 15 nt, Staphylococcus aureus subsp. aureus MW2
cgauaauagauaaug

SEQ ID NO: 4002870 - RNA, 17 nt, Staphylococcus aureus subsp. aureus MW2
cgauaauucuaacuuga

SEQ ID NO: 4002871 - RNA, 21 nt, Staphylococcus aureus subsp. aureus MW2
cgauaauuguugcauuacuuu

SEQ ID NO: 4002872 - RNA, 15 nt, Staphylococcus aureus subsp. aureus MW2
cgauaccuaaaauac

SEQ ID NO: 4002873 - RNA, 16 nt, Staphylococcus aureus subsp. aureus MW2
cgauacuuuuaaaauc

SEQ ID NO: 4002874 - RNA, 18 nt, Staphylococcus aureus subsp. aureus MW2
cgauagaaagcgucuuuu

SEQ ID NO: 4002875 - RNA, 20 nt, Staphylococcus aureus subsp. aureus MW2
cgauagaaagcgucuuuuua

SEQ ID NO: 4002876 - RNA, 20 nt, Staphylococcus aureus subsp. aureus MW2
cgauauggucuuuuaauauu

SEQ ID NO: 4002877 - RNA, 17 nt, Staphylococcus aureus subsp. aureus MW2
cgauauuucuaguugca

SEQ ID NO: 4002878 - RNA, 18 nt, Staphylococcus aureus subsp. aureus MW2
cgaucauaaauauuuucu

SEQ ID NO: 4002879 - RNA, 16 nt, Staphylococcus aureus subsp. aureus MW2
cgaucuaacaauugca

SEQ ID NO: 4002880 - RNA, 14 nt, Staphylococcus aureus subsp. aureus MW2
cgaugucagacgaa

SEQ ID NO: 4002881 - RNA, 19 nt, Staphylococcus aureus subsp. aureus MW2
cgauguguaacauuacguu

SEQ ID NO: 4002882 - RNA, 14 nt, Staphylococcus aureus subsp. aureus MW2
cgauuaaaugaugc

SEQ ID NO: 4002883 - RNA, 19 nt, Staphylococcus aureus subsp. aureus MW2
cgauuaagaaugcaccaac

SEQ ID NO: 4002884 - RNA, 17 nt, Staphylococcus aureus subsp. aureus MW2
cgauuaauaaaauucua

SEQ ID NO: 4002885 - RNA, 15 nt, Staphylococcus aureus subsp. aureus MW2
cgauuaauucuucuu

SEQ ID NO: 4002886 - RNA, 19 nt, Staphylococcus aureus subsp. aureus MW2
cgauuauuuagauaaaaaa

SEQ ID NO: 4002887 - RNA, 21 nt, Staphylococcus aureus subsp. aureus MW2
cgauuauuuagauaaaaaaua

SEQ ID NO: 4002888 - RNA, 19 nt, Staphylococcus aureus subsp. aureus MW2
cgauucgugauuuggaaua

SEQ ID NO: 4002889 - RNA, 21 nt, Staphylococcus aureus subsp. aureus MW2
cgauugauaauguaaaaugau

SEQ ID NO: 4002890 - RNA, 21 nt, Staphylococcus aureus subsp. aureus MW2
cgauuuauuuauaaaauaaaa

SEQ ID NO: 4002891 - RNA, 19 nt, Staphylococcus aureus subsp. aureus MW2
cgauuugauaaaaaaugaa

SEQ ID NO: 4002892 - RNA, 15 nt, Staphylococcus aureus subsp. aureus MW2
cgauuuguucaauga

SEQ ID NO: 4002893 - RNA, 15 nt, Staphylococcus aureus subsp. aureus MW2
cgauuuuaaagaaaa

SEQ ID NO: 4002894 - RNA, 13 nt, Staphylococcus aureus subsp. aureus MW2
cgcaaauuaaaua

SEQ ID NO: 4002895 - RNA, 21 nt, Staphylococcus aureus subsp. aureus MW2
cgcaaucauuagcgaaaaccu

SEQ ID NO: 4002896 - RNA, 14 nt, Staphylococcus aureus subsp. aureus MW2
cgcaauuuaauauu

SEQ ID NO: 4002897 - RNA, 16 nt, Staphylococcus aureus subsp. aureus MW2
cgcaauuuuuaacaaa

SEQ ID NO: 4002898 - RNA, 18 nt, Staphylococcus aureus subsp. aureus MW2
cgcacaucuaagugauau

SEQ ID NO: 4002899 - RNA, 13 nt, Staphylococcus aureus subsp. aureus MW2
cgcacauuauuuu

SEQ ID NO: 4002900 - RNA, 22 nt, Staphylococcus aureus subsp. aureus MW2
cgcacugcauuaucaacuugaa

SEQ ID NO: 4002901 - RNA, 13 nt, Staphylococcus aureus subsp. aureus MW2
cgcaucauguaua

SEQ ID NO: 4002902 - RNA, 20 nt, Staphylococcus aureus subsp. aureus MW2
cgcaucuuuugguuuaucug

SEQ ID NO: 4002903 - RNA, 22 nt, Staphylococcus aureus subsp. aureus MW2
cgcauuguuucuagcuuuaauu

SEQ ID NO: 4002904 - RNA, 17 nt, Staphylococcus aureus subsp. aureus MW2
cgccaacuaaaucacca

SEQ ID NO: 4002905 - RNA, 22 nt, Staphylococcus aureus subsp. aureus MW2
cgccaauacagaacuuuaauaa

SEQ ID NO: 4002906 - RNA, 15 nt, Staphylococcus aureus subsp. aureus MW2
cgccacaacauguuu

SEQ ID NO: 4002907 - RNA, 12 nt, Staphylococcus aureus subsp. aureus MW2
cgccagcuucua

SEQ ID NO: 4002908 - RNA, 12 nt, Staphylococcus aureus subsp. aureus MW2
cgccagcuucuu

SEQ ID NO: 4002909 - RNA, 12 nt, Staphylococcus aureus subsp. aureus MW2
cgccauaaucau

SEQ ID NO: 4002910 - RNA, 14 nt, Staphylococcus aureus subsp. aureus MW2
cgccuaaauauuua

SEQ ID NO: 4002911 - RNA, 18 nt, Staphylococcus aureus subsp. aureus MW2
cgccuuguuuauuuuuaa

SEQ ID NO: 4002912 - RNA, 20 nt, Staphylococcus aureus subsp. aureus MW2
cgcgacguuuaaaugcccac

SEQ ID NO: 4002913 - RNA, 22 nt, Staphylococcus aureus subsp. aureus MW2
cgcuauauguaaagcuaauuuu

SEQ ID NO: 4002914 - RNA, 23 nt, Staphylococcus aureus subsp. aureus MW2
cgcucauaugucuguuccucaau

SEQ ID NO: 4002915 - RNA, 19 nt, Staphylococcus aureus subsp. aureus MW2
cgcucaugaguuucucauc

SEQ ID NO: 4002916 - RNA, 13 nt, Staphylococcus aureus subsp. aureus MW2
cgcucucuuuuua

SEQ ID NO: 4002917 - RNA, 16 nt, Staphylococcus aureus subsp. aureus MW2
cgcucuggauuuuucu

SEQ ID NO: 4002918 - RNA, 22 nt, Staphylococcus aureus subsp. aureus MW2
cgcuguaauaccuuuacuuuca

SEQ ID NO: 4002919 - RNA, 13 nt, Staphylococcus aureus subsp. aureus MW2
cgcuguuuuaaau

SEQ ID NO: 4002920 - RNA, 19 nt, Staphylococcus aureus subsp. aureus MW2
cgcuguuuuuaaaugcuuu

SEQ ID NO: 4002921 - RNA, 23 nt, Staphylococcus aureus subsp. aureus MW2
cgcuuaacccuaaagcuaaugca

SEQ ID NO: 4002922 - RNA, 11 nt, Staphylococcus aureus subsp. aureus MW2
cgcuuaauucu

SEQ ID NO: 4002923 - RNA, 15 nt, Staphylococcus aureus subsp. aureus MW2
cgcuuacauuaugaa

SEQ ID NO: 4002924 - RNA, 13 nt, Staphylococcus aureus subsp. aureus MW2
cgcuuacuuauau

SEQ ID NO: 4002925 - RNA, 16 nt, Staphylococcus aureus subsp. aureus MW2
cgcuuauugcauugua

SEQ ID NO: 4002926 - RNA, 14 nt, Staphylococcus aureus subsp. aureus MW2
cgcuuuaaaucauu

SEQ ID NO: 4002927 - RNA, 15 nt, Staphylococcus aureus subsp. aureus MW2
cgcuuuucuaauuuu

SEQ ID NO: 4002928 - RNA, 22 nt, Staphylococcus aureus subsp. aureus MW2
cgcuuuucuaauuuuucuuuaa

SEQ ID NO: 4002929 - RNA, 22 nt, Staphylococcus aureus subsp. aureus MW2
cgcuuuugaaguugguccaaau

SEQ ID NO: 4002930 - RNA, 11 nt, Staphylococcus aureus subsp. aureus MW2
cgcuuuuuaau

SEQ ID NO: 4002931 - RNA, 13 nt, Staphylococcus aureus subsp. aureus MW2
cgcuuuuucauag

SEQ ID NO: 4002932 - RNA, 20 nt, Staphylococcus aureus subsp. aureus MW2
cggaaaauaucacuaauaua

SEQ ID NO: 4002933 - RNA, 14 nt, Staphylococcus aureus subsp. aureus MW2
cggaaagucagcuu

SEQ ID NO: 4002934 - RNA, 17 nt, Staphylococcus aureus subsp. aureus MW2
cggaaagucagcuuaca

SEQ ID NO: 4002935 - RNA, 19 nt, Staphylococcus aureus subsp. aureus MW2
cggaaagucagcuuacaau

SEQ ID NO: 4002936 - RNA, 21 nt, Staphylococcus aureus subsp. aureus MW2
cggaaagucagguuacaauaa

SEQ ID NO: 4002937 - RNA, 21 nt, Staphylococcus aureus subsp. aureus MW2
cggaagcauauuucuaaauua

SEQ ID NO: 4002938 - RNA, 12 nt, Staphylococcus aureus subsp. aureus MW2
cggaauaaaaua

SEQ ID NO: 4002939 - RNA, 14 nt, Staphylococcus aureus subsp. aureus MW2
cggaauaaaauaaa

SEQ ID NO: 4002940 - RNA, 15 nt, Staphylococcus aureus subsp. aureus MW2
cggaauaacuuuuua

SEQ ID NO: 4002941 - RNA, 19 nt, Staphylococcus aureus subsp. aureus MW2
cggacaaguugcacauuau

SEQ ID NO: 4002942 - RNA, 13 nt, Staphylococcus aureus subsp. aureus MW2
cggacugaaagaa

SEQ ID NO: 4002943 - RNA, 10 nt, Staphylococcus aureus subsp. aureus MW2
cggacugaug

SEQ ID NO: 4002944 - RNA, 13 nt, Staphylococcus aureus subsp. aureus MW2
cggaugagaaaug

SEQ ID NO: 4002945 - RNA, 21 nt, Staphylococcus aureus subsp. aureus MW2
cggauguuucuucaauuuaau

SEQ ID NO: 4002946 - RNA, 17 nt, Staphylococcus aureus subsp. aureus MW2
cggauuaucuaacucau

SEQ ID NO: 4002947 - RNA, 20 nt, Staphylococcus aureus subsp. aureus MW2
cggcauaauacacauugcaa

SEQ ID NO: 4002948 - RNA, 14 nt, Staphylococcus aureus subsp. aureus MW2
cggcauuuuuauau

SEQ ID NO: 4002949 - RNA, 16 nt, Staphylococcus aureus subsp. aureus MW2
cggccuucuuucgcuu

SEQ ID NO: 4002950 - RNA, 13 nt, Staphylococcus aureus subsp. aureus MW2
cggcuuuggauuu

SEQ ID NO: 4002951 - RNA, 20 nt, Staphylococcus aureus subsp. aureus MW2
cgggccccaacauagaagcu

SEQ ID NO: 4002952 - RNA, 16 nt, Staphylococcus aureus subsp. aureus MW2
cgggcuauauuugaua

SEQ ID NO: 4002953 - RNA, 19 nt, Staphylococcus aureus subsp. aureus MW2
cggggccccaacaaagaag

SEQ ID NO: 4002954 - RNA, 20 nt, Staphylococcus aureus subsp. aureus MW2
cuaaaaacagcaguaagaca

SEQ ID NO: 4002955 - RNA, 21 nt, Staphylococcus aureus subsp. aureus MW2
cuaaaaagcgugguucccaau

SEQ ID NO: 4002956 - RNA, 15 nt, Staphylococcus aureus subsp. aureus MW2
cuaaaaagucuuuaa

SEQ ID NO: 4002957 - RNA, 22 nt, Staphylococcus aureus subsp. aureus MW2
cuaaaaaucuauauaacgcuuu

SEQ ID NO: 4002958 - RNA, 17 nt, Staphylococcus aureus subsp. aureus MW2
cuaaaacaucacuugcu

SEQ ID NO: 4002959 - RNA, 20 nt, Staphylococcus aureus subsp. aureus MW2
cuaaaacaugauacgugguu

SEQ ID NO: 4002960 - RNA, 20 nt, Staphylococcus aureus subsp. aureus MW2
cuaaaaccuauuccuaauaa

SEQ ID NO: 4002961 - RNA, 21 nt, Staphylococcus aureus subsp. aureus MW2
cuaaaacggaaauaaccacca

SEQ ID NO: 4002962 - RNA, 17 nt, Staphylococcus aureus subsp. aureus MW2
cuaaaaguuucccaagc

SEQ ID NO: 4002963 - RNA, 13 nt, Staphylococcus aureus subsp. aureus MW2
cuaaaauaacaac

SEQ ID NO: 4002964 - RNA, 21 nt, Staphylococcus aureus subsp. aureus MW2
cuaaaauagaaaaauuucaaa

SEQ ID NO: 4002965 - RNA, 18 nt, Staphylococcus aureus subsp. aureus MW2
cuaaaauaucaaaauaua

SEQ ID NO: 4002966 - RNA, 15 nt, Staphylococcus aureus subsp. aureus MW2
cuaaaauuaaccauu

SEQ ID NO: 4002967 - RNA, 17 nt, Staphylococcus aureus subsp. aureus MW2
cuaaaauucuuucagcu

SEQ ID NO: 4002968 - RNA, 14 nt, Staphylococcus aureus subsp. aureus MW2
cuaaaauuuccuca

SEQ ID NO: 4002969 - RNA, 18 nt, Staphylococcus aureus subsp. aureus MW2
cuaaaccgauuaauauaa

SEQ ID NO: 4002970 - RNA, 15 nt, Staphylococcus aureus subsp. aureus MW2
cuaaaccucaacauu

SEQ ID NO: 4002971 - RNA, 18 nt, Staphylococcus aureus subsp. aureus MW2
cuaaaccucuaaauaaaa

SEQ ID NO: 4002972 - RNA, 18 nt, Staphylococcus aureus subsp. aureus MW2
cuaaaccuuuuuuaaguu

SEQ ID NO: 4002973 - RNA, 20 nt, Staphylococcus aureus subsp. aureus MW2
cuaaacgauaaauuaaugua

SEQ ID NO: 4002974 - RNA, 16 nt, Staphylococcus aureus subsp. aureus MW2
cuaaacgaucaacugc

SEQ ID NO: 4002975 - RNA, 15 nt, Staphylococcus aureus subsp. aureus MW2
cuaaacgcuaaaauu

SEQ ID NO: 4002976 - RNA, 14 nt, Staphylococcus aureus subsp. aureus MW2
cuaaacguucaugu

SEQ ID NO: 4002977 - RNA, 21 nt, Staphylococcus aureus subsp. aureus MW2
cuaaacucguugcgcucuuuu

SEQ ID NO: 4002978 - RNA, 20 nt, Staphylococcus aureus subsp. aureus MW2
cuaaagaaugacguuaucau

SEQ ID NO: 4002979 - RNA, 20 nt, Staphylococcus aureus subsp. aureus MW2
cuaaagauuucaguucauca

SEQ ID NO: 4002980 - RNA, 12 nt, Staphylococcus aureus subsp. aureus MW2
cuaaagcaauua

SEQ ID NO: 4002981 - RNA, 20 nt, Staphylococcus aureus subsp. aureus MW2
cuaaagcaauuauuauugcu

SEQ ID NO: 4002982 - RNA, 17 nt, Staphylococcus aureus subsp. aureus MW2
cuaaagcgauuuccauc

SEQ ID NO: 4002983 - RNA, 17 nt, Staphylococcus aureus subsp. aureus MW2
cuaaagcuauaaaaaau

SEQ ID NO: 4002984 - RNA, 15 nt, Staphylococcus aureus subsp. aureus MW2
cuaaaggaauuucaa

SEQ ID NO: 4002985 - RNA, 22 nt, Staphylococcus aureus subsp. aureus MW2
cuaaagggacaggcguaucugu

SEQ ID NO: 4002986 - RNA, 18 nt, Staphylococcus aureus subsp. aureus MW2
cuaaagguauucuauuuu

SEQ ID NO: 4002987 - RNA, 19 nt, Staphylococcus aureus subsp. aureus MW2
cuaaagguauucuauuuuu

SEQ ID NO: 4002988 - RNA, 13 nt, Staphylococcus aureus subsp. aureus MW2
cuaaaguaaauaa

SEQ ID NO: 4002989 - RNA, 14 nt, Staphylococcus aureus subsp. aureus MW2
cuaaaguaaauaac

SEQ ID NO: 4002990 - RNA, 16 nt, Staphylococcus aureus subsp. aureus MW2
cuaaaguauuaucuaa

SEQ ID NO: 4002991 - RNA, 19 nt, Staphylococcus aureus subsp. aureus MW2
cuaaaguguagccaaauaa

SEQ ID NO: 4002992 - RNA, 23 nt, Staphylococcus aureus subsp. aureus MW2
cuaaauaguagacgguaucaucu

SEQ ID NO: 4002993 - RNA, 15 nt, Staphylococcus aureus subsp. aureus MW2
cuaaauauuauaaaa

SEQ ID NO: 4002994 - RNA, 16 nt, Staphylococcus aureus subsp. aureus MW2
cuaaauauuauaaaaa

SEQ ID NO: 4002995 - RNA, 18 nt, Staphylococcus aureus subsp. aureus MW2
cuaaauauuauaaaaaga

SEQ ID NO: 4002996 - RNA, 20 nt, Staphylococcus aureus subsp. aureus MW2
cuaaauauuauaaaaagaua

SEQ ID NO: 4002997 - RNA, 21 nt, Staphylococcus aureus subsp. aureus MW2
cuaaauauuauaaaaagauau

SEQ ID NO: 4002998 - RNA, 18 nt, Staphylococcus aureus subsp. aureus MW2
cuaaauauuuaccuugcu

SEQ ID NO: 4002999 - RNA, 21 nt, Staphylococcus aureus subsp. aureus MW2
cuaaaucaccauuuuuuacaa

SEQ ID NO: 4003000 - RNA, 18 nt, Staphylococcus aureus subsp. aureus MW2
cuaaaucgucugcuaaau

SEQ ID NO: 4003001 - RNA, 14 nt, Staphylococcus aureus subsp. aureus MW2
cuaaaucuauacuu

SEQ ID NO: 4003002 - RNA, 13 nt, Staphylococcus aureus subsp. aureus MW2
cuaaaucuuuaaa

SEQ ID NO: 4003003 - RNA, 23 nt, Staphylococcus aureus subsp. aureus MW2
cuaaaugauggguaguuaauaua

SEQ ID NO: 4003004 - RNA, 17 nt, Staphylococcus aureus subsp. aureus MW2
cuaaaugcaauauguaa

SEQ ID NO: 4003005 - RNA, 22 nt, Staphylococcus aureus subsp. aureus MW2
cuaaaugcacuagcaacaucuu

SEQ ID NO: 4003006 - RNA, 23 nt, Staphylococcus aureus subsp. aureus MW2
cuaaaugcacuagcaacaucuuu

SEQ ID NO: 4003007 - RNA, 16 nt, Staphylococcus aureus subsp. aureus MW2
cuaaaugguuaucuaa

SEQ ID NO: 4003008 - RNA, 20 nt, Staphylococcus aureus subsp. aureus MW2
cuaaaugguuaucuaaaauu

SEQ ID NO: 4003009 - RNA, 14 nt, Staphylococcus aureus subsp. aureus MW2
cuaaauguaaaauc

SEQ ID NO: 4003010 - RNA, 19 nt, Staphylococcus aureus subsp. aureus MW2
cuaaauguaaaaucauuaa

SEQ ID NO: 4003011 - RNA, 15 nt, Staphylococcus aureus subsp. aureus MW2
cuaaauuauuguuua

SEQ ID NO: 4003012 - RNA, 16 nt, Staphylococcus aureus subsp. aureus MW2
cuaaauuauuguuuau

SEQ ID NO: 4003013 - RNA, 19 nt, Staphylococcus aureus subsp. aureus MW2
cuaaauuauuuauucauua

SEQ ID NO: 4003014 - RNA, 18 nt, Staphylococcus aureus subsp. aureus MW2
cuaaauucaauaaucuua

SEQ ID NO: 4003015 - RNA, 19 nt, Staphylococcus aureus subsp. aureus MW2
cuaaauucaauaaucuuag

SEQ ID NO: 4003016 - RNA, 22 nt, Staphylococcus aureus subsp. aureus MW2
cuaaauucaguucaaacagaaa

SEQ ID NO: 4003017 - RNA, 14 nt, Staphylococcus aureus subsp. aureus MW2
cuaaauucuuuuug

SEQ ID NO: 4003018 - RNA, 16 nt, Staphylococcus aureus subsp. aureus MW2
cuaaauucuuuuuguu

SEQ ID NO: 4003019 - RNA, 11 nt, Staphylococcus aureus subsp. aureus MW2
cuaaauugucg

SEQ ID NO: 4003020 - RNA, 13 nt, Staphylococcus aureus subsp. aureus MW2
cuaaauuuauaua

SEQ ID NO: 4003021 - RNA, 21 nt, Staphylococcus aureus subsp. aureus MW2
cuaaauuuauauagucuauga

SEQ ID NO: 4003022 - RNA, 21 nt, Staphylococcus aureus subsp. aureus MW2
cuaacaauuugaggauacaua

SEQ ID NO: 4003023 - RNA, 15 nt, Staphylococcus aureus subsp. aureus MW2
cuaacaguuaauaug

SEQ ID NO: 4003024 - RNA, 14 nt, Staphylococcus aureus subsp. aureus MW2
cuaacauaacugua

SEQ ID NO: 4003025 - RNA, 23 nt, Staphylococcus aureus subsp. aureus MW2
cuaacauugguaccuuuuuauua

SEQ ID NO: 4003026 - RNA, 15 nt, Staphylococcus aureus subsp. aureus MW2
cuaaccacaucauuc

SEQ ID NO: 4003027 - RNA, 16 nt, Staphylococcus aureus subsp. aureus MW2
cuaaccacuucuucac

SEQ ID NO: 4003028 - RNA, 18 nt, Staphylococcus aureus subsp. aureus MW2
cuaaccaucauaaauguu

SEQ ID NO: 4003029 - RNA, 19 nt, Staphylococcus aureus subsp. aureus MW2
cuaaccaucauaaauguua

SEQ ID NO: 4003030 - RNA, 22 nt, Staphylococcus aureus subsp. aureus MW2
cuaacuaaguauguauaguguu

SEQ ID NO: 4003031 - RNA, 22 nt, Staphylococcus aureus subsp. aureus MW2
cuaacuuuaugggauguauuuu

SEQ ID NO: 4003032 - RNA, 13 nt, Staphylococcus aureus subsp. aureus MW2
cuaagauacguug

SEQ ID NO: 4003033 - RNA, 17 nt, Staphylococcus aureus subsp. aureus MW2
cuaagcaucguaaaaaa

SEQ ID NO: 4003034 - RNA, 18 nt, Staphylococcus aureus subsp. aureus MW2
cuaagguuguucuauaca

SEQ ID NO: 4003035 - RNA, 16 nt, Staphylococcus aureus subsp. aureus MW2
cuaagugaauuaucua

SEQ ID NO: 4003036 - RNA, 14 nt, Staphylococcus aureus subsp. aureus MW2
cuaaguuaaaaccu

SEQ ID NO: 4003037 - RNA, 15 nt, Staphylococcus aureus subsp. aureus MW2
cuaaguuaugacuaa

SEQ ID NO: 4003038 - RNA, 13 nt, Staphylococcus aureus subsp. aureus MW2
cuaaguuugaauc

SEQ ID NO: 4003039 - RNA, 21 nt, Staphylococcus aureus subsp. aureus MW2
cuaauaaaaccgguacuuuca

SEQ ID NO: 4003040 - RNA, 14 nt, Staphylococcus aureus subsp. aureus MW2
cuaauaacaaauag

SEQ ID NO: 4003041 - RNA, 22 nt, Staphylococcus aureus subsp. aureus MW2
cuaauaacucaguaaauuuauu

SEQ ID NO: 4003042 - RNA, 14 nt, Staphylococcus aureus subsp. aureus MW2
cuacugucucaucu

SEQ ID NO: 4003043 - RNA, 14 nt, Staphylococcus aureus subsp. aureus MW2
cuacuuaaaauaag

SEQ ID NO: 4003044 - RNA, 18 nt, Staphylococcus aureus subsp. aureus MW2
cuacuuaauuaauaauuu

SEQ ID NO: 4003045 - RNA, 21 nt, Staphylococcus aureus subsp. aureus MW2
cuacuugauucuacuucaccu

SEQ ID NO: 4003046 - RNA, 20 nt, Staphylococcus aureus subsp. aureus MW2
cuacuuuauaaauaucuuuu

SEQ ID NO: 4003047 - RNA, 19 nt, Staphylococcus aureus subsp. aureus MW2
cuacuuugauauguuuccu

SEQ ID NO: 4003048 - RNA, 15 nt, Staphylococcus aureus subsp. aureus MW2
cuacuuugucugcaa

SEQ ID NO: 4003049 - RNA, 18 nt, Staphylococcus aureus subsp. aureus MW2
cuacuuugucugcaauuu

SEQ ID NO: 4003050 - RNA, 17 nt, Staphylococcus aureus subsp. aureus MW2
cuacuuuuucaauaugu

SEQ ID NO: 4003051 - RNA, 15 nt, Staphylococcus aureus subsp. aureus MW2
cuacuuuuucaucuu

SEQ ID NO: 4003052 - RNA, 22 nt, Staphylococcus aureus subsp. aureus MW2
cuagaaaacauaaauacaaaaa

SEQ ID NO: 4003053 - RNA, 14 nt, Staphylococcus aureus subsp. aureus MW2
cuagaaaguaaugc

SEQ ID NO: 4003054 - RNA, 16 nt, Staphylococcus aureus subsp. aureus MW2
cuagaaguucuuaugc

SEQ ID NO: 4003055 - RNA, 19 nt, Staphylococcus aureus subsp. aureus MW2
cuagacauuacauuuagua

SEQ ID NO: 4003056 - RNA, 18 nt, Staphylococcus aureus subsp. aureus MW2
cuagacucuaaaauguuc

SEQ ID NO: 4003057 - RNA, 14 nt, Staphylococcus aureus subsp. aureus MW2
cuagauaauaaucc

SEQ ID NO: 4003058 - RNA, 14 nt, Staphylococcus aureus subsp. aureus MW2
cuagauaugccuau

SEQ ID NO: 4003059 - RNA, 23 nt, Staphylococcus aureus subsp. aureus MW2
cuagauuucaaaucaauaccaac

SEQ ID NO: 4003060 - RNA, 11 nt, Staphylococcus aureus subsp. aureus MW2
cuagcaaaaau

SEQ ID NO: 4003061 - RNA, 17 nt, Staphylococcus aureus subsp. aureus MW2
cuagcaaaaauacuuuu

SEQ ID NO: 4003062 - RNA, 21 nt, Staphylococcus aureus subsp. aureus MW2
cuagcaaaaauacuuuuugau

SEQ ID NO: 4003063 - RNA, 12 nt, Staphylococcus aureus subsp. aureus MW2
cuagcaaaugca

SEQ ID NO: 4003064 - RNA, 19 nt, Staphylococcus aureus subsp. aureus MW2
cuagcaagaauagauugau

SEQ ID NO: 4003065 - RNA, 17 nt, Staphylococcus aureus subsp. aureus MW2
cuaggaaauaaaaaaua

SEQ ID NO: 4003066 - RNA, 20 nt, Staphylococcus aureus subsp. aureus MW2
cuaguaaaccuacuaauaua

SEQ ID NO: 4003067 - RNA, 15 nt, Staphylococcus aureus subsp. aureus MW2
cuaguaacuuaucug

SEQ ID NO: 4003068 - RNA, 18 nt, Staphylococcus aureus subsp. aureus MW2
cuaguacgaaaugcauug

SEQ ID NO: 4003069 - RNA, 20 nt, Staphylococcus aureus subsp. aureus MW2
cuaguauccuuuauaaauaa

SEQ ID NO: 4003070 - RNA, 15 nt, Staphylococcus aureus subsp. aureus MW2
cuagucaggggcccc

SEQ ID NO: 4003071 - RNA, 17 nt, Staphylococcus aureus subsp. aureus MW2
cuagucaggggccccaa

SEQ ID NO: 4003072 - RNA, 18 nt, Staphylococcus aureus subsp. aureus MW2
cuagucaggggccccaac

SEQ ID NO: 4003073 - RNA, 23 nt, Staphylococcus aureus subsp. aureus MW2
cuagucaggggccccaacacaga

SEQ ID NO: 4003074 - RNA, 17 nt, Staphylococcus aureus subsp. aureus MW2
cuagugcauuuagauga

SEQ ID NO: 4003075 - RNA, 18 nt, Staphylococcus aureus subsp. aureus MW2
cuagugcauuuagaugau

SEQ ID NO: 4003076 - RNA, 15 nt, Staphylococcus aureus subsp. aureus MW2
cuaguuauuucauag

SEQ ID NO: 4003077 - RNA, 14 nt, Staphylococcus aureus subsp. aureus MW2
cuaguucagcuucu

SEQ ID NO: 4003078 - RNA, 21 nt, Staphylococcus aureus subsp. aureus MW2
cuaguucgauucaugaauaau

SEQ ID NO: 4003079 - RNA, 21 nt, Staphylococcus aureus subsp. aureus MW2
cuaguucuaaguguugaccau

SEQ ID NO: 4003080 - RNA, 13 nt, Staphylococcus aureus subsp. aureus MW2
cuaguucuaugua

SEQ ID NO: 4003081 - RNA, 15 nt, Staphylococcus aureus subsp. aureus MW2
cuaguuguuuuauag

SEQ ID NO: 4003082 - RNA, 22 nt, Staphylococcus aureus subsp. aureus MW2
cuaguuguuuuauagcauuucu

SEQ ID NO: 4003083 - RNA, 17 nt, Staphylococcus aureus subsp. aureus MW2
cuauaaaaguacuuuaa

SEQ ID NO: 4003084 - RNA, 23 nt, Staphylococcus aureus subsp. aureus MW2
cuauaaaaguacuuuaaaauugu

SEQ ID NO: 4003085 - RNA, 23 nt, Staphylococcus aureus subsp. aureus MW2
cuauaaaaucaucguauuucaua

SEQ ID NO: 4003086 - RNA, 15 nt, Staphylococcus aureus subsp. aureus MW2
cuauaaaauuuugaa

SEQ ID NO: 4003087 - RNA, 18 nt, Staphylococcus aureus subsp. aureus MW2
cuauaaacgucacuuuau

SEQ ID NO: 4003088 - RNA, 23 nt, Staphylococcus aureus subsp. aureus MW2
cuauaaagaaugauuuauaaaaa

SEQ ID NO: 4003089 - RNA, 16 nt, Staphylococcus aureus subsp. aureus MW2
cuauaaauaaaaauau

SEQ ID NO: 4003090 - RNA, 21 nt, Staphylococcus aureus subsp. aureus MW2
cuauaaauacgucaucuuuau

SEQ ID NO: 4003091 - RNA, 17 nt, Staphylococcus aureus subsp. aureus MW2
cuauaaauacuuuugca

SEQ ID NO: 4003092 - RNA, 13 nt, Staphylococcus aureus subsp. aureus MW2
cuauaaauuauuu

SEQ ID NO: 4003093 - RNA, 14 nt, Staphylococcus aureus subsp. aureus MW2
cuauaaauuauuuu

SEQ ID NO: 4003094 - RNA, 16 nt, Staphylococcus aureus subsp. aureus MW2
cuauaacaccaauuaa

SEQ ID NO: 4003095 - RNA, 19 nt, Staphylococcus aureus subsp. aureus MW2
cuauaaccgcuacaauuau

SEQ ID NO: 4003096 - RNA, 16 nt, Staphylococcus aureus subsp. aureus MW2
cuauaaccuauuaaau

SEQ ID NO: 4003097 - RNA, 15 nt, Staphylococcus aureus subsp. aureus MW2
cuauaacgauagauu

SEQ ID NO: 4003098 - RNA, 16 nt, Staphylococcus aureus subsp. aureus MW2
cuauaacgauagauuu

SEQ ID NO: 4003099 - RNA, 18 nt, Staphylococcus aureus subsp. aureus MW2
cuauaacgauagauuuuu

SEQ ID NO: 4003100 - RNA, 18 nt, Staphylococcus aureus subsp. aureus MW2
cuauaacucuaaauauaa

SEQ ID NO: 4003101 - RNA, 16 nt, Staphylococcus aureus subsp. aureus MW2
cuauaaguauuuugaa

SEQ ID NO: 4003102 - RNA, 14 nt, Staphylococcus aureus subsp. aureus MW2
cuauaauaaagauu

SEQ ID NO: 4003103 - RNA, 20 nt, Staphylococcus aureus subsp. aureus MW2
cuauaaucauuaaguaaucu

SEQ ID NO: 4003104 - RNA, 16 nt, Staphylococcus aureus subsp. aureus MW2
cuauaaucuaucuugu

SEQ ID NO: 4003105 - RNA, 18 nt, Staphylococcus aureus subsp. aureus MW2
cuauacuccaguuuauaa

SEQ ID NO: 4003106 - RNA, 18 nt, Staphylococcus aureus subsp. aureus MW2
cuauacugaugaaaacuu

SEQ ID NO: 4003107 - RNA, 18 nt, Staphylococcus aureus subsp. aureus MW2
cuauacuuuaucuauuuc

SEQ ID NO: 4003108 - RNA, 14 nt, Staphylococcus aureus subsp. aureus MW2
cuauacuuuuaauu

SEQ ID NO: 4003109 - RNA, 13 nt, Staphylococcus aureus subsp. aureus MW2
cuauauaaaguug

SEQ ID NO: 4003110 - RNA, 23 nt, Staphylococcus aureus subsp. aureus MW2
cuauauaaauguuuauaucuuuu

SEQ ID NO: 4003111 - RNA, 17 nt, Staphylococcus aureus subsp. aureus MW2
cuauauaacgcuuuaaa

SEQ ID NO: 4003112 - RNA, 21 nt, Staphylococcus aureus subsp. aureus MW2
cuauauaacgcuuuaaaucau

SEQ ID NO: 4003113 - RNA, 13 nt, Staphylococcus aureus subsp. aureus MW2
cuauauaauaauu

SEQ ID NO: 4003114 - RNA, 14 nt, Staphylococcus aureus subsp. aureus MW2
cuauauaauuuauu

SEQ ID NO: 4003115 - RNA, 19 nt, Staphylococcus aureus subsp. aureus MW2
cuauauagccuguuaagug

SEQ ID NO: 4003116 - RNA, 17 nt, Staphylococcus aureus subsp. aureus MW2
cuauauauccauucaau

SEQ ID NO: 4003117 - RNA, 20 nt, Staphylococcus aureus subsp. aureus MW2
cuauauccaguuaauuauuu

SEQ ID NO: 4003118 - RNA, 20 nt, Staphylococcus aureus subsp. aureus MW2
cuauaucgucgauuucauua

SEQ ID NO: 4003119 - RNA, 21 nt, Staphylococcus aureus subsp. aureus MW2
cuauaucgucgauuucauuaa

SEQ ID NO: 4003120 - RNA, 16 nt, Staphylococcus aureus subsp. aureus MW2
cuauauucaauuuaau

SEQ ID NO: 4003121 - RNA, 17 nt, Staphylococcus aureus subsp. aureus MW2
cuauauucaauuuaaua

SEQ ID NO: 4003122 - RNA, 13 nt, Staphylococcus aureus subsp. aureus MW2
cuauauuuauuag

SEQ ID NO: 4003123 - RNA, 17 nt, Staphylococcus aureus subsp. aureus MW2
cuauauuuuuuuacuuu

SEQ ID NO: 4003124 - RNA, 19 nt, Staphylococcus aureus subsp. aureus MW2
cuaucaaaaaaacaaaaaa

SEQ ID NO: 4003125 - RNA, 22 nt, Staphylococcus aureus subsp. aureus MW2
cuaucaaaaaaacaaaaaauaa

SEQ ID NO: 4003126 - RNA, 18 nt, Staphylococcus aureus subsp. aureus MW2
cuaucaauauaauuuggu

SEQ ID NO: 4003127 - RNA, 17 nt, Staphylococcus aureus subsp. aureus MW2
cuaucccuguaaaacca

SEQ ID NO: 4003128 - RNA, 15 nt, Staphylococcus aureus subsp. aureus MW2
cuaucgauacuaaac

SEQ ID NO: 4003129 - RNA, 16 nt, Staphylococcus aureus subsp. aureus MW2
cuaucgccuaaaaaua

SEQ ID NO: 4003130 - RNA, 21 nt, Staphylococcus aureus subsp. aureus MW2
cuaucgccuaaaaauaaaauc

SEQ ID NO: 4003131 - RNA, 18 nt, Staphylococcus aureus subsp. aureus MW2
cucaugccaaaaacauua

SEQ ID NO: 4003132 - RNA, 20 nt, Staphylococcus aureus subsp. aureus MW2
cucaugcugaaauguagaca

SEQ ID NO: 4003133 - RNA, 14 nt, Staphylococcus aureus subsp. aureus MW2
cucauguuucagua

SEQ ID NO: 4003134 - RNA, 22 nt, Staphylococcus aureus subsp. aureus MW2
cucauuaaccuuacauaggaua

SEQ ID NO: 4003135 - RNA, 13 nt, Staphylococcus aureus subsp. aureus MW2
cucauuaauaaau

SEQ ID NO: 4003136 - RNA, 15 nt, Staphylococcus aureus subsp. aureus MW2
cucauuaauuuuucg

SEQ ID NO: 4003137 - RNA, 18 nt, Staphylococcus aureus subsp. aureus MW2
cucauuagcgaaaacuaa

SEQ ID NO: 4003138 - RNA, 20 nt, Staphylococcus aureus subsp. aureus MW2
cucauuagcgaaaacuaaag

SEQ ID NO: 4003139 - RNA, 20 nt, Staphylococcus aureus subsp. aureus MW2
cucauuuuuauaaauuuugg

SEQ ID NO: 4003140 - RNA, 20 nt, Staphylococcus aureus subsp. aureus MW2
cucauuuuuuuaauuauuuc

SEQ ID NO: 4003141 - RNA, 23 nt, Staphylococcus aureus subsp. aureus MW2
cucauuuuuuuaauuauuucccu

SEQ ID NO: 4003142 - RNA, 15 nt, Staphylococcus aureus subsp. aureus MW2
cuccaaacauagaga

SEQ ID NO: 4003143 - RNA, 12 nt, Staphylococcus aureus subsp. aureus MW2
cuccaaauauug

SEQ ID NO: 4003144 - RNA, 14 nt, Staphylococcus aureus subsp. aureus MW2
cuccaauacuuuuu

SEQ ID NO: 4003145 - RNA, 17 nt, Staphylococcus aureus subsp. aureus MW2
cuccauuauaaagccug

SEQ ID NO: 4003146 - RNA, 18 nt, Staphylococcus aureus subsp. aureus MW2
cucccuucaaaguuuuca

SEQ ID NO: 4003147 - RNA, 14 nt, Staphylococcus aureus subsp. aureus MW2
cuccgaucaugccu

SEQ ID NO: 4003148 - RNA, 15 nt, Staphylococcus aureus subsp. aureus MW2
cuccgaucaugccuu

SEQ ID NO: 4003149 - RNA, 15 nt, Staphylococcus aureus subsp. aureus MW2
cuccgguuuaauaua

SEQ ID NO: 4003150 - RNA, 16 nt, Staphylococcus aureus subsp. aureus MW2
cuccuaaauuauuguu

SEQ ID NO: 4003151 - RNA, 20 nt, Staphylococcus aureus subsp. aureus MW2
cuccuaccgcuaaaauucuu

SEQ ID NO: 4003152 - RNA, 15 nt, Staphylococcus aureus subsp. aureus MW2
cuccucuauuuuaug

SEQ ID NO: 4003153 - RNA, 20 nt, Staphylococcus aureus subsp. aureus MW2
cuccucuuuuauuuaugagu

SEQ ID NO: 4003154 - RNA, 17 nt, Staphylococcus aureus subsp. aureus MW2
cuccuggauuuuuugga

SEQ ID NO: 4003155 - RNA, 14 nt, Staphylococcus aureus subsp. aureus MW2
cuccuuaaacaaau

SEQ ID NO: 4003156 - RNA, 20 nt, Staphylococcus aureus subsp. aureus MW2
cuccuucaauguucaauuca

SEQ ID NO: 4003157 - RNA, 18 nt, Staphylococcus aureus subsp. aureus MW2
cuccuuuuguuucaaauu

SEQ ID NO: 4003158 - RNA, 19 nt, Staphylococcus aureus subsp. aureus MW2
cuccuuuuguuucaaauuu

SEQ ID NO: 4003159 - RNA, 23 nt, Staphylococcus aureus subsp. aureus MW2
cucgaaaauaaaacaaauuauua

SEQ ID NO: 4003160 - RNA, 19 nt, Staphylococcus aureus subsp. aureus MW2
cucgaguuuauucgcuugu

SEQ ID NO: 4003161 - RNA, 17 nt, Staphylococcus aureus subsp. aureus MW2
cucgaugcuaauauuua

SEQ ID NO: 4003162 - RNA, 15 nt, Staphylococcus aureus subsp. aureus MW2
cucuaaaacuuuuuc

SEQ ID NO: 4003163 - RNA, 15 nt, Staphylococcus aureus subsp. aureus MW2
cucuaaaagccaucu

SEQ ID NO: 4003164 - RNA, 15 nt, Staphylococcus aureus subsp. aureus MW2
cucuaaaauguucug

SEQ ID NO: 4003165 - RNA, 22 nt, Staphylococcus aureus subsp. aureus MW2
cucuaaacuucuauuaauaauu

SEQ ID NO: 4003166 - RNA, 14 nt, Staphylococcus aureus subsp. aureus MW2
cucuaaaggaaagc

SEQ ID NO: 4003167 - RNA, 12 nt, Staphylococcus aureus subsp. aureus MW2
cucuaaauaaaa

SEQ ID NO: 4003168 - RNA, 16 nt, Staphylococcus aureus subsp. aureus MW2
cucuaaauaaaauuaa

SEQ ID NO: 4003169 - RNA, 15 nt, Staphylococcus aureus subsp. aureus MW2
cucuaaauauaauag

SEQ ID NO: 4003170 - RNA, 18 nt, Staphylococcus aureus subsp. aureus MW2
cucuaacuuuaccaauau

SEQ ID NO: 4003171 - RNA, 20 nt, Staphylococcus aureus subsp. aureus MW2
cucuaacuuuaccaauauca

SEQ ID NO: 4003172 - RNA, 22 nt, Staphylococcus aureus subsp. aureus MW2
cucuaauucaaugauuuuuaaa

SEQ ID NO: 4003173 - RNA, 15 nt, Staphylococcus aureus subsp. aureus MW2
cucuauacccuuuau

SEQ ID NO: 4003174 - RNA, 19 nt, Staphylococcus aureus subsp. aureus MW2
cucuauuuacggcauaauu

SEQ ID NO: 4003175 - RNA, 15 nt, Staphylococcus aureus subsp. aureus MW2
cucuauuuuaugauu

SEQ ID NO: 4003176 - RNA, 20 nt, Staphylococcus aureus subsp. aureus MW2
cucuauuuuaugauuugauu

SEQ ID NO: 4003177 - RNA, 13 nt, Staphylococcus aureus subsp. aureus MW2
cucuccaccauau

SEQ ID NO: 4003178 - RNA, 15 nt, Staphylococcus aureus subsp. aureus MW2
cucugaaaaacuucu

SEQ ID NO: 4003179 - RNA, 19 nt, Staphylococcus aureus subsp. aureus MW2
cucugaaaagccuacuuug

SEQ ID NO: 4003180 - RNA, 14 nt, Staphylococcus aureus subsp. aureus MW2
cucugauauugauc

SEQ ID NO: 4003181 - RNA, 17 nt, Staphylococcus aureus subsp. aureus MW2
cucugauauugaucuga

SEQ ID NO: 4003182 - RNA, 17 nt, Staphylococcus aureus subsp. aureus MW2
cucugcuagacaaucau

SEQ ID NO: 4003183 - RNA, 21 nt, Staphylococcus aureus subsp. aureus MW2
cucuggauuuuucuuauaaaa

SEQ ID NO: 4003184 - RNA, 15 nt, Staphylococcus aureus subsp. aureus MW2
cucuguguuggggcc

SEQ ID NO: 4003185 - RNA, 17 nt, Staphylococcus aureus subsp. aureus MW2
cucuguguuggggccca

SEQ ID NO: 4003186 - RNA, 17 nt, Staphylococcus aureus subsp. aureus MW2
cucuguguuggggcccc

SEQ ID NO: 4003187 - RNA, 12 nt, Staphylococcus aureus subsp. aureus MW2
cucuuaaaauac

SEQ ID NO: 4003188 - RNA, 23 nt, Staphylococcus aureus subsp. aureus MW2
cucuuaaaucacuagcuaaugca

SEQ ID NO: 4003189 - RNA, 22 nt, Staphylococcus aureus subsp. aureus MW2
cucuuauaaagacaccuucaau

SEQ ID NO: 4003190 - RNA, 14 nt, Staphylococcus aureus subsp. aureus MW2
cucuuauuuuaaaa

SEQ ID NO: 4003191 - RNA, 19 nt, Staphylococcus aureus subsp. aureus MW2
cucuuauuuuaaaauauua

SEQ ID NO: 4003192 - RNA, 20 nt, Staphylococcus aureus subsp. aureus MW2
cucuuauuuuaaaauauuaa

SEQ ID NO: 4003193 - RNA, 17 nt, Staphylococcus aureus subsp. aureus MW2
cucuucuggagccucuu

SEQ ID NO: 4003194 - RNA, 15 nt, Staphylococcus aureus subsp. aureus MW2
cucuugaaaaaguua

SEQ ID NO: 4003195 - RNA, 15 nt, Staphylococcus aureus subsp. aureus MW2
cucuugauaaaauaa

SEQ ID NO: 4003196 - RNA, 16 nt, Staphylococcus aureus subsp. aureus MW2
cucuugauaaaauaaa

SEQ ID NO: 4003197 - RNA, 18 nt, Staphylococcus aureus subsp. aureus MW2
cucuugggaauugaccac

SEQ ID NO: 4003198 - RNA, 14 nt, Staphylococcus aureus subsp. aureus MW2
cucuuguucaagua

SEQ ID NO: 4003199 - RNA, 12 nt, Staphylococcus aureus subsp. aureus MW2
cucuuuaaacuc

SEQ ID NO: 4003200 - RNA, 20 nt, Staphylococcus aureus subsp. aureus MW2
cucuuuaaagcuaaauguua

SEQ ID NO: 4003201 - RNA, 13 nt, Staphylococcus aureus subsp. aureus MW2
cucuuuaaaucaa

SEQ ID NO: 4003202 - RNA, 21 nt, Staphylococcus aureus subsp. aureus MW2
cucuuuaaaucaaagaguaaa

SEQ ID NO: 4003203 - RNA, 17 nt, Staphylococcus aureus subsp. aureus MW2
cucuuuacaccauugca

SEQ ID NO: 4003204 - RNA, 21 nt, Staphylococcus aureus subsp. aureus MW2
cucuuuacggucgaauuuuuu

SEQ ID NO: 4003205 - RNA, 21 nt, Staphylococcus aureus subsp. aureus MW2
cucuuugaacgaaagagaaaa

SEQ ID NO: 4003206 - RNA, 20 nt, Staphylococcus aureus subsp. aureus MW2
cucuuugaacgagagagaaa

SEQ ID NO: 4003207 - RNA, 20 nt, Staphylococcus aureus subsp. aureus MW2
cucuuuucacgaauaucuua

SEQ ID NO: 4003208 - RNA, 13 nt, Staphylococcus aureus subsp. aureus MW2
cugaaaaaauuaa

SEQ ID NO: 4003209 - RNA, 17 nt, Staphylococcus aureus subsp. aureus MW2
cugaaaaauauuuaaau

SEQ ID NO: 4003210 - RNA, 21 nt, Staphylococcus aureus subsp. aureus MW2
cugaaaaauauuuaaauagaa

SEQ ID NO: 4003211 - RNA, 18 nt, Staphylococcus aureus subsp. aureus MW2
cugaaaagaauaaguugu

SEQ ID NO: 4003212 - RNA, 11 nt, Staphylococcus aureus subsp. aureus MW2
cugaaaauaac

SEQ ID NO: 4003213 - RNA, 15 nt, Staphylococcus aureus subsp. aureus MW2
cugaaaauaaccauu

SEQ ID NO: 4003214 - RNA, 15 nt, Staphylococcus aureus subsp. aureus MW2
cugaaacgccucaac

SEQ ID NO: 4003215 - RNA, 20 nt, Staphylococcus aureus subsp. aureus MW2
cugaaacgccucaacacuuu

SEQ ID NO: 4003216 - RNA, 14 nt, Staphylococcus aureus subsp. aureus MW2
cugaaauguagaca

SEQ ID NO: 4003217 - RNA, 15 nt, Staphylococcus aureus subsp. aureus MW2
cugaacgaaaaugcg

SEQ ID NO: 4003218 - RNA, 18 nt, Staphylococcus aureus subsp. aureus MW2
cugaacuuucuuuauuau

SEQ ID NO: 4003219 - RNA, 17 nt, Staphylococcus aureus subsp. aureus MW2
cugaagguaauuuaaca

SEQ ID NO: 4003220 - RNA, 18 nt, Staphylococcus aureus subsp. aureus MW2
cuguagcgauaccuuuaa

SEQ ID NO: 4003221 - RNA, 22 nt, Staphylococcus aureus subsp. aureus MW2
cuguauacgacgucgcaacagg

SEQ ID NO: 4003222 - RNA, 11 nt, Staphylococcus aureus subsp. aureus MW2
cuguauauaua

SEQ ID NO: 4003223 - RNA, 22 nt, Staphylococcus aureus subsp. aureus MW2
cuguauauggcgauaacaagaa

SEQ ID NO: 4003224 - RNA, 17 nt, Staphylococcus aureus subsp. aureus MW2
cuguaugacaggcgugu

SEQ ID NO: 4003225 - RNA, 20 nt, Staphylococcus aureus subsp. aureus MW2
cuguaugccgccuaauaaua

SEQ ID NO: 4003226 - RNA, 18 nt, Staphylococcus aureus subsp. aureus MW2
cugucaccuucuauauug

SEQ ID NO: 4003227 - RNA, 16 nt, Staphylococcus aureus subsp. aureus MW2
cugucaucuuuauaca

SEQ ID NO: 4003228 - RNA, 16 nt, Staphylococcus aureus subsp. aureus MW2
cugucuaaaaacauaa

SEQ ID NO: 4003229 - RNA, 19 nt, Staphylococcus aureus subsp. aureus MW2
cugucucaucuucuaaauc

SEQ ID NO: 4003230 - RNA, 14 nt, Staphylococcus aureus subsp. aureus MW2
cugugaauaaaauu

SEQ ID NO: 4003231 - RNA, 23 nt, Staphylococcus aureus subsp. aureus MW2
cugugaauaaaauugugccauuu

SEQ ID NO: 4003232 - RNA, 16 nt, Staphylococcus aureus subsp. aureus MW2
cugugauauuaauuga

SEQ ID NO: 4003233 - RNA, 22 nt, Staphylococcus aureus subsp. aureus MW2
cugugcaugacgauaaugaaau

SEQ ID NO: 4003234 - RNA, 17 nt, Staphylococcus aureus subsp. aureus MW2
cuguggacaaacugauu

SEQ ID NO: 4003235 - RNA, 22 nt, Staphylococcus aureus subsp. aureus MW2
cuguggacaaacugauuuuuua

SEQ ID NO: 4003236 - RNA, 18 nt, Staphylococcus aureus subsp. aureus MW2
cuguguaaaauaaaucau

SEQ ID NO: 4003237 - RNA, 15 nt, Staphylococcus aureus subsp. aureus MW2
cugugucagcauuca

SEQ ID NO: 4003238 - RNA, 14 nt, Staphylococcus aureus subsp. aureus MW2
cugugugcuguucu

SEQ ID NO: 4003239 - RNA, 14 nt, Staphylococcus aureus subsp. aureus MW2
cuguuaaacucaua

SEQ ID NO: 4003240 - RNA, 16 nt, Staphylococcus aureus subsp. aureus MW2
cuguuaauaaaucauu

SEQ ID NO: 4003241 - RNA, 23 nt, Staphylococcus aureus subsp. aureus MW2
cuguuaugaaguauccuuauuug

SEQ ID NO: 4003242 - RNA, 12 nt, Staphylococcus aureus subsp. aureus MW2
cuguucuaaaau

SEQ ID NO: 4003243 - RNA, 23 nt, Staphylococcus aureus subsp. aureus MW2
cuguucuaaaauuaaccauuucu

SEQ ID NO: 4003244 - RNA, 21 nt, Staphylococcus aureus subsp. aureus MW2
cuguucuuucgucuuguaaac

SEQ ID NO: 4003245 - RNA, 16 nt, Staphylococcus aureus subsp. aureus MW2
cuguuuauauaaguga

SEQ ID NO: 4003246 - RNA, 19 nt, Staphylococcus aureus subsp. aureus MW2
cuguuucaaagcugucaac

SEQ ID NO: 4003247 - RNA, 17 nt, Staphylococcus aureus subsp. aureus MW2
cuguuucacguaaugaa

SEQ ID NO: 4003248 - RNA, 15 nt, Staphylococcus aureus subsp. aureus MW2
cuguuucuuguucua

SEQ ID NO: 4003249 - RNA, 19 nt, Staphylococcus aureus subsp. aureus MW2
cuguuucuuguucuaaaaa

SEQ ID NO: 4003250 - RNA, 16 nt, Staphylococcus aureus subsp. aureus MW2
cuuaaaaacaauauug

SEQ ID NO: 4003251 - RNA, 17 nt, Staphylococcus aureus subsp. aureus MW2
cuuaaaagacauccaca

SEQ ID NO: 4003252 - RNA, 20 nt, Staphylococcus aureus subsp. aureus MW2
cuuaaaagacauccacagaa

SEQ ID NO: 4003253 - RNA, 22 nt, Staphylococcus aureus subsp. aureus MW2
cuuaaaagacauccacagaauu

SEQ ID NO: 4003254 - RNA, 21 nt, Staphylococcus aureus subsp. aureus MW2
cuuaaaagagaauauaaaaua

SEQ ID NO: 4003255 - RNA, 13 nt, Staphylococcus aureus subsp. aureus MW2
cuuaaaauauuua

SEQ ID NO: 4003256 - RNA, 15 nt, Staphylococcus aureus subsp. aureus MW2
cuuaaaauauuuaac

SEQ ID NO: 4003257 - RNA, 16 nt, Staphylococcus aureus subsp. aureus MW2
cuuaaaaucagucauu

SEQ ID NO: 4003258 - RNA, 20 nt, Staphylococcus aureus subsp. aureus MW2
cuuaaaaucagucauucaca

SEQ ID NO: 4003259 - RNA, 18 nt, Staphylococcus aureus subsp. aureus MW2
cuuaaaauuuaaauauug

SEQ ID NO: 4003260 - RNA, 21 nt, Staphylococcus aureus subsp. aureus MW2
cuuaaaauuuaaauauugaag

SEQ ID NO: 4003261 - RNA, 13 nt, Staphylococcus aureus subsp. aureus MW2
cuuaaacaaauaa

SEQ ID NO: 4003262 - RNA, 18 nt, Staphylococcus aureus subsp. aureus MW2
cuuaaaccuaacauaacu

SEQ ID NO: 4003263 - RNA, 17 nt, Staphylococcus aureus subsp. aureus MW2
cuuaaacgcucuucuuc

SEQ ID NO: 4003264 - RNA, 19 nt, Staphylococcus aureus subsp. aureus MW2
cuuaaacgcucuucuucuu

SEQ ID NO: 4003265 - RNA, 16 nt, Staphylococcus aureus subsp. aureus MW2
cuuaaagcuaauaaug

SEQ ID NO: 4003266 - RNA, 21 nt, Staphylococcus aureus subsp. aureus MW2
cuuaaauacaauuucuucauu

SEQ ID NO: 4003267 - RNA, 23 nt, Staphylococcus aureus subsp. aureus MW2
cuuaaauacaauuucuucauuuu

SEQ ID NO: 4003268 - RNA, 15 nt, Staphylococcus aureus subsp. aureus MW2
cuuaaauagugcuuu

SEQ ID NO: 4003269 - RNA, 18 nt, Staphylococcus aureus subsp. aureus MW2
cuuaaauagugcuuuuuc

SEQ ID NO: 4003270 - RNA, 19 nt, Staphylococcus aureus subsp. aureus MW2
cuuaaauagugcuuuuuca

SEQ ID NO: 4003271 - RNA, 18 nt, Staphylococcus aureus subsp. aureus MW2
cuuaaauaucgacaaauu

SEQ ID NO: 4003272 - RNA, 21 nt, Staphylococcus aureus subsp. aureus MW2
cuuaaauaucgacaaauuaaa

SEQ ID NO: 4003273 - RNA, 15 nt, Staphylococcus aureus subsp. aureus MW2
cuuaaauggaugaua

SEQ ID NO: 4003274 - RNA, 12 nt, Staphylococcus aureus subsp. aureus MW2
cuuaacaacaug

SEQ ID NO: 4003275 - RNA, 20 nt, Staphylococcus aureus subsp. aureus MW2
cuuaacaacaugauuucuuc

SEQ ID NO: 4003276 - RNA, 18 nt, Staphylococcus aureus subsp. aureus MW2
cuuaacaauaucaucuaa

SEQ ID NO: 4003277 - RNA, 12 nt, Staphylococcus aureus subsp. aureus MW2
cuuaacaucuuu

SEQ ID NO: 4003278 - RNA, 18 nt, Staphylococcus aureus subsp. aureus MW2
cuuaaccauuuaaaaauu

SEQ ID NO: 4003279 - RNA, 22 nt, Staphylococcus aureus subsp. aureus MW2
cuuaaccauuuaaaaauugaag

SEQ ID NO: 4003280 - RNA, 23 nt, Staphylococcus aureus subsp. aureus MW2
cuuaagcucauuucaauauuaaa

SEQ ID NO: 4003281 - RNA, 21 nt, Staphylococcus aureus subsp. aureus MW2
cuuaaguaagauuuaaacauc

SEQ ID NO: 4003282 - RNA, 16 nt, Staphylococcus aureus subsp. aureus MW2
cuuaauaagcugaaau

SEQ ID NO: 4003283 - RNA, 19 nt, Staphylococcus aureus subsp. aureus MW2
cuuaauaauuaauaagcau

SEQ ID NO: 4003284 - RNA, 18 nt, Staphylococcus aureus subsp. aureus MW2
cuuaauacgauaauaacu

SEQ ID NO: 4003285 - RNA, 20 nt, Staphylococcus aureus subsp. aureus MW2
cuuaauacgauaauaacuag

SEQ ID NO: 4003286 - RNA, 13 nt, Staphylococcus aureus subsp. aureus MW2
cuuaauacuaauu

SEQ ID NO: 4003287 - RNA, 22 nt, Staphylococcus aureus subsp. aureus MW2
cuuaauagagguauaauuaaau

SEQ ID NO: 4003288 - RNA, 22 nt, Staphylococcus aureus subsp. aureus MW2
cuuaauaucaguagcauauuga

SEQ ID NO: 4003289 - RNA, 15 nt, Staphylococcus aureus subsp. aureus MW2
cuuaauauuuauuac

SEQ ID NO: 4003290 - RNA, 17 nt, Staphylococcus aureus subsp. aureus MW2
cuuaaucgcucuaaaua

SEQ ID NO: 4003291 - RNA, 21 nt, Staphylococcus aureus subsp. aureus MW2
cuuaaugacuucuuuauauuu

SEQ ID NO: 4003292 - RNA, 19 nt, Staphylococcus aureus subsp. aureus MW2
cuuaaugcuaugauuaaag

SEQ ID NO: 4003293 - RNA, 14 nt, Staphylococcus aureus subsp. aureus MW2
cuuaaugcuucaaa

SEQ ID NO: 4003294 - RNA, 19 nt, Staphylococcus aureus subsp. aureus MW2
cuuaauuaauaauuuaacu

SEQ ID NO: 4003295 - RNA, 18 nt, Staphylococcus aureus subsp. aureus MW2
cuuaauucuucaucaaua

SEQ ID NO: 4003296 - RNA, 21 nt, Staphylococcus aureus subsp. aureus MW2
cuuaauucuucaucaauaacu

SEQ ID NO: 4003297 - RNA, 17 nt, Staphylococcus aureus subsp. aureus MW2
cuuaauugaauuaaauc

SEQ ID NO: 4003298 - RNA, 18 nt, Staphylococcus aureus subsp. aureus MW2
cuuaauuuaaaaauaguu

SEQ ID NO: 4003299 - RNA, 21 nt, Staphylococcus aureus subsp. aureus MW2
cuuaauuuaaaaauaguucuu

SEQ ID NO: 4003300 - RNA, 17 nt, Staphylococcus aureus subsp. aureus MW2
cuuaauuuguuuuaaau

SEQ ID NO: 4003301 - RNA, 14 nt, Staphylococcus aureus subsp. aureus MW2
cuuaauuuuauuau

SEQ ID NO: 4003302 - RNA, 14 nt, Staphylococcus aureus subsp. aureus MW2
cuuacaaauauacu

SEQ ID NO: 4003303 - RNA, 13 nt, Staphylococcus aureus subsp. aureus MW2
cuuacaaauauug

SEQ ID NO: 4003304 - RNA, 15 nt, Staphylococcus aureus subsp. aureus MW2
cuuacaauaaagaca

SEQ ID NO: 4003305 - RNA, 16 nt, Staphylococcus aureus subsp. aureus MW2
cuuacagacaaacauu

SEQ ID NO: 4003306 - RNA, 17 nt, Staphylococcus aureus subsp. aureus MW2
cuuacauaggauaucua

SEQ ID NO: 4003307 - RNA, 16 nt, Staphylococcus aureus subsp. aureus MW2
cuuacauuacauauau

SEQ ID NO: 4003308 - RNA, 17 nt, Staphylococcus aureus subsp. aureus MW2
cuucauauccuucauua

SEQ ID NO: 4003309 - RNA, 13 nt, Staphylococcus aureus subsp. aureus MW2
cuucaucaauaaa

SEQ ID NO: 4003310 - RNA, 20 nt, Staphylococcus aureus subsp. aureus MW2
cuucaucauuguaaaacaaa

SEQ ID NO: 4003311 - RNA, 16 nt, Staphylococcus aureus subsp. aureus MW2
cuucaucgcaauguca

SEQ ID NO: 4003312 - RNA, 17 nt, Staphylococcus aureus subsp. aureus MW2
cuucaucuaaaaagucu

SEQ ID NO: 4003313 - RNA, 15 nt, Staphylococcus aureus subsp. aureus MW2
cuucaucuuuaaaga

SEQ ID NO: 4003314 - RNA, 12 nt, Staphylococcus aureus subsp. aureus MW2
cuucaucuuuuu

SEQ ID NO: 4003315 - RNA, 17 nt, Staphylococcus aureus subsp. aureus MW2
cuucaucuuuuuuauca

SEQ ID NO: 4003316 - RNA, 14 nt, Staphylococcus aureus subsp. aureus MW2
cuucaugucguuuu

SEQ ID NO: 4003317 - RNA, 18 nt, Staphylococcus aureus subsp. aureus MW2
cuucaugucguuuucuua

SEQ ID NO: 4003318 - RNA, 22 nt, Staphylococcus aureus subsp. aureus MW2
cuucauuaguugccccuagcaa

SEQ ID NO: 4003319 - RNA, 18 nt, Staphylococcus aureus subsp. aureus MW2
cuucauuuauaacauuua

SEQ ID NO: 4003320 - RNA, 15 nt, Staphylococcus aureus subsp. aureus MW2
cuucauuugcgauuu

SEQ ID NO: 4003321 - RNA, 22 nt, Staphylococcus aureus subsp. aureus MW2
cuucauuugcgauuucuucugc

SEQ ID NO: 4003322 - RNA, 17 nt, Staphylococcus aureus subsp. aureus MW2
cuuccaacacccauaua

SEQ ID NO: 4003323 - RNA, 18 nt, Staphylococcus aureus subsp. aureus MW2
cuuccaaucaacuucaua

SEQ ID NO: 4003324 - RNA, 14 nt, Staphylococcus aureus subsp. aureus MW2
cuuccaauuuaaaa

SEQ ID NO: 4003325 - RNA, 20 nt, Staphylococcus aureus subsp. aureus MW2
cuuccaauuuaaaaugauuc

SEQ ID NO: 4003326 - RNA, 19 nt, Staphylococcus aureus subsp. aureus MW2
cuucccagucaugucccau

SEQ ID NO: 4003327 - RNA, 14 nt, Staphylococcus aureus subsp. aureus MW2
cuucccaucuuuua

SEQ ID NO: 4003328 - RNA, 20 nt, Staphylococcus aureus subsp. aureus MW2
cuucccaucuuuuagguaau

SEQ ID NO: 4003329 - RNA, 22 nt, Staphylococcus aureus subsp. aureus MW2
cuucccaucuuuuagguaauaa

SEQ ID NO: 4003330 - RNA, 16 nt, Staphylococcus aureus subsp. aureus MW2
cuuccccaccuaauca

SEQ ID NO: 4003331 - RNA, 16 nt, Staphylococcus aureus subsp. aureus MW2
cuuccccuacaaaguu

SEQ ID NO: 4003332 - RNA, 14 nt, Staphylococcus aureus subsp. aureus MW2
cuuccgcacugccu

SEQ ID NO: 4003333 - RNA, 14 nt, Staphylococcus aureus subsp. aureus MW2
cuucgaagucauau

SEQ ID NO: 4003334 - RNA, 15 nt, Staphylococcus aureus subsp. aureus MW2
cuucgacuacaaguu

SEQ ID NO: 4003335 - RNA, 18 nt, Staphylococcus aureus subsp. aureus MW2
cuucgauggcugcaacaa

SEQ ID NO: 4003336 - RNA, 20 nt, Staphylococcus aureus subsp. aureus MW2
cuucgauucuccuuuuguuu

SEQ ID NO: 4003337 - RNA, 21 nt, Staphylococcus aureus subsp. aureus MW2
cuucgccaagccauuuuucuu

SEQ ID NO: 4003338 - RNA, 22 nt, Staphylococcus aureus subsp. aureus MW2
cuucggcucucgcuuacucauu

SEQ ID NO: 4003339 - RNA, 17 nt, Staphylococcus aureus subsp. aureus MW2
cuucgucuguauccuca

SEQ ID NO: 4003340 - RNA, 19 nt, Staphylococcus aureus subsp. aureus MW2
cuucguugauuaacauuac

SEQ ID NO: 4003341 - RNA, 12 nt, Staphylococcus aureus subsp. aureus MW2
cuucguuuuaau

SEQ ID NO: 4003342 - RNA, 19 nt, Staphylococcus aureus subsp. aureus MW2
cuucuaaaacuaaagguau

SEQ ID NO: 4003343 - RNA, 20 nt, Staphylococcus aureus subsp. aureus MW2
cuucuaaaaucguuccaaua

SEQ ID NO: 4003344 - RNA, 17 nt, Staphylococcus aureus subsp. aureus MW2
cuucuaaccacuucuuc

SEQ ID NO: 4003345 - RNA, 15 nt, Staphylococcus aureus subsp. aureus MW2
cuucuaaguaauaua

SEQ ID NO: 4003346 - RNA, 18 nt, Staphylococcus aureus subsp. aureus MW2
cuucuaauuuaguuuuaa

SEQ ID NO: 4003347 - RNA, 17 nt, Staphylococcus aureus subsp. aureus MW2
cuucuaauuugcaaaau

SEQ ID NO: 4003348 - RNA, 21 nt, Staphylococcus aureus subsp. aureus MW2
cuucuaauuugcaaaaucaac

SEQ ID NO: 4003349 - RNA, 16 nt, Staphylococcus aureus subsp. aureus MW2
cuucuacauauacaaa

SEQ ID NO: 4003350 - RNA, 21 nt, Staphylococcus aureus subsp. aureus MW2
cuucuacccauaauuuaaaug

SEQ ID NO: 4003351 - RNA, 14 nt, Staphylococcus aureus subsp. aureus MW2
cuucuaguaauucu

SEQ ID NO: 4003352 - RNA, 13 nt, Staphylococcus aureus subsp. aureus MW2
cuucuauauuaau

SEQ ID NO: 4003353 - RNA, 14 nt, Staphylococcus aureus subsp. aureus MW2
cuucuaucuuuauu

SEQ ID NO: 4003354 - RNA, 22 nt, Staphylococcus aureus subsp. aureus MW2
cuucuauguuggggccccgcca

SEQ ID NO: 4003355 - RNA, 14 nt, Staphylococcus aureus subsp. aureus MW2
cuucuauuauauug

SEQ ID NO: 4003356 - RNA, 18 nt, Staphylococcus aureus subsp. aureus MW2
cuucuauuuuauaauaaa

SEQ ID NO: 4003357 - RNA, 22 nt, Staphylococcus aureus subsp. aureus MW2
cuucucaauuuaguauaaauaa

SEQ ID NO: 4003358 - RNA, 20 nt, Staphylococcus aureus subsp. aureus MW2
cuucucuauacccuuuauua

SEQ ID NO: 4003359 - RNA, 12 nt, Staphylococcus aureus subsp. aureus MW2
cuucucuaucag

SEQ ID NO: 4003360 - RNA, 16 nt, Staphylococcus aureus subsp. aureus MW2
cuucugcauagcgcuc

SEQ ID NO: 4003361 - RNA, 20 nt, Staphylococcus aureus subsp. aureus MW2
cuucuggagccucuuguucu

SEQ ID NO: 4003362 - RNA, 20 nt, Staphylococcus aureus subsp. aureus MW2
cuucuggauagguaucacua

SEQ ID NO: 4003363 - RNA, 23 nt, Staphylococcus aureus subsp. aureus MW2
cuucuggauagguaucacuagga

SEQ ID NO: 4003364 - RNA, 24 nt, Staphylococcus aureus subsp. aureus MW2
cuucuuaaaucaacaucaucuuua

SEQ ID NO: 4003365 - RNA, 21 nt, Staphylococcus aureus subsp. aureus MW2
cuucuucaggaauaucuuuca

SEQ ID NO: 4003366 - RNA, 13 nt, Staphylococcus aureus subsp. aureus MW2
cuucuucaggauc

SEQ ID NO: 4003367 - RNA, 14 nt, Staphylococcus aureus subsp. aureus MW2
cuucuucaguaagc

SEQ ID NO: 4003368 - RNA, 19 nt, Staphylococcus aureus subsp. aureus MW2
cuucuuuagcaaaacgcau

SEQ ID NO: 4003369 - RNA, 20 nt, Staphylococcus aureus subsp. aureus MW2
cuucuuucuaaaauaacuaa

SEQ ID NO: 4003370 - RNA, 22 nt, Staphylococcus aureus subsp. aureus MW2
cuucuuuguuggggccccgcca

SEQ ID NO: 4003371 - RNA, 13 nt, Staphylococcus aureus subsp. aureus MW2
cuucuuuuaaguu

SEQ ID NO: 4003372 - RNA, 13 nt, Staphylococcus aureus subsp. aureus MW2
cuucuuuucuuug

SEQ ID NO: 4003373 - RNA, 18 nt, Staphylococcus aureus subsp. aureus MW2
cuucuuuuucuugcauac

SEQ ID NO: 4003374 - RNA, 17 nt, Staphylococcus aureus subsp. aureus MW2
cuucuuuuuuguaucuc

SEQ ID NO: 4003375 - RNA, 16 nt, Staphylococcus aureus subsp. aureus MW2
cuugaaacacaaaaag

SEQ ID NO: 4003376 - RNA, 22 nt, Staphylococcus aureus subsp. aureus MW2
cuugaaauaaacauaucaucau

SEQ ID NO: 4003377 - RNA, 20 nt, Staphylococcus aureus subsp. aureus MW2
cuugaacaauucuucaucau

SEQ ID NO: 4003378 - RNA, 16 nt, Staphylococcus aureus subsp. aureus MW2
cuugaagcaucgauuu

SEQ ID NO: 4003379 - RNA, 22 nt, Staphylococcus aureus subsp. aureus MW2
cuugaauaccuuuuauuauuuu

SEQ ID NO: 4003380 - RNA, 22 nt, Staphylococcus aureus subsp. aureus MW2
cuugagcuuuguuagcaucugc

SEQ ID NO: 4003381 - RNA, 18 nt, Staphylococcus aureus subsp. aureus MW2
cuugaucauuauaaaaug

SEQ ID NO: 4003382 - RNA, 16 nt, Staphylococcus aureus subsp. aureus MW2
cuugaugaaacugauu

SEQ ID NO: 4003383 - RNA, 12 nt, Staphylococcus aureus subsp. aureus MW2
cuugauggcaac

SEQ ID NO: 4003384 - RNA, 20 nt, Staphylococcus aureus subsp. aureus MW2
cuugauggcaacuaaaauuu

SEQ ID NO: 4003385 - RNA, 19 nt, Staphylococcus aureus subsp. aureus MW2
cuugauuauauuuuucuuc

SEQ ID NO: 4003386 - RNA, 17 nt, Staphylococcus aureus subsp. aureus MW2
cuugauuguaaauaaaa

SEQ ID NO: 4003387 - RNA, 15 nt, Staphylococcus aureus subsp. aureus MW2
cuugauuuaauuuuu

SEQ ID NO: 4003388 - RNA, 16 nt, Staphylococcus aureus subsp. aureus MW2
cuugcaaauauaucau

SEQ ID NO: 4003389 - RNA, 21 nt, Staphylococcus aureus subsp. aureus MW2
cuugcaaauauaucaucucua

SEQ ID NO: 4003390 - RNA, 22 nt, Staphylococcus aureus subsp. aureus MW2
cuugcaaauauaucaucucuau

SEQ ID NO: 4003391 - RNA, 14 nt, Staphylococcus aureus subsp. aureus MW2
cuugcacaccagug

SEQ ID NO: 4003392 - RNA, 21 nt, Staphylococcus aureus subsp. aureus MW2
cuugcauacgaauuaaaauaa

SEQ ID NO: 4003393 - RNA, 20 nt, Staphylococcus aureus subsp. aureus MW2
cuugccuucaaauucucaau

SEQ ID NO: 4003394 - RNA, 16 nt, Staphylococcus aureus subsp. aureus MW2
cuugcggucucaacuu

SEQ ID NO: 4003395 - RNA, 20 nt, Staphylococcus aureus subsp. aureus MW2
cuugcggucucaacuugccu

SEQ ID NO: 4003396 - RNA, 14 nt, Staphylococcus aureus subsp. aureus MW2
cuuuauuaccagcu

SEQ ID NO: 4003397 - RNA, 16 nt, Staphylococcus aureus subsp. aureus MW2
cuuuauuguugugcuu

SEQ ID NO: 4003398 - RNA, 20 nt, Staphylococcus aureus subsp. aureus MW2
cuuuauuuacaauguuaucu

SEQ ID NO: 4003399 - RNA, 18 nt, Staphylococcus aureus subsp. aureus MW2
cuuuauuuuaaacaugaa

SEQ ID NO: 4003400 - RNA, 12 nt, Staphylococcus aureus subsp. aureus MW2
cuuuauuuucuu

SEQ ID NO: 4003401 - RNA, 22 nt, Staphylococcus aureus subsp. aureus MW2
cuuuauuuucuuguguauuuuu

SEQ ID NO: 4003402 - RNA, 18 nt, Staphylococcus aureus subsp. aureus MW2
cuuucaaauauaucuaau

SEQ ID NO: 4003403 - RNA, 18 nt, Staphylococcus aureus subsp. aureus MW2
cuuucaauaauaaaucac

SEQ ID NO: 4003404 - RNA, 14 nt, Staphylococcus aureus subsp. aureus MW2
cuuucacuacauua

SEQ ID NO: 4003405 - RNA, 18 nt, Staphylococcus aureus subsp. aureus MW2
cuuucacuacauuaaaaa

SEQ ID NO: 4003406 - RNA, 15 nt, Staphylococcus aureus subsp. aureus MW2
cuuucauaaauuguu

SEQ ID NO: 4003407 - RNA, 20 nt, Staphylococcus aureus subsp. aureus MW2
cuuucauaaauuguuuuaca

SEQ ID NO: 4003408 - RNA, 22 nt, Staphylococcus aureus subsp. aureus MW2
cuuucauaguuauuaaaucuuu

SEQ ID NO: 4003409 - RNA, 21 nt, Staphylococcus aureus subsp. aureus MW2
cuuucaucaaauucucauuca

SEQ ID NO: 4003410 - RNA, 23 nt, Staphylococcus aureus subsp. aureus MW2
cuuucaucuuuuucacuaaucau

SEQ ID NO: 4003411 - RNA, 17 nt, Staphylococcus aureus subsp. aureus MW2
cuuuccacagcuuguuc

SEQ ID NO: 4003412 - RNA, 16 nt, Staphylococcus aureus subsp. aureus MW2
cuuuccauuguugaua

SEQ ID NO: 4003413 - RNA, 18 nt, Staphylococcus aureus subsp. aureus MW2
cuuuccgccagucaucau

SEQ ID NO: 4003414 - RNA, 21 nt, Staphylococcus aureus subsp. aureus MW2
cuuuccucacuagauaguuua

SEQ ID NO: 4003415 - RNA, 13 nt, Staphylococcus aureus subsp. aureus MW2
cuuucgauaaacu

SEQ ID NO: 4003416 - RNA, 23 nt, Staphylococcus aureus subsp. aureus MW2
cuuucguuucuuuuauaucgcuu

SEQ ID NO: 4003417 - RNA, 21 nt, Staphylococcus aureus subsp. aureus MW2
cuuucuaagauguguugaaac

SEQ ID NO: 4003418 - RNA, 16 nt, Staphylococcus aureus subsp. aureus MW2
cuuucuaucuuguucu

SEQ ID NO: 4003419 - RNA, 22 nt, Staphylococcus aureus subsp. aureus MW2
cuuucuaucuuguucuucuuua

SEQ ID NO: 4003420 - RNA, 20 nt, Staphylococcus aureus subsp. aureus MW2
cuuucugcccacuuaauauc

SEQ ID NO: 4003421 - RNA, 11 nt, Staphylococcus aureus subsp. aureus MW2
cuuucuuuucu

SEQ ID NO: 4003422 - RNA, 12 nt, Staphylococcus aureus subsp. aureus MW2
cuuucuuuucug

SEQ ID NO: 4003423 - RNA, 21 nt, Staphylococcus aureus subsp. aureus MW2
cuuucuuuuucaucuuucaaa

SEQ ID NO: 4003424 - RNA, 19 nt, Staphylococcus aureus subsp. aureus MW2
cuuugaacauauuauaaaa

SEQ ID NO: 4003425 - RNA, 16 nt, Staphylococcus aureus subsp. aureus MW2
cuuugacauguguuaa

SEQ ID NO: 4003426 - RNA, 19 nt, Staphylococcus aureus subsp. aureus MW2
cuuugauaacaauuuuaaa

SEQ ID NO: 4003427 - RNA, 17 nt, Staphylococcus aureus subsp. aureus MW2
cuuugauauguuuccuc

SEQ ID NO: 4003428 - RNA, 19 nt, Staphylococcus aureus subsp. aureus MW2
cuuugauguucacuaaaug

SEQ ID NO: 4003429 - RNA, 21 nt, Staphylococcus aureus subsp. aureus MW2
cuuugauguucacuaaaugug

SEQ ID NO: 4003430 - RNA, 19 nt, Staphylococcus aureus subsp. aureus MW2
cuuugauuuaauaauauuu

SEQ ID NO: 4003431 - RNA, 17 nt, Staphylococcus aureus subsp. aureus MW2
cuuugauuucauuugug

SEQ ID NO: 4003432 - RNA, 18 nt, Staphylococcus aureus subsp. aureus MW2
cuuugcauacauaucuuu

SEQ ID NO: 4003433 - RNA, 20 nt, Staphylococcus aureus subsp. aureus MW2
cuuugcauacauaucuuuug

SEQ ID NO: 4003434 - RNA, 15 nt, Staphylococcus aureus subsp. aureus MW2
cuuugccaacaccau

SEQ ID NO: 4003435 - RNA, 16 nt, Staphylococcus aureus subsp. aureus MW2
cuuugcuaaauauuau

SEQ ID NO: 4003436 - RNA, 18 nt, Staphylococcus aureus subsp. aureus MW2
cuuugcuguccaucguca

SEQ ID NO: 4003437 - RNA, 23 nt, Staphylococcus aureus subsp. aureus MW2
cuuuggaaauuuauuauaaaaua

SEQ ID NO: 4003438 - RNA, 16 nt, Staphylococcus aureus subsp. aureus MW2
cuuuggacuuuaaagu

SEQ ID NO: 4003439 - RNA, 18 nt, Staphylococcus aureus subsp. aureus MW2
cuuuggauaugcguauau

SEQ ID NO: 4003440 - RNA, 20 nt, Staphylococcus aureus subsp. aureus MW2
cuuuggauuucuuuuuaaaa

SEQ ID NO: 4003441 - RNA, 14 nt, Staphylococcus aureus subsp. aureus MW2
cuuuggcaccagua

SEQ ID NO: 4003442 - RNA, 18 nt, Staphylococcus aureus subsp. aureus MW2
cuuuguaaccuaaaaaca

SEQ ID NO: 4003443 - RNA, 20 nt, Staphylococcus aureus subsp. aureus MW2
cuuuguaaccuaaaaacaaa

SEQ ID NO: 4003444 - RNA, 23 nt, Staphylococcus aureus subsp. aureus MW2
cuuuguauggaaauggugguuac

SEQ ID NO: 4003445 - RNA, 19 nt, Staphylococcus aureus subsp. aureus MW2
cuuugucacgauagauuua

SEQ ID NO: 4003446 - RNA, 16 nt, Staphylococcus aureus subsp. aureus MW2
cuuuguguuugcuuuu

SEQ ID NO: 4003447 - RNA, 14 nt, Staphylococcus aureus subsp. aureus MW2
cuuuguuaaaaaau

SEQ ID NO: 4003448 - RNA, 23 nt, Staphylococcus aureus subsp. aureus MW2
cuuuguucugcuuuuucuuuauc

SEQ ID NO: 4003449 - RNA, 15 nt, Staphylococcus aureus subsp. aureus MW2
cuuuguuuucaaacu

SEQ ID NO: 4003450 - RNA, 21 nt, Staphylococcus aureus subsp. aureus MW2
cuuuuaaaaucguugcagauu

SEQ ID NO: 4003451 - RNA, 19 nt, Staphylococcus aureus subsp. aureus MW2
cuuuuaaaaucuugaugau

SEQ ID NO: 4003452 - RNA, 17 nt, Staphylococcus aureus subsp. aureus MW2
cuuuuaaaccguguucu

SEQ ID NO: 4003453 - RNA, 22 nt, Staphylococcus aureus subsp. aureus MW2
cuuuuaaaccguguucuuuaau

SEQ ID NO: 4003454 - RNA, 16 nt, Staphylococcus aureus subsp. aureus MW2
cuuuuaauagaucuuu

SEQ ID NO: 4003455 - RNA, 16 nt, Staphylococcus aureus subsp. aureus MW2
cuuuuaauucuuaauc

SEQ ID NO: 4003456 - RNA, 18 nt, Staphylococcus aureus subsp. aureus MW2
cuuuuaauuguauuuucu

SEQ ID NO: 4003457 - RNA, 19 nt, Staphylococcus aureus subsp. aureus MW2
cuuuuaauuguauuuucug

SEQ ID NO: 4003458 - RNA, 15 nt, Staphylococcus aureus subsp. aureus MW2
cuuuuacaaacuuca

SEQ ID NO: 4003459 - RNA, 17 nt, Staphylococcus aureus subsp. aureus MW2
cuuuuacgccuucuuua

SEQ ID NO: 4003460 - RNA, 14 nt, Staphylococcus aureus subsp. aureus MW2
cuuuuacuaaauga

SEQ ID NO: 4003461 - RNA, 21 nt, Staphylococcus aureus subsp. aureus MW2
cuuuuacuuucucaucuauuu

SEQ ID NO: 4003462 - RNA, 14 nt, Staphylococcus aureus subsp. aureus MW2
cuuuuagaauucua

SEQ ID NO: 4003463 - RNA, 18 nt, Staphylococcus aureus subsp. aureus MW2
cuuuuagaauucuaaaua

SEQ ID NO: 4003464 - RNA, 12 nt, Staphylococcus aureus subsp. aureus MW2
cuuuuauagaaa

SEQ ID NO: 4003465 - RNA, 15 nt, Staphylococcus aureus subsp. aureus MW2
cuuuuauauuuuuau

SEQ ID NO: 4003466 - RNA, 23 nt, Staphylococcus aureus subsp. aureus MW2
cuuuuauuaaagaaacaugauug

SEQ ID NO: 4003467 - RNA, 16 nt, Staphylococcus aureus subsp. aureus MW2
cuuuuauuauuuuaug

SEQ ID NO: 4003468 - RNA, 17 nt, Staphylococcus aureus subsp. aureus MW2
cuuuuauuuaucuuuua

SEQ ID NO: 4003469 - RNA, 12 nt, Staphylococcus aureus subsp. aureus MW2
cuuuuauuuuca

SEQ ID NO: 4003470 - RNA, 15 nt, Staphylococcus aureus subsp. aureus MW2
cuuuuauuuucauaa

SEQ ID NO: 4003471 - RNA, 22 nt, Staphylococcus aureus subsp. aureus MW2
cuuuucagcaguugcacaaauu

SEQ ID NO: 4003472 - RNA, 23 nt, Staphylococcus aureus subsp. aureus MW2
cuuuucaucuguccgauuuuuug

SEQ ID NO: 4003473 - RNA, 18 nt, Staphylococcus aureus subsp. aureus MW2
cuuuucgaaauucucugu

SEQ ID NO: 4003474 - RNA, 20 nt, Staphylococcus aureus subsp. aureus MW2
cuuuucgaaauucucugugu

SEQ ID NO: 4003475 - RNA, 17 nt, Staphylococcus aureus subsp. aureus MW2
cuuuucgaaauucuuua

SEQ ID NO: 4003476 - RNA, 14 nt, Staphylococcus aureus subsp. aureus MW2
cuuuucgcuuuucu

SEQ ID NO: 4003477 - RNA, 19 nt, Staphylococcus aureus subsp. aureus MW2
cuuuucuaauuuuucuuua

SEQ ID NO: 4003478 - RNA, 14 nt, Staphylococcus aureus subsp. aureus MW2
cuuuucuaucaaaa

SEQ ID NO: 4003479 - RNA, 16 nt, Staphylococcus aureus subsp. aureus MW2
cuuuucuaucaaaaaa

SEQ ID NO: 4003480 - RNA, 13 nt, Staphylococcus aureus subsp. aureus MW2
cuuuucuauucga

SEQ ID NO: 4003481 - RNA, 18 nt, Staphylococcus aureus subsp. aureus MW2
cuuuucugucuguaaauu

SEQ ID NO: 4003482 - RNA, 19 nt, Staphylococcus aureus subsp. aureus MW2
cuuuugaauaauaaacuua

SEQ ID NO: 4003483 - RNA, 13 nt, Staphylococcus aureus subsp. aureus MW2
cuuuugauagcua

SEQ ID NO: 4003484 - RNA, 13 nt, Staphylococcus aureus subsp. aureus MW2
gaaaauagcuguu

SEQ ID NO: 4003485 - RNA, 20 nt, Staphylococcus aureus subsp. aureus MW2
gaaaauagcuguuugauauu

SEQ ID NO: 4003486 - RNA, 17 nt, Staphylococcus aureus subsp. aureus MW2
gaaaauauauuauaaaa

SEQ ID NO: 4003487 - RNA, 21 nt, Staphylococcus aureus subsp. aureus MW2
gaaaauauauuauaaaaauag

SEQ ID NO: 4003488 - RNA, 21 nt, Staphylococcus aureus subsp. aureus MW2
gaaaauaucacuaauauauuu

SEQ ID NO: 4003489 - RNA, 19 nt, Staphylococcus aureus subsp. aureus MW2
gaaaauauuuuauuauaau

SEQ ID NO: 4003490 - RNA, 23 nt, Staphylococcus aureus subsp. aureus MW2
gaaaaucuuuaacucuugaaaca

SEQ ID NO: 4003491 - RNA, 22 nt, Staphylococcus aureus subsp. aureus MW2
gaaaaugacgauacguauauag

SEQ ID NO: 4003492 - RNA, 18 nt, Staphylococcus aureus subsp. aureus MW2
gaaaaugacuaccuguug

SEQ ID NO: 4003493 - RNA, 18 nt, Staphylococcus aureus subsp. aureus MW2
gaaaaugcgcuuguaaca

SEQ ID NO: 4003494 - RNA, 14 nt, Staphylococcus aureus subsp. aureus MW2
gaaaauuaaaaaau

SEQ ID NO: 4003495 - RNA, 23 nt, Staphylococcus aureus subsp. aureus MW2
gaaaauuaagaugaaauacuuga

SEQ ID NO: 4003496 - RNA, 16 nt, Staphylococcus aureus subsp. aureus MW2
gaaaauuaucuuucau

SEQ ID NO: 4003497 - RNA, 14 nt, Staphylococcus aureus subsp. aureus MW2
gaaaauugcuaaaa

SEQ ID NO: 4003498 - RNA, 18 nt, Staphylococcus aureus subsp. aureus MW2
gaaaauugcuaaaaaaau

SEQ ID NO: 4003499 - RNA, 20 nt, Staphylococcus aureus subsp. aureus MW2
gaaaauuuauucaaaucaua

SEQ ID NO: 4003500 - RNA, 22 nt, Staphylococcus aureus subsp. aureus MW2
gaaaauuucucacugcuguucu

SEQ ID NO: 4003501 - RNA, 13 nt, Staphylococcus aureus subsp. aureus MW2
gaaaauuuuauca

SEQ ID NO: 4003502 - RNA, 15 nt, Staphylococcus aureus subsp. aureus MW2
gaaacacacuaaaag

SEQ ID NO: 4003503 - RNA, 16 nt, Staphylococcus aureus subsp. aureus MW2
gaaacacacuaaaagc

SEQ ID NO: 4003504 - RNA, 16 nt, Staphylococcus aureus subsp. aureus MW2
gaaacaucuugauauu

SEQ ID NO: 4003505 - RNA, 14 nt, Staphylococcus aureus subsp. aureus MW2
gaaaccaaaaauaa

SEQ ID NO: 4003506 - RNA, 17 nt, Staphylococcus aureus subsp. aureus MW2
gaaaccaaaaauaauua

SEQ ID NO: 4003507 - RNA, 23 nt, Staphylococcus aureus subsp. aureus MW2
gaaacgcuuugcagauugauaua

SEQ ID NO: 4003508 - RNA, 19 nt, Staphylococcus aureus subsp. aureus MW2
gaaacgucuuaauucuucu

SEQ ID NO: 4003509 - RNA, 14 nt, Staphylococcus aureus subsp. aureus MW2
gaaacuaauaauuu

SEQ ID NO: 4003510 - RNA, 13 nt, Staphylococcus aureus subsp. aureus MW2
gaaacugaaguug

SEQ ID NO: 4003511 - RNA, 15 nt, Staphylococcus aureus subsp. aureus MW2
gaaacugaaguugaa

SEQ ID NO: 4003512 - RNA, 19 nt, Staphylococcus aureus subsp. aureus MW2
gaaacuggauaaauaaaga

SEQ ID NO: 4003513 - RNA, 13 nt, Staphylococcus aureus subsp. aureus MW2
gaaacuuguccgu

SEQ ID NO: 4003514 - RNA, 14 nt, Staphylococcus aureus subsp. aureus MW2
gaaagaagucugca

SEQ ID NO: 4003515 - RNA, 17 nt, Staphylococcus aureus subsp. aureus MW2
gaaagaccguauuuuuu

SEQ ID NO: 4003516 - RNA, 21 nt, Staphylococcus aureus subsp. aureus MW2
gaaagacguuuuuuuauaaau

SEQ ID NO: 4003517 - RNA, 14 nt, Staphylococcus aureus subsp. aureus MW2
gaaagagaaaagcu

SEQ ID NO: 4003518 - RNA, 14 nt, Staphylococcus aureus subsp. aureus MW2
gaaagauauuucug

SEQ ID NO: 4003519 - RNA, 16 nt, Staphylococcus aureus subsp. aureus MW2
gaaagcaccuaaaaua

SEQ ID NO: 4003520 - RNA, 18 nt, Staphylococcus aureus subsp. aureus MW2
gaaagcauagcuguaugg

SEQ ID NO: 4003521 - RNA, 20 nt, Staphylococcus aureus subsp. aureus MW2
gaaagcgucuuuuuauacuu

SEQ ID NO: 4003522 - RNA, 22 nt, Staphylococcus aureus subsp. aureus MW2
gaaaggcuagcuaaaauuugcu

SEQ ID NO: 4003523 - RNA, 20 nt, Staphylococcus aureus subsp. aureus MW2
gaaaguaauaaguaauaauu

SEQ ID NO: 4003524 - RNA, 19 nt, Staphylococcus aureus subsp. aureus MW2
gaaaguaccgguuuuucau

SEQ ID NO: 4003525 - RNA, 20 nt, Staphylococcus aureus subsp. aureus MW2
gaaaguauuagauauauuug

SEQ ID NO: 4003526 - RNA, 16 nt, Staphylococcus aureus subsp. aureus MW2
gaaagucagcuuacaa

SEQ ID NO: 4003527 - RNA, 20 nt, Staphylococcus aureus subsp. aureus MW2
gaaagucagcuuacaauaau

SEQ ID NO: 4003528 - RNA, 23 nt, Staphylococcus aureus subsp. aureus MW2
gaaagucuuuaaccaaaauugau

SEQ ID NO: 4003529 - RNA, 16 nt, Staphylococcus aureus subsp. aureus MW2
gaaagugauucccaaa

SEQ ID NO: 4003530 - RNA, 12 nt, Staphylococcus aureus subsp. aureus MW2
gaaagugauuua

SEQ ID NO: 4003531 - RNA, 15 nt, Staphylococcus aureus subsp. aureus MW2
gaaaguguaugcaug

SEQ ID NO: 4003532 - RNA, 19 nt, Staphylococcus aureus subsp. aureus MW2
gaaaguugcuuagcuucuc

SEQ ID NO: 4003533 - RNA, 14 nt, Staphylococcus aureus subsp. aureus MW2
gaaauaaaaaauaa

SEQ ID NO: 4003534 - RNA, 9 nt, Staphylococcus aureus subsp. aureus MW2
gaaauaaua

SEQ ID NO: 4003535 - RNA, 21 nt, Staphylococcus aureus subsp. aureus MW2
gaaauaaucuaguaucuauca

SEQ ID NO: 4003536 - RNA, 19 nt, Staphylococcus aureus subsp. aureus MW2
gaaauaccuccugauugcu

SEQ ID NO: 4003537 - RNA, 22 nt, Staphylococcus aureus subsp. aureus MW2
gaaauacuugaauguaagaagu

SEQ ID NO: 4003538 - RNA, 14 nt, Staphylococcus aureus subsp. aureus MW2
gaaauagaaauguc

SEQ ID NO: 4003539 - RNA, 21 nt, Staphylococcus aureus subsp. aureus MW2
gaaauaggugcuuguaaaauu

SEQ ID NO: 4003540 - RNA, 23 nt, Staphylococcus aureus subsp. aureus MW2
gaaauauaccaaccaaaaccaaa

SEQ ID NO: 4003541 - RNA, 16 nt, Staphylococcus aureus subsp. aureus MW2
gaaauauagugauuga

SEQ ID NO: 4003542 - RNA, 13 nt, Staphylococcus aureus subsp. aureus MW2
gaaauaugaaaag

SEQ ID NO: 4003543 - RNA, 15 nt, Staphylococcus aureus subsp. aureus MW2
gaaauaugaaaagag

SEQ ID NO: 4003544 - RNA, 14 nt, Staphylococcus aureus subsp. aureus MW2
gaaauaugauugaa

SEQ ID NO: 4003545 - RNA, 13 nt, Staphylococcus aureus subsp. aureus MW2
gaaauauuuaucu

SEQ ID NO: 4003546 - RNA, 16 nt, Staphylococcus aureus subsp. aureus MW2
gaaaucagcuuuucuu

SEQ ID NO: 4003547 - RNA, 19 nt, Staphylococcus aureus subsp. aureus MW2
gaaaucaguuugaauugac

SEQ ID NO: 4003548 - RNA, 19 nt, Staphylococcus aureus subsp. aureus MW2
gaaauccgcauaaauuaga

SEQ ID NO: 4003549 - RNA, 20 nt, Staphylococcus aureus subsp. aureus MW2
gaaauccgcauaaauuagau

SEQ ID NO: 4003550 - RNA, 15 nt, Staphylococcus aureus subsp. aureus MW2
gaaaucgccuuguuu

SEQ ID NO: 4003551 - RNA, 15 nt, Staphylococcus aureus subsp. aureus MW2
gaaaugauaauuuaa

SEQ ID NO: 4003552 - RNA, 21 nt, Staphylococcus aureus subsp. aureus MW2
gaaaugauacauuauuaaaua

SEQ ID NO: 4003553 - RNA, 19 nt, Staphylococcus aureus subsp. aureus MW2
gaaaugauauuuucgcaaa

SEQ ID NO: 4003554 - RNA, 16 nt, Staphylococcus aureus subsp. aureus MW2
gaaaugguaucuaaau

SEQ ID NO: 4003555 - RNA, 19 nt, Staphylococcus aureus subsp. aureus MW2
gaaaugguaucuaaaugug

SEQ ID NO: 4003556 - RNA, 15 nt, Staphylococcus aureus subsp. aureus MW2
gaaauguagacaaua

SEQ ID NO: 4003557 - RNA, 21 nt, Staphylococcus aureus subsp. aureus MW2
gaaauguaugacauaaaccau

SEQ ID NO: 4003558 - RNA, 19 nt, Staphylococcus aureus subsp. aureus MW2
gaaauguuuauaauaauau

SEQ ID NO: 4003559 - RNA, 21 nt, Staphylococcus aureus subsp. aureus MW2
gaaauguuuaucaauucccug

SEQ ID NO: 4003560 - RNA, 13 nt, Staphylococcus aureus subsp. aureus MW2
gaaauuaaaucua

SEQ ID NO: 4003561 - RNA, 14 nt, Staphylococcus aureus subsp. aureus MW2
gaaauuaaaucuac

SEQ ID NO: 4003562 - RNA, 11 nt, Staphylococcus aureus subsp. aureus MW2
gaaauuagaaa

SEQ ID NO: 4003563 - RNA, 14 nt, Staphylococcus aureus subsp. aureus MW2
gaaauuagauuuua

SEQ ID NO: 4003564 - RNA, 21 nt, Staphylococcus aureus subsp. aureus MW2
gaaauucuacaggcaaugcaa

SEQ ID NO: 4003565 - RNA, 23 nt, Staphylococcus aureus subsp. aureus MW2
gaaauucuacaggcaaugcaagu

SEQ ID NO: 4003566 - RNA, 14 nt, Staphylococcus aureus subsp. aureus MW2
gaaauucucugugu

SEQ ID NO: 4003567 - RNA, 21 nt, Staphylococcus aureus subsp. aureus MW2
gaaauucuuuauguuggggcc

SEQ ID NO: 4003568 - RNA, 17 nt, Staphylococcus aureus subsp. aureus MW2
gaaauugugaacuaaau

SEQ ID NO: 4003569 - RNA, 19 nt, Staphylococcus aureus subsp. aureus MW2
gaaauuguguuucuuuuau

SEQ ID NO: 4003570 - RNA, 21 nt, Staphylococcus aureus subsp. aureus MW2
gaaauuuauuauaaaauagaa

SEQ ID NO: 4003571 - RNA, 16 nt, Staphylococcus aureus subsp. aureus MW2
gaaauuuauuauaauu

SEQ ID NO: 4003572 - RNA, 22 nt, Staphylococcus aureus subsp. aureus MW2
gaaguugcucgcgcucuucuuc

SEQ ID NO: 4003573 - RNA, 15 nt, Staphylococcus aureus subsp. aureus MW2
gaaguuguuucucca

SEQ ID NO: 4003574 - RNA, 20 nt, Staphylococcus aureus subsp. aureus MW2
gaauaaauaauuuagaaaua

SEQ ID NO: 4003575 - RNA, 15 nt, Staphylococcus aureus subsp. aureus MW2
gaauaaauagauaau

SEQ ID NO: 4003576 - RNA, 13 nt, Staphylococcus aureus subsp. aureus MW2
gaauaacacuaga

SEQ ID NO: 4003577 - RNA, 19 nt, Staphylococcus aureus subsp. aureus MW2
gaauaacuguuuaucauga

SEQ ID NO: 4003578 - RNA, 17 nt, Staphylococcus aureus subsp. aureus MW2
gaauaauaaacuuaaaa

SEQ ID NO: 4003579 - RNA, 23 nt, Staphylococcus aureus subsp. aureus MW2
gaauaauuagauuuaaaauguca

SEQ ID NO: 4003580 - RNA, 20 nt, Staphylococcus aureus subsp. aureus MW2
gaauaauucuuuuagaauuc

SEQ ID NO: 4003581 - RNA, 16 nt, Staphylococcus aureus subsp. aureus MW2
gaauaauugagaaaaa

SEQ ID NO: 4003582 - RNA, 21 nt, Staphylococcus aureus subsp. aureus MW2
gaauaauugagaaaaagguua

SEQ ID NO: 4003583 - RNA, 17 nt, Staphylococcus aureus subsp. aureus MW2
gaauaauuuuaaaaaua

SEQ ID NO: 4003584 - RNA, 18 nt, Staphylococcus aureus subsp. aureus MW2
gaauaauuuuaaaaauaa

SEQ ID NO: 4003585 - RNA, 13 nt, Staphylococcus aureus subsp. aureus MW2
gaauacuuuuuaa

SEQ ID NO: 4003586 - RNA, 16 nt, Staphylococcus aureus subsp. aureus MW2
gaauacuuuuuaacug

SEQ ID NO: 4003587 - RNA, 23 nt, Staphylococcus aureus subsp. aureus MW2
gaauagugagcguauuauuauug

SEQ ID NO: 4003588 - RNA, 13 nt, Staphylococcus aureus subsp. aureus MW2
gaauauaacgaau

SEQ ID NO: 4003589 - RNA, 14 nt, Staphylococcus aureus subsp. aureus MW2
gaauauaaugacca

SEQ ID NO: 4003590 - RNA, 22 nt, Staphylococcus aureus subsp. aureus MW2
gaauauacaauaguauaaauau

SEQ ID NO: 4003591 - RNA, 19 nt, Staphylococcus aureus subsp. aureus MW2
gaauauacuuaauuuaaau

SEQ ID NO: 4003592 - RNA, 22 nt, Staphylococcus aureus subsp. aureus MW2
gaauauuaacaccagauaucau

SEQ ID NO: 4003593 - RNA, 19 nt, Staphylococcus aureus subsp. aureus MW2
gaauauuaagauguauaug

SEQ ID NO: 4003594 - RNA, 21 nt, Staphylococcus aureus subsp. aureus MW2
gaauauuguauugaucuacau

SEQ ID NO: 4003595 - RNA, 12 nt, Staphylococcus aureus subsp. aureus MW2
gaauauuuaagu

SEQ ID NO: 4003596 - RNA, 13 nt, Staphylococcus aureus subsp. aureus MW2
gaaucaacaauau

SEQ ID NO: 4003597 - RNA, 19 nt, Staphylococcus aureus subsp. aureus MW2
gaaucacauuaacaaggcc

SEQ ID NO: 4003598 - RNA, 21 nt, Staphylococcus aureus subsp. aureus MW2
gaaucagaugauuuaauucug

SEQ ID NO: 4003599 - RNA, 16 nt, Staphylococcus aureus subsp. aureus MW2
gaaucaggaauguuug

SEQ ID NO: 4003600 - RNA, 19 nt, Staphylococcus aureus subsp. aureus MW2
gaauccaauuucucuaugu

SEQ ID NO: 4003601 - RNA, 14 nt, Staphylococcus aureus subsp. aureus MW2
gaaucccauaauga

SEQ ID NO: 4003602 - RNA, 21 nt, Staphylococcus aureus subsp. aureus MW2
gaaucgaagcccuuugauuua

SEQ ID NO: 4003603 - RNA, 13 nt, Staphylococcus aureus subsp. aureus MW2
gaaucgucauauu

SEQ ID NO: 4003604 - RNA, 15 nt, Staphylococcus aureus subsp. aureus MW2
gaaucuaaacuauaa

SEQ ID NO: 4003605 - RNA, 18 nt, Staphylococcus aureus subsp. aureus MW2
gaaucuugcauaaccaag

SEQ ID NO: 4003606 - RNA, 19 nt, Staphylococcus aureus subsp. aureus MW2
gaaucuugcauaaccaagu

SEQ ID NO: 4003607 - RNA, 15 nt, Staphylococcus aureus subsp. aureus MW2
gaaugaagcauuuua

SEQ ID NO: 4003608 - RNA, 14 nt, Staphylococcus aureus subsp. aureus MW2
gaaugaaguaauau

SEQ ID NO: 4003609 - RNA, 14 nt, Staphylococcus aureus subsp. aureus MW2
gaaugauuaaaauu

SEQ ID NO: 4003610 - RNA, 13 nt, Staphylococcus aureus subsp. aureus MW2
gaaugccuaauuu

SEQ ID NO: 4003611 - RNA, 21 nt, Staphylococcus aureus subsp. aureus MW2
gaaugcgauuuccuuuagcaa

SEQ ID NO: 4003612 - RNA, 14 nt, Staphylococcus aureus subsp. aureus MW2
gaauggcaaauaug

SEQ ID NO: 4003613 - RNA, 13 nt, Staphylococcus aureus subsp. aureus MW2
gaaugguauaauu

SEQ ID NO: 4003614 - RNA, 15 nt, Staphylococcus aureus subsp. aureus MW2
gaaugugaugauuaa

SEQ ID NO: 4003615 - RNA, 13 nt, Staphylococcus aureus subsp. aureus MW2
gaauguuccuugu

SEQ ID NO: 4003616 - RNA, 17 nt, Staphylococcus aureus subsp. aureus MW2
gaauguuuuugauagua

SEQ ID NO: 4003617 - RNA, 15 nt, Staphylococcus aureus subsp. aureus MW2
gaauuaacaacaaau

SEQ ID NO: 4003618 - RNA, 19 nt, Staphylococcus aureus subsp. aureus MW2
gaauuaacaacaaauauaa

SEQ ID NO: 4003619 - RNA, 22 nt, Staphylococcus aureus subsp. aureus MW2
gaauuaacuagugccucuuuua

SEQ ID NO: 4003620 - RNA, 17 nt, Staphylococcus aureus subsp. aureus MW2
gaauuaagaaaaguuac

SEQ ID NO: 4003621 - RNA, 13 nt, Staphylococcus aureus subsp. aureus MW2
gaauuaauaauga

SEQ ID NO: 4003622 - RNA, 19 nt, Staphylococcus aureus subsp. aureus MW2
gaauuacgcauccuaaugu

SEQ ID NO: 4003623 - RNA, 16 nt, Staphylococcus aureus subsp. aureus MW2
gaauuaguacuugaaa

SEQ ID NO: 4003624 - RNA, 15 nt, Staphylococcus aureus subsp. aureus MW2
gaauuaugaucaaua

SEQ ID NO: 4003625 - RNA, 18 nt, Staphylococcus aureus subsp. aureus MW2
gaauuaugaucaauaaga

SEQ ID NO: 4003626 - RNA, 13 nt, Staphylococcus aureus subsp. aureus MW2
gaauuauuauucu

SEQ ID NO: 4003627 - RNA, 15 nt, Staphylococcus aureus subsp. aureus MW2
gaauuauuuaaaaug

SEQ ID NO: 4003628 - RNA, 22 nt, Staphylococcus aureus subsp. aureus MW2
gaauucaaccaauuauuaaagc

SEQ ID NO: 4003629 - RNA, 13 nt, Staphylococcus aureus subsp. aureus MW2
gaauucucgauuu

SEQ ID NO: 4003630 - RNA, 13 nt, Staphylococcus aureus subsp. aureus MW2
gaauugaaaaauu

SEQ ID NO: 4003631 - RNA, 20 nt, Staphylococcus aureus subsp. aureus MW2
gaauugagcaacucaggaau

SEQ ID NO: 4003632 - RNA, 20 nt, Staphylococcus aureus subsp. aureus MW2
gaauugauguugaugcaacc

SEQ ID NO: 4003633 - RNA, 20 nt, Staphylococcus aureus subsp. aureus MW2
gaauuguauuaaucaaauau

SEQ ID NO: 4003634 - RNA, 16 nt, Staphylococcus aureus subsp. aureus MW2
gaauuguauuagcaau

SEQ ID NO: 4003635 - RNA, 20 nt, Staphylococcus aureus subsp. aureus MW2
gaauuguuagauaaucucau

SEQ ID NO: 4003636 - RNA, 14 nt, Staphylococcus aureus subsp. aureus MW2
gaauuuaaaaauag

SEQ ID NO: 4003637 - RNA, 19 nt, Staphylococcus aureus subsp. aureus MW2
gaauuuacuccuuacaaua

SEQ ID NO: 4003638 - RNA, 21 nt, Staphylococcus aureus subsp. aureus MW2
gaauuuaggaaugaauaaagc

SEQ ID NO: 4003639 - RNA, 22 nt, Staphylococcus aureus subsp. aureus MW2
gaauuuaggaaugaauaaagcu

SEQ ID NO: 4003640 - RNA, 20 nt, Staphylococcus aureus subsp. aureus MW2
gaauuuaguuuucguaguaa

SEQ ID NO: 4003641 - RNA, 20 nt, Staphylococcus aureus subsp. aureus MW2
gaauuuauugacauucacau

SEQ ID NO: 4003642 - RNA, 15 nt, Staphylococcus aureus subsp. aureus MW2
gaauuucgaaaagaa

SEQ ID NO: 4003643 - RNA, 22 nt, Staphylococcus aureus subsp. aureus MW2
gaauuucuuuucgaaauucuuu

SEQ ID NO: 4003644 - RNA, 13 nt, Staphylococcus aureus subsp. aureus MW2
gaauuuuaauaua

SEQ ID NO: 4003645 - RNA, 15 nt, Staphylococcus aureus subsp. aureus MW2
gaauuuuacguugaa

SEQ ID NO: 4003646 - RNA, 12 nt, Staphylococcus aureus subsp. aureus MW2
gaauuuuauaaa

SEQ ID NO: 4003647 - RNA, 13 nt, Staphylococcus aureus subsp. aureus MW2
gaauuuucguuca

SEQ ID NO: 4003648 - RNA, 14 nt, Staphylococcus aureus subsp. aureus MW2
gaauuuuuuuaaug

SEQ ID NO: 4003649 - RNA, 15 nt, Staphylococcus aureus subsp. aureus MW2
gacaaagcuuguaau

SEQ ID NO: 4003650 - RNA, 19 nt, Staphylococcus aureus subsp. aureus MW2
gacaacauaacaaagaacc

SEQ ID NO: 4003651 - RNA, 15 nt, Staphylococcus aureus subsp. aureus MW2
gacaacugauuuaau

SEQ ID NO: 4003652 - RNA, 15 nt, Staphylococcus aureus subsp. aureus MW2
gacaaggauugaaaa

SEQ ID NO: 4003653 - RNA, 22 nt, Staphylococcus aureus subsp. aureus MW2
gacaaguugcugaauaaaauau

SEQ ID NO: 4003654 - RNA, 15 nt, Staphylococcus aureus subsp. aureus MW2
gacaaucuaaaugua

SEQ ID NO: 4003655 - RNA, 16 nt, Staphylococcus aureus subsp. aureus MW2
gacaaucuaaauguaa

SEQ ID NO: 4003656 - RNA, 18 nt, Staphylococcus aureus subsp. aureus MW2
gacaaugcaaguuggggu

SEQ ID NO: 4003657 - RNA, 19 nt, Staphylococcus aureus subsp. aureus MW2
gacaauuauaauaaaacuu

SEQ ID NO: 4003658 - RNA, 17 nt, Staphylococcus aureus subsp. aureus MW2
gacacauuuacuuaaga

SEQ ID NO: 4003659 - RNA, 17 nt, Staphylococcus aureus subsp. aureus MW2
gacacguguaaaaauga

SEQ ID NO: 4003660 - RNA, 13 nt, Staphylococcus aureus subsp. aureus MW2
gacagaaaugaua

SEQ ID NO: 4003661 - RNA, 20 nt, Staphylococcus aureus subsp. aureus MW2
gagcuaauaugucuagacuu

SEQ ID NO: 4003662 - RNA, 14 nt, Staphylococcus aureus subsp. aureus MW2
gagcucauguuuca

SEQ ID NO: 4003663 - RNA, 16 nt, Staphylococcus aureus subsp. aureus MW2
gagcucauguuucagu

SEQ ID NO: 4003664 - RNA, 15 nt, Staphylococcus aureus subsp. aureus MW2
gagcugcuucaacua

SEQ ID NO: 4003665 - RNA, 17 nt, Staphylococcus aureus subsp. aureus MW2
gagcuggugagaaauug

SEQ ID NO: 4003666 - RNA, 17 nt, Staphylococcus aureus subsp. aureus MW2
gagcuugggacagaaaa

SEQ ID NO: 4003667 - RNA, 17 nt, Staphylococcus aureus subsp. aureus MW2
gagcuuuucuaaugcua

SEQ ID NO: 4003668 - RNA, 13 nt, Staphylococcus aureus subsp. aureus MW2
gaggaauuaauaa

SEQ ID NO: 4003669 - RNA, 19 nt, Staphylococcus aureus subsp. aureus MW2
gaggauacauaaaucuaau

SEQ ID NO: 4003670 - RNA, 22 nt, Staphylococcus aureus subsp. aureus MW2
gaggcaggaaugauauaccuug

SEQ ID NO: 4003671 - RNA, 14 nt, Staphylococcus aureus subsp. aureus MW2
gaggcgauaaaaga

SEQ ID NO: 4003672 - RNA, 17 nt, Staphylococcus aureus subsp. aureus MW2
gaggcgccacaacaugu

SEQ ID NO: 4003673 - RNA, 19 nt, Staphylococcus aureus subsp. aureus MW2
gagggaagugaaguuguau

SEQ ID NO: 4003674 - RNA, 19 nt, Staphylococcus aureus subsp. aureus MW2
gagguacuagaauuaacua

SEQ ID NO: 4003675 - RNA, 19 nt, Staphylococcus aureus subsp. aureus MW2
gaggugugguguaaagauc

SEQ ID NO: 4003676 - RNA, 23 nt, Staphylococcus aureus subsp. aureus MW2
gaguacauuuauuuaaugugcau

SEQ ID NO: 4003677 - RNA, 19 nt, Staphylococcus aureus subsp. aureus MW2
gaguacuaaucaauacuaa

SEQ ID NO: 4003678 - RNA, 21 nt, Staphylococcus aureus subsp. aureus MW2
gaguaguucggaugagaaaug

SEQ ID NO: 4003679 - RNA, 21 nt, Staphylococcus aureus subsp. aureus MW2
gaguauccugauuuaauguua

SEQ ID NO: 4003680 - RNA, 20 nt, Staphylococcus aureus subsp. aureus MW2
gagucaaagucauuuagaua

SEQ ID NO: 4003681 - RNA, 14 nt, Staphylococcus aureus subsp. aureus MW2
gagucuuauuuuua

SEQ ID NO: 4003682 - RNA, 15 nt, Staphylococcus aureus subsp. aureus MW2
gagugaaaauaagau

SEQ ID NO: 4003683 - RNA, 23 nt, Staphylococcus aureus subsp. aureus MW2
gaguguaugcauauaagauaauu

SEQ ID NO: 4003684 - RNA, 14 nt, Staphylococcus aureus subsp. aureus MW2
gaguuaauccucau

SEQ ID NO: 4003685 - RNA, 12 nt, Staphylococcus aureus subsp. aureus MW2
gaguuauaucuu

SEQ ID NO: 4003686 - RNA, 12 nt, Staphylococcus aureus subsp. aureus MW2
gaguugggguga

SEQ ID NO: 4003687 - RNA, 20 nt, Staphylococcus aureus subsp. aureus MW2
gaguuguacuacuugauucu

SEQ ID NO: 4003688 - RNA, 13 nt, Staphylococcus aureus subsp. aureus MW2
gauaaaaaaugaa

SEQ ID NO: 4003689 - RNA, 13 nt, Staphylococcus aureus subsp. aureus MW2
gauaaaaccaccu

SEQ ID NO: 4003690 - RNA, 19 nt, Staphylococcus aureus subsp. aureus MW2
gauaaaaccaccuaccauu

SEQ ID NO: 4003691 - RNA, 20 nt, Staphylococcus aureus subsp. aureus MW2
gauaaaaguuguauucugaa

SEQ ID NO: 4003692 - RNA, 14 nt, Staphylococcus aureus subsp. aureus MW2
gauaaacuacacac

SEQ ID NO: 4003693 - RNA, 15 nt, Staphylococcus aureus subsp. aureus MW2
gauaaacuacacacg

SEQ ID NO: 4003694 - RNA, 20 nt, Staphylococcus aureus subsp. aureus MW2
gauaaauaaacucaccaagu

SEQ ID NO: 4003695 - RNA, 22 nt, Staphylococcus aureus subsp. aureus MW2
gauaaauaugauguuaaaaaau

SEQ ID NO: 4003696 - RNA, 14 nt, Staphylococcus aureus subsp. aureus MW2
gauaaaucaucauu

SEQ ID NO: 4003697 - RNA, 23 nt, Staphylococcus aureus subsp. aureus MW2
gauaaaugcgguuaaugacuaug

SEQ ID NO: 4003698 - RNA, 16 nt, Staphylococcus aureus subsp. aureus MW2
gauaaauuaauaugaa

SEQ ID NO: 4003699 - RNA, 21 nt, Staphylococcus aureus subsp. aureus MW2
gauaaauuccauguauucuua

SEQ ID NO: 4003700 - RNA, 20 nt, Staphylococcus aureus subsp. aureus MW2
gauaaauuuuuaguuaaagu

SEQ ID NO: 4003701 - RNA, 14 nt, Staphylococcus aureus subsp. aureus MW2
gauaacgagugaaa

SEQ ID NO: 4003702 - RNA, 17 nt, Staphylococcus aureus subsp. aureus MW2
gauaacgagugaaaaua

SEQ ID NO: 4003703 - RNA, 20 nt, Staphylococcus aureus subsp. aureus MW2
gauaacuacacuuaauauau

SEQ ID NO: 4003704 - RNA, 17 nt, Staphylococcus aureus subsp. aureus MW2
gauaacuauuuaauuau

SEQ ID NO: 4003705 - RNA, 21 nt, Staphylococcus aureus subsp. aureus MW2
gauaacuguaacgugaggccc

SEQ ID NO: 4003706 - RNA, 23 nt, Staphylococcus aureus subsp. aureus MW2
gauaagaauuaacaacaaauaua

SEQ ID NO: 4003707 - RNA, 20 nt, Staphylococcus aureus subsp. aureus MW2
gauaaguuuuugaauaucua

SEQ ID NO: 4003708 - RNA, 18 nt, Staphylococcus aureus subsp. aureus MW2
gauaauaaggaagcguau

SEQ ID NO: 4003709 - RNA, 17 nt, Staphylococcus aureus subsp. aureus MW2
gauaauacuguuuaaau

SEQ ID NO: 4003710 - RNA, 18 nt, Staphylococcus aureus subsp. aureus MW2
gauaauacuguuuaaaua

SEQ ID NO: 4003711 - RNA, 18 nt, Staphylococcus aureus subsp. aureus MW2
gauaauccaccaaauaca

SEQ ID NO: 4003712 - RNA, 21 nt, Staphylococcus aureus subsp. aureus MW2
gauaauccuuuuuuaggcagg

SEQ ID NO: 4003713 - RNA, 16 nt, Staphylococcus aureus subsp. aureus MW2
gauaaucguuaaaaca

SEQ ID NO: 4003714 - RNA, 21 nt, Staphylococcus aureus subsp. aureus MW2
gauaaugauaguguaugaaug

SEQ ID NO: 4003715 - RNA, 21 nt, Staphylococcus aureus subsp. aureus MW2
gauaaugcaccugugauaacu

SEQ ID NO: 4003716 - RNA, 22 nt, Staphylococcus aureus subsp. aureus MW2
gauaauuaaaauaagauauaua

SEQ ID NO: 4003717 - RNA, 23 nt, Staphylococcus aureus subsp. aureus MW2
gauaauuaaaauaagauauauaa

SEQ ID NO: 4003718 - RNA, 13 nt, Staphylococcus aureus subsp. aureus MW2
gauaauuucuucu

SEQ ID NO: 4003719 - RNA, 23 nt, Staphylococcus aureus subsp. aureus MW2
gauaauuucuucuucuguaauau

SEQ ID NO: 4003720 - RNA, 13 nt, Staphylococcus aureus subsp. aureus MW2
gauacagaaccaa

SEQ ID NO: 4003721 - RNA, 15 nt, Staphylococcus aureus subsp. aureus MW2
gauacauaaaacauc

SEQ ID NO: 4003722 - RNA, 23 nt, Staphylococcus aureus subsp. aureus MW2
gauacauauucucugcuucuaaa

SEQ ID NO: 4003723 - RNA, 15 nt, Staphylococcus aureus subsp. aureus MW2
gauacauucuauuaa

SEQ ID NO: 4003724 - RNA, 16 nt, Staphylococcus aureus subsp. aureus MW2
gauaccaaaacucaaa

SEQ ID NO: 4003725 - RNA, 16 nt, Staphylococcus aureus subsp. aureus MW2
gauaccaaacugccua

SEQ ID NO: 4003726 - RNA, 14 nt, Staphylococcus aureus subsp. aureus MW2
gauaccuaaaauac

SEQ ID NO: 4003727 - RNA, 23 nt, Staphylococcus aureus subsp. aureus MW2
gauaccucauccgccaauuaaaa

SEQ ID NO: 4003728 - RNA, 21 nt, Staphylococcus aureus subsp. aureus MW2
gauaccuuuaauaauauugaa

SEQ ID NO: 4003729 - RNA, 19 nt, Staphylococcus aureus subsp. aureus MW2
gauaccuuuuucuaccaau

SEQ ID NO: 4003730 - RNA, 15 nt, Staphylococcus aureus subsp. aureus MW2
gauacguaaacacuu

SEQ ID NO: 4003731 - RNA, 21 nt, Staphylococcus aureus subsp. aureus MW2
gauacgugguuuuauuugauu

SEQ ID NO: 4003732 - RNA, 17 nt, Staphylococcus aureus subsp. aureus MW2
gauacuaauaucuucuu

SEQ ID NO: 4003733 - RNA, 15 nt, Staphylococcus aureus subsp. aureus MW2
gauacugccauaugu

SEQ ID NO: 4003734 - RNA, 14 nt, Staphylococcus aureus subsp. aureus MW2
gauacuuugaaaga

SEQ ID NO: 4003735 - RNA, 13 nt, Staphylococcus aureus subsp. aureus MW2
gauacuuuuaaaa

SEQ ID NO: 4003736 - RNA, 19 nt, Staphylococcus aureus subsp. aureus MW2
gauacuuuuaaaaucuuga

SEQ ID NO: 4003737 - RNA, 22 nt, Staphylococcus aureus subsp. aureus MW2
gauagaaguuuuuugauuagua

SEQ ID NO: 4003738 - RNA, 19 nt, Staphylococcus aureus subsp. aureus MW2
gauagaauacuaaaagugu

SEQ ID NO: 4003739 - RNA, 21 nt, Staphylococcus aureus subsp. aureus MW2
gauagaauacuaaaaguguua

SEQ ID NO: 4003740 - RNA, 21 nt, Staphylococcus aureus subsp. aureus MW2
gauagaaugucgauauuucua

SEQ ID NO: 4003741 - RNA, 19 nt, Staphylococcus aureus subsp. aureus MW2
gauagauucugauacagaa

SEQ ID NO: 4003742 - RNA, 21 nt, Staphylococcus aureus subsp. aureus MW2
gauagcauguuauauuaugaa

SEQ ID NO: 4003743 - RNA, 14 nt, Staphylococcus aureus subsp. aureus MW2
gauagccaauauaa

SEQ ID NO: 4003744 - RNA, 13 nt, Staphylococcus aureus subsp. aureus MW2
gauagugaauaau

SEQ ID NO: 4003745 - RNA, 17 nt, Staphylococcus aureus subsp. aureus MW2
gauaguuugagaaaauu

SEQ ID NO: 4003746 - RNA, 23 nt, Staphylococcus aureus subsp. aureus MW2
gauauaaauaggucacuuuuaau

SEQ ID NO: 4003747 - RNA, 19 nt, Staphylococcus aureus subsp. aureus MW2
gauauaagauucauauuua

SEQ ID NO: 4003748 - RNA, 21 nt, Staphylococcus aureus subsp. aureus MW2
gauauaauaaaaacagcagug

SEQ ID NO: 4003749 - RNA, 19 nt, Staphylococcus aureus subsp. aureus MW2
gauuggcugugcuauaauc

SEQ ID NO: 4003750 - RNA, 14 nt, Staphylococcus aureus subsp. aureus MW2
gauugguaaaucua

SEQ ID NO: 4003751 - RNA, 12 nt, Staphylococcus aureus subsp. aureus MW2
gauuguaaauaa

SEQ ID NO: 4003752 - RNA, 17 nt, Staphylococcus aureus subsp. aureus MW2
gauuguaauaauaaucu

SEQ ID NO: 4003753 - RNA, 24 nt, Staphylococcus aureus subsp. aureus MW2
gauuguaauaauaaucuuuaacau

SEQ ID NO: 4003754 - RNA, 23 nt, Staphylococcus aureus subsp. aureus MW2
gauugucaauuuaaagucuucau

SEQ ID NO: 4003755 - RNA, 15 nt, Staphylococcus aureus subsp. aureus MW2
gauugucuuauaaga

SEQ ID NO: 4003756 - RNA, 23 nt, Staphylococcus aureus subsp. aureus MW2
gauuguuaauucguguuugcaua

SEQ ID NO: 4003757 - RNA, 16 nt, Staphylococcus aureus subsp. aureus MW2
gauuuaaguuuauaau

SEQ ID NO: 4003758 - RNA, 15 nt, Staphylococcus aureus subsp. aureus MW2
gauuuauaaauguuu

SEQ ID NO: 4003759 - RNA, 15 nt, Staphylococcus aureus subsp. aureus MW2
gauuuauuaacucau

SEQ ID NO: 4003760 - RNA, 16 nt, Staphylococcus aureus subsp. aureus MW2
gauuuauuaacucaug

SEQ ID NO: 4003761 - RNA, 15 nt, Staphylococcus aureus subsp. aureus MW2
gauuucaguucauca

SEQ ID NO: 4003762 - RNA, 16 nt, Staphylococcus aureus subsp. aureus MW2
gauuucauaauguuaa

SEQ ID NO: 4003763 - RNA, 16 nt, Staphylococcus aureus subsp. aureus MW2
gauuucauuaauuuuu

SEQ ID NO: 4003764 - RNA, 13 nt, Staphylococcus aureus subsp. aureus MW2
gauuucauuugug

SEQ ID NO: 4003765 - RNA, 18 nt, Staphylococcus aureus subsp. aureus MW2
gauuuccuauuaggaucc

SEQ ID NO: 4003766 - RNA, 15 nt, Staphylococcus aureus subsp. aureus MW2
gauuucuaucaaaua

SEQ ID NO: 4003767 - RNA, 17 nt, Staphylococcus aureus subsp. aureus MW2
gauuucuaucaaauaau

SEQ ID NO: 4003768 - RNA, 14 nt, Staphylococcus aureus subsp. aureus MW2
gauuucuucugcua

SEQ ID NO: 4003769 - RNA, 13 nt, Staphylococcus aureus subsp. aureus MW2
gauuugauaaaaa

SEQ ID NO: 4003770 - RNA, 15 nt, Staphylococcus aureus subsp. aureus MW2
gauuugauaaaaaau

SEQ ID NO: 4003771 - RNA, 23 nt, Staphylococcus aureus subsp. aureus MW2
gauuugccaaaaguuauauaaau

SEQ ID NO: 4003772 - RNA, 17 nt, Staphylococcus aureus subsp. aureus MW2
gauuuuaaaagauaaau

SEQ ID NO: 4003773 - RNA, 17 nt, Staphylococcus aureus subsp. aureus MW2
gauuuuaaagaaaaguu

SEQ ID NO: 4003774 - RNA, 15 nt, Staphylococcus aureus subsp. aureus MW2
gauuuuaacaagaua

SEQ ID NO: 4003775 - RNA, 20 nt, Staphylococcus aureus subsp. aureus MW2
gauuuuaauaaauuagccau

SEQ ID NO: 4003776 - RNA, 19 nt, Staphylococcus aureus subsp. aureus MW2
gauuuuagugcgcuuauuu

SEQ ID NO: 4003777 - RNA, 21 nt, Staphylococcus aureus subsp. aureus MW2
gauuuuauauaaaaagaagau

SEQ ID NO: 4003778 - RNA, 13 nt, Staphylococcus aureus subsp. aureus MW2
gauuuuauuauga

SEQ ID NO: 4003779 - RNA, 15 nt, Staphylococcus aureus subsp. aureus MW2
gauuuucuaaagcuu

SEQ ID NO: 4003780 - RNA, 18 nt, Staphylococcus aureus subsp. aureus MW2
gauuuuuacaaagugauu

SEQ ID NO: 4003781 - RNA, 13 nt, Staphylococcus aureus subsp. aureus MW2
gauuuuucuuaua

SEQ ID NO: 4003782 - RNA, 14 nt, Staphylococcus aureus subsp. aureus MW2
gauuuuuuggauuc

SEQ ID NO: 4003783 - RNA, 18 nt, Staphylococcus aureus subsp. aureus MW2
gauuuuuuggauuccauc

SEQ ID NO: 4003784 - RNA, 18 nt, Staphylococcus aureus subsp. aureus MW2
gcaaaaauaauaugaauu

SEQ ID NO: 4003785 - RNA, 13 nt, Staphylococcus aureus subsp. aureus MW2
gcaaaaauacuuu

SEQ ID NO: 4003786 - RNA, 16 nt, Staphylococcus aureus subsp. aureus MW2
gcaaaacgcauuucau

SEQ ID NO: 4003787 - RNA, 13 nt, Staphylococcus aureus subsp. aureus MW2
gcaaaacuaauca

SEQ ID NO: 4003788 - RNA, 20 nt, Staphylococcus aureus subsp. aureus MW2
gcaaaacuugcgcaugcuuu

SEQ ID NO: 4003789 - RNA, 21 nt, Staphylococcus aureus subsp. aureus MW2
gcaaaagugguuguucccauu

SEQ ID NO: 4003790 - RNA, 11 nt, Staphylococcus aureus subsp. aureus MW2
gcaaaaucaac

SEQ ID NO: 4003791 - RNA, 19 nt, Staphylococcus aureus subsp. aureus MW2
gcaaaaucaacuuuaauca

SEQ ID NO: 4003792 - RNA, 20 nt, Staphylococcus aureus subsp. aureus MW2
gcaaaaucaacuuuaaucaa

SEQ ID NO: 4003793 - RNA, 20 nt, Staphylococcus aureus subsp. aureus MW2
gcaaaauuuugcaaaaaaau

SEQ ID NO: 4003794 - RNA, 18 nt, Staphylococcus aureus subsp. aureus MW2
gcaaacacaguacaaaua

SEQ ID NO: 4003795 - RNA, 16 nt, Staphylococcus aureus subsp. aureus MW2
gcaaacuugauucaau

SEQ ID NO: 4003796 - RNA, 12 nt, Staphylococcus aureus subsp. aureus MW2
gcaaagaaaaac

SEQ ID NO: 4003797 - RNA, 21 nt, Staphylococcus aureus subsp. aureus MW2
gcaaaggcgcgccaugugccu

SEQ ID NO: 4003798 - RNA, 13 nt, Staphylococcus aureus subsp. aureus MW2
gcaaauauaucau

SEQ ID NO: 4003799 - RNA, 15 nt, Staphylococcus aureus subsp. aureus MW2
gcaaauauuauuaaa

SEQ ID NO: 4003800 - RNA, 13 nt, Staphylococcus aureus subsp. aureus MW2
gcaaauauuucug

SEQ ID NO: 4003801 - RNA, 13 nt, Staphylococcus aureus subsp. aureus MW2
gcaaaucaaacaa

SEQ ID NO: 4003802 - RNA, 18 nt, Staphylococcus aureus subsp. aureus MW2
gcaaauuaguaugacuua

SEQ ID NO: 4003803 - RNA, 17 nt, Staphylococcus aureus subsp. aureus MW2
gcaaauuaucauuaaau

SEQ ID NO: 4003804 - RNA, 17 nt, Staphylococcus aureus subsp. aureus MW2
gcaaauugauuaaauaa

SEQ ID NO: 4003805 - RNA, 17 nt, Staphylococcus aureus subsp. aureus MW2
gcaaauuggaaaaauaa

SEQ ID NO: 4003806 - RNA, 19 nt, Staphylococcus aureus subsp. aureus MW2
gcaaauuuccacagcaauu

SEQ ID NO: 4003807 - RNA, 16 nt, Staphylococcus aureus subsp. aureus MW2
gcaacaaaagauguug

SEQ ID NO: 4003808 - RNA, 13 nt, Staphylococcus aureus subsp. aureus MW2
gcaacaauuugca

SEQ ID NO: 4003809 - RNA, 17 nt, Staphylococcus aureus subsp. aureus MW2
gcaacagcgcaucauaa

SEQ ID NO: 4003810 - RNA, 12 nt, Staphylococcus aureus subsp. aureus MW2
gcaacauauuuu

SEQ ID NO: 4003811 - RNA, 22 nt, Staphylococcus aureus subsp. aureus MW2
gcaacauauuuucacaaucaua

SEQ ID NO: 4003812 - RNA, 22 nt, Staphylococcus aureus subsp. aureus MW2
gcaacauugauaguuuuauaau

SEQ ID NO: 4003813 - RNA, 17 nt, Staphylococcus aureus subsp. aureus MW2
gcaacgucccaacaaca

SEQ ID NO: 4003814 - RNA, 21 nt, Staphylococcus aureus subsp. aureus MW2
gcaacuaaaacuaucugauua

SEQ ID NO: 4003815 - RNA, 18 nt, Staphylococcus aureus subsp. aureus MW2
gcaacuaagaugacugaa

SEQ ID NO: 4003816 - RNA, 12 nt, Staphylococcus aureus subsp. aureus MW2
gcaacugaaacu

SEQ ID NO: 4003817 - RNA, 18 nt, Staphylococcus aureus subsp. aureus MW2
gcaacugaucauuuucau

SEQ ID NO: 4003818 - RNA, 20 nt, Staphylococcus aureus subsp. aureus MW2
gcaacuguaaaugaaauggu

SEQ ID NO: 4003819 - RNA, 14 nt, Staphylococcus aureus subsp. aureus MW2
gcaacuuguauugu

SEQ ID NO: 4003820 - RNA, 18 nt, Staphylococcus aureus subsp. aureus MW2
gcaagccuucuauauagu

SEQ ID NO: 4003821 - RNA, 19 nt, Staphylococcus aureus subsp. aureus MW2
gcaaguuauaucauaacuu

SEQ ID NO: 4003822 - RNA, 14 nt, Staphylococcus aureus subsp. aureus MW2
gcaaguuggcgggg

SEQ ID NO: 4003823 - RNA, 20 nt, Staphylococcus aureus subsp. aureus MW2
gcaaguuggcggggccccaa

SEQ ID NO: 4003824 - RNA, 12 nt, Staphylococcus aureus subsp. aureus MW2
gcaaguugggga

SEQ ID NO: 4003825 - RNA, 13 nt, Staphylococcus aureus subsp. aureus MW2
gcaaguuggggau

SEQ ID NO: 4003826 - RNA, 12 nt, Staphylococcus aureus subsp. aureus MW2
gcaaguuggggu

SEQ ID NO: 4003827 - RNA, 18 nt, Staphylococcus aureus subsp. aureus MW2
gcaauaauuacuaaccua

SEQ ID NO: 4003828 - RNA, 14 nt, Staphylococcus aureus subsp. aureus MW2
gcaauagcaccaua

SEQ ID NO: 4003829 - RNA, 15 nt, Staphylococcus aureus subsp. aureus MW2
gcaauagcuauaacu

SEQ ID NO: 4003830 - RNA, 16 nt, Staphylococcus aureus subsp. aureus MW2
gcaauaggaugaaacu

SEQ ID NO: 4003831 - RNA, 16 nt, Staphylococcus aureus subsp. aureus MW2
gcaauaucaucauuua

SEQ ID NO: 4003832 - RNA, 18 nt, Staphylococcus aureus subsp. aureus MW2
gcaaucguugaaaaauau

SEQ ID NO: 4003833 - RNA, 14 nt, Staphylococcus aureus subsp. aureus MW2
gcaaucuuaguaca

SEQ ID NO: 4003834 - RNA, 14 nt, Staphylococcus aureus subsp. aureus MW2
gcaaugcauauugu

SEQ ID NO: 4003835 - RNA, 19 nt, Staphylococcus aureus subsp. aureus MW2
gcaaugcgaguugggguga

SEQ ID NO: 4003836 - RNA, 20 nt, Staphylococcus aureus subsp. aureus MW2
gcaauuaaccuugauuuaau

SEQ ID NO: 4003837 - RNA, 14 nt, Staphylococcus aureus subsp. aureus MW2
gcaauuaaguauag

SEQ ID NO: 4003838 - RNA, 21 nt, Staphylococcus aureus subsp. aureus MW2
gcauuauuauuucauuagaaa

SEQ ID NO: 4003839 - RNA, 15 nt, Staphylococcus aureus subsp. aureus MW2
gcauucaguuaaugu

SEQ ID NO: 4003840 - RNA, 15 nt, Staphylococcus aureus subsp. aureus MW2
gcauucuuccaacac

SEQ ID NO: 4003841 - RNA, 20 nt, Staphylococcus aureus subsp. aureus MW2
gcauugcuuuuguuaauauu

SEQ ID NO: 4003842 - RNA, 18 nt, Staphylococcus aureus subsp. aureus MW2
gcauuguuuguagaauuu

SEQ ID NO: 4003843 - RNA, 16 nt, Staphylococcus aureus subsp. aureus MW2
gcauuuaaacaaagcu

SEQ ID NO: 4003844 - RNA, 22 nt, Staphylococcus aureus subsp. aureus MW2
gcauuuaaauauaaaccagcug

SEQ ID NO: 4003845 - RNA, 13 nt, Staphylococcus aureus subsp. aureus MW2
gcauuuuguuuca

SEQ ID NO: 4003846 - RNA, 18 nt, Staphylococcus aureus subsp. aureus MW2
gcauuuuuucauuauuaa

SEQ ID NO: 4003847 - RNA, 17 nt, Staphylococcus aureus subsp. aureus MW2
gccaaaaacuuuauauu

SEQ ID NO: 4003848 - RNA, 20 nt, Staphylococcus aureus subsp. aureus MW2
gccaaauacuaguaauaaua

SEQ ID NO: 4003849 - RNA, 16 nt, Staphylococcus aureus subsp. aureus MW2
gccaacaccauuauag

SEQ ID NO: 4003850 - RNA, 16 nt, Staphylococcus aureus subsp. aureus MW2
gccaacuugcacauua

SEQ ID NO: 4003851 - RNA, 14 nt, Staphylococcus aureus subsp. aureus MW2
gccaauaaaauguc

SEQ ID NO: 4003852 - RNA, 21 nt, Staphylococcus aureus subsp. aureus MW2
gccaaucuauugcaauauagu

SEQ ID NO: 4003853 - RNA, 13 nt, Staphylococcus aureus subsp. aureus MW2
gccaauuaaaauu

SEQ ID NO: 4003854 - RNA, 20 nt, Staphylococcus aureus subsp. aureus MW2
gccaauuaauucuuugaaaa

SEQ ID NO: 4003855 - RNA, 17 nt, Staphylococcus aureus subsp. aureus MW2
gccacaacauguuugga

SEQ ID NO: 4003856 - RNA, 14 nt, Staphylococcus aureus subsp. aureus MW2
gccacacaucaaca

SEQ ID NO: 4003857 - RNA, 22 nt, Staphylococcus aureus subsp. aureus MW2
gccaccuuguuuaaguuuuuca

SEQ ID NO: 4003858 - RNA, 22 nt, Staphylococcus aureus subsp. aureus MW2
gccacugucauguguucaaaua

SEQ ID NO: 4003859 - RNA, 22 nt, Staphylococcus aureus subsp. aureus MW2
gccagcuucuauguuggggccc

SEQ ID NO: 4003860 - RNA, 20 nt, Staphylococcus aureus subsp. aureus MW2
gccagcuucuuuguuggggc

SEQ ID NO: 4003861 - RNA, 14 nt, Staphylococcus aureus subsp. aureus MW2
gccaggugauugac

SEQ ID NO: 4003862 - RNA, 13 nt, Staphylococcus aureus subsp. aureus MW2
gccauaaucuuca

SEQ ID NO: 4003863 - RNA, 14 nt, Staphylococcus aureus subsp. aureus MW2
gccauaaucuucau

SEQ ID NO: 4003864 - RNA, 18 nt, Staphylococcus aureus subsp. aureus MW2
gccauacccauauuaaau

SEQ ID NO: 4003865 - RNA, 18 nt, Staphylococcus aureus subsp. aureus MW2
gccauaucauauuacuuc

SEQ ID NO: 4003866 - RNA, 23 nt, Staphylococcus aureus subsp. aureus MW2
gccauauguuuuagaauaguuac

SEQ ID NO: 4003867 - RNA, 12 nt, Staphylococcus aureus subsp. aureus MW2
gccauauuuauu

SEQ ID NO: 4003868 - RNA, 12 nt, Staphylococcus aureus subsp. aureus MW2
gccaucaauauu

SEQ ID NO: 4003869 - RNA, 21 nt, Staphylococcus aureus subsp. aureus MW2
gccaucaauauugauaucgaa

SEQ ID NO: 4003870 - RNA, 20 nt, Staphylococcus aureus subsp. aureus MW2
gccaucaauuucgacuccau

SEQ ID NO: 4003871 - RNA, 15 nt, Staphylococcus aureus subsp. aureus MW2
gccaucuuaccuuua

SEQ ID NO: 4003872 - RNA, 22 nt, Staphylococcus aureus subsp. aureus MW2
gccaucuuuuuuagcugaacca

SEQ ID NO: 4003873 - RNA, 15 nt, Staphylococcus aureus subsp. aureus MW2
gccauuaaaauuacg

SEQ ID NO: 4003874 - RNA, 22 nt, Staphylococcus aureus subsp. aureus MW2
gccauucauaaaugacugaauu

SEQ ID NO: 4003875 - RNA, 20 nt, Staphylococcus aureus subsp. aureus MW2
gccauuuuuauuuaacacuu

SEQ ID NO: 4003876 - RNA, 11 nt, Staphylococcus aureus subsp. aureus MW2
gcccaaacaua

SEQ ID NO: 4003877 - RNA, 15 nt, Staphylococcus aureus subsp. aureus MW2
gcccagaauguguug

SEQ ID NO: 4003878 - RNA, 15 nt, Staphylococcus aureus subsp. aureus MW2
gcccaucaucacugu

SEQ ID NO: 4003879 - RNA, 18 nt, Staphylococcus aureus subsp. aureus MW2
gcccauccccaacuugca

SEQ ID NO: 4003880 - RNA, 17 nt, Staphylococcus aureus subsp. aureus MW2
gcccauucaguuuugua

SEQ ID NO: 4003881 - RNA, 21 nt, Staphylococcus aureus subsp. aureus MW2
gccccaacaaagaagcuggcg

SEQ ID NO: 4003882 - RNA, 12 nt, Staphylococcus aureus subsp. aureus MW2
gccccaacacag

SEQ ID NO: 4003883 - RNA, 14 nt, Staphylococcus aureus subsp. aureus MW2
gccccaacacagaa

SEQ ID NO: 4003884 - RNA, 15 nt, Staphylococcus aureus subsp. aureus MW2
gccccaacacagaag

SEQ ID NO: 4003885 - RNA, 16 nt, Staphylococcus aureus subsp. aureus MW2
gccccaacacagaagc

SEQ ID NO: 4003886 - RNA, 14 nt, Staphylococcus aureus subsp. aureus MW2
gccccaacacagag

SEQ ID NO: 4003887 - RNA, 17 nt, Staphylococcus aureus subsp. aureus MW2
gccccaacacagagaaa

SEQ ID NO: 4003888 - RNA, 17 nt, Staphylococcus aureus subsp. aureus MW2
gccccaacacagagaau

SEQ ID NO: 4003889 - RNA, 16 nt, Staphylococcus aureus subsp. aureus MW2
gccccgccaacuugca

SEQ ID NO: 4003890 - RNA, 15 nt, Staphylococcus aureus subsp. aureus MW2
gcccgugauggguaa

SEQ ID NO: 4003891 - RNA, 21 nt, Staphylococcus aureus subsp. aureus MW2
gcccuagguuuauauaucaca

SEQ ID NO: 4003892 - RNA, 14 nt, Staphylococcus aureus subsp. aureus MW2
gccgagauuauuau

SEQ ID NO: 4003893 - RNA, 18 nt, Staphylococcus aureus subsp. aureus MW2
gccguauuucaaauguaa

SEQ ID NO: 4003894 - RNA, 15 nt, Staphylococcus aureus subsp. aureus MW2
gccgugaaagaaaaa

SEQ ID NO: 4003895 - RNA, 17 nt, Staphylococcus aureus subsp. aureus MW2
gccguuuuugaaaugua

SEQ ID NO: 4003896 - RNA, 16 nt, Staphylococcus aureus subsp. aureus MW2
gccuaaaaauaaaauc

SEQ ID NO: 4003897 - RNA, 16 nt, Staphylococcus aureus subsp. aureus MW2
gccuaaauauuuaccu

SEQ ID NO: 4003898 - RNA, 23 nt, Staphylococcus aureus subsp. aureus MW2
gccuaauacacuugcuaaaacua

SEQ ID NO: 4003899 - RNA, 16 nt, Staphylococcus aureus subsp. aureus MW2
gccuauccauucaaau

SEQ ID NO: 4003900 - RNA, 16 nt, Staphylococcus aureus subsp. aureus MW2
gccuauucguuugaau

SEQ ID NO: 4003901 - RNA, 13 nt, Staphylococcus aureus subsp. aureus MW2
gccuauuuaaaag

SEQ ID NO: 4003902 - RNA, 11 nt, Staphylococcus aureus subsp. aureus MW2
gccucaucuaa

SEQ ID NO: 4003903 - RNA, 22 nt, Staphylococcus aureus subsp. aureus MW2
gccucugcuagacaaucaucuu

SEQ ID NO: 4003904 - RNA, 23 nt, Staphylococcus aureus subsp. aureus MW2
gccugcaucaccugaugaauaga

SEQ ID NO: 4003905 - RNA, 16 nt, Staphylococcus aureus subsp. aureus MW2
gccuguuugacacauu

SEQ ID NO: 4003906 - RNA, 12 nt, Staphylococcus aureus subsp. aureus MW2
gccuuaaaauau

SEQ ID NO: 4003907 - RNA, 16 nt, Staphylococcus aureus subsp. aureus MW2
gccuucuaauaaugcu

SEQ ID NO: 4003908 - RNA, 17 nt, Staphylococcus aureus subsp. aureus MW2
gccuucuaauaaugcug

SEQ ID NO: 4003909 - RNA, 17 nt, Staphylococcus aureus subsp. aureus MW2
gccuucuaucucuuuag

SEQ ID NO: 4003910 - RNA, 22 nt, Staphylococcus aureus subsp. aureus MW2
gccuucuguacguuuuaaauaa

SEQ ID NO: 4003911 - RNA, 23 nt, Staphylococcus aureus subsp. aureus MW2
gccuuggccuacuuuuucaauau

SEQ ID NO: 4003912 - RNA, 21 nt, Staphylococcus aureus subsp. aureus MW2
gccuuucuaauauuuuggcuu

SEQ ID NO: 4003913 - RNA, 14 nt, Staphylococcus aureus subsp. aureus MW2
gccuuuuaaacaaa

SEQ ID NO: 4003914 - RNA, 14 nt, Staphylococcus aureus subsp. aureus MW2
gccuuuugaauaau

SEQ ID NO: 4003915 - RNA, 23 nt, Staphylococcus aureus subsp. aureus MW2
gcgaaaacguugaguauuacuug

SEQ ID NO: 4003916 - RNA, 15 nt, Staphylococcus aureus subsp. aureus MW2
gcgaaaguaucuaug

SEQ ID NO: 4003917 - RNA, 16 nt, Staphylococcus aureus subsp. aureus MW2
gcgaaaucaguuugaa

SEQ ID NO: 4003918 - RNA, 16 nt, Staphylococcus aureus subsp. aureus MW2
gcgaaaugcauuacua

SEQ ID NO: 4003919 - RNA, 19 nt, Staphylococcus aureus subsp. aureus MW2
gcgacauguccauaauauc

SEQ ID NO: 4003920 - RNA, 21 nt, Staphylococcus aureus subsp. aureus MW2
gcgacuucauuacaaacauaa

SEQ ID NO: 4003921 - RNA, 13 nt, Staphylococcus aureus subsp. aureus MW2
gcgacuucuaucu

SEQ ID NO: 4003922 - RNA, 15 nt, Staphylococcus aureus subsp. aureus MW2
gcgauaaaaguugua

SEQ ID NO: 4003923 - RNA, 18 nt, Staphylococcus aureus subsp. aureus MW2
gcgauacguuuauaucuu

SEQ ID NO: 4003924 - RNA, 20 nt, Staphylococcus aureus subsp. aureus MW2
gcgcauucucauucagucaa

SEQ ID NO: 4003925 - RNA, 22 nt, Staphylococcus aureus subsp. aureus MW2
gcgcucgaaucucauugauuug

SEQ ID NO: 4003926 - RNA, 19 nt, Staphylococcus aureus subsp. aureus MW2
gcgcuguuccaaauucauu

SEQ ID NO: 4003927 - RNA, 11 nt, Staphylococcus aureus subsp. aureus MW2
gcuuacaauaa

SEQ ID NO: 4003928 - RNA, 17 nt, Staphylococcus aureus subsp. aureus MW2
gcuuacaauaaugugca

SEQ ID NO: 4003929 - RNA, 18 nt, Staphylococcus aureus subsp. aureus MW2
gcuuacauuaugaacaga

SEQ ID NO: 4003930 - RNA, 13 nt, Staphylococcus aureus subsp. aureus MW2
gcuuagauaaauu

SEQ ID NO: 4003931 - RNA, 21 nt, Staphylococcus aureus subsp. aureus MW2
gcuuagcgcaggcgcuccuac

SEQ ID NO: 4003932 - RNA, 19 nt, Staphylococcus aureus subsp. aureus MW2
gcuuagggcuuuguuuucu

SEQ ID NO: 4003933 - RNA, 17 nt, Staphylococcus aureus subsp. aureus MW2
gcuuaucaacagcuuca

SEQ ID NO: 4003934 - RNA, 12 nt, Staphylococcus aureus subsp. aureus MW2
gcuuaucauuac

SEQ ID NO: 4003935 - RNA, 14 nt, Staphylococcus aureus subsp. aureus MW2
gcuuauuaaaauua

SEQ ID NO: 4003936 - RNA, 13 nt, Staphylococcus aureus subsp. aureus MW2
gcuuauugaaaag

SEQ ID NO: 4003937 - RNA, 21 nt, Staphylococcus aureus subsp. aureus MW2
gcuuauugaaaagauaaacaa

SEQ ID NO: 4003938 - RNA, 17 nt, Staphylococcus aureus subsp. aureus MW2
gcuuauuuuuguauucu

SEQ ID NO: 4003939 - RNA, 15 nt, Staphylococcus aureus subsp. aureus MW2
gcuucaaauguaaca

SEQ ID NO: 4003940 - RNA, 23 nt, Staphylococcus aureus subsp. aureus MW2
gcuucacuaaaaaucuauauaac

SEQ ID NO: 4003941 - RNA, 14 nt, Staphylococcus aureus subsp. aureus MW2
gcuucauaaauguu

SEQ ID NO: 4003942 - RNA, 18 nt, Staphylococcus aureus subsp. aureus MW2
gcuucauagucacuuuua

SEQ ID NO: 4003943 - RNA, 12 nt, Staphylococcus aureus subsp. aureus MW2
gcuucauaugga

SEQ ID NO: 4003944 - RNA, 22 nt, Staphylococcus aureus subsp. aureus MW2
gcuucauauuuagguaauacau

SEQ ID NO: 4003945 - RNA, 22 nt, Staphylococcus aureus subsp. aureus MW2
gcuucauuaguugcauaaucaa

SEQ ID NO: 4003946 - RNA, 18 nt, Staphylococcus aureus subsp. aureus MW2
gcuuccaauuuaaaauga

SEQ ID NO: 4003947 - RNA, 21 nt, Staphylococcus aureus subsp. aureus MW2
gcuuccaauuuaaaaugauuc

SEQ ID NO: 4003948 - RNA, 23 nt, Staphylococcus aureus subsp. aureus MW2
gcuuccaccgcugcucuucucuu

SEQ ID NO: 4003949 - RNA, 18 nt, Staphylococcus aureus subsp. aureus MW2
gcuucgcuagaaccugcu

SEQ ID NO: 4003950 - RNA, 14 nt, Staphylococcus aureus subsp. aureus MW2
gcuucggcaccuuu

SEQ ID NO: 4003951 - RNA, 19 nt, Staphylococcus aureus subsp. aureus MW2
gcuucuauguuggggcccc

SEQ ID NO: 4003952 - RNA, 23 nt, Staphylococcus aureus subsp. aureus MW2
gcuucuauguuggggccccgcca

SEQ ID NO: 4003953 - RNA, 21 nt, Staphylococcus aureus subsp. aureus MW2
gcuucucuuugaacgaaagag

SEQ ID NO: 4003954 - RNA, 19 nt, Staphylococcus aureus subsp. aureus MW2
gcuucuuaucaacaacaag

SEQ ID NO: 4003955 - RNA, 19 nt, Staphylococcus aureus subsp. aureus MW2
gcuucuuuguuggggcccc

SEQ ID NO: 4003956 - RNA, 23 nt, Staphylococcus aureus subsp. aureus MW2
gcuucuuuguuggggccccgcca

SEQ ID NO: 4003957 - RNA, 16 nt, Staphylococcus aureus subsp. aureus MW2
gcuugaaguuguuucu

SEQ ID NO: 4003958 - RNA, 20 nt, Staphylococcus aureus subsp. aureus MW2
gcuugaccuucaguuucuac

SEQ ID NO: 4003959 - RNA, 20 nt, Staphylococcus aureus subsp. aureus MW2
gcuugccuacuuuuuuggca

SEQ ID NO: 4003960 - RNA, 17 nt, Staphylococcus aureus subsp. aureus MW2
gcuugcggauacauauu

SEQ ID NO: 4003961 - RNA, 22 nt, Staphylococcus aureus subsp. aureus MW2
gcuuguacaaaaaauuguaagu

SEQ ID NO: 4003962 - RNA, 19 nt, Staphylococcus aureus subsp. aureus MW2
gcuuguucaacuaaauuuu

SEQ ID NO: 4003963 - RNA, 14 nt, Staphylococcus aureus subsp. aureus MW2
gcuuguucaauacu

SEQ ID NO: 4003964 - RNA, 14 nt, Staphylococcus aureus subsp. aureus MW2
gcuuuaaaauuuuu

SEQ ID NO: 4003965 - RNA, 17 nt, Staphylococcus aureus subsp. aureus MW2
gcuuuaaacauugacua

SEQ ID NO: 4003966 - RNA, 21 nt, Staphylococcus aureus subsp. aureus MW2
gcuuuaauaauaugauaucca

SEQ ID NO: 4003967 - RNA, 16 nt, Staphylococcus aureus subsp. aureus MW2
gcuuuagcucuuuuuu

SEQ ID NO: 4003968 - RNA, 20 nt, Staphylococcus aureus subsp. aureus MW2
gcuuuaguaguguauucauu

SEQ ID NO: 4003969 - RNA, 20 nt, Staphylococcus aureus subsp. aureus MW2
gcuuuagucgguguuuucuu

SEQ ID NO: 4003970 - RNA, 18 nt, Staphylococcus aureus subsp. aureus MW2
gcuuuaucaacaaauuuu

SEQ ID NO: 4003971 - RNA, 23 nt, Staphylococcus aureus subsp. aureus MW2
gcuuuauuuucuuguguauuuuu

SEQ ID NO: 4003972 - RNA, 16 nt, Staphylococcus aureus subsp. aureus MW2
gcuuucguuucuuuua

SEQ ID NO: 4003973 - RNA, 17 nt, Staphylococcus aureus subsp. aureus MW2
gcuuucuaucuuguucu

SEQ ID NO: 4003974 - RNA, 20 nt, Staphylococcus aureus subsp. aureus MW2
gcuuucuuuuucaucuuuca

SEQ ID NO: 4003975 - RNA, 23 nt, Staphylococcus aureus subsp. aureus MW2
gcuuucuuuuuugcuguauauau

SEQ ID NO: 4003976 - RNA, 13 nt, Staphylococcus aureus subsp. aureus MW2
gcuuugauuucau

SEQ ID NO: 4003977 - RNA, 16 nt, Staphylococcus aureus subsp. aureus MW2
gcuuugauuucauuug

SEQ ID NO: 4003978 - RNA, 21 nt, Staphylococcus aureus subsp. aureus MW2
gcuuugcauacauaucuuuug

SEQ ID NO: 4003979 - RNA, 19 nt, Staphylococcus aureus subsp. aureus MW2
gcuuuuaugcaugcgcaaa

SEQ ID NO: 4003980 - RNA, 14 nt, Staphylococcus aureus subsp. aureus MW2
gcuuuuauuuauau

SEQ ID NO: 4003981 - RNA, 20 nt, Staphylococcus aureus subsp. aureus MW2
gcuuuuauuuauauuauuac

SEQ ID NO: 4003982 - RNA, 13 nt, Staphylococcus aureus subsp. aureus MW2
gcuuuuauuuuua

SEQ ID NO: 4003983 - RNA, 16 nt, Staphylococcus aureus subsp. aureus MW2
gcuuuucuaauuuuuc

SEQ ID NO: 4003984 - RNA, 17 nt, Staphylococcus aureus subsp. aureus MW2
gcuuuuguaaagcuuua

SEQ ID NO: 4003985 - RNA, 13 nt, Staphylococcus aureus subsp. aureus MW2
gcuuuuuaaaaaa

SEQ ID NO: 4003986 - RNA, 13 nt, Staphylococcus aureus subsp. aureus MW2
gcuuuuuaucaac

SEQ ID NO: 4003987 - RNA, 14 nt, Staphylococcus aureus subsp. aureus MW2
gcuuuuuauuuuua

SEQ ID NO: 4003988 - RNA, 14 nt, Staphylococcus aureus subsp. aureus MW2
gcuuuuucacgauu

SEQ ID NO: 4003989 - RNA, 18 nt, Staphylococcus aureus subsp. aureus MW2
gcuuuuucauaaauauuu

SEQ ID NO: 4003990 - RNA, 18 nt, Staphylococcus aureus subsp. aureus MW2
gcuuuuucuacaccuaca

SEQ ID NO: 4003991 - RNA, 14 nt, Staphylococcus aureus subsp. aureus MW2
gcuuuuucuuaauu

SEQ ID NO: 4003992 - RNA, 17 nt, Staphylococcus aureus subsp. aureus MW2
gcuuuuucuuuuguuuu

SEQ ID NO: 4003993 - RNA, 12 nt, Staphylococcus aureus subsp. aureus MW2
gcuuuuuguuuu

SEQ ID NO: 4003994 - RNA, 21 nt, Staphylococcus aureus subsp. aureus MW2
gcuuuuuuaaauuuaauuucg

SEQ ID NO: 4003995 - RNA, 15 nt, Staphylococcus aureus subsp. aureus MW2
gcuuuuuuaagauaa

SEQ ID NO: 4003996 - RNA, 16 nt, Staphylococcus aureus subsp. aureus MW2
gcuuuuuuaccagcau

SEQ ID NO: 4003997 - RNA, 15 nt, Staphylococcus aureus subsp. aureus MW2
gcuuuuuuuacaaua

SEQ ID NO: 4003998 - RNA, 14 nt, Staphylococcus aureus subsp. aureus MW2
gcuuuuuuuauaag

SEQ ID NO: 4003999 - RNA, 15 nt, Staphylococcus aureus subsp. aureus MW2
gcuuuuuuuuauaag

SEQ ID NO: 4004000 - RNA, 19 nt, Staphylococcus aureus subsp. aureus MW2
ggaaaauaaaaaccagcua

SEQ ID NO: 4004001 - RNA, 22 nt, Staphylococcus aureus subsp. aureus MW2
ggaaaauauauuauaaaaauag

SEQ ID NO: 4004002 - RNA, 22 nt, Staphylococcus aureus subsp. aureus MW2
ggaaaauuauuugauauuucau

SEQ ID NO: 4004003 - RNA, 17 nt, Staphylococcus aureus subsp. aureus MW2
ggaaaguaauaaguaau

SEQ ID NO: 4004004 - RNA, 13 nt, Staphylococcus aureus subsp. aureus MW2
ggaaagucagcau

SEQ ID NO: 4004005 - RNA, 19 nt, Staphylococcus aureus subsp. aureus MW2
ggaaagucagcauacaaua

SEQ ID NO: 4004006 - RNA, 20 nt, Staphylococcus aureus subsp. aureus MW2
ggaaagucagcauacaauaa

SEQ ID NO: 4004007 - RNA, 16 nt, Staphylococcus aureus subsp. aureus MW2
ggaaagucagcuuaca

SEQ ID NO: 4004008 - RNA, 19 nt, Staphylococcus aureus subsp. aureus MW2
ggaaagucagcuuacaaua

SEQ ID NO: 4004009 - RNA, 20 nt, Staphylococcus aureus subsp. aureus MW2
ggaaagucagcuuacaauaa

SEQ ID NO: 4004010 - RNA, 21 nt, Staphylococcus aureus subsp. aureus MW2
ggaaagucagcuuacaauaau

SEQ ID NO: 4004011 - RNA, 16 nt, Staphylococcus aureus subsp. aureus MW2
ggaaauaucuuacugc

SEQ ID NO: 4004012 - RNA, 16 nt, Staphylococcus aureus subsp. aureus MW2
ggaaauaugaaaagag

SEQ ID NO: 4004013 - RNA, 17 nt, Staphylococcus aureus subsp. aureus MW2
ggaaauauuccuuacua

SEQ ID NO: 4004014 - RNA, 16 nt, Staphylococcus aureus subsp. aureus MW2
ggaaaucaguaauauc

SEQ ID NO: 4004015 - RNA, 13 nt, Staphylococcus aureus subsp. aureus MW2
gguaacuuuuuaa

SEQ ID NO: 4004016 - RNA, 19 nt, Staphylococcus aureus subsp. aureus MW2
gguaagacgccgaaaagag

SEQ ID NO: 4004017 - RNA, 17 nt, Staphylococcus aureus subsp. aureus MW2
gguaaguauaauuaaac

SEQ ID NO: 4004018 - RNA, 10 nt, Staphylococcus aureus subsp. aureus MW2
gguaauaauu

SEQ ID NO: 4004019 - RNA, 12 nt, Staphylococcus aureus subsp. aureus MW2
gguaauacuuuu

SEQ ID NO: 4004020 - RNA, 17 nt, Staphylococcus aureus subsp. aureus MW2
gguaaugauuuugcuuu

SEQ ID NO: 4004021 - RNA, 22 nt, Staphylococcus aureus subsp. aureus MW2
gguaauucaccaucauauucaa

SEQ ID NO: 4004022 - RNA, 14 nt, Staphylococcus aureus subsp. aureus MW2
gguaauuuaacauu

SEQ ID NO: 4004023 - RNA, 19 nt, Staphylococcus aureus subsp. aureus MW2
gguacacuucaacauauaa

SEQ ID NO: 4004024 - RNA, 21 nt, Staphylococcus aureus subsp. aureus MW2
gguacauaaauagugaaauua

SEQ ID NO: 4004025 - RNA, 15 nt, Staphylococcus aureus subsp. aureus MW2
gguacgaagugcaac

SEQ ID NO: 4004026 - RNA, 16 nt, Staphylococcus aureus subsp. aureus MW2
gguaguuaauauaauu

SEQ ID NO: 4004027 - RNA, 19 nt, Staphylococcus aureus subsp. aureus MW2
gguaguuagguaaaaauua

SEQ ID NO: 4004028 - RNA, 22 nt, Staphylococcus aureus subsp. aureus MW2
gguauagaaaaagggcaaaaaa

SEQ ID NO: 4004029 - RNA, 20 nt, Staphylococcus aureus subsp. aureus MW2
gguaucuaaaugugaaagac

SEQ ID NO: 4004030 - RNA, 19 nt, Staphylococcus aureus subsp. aureus MW2
ggucauuaaaugaaauauc

SEQ ID NO: 4004031 - RNA, 18 nt, Staphylococcus aureus subsp. aureus MW2
ggucgugacggaaucuug

SEQ ID NO: 4004032 - RNA, 20 nt, Staphylococcus aureus subsp. aureus MW2
ggucgugagccccucccaag

SEQ ID NO: 4004033 - RNA, 13 nt, Staphylococcus aureus subsp. aureus MW2
ggucugcuguauc

SEQ ID NO: 4004034 - RNA, 15 nt, Staphylococcus aureus subsp. aureus MW2
ggugacucaaugaau

SEQ ID NO: 4004035 - RNA, 20 nt, Staphylococcus aureus subsp. aureus MW2
ggugagggccccaacacaga

SEQ ID NO: 4004036 - RNA, 17 nt, Staphylococcus aureus subsp. aureus MW2
ggugaguguuucauaau

SEQ ID NO: 4004037 - RNA, 23 nt, Staphylococcus aureus subsp. aureus MW2
gguguagauaaaucgauaaaaug

SEQ ID NO: 4004038 - RNA, 12 nt, Staphylococcus aureus subsp. aureus MW2
ggugucaauaaa

SEQ ID NO: 4004039 - RNA, 17 nt, Staphylococcus aureus subsp. aureus MW2
gguguugaaaaguaauu

SEQ ID NO: 4004040 - RNA, 20 nt, Staphylococcus aureus subsp. aureus MW2
gguuaaauucggaaaauauc

SEQ ID NO: 4004041 - RNA, 13 nt, Staphylococcus aureus subsp. aureus MW2
gguuagaaaaaaa

SEQ ID NO: 4004042 - RNA, 14 nt, Staphylococcus aureus subsp. aureus MW2
gguuauuaaaauua

SEQ ID NO: 4004043 - RNA, 23 nt, Staphylococcus aureus subsp. aureus MW2
gguuauuuccguuuuagaauuua

SEQ ID NO: 4004044 - RNA, 15 nt, Staphylococcus aureus subsp. aureus MW2
gguucaucuaaaauu

SEQ ID NO: 4004045 - RNA, 18 nt, Staphylococcus aureus subsp. aureus MW2
gguucccaauucggauua

SEQ ID NO: 4004046 - RNA, 15 nt, Staphylococcus aureus subsp. aureus MW2
gguucuucaauaugc

SEQ ID NO: 4004047 - RNA, 21 nt, Staphylococcus aureus subsp. aureus MW2
gguuuaaacaguuuaauucgu

SEQ ID NO: 4004048 - RNA, 13 nt, Staphylococcus aureus subsp. aureus MW2
gguuuauuuaaua

SEQ ID NO: 4004049 - RNA, 10 nt, Staphylococcus aureus subsp. aureus MW2
gguuucacau

SEQ ID NO: 4004050 - RNA, 11 nt, Staphylococcus aureus subsp. aureus MW2
gguuugagaau

SEQ ID NO: 4004051 - RNA, 18 nt, Staphylococcus aureus subsp. aureus MW2
gguuuuauuuuuggauuc

SEQ ID NO: 4004052 - RNA, 17 nt, Staphylococcus aureus subsp. aureus MW2
gguuuuuuauuuucaua

SEQ ID NO: 4004053 - RNA, 20 nt, Staphylococcus aureus subsp. aureus MW2
guaaaaaaagacaugagauu

SEQ ID NO: 4004054 - RNA, 20 nt, Staphylococcus aureus subsp. aureus MW2
guaaaaagugguuaauaaca

SEQ ID NO: 4004055 - RNA, 13 nt, Staphylococcus aureus subsp. aureus MW2
guaaaaaugauua

SEQ ID NO: 4004056 - RNA, 14 nt, Staphylococcus aureus subsp. aureus MW2
guaaaaauuaacaa

SEQ ID NO: 4004057 - RNA, 20 nt, Staphylococcus aureus subsp. aureus MW2
guaaaaccaaaucguuucau

SEQ ID NO: 4004058 - RNA, 20 nt, Staphylococcus aureus subsp. aureus MW2
guaaaaguuuugagccaagu

SEQ ID NO: 4004059 - RNA, 14 nt, Staphylococcus aureus subsp. aureus MW2
guaaaauaaaucau

SEQ ID NO: 4004060 - RNA, 16 nt, Staphylococcus aureus subsp. aureus MW2
guaaaauauacuugaa

SEQ ID NO: 4004061 - RNA, 17 nt, Staphylococcus aureus subsp. aureus MW2
guaaaauauacuugaag

SEQ ID NO: 4004062 - RNA, 23 nt, Staphylococcus aureus subsp. aureus MW2
guaaaauuuucguguuaauaacc

SEQ ID NO: 4004063 - RNA, 23 nt, Staphylococcus aureus subsp. aureus MW2
guaaacaacaucgauuuaucauu

SEQ ID NO: 4004064 - RNA, 17 nt, Staphylococcus aureus subsp. aureus MW2
guaaacacuauaaaagc

SEQ ID NO: 4004065 - RNA, 17 nt, Staphylococcus aureus subsp. aureus MW2
guaaacauaaccuugcu

SEQ ID NO: 4004066 - RNA, 23 nt, Staphylococcus aureus subsp. aureus MW2
guaaaccgaggugucaauaaauu

SEQ ID NO: 4004067 - RNA, 16 nt, Staphylococcus aureus subsp. aureus MW2
guaaacuucuuuucuu

SEQ ID NO: 4004068 - RNA, 22 nt, Staphylococcus aureus subsp. aureus MW2
guaaagaguacagcgguuugua

SEQ ID NO: 4004069 - RNA, 16 nt, Staphylococcus aureus subsp. aureus MW2
guaaagccaccuaaau

SEQ ID NO: 4004070 - RNA, 15 nt, Staphylococcus aureus subsp. aureus MW2
guaaaguuaaaagcu

SEQ ID NO: 4004071 - RNA, 19 nt, Staphylococcus aureus subsp. aureus MW2
guaaauaaaaauuauauaa

SEQ ID NO: 4004072 - RNA, 20 nt, Staphylococcus aureus subsp. aureus MW2
guaaauaaaaauuauauaaa

SEQ ID NO: 4004073 - RNA, 19 nt, Staphylococcus aureus subsp. aureus MW2
guaaauauucguugauagu

SEQ ID NO: 4004074 - RNA, 18 nt, Staphylococcus aureus subsp. aureus MW2
guaaauccuccauuuaac

SEQ ID NO: 4004075 - RNA, 13 nt, Staphylococcus aureus subsp. aureus MW2
guaaauuacaaaa

SEQ ID NO: 4004076 - RNA, 14 nt, Staphylococcus aureus subsp. aureus MW2
guaaauuuaaaaua

SEQ ID NO: 4004077 - RNA, 17 nt, Staphylococcus aureus subsp. aureus MW2
guaaauuuaaaauaaua

SEQ ID NO: 4004078 - RNA, 19 nt, Staphylococcus aureus subsp. aureus MW2
guaaauuuuaucuaaacau

SEQ ID NO: 4004079 - RNA, 18 nt, Staphylococcus aureus subsp. aureus MW2
guaacaagcuuuuuucaa

SEQ ID NO: 4004080 - RNA, 18 nt, Staphylococcus aureus subsp. aureus MW2
guaacaaguucauuucaa

SEQ ID NO: 4004081 - RNA, 18 nt, Staphylococcus aureus subsp. aureus MW2
guaacaauuuagcaaaua

SEQ ID NO: 4004082 - RNA, 17 nt, Staphylococcus aureus subsp. aureus MW2
guaacaguauaaauauu

SEQ ID NO: 4004083 - RNA, 15 nt, Staphylococcus aureus subsp. aureus MW2
guaacagugacugau

SEQ ID NO: 4004084 - RNA, 17 nt, Staphylococcus aureus subsp. aureus MW2
guaacauguaaugaauc

SEQ ID NO: 4004085 - RNA, 16 nt, Staphylococcus aureus subsp. aureus MW2
guaacauuaaaaauaa

SEQ ID NO: 4004086 - RNA, 18 nt, Staphylococcus aureus subsp. aureus MW2
guaacauuaaaaauaaaa

SEQ ID NO: 4004087 - RNA, 22 nt, Staphylococcus aureus subsp. aureus MW2
guaacauuacguucuaauaauu

SEQ ID NO: 4004088 - RNA, 13 nt, Staphylococcus aureus subsp. aureus MW2
guaacauuuaaaa

SEQ ID NO: 4004089 - RNA, 18 nt, Staphylococcus aureus subsp. aureus MW2
guaacauuuaaaaaaugc

SEQ ID NO: 4004090 - RNA, 19 nt, Staphylococcus aureus subsp. aureus MW2
guaacauuuaaaaaaugcg

SEQ ID NO: 4004091 - RNA, 17 nt, Staphylococcus aureus subsp. aureus MW2
guaaccauuuuuuuauc

SEQ ID NO: 4004092 - RNA, 15 nt, Staphylococcus aureus subsp. aureus MW2
guaaccuuaaauaua

SEQ ID NO: 4004093 - RNA, 22 nt, Staphylococcus aureus subsp. aureus MW2
guaacgcucaugaguuucucau

SEQ ID NO: 4004094 - RNA, 14 nt, Staphylococcus aureus subsp. aureus MW2
guaacuaaaauguc

SEQ ID NO: 4004095 - RNA, 23 nt, Staphylococcus aureus subsp. aureus MW2
guaacuaacauguuauugcuuau

SEQ ID NO: 4004096 - RNA, 22 nt, Staphylococcus aureus subsp. aureus MW2
guaacuauaugaaauguucccu

SEQ ID NO: 4004097 - RNA, 19 nt, Staphylococcus aureus subsp. aureus MW2
guaagacgccgaaaagagg

SEQ ID NO: 4004098 - RNA, 23 nt, Staphylococcus aureus subsp. aureus MW2
guaagauuauuuucaauuagaaa

SEQ ID NO: 4004099 - RNA, 23 nt, Staphylococcus aureus subsp. aureus MW2
guaaguaaaauaaaaaaugcacu

SEQ ID NO: 4004100 - RNA, 16 nt, Staphylococcus aureus subsp. aureus MW2
guaaguagaagcaaaa

SEQ ID NO: 4004101 - RNA, 17 nt, Staphylococcus aureus subsp. aureus MW2
guaaguagaagcaaaag

SEQ ID NO: 4004102 - RNA, 13 nt, Staphylococcus aureus subsp. aureus MW2
guaagugcucaaa

SEQ ID NO: 4004103 - RNA, 15 nt, Staphylococcus aureus subsp. aureus MW2
guauaaauaaaaaua

SEQ ID NO: 4004104 - RNA, 20 nt, Staphylococcus aureus subsp. aureus MW2
guauaaauaucauaaaugca

SEQ ID NO: 4004105 - RNA, 17 nt, Staphylococcus aureus subsp. aureus MW2
guauaaaugcagcugua

SEQ ID NO: 4004106 - RNA, 19 nt, Staphylococcus aureus subsp. aureus MW2
guauaaccauaaugaacag

SEQ ID NO: 4004107 - RNA, 16 nt, Staphylococcus aureus subsp. aureus MW2
guauaagaaucagcua

SEQ ID NO: 4004108 - RNA, 16 nt, Staphylococcus aureus subsp. aureus MW2
guauaagcccauugcu

SEQ ID NO: 4004109 - RNA, 20 nt, Staphylococcus aureus subsp. aureus MW2
guauaauuaaacuaauagca

SEQ ID NO: 4004110 - RNA, 16 nt, Staphylococcus aureus subsp. aureus MW2
guauacaacaugugua

SEQ ID NO: 4004111 - RNA, 15 nt, Staphylococcus aureus subsp. aureus MW2
guauaccucuuagca

SEQ ID NO: 4004112 - RNA, 20 nt, Staphylococcus aureus subsp. aureus MW2
guauacuaaacuuuuuucaa

SEQ ID NO: 4004113 - RNA, 17 nt, Staphylococcus aureus subsp. aureus MW2
guauauaaguuaaaauu

SEQ ID NO: 4004114 - RNA, 22 nt, Staphylococcus aureus subsp. aureus MW2
guauauaaguuaaaauugguuu

SEQ ID NO: 4004115 - RNA, 11 nt, Staphylococcus aureus subsp. aureus MW2
guauaucugua

SEQ ID NO: 4004116 - RNA, 19 nt, Staphylococcus aureus subsp. aureus MW2
guauaugaauuuuauaaau

SEQ ID NO: 4004117 - RNA, 17 nt, Staphylococcus aureus subsp. aureus MW2
guauauggcgauaacaa

SEQ ID NO: 4004118 - RNA, 14 nt, Staphylococcus aureus subsp. aureus MW2
guauauuaaauuua

SEQ ID NO: 4004119 - RNA, 21 nt, Staphylococcus aureus subsp. aureus MW2
guauauucaacagggguaaaa

SEQ ID NO: 4004120 - RNA, 16 nt, Staphylococcus aureus subsp. aureus MW2
guaucaacauuaauaa

SEQ ID NO: 4004121 - RNA, 19 nt, Staphylococcus aureus subsp. aureus MW2
guaucaacauuaauaaaua

SEQ ID NO: 4004122 - RNA, 21 nt, Staphylococcus aureus subsp. aureus MW2
guaucacuaggauguucauca

SEQ ID NO: 4004123 - RNA, 22 nt, Staphylococcus aureus subsp. aureus MW2
guaucaucaaaauuuaauugcu

SEQ ID NO: 4004124 - RNA, 18 nt, Staphylococcus aureus subsp. aureus MW2
guaucaucccauugcauu

SEQ ID NO: 4004125 - RNA, 20 nt, Staphylococcus aureus subsp. aureus MW2
guaucauuguguccauaaau

SEQ ID NO: 4004126 - RNA, 15 nt, Staphylococcus aureus subsp. aureus MW2
guaucauuuaaaaua

SEQ ID NO: 4004127 - RNA, 16 nt, Staphylococcus aureus subsp. aureus MW2
guauccucaguauuua

SEQ ID NO: 4004128 - RNA, 20 nt, Staphylococcus aureus subsp. aureus MW2
guaucgauaguucuauauaa

SEQ ID NO: 4004129 - RNA, 15 nt, Staphylococcus aureus subsp. aureus MW2
guaucgccaaucuau

SEQ ID NO: 4004130 - RNA, 17 nt, Staphylococcus aureus subsp. aureus MW2
guaucgccaaucuauug

SEQ ID NO: 4004131 - RNA, 19 nt, Staphylococcus aureus subsp. aureus MW2
guaucuauacaauuaugga

SEQ ID NO: 4004132 - RNA, 19 nt, Staphylococcus aureus subsp. aureus MW2
guaucuaugaaauuuuuua

SEQ ID NO: 4004133 - RNA, 21 nt, Staphylococcus aureus subsp. aureus MW2
guaucucugaaaaacuucuua

SEQ ID NO: 4004134 - RNA, 16 nt, Staphylococcus aureus subsp. aureus MW2
guaucuugucauuuga

SEQ ID NO: 4004135 - RNA, 15 nt, Staphylococcus aureus subsp. aureus MW2
guaucuuucuuuccg

SEQ ID NO: 4004136 - RNA, 16 nt, Staphylococcus aureus subsp. aureus MW2
guaugacaaauuaaaa

SEQ ID NO: 4004137 - RNA, 16 nt, Staphylococcus aureus subsp. aureus MW2
guaugagagauagaaa

SEQ ID NO: 4004138 - RNA, 19 nt, Staphylococcus aureus subsp. aureus MW2
guaugauagaauacuaaaa

SEQ ID NO: 4004139 - RNA, 21 nt, Staphylococcus aureus subsp. aureus MW2
guaugauagaauacuaaaagu

SEQ ID NO: 4004140 - RNA, 22 nt, Staphylococcus aureus subsp. aureus MW2
guaugcauauaagauaauuuuu

SEQ ID NO: 4004141 - RNA, 20 nt, Staphylococcus aureus subsp. aureus MW2
guaugcaucaguuaauaauu

SEQ ID NO: 4004142 - RNA, 15 nt, Staphylococcus aureus subsp. aureus MW2
guauguaaaaagugg

SEQ ID NO: 4004143 - RNA, 15 nt, Staphylococcus aureus subsp. aureus MW2
guauguaucuuucuu

SEQ ID NO: 4004144 - RNA, 15 nt, Staphylococcus aureus subsp. aureus MW2
guauuaaacauugcu

SEQ ID NO: 4004145 - RNA, 22 nt, Staphylococcus aureus subsp. aureus MW2
guauuacacgcauuacuuuaga

SEQ ID NO: 4004146 - RNA, 16 nt, Staphylococcus aureus subsp. aureus MW2
guauuacuugaaaaua

SEQ ID NO: 4004147 - RNA, 19 nt, Staphylococcus aureus subsp. aureus MW2
guauuagccaauaaaaugu

SEQ ID NO: 4004148 - RNA, 16 nt, Staphylococcus aureus subsp. aureus MW2
guauuaggaaugacau

SEQ ID NO: 4004149 - RNA, 13 nt, Staphylococcus aureus subsp. aureus MW2
guauuaucuuuca

SEQ ID NO: 4004150 - RNA, 22 nt, Staphylococcus aureus subsp. aureus MW2
guauuaugauugcuuauuuauu

SEQ ID NO: 4004151 - RNA, 20 nt, Staphylococcus aureus subsp. aureus MW2
guauuauuaguuuugaaguu

SEQ ID NO: 4004152 - RNA, 17 nt, Staphylococcus aureus subsp. aureus MW2
guauuauuauaauuuug

SEQ ID NO: 4004153 - RNA, 20 nt, Staphylococcus aureus subsp. aureus MW2
guauuauuauaauuuuguuu

SEQ ID NO: 4004154 - RNA, 23 nt, Staphylococcus aureus subsp. aureus MW2
guauuauuauaauuuuguuucac

SEQ ID NO: 4004155 - RNA, 14 nt, Staphylococcus aureus subsp. aureus MW2
guauucaaaaaaau

SEQ ID NO: 4004156 - RNA, 16 nt, Staphylococcus aureus subsp. aureus MW2
guauucaaaaaaauau

SEQ ID NO: 4004157 - RNA, 22 nt, Staphylococcus aureus subsp. aureus MW2
guauucaaauaaacacaucuau

SEQ ID NO: 4004158 - RNA, 21 nt, Staphylococcus aureus subsp. aureus MW2
guauucagucaguaaaaauac

SEQ ID NO: 4004159 - RNA, 23 nt, Staphylococcus aureus subsp. aureus MW2
guauucagucaguaaaaauacau

SEQ ID NO: 4004160 - RNA, 18 nt, Staphylococcus aureus subsp. aureus MW2
guauucauacgcuauugc

SEQ ID NO: 4004161 - RNA, 21 nt, Staphylococcus aureus subsp. aureus MW2
guauucgcaucauucccugca

SEQ ID NO: 4004162 - RNA, 16 nt, Staphylococcus aureus subsp. aureus MW2
guauucgcuuacauua

SEQ ID NO: 4004163 - RNA, 15 nt, Staphylococcus aureus subsp. aureus MW2
guauucuauuuuuca

SEQ ID NO: 4004164 - RNA, 19 nt, Staphylococcus aureus subsp. aureus MW2
guauucuauuuuucaauuc

SEQ ID NO: 4004165 - RNA, 13 nt, Staphylococcus aureus subsp. aureus MW2
guauugaaauaau

SEQ ID NO: 4004166 - RNA, 22 nt, Staphylococcus aureus subsp. aureus MW2
guauugagaaagacuauauaac

SEQ ID NO: 4004167 - RNA, 12 nt, Staphylococcus aureus subsp. aureus MW2
guauugauucaa

SEQ ID NO: 4004168 - RNA, 21 nt, Staphylococcus aureus subsp. aureus MW2
guauugcauguuuaaauauca

SEQ ID NO: 4004169 - RNA, 18 nt, Staphylococcus aureus subsp. aureus MW2
guauuguccauagauaca

SEQ ID NO: 4004170 - RNA, 14 nt, Staphylococcus aureus subsp. aureus MW2
guauuuaauguuuu

SEQ ID NO: 4004171 - RNA, 16 nt, Staphylococcus aureus subsp. aureus MW2
guauuuaccuucuucu

SEQ ID NO: 4004172 - RNA, 18 nt, Staphylococcus aureus subsp. aureus MW2
guauuuauacuauaaaua

SEQ ID NO: 4004173 - RNA, 22 nt, Staphylococcus aureus subsp. aureus MW2
guauuucugaaaugauacauua

SEQ ID NO: 4004174 - RNA, 23 nt, Staphylococcus aureus subsp. aureus MW2
guauuugaaagcauuuaaauaua

SEQ ID NO: 4004175 - RNA, 14 nt, Staphylococcus aureus subsp. aureus MW2
guauuuuauuuauu

SEQ ID NO: 4004176 - RNA, 22 nt, Staphylococcus aureus subsp. aureus MW2
guauuuucugcuguauggaaag

SEQ ID NO: 4004177 - RNA, 14 nt, Staphylococcus aureus subsp. aureus MW2
guauuuuuaagcug

SEQ ID NO: 4004178 - RNA, 15 nt, Staphylococcus aureus subsp. aureus MW2
guauuuuuauuuaua

SEQ ID NO: 4004179 - RNA, 15 nt, Staphylococcus aureus subsp. aureus MW2
guauuuuucaaauaa

SEQ ID NO: 4004180 - RNA, 23 nt, Staphylococcus aureus subsp. aureus MW2
guauuuuucuuaauuaucauuac

SEQ ID NO: 4004181 - RNA, 12 nt, Staphylococcus aureus subsp. aureus MW2
guauuuuuugcc

SEQ ID NO: 4004182 - RNA, 21 nt, Staphylococcus aureus subsp. aureus MW2
gucaacuuuuuuaacuuuaac

SEQ ID NO: 4004183 - RNA, 22 nt, Staphylococcus aureus subsp. aureus MW2
gucaacuuuuuuaacuuuaaca

SEQ ID NO: 4004184 - RNA, 16 nt, Staphylococcus aureus subsp. aureus MW2
gucaauauuguaggga

SEQ ID NO: 4004185 - RNA, 21 nt, Staphylococcus aureus subsp. aureus MW2
gucaaugacugagaaaaauau

SEQ ID NO: 4004186 - RNA, 17 nt, Staphylococcus aureus subsp. aureus MW2
gucaaugacuuaacauc

SEQ ID NO: 4004187 - RNA, 18 nt, Staphylococcus aureus subsp. aureus MW2
gucaauuuaaagucuuca

SEQ ID NO: 4004188 - RNA, 22 nt, Staphylococcus aureus subsp. aureus MW2
gucaauuuuaccauguuuuaca

SEQ ID NO: 4004189 - RNA, 18 nt, Staphylococcus aureus subsp. aureus MW2
gucacauguaccacauuu

SEQ ID NO: 4004190 - RNA, 14 nt, Staphylococcus aureus subsp. aureus MW2
gucaccuucuauau

SEQ ID NO: 4004191 - RNA, 18 nt, Staphylococcus aureus subsp. aureus MW2
gucuuuuuuuaugaaaag

SEQ ID NO: 4004192 - RNA, 12 nt, Staphylococcus aureus subsp. aureus MW2
gugaaaaguguu

SEQ ID NO: 4004193 - RNA, 21 nt, Staphylococcus aureus subsp. aureus MW2
gugaaaauuuauucaaaucau

SEQ ID NO: 4004194 - RNA, 23 nt, Staphylococcus aureus subsp. aureus MW2
gugaaaguacuuggaaaauacua

SEQ ID NO: 4004195 - RNA, 22 nt, Staphylococcus aureus subsp. aureus MW2
gugaaauaaucccaaccauucu

SEQ ID NO: 4004196 - RNA, 21 nt, Staphylococcus aureus subsp. aureus MW2
gugaaauuagaaaaauaugau

SEQ ID NO: 4004197 - RNA, 20 nt, Staphylococcus aureus subsp. aureus MW2
gugaaauucgaacuaucaau

SEQ ID NO: 4004198 - RNA, 19 nt, Staphylococcus aureus subsp. aureus MW2
gugaacaccccuucucuaa

SEQ ID NO: 4004199 - RNA, 17 nt, Staphylococcus aureus subsp. aureus MW2
gugaagagaugaaagau

SEQ ID NO: 4004200 - RNA, 22 nt, Staphylococcus aureus subsp. aureus MW2
gugaaguaaugugcauugcuuu

SEQ ID NO: 4004201 - RNA, 16 nt, Staphylococcus aureus subsp. aureus MW2
gugaaucuaaacuaua

SEQ ID NO: 4004202 - RNA, 21 nt, Staphylococcus aureus subsp. aureus MW2
gugaauucgaugacuuuuuaa

SEQ ID NO: 4004203 - RNA, 17 nt, Staphylococcus aureus subsp. aureus MW2
gugaauuuucagcaucu

SEQ ID NO: 4004204 - RNA, 13 nt, Staphylococcus aureus subsp. aureus MW2
gugacaaacauuu

SEQ ID NO: 4004205 - RNA, 13 nt, Staphylococcus aureus subsp. aureus MW2
gugacaauuuaaa

SEQ ID NO: 4004206 - RNA, 21 nt, Staphylococcus aureus subsp. aureus MW2
gugacaucguugcuuuuauuu

SEQ ID NO: 4004207 - RNA, 19 nt, Staphylococcus aureus subsp. aureus MW2
gugacgggguuuuaucaua

SEQ ID NO: 4004208 - RNA, 15 nt, Staphylococcus aureus subsp. aureus MW2
gugacucaaugaauu

SEQ ID NO: 4004209 - RNA, 17 nt, Staphylococcus aureus subsp. aureus MW2
gugacuuuuauaauucu

SEQ ID NO: 4004210 - RNA, 15 nt, Staphylococcus aureus subsp. aureus MW2
gugaggcccauaaau

SEQ ID NO: 4004211 - RNA, 18 nt, Staphylococcus aureus subsp. aureus MW2
gugagggacgucaucaug

SEQ ID NO: 4004212 - RNA, 15 nt, Staphylococcus aureus subsp. aureus MW2
gugagggccccaaca

SEQ ID NO: 4004213 - RNA, 14 nt, Staphylococcus aureus subsp. aureus MW2
gugagguaaaacua

SEQ ID NO: 4004214 - RNA, 20 nt, Staphylococcus aureus subsp. aureus MW2
gugaguuaccauauuuuuua

SEQ ID NO: 4004215 - RNA, 16 nt, Staphylococcus aureus subsp. aureus MW2
gugauaaauaaugcau

SEQ ID NO: 4004216 - RNA, 15 nt, Staphylococcus aureus subsp. aureus MW2
gugauaauuaaaaua

SEQ ID NO: 4004217 - RNA, 22 nt, Staphylococcus aureus subsp. aureus MW2
gugauaauuaaaauaagauaua

SEQ ID NO: 4004218 - RNA, 21 nt, Staphylococcus aureus subsp. aureus MW2
gugauagaaguuuuuugauua

SEQ ID NO: 4004219 - RNA, 19 nt, Staphylococcus aureus subsp. aureus MW2
gugauauaugaaauauuua

SEQ ID NO: 4004220 - RNA, 12 nt, Staphylococcus aureus subsp. aureus MW2
gugauaucuugc

SEQ ID NO: 4004221 - RNA, 21 nt, Staphylococcus aureus subsp. aureus MW2
gugauauuaauugaaaaacca

SEQ ID NO: 4004222 - RNA, 22 nt, Staphylococcus aureus subsp. aureus MW2
gugaugaugugcaaacgauaug

SEQ ID NO: 4004223 - RNA, 18 nt, Staphylococcus aureus subsp. aureus MW2
gugauuacauucuauacu

SEQ ID NO: 4004224 - RNA, 17 nt, Staphylococcus aureus subsp. aureus MW2
gugauuuaaaaaaauua

SEQ ID NO: 4004225 - RNA, 21 nt, Staphylococcus aureus subsp. aureus MW2
gugauuucccacgugccucau

SEQ ID NO: 4004226 - RNA, 19 nt, Staphylococcus aureus subsp. aureus MW2
gugauuuggaauacuuuuc

SEQ ID NO: 4004227 - RNA, 17 nt, Staphylococcus aureus subsp. aureus MW2
gugcaacaaaagugcca

SEQ ID NO: 4004228 - RNA, 22 nt, Staphylococcus aureus subsp. aureus MW2
gugcaauaauaaauaggaugaa

SEQ ID NO: 4004229 - RNA, 23 nt, Staphylococcus aureus subsp. aureus MW2
gugcaauauuauauuuugaauca

SEQ ID NO: 4004230 - RNA, 20 nt, Staphylococcus aureus subsp. aureus MW2
gugcaauuaauguaaugaua

SEQ ID NO: 4004231 - RNA, 17 nt, Staphylococcus aureus subsp. aureus MW2
gugcaggauaacguuca

SEQ ID NO: 4004232 - RNA, 12 nt, Staphylococcus aureus subsp. aureus MW2
gugcaugacgau

SEQ ID NO: 4004233 - RNA, 13 nt, Staphylococcus aureus subsp. aureus MW2
gugcauuuagaug

SEQ ID NO: 4004234 - RNA, 14 nt, Staphylococcus aureus subsp. aureus MW2
gugccauuaaaauu

SEQ ID NO: 4004235 - RNA, 15 nt, Staphylococcus aureus subsp. aureus MW2
gugccucauccuuuu

SEQ ID NO: 4004236 - RNA, 17 nt, Staphylococcus aureus subsp. aureus MW2
gugcgaauaauaauaca

SEQ ID NO: 4004237 - RNA, 15 nt, Staphylococcus aureus subsp. aureus MW2
gugcgguuauuuaua

SEQ ID NO: 4004238 - RNA, 15 nt, Staphylococcus aureus subsp. aureus MW2
gugcgugaagagaug

SEQ ID NO: 4004239 - RNA, 21 nt, Staphylococcus aureus subsp. aureus MW2
gugcgugaagagaugaaagau

SEQ ID NO: 4004240 - RNA, 23 nt, Staphylococcus aureus subsp. aureus MW2
gugcuaaucuauuuugcuugcuu

SEQ ID NO: 4004241 - RNA, 20 nt, Staphylococcus aureus subsp. aureus MW2
gugcuauuaauuugauaaau

SEQ ID NO: 4004242 - RNA, 14 nt, Staphylococcus aureus subsp. aureus MW2
gugcuuuaaaggca

SEQ ID NO: 4004243 - RNA, 15 nt, Staphylococcus aureus subsp. aureus MW2
gugcuuuuuauguua

SEQ ID NO: 4004244 - RNA, 20 nt, Staphylococcus aureus subsp. aureus MW2
guggaaaucucggcauuuuu

SEQ ID NO: 4004245 - RNA, 17 nt, Staphylococcus aureus subsp. aureus MW2
guggacguugaucuuug

SEQ ID NO: 4004246 - RNA, 13 nt, Staphylococcus aureus subsp. aureus MW2
guggagauuuaac

SEQ ID NO: 4004247 - RNA, 22 nt, Staphylococcus aureus subsp. aureus MW2
guggcaccucuuuuguuuagua

SEQ ID NO: 4004248 - RNA, 21 nt, Staphylococcus aureus subsp. aureus MW2
guggccuuuuaaacaaauaaa

SEQ ID NO: 4004249 - RNA, 21 nt, Staphylococcus aureus subsp. aureus MW2
guggcguaguuugaauuggga

SEQ ID NO: 4004250 - RNA, 21 nt, Staphylococcus aureus subsp. aureus MW2
guggcuacuugaauaccuuuu

SEQ ID NO: 4004251 - RNA, 19 nt, Staphylococcus aureus subsp. aureus MW2
guggcuuuuuuuauggugu

SEQ ID NO: 4004252 - RNA, 20 nt, Staphylococcus aureus subsp. aureus MW2
guggcuuuuuuuauggugug

SEQ ID NO: 4004253 - RNA, 19 nt, Staphylococcus aureus subsp. aureus MW2
gugggcuccaaacauagag

SEQ ID NO: 4004254 - RNA, 21 nt, Staphylococcus aureus subsp. aureus MW2
gugggcuccaaacauagagaa

SEQ ID NO: 4004255 - RNA, 23 nt, Staphylococcus aureus subsp. aureus MW2
guggucuugugaguuaaccacuu

SEQ ID NO: 4004256 - RNA, 21 nt, Staphylococcus aureus subsp. aureus MW2
guguaaauuugacuauugaaa

SEQ ID NO: 4004257 - RNA, 20 nt, Staphylococcus aureus subsp. aureus MW2
guguaaucucguuuuuacau

SEQ ID NO: 4004258 - RNA, 22 nt, Staphylococcus aureus subsp. aureus MW2
guguacguuaaucagugaaaua

SEQ ID NO: 4004259 - RNA, 15 nt, Staphylococcus aureus subsp. aureus MW2
guguagccaaauaaa

SEQ ID NO: 4004260 - RNA, 13 nt, Staphylococcus aureus subsp. aureus MW2
guguauacaaggc

SEQ ID NO: 4004261 - RNA, 14 nt, Staphylococcus aureus subsp. aureus MW2
guguauauuauuuu

SEQ ID NO: 4004262 - RNA, 22 nt, Staphylococcus aureus subsp. aureus MW2
guguauauuauuuugcuuuaau

SEQ ID NO: 4004263 - RNA, 22 nt, Staphylococcus aureus subsp. aureus MW2
guguauuugaaagcauuuaaau

SEQ ID NO: 4004264 - RNA, 16 nt, Staphylococcus aureus subsp. aureus MW2
gugucauaauccauuc

SEQ ID NO: 4004265 - RNA, 14 nt, Staphylococcus aureus subsp. aureus MW2
guguccuaauaagu

SEQ ID NO: 4004266 - RNA, 15 nt, Staphylococcus aureus subsp. aureus MW2
gugugauuuuggaac

SEQ ID NO: 4004267 - RNA, 16 nt, Staphylococcus aureus subsp. aureus MW2
gugugccggcuuuuuc

SEQ ID NO: 4004268 - RNA, 15 nt, Staphylococcus aureus subsp. aureus MW2
gugugggccccaaca

SEQ ID NO: 4004269 - RNA, 15 nt, Staphylococcus aureus subsp. aureus MW2
guguuaaucaacgua

SEQ ID NO: 4004270 - RNA, 20 nt, Staphylococcus aureus subsp. aureus MW2
guguuaaucaacguauauaa

SEQ ID NO: 4004271 - RNA, 15 nt, Staphylococcus aureus subsp. aureus MW2
guguuaugaauuaga

SEQ ID NO: 4004272 - RNA, 23 nt, Staphylococcus aureus subsp. aureus MW2
guguugaaaaguaauuaaauacu

SEQ ID NO: 4004273 - RNA, 12 nt, Staphylococcus aureus subsp. aureus MW2
guguuggggccc

SEQ ID NO: 4004274 - RNA, 21 nt, Staphylococcus aureus subsp. aureus MW2
guguuggggcccauccccaac

SEQ ID NO: 4004275 - RNA, 14 nt, Staphylococcus aureus subsp. aureus MW2
guguuucuuuuauu

SEQ ID NO: 4004276 - RNA, 11 nt, Staphylococcus aureus subsp. aureus MW2
guguuugcuuu

SEQ ID NO: 4004277 - RNA, 14 nt, Staphylococcus aureus subsp. aureus MW2
guuaaaaaauaugu

SEQ ID NO: 4004278 - RNA, 22 nt, Staphylococcus aureus subsp. aureus MW2
guuaaaaaauauguauguuuua

SEQ ID NO: 4004279 - RNA, 21 nt, Staphylococcus aureus subsp. aureus MW2
guugauugcaugacagcaaau

SEQ ID NO: 4004280 - RNA, 14 nt, Staphylococcus aureus subsp. aureus MW2
guugauuuaaaaua

SEQ ID NO: 4004281 - RNA, 15 nt, Staphylococcus aureus subsp. aureus MW2
guugauuuaaaauau

SEQ ID NO: 4004282 - RNA, 17 nt, Staphylococcus aureus subsp. aureus MW2
guugauuugauuuaaau

SEQ ID NO: 4004283 - RNA, 21 nt, Staphylococcus aureus subsp. aureus MW2
guugcaauugaagugaaauug

SEQ ID NO: 4004284 - RNA, 23 nt, Staphylococcus aureus subsp. aureus MW2
guugcacaaauugcaauggcaac

SEQ ID NO: 4004285 - RNA, 18 nt, Staphylococcus aureus subsp. aureus MW2
guugcauaaucaauuuca

SEQ ID NO: 4004286 - RNA, 15 nt, Staphylococcus aureus subsp. aureus MW2
guugcauuacuuucu

SEQ ID NO: 4004287 - RNA, 22 nt, Staphylococcus aureus subsp. aureus MW2
guugcccgcuuauugcauugua

SEQ ID NO: 4004288 - RNA, 14 nt, Staphylococcus aureus subsp. aureus MW2
guugcuucuuauca

SEQ ID NO: 4004289 - RNA, 17 nt, Staphylococcus aureus subsp. aureus MW2
guuggaaaaggucaaaa

SEQ ID NO: 4004290 - RNA, 15 nt, Staphylococcus aureus subsp. aureus MW2
guuguaccaaugaau

SEQ ID NO: 4004291 - RNA, 20 nt, Staphylococcus aureus subsp. aureus MW2
guuguauaaaaauguauuaa

SEQ ID NO: 4004292 - RNA, 21 nt, Staphylococcus aureus subsp. aureus MW2
guuguauucugaaacuuuaau

SEQ ID NO: 4004293 - RNA, 13 nt, Staphylococcus aureus subsp. aureus MW2
guugucuuuacau

SEQ ID NO: 4004294 - RNA, 15 nt, Staphylococcus aureus subsp. aureus MW2
guugugauauauagu

SEQ ID NO: 4004295 - RNA, 23 nt, Staphylococcus aureus subsp. aureus MW2
guugugauauauaguaggguauu

SEQ ID NO: 4004296 - RNA, 17 nt, Staphylococcus aureus subsp. aureus MW2
guuguucccauuuuuaa

SEQ ID NO: 4004297 - RNA, 16 nt, Staphylococcus aureus subsp. aureus MW2
guuguugaaauuaaau

SEQ ID NO: 4004298 - RNA, 20 nt, Staphylococcus aureus subsp. aureus MW2
guuguugcaacuugugguug

SEQ ID NO: 4004299 - RNA, 22 nt, Staphylococcus aureus subsp. aureus MW2
guuguugcccgcuuauugcauu

SEQ ID NO: 4004300 - RNA, 19 nt, Staphylococcus aureus subsp. aureus MW2
guuguuuaaauuucaaaau

SEQ ID NO: 4004301 - RNA, 13 nt, Staphylococcus aureus subsp. aureus MW2
guuguuucuccag

SEQ ID NO: 4004302 - RNA, 14 nt, Staphylococcus aureus subsp. aureus MW2
guuuaaaaaacuac

SEQ ID NO: 4004303 - RNA, 17 nt, Staphylococcus aureus subsp. aureus MW2
guuuaaaaagucaaaga

SEQ ID NO: 4004304 - RNA, 17 nt, Staphylococcus aureus subsp. aureus MW2
guuuaaaauacgacacc

SEQ ID NO: 4004305 - RNA, 13 nt, Staphylococcus aureus subsp. aureus MW2
guuuaaacauuuu

SEQ ID NO: 4004306 - RNA, 15 nt, Staphylococcus aureus subsp. aureus MW2
guuuaaaguauaagg

SEQ ID NO: 4004307 - RNA, 20 nt, Staphylococcus aureus subsp. aureus MW2
guuuaaaugugcaauuagaa

SEQ ID NO: 4004308 - RNA, 15 nt, Staphylococcus aureus subsp. aureus MW2
guuuaacaacacuac

SEQ ID NO: 4004309 - RNA, 18 nt, Staphylococcus aureus subsp. aureus MW2
guuuaacaacacuaccca

SEQ ID NO: 4004310 - RNA, 15 nt, Staphylococcus aureus subsp. aureus MW2
guuuaaguuuuucag

SEQ ID NO: 4004311 - RNA, 15 nt, Staphylococcus aureus subsp. aureus MW2
guuuaauaaugguuc

SEQ ID NO: 4004312 - RNA, 16 nt, Staphylococcus aureus subsp. aureus MW2
guuuaauaaugguucu

SEQ ID NO: 4004313 - RNA, 16 nt, Staphylococcus aureus subsp. aureus MW2
guuuaauauaauccac

SEQ ID NO: 4004314 - RNA, 13 nt, Staphylococcus aureus subsp. aureus MW2
guuuaaucgcauu

SEQ ID NO: 4004315 - RNA, 13 nt, Staphylococcus aureus subsp. aureus MW2
guuuaaucguauu

SEQ ID NO: 4004316 - RNA, 18 nt, Staphylococcus aureus subsp. aureus MW2
guuuaaugggauuucuac

SEQ ID NO: 4004317 - RNA, 19 nt, Staphylococcus aureus subsp. aureus MW2
guuuaauguuuaauaauac

SEQ ID NO: 4004318 - RNA, 13 nt, Staphylococcus aureus subsp. aureus MW2
guuuaauugcaaa

SEQ ID NO: 4004319 - RNA, 20 nt, Staphylococcus aureus subsp. aureus MW2
guuuaauuugauuaaauuca

SEQ ID NO: 4004320 - RNA, 14 nt, Staphylococcus aureus subsp. aureus MW2
guuuaauuuuaaau

SEQ ID NO: 4004321 - RNA, 18 nt, Staphylococcus aureus subsp. aureus MW2
guuuacaucaaaguguaa

SEQ ID NO: 4004322 - RNA, 18 nt, Staphylococcus aureus subsp. aureus MW2
guuuaccgucuuuugcaa

SEQ ID NO: 4004323 - RNA, 19 nt, Staphylococcus aureus subsp. aureus MW2
guuuacgaucauaaauauu

SEQ ID NO: 4004324 - RNA, 19 nt, Staphylococcus aureus subsp. aureus MW2
guuuacggauuuuucucau

SEQ ID NO: 4004325 - RNA, 14 nt, Staphylococcus aureus subsp. aureus MW2
guuuacguucuuca

SEQ ID NO: 4004326 - RNA, 17 nt, Staphylococcus aureus subsp. aureus MW2
guuuacuauuaaaggaa

SEQ ID NO: 4004327 - RNA, 13 nt, Staphylococcus aureus subsp. aureus MW2
guuuacucuuacu

SEQ ID NO: 4004328 - RNA, 15 nt, Staphylococcus aureus subsp. aureus MW2
guuuacugucaucuu

SEQ ID NO: 4004329 - RNA, 14 nt, Staphylococcus aureus subsp. aureus MW2
guuuagauagcucu

SEQ ID NO: 4004330 - RNA, 21 nt, Staphylococcus aureus subsp. aureus MW2
guuuagcgucguguauucaga

SEQ ID NO: 4004331 - RNA, 15 nt, Staphylococcus aureus subsp. aureus MW2
guuuauaaucaguuu

SEQ ID NO: 4004332 - RNA, 23 nt, Staphylococcus aureus subsp. aureus MW2
guuuauaauuuaauugguuucac

SEQ ID NO: 4004333 - RNA, 16 nt, Staphylococcus aureus subsp. aureus MW2
guuuauauugcaaaaa

SEQ ID NO: 4004334 - RNA, 17 nt, Staphylococcus aureus subsp. aureus MW2
guuuauauugcaaaaau

SEQ ID NO: 4004335 - RNA, 19 nt, Staphylococcus aureus subsp. aureus MW2
guuuauauugcaaaaauaa

SEQ ID NO: 4004336 - RNA, 16 nt, Staphylococcus aureus subsp. aureus MW2
guuuauccauauauga

SEQ ID NO: 4004337 - RNA, 22 nt, Staphylococcus aureus subsp. aureus MW2
guuuauccauauaugaugauuu

SEQ ID NO: 4004338 - RNA, 20 nt, Staphylococcus aureus subsp. aureus MW2
guuuaucuguugucaucaug

SEQ ID NO: 4004339 - RNA, 20 nt, Staphylococcus aureus subsp. aureus MW2
guuuauuacauaauuuaucu

SEQ ID NO: 4004340 - RNA, 18 nt, Staphylococcus aureus subsp. aureus MW2
guuuauuuaauaacgaag

SEQ ID NO: 4004341 - RNA, 21 nt, Staphylococcus aureus subsp. aureus MW2
guuucaaaaucaauugaaaaa

SEQ ID NO: 4004342 - RNA, 15 nt, Staphylococcus aureus subsp. aureus MW2
guuucaacuuuugau

SEQ ID NO: 4004343 - RNA, 20 nt, Staphylococcus aureus subsp. aureus MW2
guuucaaucgcauuuuguuu

SEQ ID NO: 4004344 - RNA, 14 nt, Staphylococcus aureus subsp. aureus MW2
guuucaauguauca

SEQ ID NO: 4004345 - RNA, 22 nt, Staphylococcus aureus subsp. aureus MW2
guuucaauucaauugcuaaauc

SEQ ID NO: 4004346 - RNA, 15 nt, Staphylococcus aureus subsp. aureus MW2
guuucacguaaugaa

SEQ ID NO: 4004347 - RNA, 16 nt, Staphylococcus aureus subsp. aureus MW2
guuucauaaucucuuu

SEQ ID NO: 4004348 - RNA, 14 nt, Staphylococcus aureus subsp. aureus MW2
guuuccaauccauu

SEQ ID NO: 4004349 - RNA, 14 nt, Staphylococcus aureus subsp. aureus MW2
guuuccauaaauaa

SEQ ID NO: 4004350 - RNA, 11 nt, Staphylococcus aureus subsp. aureus MW2
guuucccaagc

SEQ ID NO: 4004351 - RNA, 20 nt, Staphylococcus aureus subsp. aureus MW2
guuuccgcacaagcaucuau

SEQ ID NO: 4004352 - RNA, 19 nt, Staphylococcus aureus subsp. aureus MW2
guuucgaacguuugaaaaa

SEQ ID NO: 4004353 - RNA, 13 nt, Staphylococcus aureus subsp. aureus MW2
guuucgucagauu

SEQ ID NO: 4004354 - RNA, 20 nt, Staphylococcus aureus subsp. aureus MW2
guuucuccuacuauaaaauc

SEQ ID NO: 4004355 - RNA, 14 nt, Staphylococcus aureus subsp. aureus MW2
guuucugacuuuua

SEQ ID NO: 4004356 - RNA, 16 nt, Staphylococcus aureus subsp. aureus MW2
guuucuucaauugucu

SEQ ID NO: 4004357 - RNA, 17 nt, Staphylococcus aureus subsp. aureus MW2
guuucuuccgcacugcc

SEQ ID NO: 4004358 - RNA, 20 nt, Staphylococcus aureus subsp. aureus MW2
guuugaagaccuucuaaaau

SEQ ID NO: 4004359 - RNA, 13 nt, Staphylococcus aureus subsp. aureus MW2
guuugaucauaau

SEQ ID NO: 4004360 - RNA, 16 nt, Staphylococcus aureus subsp. aureus MW2
guuugaucauaauuca

SEQ ID NO: 4004361 - RNA, 14 nt, Staphylococcus aureus subsp. aureus MW2
guuugaucauuuac

SEQ ID NO: 4004362 - RNA, 14 nt, Staphylococcus aureus subsp. aureus MW2
guuugauuaaaauc

SEQ ID NO: 4004363 - RNA, 15 nt, Staphylococcus aureus subsp. aureus MW2
guuuggauaaaauga

SEQ ID NO: 4004364 - RNA, 22 nt, Staphylococcus aureus subsp. aureus MW2
guuuggaugaacaaaauaacau

SEQ ID NO: 4004365 - RNA, 21 nt, Staphylococcus aureus subsp. aureus MW2
guuugugguaaugauuuugcu

SEQ ID NO: 4004366 - RNA, 19 nt, Staphylococcus aureus subsp. aureus MW2
guuuguuacauauugcauu

SEQ ID NO: 4004367 - RNA, 17 nt, Staphylococcus aureus subsp. aureus MW2
guuuguucgacggauug

SEQ ID NO: 4004368 - RNA, 20 nt, Staphylococcus aureus subsp. aureus MW2
uaaaacagaauuucaucaaa

SEQ ID NO: 4004369 - RNA, 21 nt, Staphylococcus aureus subsp. aureus MW2
uaaaacagaauuucaucaaau

SEQ ID NO: 4004370 - RNA, 18 nt, Staphylococcus aureus subsp. aureus MW2
uaaaacagcaaauaaaau

SEQ ID NO: 4004371 - RNA, 14 nt, Staphylococcus aureus subsp. aureus MW2
uaaaacaucauuca

SEQ ID NO: 4004372 - RNA, 14 nt, Staphylococcus aureus subsp. aureus MW2
uaaaacauguugau

SEQ ID NO: 4004373 - RNA, 21 nt, Staphylococcus aureus subsp. aureus MW2
uaaaacauucccuuaauaaua

SEQ ID NO: 4004374 - RNA, 22 nt, Staphylococcus aureus subsp. aureus MW2
uaaaacauucccuuaauaauaa

SEQ ID NO: 4004375 - RNA, 18 nt, Staphylococcus aureus subsp. aureus MW2
uaaaaccauagagcauuu

SEQ ID NO: 4004376 - RNA, 19 nt, Staphylococcus aureus subsp. aureus MW2
uaaaaccgguacuuucauu

SEQ ID NO: 4004377 - RNA, 18 nt, Staphylococcus aureus subsp. aureus MW2
uaaaaccuuacccaaaaa

SEQ ID NO: 4004378 - RNA, 16 nt, Staphylococcus aureus subsp. aureus MW2
uaaaacgauaagaauu

SEQ ID NO: 4004379 - RNA, 20 nt, Staphylococcus aureus subsp. aureus MW2
uaaaacuaaugauaguacau

SEQ ID NO: 4004380 - RNA, 16 nt, Staphylococcus aureus subsp. aureus MW2
uaaaacuauaauaaag

SEQ ID NO: 4004381 - RNA, 15 nt, Staphylococcus aureus subsp. aureus MW2
uaaaacuuauaacug

SEQ ID NO: 4004382 - RNA, 16 nt, Staphylococcus aureus subsp. aureus MW2
uaaaacuuauaacuga

SEQ ID NO: 4004383 - RNA, 20 nt, Staphylococcus aureus subsp. aureus MW2
uaaaacuuauaacugauaau

SEQ ID NO: 4004384 - RNA, 20 nt, Staphylococcus aureus subsp. aureus MW2
uaaaacuuguuguuauuuau

SEQ ID NO: 4004385 - RNA, 21 nt, Staphylococcus aureus subsp. aureus MW2
uaaaacuuguuguuauuuauu

SEQ ID NO: 4004386 - RNA, 13 nt, Staphylococcus aureus subsp. aureus MW2
uaaaagaaaaauu

SEQ ID NO: 4004387 - RNA, 15 nt, Staphylococcus aureus subsp. aureus MW2
uaaaagaauuauuca

SEQ ID NO: 4004388 - RNA, 14 nt, Staphylococcus aureus subsp. aureus MW2
uaaaagacagaaau

SEQ ID NO: 4004389 - RNA, 19 nt, Staphylococcus aureus subsp. aureus MW2
uaaaagagaauauaaaaua

SEQ ID NO: 4004390 - RNA, 23 nt, Staphylococcus aureus subsp. aureus MW2
uaaaagaguacauuuauuuaaug

SEQ ID NO: 4004391 - RNA, 18 nt, Staphylococcus aureus subsp. aureus MW2
uaaaagccaacacauaaa

SEQ ID NO: 4004392 - RNA, 23 nt, Staphylococcus aureus subsp. aureus MW2
uaaaagcccccuuuucacaauau

SEQ ID NO: 4004393 - RNA, 22 nt, Staphylococcus aureus subsp. aureus MW2
uaaaagccccuuuuaaauucuu

SEQ ID NO: 4004394 - RNA, 15 nt, Staphylococcus aureus subsp. aureus MW2
uaaaaggcgaaacau

SEQ ID NO: 4004395 - RNA, 22 nt, Staphylococcus aureus subsp. aureus MW2
uaaaaggcgaaacauuaaaaua

SEQ ID NO: 4004396 - RNA, 17 nt, Staphylococcus aureus subsp. aureus MW2
uaaaaggcuuuguuaaa

SEQ ID NO: 4004397 - RNA, 21 nt, Staphylococcus aureus subsp. aureus MW2
uaaaaggggcuuuuaauuaau

SEQ ID NO: 4004398 - RNA, 22 nt, Staphylococcus aureus subsp. aureus MW2
uaaaaggggcuuuuaauuaauu

SEQ ID NO: 4004399 - RNA, 21 nt, Staphylococcus aureus subsp. aureus MW2
uaaaaggugugggcuuuauua

SEQ ID NO: 4004400 - RNA, 16 nt, Staphylococcus aureus subsp. aureus MW2
uaaaaguauagauaga

SEQ ID NO: 4004401 - RNA, 16 nt, Staphylococcus aureus subsp. aureus MW2
uaaaagucagcgauaa

SEQ ID NO: 4004402 - RNA, 22 nt, Staphylococcus aureus subsp. aureus MW2
uaaaagucagcgauaauuguug

SEQ ID NO: 4004403 - RNA, 21 nt, Staphylococcus aureus subsp. aureus MW2
uaaaaguggccuuuuaaacaa

SEQ ID NO: 4004404 - RNA, 18 nt, Staphylococcus aureus subsp. aureus MW2
uaaaaguuucccaagcau

SEQ ID NO: 4004405 - RNA, 12 nt, Staphylococcus aureus subsp. aureus MW2
uaaaauaaaaug

SEQ ID NO: 4004406 - RNA, 12 nt, Staphylococcus aureus subsp. aureus MW2
uaaaauaaacca

SEQ ID NO: 4004407 - RNA, 14 nt, Staphylococcus aureus subsp. aureus MW2
uaaaauaaaccacg

SEQ ID NO: 4004408 - RNA, 19 nt, Staphylococcus aureus subsp. aureus MW2
uaaaauaaaguuugggcau

SEQ ID NO: 4004409 - RNA, 14 nt, Staphylococcus aureus subsp. aureus MW2
uaaaauaacuaagu

SEQ ID NO: 4004410 - RNA, 23 nt, Staphylococcus aureus subsp. aureus MW2
uaaaauaacugcuaauuuuuuca

SEQ ID NO: 4004411 - RNA, 18 nt, Staphylococcus aureus subsp. aureus MW2
uaaaauaagauauauaau

SEQ ID NO: 4004412 - RNA, 16 nt, Staphylococcus aureus subsp. aureus MW2
uaaaauaauagauaau

SEQ ID NO: 4004413 - RNA, 16 nt, Staphylococcus aureus subsp. aureus MW2
uaaaauaaucgguaau

SEQ ID NO: 4004414 - RNA, 11 nt, Staphylococcus aureus subsp. aureus MW2
uaaaauaauga

SEQ ID NO: 4004415 - RNA, 13 nt, Staphylococcus aureus subsp. aureus MW2
uaaaauaauuaaa

SEQ ID NO: 4004416 - RNA, 16 nt, Staphylococcus aureus subsp. aureus MW2
uaaaauaauuaaacuu

SEQ ID NO: 4004417 - RNA, 15 nt, Staphylococcus aureus subsp. aureus MW2
uaaaauaauuaaaua

SEQ ID NO: 4004418 - RNA, 20 nt, Staphylococcus aureus subsp. aureus MW2
uaaaauaauuaaauaaaaau

SEQ ID NO: 4004419 - RNA, 16 nt, Staphylococcus aureus subsp. aureus MW2
uaaaauaccaaauaug

SEQ ID NO: 4004420 - RNA, 23 nt, Staphylococcus aureus subsp. aureus MW2
uaaaauacgacaccaacauauuu

SEQ ID NO: 4004421 - RNA, 13 nt, Staphylococcus aureus subsp. aureus MW2
uaaaauagaaaaa

SEQ ID NO: 4004422 - RNA, 19 nt, Staphylococcus aureus subsp. aureus MW2
uaaaauagaaaaauuucaa

SEQ ID NO: 4004423 - RNA, 21 nt, Staphylococcus aureus subsp. aureus MW2
uaaaauagaguagacguaagu

SEQ ID NO: 4004424 - RNA, 14 nt, Staphylococcus aureus subsp. aureus MW2
uaaaauauaucuua

SEQ ID NO: 4004425 - RNA, 14 nt, Staphylococcus aureus subsp. aureus MW2
uaaaauauaugaau

SEQ ID NO: 4004426 - RNA, 19 nt, Staphylococcus aureus subsp. aureus MW2
uaaaauauaugaauaaguc

SEQ ID NO: 4004427 - RNA, 21 nt, Staphylococcus aureus subsp. aureus MW2
uaaaauauauuuguaguaagu

SEQ ID NO: 4004428 - RNA, 15 nt, Staphylococcus aureus subsp. aureus MW2
uaaaauaucaaaaua

SEQ ID NO: 4004429 - RNA, 16 nt, Staphylococcus aureus subsp. aureus MW2
uaaaauaugacacaua

SEQ ID NO: 4004430 - RNA, 15 nt, Staphylococcus aureus subsp. aureus MW2
uaaaauaugauuuaa

SEQ ID NO: 4004431 - RNA, 14 nt, Staphylococcus aureus subsp. aureus MW2
uaaaauauuaauaa

SEQ ID NO: 4004432 - RNA, 16 nt, Staphylococcus aureus subsp. aureus MW2
uaaaauauuaauaaag

SEQ ID NO: 4004433 - RNA, 20 nt, Staphylococcus aureus subsp. aureus MW2
uaaaauauuaggugaaacca

SEQ ID NO: 4004434 - RNA, 23 nt, Staphylococcus aureus subsp. aureus MW2
uaaaauauuaggugaaaccauac

SEQ ID NO: 4004435 - RNA, 19 nt, Staphylococcus aureus subsp. aureus MW2
uaaaauauugguaucucca

SEQ ID NO: 4004436 - RNA, 16 nt, Staphylococcus aureus subsp. aureus MW2
uaaaauauuuaacuuu

SEQ ID NO: 4004437 - RNA, 16 nt, Staphylococcus aureus subsp. aureus MW2
uaaaaucagucauuca

SEQ ID NO: 4004438 - RNA, 15 nt, Staphylococcus aureus subsp. aureus MW2
uaaaaucaucguauu

SEQ ID NO: 4004439 - RNA, 23 nt, Staphylococcus aureus subsp. aureus MW2
uaaaaucauuaauaauuaaacaa

SEQ ID NO: 4004440 - RNA, 17 nt, Staphylococcus aureus subsp. aureus MW2
uaaaauccgcuuuauuu

SEQ ID NO: 4004441 - RNA, 20 nt, Staphylococcus aureus subsp. aureus MW2
uaaaauccgcuuuauuuuau

SEQ ID NO: 4004442 - RNA, 19 nt, Staphylococcus aureus subsp. aureus MW2
uaaaauccuaagcaucgua

SEQ ID NO: 4004443 - RNA, 23 nt, Staphylococcus aureus subsp. aureus MW2
uaaaauccuaagcaucguaaaaa

SEQ ID NO: 4004444 - RNA, 14 nt, Staphylococcus aureus subsp. aureus MW2
uaaaaucguuccaa

SEQ ID NO: 4004445 - RNA, 16 nt, Staphylococcus aureus subsp. aureus MW2
uaaaaucuauaccauu

SEQ ID NO: 4004446 - RNA, 18 nt, Staphylococcus aureus subsp. aureus MW2
uaaaaugaauaauuacua

SEQ ID NO: 4004447 - RNA, 16 nt, Staphylococcus aureus subsp. aureus MW2
uaaaaugaaugaagac

SEQ ID NO: 4004448 - RNA, 20 nt, Staphylococcus aureus subsp. aureus MW2
uaaaaugauagcuaaacauu

SEQ ID NO: 4004449 - RNA, 15 nt, Staphylococcus aureus subsp. aureus MW2
uaaaaugauaucuau

SEQ ID NO: 4004450 - RNA, 20 nt, Staphylococcus aureus subsp. aureus MW2
uaaaaugauaucugacauuu

SEQ ID NO: 4004451 - RNA, 12 nt, Staphylococcus aureus subsp. aureus MW2
uaaaaugcauag

SEQ ID NO: 4004452 - RNA, 19 nt, Staphylococcus aureus subsp. aureus MW2
uaaaaugucuuugaaaaau

SEQ ID NO: 4004453 - RNA, 16 nt, Staphylococcus aureus subsp. aureus MW2
uaaaauguuaauaaug

SEQ ID NO: 4004454 - RNA, 15 nt, Staphylococcus aureus subsp. aureus MW2
uaaaauuaaaacagc

SEQ ID NO: 4004455 - RNA, 21 nt, Staphylococcus aureus subsp. aureus MW2
uaaaauuaaaccuacaacgaa

SEQ ID NO: 4004456 - RNA, 21 nt, Staphylococcus aureus subsp. aureus MW2
uaaagaaugauuuauaaaaaa

SEQ ID NO: 4004457 - RNA, 13 nt, Staphylococcus aureus subsp. aureus MW2
uaaagaauuaagu

SEQ ID NO: 4004458 - RNA, 20 nt, Staphylococcus aureus subsp. aureus MW2
uaaagaauuucgaaaagaaa

SEQ ID NO: 4004459 - RNA, 15 nt, Staphylococcus aureus subsp. aureus MW2
uaaagacaccuucaa

SEQ ID NO: 4004460 - RNA, 23 nt, Staphylococcus aureus subsp. aureus MW2
uaaagacaccuucaauaucugua

SEQ ID NO: 4004461 - RNA, 15 nt, Staphylococcus aureus subsp. aureus MW2
uaaagagcaauuaaa

SEQ ID NO: 4004462 - RNA, 16 nt, Staphylococcus aureus subsp. aureus MW2
uaaagagcaauuaaag

SEQ ID NO: 4004463 - RNA, 20 nt, Staphylococcus aureus subsp. aureus MW2
uaaagagcaauuaaagucaa

SEQ ID NO: 4004464 - RNA, 21 nt, Staphylococcus aureus subsp. aureus MW2
uaaagaguuauguuugucguu

SEQ ID NO: 4004465 - RNA, 13 nt, Staphylococcus aureus subsp. aureus MW2
uaaagauaauauu

SEQ ID NO: 4004466 - RNA, 16 nt, Staphylococcus aureus subsp. aureus MW2
uaaagauaauauuaaa

SEQ ID NO: 4004467 - RNA, 19 nt, Staphylococcus aureus subsp. aureus MW2
uaaagaucguuuucaacau

SEQ ID NO: 4004468 - RNA, 18 nt, Staphylococcus aureus subsp. aureus MW2
uaaagauggcugcaucaa

SEQ ID NO: 4004469 - RNA, 17 nt, Staphylococcus aureus subsp. aureus MW2
uaaagauguugaaaagu

SEQ ID NO: 4004470 - RNA, 16 nt, Staphylococcus aureus subsp. aureus MW2
uaaagauuaaaauaug

SEQ ID NO: 4004471 - RNA, 14 nt, Staphylococcus aureus subsp. aureus MW2
uaaagauucaauua

SEQ ID NO: 4004472 - RNA, 13 nt, Staphylococcus aureus subsp. aureus MW2
uaaagauugauau

SEQ ID NO: 4004473 - RNA, 20 nt, Staphylococcus aureus subsp. aureus MW2
uaaagauugauauuuaggug

SEQ ID NO: 4004474 - RNA, 17 nt, Staphylococcus aureus subsp. aureus MW2
uaaagcaagcagugcua

SEQ ID NO: 4004475 - RNA, 16 nt, Staphylococcus aureus subsp. aureus MW2
uaaagcaguguugcau

SEQ ID NO: 4004476 - RNA, 16 nt, Staphylococcus aureus subsp. aureus MW2
uaaagcauaucucaag

SEQ ID NO: 4004477 - RNA, 22 nt, Staphylococcus aureus subsp. aureus MW2
uaaagccugcaacccauguggu

SEQ ID NO: 4004478 - RNA, 16 nt, Staphylococcus aureus subsp. aureus MW2
uaaagcgauuuccauc

SEQ ID NO: 4004479 - RNA, 21 nt, Staphylococcus aureus subsp. aureus MW2
uaaagcuaacauaccuaauaa

SEQ ID NO: 4004480 - RNA, 19 nt, Staphylococcus aureus subsp. aureus MW2
uaaagcugacaaaccaauu

SEQ ID NO: 4004481 - RNA, 15 nt, Staphylococcus aureus subsp. aureus MW2
uaaagcugcaauuau

SEQ ID NO: 4004482 - RNA, 16 nt, Staphylococcus aureus subsp. aureus MW2
uaaagcuuauuaaauc

SEQ ID NO: 4004483 - RNA, 16 nt, Staphylococcus aureus subsp. aureus MW2
uaaagcuuuaguuaaa

SEQ ID NO: 4004484 - RNA, 16 nt, Staphylococcus aureus subsp. aureus MW2
uaaaggaaaucaaucc

SEQ ID NO: 4004485 - RNA, 22 nt, Staphylococcus aureus subsp. aureus MW2
uaaaggaauagcuacaauuaaa

SEQ ID NO: 4004486 - RNA, 13 nt, Staphylococcus aureus subsp. aureus MW2
uaaaggaauuuca

SEQ ID NO: 4004487 - RNA, 22 nt, Staphylococcus aureus subsp. aureus MW2
uaaaggcauuguguaugagucu

SEQ ID NO: 4004488 - RNA, 14 nt, Staphylococcus aureus subsp. aureus MW2
uaaaggcgauauuu

SEQ ID NO: 4004489 - RNA, 22 nt, Staphylococcus aureus subsp. aureus MW2
uaaagggaggaauuaauaauga

SEQ ID NO: 4004490 - RNA, 19 nt, Staphylococcus aureus subsp. aureus MW2
uaaagggcuauuugauaca

SEQ ID NO: 4004491 - RNA, 17 nt, Staphylococcus aureus subsp. aureus MW2
uaaagggggcucucauu

SEQ ID NO: 4004492 - RNA, 15 nt, Staphylococcus aureus subsp. aureus MW2
uaaagguaccacugu

SEQ ID NO: 4004493 - RNA, 22 nt, Staphylococcus aureus subsp. aureus MW2
uaaagguaccacuguauuuacu

SEQ ID NO: 4004494 - RNA, 23 nt, Staphylococcus aureus subsp. aureus MW2
uaaaguaaagggaggaauuaaua

SEQ ID NO: 4004495 - RNA, 16 nt, Staphylococcus aureus subsp. aureus MW2
uaaaguacucaaguaa

SEQ ID NO: 4004496 - RNA, 17 nt, Staphylococcus aureus subsp. aureus MW2
uaaaguacuuacaaaua

SEQ ID NO: 4004497 - RNA, 18 nt, Staphylococcus aureus subsp. aureus MW2
uaaaguacuuacaaauau

SEQ ID NO: 4004498 - RNA, 16 nt, Staphylococcus aureus subsp. aureus MW2
uaaaguauguugucau

SEQ ID NO: 4004499 - RNA, 17 nt, Staphylococcus aureus subsp. aureus MW2
uaaaguauguugucaua

SEQ ID NO: 4004500 - RNA, 16 nt, Staphylococcus aureus subsp. aureus MW2
uaaagucaauuuaaau

SEQ ID NO: 4004501 - RNA, 18 nt, Staphylococcus aureus subsp. aureus MW2
uaaagucaauuuaaauaa

SEQ ID NO: 4004502 - RNA, 23 nt, Staphylococcus aureus subsp. aureus MW2
uaaagucuucaucuuuaaagaaa

SEQ ID NO: 4004503 - RNA, 15 nt, Staphylococcus aureus subsp. aureus MW2
uaaaguguaaauuug

SEQ ID NO: 4004504 - RNA, 16 nt, Staphylococcus aureus subsp. aureus MW2
uaaaguguaaauuuga

SEQ ID NO: 4004505 - RNA, 16 nt, Staphylococcus aureus subsp. aureus MW2
uaaaguguuucaacau

SEQ ID NO: 4004506 - RNA, 17 nt, Staphylococcus aureus subsp. aureus MW2
uaaaguguuucaacaua

SEQ ID NO: 4004507 - RNA, 21 nt, Staphylococcus aureus subsp. aureus MW2
uaaaguguuucaacauauuau

SEQ ID NO: 4004508 - RNA, 14 nt, Staphylococcus aureus subsp. aureus MW2
uaaaguuaaagacu

SEQ ID NO: 4004509 - RNA, 19 nt, Staphylococcus aureus subsp. aureus MW2
uaaaguuccaaguuaaugc

SEQ ID NO: 4004510 - RNA, 14 nt, Staphylococcus aureus subsp. aureus MW2
uaaaguugauuuug

SEQ ID NO: 4004511 - RNA, 15 nt, Staphylococcus aureus subsp. aureus MW2
uaaaguuuauuuaug

SEQ ID NO: 4004512 - RNA, 23 nt, Staphylococcus aureus subsp. aureus MW2
uaaaguuuauuuauguucgauua

SEQ ID NO: 4004513 - RNA, 19 nt, Staphylococcus aureus subsp. aureus MW2
uaaauaaaaauacauaauu

SEQ ID NO: 4004514 - RNA, 14 nt, Staphylococcus aureus subsp. aureus MW2
uaaauaaaaauuau

SEQ ID NO: 4004515 - RNA, 15 nt, Staphylococcus aureus subsp. aureus MW2
uaaauaaaacuaucu

SEQ ID NO: 4004516 - RNA, 15 nt, Staphylococcus aureus subsp. aureus MW2
uaaauaaaaguucaa

SEQ ID NO: 4004517 - RNA, 14 nt, Staphylococcus aureus subsp. aureus MW2
uaaauaaaaugcau

SEQ ID NO: 4004518 - RNA, 14 nt, Staphylococcus aureus subsp. aureus MW2
uaaauaaaaugcua

SEQ ID NO: 4004519 - RNA, 15 nt, Staphylococcus aureus subsp. aureus MW2
uaaauaaaauuaaaa

SEQ ID NO: 4004520 - RNA, 22 nt, Staphylococcus aureus subsp. aureus MW2
uaaauaaaauuuuuuucauaau

SEQ ID NO: 4004521 - RNA, 16 nt, Staphylococcus aureus subsp. aureus MW2
uaaauaaacucaccaa

SEQ ID NO: 4004522 - RNA, 23 nt, Staphylococcus aureus subsp. aureus MW2
uaaauaaacucaccaaguucacu

SEQ ID NO: 4004523 - RNA, 20 nt, Staphylococcus aureus subsp. aureus MW2
uaaauaaagauucaauuaau

SEQ ID NO: 4004524 - RNA, 21 nt, Staphylococcus aureus subsp. aureus MW2
uaaauaaagauucaauuaaug

SEQ ID NO: 4004525 - RNA, 21 nt, Staphylococcus aureus subsp. aureus MW2
uaaauaaaguccaauacaauu

SEQ ID NO: 4004526 - RNA, 13 nt, Staphylococcus aureus subsp. aureus MW2
uaaauaaaugacu

SEQ ID NO: 4004527 - RNA, 19 nt, Staphylococcus aureus subsp. aureus MW2
uaaauaacuauccauaaag

SEQ ID NO: 4004528 - RNA, 22 nt, Staphylococcus aureus subsp. aureus MW2
uaaauaacuauccauaaaguga

SEQ ID NO: 4004529 - RNA, 21 nt, Staphylococcus aureus subsp. aureus MW2
uaaauaacuucguuuuaauaa

SEQ ID NO: 4004530 - RNA, 19 nt, Staphylococcus aureus subsp. aureus MW2
uaaauaagugauaaauaau

SEQ ID NO: 4004531 - RNA, 19 nt, Staphylococcus aureus subsp. aureus MW2
uaaauaaucgaagauagag

SEQ ID NO: 4004532 - RNA, 20 nt, Staphylococcus aureus subsp. aureus MW2
uaaauaaugauaaauuaaag

SEQ ID NO: 4004533 - RNA, 18 nt, Staphylococcus aureus subsp. aureus MW2
uaaauaaugcauggaaaa

SEQ ID NO: 4004534 - RNA, 23 nt, Staphylococcus aureus subsp. aureus MW2
uaaauaauguugucacuuggauu

SEQ ID NO: 4004535 - RNA, 16 nt, Staphylococcus aureus subsp. aureus MW2
uaaauaauuuaaauua

SEQ ID NO: 4004536 - RNA, 17 nt, Staphylococcus aureus subsp. aureus MW2
uaaauaauuuaaauuaa

SEQ ID NO: 4004537 - RNA, 18 nt, Staphylococcus aureus subsp. aureus MW2
uaaauaauuuaaauuaaa

SEQ ID NO: 4004538 - RNA, 19 nt, Staphylococcus aureus subsp. aureus MW2
uaaauaauuuaaauuaaaa

SEQ ID NO: 4004539 - RNA, 20 nt, Staphylococcus aureus subsp. aureus MW2
uaaauacaaagccuuaauau

SEQ ID NO: 4004540 - RNA, 22 nt, Staphylococcus aureus subsp. aureus MW2
uaaauacaaagccuuaauauca

SEQ ID NO: 4004541 - RNA, 16 nt, Staphylococcus aureus subsp. aureus MW2
uaaauacaauguuauu

SEQ ID NO: 4004542 - RNA, 17 nt, Staphylococcus aureus subsp. aureus MW2
uaaauacaauuucuuca

SEQ ID NO: 4004543 - RNA, 13 nt, Staphylococcus aureus subsp. aureus MW2
uaaauacaucgga

SEQ ID NO: 4004544 - RNA, 22 nt, Staphylococcus aureus subsp. aureus MW2
uaaaugguuuucuuuuucuaua

SEQ ID NO: 4004545 - RNA, 12 nt, Staphylococcus aureus subsp. aureus MW2
uaaauguaucac

SEQ ID NO: 4004546 - RNA, 21 nt, Staphylococcus aureus subsp. aureus MW2
uaaaugucacugcaaacacag

SEQ ID NO: 4004547 - RNA, 13 nt, Staphylococcus aureus subsp. aureus MW2
uaaaugugacuuu

SEQ ID NO: 4004548 - RNA, 14 nt, Staphylococcus aureus subsp. aureus MW2
uaaaugugcaauua

SEQ ID NO: 4004549 - RNA, 19 nt, Staphylococcus aureus subsp. aureus MW2
uaaauguuaaauucuaaaa

SEQ ID NO: 4004550 - RNA, 13 nt, Staphylococcus aureus subsp. aureus MW2
uaaauguuauuaa

SEQ ID NO: 4004551 - RNA, 16 nt, Staphylococcus aureus subsp. aureus MW2
uaaauguuauugcuua

SEQ ID NO: 4004552 - RNA, 22 nt, Staphylococcus aureus subsp. aureus MW2
uaaauguuuuguguauuuauuu

SEQ ID NO: 4004553 - RNA, 17 nt, Staphylococcus aureus subsp. aureus MW2
uaaauuaaaugcauaau

SEQ ID NO: 4004554 - RNA, 19 nt, Staphylococcus aureus subsp. aureus MW2
uaaauuaaguacuauuaaa

SEQ ID NO: 4004555 - RNA, 15 nt, Staphylococcus aureus subsp. aureus MW2
uaaauuacaauuaau

SEQ ID NO: 4004556 - RNA, 17 nt, Staphylococcus aureus subsp. aureus MW2
uaaauuacuauauuuaa

SEQ ID NO: 4004557 - RNA, 23 nt, Staphylococcus aureus subsp. aureus MW2
uaaauuacuauauuuaaauugga

SEQ ID NO: 4004558 - RNA, 16 nt, Staphylococcus aureus subsp. aureus MW2
uaaauuagccauuuca

SEQ ID NO: 4004559 - RNA, 16 nt, Staphylococcus aureus subsp. aureus MW2
uaaauuaguuaauaac

SEQ ID NO: 4004560 - RNA, 15 nt, Staphylococcus aureus subsp. aureus MW2
uaaauuauaaauagu

SEQ ID NO: 4004561 - RNA, 18 nt, Staphylococcus aureus subsp. aureus MW2
uaaauuaucuaaagaaau

SEQ ID NO: 4004562 - RNA, 15 nt, Staphylococcus aureus subsp. aureus MW2
uaaauuauuuauuca

SEQ ID NO: 4004563 - RNA, 22 nt, Staphylococcus aureus subsp. aureus MW2
uaaauuauuuauucauuauagu

SEQ ID NO: 4004564 - RNA, 16 nt, Staphylococcus aureus subsp. aureus MW2
uaaauucaauaaucuu

SEQ ID NO: 4004565 - RNA, 13 nt, Staphylococcus aureus subsp. aureus MW2
uaaauucaucuua

SEQ ID NO: 4004566 - RNA, 19 nt, Staphylococcus aureus subsp. aureus MW2
uaaauuccauguauucuua

SEQ ID NO: 4004567 - RNA, 21 nt, Staphylococcus aureus subsp. aureus MW2
uaaauuccauguauucuuaga

SEQ ID NO: 4004568 - RNA, 14 nt, Staphylococcus aureus subsp. aureus MW2
uaaauucuaucuau

SEQ ID NO: 4004569 - RNA, 20 nt, Staphylococcus aureus subsp. aureus MW2
uaaauucuuuucaagaaauu

SEQ ID NO: 4004570 - RNA, 13 nt, Staphylococcus aureus subsp. aureus MW2
uaaauugagaagu

SEQ ID NO: 4004571 - RNA, 20 nt, Staphylococcus aureus subsp. aureus MW2
uaaauuguaauauauuaaua

SEQ ID NO: 4004572 - RNA, 17 nt, Staphylococcus aureus subsp. aureus MW2
uaaauuguaugaauaau

SEQ ID NO: 4004573 - RNA, 17 nt, Staphylococcus aureus subsp. aureus MW2
uaaauuguuuacuauac

SEQ ID NO: 4004574 - RNA, 18 nt, Staphylococcus aureus subsp. aureus MW2
uaaauuguuuacuauacu

SEQ ID NO: 4004575 - RNA, 15 nt, Staphylococcus aureus subsp. aureus MW2
uaaauuuaaaagaaa

SEQ ID NO: 4004576 - RNA, 17 nt, Staphylococcus aureus subsp. aureus MW2
uaaauuuaaaauaauag

SEQ ID NO: 4004577 - RNA, 18 nt, Staphylococcus aureus subsp. aureus MW2
uaaauuuaacguuauuca

SEQ ID NO: 4004578 - RNA, 23 nt, Staphylococcus aureus subsp. aureus MW2
uaaauuuaacucaacuuaaauau

SEQ ID NO: 4004579 - RNA, 15 nt, Staphylococcus aureus subsp. aureus MW2
uaaauuuauuuuuaa

SEQ ID NO: 4004580 - RNA, 11 nt, Staphylococcus aureus subsp. aureus MW2
uaaauuucaaa

SEQ ID NO: 4004581 - RNA, 20 nt, Staphylococcus aureus subsp. aureus MW2
uaaauuucaaauauaaaaaa

SEQ ID NO: 4004582 - RNA, 22 nt, Staphylococcus aureus subsp. aureus MW2
uaaauuucgauuaauugaaugc

SEQ ID NO: 4004583 - RNA, 17 nt, Staphylococcus aureus subsp. aureus MW2
uaaauuucugaacauaa

SEQ ID NO: 4004584 - RNA, 17 nt, Staphylococcus aureus subsp. aureus MW2
uaaauuuuauauauccu

SEQ ID NO: 4004585 - RNA, 18 nt, Staphylococcus aureus subsp. aureus MW2
uaaauuuuauauauccug

SEQ ID NO: 4004586 - RNA, 20 nt, Staphylococcus aureus subsp. aureus MW2
uaaauuuuaucuaaacauuu

SEQ ID NO: 4004587 - RNA, 21 nt, Staphylococcus aureus subsp. aureus MW2
uaaauuuugagaaaauaucau

SEQ ID NO: 4004588 - RNA, 23 nt, Staphylococcus aureus subsp. aureus MW2
uaaauuuugagaaaauaucauuu

SEQ ID NO: 4004589 - RNA, 15 nt, Staphylococcus aureus subsp. aureus MW2
uaacaaaaugauugg

SEQ ID NO: 4004590 - RNA, 16 nt, Staphylococcus aureus subsp. aureus MW2
uaacaaaaugauuggu

SEQ ID NO: 4004591 - RNA, 13 nt, Staphylococcus aureus subsp. aureus MW2
uaacaaacauuaa

SEQ ID NO: 4004592 - RNA, 12 nt, Staphylococcus aureus subsp. aureus MW2
uaacaaacguug

SEQ ID NO: 4004593 - RNA, 17 nt, Staphylococcus aureus subsp. aureus MW2
uaacaaagauuauugaa

SEQ ID NO: 4004594 - RNA, 18 nt, Staphylococcus aureus subsp. aureus MW2
uaacaaagauuauugaaa

SEQ ID NO: 4004595 - RNA, 14 nt, Staphylococcus aureus subsp. aureus MW2
uaacaaauuagaau

SEQ ID NO: 4004596 - RNA, 17 nt, Staphylococcus aureus subsp. aureus MW2
uaacaacacuacccaca

SEQ ID NO: 4004597 - RNA, 13 nt, Staphylococcus aureus subsp. aureus MW2
uaacaacaugauu

SEQ ID NO: 4004598 - RNA, 21 nt, Staphylococcus aureus subsp. aureus MW2
uaacaaccuauuaauugaaau

SEQ ID NO: 4004599 - RNA, 21 nt, Staphylococcus aureus subsp. aureus MW2
uaacaacuguucuaaaauuaa

SEQ ID NO: 4004600 - RNA, 19 nt, Staphylococcus aureus subsp. aureus MW2
uaacaagaaguaauguuaa

SEQ ID NO: 4004601 - RNA, 20 nt, Staphylococcus aureus subsp. aureus MW2
uaacaaguacaauaauaccu

SEQ ID NO: 4004602 - RNA, 19 nt, Staphylococcus aureus subsp. aureus MW2
uaacaagugaugaaaaaga

SEQ ID NO: 4004603 - RNA, 17 nt, Staphylococcus aureus subsp. aureus MW2
uaacaaguucauuucaa

SEQ ID NO: 4004604 - RNA, 20 nt, Staphylococcus aureus subsp. aureus MW2
uaacaauagugacuuuuaua

SEQ ID NO: 4004605 - RNA, 13 nt, Staphylococcus aureus subsp. aureus MW2
uaacaauaucauc

SEQ ID NO: 4004606 - RNA, 14 nt, Staphylococcus aureus subsp. aureus MW2
uaacaaugaaccau

SEQ ID NO: 4004607 - RNA, 23 nt, Staphylococcus aureus subsp. aureus MW2
uaacaaugcagcuguauuuaaua

SEQ ID NO: 4004608 - RNA, 15 nt, Staphylococcus aureus subsp. aureus MW2
uaacaauuuauuaaa

SEQ ID NO: 4004609 - RNA, 22 nt, Staphylococcus aureus subsp. aureus MW2
uaacaauuuauuaaaacgaagu

SEQ ID NO: 4004610 - RNA, 13 nt, Staphylococcus aureus subsp. aureus MW2
uaacaauuuuaaa

SEQ ID NO: 4004611 - RNA, 18 nt, Staphylococcus aureus subsp. aureus MW2
uaacaauuuuaucugaau

SEQ ID NO: 4004612 - RNA, 22 nt, Staphylococcus aureus subsp. aureus MW2
uaacacaucaugacauuaauca

SEQ ID NO: 4004613 - RNA, 17 nt, Staphylococcus aureus subsp. aureus MW2
uaacacaugcuucauau

SEQ ID NO: 4004614 - RNA, 21 nt, Staphylococcus aureus subsp. aureus MW2
uaacacauucuuauuugaaau

SEQ ID NO: 4004615 - RNA, 19 nt, Staphylococcus aureus subsp. aureus MW2
uaacaccaauuaaaucgau

SEQ ID NO: 4004616 - RNA, 16 nt, Staphylococcus aureus subsp. aureus MW2
uaacaccaauugaaua

SEQ ID NO: 4004617 - RNA, 13 nt, Staphylococcus aureus subsp. aureus MW2
uaacaccauaaca

SEQ ID NO: 4004618 - RNA, 21 nt, Staphylococcus aureus subsp. aureus MW2
uaacacgauuugguugaacug

SEQ ID NO: 4004619 - RNA, 22 nt, Staphylococcus aureus subsp. aureus MW2
uaacacgcucuuuucaaaaaua

SEQ ID NO: 4004620 - RNA, 21 nt, Staphylococcus aureus subsp. aureus MW2
uaacacucagauuuuauuaaa

SEQ ID NO: 4004621 - RNA, 14 nt, Staphylococcus aureus subsp. aureus MW2
uaacagacuuuguu

SEQ ID NO: 4004622 - RNA, 17 nt, Staphylococcus aureus subsp. aureus MW2
uaacagacuuuguuaaa

SEQ ID NO: 4004623 - RNA, 18 nt, Staphylococcus aureus subsp. aureus MW2
uaacagacuuuguuaaaa

SEQ ID NO: 4004624 - RNA, 15 nt, Staphylococcus aureus subsp. aureus MW2
uaacagcuaaaaauu

SEQ ID NO: 4004625 - RNA, 16 nt, Staphylococcus aureus subsp. aureus MW2
uaacagcuacaaauaa

SEQ ID NO: 4004626 - RNA, 20 nt, Staphylococcus aureus subsp. aureus MW2
uaacagcuuaauuuuauuau

SEQ ID NO: 4004627 - RNA, 14 nt, Staphylococcus aureus subsp. aureus MW2
uaacaguauaaaua

SEQ ID NO: 4004628 - RNA, 16 nt, Staphylococcus aureus subsp. aureus MW2
uaacagugugaaauaa

SEQ ID NO: 4004629 - RNA, 15 nt, Staphylococcus aureus subsp. aureus MW2
uaacauaagaaaaag

SEQ ID NO: 4004630 - RNA, 15 nt, Staphylococcus aureus subsp. aureus MW2
uaacauaauaauaau

SEQ ID NO: 4004631 - RNA, 19 nt, Staphylococcus aureus subsp. aureus MW2
uaacauagcuuaauaauua

SEQ ID NO: 4004632 - RNA, 22 nt, Staphylococcus aureus subsp. aureus MW2
uaacauaucgcgcaucaaaaau

SEQ ID NO: 4004633 - RNA, 22 nt, Staphylococcus aureus subsp. aureus MW2
uaacugugauauuaauugaaaa

SEQ ID NO: 4004634 - RNA, 13 nt, Staphylococcus aureus subsp. aureus MW2
uaacuguucuuuc

SEQ ID NO: 4004635 - RNA, 16 nt, Staphylococcus aureus subsp. aureus MW2
uaacuguucuuucguc

SEQ ID NO: 4004636 - RNA, 15 nt, Staphylococcus aureus subsp. aureus MW2
uaacuguuuaucaug

SEQ ID NO: 4004637 - RNA, 12 nt, Staphylococcus aureus subsp. aureus MW2
uaacuguuugau

SEQ ID NO: 4004638 - RNA, 20 nt, Staphylococcus aureus subsp. aureus MW2
uaacuguuuuaaauuaacuu

SEQ ID NO: 4004639 - RNA, 13 nt, Staphylococcus aureus subsp. aureus MW2
uaacuuaaaauuu

SEQ ID NO: 4004640 - RNA, 21 nt, Staphylococcus aureus subsp. aureus MW2
uaacuuaaaauuuaaauauug

SEQ ID NO: 4004641 - RNA, 19 nt, Staphylococcus aureus subsp. aureus MW2
uaacuuaagcucauuucaa

SEQ ID NO: 4004642 - RNA, 13 nt, Staphylococcus aureus subsp. aureus MW2
uaacuuaccauga

SEQ ID NO: 4004643 - RNA, 22 nt, Staphylococcus aureus subsp. aureus MW2
uaacuuagaccccuaauuaaaa

SEQ ID NO: 4004644 - RNA, 23 nt, Staphylococcus aureus subsp. aureus MW2
uaacuuagaccccuaauuaaaau

SEQ ID NO: 4004645 - RNA, 17 nt, Staphylococcus aureus subsp. aureus MW2
uaacuuaucugauuguu

SEQ ID NO: 4004646 - RNA, 16 nt, Staphylococcus aureus subsp. aureus MW2
uaacuucauaauauau

SEQ ID NO: 4004647 - RNA, 19 nt, Staphylococcus aureus subsp. aureus MW2
uaacuucauaauauauccu

SEQ ID NO: 4004648 - RNA, 16 nt, Staphylococcus aureus subsp. aureus MW2
uaacuucguuuuaaua

SEQ ID NO: 4004649 - RNA, 17 nt, Staphylococcus aureus subsp. aureus MW2
uaacuucugguucuuca

SEQ ID NO: 4004650 - RNA, 18 nt, Staphylococcus aureus subsp. aureus MW2
uaacuucugguucuucac

SEQ ID NO: 4004651 - RNA, 17 nt, Staphylococcus aureus subsp. aureus MW2
uaacuuguaauauaaca

SEQ ID NO: 4004652 - RNA, 15 nt, Staphylococcus aureus subsp. aureus MW2
uaacuugucuuuuuu

SEQ ID NO: 4004653 - RNA, 13 nt, Staphylococcus aureus subsp. aureus MW2
uaacuuuaaaaau

SEQ ID NO: 4004654 - RNA, 16 nt, Staphylococcus aureus subsp. aureus MW2
uaacuuuaauuaaagc

SEQ ID NO: 4004655 - RNA, 14 nt, Staphylococcus aureus subsp. aureus MW2
uaacuuuaccaaua

SEQ ID NO: 4004656 - RNA, 18 nt, Staphylococcus aureus subsp. aureus MW2
uaacuuuaccaauaucau

SEQ ID NO: 4004657 - RNA, 13 nt, Staphylococcus aureus subsp. aureus MW2
uaacuuucccuac

SEQ ID NO: 4004658 - RNA, 22 nt, Staphylococcus aureus subsp. aureus MW2
uaacuuucuaauuguuucauug

SEQ ID NO: 4004659 - RNA, 16 nt, Staphylococcus aureus subsp. aureus MW2
uaacuuuguaugaaga

SEQ ID NO: 4004660 - RNA, 18 nt, Staphylococcus aureus subsp. aureus MW2
uaacuuugucuguauuau

SEQ ID NO: 4004661 - RNA, 16 nt, Staphylococcus aureus subsp. aureus MW2
uaacuuuuuaaaggac

SEQ ID NO: 4004662 - RNA, 13 nt, Staphylococcus aureus subsp. aureus MW2
uaacuuuuuaaua

SEQ ID NO: 4004663 - RNA, 21 nt, Staphylococcus aureus subsp. aureus MW2
uaacuuuuugugauuauucca

SEQ ID NO: 4004664 - RNA, 21 nt, Staphylococcus aureus subsp. aureus MW2
uaagaaaaauguguuaaaaua

SEQ ID NO: 4004665 - RNA, 23 nt, Staphylococcus aureus subsp. aureus MW2
uaagaaaaauguguuaaaauaua

SEQ ID NO: 4004666 - RNA, 15 nt, Staphylococcus aureus subsp. aureus MW2
uaagaaaauacuaac

SEQ ID NO: 4004667 - RNA, 23 nt, Staphylococcus aureus subsp. aureus MW2
uaagaacuugcuuuucauuuaau

SEQ ID NO: 4004668 - RNA, 22 nt, Staphylococcus aureus subsp. aureus MW2
uaagaagguguuugauuuugag

SEQ ID NO: 4004669 - RNA, 18 nt, Staphylococcus aureus subsp. aureus MW2
uaagaagugcuuaugaau

SEQ ID NO: 4004670 - RNA, 23 nt, Staphylococcus aureus subsp. aureus MW2
uaagaaguuaaacgacaugaaag

SEQ ID NO: 4004671 - RNA, 20 nt, Staphylococcus aureus subsp. aureus MW2
uaagaaugcaccaacaauag

SEQ ID NO: 4004672 - RNA, 15 nt, Staphylococcus aureus subsp. aureus MW2
uaagaauuaacaaca

SEQ ID NO: 4004673 - RNA, 12 nt, Staphylococcus aureus subsp. aureus MW2
uaagaauuuaaa

SEQ ID NO: 4004674 - RNA, 13 nt, Staphylococcus aureus subsp. aureus MW2
uaagaauuuaaaa

SEQ ID NO: 4004675 - RNA, 17 nt, Staphylococcus aureus subsp. aureus MW2
uaagacagcuucucauu

SEQ ID NO: 4004676 - RNA, 14 nt, Staphylococcus aureus subsp. aureus MW2
uaagacauaugcag

SEQ ID NO: 4004677 - RNA, 16 nt, Staphylococcus aureus subsp. aureus MW2
uaagacugauuaauua

SEQ ID NO: 4004678 - RNA, 24 nt, Staphylococcus aureus subsp. aureus MW2
uaagacugccauucuuuuucucaa

SEQ ID NO: 4004679 - RNA, 14 nt, Staphylococcus aureus subsp. aureus MW2
uaagagauuuucuu

SEQ ID NO: 4004680 - RNA, 18 nt, Staphylococcus aureus subsp. aureus MW2
uaagauaacgagugaaaa

SEQ ID NO: 4004681 - RNA, 18 nt, Staphylococcus aureus subsp. aureus MW2
uaagauaguuugagaaaa

SEQ ID NO: 4004682 - RNA, 23 nt, Staphylococcus aureus subsp. aureus MW2
uaagauaguuugagaaaauuaau

SEQ ID NO: 4004683 - RNA, 16 nt, Staphylococcus aureus subsp. aureus MW2
uaagauauuuaguaca

SEQ ID NO: 4004684 - RNA, 14 nt, Staphylococcus aureus subsp. aureus MW2
uaagauauuuccaa

SEQ ID NO: 4004685 - RNA, 19 nt, Staphylococcus aureus subsp. aureus MW2
uaagaugacugaaccaauc

SEQ ID NO: 4004686 - RNA, 22 nt, Staphylococcus aureus subsp. aureus MW2
uaagaugcaugccaauuaauuc

SEQ ID NO: 4004687 - RNA, 21 nt, Staphylococcus aureus subsp. aureus MW2
uaagauguauaugaauuuuau

SEQ ID NO: 4004688 - RNA, 22 nt, Staphylococcus aureus subsp. aureus MW2
uaagauguauaugaauuuuaua

SEQ ID NO: 4004689 - RNA, 15 nt, Staphylococcus aureus subsp. aureus MW2
uaagauuagcuauga

SEQ ID NO: 4004690 - RNA, 15 nt, Staphylococcus aureus subsp. aureus MW2
uaagauuauuuucaa

SEQ ID NO: 4004691 - RNA, 21 nt, Staphylococcus aureus subsp. aureus MW2
uaagauuauuuucaauuagaa

SEQ ID NO: 4004692 - RNA, 20 nt, Staphylococcus aureus subsp. aureus MW2
uaagauuuugcuuuaaacau

SEQ ID NO: 4004693 - RNA, 22 nt, Staphylococcus aureus subsp. aureus MW2
uaagauuuuuuauguuuaauuu

SEQ ID NO: 4004694 - RNA, 12 nt, Staphylococcus aureus subsp. aureus MW2
uaagcaaagaca

SEQ ID NO: 4004695 - RNA, 13 nt, Staphylococcus aureus subsp. aureus MW2
uaagcaaagauga

SEQ ID NO: 4004696 - RNA, 20 nt, Staphylococcus aureus subsp. aureus MW2
uaagcagacuaaaaguggcc

SEQ ID NO: 4004697 - RNA, 15 nt, Staphylococcus aureus subsp. aureus MW2
uaagcaguuaauaag

SEQ ID NO: 4004698 - RNA, 20 nt, Staphylococcus aureus subsp. aureus MW2
uaagcaguuaauaagaaacu

SEQ ID NO: 4004699 - RNA, 22 nt, Staphylococcus aureus subsp. aureus MW2
uaagcaguugguggaugucaug

SEQ ID NO: 4004700 - RNA, 16 nt, Staphylococcus aureus subsp. aureus MW2
uaagcaugauaaaaau

SEQ ID NO: 4004701 - RNA, 20 nt, Staphylococcus aureus subsp. aureus MW2
uaagcauuaauguucaauuu

SEQ ID NO: 4004702 - RNA, 17 nt, Staphylococcus aureus subsp. aureus MW2
uaagccuguuugacaca

SEQ ID NO: 4004703 - RNA, 17 nt, Staphylococcus aureus subsp. aureus MW2
uaagccuuuucaaacau

SEQ ID NO: 4004704 - RNA, 18 nt, Staphylococcus aureus subsp. aureus MW2
uaagccuuuucaaacaua

SEQ ID NO: 4004705 - RNA, 14 nt, Staphylococcus aureus subsp. aureus MW2
uaagcguaauauuu

SEQ ID NO: 4004706 - RNA, 18 nt, Staphylococcus aureus subsp. aureus MW2
uaagcguaauauuuaaga

SEQ ID NO: 4004707 - RNA, 16 nt, Staphylococcus aureus subsp. aureus MW2
uaagcguuuaaucaca

SEQ ID NO: 4004708 - RNA, 21 nt, Staphylococcus aureus subsp. aureus MW2
uaagcucauuucaauauuaaa

SEQ ID NO: 4004709 - RNA, 19 nt, Staphylococcus aureus subsp. aureus MW2
uaagcuuagaaacgaaauu

SEQ ID NO: 4004710 - RNA, 13 nt, Staphylococcus aureus subsp. aureus MW2
uaagcuuaucaac

SEQ ID NO: 4004711 - RNA, 23 nt, Staphylococcus aureus subsp. aureus MW2
uaaggaaccugucuuaauucauu

SEQ ID NO: 4004712 - RNA, 20 nt, Staphylococcus aureus subsp. aureus MW2
uaaggcuauuccuaguucua

SEQ ID NO: 4004713 - RNA, 20 nt, Staphylococcus aureus subsp. aureus MW2
uaaguaaaauaaaaaaugca

SEQ ID NO: 4004714 - RNA, 19 nt, Staphylococcus aureus subsp. aureus MW2
uaaguaagcguaauauuua

SEQ ID NO: 4004715 - RNA, 16 nt, Staphylococcus aureus subsp. aureus MW2
uaaguaauaauauaaa

SEQ ID NO: 4004716 - RNA, 20 nt, Staphylococcus aureus subsp. aureus MW2
uaaguaauaauauaaauaaa

SEQ ID NO: 4004717 - RNA, 13 nt, Staphylococcus aureus subsp. aureus MW2
uaaguaauauaau

SEQ ID NO: 4004718 - RNA, 12 nt, Staphylococcus aureus subsp. aureus MW2
uaaguaauucau

SEQ ID NO: 4004719 - RNA, 12 nt, Staphylococcus aureus subsp. aureus MW2
uaaguacuucaa

SEQ ID NO: 4004720 - RNA, 14 nt, Staphylococcus aureus subsp. aureus MW2
uaaguagaagcaaa

SEQ ID NO: 4004721 - RNA, 15 nt, Staphylococcus aureus subsp. aureus MW2
uaauagcgauaagca

SEQ ID NO: 4004722 - RNA, 18 nt, Staphylococcus aureus subsp. aureus MW2
uaauagcgauaagcauga

SEQ ID NO: 4004723 - RNA, 15 nt, Staphylococcus aureus subsp. aureus MW2
uaauagcgucaaguu

SEQ ID NO: 4004724 - RNA, 14 nt, Staphylococcus aureus subsp. aureus MW2
uaauagcuauauuu

SEQ ID NO: 4004725 - RNA, 21 nt, Staphylococcus aureus subsp. aureus MW2
uaauaggauaugcuaaacacu

SEQ ID NO: 4004726 - RNA, 18 nt, Staphylococcus aureus subsp. aureus MW2
uaauaggauuauuaucaa

SEQ ID NO: 4004727 - RNA, 21 nt, Staphylococcus aureus subsp. aureus MW2
uaauagguuaguaauauauua

SEQ ID NO: 4004728 - RNA, 21 nt, Staphylococcus aureus subsp. aureus MW2
uaauagguuauuugauaauga

SEQ ID NO: 4004729 - RNA, 20 nt, Staphylococcus aureus subsp. aureus MW2
uaauagguucuucuuucaua

SEQ ID NO: 4004730 - RNA, 17 nt, Staphylococcus aureus subsp. aureus MW2
uaauaguguuauauugu

SEQ ID NO: 4004731 - RNA, 14 nt, Staphylococcus aureus subsp. aureus MW2
uaauaguuaacgau

SEQ ID NO: 4004732 - RNA, 14 nt, Staphylococcus aureus subsp. aureus MW2
uaauaguuuuaaua

SEQ ID NO: 4004733 - RNA, 15 nt, Staphylococcus aureus subsp. aureus MW2
uaauaguuuuaauau

SEQ ID NO: 4004734 - RNA, 12 nt, Staphylococcus aureus subsp. aureus MW2
uaauauaaaaac

SEQ ID NO: 4004735 - RNA, 19 nt, Staphylococcus aureus subsp. aureus MW2
uaauauaaaaacaaaagaa

SEQ ID NO: 4004736 - RNA, 20 nt, Staphylococcus aureus subsp. aureus MW2
uaauauaaaaacaaaagaaa

SEQ ID NO: 4004737 - RNA, 12 nt, Staphylococcus aureus subsp. aureus MW2
uaauauaauacc

SEQ ID NO: 4004738 - RNA, 15 nt, Staphylococcus aureus subsp. aureus MW2
uaauauaauuauuaa

SEQ ID NO: 4004739 - RNA, 19 nt, Staphylococcus aureus subsp. aureus MW2
uaauauacgagacauuucu

SEQ ID NO: 4004740 - RNA, 14 nt, Staphylococcus aureus subsp. aureus MW2
uaauauauaaaagu

SEQ ID NO: 4004741 - RNA, 15 nt, Staphylococcus aureus subsp. aureus MW2
uaauauauaaaaguc

SEQ ID NO: 4004742 - RNA, 14 nt, Staphylococcus aureus subsp. aureus MW2
uaauauauuaaaaa

SEQ ID NO: 4004743 - RNA, 15 nt, Staphylococcus aureus subsp. aureus MW2
uaauauauuaaaaau

SEQ ID NO: 4004744 - RNA, 16 nt, Staphylococcus aureus subsp. aureus MW2
uaauauauuaaaaauc

SEQ ID NO: 4004745 - RNA, 13 nt, Staphylococcus aureus subsp. aureus MW2
uaauauauuaaua

SEQ ID NO: 4004746 - RNA, 13 nt, Staphylococcus aureus subsp. aureus MW2
uaauauauuaauu

SEQ ID NO: 4004747 - RNA, 14 nt, Staphylococcus aureus subsp. aureus MW2
uaauauauuacuaa

SEQ ID NO: 4004748 - RNA, 14 nt, Staphylococcus aureus subsp. aureus MW2
uaauauauuuagau

SEQ ID NO: 4004749 - RNA, 16 nt, Staphylococcus aureus subsp. aureus MW2
uaauaucaguagcaua

SEQ ID NO: 4004750 - RNA, 15 nt, Staphylococcus aureus subsp. aureus MW2
uaauauccugcaguu

SEQ ID NO: 4004751 - RNA, 15 nt, Staphylococcus aureus subsp. aureus MW2
uaauaucuaaagauu

SEQ ID NO: 4004752 - RNA, 19 nt, Staphylococcus aureus subsp. aureus MW2
uaauaucuuacuacuuaau

SEQ ID NO: 4004753 - RNA, 21 nt, Staphylococcus aureus subsp. aureus MW2
uaauaucuuacuacuuaauua

SEQ ID NO: 4004754 - RNA, 15 nt, Staphylococcus aureus subsp. aureus MW2
uaauaucuuuuaaug

SEQ ID NO: 4004755 - RNA, 16 nt, Staphylococcus aureus subsp. aureus MW2
uaauaugaacaaaaau

SEQ ID NO: 4004756 - RNA, 17 nt, Staphylococcus aureus subsp. aureus MW2
uaauaugaaggcuuuuu

SEQ ID NO: 4004757 - RNA, 13 nt, Staphylococcus aureus subsp. aureus MW2
uaauaugaauuug

SEQ ID NO: 4004758 - RNA, 18 nt, Staphylococcus aureus subsp. aureus MW2
uaauaugagugaaaguuu

SEQ ID NO: 4004759 - RNA, 21 nt, Staphylococcus aureus subsp. aureus MW2
uaauaugagugaaaguuugaa

SEQ ID NO: 4004760 - RNA, 12 nt, Staphylococcus aureus subsp. aureus MW2
uaauaugauugg

SEQ ID NO: 4004761 - RNA, 20 nt, Staphylococcus aureus subsp. aureus MW2
uaauaugauugguuugugau

SEQ ID NO: 4004762 - RNA, 17 nt, Staphylococcus aureus subsp. aureus MW2
uaauaugcuauguaaau

SEQ ID NO: 4004763 - RNA, 17 nt, Staphylococcus aureus subsp. aureus MW2
uaauauuauucuuuaua

SEQ ID NO: 4004764 - RNA, 14 nt, Staphylococcus aureus subsp. aureus MW2
uaauauucaacuug

SEQ ID NO: 4004765 - RNA, 12 nt, Staphylococcus aureus subsp. aureus MW2
uaauauugaaua

SEQ ID NO: 4004766 - RNA, 20 nt, Staphylococcus aureus subsp. aureus MW2
uaauauugagacuauuauaa

SEQ ID NO: 4004767 - RNA, 21 nt, Staphylococcus aureus subsp. aureus MW2
uaauauugagacuauuauaau

SEQ ID NO: 4004768 - RNA, 17 nt, Staphylococcus aureus subsp. aureus MW2
uaauauuggacuuugcu

SEQ ID NO: 4004769 - RNA, 16 nt, Staphylococcus aureus subsp. aureus MW2
uaauauugguuauaua

SEQ ID NO: 4004770 - RNA, 23 nt, Staphylococcus aureus subsp. aureus MW2
uaauauugguuauauauugucuu

SEQ ID NO: 4004771 - RNA, 15 nt, Staphylococcus aureus subsp. aureus MW2
uaauauuuaaaaaac

SEQ ID NO: 4004772 - RNA, 16 nt, Staphylococcus aureus subsp. aureus MW2
uaauauuuaaaaaaca

SEQ ID NO: 4004773 - RNA, 19 nt, Staphylococcus aureus subsp. aureus MW2
uaauauuuaagaaguuaaa

SEQ ID NO: 4004774 - RNA, 17 nt, Staphylococcus aureus subsp. aureus MW2
uaauauuuauuaccuua

SEQ ID NO: 4004775 - RNA, 16 nt, Staphylococcus aureus subsp. aureus MW2
uaauauuuauuuuaaa

SEQ ID NO: 4004776 - RNA, 17 nt, Staphylococcus aureus subsp. aureus MW2
uaauauuuauuuuaaau

SEQ ID NO: 4004777 - RNA, 19 nt, Staphylococcus aureus subsp. aureus MW2
uaauauuuauuuuaaauuu

SEQ ID NO: 4004778 - RNA, 17 nt, Staphylococcus aureus subsp. aureus MW2
uaauauuucuuaccauu

SEQ ID NO: 4004779 - RNA, 18 nt, Staphylococcus aureus subsp. aureus MW2
uaauauuugauuauucgu

SEQ ID NO: 4004780 - RNA, 12 nt, Staphylococcus aureus subsp. aureus MW2
uaauauuuuggc

SEQ ID NO: 4004781 - RNA, 13 nt, Staphylococcus aureus subsp. aureus MW2
uaaucaaagauuu

SEQ ID NO: 4004782 - RNA, 20 nt, Staphylococcus aureus subsp. aureus MW2
uaaucaaaguaucagucauu

SEQ ID NO: 4004783 - RNA, 12 nt, Staphylococcus aureus subsp. aureus MW2
uaaucaaauauu

SEQ ID NO: 4004784 - RNA, 22 nt, Staphylococcus aureus subsp. aureus MW2
uaaucaagaauauaaaugauuu

SEQ ID NO: 4004785 - RNA, 15 nt, Staphylococcus aureus subsp. aureus MW2
uaaucaagcaaugca

SEQ ID NO: 4004786 - RNA, 20 nt, Staphylococcus aureus subsp. aureus MW2
uaaucaagucugcauuaauu

SEQ ID NO: 4004787 - RNA, 17 nt, Staphylococcus aureus subsp. aureus MW2
uaaucaauguucuaggc

SEQ ID NO: 4004788 - RNA, 19 nt, Staphylococcus aureus subsp. aureus MW2
uaaucaauguucuaggcuc

SEQ ID NO: 4004789 - RNA, 22 nt, Staphylococcus aureus subsp. aureus MW2
uaaucaauguucuaggcuccua

SEQ ID NO: 4004790 - RNA, 13 nt, Staphylococcus aureus subsp. aureus MW2
uaaucacauuaau

SEQ ID NO: 4004791 - RNA, 14 nt, Staphylococcus aureus subsp. aureus MW2
uaaucacauuaauu

SEQ ID NO: 4004792 - RNA, 16 nt, Staphylococcus aureus subsp. aureus MW2
uaaucacuucugaaaa

SEQ ID NO: 4004793 - RNA, 22 nt, Staphylococcus aureus subsp. aureus MW2
uaaucacuuggcgacauuugua

SEQ ID NO: 4004794 - RNA, 21 nt, Staphylococcus aureus subsp. aureus MW2
uaaucagcuauaaaaguacuu

SEQ ID NO: 4004795 - RNA, 16 nt, Staphylococcus aureus subsp. aureus MW2
uaaucagcuuuuucac

SEQ ID NO: 4004796 - RNA, 19 nt, Staphylococcus aureus subsp. aureus MW2
uaaucagugaaauaucaag

SEQ ID NO: 4004797 - RNA, 14 nt, Staphylococcus aureus subsp. aureus MW2
uaaucaguuacucu

SEQ ID NO: 4004798 - RNA, 15 nt, Staphylococcus aureus subsp. aureus MW2
uaaucaguuuccgca

SEQ ID NO: 4004799 - RNA, 17 nt, Staphylococcus aureus subsp. aureus MW2
uaaucauguaaugcuua

SEQ ID NO: 4004800 - RNA, 21 nt, Staphylococcus aureus subsp. aureus MW2
uaaucauguaaugcuuaaaaa

SEQ ID NO: 4004801 - RNA, 17 nt, Staphylococcus aureus subsp. aureus MW2
uaaucauuguuuuaaau

SEQ ID NO: 4004802 - RNA, 14 nt, Staphylococcus aureus subsp. aureus MW2
uaaucauuuuuuca

SEQ ID NO: 4004803 - RNA, 15 nt, Staphylococcus aureus subsp. aureus MW2
uaaucauuuuuucaa

SEQ ID NO: 4004804 - RNA, 21 nt, Staphylococcus aureus subsp. aureus MW2
uaauccaccuaaaaaguacuu

SEQ ID NO: 4004805 - RNA, 19 nt, Staphylococcus aureus subsp. aureus MW2
uaauccaguaaucaaagau

SEQ ID NO: 4004806 - RNA, 23 nt, Staphylococcus aureus subsp. aureus MW2
uaauccgagucauacucaucaga

SEQ ID NO: 4004807 - RNA, 18 nt, Staphylococcus aureus subsp. aureus MW2
uaauccuauacguacugc

SEQ ID NO: 4004808 - RNA, 15 nt, Staphylococcus aureus subsp. aureus MW2
uaauccuuuuuuagg

SEQ ID NO: 4004809 - RNA, 15 nt, Staphylococcus aureus subsp. aureus MW2
uaaucgaacagaaaa

SEQ ID NO: 4004810 - RNA, 17 nt, Staphylococcus aureus subsp. aureus MW2
uaauuaagaaaaucauu

SEQ ID NO: 4004811 - RNA, 20 nt, Staphylococcus aureus subsp. aureus MW2
uaauuaagaaaaucauucau

SEQ ID NO: 4004812 - RNA, 15 nt, Staphylococcus aureus subsp. aureus MW2
uaauuaauaauuuaa

SEQ ID NO: 4004813 - RNA, 14 nt, Staphylococcus aureus subsp. aureus MW2
uaauuaaugccauu

SEQ ID NO: 4004814 - RNA, 13 nt, Staphylococcus aureus subsp. aureus MW2
uaauuaauuaaaa

SEQ ID NO: 4004815 - RNA, 23 nt, Staphylococcus aureus subsp. aureus MW2
uaauuaauuacuuucauuguaaa

SEQ ID NO: 4004816 - RNA, 21 nt, Staphylococcus aureus subsp. aureus MW2
uaauuaauuaucauaaauaua

SEQ ID NO: 4004817 - RNA, 14 nt, Staphylococcus aureus subsp. aureus MW2
uaauuacauguugg

SEQ ID NO: 4004818 - RNA, 14 nt, Staphylococcus aureus subsp. aureus MW2
uaauuacuuucauu

SEQ ID NO: 4004819 - RNA, 20 nt, Staphylococcus aureus subsp. aureus MW2
uaauuacuuucauuguaaau

SEQ ID NO: 4004820 - RNA, 22 nt, Staphylococcus aureus subsp. aureus MW2
uaauuacuuucauuguaaauuu

SEQ ID NO: 4004821 - RNA, 16 nt, Staphylococcus aureus subsp. aureus MW2
uaauuaggauuaacau

SEQ ID NO: 4004822 - RNA, 18 nt, Staphylococcus aureus subsp. aureus MW2
uaauuaggauuaacauaa

SEQ ID NO: 4004823 - RNA, 17 nt, Staphylococcus aureus subsp. aureus MW2
uaauuaggauuuccgga

SEQ ID NO: 4004824 - RNA, 21 nt, Staphylococcus aureus subsp. aureus MW2
uaauuagguauaguguuugac

SEQ ID NO: 4004825 - RNA, 18 nt, Staphylococcus aureus subsp. aureus MW2
uaauuagucauugaaaau

SEQ ID NO: 4004826 - RNA, 11 nt, Staphylococcus aureus subsp. aureus MW2
uaauuaucauu

SEQ ID NO: 4004827 - RNA, 16 nt, Staphylococcus aureus subsp. aureus MW2
uaauuaucuucaucau

SEQ ID NO: 4004828 - RNA, 12 nt, Staphylococcus aureus subsp. aureus MW2
uaauuaugaaaa

SEQ ID NO: 4004829 - RNA, 17 nt, Staphylococcus aureus subsp. aureus MW2
uaauuauugcaucauaa

SEQ ID NO: 4004830 - RNA, 15 nt, Staphylococcus aureus subsp. aureus MW2
uaauucauaaaugcu

SEQ ID NO: 4004831 - RNA, 19 nt, Staphylococcus aureus subsp. aureus MW2
uaauucccuaggaaauaaa

SEQ ID NO: 4004832 - RNA, 23 nt, Staphylococcus aureus subsp. aureus MW2
uaauuccucuggaacuuuaauac

SEQ ID NO: 4004833 - RNA, 17 nt, Staphylococcus aureus subsp. aureus MW2
uaauuccugaaacaaug

SEQ ID NO: 4004834 - RNA, 12 nt, Staphylococcus aureus subsp. aureus MW2
uaauuccuggug

SEQ ID NO: 4004835 - RNA, 13 nt, Staphylococcus aureus subsp. aureus MW2
uaauuccuggugc

SEQ ID NO: 4004836 - RNA, 15 nt, Staphylococcus aureus subsp. aureus MW2
uaauucgccaucuuu

SEQ ID NO: 4004837 - RNA, 18 nt, Staphylococcus aureus subsp. aureus MW2
uaauucguugauuuagca

SEQ ID NO: 4004838 - RNA, 21 nt, Staphylococcus aureus subsp. aureus MW2
uaauucuaagucucuugucau

SEQ ID NO: 4004839 - RNA, 12 nt, Staphylococcus aureus subsp. aureus MW2
uaauucugaaau

SEQ ID NO: 4004840 - RNA, 22 nt, Staphylococcus aureus subsp. aureus MW2
uaauucugaaaucaguuuuuga

SEQ ID NO: 4004841 - RNA, 16 nt, Staphylococcus aureus subsp. aureus MW2
uaauucugguuuaaug

SEQ ID NO: 4004842 - RNA, 17 nt, Staphylococcus aureus subsp. aureus MW2
uaauucuguuguuucga

SEQ ID NO: 4004843 - RNA, 14 nt, Staphylococcus aureus subsp. aureus MW2
uaauucuguuucaa

SEQ ID NO: 4004844 - RNA, 18 nt, Staphylococcus aureus subsp. aureus MW2
uaauucuguuucaaagcu

SEQ ID NO: 4004845 - RNA, 20 nt, Staphylococcus aureus subsp. aureus MW2
uaauucuuaaucgagugauu

SEQ ID NO: 4004846 - RNA, 23 nt, Staphylococcus aureus subsp. aureus MW2
uaauucuuaaucgagugauucag

SEQ ID NO: 4004847 - RNA, 13 nt, Staphylococcus aureus subsp. aureus MW2
uaauucuucauca

SEQ ID NO: 4004848 - RNA, 23 nt, Staphylococcus aureus subsp. aureus MW2
uaauucuucaucaauaacuauaa

SEQ ID NO: 4004849 - RNA, 19 nt, Staphylococcus aureus subsp. aureus MW2
uaauucuuguaaaucauag

SEQ ID NO: 4004850 - RNA, 14 nt, Staphylococcus aureus subsp. aureus MW2
uaauucuuuaauaa

SEQ ID NO: 4004851 - RNA, 18 nt, Staphylococcus aureus subsp. aureus MW2
uaauucuuuaccauucaa

SEQ ID NO: 4004852 - RNA, 13 nt, Staphylococcus aureus subsp. aureus MW2
uaauugaaaauaa

SEQ ID NO: 4004853 - RNA, 13 nt, Staphylococcus aureus subsp. aureus MW2
uaauugaaaugau

SEQ ID NO: 4004854 - RNA, 14 nt, Staphylococcus aureus subsp. aureus MW2
uaauugaaaugaua

SEQ ID NO: 4004855 - RNA, 22 nt, Staphylococcus aureus subsp. aureus MW2
uaauugaaguaugcacaucauu

SEQ ID NO: 4004856 - RNA, 20 nt, Staphylococcus aureus subsp. aureus MW2
uaauugaaucguauugaaaa

SEQ ID NO: 4004857 - RNA, 22 nt, Staphylococcus aureus subsp. aureus MW2
uaauugaauugauuauaaugau

SEQ ID NO: 4004858 - RNA, 23 nt, Staphylococcus aureus subsp. aureus MW2
uaauugauacggaucauaaucau

SEQ ID NO: 4004859 - RNA, 15 nt, Staphylococcus aureus subsp. aureus MW2
uaauugaugucacau

SEQ ID NO: 4004860 - RNA, 20 nt, Staphylococcus aureus subsp. aureus MW2
uaauugcaaaugcucuaaca

SEQ ID NO: 4004861 - RNA, 19 nt, Staphylococcus aureus subsp. aureus MW2
uaauugcauagcuaaauaa

SEQ ID NO: 4004862 - RNA, 20 nt, Staphylococcus aureus subsp. aureus MW2
uaauugcauagcuaaauaaa

SEQ ID NO: 4004863 - RNA, 21 nt, Staphylococcus aureus subsp. aureus MW2
uaauugcauagcuaaauaaau

SEQ ID NO: 4004864 - RNA, 22 nt, Staphylococcus aureus subsp. aureus MW2
uaauugcauagcuaaauaaauu

SEQ ID NO: 4004865 - RNA, 12 nt, Staphylococcus aureus subsp. aureus MW2
uaauugcauuac

SEQ ID NO: 4004866 - RNA, 16 nt, Staphylococcus aureus subsp. aureus MW2
uaauugcguuuaauaa

SEQ ID NO: 4004867 - RNA, 19 nt, Staphylococcus aureus subsp. aureus MW2
uaauugcguuuaauaacau
